United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 62

SEQ ID NO: 118638 - DNA, 1797 bp, Artificial Sequence
  Description of Artificial Sequence: Synthetic coding sequence
atgatgaggctacgaggaagcggtatgcttagggacctgctgctccgcagcccggctggtgttagcgccacactgcgtagggctcaacccctggttacgctttgtagaaggccgcggggcggcggacggccagcagccggccctgccgccgcagcgcggttgcatccctggtggggaggcggcggctggcctgccgagccacttgccagaggcctctcaagttccccttctgagatcctgcaggagcttggcaagggatctacccatcctcaaccgggagtttctccgcccgccgcccctgccgccccaggacccaaagatggaccgggtgagactgacgcttttggcaacagtgaaggcaaagagctggtggcaagtggcgaaaataaaatcaaacaggggctactgccgtctttagaggatctgctgttttacaccatcgctgagggacaggaaaagatccccgttcacaaattcatcacggccctgaaaagtacaggtctccgcacttctgatccaaggttaaaggagtgtatggatatgctgcggctaacactacagactactagtgatggggtgatgctggacaaagatttgttcaaaaagtgcgtacagtctaacattgtgttactgacccaggcctttcgccgaaagtttgtgatccccgacttcatgtcatttaccagccacatagacgagctgtacgaatctgccaagaaacagagtggcggcaaggtcgcagattatattccacagctggccaagtttagcccagacctgtggggagtaagtgtatgcactgtcgacggccaacggcattcaactggcgacacaaaggtacccttttgtctgcagtcttgcgtcaaacctcttaagtacgccattgccgtgaacgacctggggacagaatatgttcaccggtacgtgggaaaagaaccatcaggtctgaggtttaataagctctttttgaacgaagacgataaaccacacaaccctatggttaatgccggggcaattgtggtcacttctttgataaaacaaggggtgaacaacgccgaaaagttcgattatgtgatgcagttcctcaacaagatggctggtaacgaatacgttggctttagtaatgcaaccttccagagcgagagagagtcgggcgatcggaacttcgccatcggttactacttgaaggaaaaaaagtgttttcctgagggaaccgacatggtcggaatcctagatttttattttcagctctgttctatcgaggtaacttgcgaaagcgcaagtgttatggccgcgacactcgctaacggaggattctgtcctatcaccggcgaaagagtcctgtctcccgaagccgttcgcaacaccctatccttgatgcactcatgcggtatgtatgatttttcgggacagttcgctttccacgtcggactgccagctaagagcggagttgccggggggatcctgctggtcgtgcccaatgtgatgggcatgatgtgttggtcacctcctctcgacaagatgggcaactcggtgaaggggatccatttttgtcatgatttggtgtctctgtgcaattttcacaactacgacaatttgagacacttcgccaagaagctggatccccggcgggaagggggcgatcaaaggcactcattcggtcccttggattacgaatccttgcagcaggagcttgctttgaaagagacagtatggaagaaagtgtcccctgagagcaacgaggacatctccaccacagtagtttaccgtatggaatccctgggggagaaatcttag

SEQ ID NO: 118639 - DNA, 525 bp, Artificial Sequence
  Description of Artificial Sequence: Synthetic coding sequence
atggggatgatgtgttggagtccacccttggataaaatgggcaattcagtaaaaggtatccacttctgccatgacttagtgagcctgtgtaactttcacaactacgataacttacgtcatttcgcgaaaaagctggatcccagaagggagggcggcgatcagagggtgaaatccgtcattaatctgctgtttgccgcatacacgggagatgttagcgccctgcggaggtttgccctttctgcgatggatatggaacagcgggactacgattctcgaacggctcttcacgttgctgctgccgagggccacgtggaggtcgtgaaattcctgctggaggcttgcaaggtgaatccgttccccaaagaccgttggaacaacacccctatggatgaggctctgcatttcgggcaccatgatgtcttcaagattttacaggagtaccaggtccagtacacgccccagggggactctgacaacggaaaggaaaatcagacagtgcacaagaatcttgacggcttgctgtag

SEQ ID NO: 118640 - DNA, 1809 bp, Artificial Sequence
  Description of Artificial Sequence: Synthetic coding sequence
atgagaagtatgaaagctttgcagaaagctctgagccgggcgggcagtcattgcggaagaggaggctgggggcaccctagcagaagccccctcttgggtggtggcgtgcgccaccaccttagcgaggcggcagcccaaggacgtgaaacgccccactctcatcagccccaacatcaggatcatgactcttcagaatcggggatgttgagtcgactcggcgatctgctattttataccattgcagaagggcaggaaaggatacctattcacaaattcacaacagctctcaaggctaccggccttcagacctccgacccacgcctcagagattgcatgtcagaaatgcaccgagtggtgcaagagagttcctctggcggattacttgatcgcgatctgtttagaaagtgtgttagctcgaacattgtcctgctgacccaggccttccgaaagaaatttgtgatcccagatttcgaggagtttaccgggcacgtggaccggatcttcgaggacgtgaaagaattgacaggagggaaggtagcggcttacattccacagctggccaagtcaaacccagacttgtggggtgtctcactctgcaccgtcgatggacaacggcacagcgtgggccatacaaagatacctttttgtctgcagagttgcgtaaagcccctgacctatgcgataagcatctcgacgctgggaaccgactacgtgcacaaatttgtcggaaaagaacctagcggactgagatacaacaaattaagccttaacgaggaggggatccctcacaacccaatggtcaatgccggggccatcgtcgtgagctctctgattaagatggattgtaacaaagccgagaaattcgattttgttttgcaatatttaaacaaaatggctggaaacgaatatatgggatttagcaatgcaacattccagagtgaaaaggaaactggagatcgcaattatgccataggttactaccttaaagagaaaaagtgtttccccaaaggggtcgacatgatggccgccttggatctttattttcaactctgcagcgtggaagtgacttgcgagagcggttccgtgatggctgcgaccctagctaatggaggcatctgcccgatcacaggcgaatctgttttgtccgccgaggccgtccggaacaccctgagcctcatgcacagctgtgggatgtatgacttcagcgggcagtttgcttttcacgtgggtcttccagccaagagtgccgtgagcggggctattctgctcgtggtgccaaacgtgatggggatgatgtgcttaagcccccctctggacaagctgggtaatagtcaccggggaacttctttttgccagaagttggtctcactgtttaattttcacaattatgacaatctgaggcactgcgctagaaaactcgatcctcggcgggagggagccgagatccgcaataagaccgtagtgaaccttctctttgccgcgtatagcggcgacgtctctgccctgagaaggttcgcactgtctgcaatggatatggagcagaaggactacgattcgcggacagcactgcatgtagcggccgctgaagggcatatagaagtagtgaagtttctgatcgaggcgtgtaaggtgaacccttttgcaaaggataggtgggggaacataccacttgatgacgccgtgcaattcaatcacctagaagtggtgaagctgttgcaggattaccaggactcatacactcttagcgagactcaagctgaggctgcagctgaagcccttagtaaagaaaatctcgaaagcatggtctag

SEQ ID NO: 118641 - DNA, 534 bp, Artificial Sequence
  Description of Artificial Sequence: Synthetic coding sequence
atgagaagcatgaaggcccttcagaaagcactgagcagagcaggttcacattgtggtcggggaggatgggggcatccttcacgtagccccctgctaggaggcggagtgcgtcatcacctgagcgaggccgccgcccaagggagagagacaccacactctcatcagccacaacatcaggaccacgactcttccgaatccggtatgctctcccgcctcggggaccttttgttttacaccattgccgaaggtcaagagaggatacccatccacaaattcacgacagcactgaaagcaacgggcctgcagactagcgatcctaggttaagagattgcatgtccgagatgcaccgggtggtccaggagagctcttccggggggctgctggatagagacctgttcaggaaatggcagccaacatctctcagctggccctcacaaacacagacgtgtggagtgagcccttgcgctctatggatggtgaacggaaccctgtgggctacacagaggagtccttctgcatgctctccggtgtag

SEQ ID NO: 118642 - DNA, 2049 bp, Artificial Sequence
  Description of Artificial Sequence: Synthetic coding sequence
atgtgcgggatcttcgcctatatgaattaccgagtgcctcgcacacggaaggaaatatttgagactttaatcaagggcctgcaaagactggagtaccgtggttatgatagtgcgggggtcgccatcgacggaaacaaccacgaagttaaggagagacatatccagctagtgaagaagagaggaaaggtgaaggccctggacgaagagctctataaacaagattctatggatctcaaagtagagtttgaaacccattttggtattgcccacaccagatgggctacccacggcgtgccatcggccgttaattcacatcctcaaaggtcagataaggggaacgagttcgtggttattcacaacggcatcatcacaaattacaaagatttgaggaaattcctcgagagtaaggggtacgagtttgaaagcgaaactgacaccgagacaatcgccaagctgataaaatacgtgtttgataacagggagactgaggatattaccttttcaacgctggtggaacgcgtgatccagcagttagaaggggcctttgcgctggtatttaagagtgttcattacccaggggaggcggtcgccacacggaggggatccccgctgttaattggcgttcgaagtaagtataaactgagtaccgaacaaattcctatcctgtaccggacctgtacactcgagaatgtgaagaatatttgtaagacacgcatgaagcggctggacagctcggcctgtctgcacgctgtgggtgacaaggccgtggagttcttcttcgcatcagatgcctccgccattatcgaacatactaatcgggtaatcttcttggaggacgatgacatcgccgcagtggcagatggcaagctcagcatccatcgagtgaagcgcagtgcctcggatgacccatcccgggcaattcagacccttcagatggaactgcagcaaataatgaagggcaatttcagcgcctttatgcaaaaagagatttttgagcagcccgagtccgttttcaataccatgcgcggacgcgtgaactttgagacgaatacagtgctcttgggcgggctaaaggatcatctaaaagagattcgtcgctgccggcgccttatcgtgattggctgtggcacgtcctatcatgcagcggtagcaacgagacaagtgttggaagagcttacagagctcccggtgatggttgaattggcatccgattttttagaccgcaatacacctgtttttcgcgacgacgtttgcttcttcatctcccagagcggtgagacagccgatactctgctggccctgagatactgcaaggatcgaggtgcccttaccgtcggagtgacgaacactgtaggttcttctatcagccgagagacagattgcggagtgcatatcaatgctggcccagagattggcgtcgcaagcaccaaggcatacacgagccaattcatctcacttgtgatgttcggactcatgatgtctgaagatcgcatttcgcttcaaaaccggaggcaggaaattataagggggttgcgcagcctacctgaacttatcaaggaggttctctcacttgaggaaaagattcacgatctggccctggaactctacactcagaggagcttgctggttatgggtaggggatacaattacgcaacttgcctcgagggggcgttgaaaattaaggaaataacatatatgcactcggagggaatactagccggcgaactcaaacacgggccactagccctgattgacaaacagatgccagtaattatggtgattatgaaggatccctgcttcgctaaatgtcagaatgcgttacagcaagtgaccgcccggcagggtaggccaattattctgtgctccaaggatgacacagaatcatctaagttcgcttacaaaacgatcgagctgccacacaccgtcgactgccttcagggaatccttagcgtgatccccctacagctgctgtcctttcatttggccgtcctgaggggatacgatgtggactttccaagaaatttagccaagtcggtcaccgtagagtag

SEQ ID NO: 118643 - DNA, 1086 bp, Artificial Sequence
  Description of Artificial Sequence: Synthetic coding sequence
atggccggcggtcgccataggagagtggtgggaaccctccacctattattgctggtcgctgcactcccttgggccagtcggggcgtatcccccagcgcctctgcctggcccgaagaaaagaattaccaccaacccgcaatcctgaattcatctgcccttagacagattgcagaggggacctcgatctcagagatgtggcaaaatgatctgcagccacttctgattgaacggtatcccggcagtccaggctcctatgccgcccggcagcacattatgcagaggattcaacgcctgcaggcagattgggtgttggaaattgacacctttctgtcacaaaccccatatggataccggtcattttccaacatcatatcaacactcaaccccactgcaaagagacacctggtgctagcctgccactatgacagcaagtacttctctcattggaacaaccgcgtctttgtgggggctactgactctgccgtgccctgcgctatgatgcttgagctggctcgcgccctcgacaagaagctgctgtcactgaaaacagtttctgacagcaaaccagatctgtccctccagcttattttttttgatggcgaagaggctttcttgcattggtctccccaggactctttgtacgggagtcgacacttggcggccaagatggcatcaaccccccatcctcctggcgctcgcggcacctcccagctgcatggcatggacttgctcgtactgctggacctgataggggccccaaatcccaccttccccaatttcttcccaaatagcgcccggtggttcgaaaggctgcaggctatcgaacacgaactacacgagctcgggcttcttaaagatcactctctggaaggcaggtacttccagaactattcatacggaggcgtcatccaagacgatcacatccctttccttcgccggggcgtccccgtattacatcttatcccttcaccctttcctgaggtgtggcatactatggacgacaacgaggagaacttggacgagtctacgattgataaccttaataaaattttacaggtcttcgtgctggaatacctgcatttatag

SEQ ID NO: 118644 - DNA, 939 bp, Artificial Sequence
  Description of Artificial Sequence: Synthetic coding sequence
atggccggcggccgacaccgcagagtagttggcaccctgcacctactgctactcgtggcagcgcttccatgggcaagtagaggggtgtcacctagtgcttctgcatggcccgaggagaagcacatcatgcagagaattcagcggttgcaggccgattgggtgttagagatcgatactttcttatcccaaactccctatggctacagaagcttctctaacataatctccacacttaaccccaccgcaaagcgacacctggtgttagcctgtcattacgactcaaagtacttttcacactggaacaatagagtgtttgtgggggcgaccgacagcgccgtgccctgcgccatgatgctagagctcgctcgagctctcgacaaaaagcttctgtcactgaagactgtgagcgacagcaagccagatctgtcgttacagctaatcttctttgacggtgaagaggcttttctacattggtcccctcaggactctctctatgggtcgaggcatctggcggcaaagatggcaagtacaccccacccccctggggcacggggtaccagccagcttcacggcatggacctcctggtgttgctcgaccttatcggcgctccgaatccaaccttccccaattttttccctaattccgcgcggtggttcgagcggctacaggcgattgaacacgagctgcatgagctggggctgctcaaggaccactctctcgagggccgttactttcaaaactattcttacggcggagtcatccaagatgaccatattccctttctccggcggggagtgccagttctccatctgattccctctcccttccccgaagtctggcatactatggatgataacgaggaaaatctggacgagagtactattgacaacctcaataagatcctccaggtgtttgtgctcgagtacctgcatctctag

SEQ ID NO: 118645 - DNA, 2328 bp, Artificial Sequence
  Description of Artificial Sequence: Synthetic coding sequence
atggcagcactggactcgctatccctgttcacaagcctgggtttgagcgagcagaaagcaagagaaactctgaagaattcagcactctcagcccagcttagggaggctgctacgcaggcacagcagacgctgggatcgacgatcgacaaggccacaggaatcctgctctatggtttggcgtctagactgcgagacacacgccgcctgtccttcctcgtttcgtatatcgctagcaaaaagattcacactgagcctcagttgtccgctgctttagaatatgtccgttctcacccgctggatccgatagacaccgttgacttcgagagagaatgtggcgtaggggtgattgtgactcccgagcagatcgaagaagcggtggaggccgctatcaacaggcataggccccaactgctcgtggagcgctatcacttcaacatgggcctcctcatgggcgaggcaagggccgtcctgaagtgggccgacgggaagatgattaagaacgaagtcgatatgcaggtgttgcatctgctcgggcccaaattggaagccgatctcgaaaagaaattcaaggtggccaaggctagactagaggagacggacagaagaactgccaaagatgtggtggaaaatggcgaaacagccgaccagacattgtcgctcatggagcaattgcgtggagaggccctgaaattccataaacccggcgagaactataagacacccgggtacgtcgttactcctcacaccatgaatctgctcaagcagcatctggaaataaccggcggacaagtgaggacacgctttcccccagaacctaacggcatcctccacattgggcatgctaaggccatcaattttaactttggttatgccaaagccaataacgggatctgcttcctgcgtttcgacgacactaatccggagaaggaagaggcaaaatttttcacggctatctgtgatatggttgcgtggcttggctataccccttacaaagtgacctacgctagtgactacttcgatcaattgtacgcctgggccgtggagctgatcaggagagggctggcgtacgtttgccatcagagaggggaagagctaaaggggcataatacgttgccatccccatggcgcgaccgtccgatggaggagtccctgctgctctttgaggccatgcggaagggaaaattttccgagggcgaggccacactgcgaatgaagctggttatggaggatggaaagatggaccctgtggcttaccgtgtaaagtacaccccacatcaccgcacaggggataaatggtgcatatatcctacctacgactacacccactgcctttgcgacagtatagagcacatcacacattcactgtgcaccaaggagtttcaggctcgacggtcgagctatttctggctttgcaatgcgctggacgtctattgtcctgttcagtgggagtacggccggctgaacctccactatgcagtcgtatccaagcgaaagattctgcagttggtggccaccggggcagtgcgggattgggatgaccctcgcctgtttaccctcaccgctctccgaaggcggggtttccctcccgaggctatcaataacttctgtgctcgagttggcgtcactgtggctcaaacaactatggaaccccatctcctcgaagcatgcgttagagatgtgctgaacgacaccgccccccgcgccatggcagttttagaatccctgcgggtcattataacaaactttcctgccgctaaaagtctagacatccaggtgcctaacttccccgccgatgaaactaaaggcttccatcaggttcctttcgcgcctatcgttttcattgagcgcactgatttcaaggaagagccagaacctggctttaaacgcctggcatggggccagcccgttggactacgccatacggggtatgtcatagagctccaacacgttgtgaaaggaccaagtggttgtgtggagtcgcttgaagttacttgccgccgagcagatgccggggaaaagcctaaggccttcattcactgggtgagccagcctttgatgtgtgaagttcggctatacgagcgcctattccagcataagaatcctgaggacccgaccgaggtccccggaggatttctaagcgatcttaaccttgcctccctgcacgtggttgatgcagctctagttgattgctccgtggctcttgctaaaccgtttgacaaatttcaattcgagcgacttgggtacttctcagtggacccagacagccatcaaggaaaattggtcttcaatcgcaccgtaaccctgaaggaggaccccggcaaggtgtag

SEQ ID NO: 118646 - DNA, 2295 bp, Artificial Sequence
  Description of Artificial Sequence: Synthetic coding sequence
atggccgccttggacagccttagcctgtttacttccctcgggctcagtgagcagaaggccagagagactctcaagaatagcgccctgtctgctcagctccgggaggccgcaacccaggcacaacaaacacttggcagcaccatcgacaaagctacaggcatcctgctgtatggacttgctagtcggctccgcgatactaggagactgtcattcctcgtctcttatatcgccacggccctcgaatacgtgcgttcccatcctctcgatccgatcgacactgtcgattttgagcgggagtgtggggtgggagtgatcgtcactcctgagcaaatcgaagaggccgtggaggccgccataaaccgccaccggccgcagttgctggtggagcgatatcattttaatatggggctcctcatgggagaggctcgggctgtcctgaagtgggccgacggaaagatgattaagaacgaggtggacatgcaggtgctgcacctcctggggccaaagttagaggctgatctggagaaaaaattcaaagtcgcaaaggctcgattagaagagactgacaggcggacagcaaaagatgtggttgaaaacggggagaccgccgaccaaactctctccctaatggaacaactgcggggcgaagccctcaaatttcataaaccaggcgagaactacaaaacacctggatacgtggttacgccccacacaatgaatctgctaaaacagcacctggaaataacaggggggcaagtaaggacccggtttccccccgaacccaatgggatcctgcatattggccatgccaaggcgattaactttaatttcggatacgccaaagcaaacaacggcatctgcttcttgcgtttcgatgatacaaaccccgagaaagaggaagccaagtttttcacagccatatgcgacatggtcgcctggctaggttacacaccctacaaagttacatatgcgtccgattattttgatcagctgtatgcgtgggccgtggaactgattagaaggggattagcctatgtgtgccatcaacgtggggaggagcttaaaggccataacacacttccaagtccctggcgtgacaggcccatggaagaaagcttgctcttattcgaagctatgcggaagggtaaattcagcgagggcgaagccacactcaggatgaaattggtgatggaggatggcaaaatggacccagtcgcctatagggtgaaatacacgccgcatcacaggactggcgataaatggtgcatttacccaacatacgattacacacactgtctatgtgatagcattgaacatattacgcattctctgtgcaccaaagagttccaagcacgccgctcctcttacttttggctatgtaatgctctggacgtgtactgcccagttcagtgggagtacgggcgactgaacttgcactatgccgtggtcagtaaaaggaaaatcctgcagctcgtagcgactggggctgtacgcgactgggatgacccgaggctgttcacactcacagcactccgtaggagaggatttcctcccgaagccataaacaacttctgcgccagggtaggagtcaccgtggctcaaacaacaatggagccccacctgctggaggcctgtgtgcgggatgtgttgaacgacaccgcgccacgggctatggccgtgctggagtccttgagagtcattattactaatttccccgctgcgaagagtctggacatacaggtcccaaactttccggcagacgaaaccaagggttttcaccaggtaccttttgcccccatcgttttcatcgagaggaccgactttaaggaagaacctgagcctggattcaagagattagcctggggccagcctgttgggctccgtcatacgggttatgtaattgaacttcagcacgtggtgaaaggaccctctggctgtgtggagagtcttgaggttacatgtagaagggccgatgccggcgagaaaccgaaggcgtttatccactgggtctcccagcctctgatgtgcgaggtgcgtctgtatgagaggctctttcagcacaaaaaccccgaggaccctaccgaagtcccagggggctttttgagtgatctgaatctggcatcacttcatgtggtggatgccgccctggtcgactgctcagttgctctggcaaagccttttgataaattccaatttgagaggctgggatatttttctgttgacccagattcccaccaggggaaactcgtgttcaacaggaccgtcaccctgaaagaggatccaggcaaagtgtag

SEQ ID NO: 118647 - DNA, 849 bp, Artificial Sequence
  Description of Artificial Sequence: Synthetic coding sequence
atgcccacatgccgcctggggcccaagtttctcttggtctccggggtcagtgctatggccgccttggattccctttcgctttttacttctctagggttaagcgaacagaaggctagagaaaccctgaaaaattccgctctcagcgctcaattgcgagaagctgccacgcaagctcagcaaactttgggctctacaatcgacaaagctactggcatcctgctctatggcctagcctcgagactaagagacacccgccggttatcattccttgtttcctatattgcatctaagaaaatccacactgaaccacagttgagcgcagcccttgagtacgtgcgttctcatccccttgacccaatcgatactgtagacttcgagagagagtgcggcgtaggggtcattgtgacaccagaacagatcgaggaggccgtggaagccgcgatcaaccgacacagaccacagttactcgtggaaaggtaccattttaatatgggcctgctgatgggtgaagcgagggccgtactcaagtgggcagatggtaaaatgatcaagaacgaagtggatatgcaggttctgcatctcctcggcccaaaacttgaagccgacctcgaaaaaaaatttaaagtcgccaaggccaggcttgaggagacggacaggcgtaccgctaaggatgtagttgagaacggcgagacggctgatcagacactgagtctcatggagcagttaagaggcgaagcgttaaagttccacaaaccaggcacttaccccgtacccgccaggacacagtggaacccagcttattggacatgccaatcacaccagttccaactgtggttatgccaagtgtag

SEQ ID NO: 118648 - DNA, 2874 bp, Artificial Sequence
  Description of Artificial Sequence: Synthetic coding sequence
atgaatttcgccgaacgagagggcagcaagcggtattgcattcagactaagcatgtggctattctttgtgctgttgtggtgggcgttggtctcatcgttggcctggctgtcggcctcactaggtcttgtgactcctcaggagacggtggaccaggtaccgctcctgctccatctcacctgcccagctccaccgccagcccgagcgggccccccgcccaggatcaggatatctgccccgccagcgaggatgagagcggacaatggaaaaactttcgccttccagactttgtgaatcctgtgcactatgacctgcacgtcaagccgttgttggaggaggacacttatactggcacagtcagcatctccatcaatctctctgccccaacccgctacctgtggctgcatcttagagaaactagaatcaccagactccccgagctgaaacgcccatcaggcgaccaagttcaggtgcgccggtgctttgagtacaagaaacaggagtatgtagtagtggaggcagaagaggagcttaccccctccagcggtgacggactctatctgctgaccatggagtttgcaggctggttgaatggatcactggtgggcttctaccgcacaacatacaccgagaatggccaagtgaagagtatagtggccaccgaccacgaaccaactgatgcccgcaagtcttttccctgtttcgatgagcccaacaaaaaagccacctatactatttctatcacacacccaaaagaatatggtgctctgagcaacatgcccgtggctaaagaggagtccgtcgacgacaagtggacccgtaccacctttgaaaaaagcgtgcccatgagtacataccttgtatgttttgccgtgcaccagtttgactcagtgaagcggatctcgaactctgggaaacctctgactatatacgtgcagccagaacagaagcacaccgctgagtacgctgccaacattacaaaatccgtcttcgactacttcgaggagtatttcgcgatgaactatagtctacctaagctggataagatcgccatccctgatttcggaacgggagccatggagaattggggattaatcacctaccgtgaaacaaatctgctttatgaccccaaggagtccgcgtcaagtaatcaacaacgggtggctaccgtggttgcacacgaattagtgcaccagtggttcggcaacatcgtgactatggactggtgggaagatctatggctgaacgaaggctttgctagtttctttgagttcctgggcgttaaccatgccgagaccgattggcagatgcgcgatcagatgctgctggaagatgtactacccgtgcaggaggatgactccctgatgagttctcacccaattatcgtaaccgttactactcccgacgagattacaagcgtcttcgatggcattagctactcaaaagggtcttctattctccgtatgctagaagattggattaagcccgaaaactttcagaagggatgtcagatgtatctggaaaagtaccagtttaagaatgcaaaaacatctgatttttgggcggcactggaggaggcgtcacgcttgccggtgaaggaggttatggacacctggaccagacaaatggggtacccggtgcttaatgtaaacggtgtgaagaatataacccagaagcggttcttgcttgacccccgcgcaaacccctcacagccccctagcgacctcggctatacatggaatatccctgttaagtggaccgaggataatatcacgagctctgtcttgttcaacaggtcagaaaaggagggcatcaccttgaacagtagtaatccatcaggcaacgcgttcttgaagataaatccagatcacatcggattctatcgcgtgaattacgaggtcgcgacatgggattcaatagccacagccctgagcttgaatcacaagactttctcttccgccgatcgtgcctcactaattgacgatgcttttgcactggcaagggcccaattactcgattataaggtggccttaaacctcacaaagtacctcaagagggaggaaaactttttgccctggcagcgagtaatttccgccgtgacgtacatcattagcatgtttgaagacgataaagagttataccccatgatagaagaatattttcagggccaggtgaaacccattgccgacagtctgggttggaatgatgccggggatcatgtgaccaaactgctgagatcatcagttctgggctttgcctgtaagatgggtgacagggaagctttaaacaatgcatcaagcttatttgagcaatggctgaacggcaccgtgagtttacccgtgaatctgaggctactcgtgtacagatatggcatgcagaactctggaaatgaaatcagttggaactacaccctagaacagtatcaaaaaaccagcctcgcacaagaaaaggaaaaactgctgtacgggctggcgagcgttaaaaacgtgacgctcctgtccagatatctggacctgcttaaggacactaatcttataaagacacaagacgtttttacagttattcgctatatatcttacaactcttacggaaagaatatggcatggaattggattcagctgaattgggattatctggtgaatcgttatacattgaacaaccggaacctcgggcggatagtaaccattgccgagcccttcaacaccgagctccagctgtggcagatggagagtttcttcgctaagtatccccaggcaggcgcaggtgagaagccgagagaacaagtgctggagactgtgaaaaataatattgagtggctcaagcaacacagaaacaccattcgtgagtggttcttcaatttattggagtctggctag

SEQ ID NO: 118649 - DNA, 4539 bp, Artificial Sequence
  Description of Artificial Sequence: Synthetic coding sequence
atggcgacactaagtttgaccgtgaattccggggatcccccattgggggcattgctggctgtggaacacgtgaaggacgacgtttccatttctgtggaagagggaaaggagaatatccttcacgtctctgagaacgtaatctttacagacgtgaattctattctccggtacttggccagggtggccactacagccggtctttacggcagcaatttgatggaacacacagagatcgaccactggttggagttttccgctactaaattatcatcttgcgattcattcacatcaaccattaacgagctgaaccattgcctttccctaagaacctatctggtcggaaattctctgagtctggcagatctctgcgtatgggcgactctgaagggcaatgcagcctggcaagagcagctgaagcaaaaaaaagctccggtgcatgtcaaacgctggttcggcttcctggaagcacagcaggcttttcagtccgttgggacaaaatgggacgtatccaccaccaaggccagagttgcgccagagaagaagcaggacgtgggcaagtttgttgagttgcctggcgccgaaatgggcaaggtgaccgtgcgcttcccccccgaggcaagcggttacttacacattggccacgccaaggccgccctcctcaaccagcattatcaagtgaattttaaagggaaattgataatgaggtttgacgacacaaatcccgagaaggagaaagaagattttgagaaagtgattctcgaggatgtcgctatgttacacattaagcctgatcagtttacttacaccagcgaccacttcgagaccattatgaaatacgccgagaagctgattcaagagggaaaggcatatgtggatgacactcctgccgaacagatgaaggctgagagggagcaaaggatcgactcaaagcacaggaaaaatcctatagagaagaatcttcaaatgtgggaggagatgaagaagggcagccagttcgggcagagctgctgtttgcgggcaaagatcgatatgagctcaaataatggatgtatgagagatccgacactttaccgctgtaagatccagccacacccgaggactggtaacaaatacaacgtgtacccaacttatgactttgcctgtcccatagtggatagcattgaaggtgttactcatgccctaagaacaacagagtaccatgacagagacgagcaattttattggattattgaagctctaggtatccgcaaaccctatatctgggaatatagccggctcaacctgaataacactgtactttcgaagcgtaaactgacctggtttgtgaatgagggtctcgtggatggctgggatgatccaagatttcctaccgtgaggggtgtgctaagaagaggtatgaccgtcgaaggcctgaagcagtttatagccgcccaggggtcttcccgttctgtcgtcaatatggagtgggataagatatgggccttcaataaaaaagtgatagaccccgtcgccccacgctatgtggcacttctgaagaaagaagttatccccgtgaacgtccccgaagcccaggaggaaatgaaagaggtggccaaacaccccaaaaatcctgaggtaggtctgaagccagtctggtacagccctaaggtcttcatcgagggcgccgatgcagagacatttagcgagggcgagatggtcacattcattaactggggaaacttgaatatcaccaaaatccacaagaacgcggatgggaaaatcatttcgcttgatgccaaattgaatcttgagaacaaggactacaagaaaacaaccaaggtgacttggctcgccgaaacaacccacgccctaccaataccagtgatctgcgtgacctacgagcacctgattaccaaaccagtgcttgggaaggatgaagacttcaagcaatatgtcaataagaactctaaacacgaggagctgatgctcggcgatccatgtctgaaagatctgaagaagggcgatattattcagctgcagcgcaggggattttttatttgtgatcagccttacgaaccagtatccccctattcttgtaaagaagctccgtgtgtgctgatatatatcccagacgggcatacgaaggaaatgcccactagcgggtctaaggaaaagaccaaggttgaggctacaaagaacgagaccagcgcaccctttaaggaaagaccaacacccagcctaaacaataactgtacaacctccgaagactcacttgtgctttataacagagttgccgtgcaaggagacgtagtgagggaacttaaagcaaaaaaggctccaaaagaggatgtcgatgctgcggtcaagcagcttctgtcactcaaggccgagtacaaggagaaaactgggcaagagtataaacccggcaaccctccagcagaaatcggacaaaacattagttcaaactcatccgctagcattctcgagagtaagagcctttacgacgaggttgctgcacaaggcgaggtcgtgcgtaagctcaaagccgagaagtcacccaaggccaaaattaatgaagccgtagaatgtctgctctcactgaaggcccagtacaaggagaagacaggcaaagagtacattccaggccaaccacctctgtctcagagcagcgattccagccccacgaggaactctgaaccagccggtctggaaaccccagaggcaaaggtgttgttcgacaaagtagcctcacaaggggaggtggtccgcaaactcaagacagaaaaagcaccaaaagaccaggtcgatatcgccgtccaagaattacttcagctcaaggcacagtataagagcttgatcggggtcgagtataagccggtcagcgccactggagctgaggacaaagacaagaagaaaaaggaaaaggagaataaatccgaaaaacagaataagccacagaagcagaatgatgggcaaaggaaagacccctccaagaatcagggaggtggcttatcttcgagcggagccggagagggccaaggtccaaagaagcagacacgtctgggcctggaggccaagaaggaagaaaaccttgctgattggtacagccaggtcataacgaagtcagagatgatcgagtaccacgatattagtggctgttatatcctccggccttgggcctatgctatctgggaggctatcaaagacttcttcgatgcagaaatcaagaagctcggcgtggagaattgctacttccccatgtttgtgagccagagcgctctggagaaggagaagacccacgtcgccgatttcgcccccgaggtggcctgggtaactagatccggcaagaccgagttggcagaacccattgcaatccgacccacctccgaaacagtaatgtatcctgcttacgccaaatgggtgcagtcccatagggatctgcccatcaagttgaatcagtggtgtaacgtggtccgctgggaatttaaacacccgcagccgtttttgcggacccgagagttcctgtggcaggagggccattctgcttttgccaccatggaagaagccgctgaagaagttctccagatccttgacctctacgctcaggtatatgaggagttattagcaattccggtggtcaaaggaagaaagacagagaaggaaaaattcgctggtggggattacacaacaaccatcgaagcgtttataagtgccagtggacgcgctatacaggggggaacttcccatcatctgggacagaacttttctaaaatgttcgaaatagtcttcgaggatcccaagatcccaggagagaaacagttcgcctaccagaactcctgggggctcactactaggacgattggtgtcatgacaatggtgcatggagacaacatgggcctggtgcttccacccagggttgcttgtgtgcaggtggtgattataccttgcggcattacgaacgccttgtctgaggaagacaaggaagccctgattgccaaatgcaacgattataggagacgcctcttgtcagtgaacatccgggttcgggcggacctgagggacaactactcccccgggtggaagttcaatcactgggaactcaagggggtccccatcaggctcgaggtgggacctcgagatatgaagtcttgccagttcgtcgcagtgcgtcgcgataccggcgagaagctcacagtcgcagagaacgaggccgaaaccaagctgcaggctatcctggaggacattcaggtgacactgttcactagggcctccgaagaccttaaaactcatatggtggtggcaaataccatggaagactttcaaaaaatattagatagcgggaagatcgtccagatacccttctgtggcgagatcgactgcgaggactggataaaaaaaaccacagcacgcgaccaggacttggaacctggcgcaccgtcgatgggcgccaaatctctgtgtattccatttaaacctctctgcgagctgcagcctggtgccaaatgtgtatgcggtaagaaccctgccaaatattatacactcttcggcagaagctactag

SEQ ID NO: 118650 - DNA, 2964 bp, Artificial Sequence
  Description of Artificial Sequence: Synthetic coding sequence
atggccacactgtcactgactgtgaatagcggggatcctccccttggcgccttgctggcggtcgaacacgtcaaggacgacgtctccatcagtgtggaggagggtaaggagaacattctgcacgtcagtgagaacgtgattttcactgatgtcaactcaatattgagatacctggctcgcgtcgcaaccaccgccggcctgtacgggagtaatttgatggaacatacagagattgaccattggctcgagttttctgctacaaagttgagttcctgcgattcatttacctctaccatcaacgagcttaatcactgcctttccctgcggacttatctcgtaggaaactcccttagcttagccgacctatgtgtctgggcaaccctaaagggaaacgctgcctggcaggagcagctgaaacaaaagaaggcaccagttcacgtaaagcgatggtttggcttcctcgaagcccagcaggcttttcagtcagttggcaccaaatgggacgtgtccaccaccaaggcgcgtgtggccccagagaaaaaacaagacgtgggcaaattcgtggagctgcctggagcggagatgggtaaggtcacagtgaggttccccccagaagctagtgggtatctgcacatcggccatgctaaagccgctctgttgaaccagcactaccaagttaacttcaagggaaagctcatcatgcggtttgacgacaccaaccctgagaaagaaaaggaggatttcgagaaagtgattaagagtgtcgtgatgacgctgtgccagaagtcaatcaaggtgacggggctgccgaacacattcatggtgattttagaggatgtcgccatgcttcacattaagccagaccagttcacctatacgagtgatcacttcgagacaattatgaagtacgcggagaagctcatccaagaggggaaggcatacgtcgatgatacacccgccgagcagatgaaggcagagcgggagcagaggattgatagcaaacatagaaagaaccctatagaaaagaatctgcagatgtgggaggagatgaaaaaagggtcccagttcggacaatcttgttgcctgcgcgctaaaatcgacatgtcttcgaacaacggctgtatgagagacccaactctgtatcgctgcaagatacaacctcatccacgcactggaaataaatacaacgtgtacccgacgtacgacttcgcatgtcctatcgtagattccatcgagggcgtgacccatgccctgcggacaacagagtaccacgaccgcgacgaacagttttactggatcatagaagcccttgggatccgcaagccgtacatttgggagtatagtcgcttaaacctgaacaataccgtcctttccaagcgcaagctaacttggttcgtaaacgaggggctcgtggacgggtgggacgatcctcggttccctactgttaggggagtcctaagacgtgggatgactgttgaagggctcaagcagttcattgctgcacagggctcatctagaagcgtcgtaaatatggaatgggacaagatttgggctttcaacaagaaagtgatcgatccagtggcacctaggtacgtggcattgcttaaaaaggaagtcattcctgtaaatgtgccagaagcacaggaagagatgaaggaggtggctaagcatccgaagaaccccgaggtaggcctaaagcctgtctggtactcgccaaaggtgtttatcgaaggcgctgatgccgaaacattctcggagggggaaatggtcacttttatcaattggggcaacctgaatattactaagattcacaaaaatgctgacgggaagatcatcagtctggatgccaagcttaatctcgagaacaaggactacaaaaagactacaaaagtaacctggctcgctgaaacaacacatgccctgcccatcccggtaatttgcgtgacttacgaacacctcataacaaagcctgtgctcgggaaagatgaagatttcaaacaatacgtcaacaagaatagtaaacacgaagaactgatgctgggcgatccatgcttgaaagacctaaagaaaggtgatatcattcagctccaacggaggggctttttcatatgtgaccagccctacgagcccgtctccccatactcatgcaaggaagctccgtgtgtgctgatctacattcccgatggacacaccaaggagatgccgacatccggctcaaaggaaaaaaccaaggtcgaagcaaccaaaaacgagacatctgcccccttcaaagagcggccaacaccttctctaaataacaactgcactacaagtgaggattccttggtgttgtataaccgcgtggccgttcagggagatgttgtgcgcgaactgaaggcaaaaaaagctcccaaagaggacgtcgatgcggcagtaaagcagctgctctctctcaaggcagaatataaggagaagactggacaggagtacaaacccggaaaccctcctgctgaaatcgggcagaacatatcctccaactccagcgcgtctatcctggagtctaagtccctgtacgacgaagtggctgcccagggagaggtggtacgtaagctcaaagcagagaaatcaccgaaagccaaaatcaatgaggcagtagaatgccttctgtctctgaaagcccagtacaaagaaaagactgggaaggaatacattccgggacagccaccattaagccaaagtagcgactccagccccactcgtaacagcgagccggctggcctagaaacgccagaggcaaaggtactattcgataaagtggcctcccagggcgaagtcgtacgcaaactgaagaccgagaaggcacccaaggaccaagtggacatcgcagtgcaagagttgttgcaactgaaggcccaatataaaagcctcataggggtggagtataaacctgtcagcgccaccggtgcagaagacaaggataaatag

SEQ ID NO: 118651 - DNA, 2928 bp, Artificial Sequence
  Description of Artificial Sequence: Synthetic coding sequence
atggctactctctctctgacagtgaatagcggcgacccgcctcttggggcactgttagccgtggagcatgttaaggacgacgtgtctatttctgtggaggagggaaaagaaaatattttgcacgtttcggagaacgtgattttcacagacgtgaactcgattctgaggtacctcgctcgagtggccaccaccgctggtctctatgggtcgaatctaatggagcataccgagatcgaccattggctagagttttccgccactaaactctctagctgtgactcctttaccagcactatcaacgaactcaatcactgtctctccctgcggacatacctggtagggaacagcctttcacttgctgacctctgtgtttgggccaccctgaaagggaatgccgcatggcaggaacagctgaaacagaaaaaggcccccgtacacgtgaagcgatggtttgggttcttagaagcacaacaggcctttcaaagtgtagggacgaagtgggacgtatcgacaacaaaggcacgagtcgcccccgagaaaaagcaagacgtgggcaagtttgtggagttgccaggcgccgagatgggaaaagtgaccgtcaggttccctcctgaagcatcaggttacctgcacataggacacgccaaagcggcactcctcaatcagcattatcaggtaaatttcaagggcaaattaatcatgagattcgacgatacgaacccagaaaaagagaaggaggatttcgagaaggttattctggaggacgtcgctatgctgcacatcaagccagaccagtttacatatacctctgatcactttgaaaccattatgaagtacgccgaaaagctcatacaggagggtaaagcatatgtcgacgatacccctgcggagcaaatgaaggccgagagggagcaacgcatcgattcgaaacatcgcaagaaccctattgaaaaaaacctccagatgtgggaggagatgaaaaagggctcccaatttggacaatcttgctgcttgagggcgaagattgatatgagttccaataacggatgtatgagggacccaactctctacagatgcaaaatccagcctcacccgcgtaccgggaataaatacaacgtctacccaacctatgactttgcatgtccaattgtggactcgattgagggagtgacacacgctctgcggacaaccgaataccacgaccgggacgagcagttttattggatcatcgaagccctgggtatccgaaagccttatatctgggaatatagccggctgaacttgaataatacagtgctgtcaaaacggaaactgacatggttcgtgaatgaaggactggttgatggatgggatgaccctagattccccacagtccggggtgttctgagacgcggcatgacagtcgaagggctaaagcagtttattgccgcccagggcagttccaggagtgtggtcaacatggagtgggacaaaatttgggcttttaacaagaaattacgcgccctctgtaaaaaggtcatcgaccctgtcgccccgcgttatgtcgctctgcttaaaaaagaggtcatcccagtgaacgtcccagaggcccaggaagaaatgaaggaagttgctaagcatcccaaaaaccctgaggtcgggctgaaacccgtgtggtactcacctaaagtctttatcgaaggggcggacgccgaaacattctccgagggggaaatggtgacatttattaactggggaaacctgaatattaccaagatccacaagaatgccgacggcaagatcatctccctggatgccaagctcaatctggaaaataaggattacaaaaaaactaccaaggtcacctggctggcagagaccactcatgctttaccgatcccagtcatatgcgttacttatgagcacttgatcacaaagcccgtgctgggcaaggacgaggactttaagcaatacgtgaacaagaatagcaaacatgaggagctgatgctgggggatccttgtctgaaagacctaaagaagggagacatcattcagttgcagaggcggggcttctttatttgcgaccagccttatgagcccgtgagtccctattcttgcaaagaggcaccgtgtgtgttaatttacattcccgacgggcacaccaaagagatgccaaccagcggctctaaagagaaaacaaaggtggaagcaacaaaaaacgagacctccgcaccgttcaaggagaggcccactcctagtctgaacaataattgtacgacctcagaagattccctggtcctctacaacagagttgccgtccagggcgacgtggtcagggaattaaaggctaagaaagccccgaaagaagacgtagatgcagccgtgaaacagttgctttccctgaaagcagaatataaggagaaaacgggccaagagtacaaacccggtaatcctcctgccgagattgggcaaaatatatcctctaatagcagcgcctctatattggagtctaagtctttgtacgacgaggtggccgcacagggcgaagttgtccgcaagctgaaagccgagaagtcccccaaagcaaagattaacgaagctgttgagtgtctgttgagccttaaggcccagtataaggaaaagaccgggaaggagtacatacccggtcaaccacctctttcacagtcttctgattcatcccctacccgaaactctgaaccagcgggccttgagactcccgaggccaaagtgttgtttgataaggtggcttcacaaggtgaagtcgtaagaaagctgaaaaccgaaaaggcacctaaagaccaggtggacatcgcggtccaggagctgctgcagttgaaagcacagtacaagtccttaattggggtcgagtacaaacccgtcagtgcgacaggagccgaggacaaggataaaaagaagaaagagaaatag

SEQ ID NO: 118652 - DNA, 1572 bp, Artificial Sequence
  Description of Artificial Sequence: Synthetic coding sequence
atggccgctctgctgagacgtttgctacaaagggaacggccaagcgccgccagcggcaggcccgtaggcagacgcgaggcaaatctcggaacagatgccggcgtggcagtgcgcgtgaggttcgcaccttcgccgacaggattcctgcatctagggggactgagaaccgcgctgtataactacatattcgcaaaaaagtaccagggatcgttcattttgcgcctggaagacaccgaccaaacgagggtcgtgcctggggctgccgagaacattgaagacatgcttgagtgggcagggatacctcccgacgaatcccctcgccgtggcgggccagccggaccctaccagcagtcacagcgcttggagctttacgcccaggccacagaagcactgctgaagactggggcggcgtatccgtgcttctgttcaccccaaagactcgaattgttgaagaaggaggctctgaggaatcaccagacccctcgctacgacaaccgctgtaggaacatgtctcaggaacaagtcgcccaaaagcttgccaaggatcccaagcctgccatcagattccgcctggaacaggtggtccccgccttccaagaccttgtttatggatggaatcgccatgaagtggccagcgttgaaggagaccccgtaataatgaagtctgacgggttccccacataccatcttgcatgcgtggtggatgaccatcatatgggcatctcccatgtcctccgcggcagcgaatggctcgtttccacagctaagcacctactgctgtaccaagctctgggttggcagccccctcactttgcccacctgccccttcttctcaaccgcgacggatccaagctatccaagaggcagggtgacgtcttcctcgagcattttgcggctgacggcttccttccagactccttattggacatcatcacgaattgtgggagcgggttcgcagagaatcagatgggacgaaccctgcctgagctgatcacacagtttaatttaacacaggtaacctgccactctgctctgctggatctcgagaagctgcccgagtttaacaggttgcatctgcagcgcctcgtgtccaatgagagtcagcggcggcagctggttggaaaattacaggtcctcgtggaggaagcatttggttgtcagttacagaaccgggacgtgttgaatccagtttacgtggaacgtatccttctgttgaggcagggacacatttgccgtctgcaggacctggtgtcgcccgtatattcgtacctgtggacccggcccgccgtcggccgagcccaattggatgcaatatccgagaaggtggacgttatcgccaagcgagtgctcgggctgctggagcgttcaagcatgagtctgactcaagacatgctgaacggagagctgaagaaactaagtgaggggttggaggggacgaagtatagtaacgtaatgaaactcctccggatggctctatccgggcagcagcaaggcccacctgtcgcagaaatgatgcttgccctgggaccaaaggaagttcgggagcggattcaaaaggtcgtgtccagttag

SEQ ID NO: 118653 - DNA, 1572 bp, Artificial Sequence
  Description of Artificial Sequence: Synthetic coding sequence
atggccgcccttctcagacggctgctgcagcgagaaagaccatctgcagccagcgggagacctgtgggccgacgtgaggctaacttgggcacagatgctggcgtggccgtgagggtccgttttgcccccagtcccacaggtttcctacatctgggaggcctccgaaccgctttatataactacatcttcgccaagaagtatcaaggttccttcatccttcggctcgaggatacagatcagactcgagtggttccaggggcagctgaaaacattgaagacatgctggaatgggcaggaatcccccctgatgagagcccccggaggggcgggccagccgggccttaccaacagtctcaacggctcgagctgtacgcacaagcaacagaagccctgctgaagactggagccgcctacccctgcttctgcagcccgcagaggcttgaactcctcaaaaaagaagcgttgcgtaatcatcaaactccccggtacgataataggtgccggaacatgtcccaggaacaggtagctcagaaactggctaaagacccaaagcctgccatcagatttagactggagcaagtggtccccgctttccaggaccttgtctacggttggaatcgccacgaggttgccagcgtcgaaggggaccctgtcatcatgaagtccgacggcttccccacctatcatctggcctgtgtagttgacgaccatcacatgggtatctctcatgtgttaaggggctccgagtggctagtgtccaccgcaaagcatctccttctttaccaggccctcggctggcagccccctcattttgcacatttgcccctactattgaacagagacggtagtaaacttagcaagagacagggggatgtgttcctggagcacttcgctgcagacgggttcctccctgattcacttctggatatcatcacaaattgtggaagcggatttgcggagaaccaaatgggcagaactttgcccgagttgatcacacagttcaatctcactcaggtgacttgccactcagctctccttgatttagagaaattgcccgaattcaatcggctccatctgcagcgactcgttagcaacgagtcacaacggagacagttggtggggaaacttcaggttctagtggaggaagccttcggttgccagctccagaaccgagacgttctgaatcccgtgtatgtggaaagaattctgctcctgagacaggggcacatttgccggctacaggacctagtttcaccagtttactcttatctgtggaccaggccagccgtaggccgagcccaacttgatgcgatttctgagaaggttgatgtgatcgctaaaagggtcctgggactcctcgagaggtcatctatgtcactgacgcaggacatgcttaacggtgagcttaagaaactgtcagagggccttgagggaactaaatacagcaatgtgatgaagctcctgagaatggcactgagcgggcagcagcagggccctccagttgcagagatgatgctggctctcggaccaaaagaagtgagagaacggattcagaaggtggtgtcttcttag

SEQ ID NO: 118654 - DNA, 321 bp, Artificial Sequence
  Description of Artificial Sequence: Synthetic coding sequence
atggctcaggagtttgtcaattgcaagatccaacccggaaaggtcgtcgtgttcatcaagcctacctgcccatattgcaggcgagctcaggagattctgagtcagttacctatcaaacaaggactgctggaattcgtggatattaccgccactaatcataccaacgagatccaagattatctgcaacaactgacgggggctcgcactgtacccagggttttcatcgggaaagattgtattggggggtgcagtgacttggtgtccctgcagcagagcggtgagctgctgacccgcctgaagcagatcggtgccctgcagtag

SEQ ID NO: 118655 - DNA, 321 bp, Artificial Sequence
  Description of Artificial Sequence: Synthetic coding sequence
atggcccaagaatttgtcaattgcaaaatacagccaggtaaggtggtggttttcatcaaacccacttgcccatactgtagaagggcacaggaaatcctgtcccagctacccattaagcagggcctgctggaatttgtggatattacagctaccaaccacaccaatgagattcaggactatctgcagcagctgacaggggcccgtacagtacctagagtttttattggtaaggattgtatcggcggctgctccgacctggtctctttacagcaaagcggtgaattactgactcgcctaaagcaaatcggagccctgcagtag

SEQ ID NO: 118656 - DNA, 321 bp, Artificial Sequence
  Description of Artificial Sequence: Synthetic coding sequence
atggcacaagagtttgtgaactgcaagatccagcctggtaaggtggtagtgtttatcaagccgacttgcccctattgcagaagagcacaggaaatcctaagtcagcttcccatcaagcaaggcctgctcgaatttgtggacatcaccgctaccaatcacacaaatgagatacaggactatctgcagcagctgaccggggctcgcactgtcccacgcgtgtttatagggaaggattgtatcggtggctgctctgacctagttagcttgcaacagtccggtgaactcctcacaaggctgaagcaaataggtgccctccaatag

SEQ ID NO: 118657 - DNA, 321 bp, Artificial Sequence
  Description of Artificial Sequence: Synthetic coding sequence
atggcgcaggaatttgttaattgcaaaatccagccaggtaaggtcgtggtgttcataaagccaacctgtccatactgtaggcgcgctcaagaaatcctatcccagctcccaatcaaacagggtctcctggagttcgtggatatcacagccacaaaccacaccaatgagattcaggactacctgcagcaattgaccggagcccgcaccgtgccaagggtctttattggtaaggactgcattggaggatgttcggatctggtctccctgcagcagagcggagaactactgacccgcctgaagcagataggtgccctccagtag

SEQ ID NO: 118658 - DNA, 321 bp, Artificial Sequence
  Description of Artificial Sequence: Synthetic coding sequence
atggctcaagagtttgtcaattgtaaaatccagccaggcaaagtggtggttttcataaaaccaacctgtccttattgtagacgggcgcaagaaatacttagccagctgccaatcaagcagggactgctggagttcgtcgatatcactgccaccaatcatactaatgagatacaggactacttacagcaactgacaggggcaaggaccgtaccccgtgtcttcattgggaaggattgcatcggcggctgtagcgacttggtatcgctgcagcagtccggggaactcctcacacgccttaagcagatcggcgctttgcagtag

SEQ ID NO: 118659 - DNA, 495 bp, Artificial Sequence
  Description of Artificial Sequence: Synthetic coding sequence
atgatctggagacgagccgcgttggcaggcaccaggctagtgtggagtcgctctggtagcgcggggtggctcgaccgcgccgctggagctgcaggggcagcagccgcagccgcaagcggcatggagagtaacacatctagttctctggagaacttggctacggcacccgtcaatcagatccaagaaacgatttcagacaactgcgtcgttattttttcaaagacctcttgcagctactgtaccatggccaagaagctgtttcatgatatgaacgttaactacaaggtggtagagctcgacctgctcgagtatggcaatcagtttcaggacgccctgtacaagatgactggcgaaagaaccgttcctcgaatatttgtgaatggaacctttattggtggagctaccgatacccaccgcctccacaaagaggggaaacttctcccactggttcaccagtgctacctcaaaaagtcaaagcgaaaagaattccagtag

SEQ ID NO: 118660 - DNA, 498 bp, Artificial Sequence
  Description of Artificial Sequence: Synthetic coding sequence
atgaacccgcgggataagcaagtaagccggttttcgccactgaaagatgtgtacacctgggtggcacttgccggtatccagagatccggctctccggggcggacgcgctcagccgcccgccgcatggagagtaatacctctagtagtctggaaaatttggctaccgctcccgtgaatcaaatccaagagactatctcggacaactgtgtcgtcatcttctccaagacttcgtgttcatattgtacgatggccaaaaaacttttccacgacatgaatgtgaactataaagttgttgaactggatctgcttgaatacggaaatcaattccaagacgctctgtataagatgacaggtgaacggaccgttccccgcatctttgtgaacggaacattcatcggcggggccactgacacgcatcgattgcataaagagggaaaacttctgcccctcgtgcatcaatgctaccttaaaaagagcaaacgaaaagaatttcagtag

SEQ ID NO: 118661 - DNA, 1008 bp, Artificial Sequence
  Description of Artificial Sequence: Synthetic coding sequence
atggctgcaggtgcagctgaggcagccgtggcggctgtcgaagaggtcggcagtgcaggccaatttgaagaactgttaaggctgaaggctaagtctcttttggtggtccatttttgggctccgtgggcgccccagtgcgcccagatgaatgaagtgatggccgaactggctaaggaactcccacaggtatcttttgtgaaattggaggccgagggagttcccgaagtctctgagaagtatgaaatatcatcagtgcccacgttcctgttctttaaaaacagccagaaaatcgaccggctcgatggtgctcacgccccagaactaacaaagaaagttcaacgccatgcaagctcaggatcgtttctgccttccgccaatgaacatcttaaagaagatcttaacctccggctcaaaaagctcactcatgccgcaccatgtatgttattcatgaagggcacccctcaagaacctcgctgtggatttagtaaacagatggtggagatcctccataagcataatattcagttctcttcctttgatatatttagcgacgaggaagtgaggcagggactgaaggcatactcctcatggcccacatatccccaattgtatgtctccggcgaactaatcggaggattagacatcatcaaggagctcgaggcaagcgaggagcttgacaccatatgcccaaaagcacctaagttggaagaaagactgaaggtcctgactaacaaggcctccgtgatgttgtttatgaaaggcaataaacaggaggctaagtgcggcttttcaaaacagatactggaaattctcaactctaccggcgtggaatacgagaccttcgatatcctggaggatgaagaggtccggcaggggctgaaagcctactccaactggcctacttatccgcagctgtacgtgaagggcgagctggtaggcggcctcgacatagtgaaagagctgaaagagaacggcgaactactcccaattctccgaggggagaattag

SEQ ID NO: 118662 - DNA, 1008 bp, Artificial Sequence
  Description of Artificial Sequence: Synthetic coding sequence
atggcagctggcgccgcggaagctgctgtcgccgcagttgaggaggtgggctcagccggccagtttgaagagttgctgaggttgaaggccaagtccctcctcgtagtgcacttttgggctccgtgggctcctcagtgcgcccagatgaatgaggtgatggcagaactcgccaaagagttgccacaggtgtcgttcgtaaagctggaagctgagggagtgcccgaggtgagcgagaaatatgaaatctccagcgttcccaccttcctcttctttaagaactcccagaaaatcgatcgcctcgacggagcacatgcccctgagctgactaaaaaggtccagcgccatgcctcttccggtagttttttacccagtgcaaatgaacacctgaaggaggatctcaatctacgtcttaagaagctgactcacgctgctccgtgcatgctttttatgaaaggcacaccacaggaacccagatgtggctttagcaagcaaatggttgagatcctccacaagcataacattcagttctcttcattcgatatcttttcagatgaggaggtgaggcaggggctgaaggcgtactcctcctggccaacctatccccaattatatgtgagcggagaactcattggtggattggatataatcaaggaactggaggccagcgaggaactggacaccatctgtcctaaagcccctaagttggaggagagactcaaagtgctgacaaacaaagcttcagtaatgttgtttatgaaggggaacaagcaagaggcaaagtgcgggttttcaaaacagatactggagatattaaattctaccggagtagaatatgagacattcgatatcctggaagacgaagaggtaaggcaagggctgaaagcttacagtaactggcccacatacccacagctgtatgtcaaaggtgagctcgttggaggcctggatattgtaaaagaattaaaagagaatggagagttgctgcccatcctgcggggggagaattag

SEQ ID NO: 118663 - DNA, 1008 bp, Artificial Sequence
  Description of Artificial Sequence: Synthetic coding sequence
atggcagcgggggctgcagaagctgccgttgctgccgtggaagaggttgggtccgcgggccagtttgaggaactcctgcgcctcaaggcaaaatccctgttggttgtgcacttctgggccccctgggccccccagtgtgcacaaatgaacgaagttatggcagagctagccaaggagttgcctcaagtgagcttcgtcaaactcgaggccgagggtgtacctgaagtgtctgaaaagtatgagattagcagtgtgcccacattcctcttttttaagaatagtcaaaaaattgataggctggatggggcgcatgcacccgaattgacaaaaaaggtgcagcgacacgcctcctccggttctttcctacctagtgccaacgaacatttgaaagaggacctgaatttacgattgaagaagctcacccacgctgccccatgcatgctctttatgaaaggtacaccccaggagcctcgatgtggctttagcaagcagatggtggaaatccttcacaagcataatatccagttttcaagcttcgacatattctcagacgaagaagttcgccaaggactgaaggcctattcgtcctggccaacatatccacagctctacgtaagcggggagctgattgggggcctcgatattattaaggagctggaggccagcgaggagctcgacaccatctgcccaaaagctcctaagctagaggagaggctaaaggtcctgactaacaaagctagcgtgatgcttttcatgaagggtaacaaacaggaggccaaatgtggattctcaaagcagatcctggagatcctcaacagcaccggggtggagtacgagacattcgacatcctggaggacgaggaagttagacagggcctgaaggcctactcgaattggcctacatacccacagctgtacgtgaagggggagctggtaggaggcctggacatcgttaaggaattgaaggaaaacggcgagctgctccccattttgaggggcgaaaattag

SEQ ID NO: 118664 - DNA, 474 bp, Artificial Sequence
  Description of Artificial Sequence: Synthetic coding sequence
atgagtggaagtctggggcgggccgctgccgccctcttaagatggggtcgtggtgctggtggcggtggactctggggccccggggtccgcgccgccggtagcggtgctggggggggcggctcagcagaacagctcgacgctctggttaaaaaggacaaggttgtggtttttctgaaagggactccagagcagccccaatgcggcttctccaacgcagttgtgcagatattacggttgcacggggtgcgggactacgccgcttataatgtgctggatgatcccgagcttcggcagggtattaaagactattccaactggcctacaatcccacaggtgtatctgaacggagaattcgtgggaggctgcgacatcttgctccagatgcaccagaatggagatctggtggaggagctgaaaaagttgggaatccattcagcgctgttggacgaaaagaaagaccaggattccaaatag

SEQ ID NO: 118665 - DNA, 873 bp, Artificial Sequence
  Description of Artificial Sequence: Synthetic coding sequence
atgcttaagagggaaatgaagcccgaatctgatcgaccgagaaaagtgcggttcaggatcgcttcctcccatagcggccgtgtgttaaaggaagtgtatgaagacggccagcccagtggatccctagacagcgagtgcgctagcatctgcggaatagatggcctcggcgatagcgatggacagcagaatgggcatatagagagcgagggagatgagaacgagaacgaccaagacagcctcctcgtccttgctcgcgctgctagtgaaaaaggcttcggtactagaagagtcaatattttgagcaagaacggcacagtgcggggtgtgaagtacaaggtaagcgctgggcaggcgctcttcaacaacctgactaaggtgctgcagcagccctctactgatctcgagtttgaccgcgtagtaatctacacgacgtgtctgagggtcgtgagaactacattcgagcggtgcgaactggtccggaagattttccaaaatcacagggtgaagttcgaggaaaaaaatatagccttgaatggcgagtatggaaaggaactggacgaacggtgccgacgcgtgagtgaggccccatcgcttcctgttgtctttatcgatggacactacttggggggggccgaaaagatcctgagtatgaatgaatctggggagctgcaggacatcctgactaagatagagcgcgtacaacacccacatgaatgcccgagttgcggagggttcggatttttgccgtgcagcgtgtgtcacggcagtaaaatgagtatgttccggaattgtttcactgatagctttaaagccctgaaatgtacagcctgcaacgagaatggcctccagagatgcaaaaactgcgcaggttag

SEQ ID NO: 118666 - DNA, 828 bp, Artificial Sequence
  Description of Artificial Sequence: Synthetic coding sequence
atgagccactgctcctcccgcgctctgaccctcctgagctccgtgtttggtgcttgcgggctgcttctggtggggatcgctgtctccactgattattggctttatatggaagagggaactgtgctgccacagaatcagactaccgaagtcaagatggctctgcatgctggactgtggcgggtctgctttttcgctggacgcgaaaaagggcgctgcgtcgcttctgaatactttctggaacctgagatcaacctagtgaccgaaaataccgagaacattctcaagaccgtacggaccgcaacacccttcccaatggtctccctcttcctggtgttcactgccttcgtcatctcgaatattggacatatacggccccagaggactattctcgcttttgtgtccggcatcttttttattctttctggcctgtctctggtcgtgggtctggtgctgtatatcagcagtatcaacgatgaggtgatgaaccgcccttctagctccgagcagtacttccactaccgatatggctggagttttgcttttgccgcttcctctttcctcctcaaagagggcgcaggtgttatgagtgtctatctctttacaaagagatacgccgaggaggaaatgtataggcctcaccctgccttctaccggcctcgcctgagtgattgttcagattattctgggcagtttctgcagccagaggcctggcgcagaggccggtctcccagcgatatttcctctgatgtttctatacagatgacacaaaattaccctccagcgatcaagtaccctgatcaccttcacatttcaacctccccctgctag

SEQ ID NO: 118667 - DNA, 987 bp, Artificial Sequence
  Description of Artificial Sequence: Synthetic coding sequence
atggccctccggggcgttagcgtgcgtctgttgtcgagagggcccggactgcatgtactgcggacatgggtaagcagcgccgcccagactgcctctagacccgagttcgattggcaagatcctttggtgctggaggagcaattgactacagatgagatattgatcagagacacctttaggacttactgccaggaacgcctcatgccccgcattctcttggcgaaccggaatgaggggtatggttgcgcgggggtgagctccgtcgcctatgggcttttagctcgagagttggaacgcgttgactccggctacaggagcgctatgagtgtccagtcttccctcgttatgcaccccatctatgcttatggaagtgaggaacagaggcagaaatatctgccacagttggccaaaggggagttgttaggatgctttggactcacagagcctaacagcggtagcgatccgtcaagcatggagactcgtgcacattataactcgagcaacaaatcatacaccctgaatggcaccaagacctggatcaccaatagccctatggcggacctatttgtcgtgtgggctcggtgcgaggacggttgtataagagggtttctgctggagaaaggcatgaggggccttagtgccccccggatccagggaaagttcagtcttagagcctcggccaccggcatgatcataatggacggagtggaggtgccagaagaaaacgtcctccctggcgccagcagccttggtggtccctttggctgtcttaataacgcgcgctacgggatcgcatggggcgttctgggtgcttccgagttctgcctgcacaccgcacgccagtatgccttggacagaatgcagttcggcgtccccctcgcgcgaaaccagctgattcagaaaaagcttgccgatatgttgacggagattacactcggcctgcacgcgtgtctccagttggggcggcttaaagaccaagataaatag

SEQ ID NO: 118668 - DNA, 1185 bp, Artificial Sequence
  Description of Artificial Sequence: Synthetic coding sequence
atgagatctagcagcgggaccccctctgccccgactgcccgccgcgactcatgcctggctagctgttggcccatcgcgactaagagcctcgcactgttgccgcggttggaatgctcaggtaccattttagcccactgcaagttttgtctgccaggatcgtcagactccccagcttcaacccccctcgttgccggaatcactggatacgggtgcgccggagtgagtagtgtggcctatggtctgcttgcaagggagctagagagagtagactccggttaccgcagcgccatgtccgtacaatctagtctggtgatgcatcctatatacgcctatgggtcagaggagcagcggcagaagtatctcccgcagctggctaaaggagaactcctgggatgtttcggtctgacggaacctaacagcgggtctgatcctagttccatggagacacgggcacattataacagctctaacaaatcatacacactgaacggtacaaagacatggataacgaactctcctatggccgatcttttcgtagtgtgggcacggtgtgaggacggctgcattcgagggttccttctcgagaaaggaatgaggggattgtctgcccccaggattcaaggtaaattctcactgagggcgagcgcgaccgggatgataatcatggatggtgtggaagtgcccgaggagaacgtcctcccaggcgcttcttctctaggcggtcccttcggttgtctgaataatgcccggtacggtatagcttggggtgtcttaggcgcttccgagttctgtctgcacacggctaggcagtatgccttggaccgcatgcagttcggcgtgcccctagcacggaatcagttgatccagaaaaagttagccgacatgctgactgagattaccttgggcctgcacgcctgtctgcagctggggcggctgaaggaccaagacaaagcagcacccgaaatggtcagcctgctcaagcgcaacaattgcggaaaagcactcgacatcgctagacaggcgagagacatgctgggcggaaatgggattagtgacgagtatcatgttattcgccatgcgatgaacctcgaggcagtcaatacatacgaaggaacacatgacatacacgctctgattctgggcagggctattacaggcatccaggcattcacggcttctaagtag

SEQ ID NO: 118669 - DNA, 1287 bp, Artificial Sequence
  Description of Artificial Sequence: Synthetic coding sequence
atggctttgcgtggagtgtccgtccgcctgctgtcccggggacctggcctgcatgtattgagaacatgggtctcatccgcagctcagacagagaaaggagggcggacacaaagtcagctggccaagagctccagacctgagtttgattggcaggatcctctggtgttagaagagcaacttactactgatgaaatcttaattagggacaccttccgcacgtattgtcaggagcgtttgatgccgagaatcctgcttgctaaccgaaacgaagtgtttcaccgggaaatcatctctgagatgggcgaattgggagttctgggtcctacaataaaaggctatggctgtgcaggggtctcctctgtggcttacgggcttctcgcgcgcgaattagagagagtggactccggttatcggagtgccatgagcgtgcagtctagtttggtgatgcatccgatctacgcatacggatccgaggagcaaaggcaaaaatacctaccccagctggccaagggcgaactgctgggatgtttcgggctaactgaaccaaatagcggcagcgacccatccagcatggagacccgcgcacactacaactctagcaacaagagctatacactaaacggcacaaaaacctggataactaactcgccaatggctgatctgttcgttgtttgggcaaggtgcgaggacgggtgcatccgagggtttctactcgagaaagggatgagggggctgagtgctccccgtatccaggggaagttttccctgcgggcatcagccacaggtatgattatcatggatggggtggaggtgcccgaagagaacgtgctgccgggagcctcatctctcggcggccctttcggttgcctaaataacgcaagatacggcattgcatggggagttctcggggctagcgagttctgtttacacaccgccaggcaatacgcactggaccgcatgcagtttggggtgcctctggccaggaatcagttgatccagaagaagctggctgacatgctgaccgagataactttggggctgcacgcctgcctgcaattgggaagactcaaagatcaggataaggctgcacctgaaatggtcagcctgctcaagagaaataactgcggtaaagccctggacattgctcgccaagctcgggatatgctcgggggtaatgggatatcagatgaatatcacgttatacgccatgcgatgaatctggaagctgtgaatacatatgaagtggtgcagatgtgttccctgaagcggaggtggaatagcttgtag

SEQ ID NO: 118670 - DNA, 297 bp, Artificial Sequence
  Description of Artificial Sequence: Synthetic coding sequence
  Description of Combined DNA/RNA Molecule: Synthetic coding sequence
atgtgcgcggctcgtctagctgcagctgcagcagcagcacagagcgtttatgcattttccgcgagacctctggccggtggcgagcccgtgtcccttgggagcttacgaggtaaagtgcttttaatcgaaaacgttgcctcactgugaggtacgacggtgcgggattacactcagatgaatgaattgcaacgcagacttggtccaaggggactggtggtgctgggttttccttgtaaccaattcggccatcaggtccgcagggccgagagaggaggcgctggagcagacgtacagtag

SEQ ID NO: 118671 - DNA, 612 bp, Artificial Sequence
  Description of Artificial Sequence: Synthetic coding sequence
  Description of Combined DNA/RNA Molecule: Synthetic coding sequence
atgtgcgcagccagactggccgcagccgccgccgccgctcagtctgtatatgctttcagcgcccggcccctggcaggaggagagcccgtctctctgggctcattgcgcgggaaggtccttctgatagaaaatgttgcatcacttugaggcactaccgttcgggactacacacaaatgaacgagctgcagcggaggctcgggccgcggggcctggtagtgttgggttttccctgcaaccaattcggccatcaggaaaacgctaagaatgaagaaattttaaatagccttaagtatgttcgtcccggaggcggcttcgagcccaacttcatgctctttgagaaatgcgaggtcaacggagccggtgcgcacccgcttttcgctttccttagagaagctctcccagcgccttcagacgacgcgaccgcactgatgacagatcccaagctgattacatggtcacccgtctgccgcaatgatgtcgcctggaactttgaaaagttcttggtcggccctgacggtgtaccgcttaggagatactccaggagattccagactattgacattgaaccagatattgaggctctgctgtctcagggcccctcttgcgcctag

SEQ ID NO: 118672 - DNA, 573 bp, Artificial Sequence
  Description of Artificial Sequence: Synthetic coding sequence
  Description of Combined DNA/RNA Molecule: Synthetic coding sequence
atggccttcatcgctaaaagtttttatgatttaagcgcaataagcctggacggagagaaagtcgactttaacacctttaggggcagggccgttctgatcgagaatgtggcctccttaugagggacgaccacaagagacttcacacaactgaacgaactgcagtgccgcttccctaggcgacttgtggtcctaggattcccctgcaaccagtttgggcatcaggagaattgccagaatgaggaaatccttaattctcttaagtatgtgcgacccggcggaggataccagccaacctttaccctcgtgcagaagtgtgaggtgaacggccagaatgaacatcccgtgtttgcgtatcttaaggataagctaccctatccatacgatgacccattctccctgatgactgatcctaaactcattatctggtcccctgtgagacgaagcgatgtggcttggaactttgagaagtttctcatcggacctgagggtgaaccatttcgtaggtattcaaggactttcccgactattaacatcgagccggacatcaaacggctcctaaaggttgctatctag

SEQ ID NO: 118673 - DNA, 594 bp, Artificial Sequence
  Description of Artificial Sequence: Synthetic coding sequence
  Description of Combined DNA/RNA Molecule: Synthetic coding sequence
atgagcctgggacggctctgcaggctgctcaaacccgcccttctgtgtggggccctcgcagcccctgggctcgccggtaccatgtgcgccagtcgcgatgactggcgatgtgcacggagtatgcacgagttcagcgcgaaagacatcgacggccacatggtgaatctggataaataccgggggttcgtgtgcatcgtcacaaacgtcgcgtctcagugaggtaagacggaggtgaattacactcagttggtggacttgcacgctcgctacgctgagtgcggcttaagaattcttgccttcccctgcaatcagttcggaaagcaggagcctggctccaatgaggagatcaaggagtttgcagccgggtacaatgtcaagtttgacatgttttctaagatttgcgtgaacggcgatgacgcccatcccctgtggaagtggatgaagatacagcccaagggtaagggcattctcgggaacgcaatcaagtggaacttcacgaaatttctcatcgataagaacggctgcgtcgtgaaacggtacggcccaatggaagagcctctagtgatcgaaaaagacctcccacactacttctag

SEQ ID NO: 118674 - DNA, 666 bp, Artificial Sequence
  Description of Artificial Sequence: Synthetic coding sequence
atgactacccagttgcgggtggtgcatctcctccctctcctcctggcgtgcttcgttcagacctcacctaagcaggaaaagatgaagatggattgtcataaggacgaaaagggtactatatatgattatgaggctatcgccctgaataaaaatgaatatgtctcttttaagcagtacgtaggtaagcacatcttgttcgtcaatgtcgctacatattgtgggctgaccgcacagtacccagagctcaatgcgttacaggaggagcttaagccatatggccttgtggttctcggctttccgtgtaatcagttcgggaagcaagaacctggagataacaaggaaatcttacccgggctgaaatacgttagacctggcgggggcttcgtgcctagcttccagctgtttgagaaaggcgatgtaaacggagagaaggagcagaaagtcttttcttttctgaaacattcatgcccacatcctagtgaaattcttggtaccttcaaatcaatcagctgggatcctgtgaaggtgcatgacattagatggaacttcgagaaatttttggttggccccgatggcatcccagttatgaggtggtcacaccgtgccaccgtatctagtgtgaagacagatattttggcttacctcaaacagttcaaaactaaatag

SEQ ID NO: 118675 - DNA, 303 bp, Artificial Sequence
  Description of Artificial Sequence: Synthetic coding sequence
atgaccacgcagctgcgcgtggtgcacttgctgcctctcttactggcatgtttcgtccagacatcacctaaacaggagaagatgaaaatggattgccacaaggacgagaaaggaacaatttatgactacgaggctattgcgctgaacaaaaatgaatacgtttccttcaaacagtatgttgggaaacacatattattcgtgaatgtggccacttattgtggcctcactgcacagtaccccggaatgagcgttcagggcgaggatctgtacctagtgtcatcttttcttaggaaggggatgtag

SEQ ID NO: 118676 - DNA, 573 bp, Artificial Sequence
  Description of Artificial Sequence: Synthetic coding sequence
atggctgagaagacccagaaatctgtaaagattgccccgggcgcagtggtgtgcgttgaatcggaaatcaggggtgacgtaaccatagggccacgcacggtcatccaccccaaggctaggataatcgccgaagcggggcctatcgtcatcggagagggtaatttgattgaggagcaagccctgattattaatgcctatccggacaacatcactcccgatacagaagatccggagcctaagcccatgattattggcacaaataacgtgtttgaggttggatgctattcgcaggccatgaaaatgggagataataacgtcatcgaaagcaaggcttatgtgggccgtaatgttatactaacttccggatgcatcattggggcctgctgcaatctgaatacgttcgaagtcattcctgagaacacagtcatttacggggccgattgcctccggagggtccagacagagagaccccagccacaaactctgcaactggacttcctgatgaagatcctccctaattaccatcatctaaaaaaaaccatgaaggggtcatccacgccagttaaaaattag

SEQ ID NO: 118677 - DNA, 1440 bp, Artificial Sequence
  Description of Artificial Sequence: Synthetic coding sequence
atggcttgccgccaggaaccccaacctcagggaccaccccctgccgctggagccgttgcctcgtatgactatctggtcatcgggggcgggtccggcggactggccagcgctcgccgggctgcagaattgggagccagggccgccgtcgttgagagccacaaactgggcggcacgtgcgtaaacgtcggttgcgttcccaagaaggttatgtggaacacagcagtccattccgaattcatgcatgaccacgccgactacggctttccaagttgtgagggcaagtttaattggagagttattaaggaaaagagggatgcatatgttagcaggctcaatgcgatctatcagaacaacttaaccaagtctcacattgagattattagggggcacgccgcctttactagcgatcccaaaccaaccatcgaggtgtcaggtaaaaaatacaccgctccccacattctgatcgccaccggaggcatgccctcaactcctcacgaatcccagatcccaggggcaagtttgggcattacatccgacgggtttttccagttggaagagctgcccgggcgctctgtgattgtaggcgcaggttacattgctgttgaaatggcagggatactcagcgccttgggatcaaagacctctttgatgatccggcatgataaggtcttgcgctctttcgacagtatgatttcgaccaattgtaccgaggagttggagaacgcaggtgttgaagtcctcaaattcagccaagtgaaagaggtgaagaagaccctgagcggtttggaagtttccatggttaccgccgtgccagggcgcctgcctgtgatgactatgattcccgacgtggattgcctgttatgggccattggccgggtgcctaacaccaaggacctgagtttgaataaactgggtattcagacagacgacaaagggcacatcatcgtcgatgagtttcagaataccaatgtgaagggaatctacgcagttggtgatgtatgcggaaaggccctgctaacgcctgtggccatcgctgccggtagaaagctggcacaccggcttttcgagtacaaggaagatagtaagctggattataacaatattcccacagtggtcttctcccacccccccattggcactgtcggactaactgaggatgaagccatccacaagtacggtatagagaatgtcaaaacctacagtacttcgtttacaccaatgtatcatgctgttaccaaacggaaaactaaatgtgtcatgaagatggtttgtgcaaacaaagaggaaaaagtggtcgggatacacatgcagggactcggctgtgacgaaatgctgcaaggctttgctgtcgcggtcaagatgggggccaccaaagctgatttcgataataccgtggcaattcatcctacctcttctgaggagctagtgacactccgctag

SEQ ID NO: 118678 - DNA, 1323 bp, Artificial Sequence
  Description of Artificial Sequence: Synthetic coding sequence
atggctctcctgcctcgcgccctctccgctggagccggtccatcatggaggcgggccgcgcgggctttcagagggttcctgctgctcctgcccgaacccgcagccctgacgagggcgctgtctagggctatggcctgccggcaagaacctcagccccagggacctcctcctgcagctggcgctgtcgcaagctacgactaccttgtaataggtggaggttctggggggctggccagcgcccgaagggccgctgaactgggcgccagggcagccgttgtggagagccataagctcgggggcacctgcgttaacgtgggctgcgtgccgaaaaaggtgatgtggaatacagctgtccactctgagtttatgcatgatcatgctgattacggatttccttcatgtgaaggaaaattcaattggagagtgatcaaagagaaacgggatgcttatgtgtcccggctcaatgccatttaccagaacaatctgaccaaatcccatatagaaattatacgaggacacgctgcattcaccagcgatcctaagcctacaatagaagtatctggcaagaagtataccgcccctcacatcctgatcgcgaccggtggtatgccttctacgcctcacgagtcccagattcccggcgccagtcttggaataacgtctgatggtttctttcagcttgaggaacttcccggacgctctgtaatagtgggggccggttatatcgctgttgaaatggcaggcattcttagcgcccttggctccaagacctccctgatgattaggcatgataagggcattcagacagacgacaagggccacattatcgtggacgaattccagaacaccaacgtaaagggaatttacgctgtgggggacgtctgcggtaaggctttgcttaccccagtggctatagccgcgggtagaaagttggctcatcggctctttgagtacaaggaggacagcaagttggactacaataacattcccacggtagttttcagccaccctcccatcggtaccgttggactgacggaagatgaggcaatacataaatatgggatagaaaacgttaaaacctactctacgtcctttaccccaatgtaccatgccgtcaccaagaggaaaactaaatgtgtcatgaaaatggtgtgcgccaataaggaagagaaggtagttggcattcacatgcagggccttggttgtgacgaaatgctccaggggtttgccgtcgcagtgaagatgggcgcgacaaaagctgactttgataacaccgtcgccatacaccctacaagctcagaagagctggtcacgttaagatag

SEQ ID NO: 118679 - DNA, 1410 bp, Artificial Sequence
  Description of Artificial Sequence: Synthetic coding sequence
atggcactgctacctcgagccctttccgctggggctggcccatcatggcggagagcggcccgggcctttagggggtttctccttctgctgccggagcctgctgccctgacacgcgccttaagccgggcaatggcttgcagacaggaaccccagccacaaggacctccgccagccgccggggcagtggccagctatgattacctcgttatcgggggaggaagcggaggactcgcaagcgcgcgacgggcagctgagctgggagctcgtgccgccgtggttgagtctcacaaactcggaggcacttgtgtcaacgtcgggtgcgttcctaagaaggtgatgtggaacacagctgtgcactctgaatttatgcacgatcatgccgactatgggtttccaagttgcgaggggaagttcaactggcgcgttatcaaggaaaaacgggatgcctacgtcagtcggttgaacgccatctaccagaacaacctcacaaaaagtcatattgagatcattcgcggccatgccgccttcacaagcgaccctaaacccacgatcgaggtgtctggcaagaagtacacagctccacatatcttgatcgcgactggcggtatgccatcgaccccccatgaaagccagattccaggtgccagtctcggcataactagtgatggattctttcagctggaggagttgcctgggaggagcgtgatagttggcgccgggtatattgccgtcgaaatggcagggatcctctcagctctgggctcaaagactagtctgatgattaggcatgataaagttctccgttcctttgattccatgatctccactaattgtaccgaagagctggagaacgccggtgtagaggtgcttaagttctcacaagggatccagacggatgacaaagggcatattattgttgacgaatttcagaatactaatgtgaaaggcatctatgccgttggggatgtttgcggcaaggccctccttacccccgtcgccatcgccgccgggcgcaagctcgcccataggctgtttgagtacaaagaggattccaagctcgattacaacaatatccctactgtggtcttctcccatcctcctataggaacggtgggtttgacagaagatgaggccatccacaagtacggcattgaaaatgtgaagacttacagtaccagcttcacacctatgtaccacgcagtgacaaagcggaagacaaagtgcgtcatgaagatggtatgtgccaacaaggaggagaaggttgtaggcattcacatgcagggccttgggtgcgatgaaatgctgcaagggtttgctgtggccgtcaagatgggtgcaaccaaggccgacttcgataatactgtggctattcacccaacatcttcagaagaactcgtcacccttagatag

SEQ ID NO: 118680 - DNA, 1482 bp, Artificial Sequence
  Description of Artificial Sequence: Synthetic coding sequence
atggcgttattaccacgggctttgtcagctggggccggtcctagctggcgccgagcagctcgggcctttcggggttttctcctgctgctcccagagcccgccgccctgactagagctctttccagagcaatggcctgtagacaggaaccccagccgcaaggccccccacctgctgccggcgccgtggcctcttatgactacctggtaatcggaggcggctccggcggccttgcatcggcgaggcgcgctgccgagctgggcgctagagccgccgtggtagaatcccataaactcggtgggacctgcgtcaacgttgggtgtgtgcccaaaaaggttatgtggaacactgccgtgcactctgagtttatgcacgaccatgccgactatggatttccgagctgcgaaggtaaatttaattggagagtcattaaggagaagcgcgatgcctacgttagccggctgaacgcaatctaccagaacaaccttaccaagtctcacatagagattatacgcggacatgcagccttcacttccgacccaaagcccacaatcgaagtgtctgggaagaaatacactgcaccacatatcctcattgcgaccggaggaatgccgtctacaccacacgagagtcagattcccggtgcatctctcggcatcacctccgatgggttttttcagctggaagagctccccggcagatcggttatcgtgggggccgggtacatcgctgtggaaatggccgggattctgtctgcgctgggcagcaaaacaagtcttatgattcgccatgacaaggtgaaagaagtgaaaaagactctgtctggactggaggtttccatggtaacggcggtgcctggaagattacccgtgatgacgatgatcccagacgtcgattgtctgctctgggcgatcggccgtgtgccaaacacaaaggacctctccctcaacaagctaggtatacagacagatgacaagggacacatcatcgtggacgaattccaaaatacgaacgtgaaggggatttatgcagtgggagacgtgtgcggaaaggctttgttaacccctgtcgcaattgctgcagggaggaaactggctcatcggctcttcgagtataaggaagactccaagttggattacaacaacataccgaccgtcgtcttcagccaccccccaattgggacagttggcctgaccgaagacgaggctatccacaagtacggaattgaaaacgtaaagacttatagcacatccttcacgcccatgtaccatgcagtaacaaaacgcaagactaagtgcgtgatgaagatggtgtgcgcaaacaaggaagagaaggttgtggggattcacatgcaggggctcggatgcgatgagatgttgcagggtttcgccgtcgcagtgaagatgggcgcaaccaaggcggactttgataatacagtggctatccatcctaccagcagcgaggagctcgtaacactaagatag

SEQ ID NO: 118681 - DNA, 669 bp, Artificial Sequence
  Description of Artificial Sequence: Synthetic coding sequence
atggccgagaagcctaagttacattacttcaacgcaagaggtagaatggagtcaactcgctggctgctagctgccgctggtgtcgagttcgaggagaagttcattaagtccgcggaggatctggacaagctgcgcaacgacggctaccttatgttccaacaagtgcctatggtggaaatcgatgggatgaagcttgttcaaacccgcgctatcctcaattacatcgcatcaaaatataacctctacgggaaagacataaaagaacgcgcattaattgacatgtacatagaaggaatcgctgacctgggagaaatgattctgttgctgccggtttgtccccccgaggagaaggacgccaaattagccctgatcaaagaaaagataaaaaaccgctatttccctgcctttgagaaggtgctcaaatcacacggccaggattacttggtggggaataaactgtccagagccgacatccacctagtagaactgctttactacgtggaggagctggacagcagtctcatttcatctttccctttactgaaggccctgaagactcgaatttccaacctgcccacagtgaagaagttcttgcagcctggatctcctaggaagcctcccatggatgaaaagtcactcgaggaggctcgaaaaatcttcagattttag

SEQ ID NO: 118682 - DNA, 669 bp, Artificial Sequence
  Description of Artificial Sequence: Synthetic coding sequence
atggccgagaaacctaagctgcattacagtaacatccgaggtagaatggaaagcatccgttggctccttgccgccgctggagttgagttcgaggaaaagtttataaaaagcgccgaagatctggataagctcaggaatgatggctatctaatgtttcaacaagtgcctatggttgaaatagacggcatgaagctggtacagactagagcgattctgaactacatcgctagcaagtataacctatacggaaaggatatcaaagagaaggccttaatcgatatgtatatcgagggaatcgccgacctgggagaaatgatcctgttgctccccttctcccaaccggaagaacaggatgcaaagctggccttgatccaggagaaaacaaaaaacagatacttcccagcctttgaaaaagtgctcaagtcacatggacaggattatttggtaggtaacaaattgtcccgtgcagatatccatcttgtcgagctattgtattacgtggaggagctggattcatctctcatatctagcttcccactcttgaaagcccttaaaaccagaataagtaaccttcccactgtgaaaaagtttctgcagcccggatccccacgcaagccgccaatggacgagaagtcactggaagagtcaagaaagatattcagattttag

SEQ ID NO: 118683 - DNA, 729 bp, Artificial Sequence
  Description of Artificial Sequence: Synthetic coding sequence
atgttgttactggccccccaaatgcttagtttgttgctgcttgcccttccagtgctcgcttcgccagcttacgtcgcccctgctccaggacaggccttgcagcagacaggcatcgtgggtggacaggaggccccgcgatcgaaatggccctggcaagtgtctcttagggtacgcggaccgtattggatgcatttctgtggtggatctttgatccatcctcagtgggtgctgacagccgcccactgcgtggagcctgatatcaaggacctcgcggccctgagggtgcagctgagggagcagcatctgtactatcaggatcagttactgccagtgagcagaataatcgtgcacccccagttttatattatccaaacaggtgcagacattgccttgctcgagctggaagagcccgtcaatatatccagccacatccatacagtgacacttccgccagcatctgaaacgttccccccaggcatgccttgctgggtaaccggctggggcgatgtcgataacaacgtccacctacctccaccatatccgttgaaggaggtagaggtcccagtcgtagagaatcacctgtgcaacgccgagtaccatacaggcctgcacacaggccactcgtttcagatagtgagagatgacatgctgtgtgcagggtccgaaaaccacgacagttgccaaggtgattccggcggacccctcgtgtgtaaagtcaatggaacttag

SEQ ID NO: 118684 - DNA, 519 bp, Artificial Sequence
  Description of Artificial Sequence: Synthetic coding sequence
atgttccaacaggtgccaatggtggagatcgacggcatgaagctcgtacagacccgagccattctgaattatattgccagcaagtataacttgtatggtaaggacatcaaggaacgcgccttgattgacatgtacaccgaaggtatggccgacttaaatgagatgatactgctcttaccactatgtcgacctgaagaaaaagatgccaagatcgccctgatcaaagaaaagactaagtcccgatatttccctgccttcgagaaagtgttgcagtctcatggccaggactatctggttggaaacaagctcagccgtgccgatatttctctggtggagctgctctactacgtcgaagagctggatagttctctgatcagtaattttccactgctaaaagctctcaaaacacgaatatccaatctgcctacagtgaaaaagttcttgcagcctggcagccccagaaagccacccgctgatgctaaggccctggaagaagcacgtaagattttccgattctag

SEQ ID NO: 118685 - DNA, 327 bp, Artificial Sequence
  Description of Artificial Sequence: Synthetic coding sequence
atgttccagcaagttcctatggtggaaattgacggaatgaaattggtgcaaaccagggctatcctcaattatatcgcctcaaagtataacctttacggaaaagacatcaaggaacgcgccctaatcgatatgtacactgagggaatggcagatctgaatgagatgatccttctgctgccgctgtgcaggcctgaagagaaggacgctaagatcgcactcataaaggaaaaaacaaaaagtaggtactttcctgcctttgaggccgacatctctctggtggagctgctgtattatgtggaggaactcgactcaagtttgatttcatag

SEQ ID NO: 118686 - DNA, 669 bp, Artificial Sequence
  Description of Artificial Sequence: Synthetic coding sequence
atggccgccaggcccaagttgcattacccaaacggacggggccgcatggagtcggtgcgatgggtgctggccgctgcgggagtcgaatttgacgaagagttcctcgaaacaaaagaacaactgtataagcttcaggacggaaaccacctactgttccaacaggttccaatggtcgagattgacggtatgaaactggtgcagacacggtccatcctgcattatatagccgataagcacaacttgtttggcaagaatctgaaggagaggaccctcattgacatgtacgtggaaggaaccctggacttgttggagctcttgatcatgcacccattccttaaaccggacgaccagcagaaggaagtagtgaacatggcccaaaaggccatcattagatacttcccagtcttcgaaaaaatactgaggggccacgggcagagttttctggtgggcaatcaactgagcctcgccgatgtaatcctcctccagaccatcctggcactcgaagagaagattcccaacattttgtctgcatttcctttcttacaagagtatactgtgaagctatccaacatacccacgatcaaacgtttcctggagcccgggagcaaaaaaaaacctccacctgatgagatatatgtgaggactgtgtacaatatcttccgcccttag

SEQ ID NO: 118687 - DNA, 390 bp, Artificial Sequence
  Description of Artificial Sequence: Synthetic coding sequence
atgtatgtggaaggcaccctggacctgttggagctgctgatcatgcatccttttctcaaacccgatgaccaacagaaagaagttgtgaacatggcccaaaaagccattatccgatacttccctgtgttcgaaaagatacttagagggcacggccagagttttctcgtgggcaaccaattatccctggctgatgtgattctgctgcaaaccatcctggcattggaggaaaagattcccaatatcctgtctgcttttccattcctgcaggaatacacagtgaaactgagcaacatccccaccataaaaaggtttcttgagcctggatctaaaaagaagcctccacccgatgagatttacgtccgcacagtctacaacatttttagaccttag

SEQ ID NO: 118688 - DNA, 669 bp, Artificial Sequence
  Description of Artificial Sequence: Synthetic coding sequence
atggctgcgcgtccaaaactgcattatcccaacggtcgtggccgcatggaatcggttaggtgggtcctggcggccgctggcgtcgagttcgacgaggaattcctggagacaaaagagcagctttacaaactccaggacgggaaccatctcctgttccagcaagtaccaatggtggagattgatggtatgaagctagttcaaacgaggagtatactgcattatattgcagataaacacaacctgttcggaaaaaacctgaaagagagaacgctgattgatatgtatgtggaaggcacattggatttactggagctgctgattatgcatcctttcctgaaacccgatgatcaacagaaggaagtggtgaacatggctcagaaggctatcatccgttacttccctgtcttcgagaagatactcagagggcacggccagtcatttctggtggggaatcaactttccttagctgatgttatcttactccaaaccatattagcattggaagagaagatccctaacattctcagcgcctttcccttcttgcaggagtacactgtaaagctcagcaacatccccaccataaagaggtttctggaaccgggatccaaaaagaaacctccaccggacgaaatctacgtgcgcaccgtgtacaacatctttaggccttag

SEQ ID NO: 118689 - DNA, 270 bp, Artificial Sequence
  Description of Artificial Sequence: Synthetic coding sequence
atgtatgtcgagggcacgctggatctcctcgagcttctaatcatgcacccctttctcaaacccgacgaccagcaaaaggaagtggtgaacatggcacagaaggccatcatcaggtacttcccggtgtttgagaaaattttacggggtcatggccagtcttttcttgtgggaaaccagctgtcgctcgctgatgtgatactgctgcagactatcctggctttggaagaaaaaattccgaacattctgagtgccttcccgttccttcagtag

SEQ ID NO: 118690 - DNA, 390 bp, Artificial Sequence
  Description of Artificial Sequence: Synthetic coding sequence
atgtacgtagaggggaccctggatttgttggagctgctgatcatgcatccctttcttaaacccgatgaccaacagaaggaggtggtcaacatggcacaaaaggctattatacgatatttccctgtcttcgaaaagattctgcgggggcacggccagtcatttttagtcggtaatcagttgagcttggccgatgttatcctgctgcagacaatcttggccttggaggaaaaaattcctaacattctgtccgcttttccgttcttgcaagaatacacagtgaagctgtctaacattcctaccatcaaacggttcttagaacctggcagtaaaaaaaagcctcccccagacgagatttatgttcgaaccgtatacaacattttcaggccctag

SEQ ID NO: 118691 - DNA, 669 bp, Artificial Sequence
  Description of Artificial Sequence: Synthetic coding sequence
atggcagaaaaaccaaaactacactactcaaacgcccgcggatccatggaatctattaggtggctgttggccgcagctggggttgagctggaagagaagtttctggagtccgccgaagatctggacaagctgcgtaatgacggctctcttctcttccagcaagtacctatggttgagatcgatgggatgaagctggtgcagactcgcgctatcctgaactacatagcctccaagtacaacctatatggaaaagacatgaaggaacgcgccctgatagacatgtataccgagggcattgtggatttgacggagatgatcctgttgttgctgatctgccagccagaggaacgggatgccaagacagctcttgtgaaagaaaaaatcaaaaaccgctatttccctgcctttgaaaaagtgttgaagtcgcacagacaggattatctagtcggaaacaagctctcttgggccgacattcacctggtggaactattctactacgtggaggagctggattcatctttgatcagctcttttcctctacttaaggctctgaagaccaggataagcaacctcccaaccgtaaagaaattcctacaaccagggtcccagcgaaagccaccaatggacgagaagtccctcgaagaggcgcggaaaatatttcggttttag

SEQ ID NO: 118692 - DNA, 669 bp, Artificial Sequence
  Description of Artificial Sequence: Synthetic coding sequence
atggcagagaagcccaaactgcattactcaaatgcacggggctcgatggaaagcattcggtggctcttagcagcagccggcgtggaacttgaagagaagttcctggagtcggcggaggacttggacaaactcaggaatgacggcagccttctatttcagcaagtgccaatggtggagattgacgggatgaaacttgtacagacgcgcgccatcctcaattacatcgccagtaaatataacctttacggtaaagatatgaaagaaagggcgctcatagacatgtatactgaagggatcgttgaccttaccgagatgatcctgctgttgctcatttgtcagcctgaggagagggacgccaaaaccgccctcgtaaaagagaagatcaaaaatagatactttcctgcctttgaaaaggttctaaagtctcatcggcaggactacctggtgggcaataagttgtcttgggcggacatccaccttgtggagcttttctattacgtggaagagctcgactcttccctgatctcatcttttcccctcctcaaagccctgaagacaaggatctcgaatctgccgaccgtgaaaaaatttctgcagccgggctctcagaggaaacctcctatggacgaaaagtccctagaagaggcacgtaagatctttaggttctag

SEQ ID NO: 118693 - DNA, 657 bp, Artificial Sequence
  Description of Artificial Sequence: Synthetic coding sequence
atgccaatgatactagggtactgggacatacggggtctagctcacgcaattagacttctactcgagtataccgatagctcatacgaagagaagaagtacaccatgggtgatgcgcctgattacgacagaagtcagtggctgaacgaaaagtttaagctgggtttagattttcccaacctcccttatttgatagatggggctcacaagattacgcagtctaacgccatactgtgttacattgcgcggaaacacaatttatgcggagaaaccgaagaggaaaagattcgtgtagatatcctagagaaccaaaccatggacaatcatatgcagctaggaatgatttgctacaatcccgagttcgaaaagcttaaacccaagtatctggaagaacttcctgaaaaactcaaactgtactcagagtttctcggcaagagaccttggttcgctggcaacaaaatcacgttcgtggactttctggtgtatgacgtgcttgacctccaccggatatttgagccaaagtgcctagacgcattccctaatttaaaagacttcatctcccgctttgaaggtttggagaaaatttccgcgtacatgaagagctccaggttcctcccgaggcctgtcttctccaaaatggcagtgtggggcaacaaatag

SEQ ID NO: 118694 - DNA, 546 bp, Artificial Sequence
  Description of Artificial Sequence: Synthetic coding sequence
atgcctatgatactgggctactgggacataagagggttggcgcacgctatccgcctgcttctcgagtacaccgatagctcttacgaggaaaagaaatatacaatgggcgatgcccccgattacgatcggagccagtggctaaacgaaaagtttaagcttggcctggactttcctaacctgccatatttgatcgacggcgcacataagattacccagagcaatgcaattctgtgctacatcgcccgcaagcacaacctgtgtggtgagaccgaagaagaaaagatcagagtggatatcttagaaaaccagactatggacaatcatatgcagttaggcatgatatgttacaatcccgagttcgaaaaattgaagcccaagtaccttgaagagctgcccgaaaaactgaagttgtacagcgaattcttagggaagcgaccttggtttgccggaaacaaaggccttgaaaagattagcgcatatatgaagtcctctaggtttcttccaaggcccgttttttcaaagatggcagtgtggggaaacaaatag

SEQ ID NO: 118695 - DNA, 450 bp, Artificial Sequence
  Description of Artificial Sequence: Synthetic coding sequence
atgccgatgatcctaggatactgggacatccgcggactggcccatgccattcggctgcttctggagtatactgactcaagctatgaggagaagaagtatactatgggcgatgcccctgattacgatagatctcagtggctgaacgagaagtttaagctgggcctggatttccctaacctgccttacctgatcgacggcgcgcacaagattacccagagcaatgccatcttgtgttacatcgcacgaaagcataatctgtgcggagagacagaagaggagaagatccgggtggatatcttggaaaatcaaactatggataaccatatgcagttaggtatgatctgctacaatcccgagtttggtctcgagaaaatttccgcttatatgaagtctagtcgcttccttccgcgccctgtgttcagtaagatggcagtgtggggtaataaatag

SEQ ID NO: 118696 - DNA, 714 bp, Artificial Sequence
  Description of Artificial Sequence: Synthetic coding sequence
atgccaatgattctcgggtattgggacatccggggccttgctcacgccataaggctgctgctagaatacaccgactctagctatgaggagaagaaatataccatgggcgatgcgccagactatgataggtcacagtggctcaatgagaagttcaaactggggcttgatttcccgaacgggatgctgggcagcctcgtggctcagttatcatttgctggcttcccttccattcagctaccatatctgatcgatggagctcataagatcacacagtccaatgcgatcctatgttatatagcccgtaagcacaacttgtgcggtgaaacggaagaagagaagatccgtgttgatattcttgagaatcagaccatggacaaccatatgcagttggggatgatctgttataatcctgagtttgagaaactcaagccaaagtatctggaggaattgcccgaaaaactaaagctttactccgagttcctcgggaagagaccctggtttgccggaaacaagataacttttgtggactttctcgtctacgacgttctggaccttcataggatatttgaacctaaatgcctggacgcatttccaaatctgaaggattttatctcacgatttgaggggttagagaaaatcagcgcctacatgaaatcaagtcgtttcctgccgagacctgtgttcagtaagatggctgtatggggcaacaaatag

SEQ ID NO: 118697 - DNA, 657 bp, Artificial Sequence
  Description of Artificial Sequence: Synthetic coding sequence
atgcctatgactttggggtactggaacattcgcggcctcgcgcattctattaggctgctgctcgagtacactgactcttcttacgaggagaagaagtacaccatgggcgatgcgcccgactatgatagatcacaatggctaaacgagaaatttaagctggggctagacttccctaacctgccctacttaatcgacggaacccataaaattactcagtccaacgcaatcctaagatacatcgcgaggaagcacaacctgtgcggggagtccgagaaggaacaaattagagaagacatcctggaaaaccagtttatggattccagaatgcagcttgctaaactctgttatgatccagattttgagaaattgaaacccgagtatttacaggctttgccggagatgcttaaactctattctcagttcctgggcaaacagccgtggttcctgggcgacaagatcactttcgtagactttatcgcctacgatgttcttgagcgaaatcaagtctttgagccaagctgccttgatgcctttcccaacctcaaagacttcatcagcaggttcgaaggcttggagaaaatctcggcatacatgaagtcctcccgttttcttcctaggcctgtgttcactaagatggccgtgtgggggaataaatag

SEQ ID NO: 118698 - DNA, 540 bp, Artificial Sequence
  Description of Artificial Sequence: Synthetic coding sequence
atgaccctgggatattggaacatacgtggattggcccactcaatccgacttctgttagagtatactgacagctcgtatgaagaaaaaaaatacacaatgggtgatgcaccagactacgaccgcagccagtggctgaacgagaagtttaaactgggtttggatttccccaacctgccttacctaattgatggtacgcataagatcacacagtctaacgcgatcctaaggtatattgctcggaagcacaacctctgcggagagagcgaaaaggaacagataagggaagatatcctggagaatcagtttatggattcccgcatgcagctggctaagctgtgctatgatccggactttgaaaagcttaaaccagagtatctgcaggcacttccagagatgctaaagctgtattcacagtttctgggcaagcaaccttggttccttggagataaaggactcgagaagatctcagcatacatgaagtcaagtcggtttctgccgcggccggttttcacaaagatggctgtttggggaaacaagtag

SEQ ID NO: 118699 - DNA, 264 bp, Artificial Sequence
  Description of Artificial Sequence: Synthetic coding sequence
atggattcccgcatgcagctggcaaaactttgctatgacccagatttcgaaaaactgaagcctgaatacctacaggctctacctgaaatgttgaaactctactcccagttccttggaaagcagccttggttcctgggcgacaaaataactttcgtggattttatagcctacgacgtgctggaacgcaatcaggtgttcgaaccaagctgtttggatgctttccctaatctcaaggacttcatctctcggttcgaacatagctag

SEQ ID NO: 118700 - DNA, 576 bp, Artificial Sequence
  Description of Artificial Sequence: Synthetic coding sequence
atgccaatgaccctgggatactggaatatacgaggtctggctcacagtatcaggctgctgttagagtacaccgatagcagctatgaggaaaagaaatacacgatgggggacgctccagattacgataggagccagtggctgaatgaaaagttcaagctgggccttgacttccccaatttgccttatctcattgatgggacccacaaaataactcagtctaatgccattttaagatacattgctcgcaaacacaatctgtgcggtgagtccgaaaaagaacaaatacgagaggatatccttgaaaatcagttcatggacagccggatgcagctggcgaaactgtgctacgatcctgacttcgaaaagctgaagcccgaatatttgcaggctctacctgagatgctgaaactttattcgcagttccttgggaagcagccctggtttctgggcgacaaaataacttttgtggacttcatcgcctacgatgtgttggagcgtaaccaggtgtttgaaccgtcatgtttagatgccttcccgaacctgaaagatttcataagtagatttgagcattcctag

SEQ ID NO: 118701 - DNA, 576 bp, Artificial Sequence
  Description of Artificial Sequence: Synthetic coding sequence
atgccaatgactctgggctattggaatatcagagggctagcccacagtattagattacttcttgagtacactgactcgtcttacgaagagaagaaatataccatgggagacgcgcccgattacgataggagtcagtggctcaatgagaagttcaaacttggtttggatttccccaatctgccttacctgatcgatggcacacacaaaatcacccagtccaatgcgatcctgaggtacattgcgcgaaagcacaacctctgtggcgagagcgagaaggaacaaatacgagaggacattctggagaaccagttcatggactctcggatgcagcttgccaaactatgctacgacccagactttgagaaattgaagcccgagtaccttcaagccttgcccgaaatgctcaaactctactcacaattcctgggcaagcagccatggttcctgggagacaagataactttcgtggattttatagcttatgacgttctggagcgcaatcaggtttttgaacccagctgtttggacgcctttcctaatctaaaagacttcatatctcggttcgagcacagctag

SEQ ID NO: 118702 - DNA, 678 bp, Artificial Sequence
  Description of Artificial Sequence: Synthetic coding sequence
atgtcttgcgagtctagcatggtcctggggtactgggacatcaggggcttagcacacgctattagactgctgttagagttcacggacacctcatacgaggagaaacgctacacttgtggcgaggctccagattatgatagatctcagtggctggacgtgaagtttaaattggatctagatttccccaacttgccttacctgctggatggcaagaacaagattacacagtccaatgctatactccggtatattgcccggaagcataatatgtgcggagagactgaagaagagaaaattcgtgtggatattatagaaaaccaggtgatggattttcgtacgcagctgattcgcctgtgttattcttcagaccatgaaaagctgaaacctcagtacctagaggagctgccaggtcagcttaagcaattcagtatgtttcttgggaagttcagttggttcgcaggggaaaagctcactttcgtggattttctgacttacgacatcctggaccaaaataggatcttcgaccctaagtgtctcgatgagtttcccaacttgaaagctttcatgtgccggttcgaggctcttgagaaaatcgcggcctacttgcagagtgaccagttttgtaagatgcccatcaacaacaagatggctcagtggggcaataagcccgtttgttag

SEQ ID NO: 118703 - DNA, 678 bp, Artificial Sequence
  Description of Artificial Sequence: Synthetic coding sequence
atgtcttgtgagtcttctatggtgctcggctattgggatatcagggggctggcccacgcgatcaggctcctcttagagtttacggacacctcatatgaggagaaaaggtacacatgtggagaggcccctgactatgaccgcagccaatggcttgatgttaagtttaaactagatctggactttccgaatctaccttatttgttggacggaaagaataagatcacgcagtctaatgcaatcctcagatatattgccaggaagcacaatatgtgtggcgagaccgaggaggagaaaatccgggttgacatcattgagaatcaagtgatggactttcgcacgcagctgatccgcctttgctacagcagtgaccacgaaaagctaaagccccagtacttggaggagctgcctggccagctgaagcagtttagcatgttcctgggcaagttcagttggttcgccggggaaaaactgacattcgtagacttcctgacctacgatattctggaccagaatcgaatttttgatcccaaatgcctggacgagttccccaatcttaaagcattcatgtgtagattcgaggctcttgaaaaaattgctgcatatctgcagtctgaccagttctgcaagatgcctatcaacaacaaaatggcacagtgggggaataaacctgtctgctag

SEQ ID NO: 118704 - DNA, 678 bp, Artificial Sequence
  Description of Artificial Sequence: Synthetic coding sequence
atgagttgtgaatcttccatggtgttaggctactgggatattcgaggactggcccatgccattcgattgctgcttgagttcaccgatacatcgtatgaggaaaaaagatatacatgtggcgaggcgcctgattacgatcgttcccaatggctggatgtgaagtttaaattggatttggacttccccaacctgccctacctcctcgatggcaaaaacaagatcacacagtcaaacgcaattttgcggtatattgctaggaagcataacatgtgcggggagacggaagaagaaaagatcagggtcgatatcattgaaaatcaagtaatggactttagaacgcaactcattaggctctgctactcttccgaccatgaaaagctgaagccccagtacctcgaggagctgcccggccaactgaaacaattctcaatgtttttgggcaagttttcatggtttgcgggcgagaagttgactttcgtagattttctcacatacgatattctcgatcagaatcgtatttttgaccccaagtgtctggacgagtttccaaacctgaaagcattcatgtgcaggttcgaggccctggagaagatcgcagcctacctgcagagtgatcagttctgtaaaatgccaatcaacaataagatggcccagtgggggaataagcccgtctgttag

SEQ ID NO: 118705 - DNA, 588 bp, Artificial Sequence
  Description of Artificial Sequence: Synthetic coding sequence
atgagcatgacactcggatactgggatatccgcggcctcgcacacgccataagactgttgctggagtacacagacagcagctacgaggagaaaaaatatactatgggtgatgcgccagattatgacagaagccagtggctgaacgaaaaatttaagctaggcctcgacttccccaatctgccatatctcattgacggcgcccacaaaatcacacagtctaacgctattctgtgttacatcgcacgaaagcacaatctatgcggggagacggaggaagagaaaatccgcgtggacatccttgaaaatcaagccatggatgtttctaatcagttggcccgcgtctgctatagccccgacttcgaaaagctaaagcccgagtatctggaagaactgcctaccatgatgcaacacttctctcaatttcttgggaagaggccatggttcgtgggagacaagatcacttttgtggatttcctcgcatatgacgttttagatttgcaccggatatttgagcctaactgcttagacgcctttcctaacctgaaggacttcatctctagattcgaagtaagttgcggcataatgtag

SEQ ID NO: 118706 - DNA, 474 bp, Artificial Sequence
  Description of Artificial Sequence: Synthetic coding sequence
atgagtatgaccctgggatactgggacattcgtgggctcgcccacgctataagattgctgttagaatacaccgatagttcatatgaggaaaagaaatacaccatgggcgatgcccctgactatgacaggagccagtggctgaatgaaaaatttaagttggggctggattttcccaatgagaagctgaagcctgagtacctggaggagcttcccacaatgatgcagcacttttctcagtttctgggcaagcggccatggttcgtcggagacaagatcacattcgtggactttctggcctacgacgtcttagacttgcaccgcatttttgaacctaactgtctcgacgcattccctaatttaaaagattttatctctcgatttgaagggctggagaagattagtgcatatatgaaatctagcagatttcttcccaagcctctctatactcgggtggctgtgtggggaaacaaatag

SEQ ID NO: 118707 - DNA, 609 bp, Artificial Sequence
  Description of Artificial Sequence: Synthetic coding sequence
atgctaggtagccttttggcccaattgtctttcccaggatttccgtccattcagctgccttatctcatcgatggcgcccacaagatcacacagtctaatgccatactttgttacattgcccggaaacataacctatgtggtgagactgaggaggagaagatcagggtggacatcctcgagaaccaggcgatggacgtttctaatcaactagctcgcgtgtgttacagcccagatttcgagaagctcaaacccgagtaccttgaagaacttcctacaatgatgcagcatttctctcagtttctggggaagcggccatggttcgtgggggataagatcacgtttgttgacttcctggcttacgacgttctagatctccaccggatttttgagcctaattgcctcgatgcctttcccaatttgaaggacttcatatcgcgctttgaggtcatgcccccctcttcgttcctcttcgacgcaccatgttccgtcacctcctttcagatgctgagccaatcctggagctacataaagaataatctgcacttgctcagcgcaggatttatgcctggtaccttgcctagtacactgtacctgtcctgtggcatttag

SEQ ID NO: 118708 - DNA, 657 bp, Artificial Sequence
  Description of Artificial Sequence: Synthetic coding sequence
atgtcaatgactctgggctactgggatatccgcggactcgcacacgcaatcagactcctgcttgagtataccgatagctcttacgaagagaaaaagtatacaatgggagacgccccggactatgatcgcagccaatggctcaatgagaaattcaagctggggttggatttccccaatcttccgtatctgatagacggcgctcataaaatcactcaaagcaacgccattttgtgttacattgcccgaaaacataatttgtgtggcgagacagaggaagagaagatcagagtggatatactggaaaatcaagcgatggatgtgagcaatcagttagctagagtttgttactctcctgactttgagaagctgaagcctgagtacctggaggagttacctacgatgatgcagcacttcagccagttcttaggaaagcggccgtggttcgtgggggacaagataactttcgtcgatttcttggcgtacgacgttcttgatttgcaccggatcttcgaaccgaactgtctggatgcctttcctaacttgaaagatttcatttcccggtttgaagggctcgagaaaatctccgcatacatgaaaagttcccggttcctgcccaaacccctctacacgcgagtggcggtctggggcaacaagtag

SEQ ID NO: 118709 - DNA, 657 bp, Artificial Sequence
  Description of Artificial Sequence: Synthetic coding sequence
atgccaatgacactcggctactgggacatccgcggcctggcccatgctattcgcctcttgctggaatatacagactcttcttatgtggagaagaaatataccttaggggatgcacctgattacgatagaagccagtggctcaacgagaagttcaaactcgggctcgatttccccaatctgccctacttgattgatggcgctcataaaattactcaatcgaatgcaattctcaggtacattgctaggaagcacaacctctgtggagagaccgaggaggagaaaatacgagtcgacatccttgagaatcaagtcatggacaatcacatggagctggtaaggttgtgttatgatccagattttgagaaattaaagccgaaatatctcgaggaattgccggagaaactgaaattatatagcgagttcctgggcaagagaccttggtttgcgggggacaagatcactttcgtggacttccttgcctacgacgtactcgacatgaagaggatctttgagcccaagtgtctggacgcatttctgaatctcaaggacttcatttcacgatttgaaggcctaaagaagatctctgcatacatgaagtcctcgcagtttctacgtgggctgctgttcgggaagtccgctacctggaattcaaagtag

SEQ ID NO: 118710 - DNA, 714 bp, Artificial Sequence
  Description of Artificial Sequence: Synthetic coding sequence
atgccgatgaccctggggtattgggacataaggggcctcgcacacgccattcggctactgctggaatacaccgactcttcctacgtggaaaagaaatacacgctgggcgatgccccagactatgatcgatcccagtggctgaacgagaagttcaagcttgggctggattttcctaatgggatgctgggaagtcttgtggcgcagctttcatttccgggatttccgtccattcagctcccttatctcattgatggagcgcataaaattacccaatctaacgcaatactgcgttatatcgcccgtaagcataatctgtgtggagaaaccgaagaagaaaagattcgggtggatatcctggagaatcaagtgatggataaccacatggagttggtgcgcctgtgctatgacccggattttgagaagctcaaacccaagtacctggaagagctgccagaaaaactgaagctctactctgagtttctggggaagcggccctggttcgccggggataagataacctttgttgatttcctcgcatatgacgtgctcgacatgaaaaggatcttcgagcccaaatgcctcgatgcgttcttgaacctgaaggactttatatcaaggttcgaagggctgaagaagatttcagcgtatatgaaaagcagccagttcctccgtggactactgttcggaaagtccgccacatggaacagcaagtag

SEQ ID NO: 118711 - DNA, 609 bp, Artificial Sequence
  Description of Artificial Sequence: Synthetic coding sequence
atgctcgggtccctagtggcccagctctccttccccggtttcccctcaattcagctgccctatctgattgatggagcccacaaaataactcagagcaacgctatactgaggtacatcgcccgcaaacacaatttatgcggcgagaccgaagaggagaaaattagagtagacattctagaaaaccaagtgatggacaatcatatggagttggtgcgcctgtgctatgacccagactttgaaaaactgaagccaaagtatttggaagaattacccgagaagctgaaactgtatagcgagttcctggggaagagaccgtggtttgcgggggataagataacgtttgtggattttctggcctatgatgtcttagatatgaagagaatttttgaacccaaatgccttgacgccttcctgaatctcaaagatttcatatctaggttcgaggtcatgccacccagttctttcttgttcgatgcaccgtgttcctttctatccttccagatgctgagtcagtcctggtcctatactaaaaataattcctacgtgctgagtaccggctttatgccaggaatcatgccgtctactctgtacctgagctgcagaatttag

SEQ ID NO: 118712 - DNA, 627 bp, Artificial Sequence
  Description of Artificial Sequence: Synthetic coding sequence
atgtcaggggaatccgccaggtcacttggtaaggggtcggctcctccaggcccagtcccagagggatctattagaatctactccatgcggttttgcccgttcgccgagcgaacgagacttgtgctgaaagcaaaggggataaggcatgaagtcatcaatattaacctcaagaataagccagagtggttcttcaagaagaatccttttggactcgttccagtgctggagaatagtcagggacagctgatctacgagagtgctataacctgcgaatacctggacgaggcttacccgggaaaaaagctgctcccggatgacccttatgaaaaggcctgccagaaaatgatcctcgagctctttagtaaggtgctgaccaataaaaagacaaccttcttcggaggcaattcaatatctatgatcgactatcttatatggccttggtttgagcggctggaagccatgaagctgaatgaatgcgtggaccatacccctaaactgaagctttggatggctgccatgaaggaagatcctacagtgtctgctctactgacttctgaaaaggattggcagggatttctggagttgtatcttcagaattctccggaggcatgcgattacggcttgtag

SEQ ID NO: 118713 - DNA, 726 bp, Artificial Sequence
  Description of Artificial Sequence: Synthetic coding sequence
atgtcaggggagtccgccagaagcctcggcaaggggtcagctccgcctggacccgtgccggagggaagtattcggatatacagtatgagattctgtcccttcgcggaacgaactcggctggtgctcaaggcgaaggggatacggcacgaagtaatcaatatcaacctgaagaacaagcccgaatggttttttaagaaaaacccttttggcctggtgcctgtcctggagaactctcagggccagctaatatacgagagcgcgatcacctgtgagtaccttgacgaagcctaccccgggaaaaagctgctccctgacgacccgtacgaaaaggcatgtcagaagatgatcctggaactgttctcaaaggtaccatctttggtggggtcattcattaggtctcagaacaaagaagactatgctggcttgaaggaggagttccgcaaagagttcactaaacttgaagaggtgctaacaaataagaagactacattttttggaggtaatagtatctccatgatcgactatctcatttggccctggtttgagcggttagaggccatgaagttaaacgaatgtgttgaccacacccccaagcttaaattgtggatggcagccatgaaagaagacccaaccgtgagcgcattgcttaccagcgagaaggattggcaaggcttcctcgaactgtacctccaaaactctcctgaggcctgcgattacggactgtag

SEQ ID NO: 118714 - DNA, 543 bp, Artificial Sequence
  Description of Artificial Sequence: Synthetic coding sequence
atgagattctgtccttttgccgagagaaccaggctggtgcttaaggcaaagggcattcggcacgaggtcatcaatattaacctcaagaacaaaccagaatggttctttaagaagaaccctttcggcctcgtgcctgtgttggaaaacagccaagggcagctgatttacgaaagtgccattacgtgtgagtatctggacgaggcttaccctggcaaaaaactcttgccagacgatccctatgagaaagcttgccagaagatgattcttgaactgttctccaaggtactcaccaataagaaaacaaccttttttgggggaaatagtattagcatgatagattacctcatttggccttggtttgaaaggctcgaggccatgaagcttaacgagtgtgtggaccacacgcccaagctgaagctctggatggctgcgatgaaggaagatccaacagttagcgctttgcttacttctgagaaagattggcagggattcctagaattgtacctgcagaattcaccagaggcttgcgattatggcctgtag

SEQ ID NO: 118715 - DNA, 603 bp, Artificial Sequence
  Description of Artificial Sequence: Synthetic coding sequence
atgaggttctgtcccttcgcagaacgtacccggctggttctgaaagcaaaagggatccggcacgaggttatcaatatcaatctgaagaacaagcccgagtggttttttaaaaagaacccattcggacttgtacccgtcttggaaaattctcaagggcagcttatttatgaaagcgccatcacttgtgagtatttagatgaggcgtacccgggtaagaaactccttcccgacgatccatatgaaaaagcttgtcaaaaaatgatcctcgagctgttcagcaaggtgccgtctctcgtcggctcttttattagatcccaaaacaaggaagactatgctggactcaaggaggaattcagaaaagagttcaccaagctagaagaagtcctgacaaataagaagacaacctttttcggagggaacagcatttctatgatagattatcttatttggccctggttcgaacgtctcgaggccatgaagctgaatgaatgtgtggatcacacccccaagcttaagctatggatggctgccatgaaagaggatcctacagtgtcggctctcctgacatcggagaaagattggcaagggtttttagagctgtag

SEQ ID NO: 118716 - DNA, 642 bp, Artificial Sequence
  Description of Artificial Sequence: Synthetic coding sequence
atgcggttttgccctttcgccgagcgcacccggctcgtgctaaaggccaaagggatccgtcacgaggttatcaacattaacctaaagaataaacctgagtggtttttcaaaaagaaccctttcggccttgtccccgtattggaaaacagccagggccagctcatctatgagtctgccatcacttgcgagtacctcgacgaagcatacccagggaaaaaactgctgccggatgacccatacgagaaagcttgccaaaagatgattttagaactattctctaaagtcccctcactcgttgggagctttatacggagccaaaacaaagaggattatgcaggcctcaaagaagaatttcgtaaggagttcactaaactggaagaggtgctcacaaacaagaagacaaccttcttcggtggaaacagcatctctatgattgattacctgatatggccctggttcgaaagactcgaagctatgaagttgaacgaatgcgttgatcacacaccaaaactgaagctctggatggccgcgatgaaagaagatcctacggtctcagcattgctgacttccgagaaagattggcaaggatttctggaattatatctccagaattctccagaggcctgtgactatggactatag

SEQ ID NO: 118717 - DNA, 732 bp, Artificial Sequence
  Description of Artificial Sequence: Synthetic coding sequence
atgagtggcgacgctacaaggacccttggcaaaggtagccaacctcctggtcccgtacccgaaggcctgattagaatttattcgatgaggttttgtccttatagtcacagaaccagacttgttctgaaagctaaagatatcagacatgaagtagttaacattaatctgagaaacaaaccagagtggtattatacgaagcacccatttggccacattccagtcctggaaacttcccagtgccagctcatctatgagtccgtgatagcatgcgaatatctagacgatgcctatccgggtcgaaagctttttccttatgacccttatgagcgggcacgccagaaaatgctgcttgagctgttttgcaaggtgccacacctcacaaaagaatgtctggtagctttgcgatgtggaagagagtgtacaaacctgaaagccgcattacggcaagagttttcgaaccttgaggaaatcctcgaataccaaaatactactttcttcggaggaacatgcatctccatgatcgattatttgctatggccatggtttgagcggctcgacgtttatggcattttggactgtgtgagccatacgcctgccctgcggctgtggatttctgcaatgaagtgggatccaaccgtttgtgcactgttgatggacaaaagcatcttccaaggttttttaaatctttacttccagaacaaccccaacgcatttgactttggactgtgttag

SEQ ID NO: 118718 - DNA, 648 bp, Artificial Sequence
  Description of Artificial Sequence: Synthetic coding sequence
atgcgcttttgcccgtatagtcacagaactagacttgtgctcaaagcgaaagacattcgacacgaagtcgtgaacataaatctccgtaacaagccagagtggtactacaccaagcatccatttgggcacattccggtgttagaaacctcccagtgtcagttaatctacgagagtgtaatcgcatgcgagtatttggatgatgcatatccgggccgtaagctctttccatacgatccttacgagcgagccagacaaaagatgctgctcgagcttttctgcaaagtgccccacctgacgaaagaatgcctggtggcattgcgttgtgggcgggagtgcactaacctgaaggccgccctgagacaggagttctccaacctagaagagattttagagtatcagaatactaccttcttcggcgggacctgcatctcaatgatcgactacttattatggccttggttcgagcgacttgacgtctacggaatcctggactgtgtgtctcatacccccgccctgcgcctatggatatccgcgatgaaatgggatccaacagtgtgcgcactcctgatggataaatctatattccagggatttttgaatttgtacttccagaataatcctaacgcttttgacttcggcctttgctag

SEQ ID NO: 118719 - DNA, 732 bp, Artificial Sequence
  Description of Artificial Sequence: Synthetic coding sequence
atgagcggcgatgctaccaggacactgggaaagggtagccagcctcccggaccggtgcccgagggccttatccgaatctatagtatgagattttgcccctactcccacaggacccgcctggtccttaaagctaaggacattcgtcacgaggtcgtgaatatcaatcttcgaaataagcctgagtggtactacaccaaacatccatttggacacattcctgtgcttgagacaagtcaatgtcaactgatctacgagtctgtcatcgcttgcgaatatttggacgacgcataccctggcagaaaactatttccgtacgacccatatgaaagggctcggcaaaaaatgctcttggagctattttgtaaagtcccacacctgaccaaagaatgtctggttgccttgagatgcggccgggagtgtacgaaccttaaagccgccctacgccaggagttctcgaaccttgaagaaatcttggagtatcagaacactaccttttttggggggacttgcatttctatgatcgactacctgttgtggccctggtttgagcgcctggatgtttacggaattcttgattgtgtgtctcacactccggccctgcgtctctggatcagcgcgatgaagtgggaccccactgtttgcgctctcctgatggataagtccatcttccagggctttctcaacctgtacttccaaaacaacccaaatgcgttcgattttggcctctgctag

SEQ ID NO: 118720 - DNA, 501 bp, Artificial Sequence
  Description of Artificial Sequence: Synthetic coding sequence
atgagtggcgacgctactaggaccctgggcaagggcagtcaaccacccggcccagtgcctgagggcttgatccggatctattcgatgcgattctgcccctattcacataggacacgcttggtcctcaaagccaaggacatacgtcacgaagttgtgaacataaacctcaggaataagccagagtggtactatactaagcacccatttggacatatacccgtgctggagaccagtcaatgccagctcatttatgagagtgttattgcctgtgaatatcttgacgacgcgtaccctggaaggaagctattcccatatgacccctatgaacgcgcccgtcagaaaatgctgctggaactgttctgcaaggttccacacctaacaaaggaatgtttggtcgcgcttcgatgcgggagagaatgtaccaatctgaaggctgcactccggcaggaattctccaatctagaggaagataggaagaagagaaagttcatacccggatag

SEQ ID NO: 118721 - DNA, 366 bp, Artificial Sequence
  Description of Artificial Sequence: Synthetic coding sequence
atgcggttttgtccatactcccatagaacccgccttgtacttaaggccaaagatatccggcatgaggttgtgaatattaacctgcgtaacaaaccagagtggtactatactaagcatccatttggtcacatcccagttcttgaaacctctcagtgtcaactcatttatgagagcgtgatcgcctgtgagtatctagacgatgcttaccctggtaggaagctgtttccttacgatccctacgaaagagcccggcaaaagatgctgctggaactgttttgcaaattgtgcgaaccacacgcgagccctgccgctctggatattagccacgaagttgggccccacagtctctgcagctcacatggctag

SEQ ID NO: 118722 - DNA, 630 bp, Artificial Sequence
  Description of Artificial Sequence: Synthetic coding sequence
atgtctggcgatgcaactagaacactgggtaagggatcccagccccccgggccggtgcctgagggattaattcgtatctattcaatgaggttctgtccctatagtcaccgaactagattggtcctgaaagccaaagatattaggcacgaggtagtgaatataaacttgcgaaataagccagagtggtattatacaaaacacccttttggacacatacctgtcctggagaccagccagtgtcagttgatctacgaaagtgtaatcgcctgtgagtatctcgacgatgcttacccgggaaggaaactgtttccctacgacccctacgagagagctaggcagaaaatgctccttgagctgttctgcaaaatcctggaatatcagaatacaacattctttggcgggacctgcatctccatgattgattatttgctgtggccatggttcgagcggctggacgtatacggaatactggattgcgtatctcacactcctgccctaaggctgtggattagcgccatgaaatgggatccaaccgtctgcgcccttctgatggacaagtcaattttccaggggtttcttaatttgtactttcaaaacaatccaaatgcctttgattttggcctttgctag

SEQ ID NO: 118723 - DNA, 723 bp, Artificial Sequence
  Description of Artificial Sequence: Synthetic coding sequence
atgggcctggaactgtacctcgaccttctgtcacagccgtgccgggccgtttacatctttgccaagaaaaatgacatcccatttgagctgcgaatcgttgacctaataaaaggccaacacctgtctgacgcgttcgctcaggtcaatccgctgaaaaaagtgccagcattaaaggatggagactttacattaactgaatccgtggcaatactactttaccttaccagaaagtacaaggttcctgactattggtacccccaagatcttcaggcccgggcacgcgtcgacgaatacctggcctggcaacatactacattacgccgcagctgcctccgagccctgtggcacaaagtgatgtttccggtcttcttgggggagcccgttagcccacagacactcgcagccactctcgccgagctcgacgtcacactgcagctcctggaagacaagtttttgcaaaataaggcctttctcaccgggccccacatttctctggccgacctggtggccattaccgaactcatgcaccccgtgggggctggctgccaagtgttcgaaggtcgcccgaagctggccacttggaggcaaagagtagaggccgccgtaggcgaggacctatttcaagaagcccatgaggttatcttgaaggctaaagatttcccccctgctgatcccaccataaagcagaaactgatgccctgggtcttggccatgattcggtag

SEQ ID NO: 118724 - DNA, 486 bp, Artificial Sequence
  Description of Artificial Sequence: Synthetic coding sequence
atgggacttgagctgtacctggatcttttatcacaaccctgcagagccgtgtacatcttcgccaagaaaaacgacatccctttcgagcttcgcatagttgacctcatcaagggcgtgatgttccctgtgtttcttggagagcctgttagcccacagactttagccgcaaccttggctgagctggatgtcaccctccaactgctggaagacaaattcctgcaaaataaggcctttttaactggaccccacatctcgcttgcagacttagtcgctataactgagttaatgcacccagtcggggccggttgccaggtgtttgagggccggcccaagctagcgacgtggcgacagcgggtcgaagctgcggttggtgaagatctgtttcaagaggctcacgaagtaattctgaaggcgaaagacttcccaccagctgatcctacaatcaagcagaagcttatgccctgggtgttggcaatgattcggtag

SEQ ID NO: 118725 - DNA, 369 bp, Artificial Sequence
  Description of Artificial Sequence: Synthetic coding sequence
atgttcccagtgttcctgggggagcctgtcagtccacagaccctggcagccacactggcagagttagacgtgaccttgcagctgctagaagacaagttcctgcagaataaggcctttctaacgggtccacatatttcacttgctgatctcgtcgctatcacagagcttatgcatcccgtgggcgccggatgtcaagtcttcgaaggcaggcctaagctcgccacgtggagacagcgcgtagaagcggccgtgggagaagatttattccaagaagcccatgaagtaattctgaaggctaaagactttccacccgcagatcccacaatcaagcaaaaactgatgccgtgggtgcttgctatgattcggtag

SEQ ID NO: 118726 - DNA, 198 bp, Artificial Sequence
  Description of Artificial Sequence: Synthetic coding sequence
atgggcctcgaactctacctggatctgttgtcgcagccctgcagggccgtttatattttcgccaagaaaaacgacatcccatttgagctccggattgtcgacctcattaagggtcaacacctgagtgacgccttcgctcaagtcaatcccctgaaaaaggtgccggccctgaaggatggtgatttcacacttacatag

SEQ ID NO: 118727 - DNA, 219 bp, Artificial Sequence
  Description of Artificial Sequence: Synthetic coding sequence
atggggctggagctttatctagatctgttgagccagccttgtagagcggtgtacatctttgccaaaaaaaatgatattcccttcgagcttaggattgtcgacctcatcaaggcccgagggtgttggcttccttctttaaggcgtcccacccaggccgggcacatggcagctgcgcgagggggttcgtctggaggaggaccactgccgggtgggccctag

SEQ ID NO: 118728 - DNA, 405 bp, Artificial Sequence
  Description of Artificial Sequence: Synthetic coding sequence
atgccctttctcgagttagacaccaatctcccagccaatcgcgtgcctgccggcctggaaaagagactatgcgctgccgcagcctctattctgggcaaacctgccgatcgcgtgaacgtgacagttagaccggggctggcaatggccttgagcggcagtacagagccttgtgcccagttatccatttcctctatcggcgttgtcggcactgccgaggataaccggtcccattctgcccacttcttcgagttcctgaccaaggagctggcactgggccaggacaggtttccaactgtcctgtccacttcccccgcagctcacggcggccctagatgtcctggagagattatagaagggaagaagtcatgcttaaatgaagaagctttgttcatctactttatctag

SEQ ID NO: 118729 - DNA, 831 bp, Artificial Sequence
  Description of Artificial Sequence: Synthetic coding sequence
atgcccgtgcctgcctcatggccacaccctcccggccctttcctgctccttaccctgctcctgggcttaaccgaagtcgctggcgaagaggagctacagatgatccagcctgagaagctgcttttggtgaccgtgggaaaaaccgccacactgcactgtacagtgacctccctgttgccagtagggcccgtcttgtggttcagaggcgtcggaccggggagagagctcatctacaaccagaaagaaggtcacttccctagagtgactaccgtctcagacctcaccaagaggaataacatggactttagcatacggatcagcagtatcaccccagctgacgtcggaacctattattgcgtgaaattcaggaagggctctcctgaaaatgtggagttcaagtctggtcctggcacggaaatggctctcggcgctaagcccagtgcccccgtcgtcttagggccagcggcccggacaacaccggaacacacagtgagctttacttgcgagagccatggttttagtcccagggacatcactctgaagtggttcaaaaatggaaacgagctatccgactttcagaccaacgtggatcctaccggccagagcgtcgcctatagcatccgatctaccgctagggttgtgctagacccttgggacgtccggtctcaggtgatctgcgaggttgcacacgtgacactgcagggtgatcctttacgaggaacggcaaatctgtcagaggccatccgcggccctgcctcttccttgacagctctgctgctcattgccgtcctcctgggcccaatttacgttccctggaagcagaaaacctag

SEQ ID NO: 118730 - DNA, 1092 bp, Artificial Sequence
  Description of Artificial Sequence: Synthetic coding sequence
atggcgacgaattggggatctctcctacaggataagcagcagctggaggagcttgcgcggcaggcagtggacagagctttagcagagggtgtgcttctgcgaacttctcaggagccgacgagtagtgaagttgtgagctatgcgccttttaccctgttcccttctttggttccatccgcactgctggaacaggcatatgctgtacaaatggactttaatttgctcgtggatgcagtttcacagaacgcagcctttctggaacagacactgtcgagtgccctcgtcctgctaatagctcaggagaaagaacgaaacatctttgatcagagggctatcgaaaatgagttgctggctaggaacattcacgtgatccggaggactttcgaggatatctctgaaaaggggtccttagaccaggataggaggctgtttgtggacggacaggaaatcgcagtcgtgtactttagagatgggtacatgccccgtcagtactcactccagaattgggaagcccggttacttttggagagatctcacgccgccaagtgccctgacatcgctacccagttagccggcaccaaaaaagtgcagcaagagctcagccgccccggcatgctggaaatgctgttgccggggcagccggaggccgtagcccggctgcgggcaacttttgcaggactgtatagcttggacgttggcgaggaaggcgaccaggccatagccgaggcactcgccgcgccctcaagattcgttctgaagccacagagagaaggggggggtaacaacctatatggtgaggagatggtgcaggccttgaagcaattgaaagatagcgaggagcgcgcctcgtatatccttatggagaagatcgagccagaaccctttgagaattgcctcctgcgtccaggcagcccagcccgggttgtgcagtgcatttccgaattgggaatttttggtgtttacgtcagacaggagaaaaccctggtcatgaataaacacgtcggccacttattgcgaactaaagccattgagcacgctgatgggggtgttgcagccggagtggctgtgctcgataatccataccccgtctag

SEQ ID NO: 118731 - DNA, 1041 bp, Artificial Sequence
  Description of Artificial Sequence: Synthetic coding sequence
atgttccagaggagtgctgacgggtcccccgcgttgaagcagatcgaaatcaacacaatctcggcaagcttcggtgggctggcctcgcgcaccccagccgttcaccgacacgtgttgtcggtactctcgaaaacgaaagaggctgggaagattttgtccaataacccttccaagggattggctctaggcatcgccaaggcatgggagttatacggttctcctaacgctctcgtgttactcatagcccaggagaaagaacggaatatttttgaccagcgggccatagagaacgagcttctggcaaggaacattcatgttattcgtcgtacattcgaggacattagcgagaaaggcagcctggatcaggacaggagattgttcgtcgacggccaggagatcgcagttgtctactttcgggacggatacatgcccagacaatacagcctgcagaactgggaagctcgactactattggagaggagccacgctgccaagtgtcccgatatagctacccagctggcaggcaccaagaaagtgcagcaggagctgagcagacccggcatgctggagatgcttctgcccggccagcccgaggccgtagccagactcagggccacttttgcagggttatatagcttggacgttggggaagagggggatcaggctatcgctgaagccctggcagccccctcccgctttgtgctgaagcctcagagagaaggcggcgggaataatctctacggcgaggaaatggtccaggcacttaagcagttgaaggattctgaagaaagagcatcatatattctgatggagaaaatcgaacccgaaccgttcgagaattgtttgctacggccaggcagtcccgcgcgggtggtgcaatgcatctctgaactggggatatttggcgtgtatgtgcggcaggagaaaaccctggttatgaacaaacacgtggggcacctcctaagaactaaggcgattgagcatgctgatgggggagttgcggcaggtgtagccgttctcgacaacccatatcctgtgtag

SEQ ID NO: 118732 - DNA, 768 bp, Artificial Sequence
  Description of Artificial Sequence: Synthetic coding sequence
atgtcttctatcggcaccgggtatgatttaagtgcttccaccttcagccctgacggacgagtttttcaggtggaatacgccatgaaggccgtggagaactcttccacagccatcggcattcgctgtaaggacggcgtggtattcggcgttgaaaaacttgtcttgtccaagttatacgaggagggaagcaacaaacggctttttaacgtggaccgccacgtcggcatggcggtggccggactcttggccgacgcacgcagtctggccgacatagcccgcgaagaagcatctaattttagaagcaatttcggatataacatcccactcaaacacctggcggaccgagtggcaatgtacgtccacgcgtatacgctgtattctgccgttaggcctttcggatgttctttcatgttaggatcgtatagcgtgaatgatggcgcgcagctttacatgatagatccatctggtgtttcttatgggtactggggttgtgccatcggcaaagccaggcaggcagcaaagacggagatcgagaagctgcagatgaaggaaatgacttgccgcgatatcgttaaagaagttgccaagatcatctacattgtccacgacgaagtcaaagacaaagcctttgaactggaactgtcatgggtgggggagctcaccaatggtagacacgagatagtgccgaaggacatccgcgaggaggcggagaagtatgctaaagaatctctgaaagaggaggatgaatcagatgacgacaacatgtag

SEQ ID NO: 118733 - DNA, 525 bp, Artificial Sequence
  Description of Artificial Sequence: Synthetic coding sequence
atgcaggcaggaaagccaatactttattcatactttcggtccagctgtagttggagggttaggatagccctggctctgaagggtattgactatgagacggtgcctattaatctgataaaggacgggggccagcagttctccaaagacttccaggccttaaatccgatgaaacaagttcctaccttgaagatcgacgggattaccattcaccagagcaatctgagcgtgctgaaacaggtgggcgaggagatgcaactgacgtgggcccagaatgctattacatgtgggttcaacgccctggagcagatcctgcagtcaacggctgggatctactgcgtgggggacgaagtcaccatggctgatctgtgtctcgtcccacaggtggccaatgctgaacgatttaaggttgacctgactccctatccaaccatatcatcaatcaataaacgcctcctggtattagaggcgttccaggtgtcacacccttgcagacagccagacacccccacggagcttcgcgcgtag

SEQ ID NO: 118734 - DNA, 486 bp, Artificial Sequence
  Description of Artificial Sequence: Synthetic coding sequence
atgaagcaagtccccacgctaaaaatcgatgggattaccatccaccagtccctggccatcatcgagtacttggaggaaatgagacccacgcctaggttgcttcctcaggaccccaagaaaagggcttctgtccgcatgatcagtgatctgatcgcaggaggtattcagcctctacagaatctttctgtcctgaaacaagtgggcgaggagatgcagttgacctgggcccagaatgctatcacctgcgggttcaatgctttagagcagattctgcaatctacagctggaatctactgcgtcggggatgaagtcacaatggctgacctctgccttgtgccccaggtcgccaatgccgagcgttttaaagtggacttgaccccctaccccaccatctcctccatcaataaacgcctcctcgtgctggaggcctttcaggtcagtcacccttgccgacagcccgacacaccgaccgaactccgggcctag

SEQ ID NO: 118735 - DNA, 486 bp, Artificial Sequence
  Description of Artificial Sequence: Synthetic coding sequence
atgaagcaggtgccgaccctgaaaattgacggaatcaccattcatcagagtctggccattattgagtacctcgaggagatgaggcctacacccaggctcctgccacaagatccaaaaaagagggcttccgtacgcatgatctcagatcttatcgccggcggcatccaaccactgcagaacctgtctgtactgaagcaggtaggcgaggagatgcagctgacatgggcccagaacgcgattacgtgtgggtttaacgccctggagcagattttgcagtctaccgctggcatttactgcgttggagacgaggttaccatggccgatctgtgcctggtgccacaggtggcaaacgctgagcgcttcaaagtggatcttacaccttaccccactatatcttccattaacaaaagactattagttctcgaggcctttcaggtgagtcacccatgcaggcagcctgatacacccacggagctccgagcctag

SEQ ID NO: 118736 - DNA, 180 bp, Artificial Sequence
  Description of Artificial Sequence: Synthetic coding sequence
atgaagcaagttccaaccctgaagatagacggtatcactattcaccaatccctggccatcatagaatacctcgaagagatgaggcctacccccagattgctgcctcaagatcctaagaagcgggcctctgtaagaatgatttccgatctcatcgcaggagggatacagccccttcagtag

SEQ ID NO: 118737 - DNA, 117 bp, Artificial Sequence
  Description of Artificial Sequence: Synthetic coding sequence
atgaaacaagtcccgacactcaaaatcgacggcattaccattcaccagtcgctcgcaatcattgaataccttgaggagatgcgccccaccccgagactactgccacaggacccttag

SEQ ID NO: 118738 - DNA, 486 bp, Artificial Sequence
  Description of Artificial Sequence: Synthetic coding sequence
atgaaacaggtgcccaccctgaagatagacggcatcacaatccatcagtcccttgctattattgagtatcttgaggagatgagaccgacccctagattactgccgcaagaccctaaaaagcgcgcgtccgtcaggatgatctcagatctgatagcgggaggcatacagcccctgcagaatctgagcgtcctcaaacaagttggggaagagatgcagctgacctgggcccaaaacgccatcacatgcgggttcaatgctctggagcagatcctccagtctacagccggaatctattgtgtgggggatgaggttaccatggccgacttgtgcctcgtaccacaggtggccaacgcagaaagattcaaggtggaccttaccccctacccgaccatcagtagcataaataaacggctgctagtcctggaagccttccaggtgtcacatccctgtcgccagccggacaccccgaccgagctacgggcgtag

SEQ ID NO: 118739 - DNA, 387 bp, Artificial Sequence
  Description of Artificial Sequence: Synthetic coding sequence
atggccggtaatctgctgagcggagcaggcagacgtctttgggattgggtacctctggcctgtcggtccttttctctgggagtccctcggttgattggcatacgcctaaccctccctcctccaaaggtcgtggaccggtggaacgagaagagggcaatgttcggcgtgtatgacaatatcggtatcctcggaaactttgagaagcaccctaaggaactcatacgtgggcccatctggctgagagggtggaaaggtaacgaattgcaacggtgtatcaggaagaggaagatggtgggttccagaatgttcgcagatgatctgcacaatctgaataaaagaattagatatctctacaaacactttaatcggcatggtaagtttcgctag

SEQ ID NO: 118740 - DNA, 783 bp, Artificial Sequence
  Description of Artificial Sequence: Synthetic coding sequence
atggaggaaatgagagaccctagcaaaattaaatggggagatgctggcgccgagtacgtggttgagagcacaggtgtctttactaccatggagaaggctggtgcccaccttcagggtggggcgaagagagttatcatcagtgccccgagcgccgatgctccgatgttcgtgatgggggtcaatcacgaaaaatacgacaacagcctgaaaattatctcgaacgcttcttgcacgacaaattgcttggcgccactggccaaggttattcacgataacttcggcattgttgaaggtcttatgaccacagtacatgctatcacagccacccagaagacggttgatgggccaagcggtaagctttggagggacgggcgaggggctcttcagaatataatccccgctagcaccggggccgctaaagcagtcggtaaggtgattccagaactaaatggaaagttgactgggatggcctttagagtacccacggccaacgtgtctgtggtagatctcacttgtaggttggagaaaccagctaagtacgatgacataaaaaaggttgtaaagcaggccagcgaggggcccctcaagggcattctgggctatactgaacaccaggtggttagcagtgactttaactccgatacccattctagcaccttcgatgccggcgccggcatcgccttgaacgaccatttcgtgaaactgatcagctggtatgataatgaatttggctactctaaccgggtggtggatctcatggcccatatggccagcaaggaatag

SEQ ID NO: 118741 - DNA, 882 bp, Artificial Sequence
  Description of Artificial Sequence: Synthetic coding sequence
atggtgtatatgttccaatacgactccacgcacggcaaattccatggtacggtgaaagccgaaaacggcaagctggtcattaacggaaatccaatcactatattccaagagagggatcctagcaagataaagtggggtgacgctggcgctgaatatgtcgtcgaaagcactggagtcttcacgacgatggaaaaagcgggggcacacctgcaggggggagccaaacgggtgatcatcagtgccccgtccgctgacgcccccatgttcgtgatgggcgtgaatcatgagaagtatgacaatagcttgaagatcataagcaatgcatcctgtaccaccaactgcctcgctccactggccaaggtaattcacgacaacttcggaattgtggagggtctgatgacaacagtccatgcaattactgccacccagaagacagtcgacgggccttcaggcaaactgtggcgggacgggcgcggggcgctgcagaatatcataccagctagtacgggcgctgcaaaggcagttggaaaagttatacccgagctgaacggcaaattgactgggatggcctttcgggtgccgacagcaaacgtctcagtcgttgatctcacctgccgcctggagaagcccgcaaagtacgatgatattaagaaggtggtgaagcaggcctctgaaggtccactcaaggggattttgggctacaccgaacatcaggtcgtgtccagcgactttaactctgatacccactctagtacatttgatgccggcgccgggatcgccctgaacgaccattttgtaaaactgatctcctggtatgacaacgagtttggatattccaatcgcgtggtcgacctgatggcccacatggcctcgaaggaatag

SEQ ID NO: 118742 - DNA, 1008 bp, Artificial Sequence
  Description of Artificial Sequence: Synthetic coding sequence
atgggcaaagtaaaagtgggggtgaacggcttcggccggataggcagattggtaacaagagccgccttcaatagcggaaaggtcgacattgtcgccattaatgatccattcatcgacctcaattacatggtgtatatgttccagtacgacagtacccacgggaagttccacgggacggtgaaggccgagaatggaaagctggttataaatggaaaccctatcaccattttccaggaaagggatcccagcaagattaagtggggggatgccggagccgagtacgttgtggagtccacaggtgtatttacaacaatggagaaggccggggcccacctgcaaggcggagcaaaaagagtgataattagcgctccaagtgcagatgccccaatgttcgtcatgggcgtgaaccacgagaaatatgataactcattgaagataatcagcaacgccagctgtactactaattgtctggcacccctcgccaaagttatccacgataatttcggcatcgtcgagggcctgatgactacagtgcatgcaatcacagcaacccaaaaaacagtggatgggcccagtggaaagctgtggagagatgggcggggggccctgcagaacatcatccccgcatctaccggagccgctaaagcagttggtaaggtgattccagaactgaatgggaagctcactggaatggctttccgcgtgcctacagcgaacgtaagcgtcgtcgacctaacctgccgactggaaaagcccgccaagtatgatgatatcaagaaagtggtgaagcaagcctccgagggccctctgaaaggaatattgggatatacggagcaccaggtggtctcttctgacttcaattcagacacacactcaagcacgttcgatgcaggtgcaggcatagctctcaacgaccactttgttaagttgatttcatggtatgacaatgagtttgggtattctaatcgagtggttgatttgatggcccatatggcctctaaggaatag

SEQ ID NO: 118743 - DNA, 1008 bp, Artificial Sequence
  Description of Artificial Sequence: Synthetic coding sequence
atgggtaaggtgaaagtgggggtaaatggctttggtagaatcggacgcttggtgactcgcgccgccttcaacagcgggaaggttgatatcgtagccattaatgacccttttattgatctgaattacatggtctatatgttccagtacgattcaacgcacggtaaatttcacgggactgtgaaagccgagaacggtaagctcgttattaacggaaaccccatcactatctttcaagagcgcgatccgagcaagatcaaatggggagacgcaggggctgagtacgtggtcgaaagcactggagtgtttacaacaatggagaaggccggcgcccacctccaaggaggggcaaagcgagtcatcatcagtgccccctccgctgacgcaccaatgttcgtgatgggcgttaaccatgagaaatatgataacagtttgaagatcatttccaatgcttcttgcaccacaaattgcctcgcaccccttgctaaggtgatccatgacaattttgggattgtggagggccttatgactaccgtccacgccattacagccactcagaagaccgtagacggcccaagcggcaagttgtggagggacggccggggcgccctgcagaatataatccccgcttccacaggagcagctaaggccgtaggaaaggtgatccctgagttgaacggcaagctgaccggaatggcattccgggttccaaccgcaaacgtcagtgtagtggatttgacctgccggctggagaaacccgccaagtacgacgatatcaagaaggttgtgaagcaggcctcggagggccctctgaaaggcattcttggttatactgaacaccaggtggtgtcttcagattttaattctgacacgcactctagtacattcgatgcaggtgcgggcatcgctctgaatgaccacttcgtgaagcttatcagttggtatgataatgagttcgggtactccaacagggtagtggatctgatggcgcatatggcctcaaaggagtag

SEQ ID NO: 118744 - DNA, 648 bp, Artificial Sequence
  Description of Artificial Sequence: Synthetic coding sequence
atggggaaagtgaaggtgggggtgaatggcttcggtcggatcggccgacttgtcacacgggccgccttcaacagcggcaaagtcgatatcgtggctatcaacgatcccttcatagatctgaattatatggtttatatgttccagtacgactctacccacggaaagttccacggcacagtgaaagcagaaaacggaaagctagtcattaacggcaatcctattacaatctttcaggagcgcgacccttcgaagattaagtggggggatgctggtgcggagtacgtggtggagtctactggtgtgttcacaaccatggagaaagcgggagctcacctgcagggaggagccaaacgagttatcatttcggcgccatccgccgatgcgccaatgtttgttatgggggtgaatcacgaaaagtatgataactccctgaaaattatcagcaatgcgtcatgcaccactaattgcctcgcgccgttggcaaaagttatacatgacaacttcggcattgtcgagggcctcatgaccacggttcatgcgatcacagctacccagagagaagcacactggcatgggctgccttgtccccactgccagcgggtctcagggggcccggatctgccttcaagaaaaacatgccagatatag

SEQ ID NO: 118745 - DNA, 675 bp, Artificial Sequence
  Description of Artificial Sequence: Synthetic coding sequence
atgacactgtttcattttggaaactgttttgcactggcctattttccctactttattacatataagtgctccggtctttccgagtataacgcattctggaagtgtgtgcaggcaggagttacttatttgttcgtgcaattgtgtaaaatgttattccttgctacatttttcccgacttgggagggcggcatatatgatttcataggcgagttcatgaaggcttccgtggatgtggctgacctcatcggccttaacttggttatgagtagaaacgctggaaaaggtgaatataagattatggtcgccgcattggggtgggcaacagccgaacttataatgtctagatgcatccccctctgggttggtgctcgcggaattgagttcgactggaaatacattcagatgtctatcgatagtaacatatcactcgtccattatattgtcgcctccgcccaggtctggatgatcactcgatatgatctgtaccatacgtttaggcccgcagtcctcctcttaatgttcctcagcgtctacaaggcttttgtgatggaaacattcgtgcacctgtgctcactgggatcgtgggctgccctcctggcgagggctgtcgtcacggggctgcttgccctcagtacacttgctctgtacgtagccgtggttaacgtgcactcctag

SEQ ID NO: 118746 - DNA, 1104 bp, Artificial Sequence
  Description of Artificial Sequence: Synthetic coding sequence
atggctgccgctttgcaggtgctgcctcggctcgcacgcgcgcctctgcacccattgctgtggcgaggctctgtcgcgagactggcatcatccatggctttggcagagcaggctaggcagttatttgaatccgccgtcggcgctgtccttcccgggcccatgctccaccgcgcactgtccctggaccccggcggaaggcagttaaaagtgcgcgaccgtaattttcagctcagacagaacctctacctcgtcggtttcggcaaagcggtcctaggaatggctgccgcagctgaagaactactgggtcaacaccttgttcaaggagtaatcagcgtgcctaaagggattagggccgcaatggagagggctgggaagcaggaaatgctgttgaaaccccattcccgggtccaggtgtttgagggagccgaagacaacctacctgatcgcgatgccctgagagcagcacttgctatccagcagctagcagagggactgaccgcagatgacctgctacttgttttgatatctggcggtggaagcgcccttctcccagccccgattccacctgttaccctggaggaaaaacagacacttacaagacttttggcagccaggggggccactatccaggaacttaacaccatacgaaaagcgctatctcagctaaagggagggggcttggcacaagctgcctaccccgcacaggtggtttcactaatcctctcggacgtggtgggtgacccagttgaggtgattgccagcggcccaaccgtggcctcatctcacaatgttcaggactgcctccacatccttaaccgttacggccttagagcagctctgccccgcagcgtgaagactgtgctttctagagccgacagcgatcctcatgggccacacacttgtggccacgttcttaacgtcataatagggtctaatgtcctggccctggctgaggcacagagacaagcggaagccttaggttatcaagctgtcgtcctgtctgcggccatgcaggggtgggggactcccgctgcccacagagatgacaggtatcagtgtcacggacacccaccgctggtgcctgccgccagtgtaatggcctag

SEQ ID NO: 118747 - DNA, 705 bp, Artificial Sequence
  Description of Artificial Sequence: Synthetic coding sequence
atggctgctgcactacaagtgctcccgcggttggccagggcgcctctgcaccctctgctctggcgcgggtcagtggctcgcttagccagtagcatggctttggccgagcaggccagacagctgtttgaatccgctgttggcgctgtgttgccgggtccgatgctgcatcgagcactgtctttggatcctggcggtcggcagcttaaggttcgagaccggaatttccagctgcggcaaaacctgtacctggtggggttcggaaaggcagtgctgggcatggcagccgctgcagaagagctactgggccagcatctcgttcagggcgttatcagtgtgccgaagggtatacgggccgctatggagcgggcggggaagcaggagatgctccttaagccacactccagagtgcaggtgtttgagggcgcagaggataacctacctgatcgggacgcactgcgggcagccttggcaatccagcagttggctgaaggtctgacagccgatgatcttctgctggtccttatctcgggcggagaaccgcatccagtaaggtgcggtggaggaccctgcggcggtgactgccagtggcctcatcgaggccagtttcctcagtgtgctagattacctgcttatccccagtctttgaggcccccttgctctccagccactttctgcgaggactgcgcggtgtctggtcgcctttag

SEQ ID NO: 118748 - DNA, 1374 bp, Artificial Sequence
  Description of Artificial Sequence: Synthetic coding sequence
atggctgcagcactccaggtactgccccggctcgctcgcgccccccttcatccattgctctggagaggttcagttgcaagacttgcctcgagtatggctcttgccgagcaggctcggcaactttttgaatcagcagtcggcgctgttctgcccgggccaatgctgcaccgcgccttgagcctggaccctggggggagacagttgaaggtaagggaccgtaattttcagctgcgccagaatctctatttagtgggatttggaaaagctgtcttaggtatggcagctgccgcagaggagctacttgggcagcacctggtgcagggagtgatttctgtgcctaaagggattcgcgccgcaccaatccccccagtaactctggaggaaaaacagaccctcacccggttgttggccgcccgcggagcgactattcaagaactcaatactattcgcaaggcattgtctcagctgaaggggggcgggctggcccaagccgcgtatcctgctcaggttgtcagtctgattctgtcagacgtcgttggggatccagtggaggtgatcgccagtgggccgacagtggccagctcacataatgtgcaggattgtcttcacattttgaacaggtatggcctccgcgccgccctaccacgatccgtgaaaacagtcctgtctagagccgattcagatccccacggacctcatacatgtgggcacgtgctgaatgtaataataggatcaaatgtgttagcactggccgaggctcagcgtcaagcagaggctttaggatatcaggccgtggtgttatccgctgctatgcagggagatgtaaagtccatggcccagttctatggcctcttggctcacgtggcccggactaggctaactcccagtatggcgggggcctcagtggaggaggacgcgcagctacatgaactggcagcagaacttcaaattcctgatctgcaactagaggaagctctggagaccatggcttggggtcgtggtcctgtatgtctcctggctgggggcgaacctacagtccaactccagggcagcggaagggggggacgcaaccaggaactcgccctcagggtgggagcagaattgagacgctggccactgggccctatcgatgtcctgtttctttctgggggcacggacggtcaggacggccccaccgaagccgccggggcctgggtgacgcccgaactcgcaagtcaggcagccgccgagggactcgatatcgccacctttctggcacacaatgatagccatacctttttctgctgcttgcagggtggtgctcaccttctgcacacaggaatgaccggcactaatgttatggatacacaccttctgttcctcaggcccagatag

SEQ ID NO: 118749 - DNA, 1572 bp, Artificial Sequence
  Description of Artificial Sequence: Synthetic coding sequence
atggcagctgcactgcaggtgctccctaggcttgctagggcgccgctccatcccctgctatggcgtggctcagtggctcgacttgccagctccatggcgttggcagagcaagcccgtcagctttttgaaagcgccgtcggggcagtactgcccggacccatgctgcaccgagccctgagtctggatcctgggggccgccagttgaaggtgagagaccgcaacttccagctccgccaaaatctatacctcgtggggtttggaaaggccgtgctggggatggctgccgccgccgaggaattgctgggccagcatttggtgcagggagtgatcagtgtacccaaaggaattcgggccgcaatggagagggcagggaaacaggagatgcttcttaaacctcattctagggtgcaagttttcgagggtgcagaagacaacctcccagatagagacgccctgcgggccgccctggccatccagcaacttgccgagggcctgaccgcagacgacctcctcctggtcttgatcagcggcggcggctccgcactactgccggcacctatcccccccgtcaccctagaagagaagcagactcttaccaggcttctggctgcgaggggggcgactatacaggagttgaacactataaggaaggcgttgtctcaactcaagggaggtggacttgcccaggctgcgtatcctgcgcaggtagtttccttgatcctgtctgatgtcgtgggagaccccgttgaagtaatcgcctccggacctacagtggccagttcccacaacgtgcaggactgtctgcatattctcaatcgatacggtctacgcgctgcgctgccacggagcgtgaaaactgtattgtcccgtgccgacagtgaccctcatggccctcacacatgtggacacgtgttaaatgtgattattgggtctaacgtactggccttagccgaggcgcaaagacaggctgaggcacttggataccaggccgttgttctgtccgcggccatgcagggggatgtgaaaagcatggcacaattttatggtcttctggcccacgtggcaaggaccagactcactccttcaatggctggcgcgtccgtggaggaagatgctcagctccatgaactggccgccgagctgcagatccctgacctgcagcttgaagaagccctcgagacgatggcctgggggagaggtcccgtgtgcctgctggccggtggcgagcctaccgtgcagctgcagggatcagggagggggggacgcaatcaggagctggccctgagagttggcgccgaactgcgccgctggccactggggccaatcgatgtgctctttctctcaggcggcacagatggacaagatggcccgactgaagcagccggcgcctgggtgacgcccgagctggcatcacaagccgcggccgaggggctcgatattgccacattcctggcccataacgattcccacacgtttttctgttgtctgcagggaggagctcaccttcttcacactggaatgactggcaccaacgtaatggacacccacctgttgttcctcaggccaaggtag

SEQ ID NO: 118750 - DNA, 852 bp, Artificial Sequence
  Description of Artificial Sequence: Synthetic coding sequence
atggaacttctcttgagtcagtcctgcatctggtggcccatggtgggggaaggtcgcactatcatcagttgtggcattaaagctatggaaagatccggcaactacttgatttggctgcagaagggcgagatgctgctgaagccgcatagtcgggtgcaggtctttgagggagcggaagacaatctcccggatcgcgacgctctccgcgctgccctggctatccaacagttagccgagggtctgactgcagatgacctgctgctggtactgataagcggcggggggtccgccctcttacccgcaccgatcccgcctgtgaccctggaagagaagcagaccctcacccggctgcttgccgcacgaggcgccaccattcaggagctcaataccatccggaaagctctgtcccagctgaaaggaggcggactggcacaggcggcatatccagcccaggtagtgtcactgatcctttccgatgttgtgggtgaccccgtggaagtgattgccagtgggcctacagtcgcgagttcgcataatgtgcaggactgtcttcatattttaaataggtacggcctgcgtgcggctttgccacggtccgttaagacagtcctcagtcgcgctgacagcgatccacacggcccacacacatgcgggcatgtactgaacgtgattatcggtagcaatgtacttgccctggccgaggcacaaaggcaagctgaggctctcggttatcaagccgtggtactgtcagctgctatgcaggggtgggggactcctgctgcacacagagacgacagataccaatgtcacgggcaccccccgctggtgccagccgcaagcgtcatggcctag

SEQ ID NO: 118751 - DNA, 723 bp, Artificial Sequence
  Description of Artificial Sequence: Synthetic coding sequence
atgctgctgaagccacatagtcgggtgcaagtgttcgaaggagcggaggacaacctgcccgatcgggatgctctccgagccgcgctcgccattcagcagctggctgaggggctgacagcggacgatctcctgctggtactcatttccggaggcggttcggcgcttttgccggctccaattccccccgtgaccctcgaggagaaacagactttgactaggctgctggcggccagaggcgccactatccaggagctcaataccattcggaaggccctaagccaactgaaaggtggcggcctggcccaggcggcatatccggcccaggtggtctccctgatcctgagcgatgttgtgggggaccccgtcgaagtgattgcaagcgggcctaccgtggcaagttcccacaacgttcaggactgtcttcatatactaaatcgctatggactgagggccgccctgcctcgtagtgtcaaaaccgtgctttccagggccgactccgaccctcatggcccacacacctgcggacacgtgctgaatgtcataatcggctccaacgtgctggccttggccgaggctcaaaggcaggccgaggccctggggtaccaggccgttgttctgtccgccgctatgcagggctggggcacccccgcagcccatcgcgacgatcgatatcagtgccatggacacccacctctcgtccctgctgcatcggtcatggcttag

SEQ ID NO: 118752 - DNA, 618 bp, Artificial Sequence
  Description of Artificial Sequence: Synthetic coding sequence
atggcagccgctttacaggttctcccccggttagccagagcccctctgcacccactgctgtggaggggctcagttgctaggttggcaagctcaatggccctggcagaacaagcgcgccagctgtttgagagcgccgttggcgccgttctgcccgggccaatgctccacagggcactcagtctcgacccaggaggaaggcagctcaaggtgagggatagaaactttcagttgcgccagaacctgtatctcgtgggctttggaaaagctgtgcttggcatggccgctgctgccgaggaactcctagggcagcatctcgtgcaaggcgtcatttctgtgcccaagggtattcgagctgctatggagcgggctggcaaacaggaaatgttactgaaaccgcacagcagagtgcaggtcttcgaaggggccgaggacaacctgcccgatagggacgctctgcgggccgctttggcaattcagcagctcgccgaaggactgaccgcggacgacctgctgttggtcttgattagcggttgggggactccagcggctcaccgagatgacaggtaccaatgccacggtcatccaccactggtgcccgctgcctccgtcatggcgtag

SEQ ID NO: 118753 - DNA, 705 bp, Artificial Sequence
  Description of Artificial Sequence: Synthetic coding sequence
atggccgctgccctccaggtgctgccacggctggcccgtgcacctctgcatcctttgctgtggagagggagcgtcgctcggctggcctctagtatggcactggccgagcaggccaggcagctgttcgaatccgctgtgggtgccgtcttgccagggccaatgcttcaccgggctctgagtctcgatccagggggtagacagctcaaggtgagggatcggaactttcagctgcgtcaaaatctgtacctcgttggttttgggaaggcagtgctaggaatggctgcggccgcagaagagctgctgggccagcacctcgtccaaggcgtcatctccgttcccaaaggaattcgcgctgccatggagcgcgcgggcaaacaggagatgctgctgaagcctcactcccgggttcaagtgttcgaaggagcagaggataatctgcccgaccgcgacgctctgagggcagcactggccattcagcagctggcggaaggccttacagccgatgatttgctgctggtcctaattagtggcggcgaacctcaccctgttagatgtggtggcggtccatgtggaggtgattgccaatggccccataggggacagtttccccaatgtgcgcgcctgcctgcctatcctcagagcctccggccaccttgttctcccgccactttctgtgaagattgcgcggttagcggacgactctag

SEQ ID NO: 118754 - DNA, 285 bp, Artificial Sequence
  Description of Artificial Sequence: Synthetic coding sequence
aaaatccttgatgccatgaacagggattgcggtatccccctttctcacctccaggtggatgggggtatgacgtctaataaaatactgatgcagttgcaggccgatattctgtatatccccgtcgttaagccctcgatgcccgagacaacagccctgggtgccgcgatggccgcgggggctgccgaaggggtaggggtgtggagcttggaacctgaggatttgagtgccgttactatggagcgattcgaaccgcagatcaacgctgagggaaccttcaaggagtag

SEQ ID NO: 118755 - DNA, 1662 bp, Artificial Sequence
  Description of Artificial Sequence: Synthetic coding sequence
atggcagcttctaaaaaggccgtcctggggccactggtaggcgctgtcgatcaggggactagttccacaaggttcctggtgtttaacagcaagacggcagaactgctgagccatcaccaggtcgagatcaaacaggagtttcccagggaaggctgggtggaacaagatcctaaagaaatcctccatagcgtctatgaatgcattgagaaaacttgcgagaagctcgggcagctaaacattgacatcagcaacattaaagctatcggcgttagcaatcagcgcgagaccacggttgtatgggacaagataacaggcgaacccttgtacaacgcagtcgtatggctggatctgaggacccaatcaaccgtcgagtcactttccaagcgcattccaggaaacaataactttgtgaagagtaagactggcttacccctcagtacatatttctctgcagttaagctacgatggctgttggacaacgtaagaaaagtccagaaggccgtggaggagaagagggcactattcgggaccatcgattcgtggcttatatggagtctcactgggggtgtgaacgggggagtccattgcaccgacgtcacgaatgccagtaggacaatgctatttaacattcattcgcttgagtgggacaaacagctgtgcgagttttttggcatccctatggagatacttccaaatgtccgcagctctagcgagatctatgggctaatgaaggccggcgctctggagggcgttccgatttccgggtgcctgggagatcagagcgcagccttggtcgggcagatgtgctttcagatcgggcaagcaaaaaatacttatggaacaggctgttttttgttgtgtaatacaggccacaaatgcgtcttctcagatcacggacttctgaccactgtcgcttacaagctgggtagagacaaacccgtttactacgctctcgagggctctgtagcaatagcaggtgccgtaatcaggtggctgagggacaaccttggcattattaaaacatccgaagaaatagaaaaactcgctaaggaggtggggacttcctacggatgctacttcgtgcctgcctttagcggactctacgcaccttactgggagcccagcgcacgcggcataatctgtggtttgacgcagttcaccaataagtgccatattgcctttgctgcactggaagccgtctgttttcaaactcgcgagattcttgatgccatgaatcgggactgcggcattcccctctcccacctgcaagttgatggcggaatgacttccaacaagatccttatgcagctgcaggctgacatcctttatatcccagtcgtaaaaccttcaatgccagaaacaactgctctcggtgccgctatggctgccggagccgccgagggagtcggcgtgtggtccctggagcctgaggacctgagcgcagttactatggaaaggttcgagccacagattaacgctgaggagtctgaaattcgttacagtacgtggaaaaaagctgtcatgaagagcatgggttgggtgacaacccagtccccggagtccggagatcccagtattttttgctccctacccttgggcttctttatcgtgagttcgatggtgatgctaataggcgcgcggtacatatctggaattccatag

SEQ ID NO: 118756 - DNA, 1575 bp, Artificial Sequence
  Description of Artificial Sequence: Synthetic coding sequence
atggccgctagtaagaaagcggttttaggacctttagtcggggcggtcgatcaaggcaccagttccacaaggttcctagtttttaattctaagactgccgaacttttgagccatcaccaagtagagattaaacaagaatttcctagggaaggctgggtagagcaggatcccaaagagatcctacactcagtctatgaatgcattgagaaaacatgcgaaaaacttgggcaactcaacatagacatctcaaacatcaaggccattggcgtctccaatcagagagaaacaacagtggtttgggacaaaatcacaggggagcctttatataatgccgtggtgtggctagacctaaggacccagagtacggttgagagcttgtctaaaaggatcccaggtaacaataatttcgtgaaatccaagactggattacctctgtcgacctatttctctgccgtaaagctcaggtggttgctcgacaatgtacggaaagttcaaaaagccgtggaagagaagcgtgccctgttcggcacgatcgattcttggcttatttggtcactgactggaggcgtcaacggcggtgtacactgcactgatgtcactaacgccagcaggacaatgctttttaatattcactcactggaatgggacaagcagctgtgcgaatttttcggtattcccatggaaatcctgcccaacgtccggtcatcgagcgagatatatggactgatgaaagccggtgcattagagggcgtccccatcagcggttgtttaggggatcagagcgccgccttggtgggtcagatgtgtttccagattggccaggcgaaaaacacctacggaacaggctgtttcctactgtgtaatacaggacacaaatgtgttttctcagaccacggactgttgacaactgtggcatataaactgggccgggacaagcctgtgtattatgcccttgaaggttccgtcgccatcgctggagctgttattagatggttgcgcgataatcttggaatcattaaaactagtgaggaaatcgaaaaactggctaaggaagtggggactagctacggctgttacttcgtacctgcattttcaggactttatgccccctactgggagccttccgcccgtggaataatctgtggtctaacacagttcaccaacaagtgtcacatcgcattcgccgccctcgaggcagtgtgttttcagacccgcgagatactggatgcaatgaatcgcgattgcggcatacccttgtcccacctgcaggttgacggagggatgactagtaataaaatccttatgcagctacaagcggatatcctgtatataccagtcgtgaagccatctatgccagagaccaccgctctgggcgccgccatggccgcaggtgctgcagaaggtgtcggagtctggtctctggaaccagaagacctgtctgcagtgacaatggagagatttgagccacaaatcaatgcagaggaatccgagattcggtattcaacttggaagaaggcagtgatgaagtccatggggtgggtcactactcaatcgccagagtcgggaattccctag

SEQ ID NO: 118757 - DNA, 1593 bp, Artificial Sequence
  Description of Artificial Sequence: Synthetic coding sequence
atggccgcttccaagaaggcagttttaggaccactcgtcggggccgtagatcagggaacctcaagcacacgctttctcgtcttcaacagcaaaaccgcagagctcctgtcccatcatcaggtagagattaaacaggagttcccacgggaggggtgggttgagcaggaccccaaagagatacttcatagcgtctacgagtgcattgaaaaaacgtgtgagaaactgggtcagcttaatatcgatatctcaaacatcaaggccatcggtgtatctaatcagcgcgagaccaccgtggtgtgggacaagattactggagaacctctctacaacgccgtggtgtggctggacttacggacgcaaagtacagtagagagtctaagtaaaaggattccaggaaacaacaattttgtcaagtctaaaaccggactgcccctttccacttacttctctgctgtgaaactaaggtggctcttggataatgtgaggaaggtacagaaggcggtggaagaaaaaagagcccttttcgggacaatcgactcctggcttatatggagtctgacaggaggcgtcaatggaggagtgcattgcacagatgtgacgaatgccagtcgcacgatgctctttaacatccactcgctggagtgggacaagcagctctgcgagttcttcggtatacctatggagatcctaccaaatgtgcggagctcgagtgagatttacgggctcatgaagatctcacatagcgtgaaggccggtgctctggaaggcgtacccatctccggctgcttaggggaccagtcagccgctttggtgggacagatgtgtttccagatagggcaggccaagaacacgtatggtaccggatgtttccttctgtgtaacaccggtcataaatgcgtattctcagaccatggactgctgactaccgttgcttacaaactggggcgggacaaaccagtgtactatgccttggagggttccgtcgccattgccggggctgtgatcaggtggctgagagacaatctcggcataatcaagacctccgaggagatcgagaagctagccaaagaggtgggaacaagctatggttgctactttgttcccgcctttagcggactttatgccccatattgggagcctagcgcccgcggcataatttgcggacttacccaatttaccaacaagtgccacatcgcattcgcagcattggaggctgtctgcttccagacgcgggagatccttgacgctatgaatagagattgcggcatacccttaagccacttacaagtcgatgggggcatgacgtctaataagatcctcatgcaactccaagctgacattctgtacatccccgtggttaagccctctatgcctgagacaaccgccctcggagccgccatggcagccggagcagctgagggagtcggcgtgtggagcctcgagccggaggacctctcagcagtaacgatggaaagattcgagccgcagatcaacgccgaagagagtgagattaggtattcaacctggaaaaaagcagtgatgaagagcatgggctgggtaacaacgcagtcacccgagtccggcattccctag

SEQ ID NO: 118758 - DNA, 1065 bp, Artificial Sequence
  Description of Artificial Sequence: Synthetic coding sequence
atgctgtttaatatacactcacttgaatgggataagcaactgtgcgaattcttcggaattcctatggagatccttccaaacgtgcgttcttcctcagagatatacgggctgatgaaaatcagccatagcgtgaaggccggcgctctggagggagtcccaatttctggctgccttggagatcagtctgccgcgttggtgggacaaatgtgctttcagatcgggcaggcgaagaacacttacggcacgggttgtttcctcctatgtaatactggccacaaatgcgtgttttcagatcatggattgctaactactgtggcctacaaattgggcagggacaagcctgtgtattacgccttggaggggtctgtggcgatcgccggagccgtaatacgctggcttcgagataatctcgggatcatcaagacctccgaggagatagaaaagctcgctaaagaggtgggcacctcctacggctgctactttgttccagccttcagtgggctgtacgccccctactgggaaccatcagctcgaggtatcatatgcggacttactcaattcaccaacaaatgtcacatcgcattcgctgccctggaggctgtgtgcttccagacccgggagatcctggatgctatgaatcgagattgtgggatcccgctaagtcacctgcaggtggacggcggaatgacatccaacaagatcctgatgcagctccaggccgacatcttatacatacccgtcgtcaagccgagtatgcccgaaactacggccctcggggccgccatggctgccggagctgccgaaggtgtcggggtgtggagcctggagcctgaggatctgtcagccgtgactatggaacggttcgaaccgcagatcaatgccgaagagtctgagatccggtacagcacctggaaaaaggctgtgatgaagtcgatgggctgggtcaccactcagagccccgaatctggagacccctccatcttttgtagcctgcctctgggattcttcattgtttcttctatggttatgttgatcggggcccgctatatttctgggataccttag

SEQ ID NO: 118759 - DNA, 1104 bp, Artificial Sequence
  Description of Artificial Sequence: Synthetic coding sequence
atggcctaccttgacaactttaaaacaaacgcccgacacttcatcctgtttgtgaacatttctagcctgacaggaggcgtcaatggcggtgtccattgcaccgatgtcaccaacgcttctcgtaccatgctgtttaatatccacagtcttgagtgggataaacagctgtgcgagtttttcggcattcctatggagatcttacctaacgtgcggtcctccagtgaaatctacgggctgatgaagatatcacactcagtcaaggccggagccctggagggagtgccaatctctggatgcttgggcgatcaatctgcagccctcgttggtcaaatgtgctttcaaattggccaggccaaaaacacatacggaacaggttgtttcctgttgtgtaatacaggccataagtgcgtgttttccgatcatggccttctaactacggttgcttataagctcggcagggacaaaccagtgtactacgccctcgagggaagcgtcgcgattgccggggccgtgatcaggtggttgagagataatctgggcattattaaaacctccgaggagattgaaaaactggctaaagaagtcggcacttcctatgggtgttattttgtgccagctttcagtggactctatgctccctattgggagccgagcgctagaggcattatctgtggactcacccagttcaccaataagtgccacattgcttttgccgctctcgaggcagtgtgttttcagactcgagagattctagatgctatgaaccgggactgcggtatcccgctgagccacctgcaggtcgacggaggtatgacgtccaataagatcttgatgcagctccaagcagatatcctgtacatccctgtggtgaaacctagcatgcctgaaacaactgccctcggtgcggccatggcagctggagccgctgagggcgtaggagtctggtctttggagccagaggacctatccgcagtaactatggaaagattcgagccccagatcaacgccgaagaatccgagattcgctattcaacatggaaaaaagcggtgatgaaatcgatgggatgggttactacacagagtcccgagagtggcattccatag

SEQ ID NO: 118760 - DNA, 1680 bp, Artificial Sequence
  Description of Artificial Sequence: Synthetic coding sequence
atggctgcctcaaaaaaggccgtactaggacctctggtcggagccgtagaccagggcaccagttccacaaggtttttggtcttcaactctaagactgccgagctgctgagtcaccatcaggtggaaataaagcaggaattccctagggagggttgggtggagcaagatcccaaggaaattttgcatagcgtgtacgaatgtatcgagaaaacatgtgagaaactaggacagctgaatatagacataagtaatatcaaggctatcggagtgagcaatcaacgggaaacaaccgttgtgtgggacaaaattaccggagaaccactttacaacgccgtggtttggctcgatctgcgtactcaatcaacagttgagtcactgagcaaacgtattccgggaaataataactttgtgaagtcaaaaacaggtctgcctttaagcacttacttctccgccgtaaagttgagatggctgctggataacgtccggaaagtgcagaaggcagtggaggagaaaagggccctgtttgggaccattgactcctggttgatttggagcctaaccggcggcgttaatgggggagtgcactgtacggacgtgacaaatgccagtcgaacaatgctattcaacatccacagcctggagtgggataaacaactctgtgagttttttggcattccaatggagatcctccccaacgtgagaagtagcagcgaaatttacggtttaatgactattcataattccaagaaggcaggggcccttgaaggcgtgcccatatctgggtgtctgggcgaccaatcggccgctttagtgggccagatgtgctttcagatcgggcaggccaagaacacctacggtaccggttgcttcctgctgtgcaacactgggcataagtgtgtgttcagtgaccatggcctactcacgactgtggcatataagctagggcgtgacaaacctgtgtactatgcactggaaggcagcgtggctatagcaggcgccgtaatccggtggctgagggataaccttggaatcattaaaacgtcagaggagatcgagaagctcgcaaaagaagttgggacctcatatgggtgctattttgtgccggcttttagcgggctttatgccccatactgggagccctcggccagaggaattatctgtggtctaacacaatttactaataaatgtcatatcgcctttgcagcacttgaagcagtgtgcttccagacaagggagatactggatgctatgaatagggactgtgggattcccctctcccatttacaggtagacgggggaatgacaagcaataagattctgatgcaacttcaggctgacatcctctacatcccagttgtcaagcctagtatgcccgaaactacagcactgggcgcagctatggcagccggcgctgccgaaggagtgggcgtctggagtcttgagcccgaggatctgagcgccgtgactatggaaagattcgaacctcaaatcaacgcggaggagagcgagatcagatattccacatggaagaaggccgtaatgaagtccatgggatgggttacaacccagtcgcccgaaagcggagaccccagcatcttctgttccctccccctgggcttcttcattgtatcttccatggtgatgcttatcggggctcgatatattagcgggattccctag

SEQ ID NO: 118761 - DNA, 1662 bp, Artificial Sequence
  Description of Artificial Sequence: Synthetic coding sequence
atggcagctccaaagaccgcggccgttgggccactggtgggcgccgttgtgcaggggacaaattccacacgcttcctggtgtttaattccaagaccgcagaactgctgtcccaccataaggtggaactcacacaggagttccctaaggagggctgggttgagcaagatccaaaagagatcctgcagagcgtttacgagtgtattgcaagaacttgtgaaaaattagacgagctgaacatagatataagtaatattaaagcggtgggcgtgtccaatcagcgcgaaactacagtgatttgggacaagctgactggcgagcctctgtacaacgcggtcgtgtggctggatctacgtacacagactaccgtcgaagatttaagcaagaaaattccaggcaatagcaacttcgttaagagtaagaccggtcttcccctgagcacatatttcagcgcagtcaagctccgctggatgttggataatgtgcgaaacgtgcagaaagccgtggaggagggcagggcactgttcggcacaattgattcatggcttatttggtcgttaactgggggcgtgaatggcggggtgcattgtacggatgtgaccaatgctagccggacaatgctgtttaacatccattctttagagtgggataaggagctgtgcgacttcttcgagatccccatggatcttttgcctaacgtgttcagtagcagcgagatatacggtctcattaaaaccggggccctggagggtgtccctatctctggctgtttgggcgatcaatgtgctgctttggtcggtcaaatgtgtttccaggaagggcaggcgaagaacacatacgggaccggatgctttctgctatgtaataccggaaggaaatgtgtgttctctgaacacggtctgctgactactgtcgcctataagcttggacgtgaaaagcccgcctactatgctcttgagggcagtgtggccatcgctggagcagtgattagatggctgcgggataatttgggcatcattgaaactagcggagatatcgaaaggctggcaaaagaagtagggacttcctatggttgttacttcgttcccgccttcagtggactttacgccccctattgggagccaagcgcaaggggaatcctgtgtggactgactcaattcacaaataagtgtcatatcgcttttgctgccctggaagctgtctgctttcagacaagagaaattcttgaagctatgaatcgggactgtggaatcccactgcgccacctgcaggtggatggggggatgacaaataataaagttttaatgcagctgcaggccgacatattgcatattcctgtgattaaacccttcatgcccgagactactgccctgggcgcagctatggccgcaggagcagctgagggcgtgtcagtatggagcctggaaccacaggccttgtccgtgctgcgaatggagaggtttgagcctcagattcaagcaaccgagtctgagatccgctatgcaacgtggaaaaaagccgtgatgaaatccatgggctgggtgacaagtcagtccccagaggggggtgacccctccatcttctcaagtctacctctcggtttcttcatcgtgtcgtccatggtcatgttgatcggtgccaggtatatcagtggagttccttag

SEQ ID NO: 118762 - DNA, 1050 bp, Artificial Sequence
  Description of Artificial Sequence: Synthetic coding sequence
atggcaagtaaaaaggtctgtatcgttggaagcggaaattgggggtccgcaattgctaaaattgtgggcggtaatgccgcacaactggcccagttcgacccaagggtaacgatgtgggtgttcgaggaagacattggtgggaaaaagctcacagaaatcatcaatacacaacatgaaaacgtaaaatatttacccggtcacaagctgccgcccaacgtcgtggctgtacccgatgtggttcaggccgcagaagacgccgatattctaatttttgtggtcccgcatcagtttattggaaagatctgcgatcagctaaaaggacacctgaaggcaaacgctaccggcatctccctgattaaaggagtcgatgagggtcccaatgggctaaagctgatatcagaggttatcggcgagagactgggcatccctatgtctgttttgatgggcgccaatatagccagtgaagtcgccgacgagaaattctgtgagactactatcggctgtaaggatccagcccagggacaactcctcaaagagctcatgcagacccccaacttccggattaccgtggtccaggaagtcgatactgtagagatttgcggagcactaaaaaatgtagtggctgttggcgccggattctgtgatggactggggttcggcgacaacacaaaagccgctgtgattagattggggctgatggagatgattgccttcgccaaactgttctgtagcggtcccgtgagctcggctacatttctagagagttgcggtgtggcagatttaatcaccacttgttatggaggccgcaatcgaaaagtggctgaggccttcgcaagaaccggtaagagtattgagcagttggagaaagaattactgaacggacagaagctccagggccctgagactgcaagggagttgtacagcatcctgcagcataaaggccttgttgataagtttcctctgtttatggcagtgtataaggtttgctacgagggccaacccgtaggagaattcatccactgtcttcagaatcaccccgagcacatgtag

SEQ ID NO: 118763 - DNA, 981 bp, Artificial Sequence
  Description of Artificial Sequence: Synthetic coding sequence
atgcagactccaaatttccgcatcactgtcgtacaggaggtagatactgtggagatctgtggagctttgaaggtgcggggagcccaacgacagctgtggggggaggaaaaggctccaaaggaggtgtggcttagcagcgccaggctgcaggtcctgcaggcccttactatcgagcagtggttcccttttcctaccatgtctcatgcttataggaggtcctgccgaagcaaagccagagccattcaagctgactattcctcctctgatagagggccaccttgtagttgcccaatcttggcaccgtgtggaacaccacaccccttggcacctgggggacagggggacaaggaaatgccgcggttaatgggagataaaacatcattgacaccgaggcagaccaatggtcaaaattacgggtcttggactgccgtagacggtctgtacaatggcatggtgcgatgggaggaccagttggagcgacgcgtcgtgttcagaaagtgccctcgggggggcagcatgggccaagggctgcgaaaaggagtacagcaagggggcaagcctcgtggagggagtagactccttaaagggcataccttgtacctgtccagcgccgtgggcgtcacggctgacgagatgtcaatgcgcggcctccatatggggcccattggtggtgggctcttcacgtacgacttacactcatttaagaacgtggtagctgtaggggcagggttttgtgacgggctgggatttggagataacaccaaagccgccgtgattagattaggtctcatggaaatgattgcattcgctaaactcttttgctcgggcccagtcagttcagcaaccttcctggagtcctgtggcgttgctgatctaatcacgacctgctatggcggacggaatcgaaaggtggctgaggcttttgctcggactgggaaggttggccccggaaggagagaaaacaggggagccgccttatag

SEQ ID NO: 118764 - DNA, 1056 bp, Artificial Sequence
  Description of Artificial Sequence: Synthetic coding sequence
atggccgccgccccgctgaaggtctgcatagtcggttccggaaattggggatcagccgtcgccaaaatcatcgggaacaacgttaagaaattacaaaagtttgcatctacggtcaaaatgtgggttttcgaagaaacggtcaacggaaggaaactcaccgacatcattaacaacgatcacgagaacgtgaagtacttgcctgggcacaagctgcccgagaacgtcgtggcaatgtctaatctgtctgaggccgtgcaagatgctgacttgctggtcttcgtcatcccccaccaattcatccaccggatttgtgatgagataacaggtcgcgttccaaaaaaggctctcgggattacccttatcaagggtatagatgaaggtccagaggggctcaaattgatttccgatataatcagggaaaagatgggcattgatatttccgtcctcatgggagccaatatagccaacgaagtagccgcagagaaattttgcgagacaaccattggcagcaaggtaatggaaaatggtctgctcttcaaggagctcttacagactccgaacttccgaattaccgtcgtggacgacgctgatacagtagagctgtgcggagcgctgaagaacattgtggcagttggagcaggcttctgcgacggacttcgatgcggtgataatactaaggcagcagtaattcggctgggcctcatggaaatgatagcttttgcgcgaatcttctgcaaagggcaagtcagcacagctaccttcctggagtcctgtggcgtggccgacctcatcacgacttgttatggtggcagaaacaggagggttgcagaggcctttgcgcgcacagggaagactatcgaagagctggagaaggaaatgctgaatggccagaaactgcagggacctcagactagtgctgaggtgtaccgtatcctgaagcagaaaggattgttggacaagttcccactcttcacagctgtgtatcagatctgctatgagagtaggccagtacaagagatgctcagctgtctgcagtcacacccggaacacacttag

SEQ ID NO: 118765 - DNA, 1860 bp, Artificial Sequence
  Description of Artificial Sequence: Synthetic coding sequence
atggagtcaagctcttcctctaactcttacttctctgtcggtcccactagccctagcgcggtcgtcctgctctacagcctatcaaaagaatcgttacaatctgtagacgttttgagggaggaagtgagtgaaatccttgacgagatgagccataaactccgcctgggggccatacgcttttgtgccttcacgctaagcaaggtgttcaaacaaattttctctaaagtgtgcgtcaatgaggagggaatccagaaactccaacgcgccatccaggagcacccagtcgtgctgttgcccagccatcggtcttacattgattttctgatgctcagtttcttgctgtacaactacgaccttccagtcccagttatcgcggccggcatggactttctgggaatgaaaatggtgggcgagctgctgcgaatgagcggcgcattcttcatgaggcgaacatttggcggaaataaactgtactgggccgtcttctctgagtatgtgaagactatgctccggaacggctatgcgccagttgagttcttcttggaggggactcgttcccggtccgctaagactctaactcctaagtttggactgttaaatattgtaatggaacccttttttaaacgggaagtctttgacacttaccttgtacctatttccattagctatgacaagatacttgaggagacactgtacgtatacgagctactgggggtgcctaaacccaaagagagcaccaccgggctgctcaaggcacggaaaattctgagcgagaacttcggctctattcatgtgtactttggtgatcccgtgagcctaaggagcctggccgcaggccggatgtctagatcttcttacaatctggtgcccagatatattccccaaaagcagagtgaagatatgcacgcgtttgtcacagaagtggcctacaagatggagcttctacaaattgaaaacatggtgctgtccccttggactttaatagtggcagtattgttacagaatcgacccagtatggattttgatgccctcgtcgaaaagacgctgtggctcaagggactcactcaggccttcgggggcttcctgatctggcccgacaacaagcccgcggaagaggtggttcccgcctctattcttctgcacagtaacattgcctcactggtcaaggatcaggtgatcctaaaggtcgactctggggactctgaggtcgtagacggtttgatgctgcagcacattactctgctaatgtgttccgcttataggaaccagctgctcaacatctttgtcagaccatcactggtcgctgtggcgctccagatgaccccaggtttcaggaaagaggatgtgtactcctgcttccgatttctgcgggacgtctttgccgatgagttcattttcctgcccggcaacaccctgaaagatttcgaggagggatgttacctgctctgcaagtctgaagctatacaggttacaacaaaagacatcttggttacagagaaaggaaatacagtgttggagttcctcgttgggctgtttaagccatttgttgaatcttaccagataatatgcaaatatctgctttctgaggaggaggaccacttctctgaagaacagtatttggccgccgtgagaaagttcactagtcaattactggaccaaggcacgtctcagtgttatgacgttctgtcctccgacgtgcagaaaaacgctctagcagcatgtgtacggctcggagtcgtggaaaaaaaaaaaatcaacaataattgcatctttaatgtgaatgagccagctaccacgaaactggaggaaatgttgggctgtaaaacccccataggcaaacctgccacagctaaactgtag

SEQ ID NO: 118766 - DNA, 2043 bp, Artificial Sequence
  Description of Artificial Sequence: Synthetic coding sequence
atggagagttcttcctcatctaactcctacttctcagttggcccgaccagcccgtctgccgtggtgctgttgtatagcaaggaactgaaaaaatgggacgaatttgaagacattctggaggagcggagacatgtgtccgacttaaagttcgctatgaaatgttacacccctttagtatacaaaggaattaccccttgtaagccaatcgacattaagtgcagcgtgcttaactctgaggagatccattatgtgatcaaacagctgagcaaagaaagccttcagagtgtggatgtgttaagagaggaggtttctgaaatactggatgaaatgagccataaactgcgccttggagcaatccgcttctgcgcgttcacgttaagcaaggtgtttaaacagatctttagtaaagtctgcgtcaacgaggagggaatccagaagttacagcgcgccattcaggagcatcccgtggtgcttctgccttctcatcgctcctacatagacttcttgatgctcagctttctgctgtacaattatgacctgcctgtgccagtgatagccgcggggatggatttcctcggcatgaagatggttggtgagctcctacgtatgagtggagcattctttatgaggcggaccttcggaggcaacaagctctactgggccgtgttctccgagtatgtgaagacaatgttgaggaacgggtatgcacccgttgagttctttttggaaggcacacggtccagaagcgccaaaacactcacccctaagttcggccttttgaacatcgtcatggagccgttctttaaacgcgaggtctttgatacgtacctggtgcccatctcaatcagctacgataagattttggaggagaccctctatgtctatgaattgctcggtgtgccgaagccaaaagagagtaccactggactgctgaaggccagaaagattttgtcggaaaatttcgggagcatacatgtctactttggggacccggtgtctctgcggagcctcgctgcaggtcgtatgtctagaagctcttacaacctggtgcccagatacatcccccagaaacagtccgaggatatgcatgccttcgttacagaagtggcgtacaagatggagctcctgcagattgagaatatggtcctttctccctggaccctgatcgttgcagtgctactgcagaaccggcccagcatggattttgacgccctggtggagaagactctgtggctcaaaggcctcacgcaggcgtttggtgggttcctgatttggcccgataacaagcctgctgaggaagttgtgcctgcatccattcttctccattcaaacatcgccagtctggtcaaagatcaggtgattctaaaggtcgatagtggcgactcagaagtcgtggacgggctgatgctacagcacattactctcctcatgtgcagtgcttaccggaaccaactgctgaatattttcgtgcggcccagcttggtggccgtggccttacagatgacacccggttttcggaaagaggatgtttatagctgttttcgcttcctgcgcgacgtgttcgcagacgagtttatattcttaccaggtaacacacttaaggattttgaagaaggctgctacctcttgtgcaaatccgaggctatacaggttactaccaaggatatcttggttacagagaagggcaacacagtcctcgaattccttgtgggcctctttaagccatttgtcgagtcctaccaaatcatttgtaaatatttgctgtccgaggaggaagaccacttttccgaggagcagtacctcgccgccgtcaggaaattcacttcgcaactgcttgatcagggaacgtcacagtgctatgatgtgctctcctcagacgtccagaagaatgcacttgcagcttgcgtgcggttaggcgtggtggagaagaagaaaattaacaacaattgtatattcaacgtgaacgagccagctacaacaaagctggaggaaatgctgggctgcaagactcccattggaaagcctgctacagcgaagttgtag

SEQ ID NO: 118767 - DNA, 1764 bp, Artificial Sequence
  Description of Artificial Sequence: Synthetic coding sequence
atggagtcctcctccagctcgaacagctacttctctgtcgggccaacttctcccagcgcagtggtgctgctctacagcaaagaactgaagaaatgggacgagttcgaggacattctggaggagcggcgacacgtctctgacctcaaatttgccatgaagtgttatacaccactcgtgtataaaggtatcacaccctgcaagcccatcgacataaagtgctctgtcttgaattccgaggaaatccattatgtgataaagcagctgtctaaggaaagcctgcagagcgtggatgtccttcgcgaggaggtgagcgaaatcctggatgaaatgtcacataaattgcggttgggagcaattcgcttctgtgcatttacactctccaaagtgttcaagcagatcttttcaaaactacagcgcgcaattcaggaacaccctgtagtcttacttccatctcatagaagctatattgacttcctgatgctctccttcttgctgtataactacgatctgcccgtaccggtaattgcagctggcatggactttcttggcatgaagatggtaggagagcttctgcgtatgagtggagcgtttttcatgcgaagaacttttggcggcaacaagttgtattgggctgtcttctctgagtacgttaaaaccatgctgagaaacggctatgcgcccgttgagtttttcctggagggaactagatctagatctgctaaaacgttgaccccaaagttcggcttgctcaacatagtgatggaaccattcttcaaaagagaagtcttcgatacgtacctcgtccccattagcatcagctatgataagattctggaagagaccctctatgtctatgaactgcttggtgtgccaaagccaaaagagtcaaccaccggtctgctgaaagccaggaagatcttgtcagaaaatttcgggtccatacacgtgtatttcggcgaccccgtgtctctgcgctccttagcagctggcagaatgtcaagatcatcctacaacctcgttccaaggtatataccccaaaaacagagcgaggacatgcatgcttttgtgactgaggttgcgtacaaaatggaactcctgcagattgagaacatggtcctgtccccctggaccctgatcgtggctgttctgcttcagaacaggccgtcaatggacttcgacgcattggtcgagaaaaccctgtggttgaagggactcacacaggccttcgggggtttcctcatctggccagataacaaacccgctgaggaagtagttcctgcttccatcttgctgcacagcaacatcgctagccttgttaaagaccaggtgatcctcaaagtcgacagtggcgactccgaagtcgttgacggcctgatgttacagcatatcaccctcttgatgtgtagcgcttatcgcaatcaacttctcaatatctttgtgcggccaagtctggtcgctgtggctttgcagatgacacccggcttcaggaaagaggacgtgtacagttgctttaggtttctgcgagacgtgtttgctgacgagtttatctttttacccggaaacactctgaaagattttgaggaagggtgctatttgctttgcaaatccgaggccatacaggtgaccaccaaagatatattggtgacagaaaaggggaatacagtacttgaattcctcgtgggccttttcaaaccctttgtggagtcttaccagatcatttgcaaatacctattatccgaagaagaagatcatttctccgagtag

SEQ ID NO: 118768 - DNA, 669 bp, Artificial Sequence
  Description of Artificial Sequence: Synthetic coding sequence
atggaaagttcctcctccagcaattcctattttagcgtggggcctacctctccgtctgccgtggtgctcctgtactccctgagtaaagaatcgttgcagtcagtcgatgtacttcgtgaagaggtcagcgaaatcctggacgaaatgtcccacaaactgcgtttaggagcaattagattctgtgcttttacccttagcaaagtgttcaagcagatcttctctaaggtctgcgtaaacgaagagggaatccagaaactccagcgcgctattcaggagcacccagttgtactactgccgtctcaccgcagttacatagatttcctaatgctgagcttcctgctctacaattacgatctaccagtgccagtcatagcagctgggatggatttcctgggtatgaaaatggtaggtgagcttctgcgtatgagtggcgcctttttcatgagaagaacatttgggggaaataaactgtactgggcagttttttccgagtacgtaaaaactatgctgcgcaatggatacgcccccgtggaattcttcttggaaggcactcgctccaggtctgccaagactctcacacctaagtttgggctgttaaacatagttatggagccattctttaagcgagaggttttcgacacgtacctagtacctatttccataagctag

SEQ ID NO: 118769 - DNA, 870 bp, Artificial Sequence
  Description of Artificial Sequence: Synthetic coding sequence
atgtcaaggaattctcgtaagaccattggtaaagtcagagtggactacattataatcaaaccattacctggctactcatgcgacatgaagagctccttttccaaatactggaaacccagaattcctttagacgtagggcatcggggtgccggcaactcgaccaccaccgctcagttggccaaggtccaggagaacactatcgcttctcttcggaatgccgcctcacacggcgcggccttcgtggagtttgatgtacatttgagtaaggatttcgtccccgtggtctaccatgacttgacctgttgtctaacgatgaaaaaaaacctgtggtttcgccggaagattccgttccaaaagataagccacttcctcctgttgaggtgggtccggcagaagcaaaacaagtatccaatcttattcctcacccagggaaagtctgagatatatcccgagctaatggatctccgcagtagaacaactccaatcgccatgagtttcgctcagttcgaaaacctgctgggcataaatgttcacactgaagatctgttgcgaaatcccagctacatacaggaagccaaggccaaaggattggttattttctgctggggtgatgacacaaacgaccccgagaacagacgaaaactgaaggagctgggcgtgaatggacttatctatgatcggatttacgattggatgcccgaacagccgaacatattccaggtggagcagctggaaaggctaaagcaggaactcccagaactgaagtcttgcctatgcccaacagtttcccgattcgtaccttcctctctgtgcggagagagtgatatccacgtagacgccaatggaatcgataacgtggagaatgcctag

SEQ ID NO: 118770 - DNA, 2019 bp, Artificial Sequence
  Description of Artificial Sequence: Synthetic coding sequence
atgaccccttcacaggtggcgttcgagattagaggcactctgctgcctggggaggtgttcgcaatctgcggtagctgtgatgccctgggaaactggaatccacaaaatgctgtggcgctgctccccgagaatgatacaggtgagtccatgctgtggaaagccaccatcgttttgtctcggggcgtcagcgtacagtaccgctatttcaaagggtatttccttgagccgaaaactatcgggggaccctgccaggtcattgtgcataaatgggaaacacatttacagcccaggagtataactccactggagtcggaaatcatcatcgacgacggccagtttggcatccacaatggagtggagacccttgactccgggtggctgacatgccagactgaaattcgcctcaggttgcactatagtgagaagcctcctgtctctatcaccaagaaaaaactgaaaaagtctcgttttagagtgaagctgacattagagggtctggaagaggatgatgatgatagagtttcccccaccgtgctccataagatgagcaatagtctggaaatctcactgatttccgataacgagttcaagtgtcggcactcccagccagaatgcggctatgggctgcagcctgaccgttggaccgagtactcaatccagacgatggaaccagataacctcgaacttattttcgatttcttcgaagaggacttatctgaacatgttgttcagggtgatgccttgcctggccacgttggcaccgcttgccttctctccagtactattgcggagtctgggaagagtgctggaatccttaccttaccaattatgtcccgcaatagccgaaaaactattggcaaggtgcgcgtagactacattattatcaagcccctgccgggatatagttgtgatatgaaaagttctttctccaaatactggaagccacgcatacccctggatgtcgggcatcgaggtgcaggcaattcaaccacaacggcacagctggctaaagtgcaggaaaacacgatcgccagcctaagaaacgctgctagccatggcgccgctttcgtggaatttgatgtgcacctgtcaaaggattttgtgccggtcgtctaccatgatctaacctgctgcctaaccatgaagaagaaattcgatgccgatccggttgagctgttcgagattcctgtcaaagagctcacattcgaccaactacagctgctgaagctgactcacgtgacagcccttaagtccaaagacaggaaagaatctgtggttcaagaagaaaacagcttttccgagaatcagccatttccaagcctgaagatggtgttagagtctctgccagaggacgtagggtttaacatcgagattaagtggatttgccagcaacgggacggcatgtgggatgggaacctttccacatatttcgacatgaatctgtttctggacattattctgaaaaccgtgctggaaaattctggaaagcgtcgaattgtattttctagttttgatgcggacatatgcacaatggtaagacagaaacagaataagtatcccatcctgtttcttacacagggtaagtctgagatctaccctgaattgatggatctccgatcccggacaactcccatcgcgatgagctttgcccagttcgagaatctgctgggtatcaacgtccataccgaggaccttttgaggaacccctcctatatacaggaagctaaggcaaaaggattggtgattttttgttggggtgatgataccaacgatcctgagaatcggcggaagctgaaagagctgggggttaacggactcatctacgacagaatatacgattggatgccggaacagccaaatatatttcaagtggagcagctggaacgtctgaaacaggaacttcctgagctcaagagctgcctgtgtccaacagtgagcagatttgtgcctagtagcctttgtggcgaaagcgacatccacgtagatgctaatggcatagataatgtcgagaacgcgtag

SEQ ID NO: 118771 - DNA, 795 bp, Artificial Sequence
  Description of Artificial Sequence: Synthetic coding sequence
tagtgcgatatgaaatcatcatttagcaaatattggaaacctaggattcccttagacgtagggcacaggggcgctggcaacagtacaactactgcccaactggccaaagttcaggagaatactatcgccagtctgcggaacgccgcctcccatggcgcagctttcgttgagtttgacgtccacctttccaaggatttcgtccccgttgtgtaccacgacttaacttgttgtctcacaatgaagaaaaacctctggtttcgacggaaaataccatttcagaagattagccactttcttctgctgcgatgggtgcgccagaagcagaataaataccccatccttttccttacccaaggcaagtctgagatctacccggagctgatggatttacgtagccggacgacccctatagctatgtccttcgctcagttcgagaacctgttgggcatcaacgtacacaccgaagaccttctgcggaacccttcgtacatccaggaggcaaaggcgaaaggtttagttattttctgctggggggatgacacgaacgaccccgaaaatcgtaggaagcttaaagaactgggcgtgaacggtttgatttatgatcgaatatacgactggatgcccgagcaacctaacatctttcaggttgagcagctggaaagactgaagcaggagctcccagagttgaagtcatgtctatgtcccacagtctcccgcttcgtgccctcttctctgtgcggggaatccgacatccatgtggatgcgaatggtattgataacgtagagaacgcctag

SEQ ID NO: 118772 - DNA, 996 bp, Artificial Sequence
  Description of Artificial Sequence: Synthetic coding sequence
atgtggctttgggaggatcaggggggcttactgggtcctttcagctttttgttgcttgtcctgctgctggtgacacggagtccagtgaatgcctgcctcctgacaggctccttgttcgtgctcctgagagtattctctttcgagccagtcccatcctgcagggccctgcaggtactaaaacccagagatcggatcagcgccatcgcccacaggggcggatctcatgatgctcccgagaatacgctggccgccatccggcaagctgctaaaaatggagcaacgggtgttgaactcgacatagaatttacgtcagacggaatacccgtgctaatgcatgacaataccgtggacaggaccaccgatggtaccgggcgtctttgcgacctgacctttgagcagatcagaaaacttaacccagcagccaatcaccgactgagaaatgattttcccgacgaaaagatccccacactgcgggaggctgtcgccgagtgtctcaaccacaaccttacaattttcttcgatgtgaaagggcatgcgcacaaggccacagaagctctcaaaaaaatgtatatggaatttccacagctatacaataacagtgtggtgtgctccttcctgccagaggtgatttataagatgcgacagaccgaccgggacgtgataacagccctcactcacaggccctggagtctgtcacatactggcgatgggaaaccccgctacgacacattctggaagcatttcatctttgttatgatggatatcctcctggactggagcatgcataacattctctggtacctgtgcggtatcagcgcatttcttatgcaaaaggactttgtctcccccgcctatctcaagaaatggagcgctaaggggatccaggtagtcgggtggaccgtgaatacatttgacgaaaaatcatattacgagtcccacctcggatctagttacatcaccgacagtatggttgaggattgcgaacctcacttttag

SEQ ID NO: 118773 - DNA, 1818 bp, Artificial Sequence
  Description of Artificial Sequence: Synthetic coding sequence
atggttagacaccagccattgcagtattacgaacctcaactctgtctgagctgccttactggtatctacggctgccggtggaaacgctatcagcgctcacatgatgataccacaccctgggaaaggttgtggttcctgcttctgacttttacctttggactaacactaacttggctgtatttctggtgggaagttcacaacgactacgacgaattcaattggtacctatacaatagaatgggatattggtccgactggccggtgcccatccttgtgaccacagctgccgctttcgcctacatagcaggcctgcttgtgctggccctgtgccacatcgcagtgggccagcagatgaatctccattggctccataaaatcggtttagtagttatcttagcctccacggtcgtggcaatgagcgctgttgctcaattatgggaagacgaatgggaggttttgcttatcagcttgcagggtacagcccctttcctccacgttggagccgtcgctgccgttaccatgctttcctggattgtcgccggccagttcgccagagccgaaagaactagctcccaggttacaatactgtgcaccttttttacagtagtctttgcactgtatctagctccgttaacgataagcagcccgtgcatcatggaaaaaaaagacctgggccctaaacctgctctcattggacacagaggggcgccgatgttagcacccgaacacactctaatgtcctttcggaaggctctggaacagaagctctacggcctgcaggcggatattacgatatccttggatggcgtcccatttctcatgcatgatacgactctcagaaggacaaccaacgttgaggaggaatttccagagctggcccgccgccctgcaagcatgctaaactggaccaccctgcagcggttgaatgccggacaatggttcctgaagactgacccattttggaccgccagtagtttgagcccctctgaccacagagaggctcaaaaccaatctatctgttctctcgcggaactgcttgagctcgccaagggtaatgccaccctgttgttgaacctgcgcgatcctccacgggagcacccatatcggtcgtctttcatcaatgttaccctcgaggccgtcctgcattctgggttcccgcaacaccaggtgatgtggctaccgtcacgccagagacccctggtccgtaaggtggcgcctggcttccagcaaacttccggatccaaagaagcagtggcatcacttcggagaggacacattcagcgtctgaatctccgctacacacaggtgtcccgccaggagcttagagattatgctagctggaaccttagcgtcaatctgtatacagttaatgctccatggctcttcagtttgttgtggtgcgcgggggtgccttccgtcacctccgataactcacatgctttgtcacaagtgccgtcgccactctggataatgccccctgatgaatattgtctgatgtgggtaaccgcagacctcgtgtcgttcacactcatcgtgggcatcttcgtgctgcagaaatggcggctcggcggaattcgatcatacaatccagagcagattatgctgtcggccgccgtcaggaggacttccagggacgtctctatcatgaaggagaagctgattttcagcgaaatttccgatggggtggaggtgtccgatgtcctgagcgtgtgttcagacaactcttatgacacttatgctaactctactgccacgccggtaggacccaggggagggggttctcacacaaaaacgctgatcgagaggtctggacggtag

SEQ ID NO: 118774 - DNA, 1461 bp, Artificial Sequence
  Description of Artificial Sequence: Synthetic coding sequence
atggtgcggcaccagccattacagtattacgagcctcagctgtgtctttcatgtttgaccggaatctatggatgccgctggaaaaggtatcagagaagccatgacgatacaacacccgggaccgctccttttctgcacgttggcgcagttgcagctgtaacgatgctgagctggatcgttgcaggacagttcgctcgggcggaacgtacttctagccaggtgaccattctctgcactttcttcacggtggtcttcgcattatatctggctcctttaactatctcttcaccctgcataatggaaaagaaagaccttggcccaaaaccagccctgattggtcatcgtggtgcccccatgcttgcgcccgagcataccctcatgtccttccgcaaggctctggaacagaaattatacgggctgcaagccgacatcacgatttccctcgacggagtgcctttcctgatgcacgatactacattaagaagaactaccaacgtggaggaggagtttcccgaactggccaggaggcctgcaagcatgttaaactggaccacgttgcagcgtctaaacgccgggcagtggttcctgaaaacggacccattctggactgcaagcagtctgtcaccgtctgaccacagagaggcccagaatcagtccatctgtagcctggcggaactactggagctcgcaaaaggtaacgctacactcctgctaaatctgagggatcctcctagagagcacccttaccggagttcctttataaatgtcaccctggaagcagtcttgcattctgggtttcctcaacatcaggtgatgtggctcccctctcgacagaggcccctcgtgaggaaggtcgcccccggctttcagcagacctcgggctcaaaggaagccgtggcttccttgaggcgaggccacattcagcgactcaatttgagatatacacaggtgtccaggcaagaactgagggactacgcttcttggaacctttctgtgaacctgtatacggtgaacgctccatggttgtttagcctgctttggtgtgctggagtgccctccgtcacaagcgacaattcgcatgccttatcgcaggtcccctcgcccctctggatcatgccccctgatgagtattgtttaatgtgggtgacggcggatctggtctcgttcactctcattgttggcatcttcgtcctacagaaatggcgcctgggaggaatacgaagttataatccagagcagataatgttgtccgccgcagtcaggcgaactagtagagatgtcagtatcatgaaggaaaagctcatcttcagtgagatctcagatggcgtggaggtgtccgacgttttgtcggtttgctccgataactcctacgatacttatgccaattctacagccacgccagtgggccctagaggcggaggctcgcacactaagactctgatagagaggagtgggaggtag

SEQ ID NO: 118775 - DNA, 408 bp, Artificial Sequence
  Description of Artificial Sequence: Synthetic coding sequence
atggtgcgtcaccaacccctccagtactatgaaccgcagctgtgcctgtcgtgcctgacgggcatctacggctgccggtggaaacgctaccagcggtcgcatgatgacaccactccctgggagaggctctggttcctgctattaacatttacctttgggttaactttgacttggctgtacttttggtgggaggtgcacaacgactacgatgagtttaactggtatctctataaccgaatgggttactggagcgactggcccgttcccatcctcgtgaccaccgccgccgccttcgcttacattgccggccttctggtgttggctttatgccacatcgccgtaggacagcaaatgaatctccattggctgcacaaagcctcatcaggcctaccacttagccccttgtag

SEQ ID NO: 118776 - DNA, 1404 bp, Artificial Sequence
  Description of Artificial Sequence: Synthetic coding sequence
atgagcgcagtagctcagctttgggaagatgagtgggaagtgctacttatttctctgcagggaacagctccttttctgcacgtgggcgccgtcgcagcagtcaccatgctctcatggattgtggccggccaatttgctagggcagagcggacaagtagccaggtcaccatactctgtacattctttaccgtggttttcgcgctttacctggctcctttaaccatttcctcaccctgcatcatggagaaaaaggaccttggccccaagcccgccttaattgggcaccgcggtgcacccatgctggcaccagaacacactcttatgagcttccggaaggccctggaacaaaaattgtacggcttgcaggcagacataaccattagcctggacggagtaccatttctgatgcatgatacaacccttcgtagaactaccaacgtcgaggaggagttccctgagctggcccgtcggccggcaagtatgctgaactggacaacactacaacggctcaatgccggtcagtggttcctcaaaactgatcccttctggactgctagcagcctgtccccttctgaccaccgcgaagcacagaaccagtctatctgttcgctagcagaactcctggagctggccaagggcaatgctactctgctgcttaacctgagagatcccccccgcgaacatccgtatcggtcctcgtttatcaatgtgaccctggaggcagtcttacacagcggtttcccacagcaccaggttatgtggttgccttccaggcaaagaccgctcgtgcgtaaggtcgcacctggattccagcagacatccgggagcaaagaagccgtcgcctctttacgccggggccacatccagagacttaatctcagatacacccaggtctctaggcaggagttgagggactacgcctcgtggaacctcagcgtgaatctctacaccgtcaacgcgccatggctgttctctctactgtggtgtgcaggcgttcccagtgtcactagtgataattcccatgcactgtcccaggttccgtctcccctttggatcatgccccccgatgagtactgtctgatgtgggtcacagctgatctcgtgtcatttactctgatagttgggatattcgttctgcagaagtggcggctgggtggcatacgcagctacaatcctgagcagatcatgctatctgcggccgtccgtcgtacctcacgcgacgtgagcatcatgaaagagaaactcattttctccgagatctctgatggggttgaggtgtctgacgtcctaagcgtttgtagcgacaactcctatgatacgtacgcaaactccaccgctactcctgtgggccccagagggggcggcagccatacgaagaccctaattgagagatctggaagatag

SEQ ID NO: 118777 - DNA, 1818 bp, Artificial Sequence
  Description of Artificial Sequence: Synthetic coding sequence
atggtgcgccaccaaccactgcagtattacgagccgcagctctgtctgagctgtctcaccggaatctacgggtgcaggtggaaacgatatcagcgctcccacgatgatactacaccctgggagcggctgtggtttctattactgacctttactttcggactgacccttacttggctgtacttctggtgggaggtgcataacgactatgacgaatttaactggtacttatataaccgtatggggtattggtcagattggcccgtgcccatattggtgactacagccgctgcctttgcctacattgctgggctcttggtgctggcactgtgccatatcgcagtgggtcaacagatgaatctccattggctccacaaaatcggcttagttgtcatcctcgcatcgacagtggttgctatgtctgcagtagcacagttatgggaagatgaatgggaagtgttacttatctctctccagggcacagcccccttcctgcacgtcggggccgtagcagcagtcactatgctgagttggatagtggcgggccagtttgctcgtgctgagcgcacttcaagccaggtcaccatcctgtgcaccttcttcaccgtggtgttcgcactgtatctcgctcccctgacaatttctagcccctgtatcatggaaaagaaagacttgggacctaaaccagccctgatcggccatagaggcgctcctatgctggcaccagagcacactctgatgtctttccggaaagcacttgaacaaaagctgtatggcttgcaagccgatattacgataagcctggatggggttcctttcttgatgcacgacacaacattaagacgcacaaccaacgtggaagaggaattccctgaactggccaggcggcccgcatctatgttgaattggacaactcttcagaggctgaatgccgggcagtggtttttgaagactgatcccttttggacggcctcatccctcagccctagcgatcacagagaggcacaaaaccagagtatatgttctctggccgagctcctcgagctggctaaggggaacgcgacccttcttctgaacctgagagatcccccaagagagcacccttaccggtcctccttcataaatgtgactctggaggcggtgttgcactctggctttccacagcatcaggtgatgtggctaccttcccgtcaacgtcccctagtaagaaaggtggcaccaggctttcaacaaacaagcggatccaaagaggccgtggctagtctgcggcgaggtcatatacagcggcttaacctaagatatacccaggtgagcaggcaggaactgcgcgattacgcatcgtggaatctctccgtaaacctctataccgttaatgcaccttggctgtttagcctgctttggtgtgccggggtaccttctgttacatccgataacagtcacgccctcagtcaggtgccgtcgcccctgtggatcatgcctcccgatgagtattgtctgatgtgggtcacagcagatcttgtatcctttactctgattgtcggtatatttgtgctgcaaaaatggcggctgggaggcattcgatcttacaacccagagcagattatgctctccgcggccgtgagacgtacatctagggacgtctccatcatgaaggagaagctgatattttcagagatttctgatggcgtggaagttagtgatgtgttatctgtgtgctcagacaactcttacgatacatatgcaaatagtactgctacccctgtagggcccagaggtggcgggagccacaccaaaacccttatcgagcgtagcggtaggtag

SEQ ID NO: 118778 - DNA, 222 bp, Artificial Sequence
  Description of Artificial Sequence: Synthetic coding sequence
atggttcgtcatcaacctctgcagtactatgagccgcagctgtgtctgtcttgcttgactgggatctacggctgccgttggaagcggtatcagaggagtcatgacgacacaaccccatgggagcggctctggtttctgcttcttacatttacatttggactgaccctgacctggctgtatttttggtgggaggtgcataatgactatgacgagtttaactag

SEQ ID NO: 118779 - DNA, 1461 bp, Artificial Sequence
  Description of Artificial Sequence: Synthetic coding sequence
atggtgaggcaccagcccttacagtactacgaaccacaactgtgcctgtcctgtctcacagggatttacggatgtcggtggaagagatatcaaagaagccacgacgatactactccaggtacagcaccctttctccatgtgggcgctgtggccgctgtcacgatgctgagctggatcgtcgcgggacagttcgccagggctgaaaggacaagcagccaggtgacaattctctgtaccttttttaccgtagttttcgctctctatctggcaccattaactatcagttctccctgtattatggaaaagaaggatctcggccccaagcccgccttgattggacacagaggagcccccatgctcgccccagagcatactttaatgtctttccggaaagcactggagcaaaagttgtacggactgcaggcggacattaccattagtctggacggagtacctttccttatgcatgacaccacactccggcggactacaaatgttgaggaggaattcccagagctggctagaagaccagcctccatgctcaattggaccaccctgcaacggctgaacgccggccaatggttcctaaagaccgaccccttttggacagccagcagcttgtcccccagcgaccacagggaagctcaaaaccagagcatatgcagcttagcggagctgcttgaactggcgaagggaaatgccacccttcttcttaacctgcgtgacccaccccgggagcacccatacaggtcctcattcatcaatgtaactctcgaagcggtgctgcacagtgggttccctcagcaccaggtgatgtggctgccctctagacagcgccccttagttaggaaggtggctccaggattccagcagacatcaggctccaaagaggccgttgcctccctgaggcgggggcatatccagcgactgaacctgagatatacacaggtatctagacaagagcttcgggattacgcatcatggaacctgagtgtaaacctctacaccgtcaacgcgccctggctttttagtctgctctggtgtgcgggagtaccctctgtgacgagcgacaactctcatgctctttctcaggtcccctcaccattgtggattatgccgcctgacgaatactgtttgatgtgggtcaccgccgacctggtgagctttactctaatagtcgggatatttgtccttcagaagtggaggttgggcggaattagaagctacaaccctgagcaaattatgctcagtgctgccgtccggcgcacttctagagatgtatcaattatgaaggaaaagttgatcttctccgagatttccgatggagtggaagtgagtgatgtgctcagcgtatgcagcgataacagctatgatacatatgctaacagcaccgccacacccgtggggcctagagggggtggaagtcacacgaaaactctcatcgagcgctcaggccggtag

SEQ ID NO: 118780 - DNA, 1083 bp, Artificial Sequence
  Description of Artificial Sequence: Synthetic coding sequence
atgagctttcggaaggcgcttgaacaaaagctgtacggactacaggccgacattactatcagtctcgacggagtgcctttcttgatgcacgatacaaccctgagacgaaccaccaatgttgaggaagaatttcctgagttggcccggcgccccgcttccatgctaaattggaccactctacagcggctgaatgccggacagtggtttctgaagaccgatcccttttggactgcctcatccctatcgcccagcgatcaccgtgaagctcaaaaccagtccatctgcagccttgccgaactactggagctcgccaagggaaatgcaactctgctgctcaacctcagagatccccccagggagcatccatatcgcagctctttcattaacgtcactctcgaggctgtgctgcatagcggattccctcaacatcaggtgatgtggctgccttctcggcagcgccctctggtcagaaaggtcgcccccggatttcagcagacaagtggctcaaaggaggccgttgcgtctttacggagagggcatatccagcgcctcaacctgaggtacacccaggtcagcagacaagagcttcgcgattatgcttcctggaacctaagcgtaaatttgtacactgtcaatgcaccttggctcttttctctgctgtggtgtgcaggtgtgccctccgtgacttccgacaatagccacgccctgagccaggtaccctctcccttgtggatcatgccaccagatgagtactgtttgatgtgggtgacagctgacctggtgagctttacacttattgtggggatctttgtgctgcagaagtggcgcctcggtggaatccggagctataatccagagcagatcatgctctcagcagcagtgaggcggacttcacgcgacgtcagcattatgaaggagaaactcatttttagcgagattagcgatggtgtcgaggtgtcagatgtgctcagcgtgtgctctgacaattcctacgatacttacgccaacagcactgccacacccgtggggccgcgaggcggcgggagccacacgaaaactttaatcgagcgaagtggacggtag

SEQ ID NO: 118781 - DNA, 1272 bp, Artificial Sequence
  Description of Artificial Sequence: Synthetic coding sequence
atgctacgcgtccgctgtctccgaggcggcagtagaggcgccgaagctgtccactacatcggttccaggctggggaggactctcacaggatgggttcagagaaccttccagagtacccaggcagctaccgctagcagtaggaatagttgcgcagcggatgataaggcaaccgagcctctccccaaggactgcccagtgagctcatacaatgaatgggatcctctggaggaagtcatcgtcgggcgcgctgagaatgcttgtgttcccccatttacaattgaggtgaaagccaacacgtacgagaagtactggcccttttatcagaagcagggaggccattatttccctaaggatcatctgaagaaggccgtggccgaaatagaagaaatgtgtaatatccttaagacagaaggcgttactgttcggaggcccgacccaattgattggagtctcaagtacaaaacacccgacttcgagtccaccggtctgtacagcgccatgccccgggatatcctgatcgttgtcggtaacgaaattattgaggcccctatggcgtggcgctcccgcttttttgaataccgggcttacaggtccatcattaaagattattttcatcgcggggcgaagtggactaccgctccaaagcctaccatggccgacgagctgtataaccaggactaccctattcacagcgtggaagatagacacaagctggccgctcaggggaaattcgtgaccaccgagttcgaaccatgcttcgatgccgctgacttcatcagagccggaagagacatttttgcgcaacgctctcaggttactaactatctcggaatcgaatggatgcgtagacacctagcccctgactatcgggtccacattataagcttcaaagatcccaaccccatgcacatcgatgcgacatttaatataattgggcctgggattgtactgtcaaaccctgaccgcccctgccaccaaatcgatctgtttaaaaaggccggctggaccatcataaccccaccaacaccgatcatccctgacgatcaccctctttggatgagcagcaagtggttgtcaatgaacgtgctgatgctggatgaaaagcgggtcatggtcgacgcaaatgaagttccaattcagaagatgttcgaaaagctgggcatcacaactatcaaggtgaacattcggaacgcaaactcgcttggaggcggtttccactgctggacctgcgatgtgagaaggcggggaaccctgcagagttatctcgactag

SEQ ID NO: 118782 - DNA, 1176 bp, Artificial Sequence
  Description of Artificial Sequence: Synthetic coding sequence
atgctccgtgtcaggtgcctgagaggcggcagccgcggggccgaggccgtacactacattggcagcaggctcggccgcacgttaactggctgggtgcagcggacatttcagagcactcaggccgccacagcctcaagcagaaactcgtgtgccgccgacgataaggccacagaacctctgcccaaggattgcccagtaagcagttacaatgaatgggatccactggaagaggtcatcgtgggtcgagcggaaaacgcttgcgtgcccccatttaccattgaggttaaagccaatacctacgagaaatactggcctttttaccagaagcagggcggacactactttccgaaagatcacctgaaaaaggcagtcgctgagattgaggagatgtgtaatatcctgaaaactgaaggcgtgaccgtgagaagacctgacccaatcgactggtctctgaaatataaaacaccggacttcgaatcaacaggactgtattccgctatgcctcgggacattctgattgtcgttggtaatgaaatcatagaggcccctatggcctggcgaagtagatttttcgagtatagagcatatcgctctattattaaggattatttccatcgcggtgctaaatggactacagccccgaagccgaccatggctgatgagctctataatcaggattacccaatccattcagtggaggatcgacacaaactcgcagcgcaaggtaagtttgtaacaacagagttcgagccttgttttgatgcagccgatttcattcgcgcaggcagagatatctttgcacagagaagtcaggtgacaaactacctgggcatcgaatggatgagacggcacctggctcctgattaccgtgtacatatcatatccttcaaagacccaaatccaatgcatattgacgctacgttcaacattattggaccaggcatagtcctctccaatcccgaccgtccgtgtcatcaaatcgatctttttaaaaaagcgggctggacgatcatcaccccgcccacacccattattccagatgatcaccccctgtggatgtcatcgaagtggctgagtatgaatgtgcttatgctcgatgaaaaacgtgttatggtggacgctaacgaagtgcctatccagaaaatgttcgagaaactggggatgtataataagtag

SEQ ID NO: 118783 - DNA, 1260 bp, Artificial Sequence
  Description of Artificial Sequence: Synthetic coding sequence
atgtggcctgggaacgcgtggcgagcggccctcttttgggtgcctaggggaaggcgagctcaaagcgcattagctcagctccgaggaattctggaaggtgagctggaaggcattcggggcgcaggtacctggaagagcgagagagtgatcacctccaggcagggccctcacatcagggtggatggggtatccgggggaatactgaacttctgcgctaacaactacttgggcttgtcctcacaccctgaggtgatccaggcgggtcttcaggccctcgaggagttcggtgccggcttaagttctgtgagattcatttgcggcacacagtctattcacaaaaatctagaggctaagatagctcgctttcatcagagagaggatgcaatcctgtatccttcttgttacgatgctaacgcgggtctgttcgaggcactgctgacgccagaggacgcagtgctgtctgatgaattgaaccatgcgtctattatcgatgggattcgtctgtgcaaagcacacaaataccgatacaggcatctggatatggctgatctcgaggctaaattacaggaagctcagaaacacaggctcaggctggtcgcaactgacggcgctttttcaatggatggcgatatcgcccccctccaggagatatgttgcctggcctcacgctatggagccttagtgttcatggacgagtgtcatgcaacaggtttcctaggcccgacgggcagaggcaccgacgagctgttgggggtgatggaccaggtgaccatcatcaactctaccctcggcaaggcgctcgggggcgcgtctggcgggtacaccacggggcccggacccctggtctcgttgctgcgacaaagggcccgaccctatctgttttctaacagtctgccgcccgccgtcgtgggctgtgctagcaaagccttggatttgctgatgggatctaacactatcgtccagagcatggccgccaagactcagcgatttcggtctaaaatggaagccgcagggttcacaatttccggtgccagccatccaatctgcccagtgatgcttggagacgcaagactggcttcaagaatggctgatgatatgttgaaaaggggaatctttgttatcgggttcagctatccagtggtcccaaaaggcaaggcccggatccgcgtacagatttcagcagtccatagcgaggaggatatcgatcgctgtgtcgaagcttttgttgaagtcggtcggctccacggagccctcccctag

SEQ ID NO: 118784 - DNA, 1338 bp, Artificial Sequence
  Description of Artificial Sequence: Synthetic coding sequence
atgtggcctggaaatgcctggagggccgccctcttctgggtaccacggggccgccgggctcagagcgcgcttgcacaactcagggggattctggagggcgaattggaggggatccggggggcaggaacttggaaaagtgagcgcgtcattaccagccggcaggggcctcacatccgtgtcgacggcgtgtcggggggacccgggacggtcatttttccaggcttgccgcttcctcacctctcatgctgcattcatctgttgtcttttacttccgggattcttaacttctgtgccaataactacctgggactcagtagtcatcctgaggtgattcaggctggtctgcaggccctcgaggagtttggggctgggctttcgtctgttaggttcatctgtggaactcagagcatacataaaaatcttgaagctaagatcgctagattccaccagagggaagacgcgattctgtacccctcgtgttatgacgctaacgcgggcctgttcgaggcgttgctgacccccgaggacgccgtgctgtcagacgagcttaatcacgcgtctattattgacgggatccgactctgtaaggcccataaatacagatacagacatctggacatggcagacctggaggccaagctgcaagaagctcagaaacaccgactgaggctggtggcaacagatggagccttctctatggatggagacattgcaccgttgcaggagatctgctgtttagccagcaggtacggggcactggtgttcatggacgagtgtcatgctactgggttcctggggccaacgggacgtggaacagatgagttactgggcgttatggaccaagtgactatcataaatagcacactcggtaaggcactgggaggggcttccgggggttatacgacaggaccaggacccctggtgtccctgctgagacaacgcgccagaccctacctgttctcaaactctctccctcccgcagtggtgggctgtgcatccaaggcgctggacttactgatgggctctaatacgatcgtacagagcatggcagccaagacccagaggttccgaagcaaaatggaggcggccggtttcaccatctcaggggcctcccaccccatatgtcccgtgatgcttggcgatgcccggctcgcctccagaatggctgatgacatgctgaaacggggcatcttcgtgatcggcttctcatatcccgtggtcccgaagggcaaggcaaggattagagtgcagattagtgccgtacacagtgaagaggacattgaccggtgcgtggaagcttttgtcgaggtgggacggctgcacggggcattaccgtag

SEQ ID NO: 118785 - DNA, 744 bp, Artificial Sequence
  Description of Artificial Sequence: Synthetic coding sequence
atgtggcctggcaacgcatggagggctgctctgttttgggttccccgtggacgcagggctcagtcagcacttgcacagttgagaggtattcttgaaggcgagctggaaggtatccgtggtgcaggaacctggaaatctgagagagtgatcacctcacggcaaggcccccacattcgcgttgacggagtgtctggtgggcctggtactgtcatcttcccaggcctgcccctgccccatttgtcttgctgcattcatctgttgagtttcacttcaggaattctaaacttctgtgctaacaactacctgggcctgtccagtcatcccgaggttatacaagccggactgcaagctctggaagaattcggtgccgggctgagttccgtccgcttcatctgtggtacccagtccatacataagaacctcgaggctaaaatcgccagattccatcagcgagaggatgcaattttatatccctcatgctatgatgccaatgcagggctgttcgaagccttgctgacgcctgaggatgcagtactgagcgatgaattaaatcacgcttctatcatagacggtattagattatgcaaggcccacaaatatagatatcgtcatctggacatggctgacctggaggcgaaactgcaggaagcacagaagcaccgcctcagactagtggcaacagacggcgccttccacggctggcggcaccgaactcccgccggcgacctgctcccacggctctag

SEQ ID NO: 118786 - DNA, 522 bp, Artificial Sequence
  Description of Artificial Sequence: Synthetic coding sequence
atggctctgcgagtggtgaggtctgtgcgggctctgctgtgcaccctgagggctgtcccaagtcccgccgctccttgccctccaagaccctggcagcttggtgtcggagccgttaggacccttcgcactggccccgccctgctctcagtacgcaagtttactgagaagcatgagtgggttaccacagagaacggaattggcaccgtgggaatcagcaatttcgcacaggaagcattgggcgatgtagtgtactgtagcctgcctgaagtaggcaccaagttaaacaagcaggacgagtttggggctctggagagcgtgaaggccgcctctgaactgtattcacctctgtccggcgaagttaccgagatcaatgaagcccttgcagagaacccggggctcgtgaataaatcatgttacgaggatggttggctgattaaaatgacgttgagcaacccatctgaactcgatgagctgatgagcgaagaggcatacgagaagtacataaagtcaattgaagagtag

SEQ ID NO: 118787 - DNA, 3063 bp, Artificial Sequence
  Description of Artificial Sequence: Synthetic coding sequence
atgcagtcatgtgcccgcgcctgggggctaaggttgggccggggcgtcggaggtggccggcgccttgcaggtgggtctggaccttgttgggccccccgtagcagggattcctcctctggcggcggcgactccgctgcagcgggagcatctagactgctggagaggctgttaccccggcatgacgattttgcccggcggcacatcggtccgggagataaggaccagagagagatgctgcagacgctcgggcttgccagcatagatgagctaattgagaagaccgtcccagccaacatccggctgaagcgaccactaaagatggaggatccagtatgtgaaaatgaaattctcgccactttgcatgcgatctcaagtaagaaccagatttggcggagctatatcgggatgggatactacaattgttcggtaccgcaaaccatccttagaaacttattggaaaactccgggtggataactcagtacaccccataccagccagaagtgtctcagggccgccttgagagtctgctgaactatcagactatggtgtgcgatattactggcctggatatggccaacgcatcactgctggacgagggaaccgccgctgccgaggccctgcagctttgctatagacacaataaacgccgaaaatttctcgtggaccctaggtgtcacccacagaccatagcggtcgtacagacccgggctaagtatacgggcgtgcttaccgagctcaagctgccctgcgagatggattttagcgggaaagacgtctctggcgtgctgtttcagtatcctgacaccgaaggtaaagtggaggattttacagaactggtggaaagggctcaccagagtgggagtttggcctgctgcgcgaccgatttactggccctctgtatcctgcgcccccctggcgagtttggcgtggatattgctctggggagctcacagcgattcggggtgcccctgggctatggaggtcctcacgccgctttctttgcagtgcgagagagcctggtcagaatgatgccagggaggatggtgggagtgacaagggatgccacagggaaggaggtgtacaggctcgctctgcagacaagggagcagcacatcaggagagacaaggccacttctaatatctgtactgcccaggctctcctcgcaaatatggccgctatgtttgctatctatcacggctcccacggtctggagcacattgcgcgacgagtccataatgcgacacttattctgtcggaggggctgaagcgagcaggccaccagttgcagcatgatctgttcttcgataccctgaagatccagtgtgggtgctcagtgaaagaggttctgggacgggccgcacagcggcaaatcaattttcggttgttcgaagatggcaccctgggtattagtcttgatgagaccgtgaacgagaaagatcttgacgacttgctgtggatttttggctgcgagtcttcagccgaactcgtcgcagagtctatgggggaagagtgtcgaggcatcccagggtccgtgttcaagagaacctccccgtttctgacccaccaggtcttcaattcgtatcattccgaaactaatattgtgaggtacatgaaaaaactggagaacaaagatattagcctggtacattcaatgatacctttaggctcgtgtactatgaaactgaactctagtagcgagttagcgccaattacgtggaaagagttcgcgaatatacatccttttgttcctctggaccaagctcagggctaccagcagctctttagggagttagagaaagatttgtgcgagttgactggctacgaccaggtgtgcttccagccgaactctggagcccagggggaatatgccgggctggccactattcgcgcgtacctgaaccagaaaggagaaggtcataggactgtgtgtttgatccccaagtcggcacacggaactaatcccgcatcggcccatatggccgggatgaagattcagccggtggaagtcgacaagtacggaaacatcgacgccgtgcatctcaaagctatggttgataaacataaggagaacctcgcggcaatcatgatcacgtacccatccaccaacggagtcttcgaggaaaacatatcagatgtttgtgatcttattcatcagcacggaggccaggtgtatctggacggagcaaatatgaatgcccaggtggggatctgtcgcccaggggattttggatccgacgtgtcccacctcaatttgcataaaactttttgcattcctcacggggggggcggccctggcatgggccccataggcgtaaagaagcatctagcaccctttcttcctaaccatcccgtgatcagtctcaaacgtaatgaggacgcatgccccgtaggaaccgtgagcgctgccccctggggatctagtagcatcctgcccataagctgggcatacattaagatgatggggggtaagggtcttaagcaagcaactgaaactgcaatccttaatgctaactacatggctaagcgtctagagacccactatcgtatattatttcgcggcgcacggggctacgtgggacacgagttcatcctcgatactcgcccatttaaaaaaagcgccaatatagaggccgtggatgtcgccaagagactccaggattacgggttccatgcgccaacgatgtcgtggcctgtggctggtaccctgatggttgagccgacagagagcgaagataaggcggagttagatcgattctgtgatgctatgattagtattagacaggaaatagccgatattgaagaggggcgaatcgatcctagggtcaatcccctgaagatgagcccccactcattgacctgtgtgacatcctctcattgggataggccatattctcgtgaggtggccgccttcccacttccatttgtgaagcccgagaataaattttggccaaccatcgctagaatagatgacatctacggagatcagcacttagtctgcacctgtcctcccatggaggtgtacgaaagcccatttagcgaacagaaacgcgctagttcatag

SEQ ID NO: 118788 - DNA, 888 bp, Artificial Sequence
  Description of Artificial Sequence: Synthetic coding sequence
atggtcgatagcgtctatagaaccaggtctctgggcgtagctgctgaaggccttcccgatcagtatgccgacggcgaagccgctcgcgtgtggcaattatatatcggagatacccgcagcaggacggctgagtacaaagcatggctcctgggcctcctgcggcaacacgggtgtcagagggtgctggacgtggcctgcggtaccggagtcgattcaattatgcttgttgaggagggttttagcgtgacatccgtagacgcctcagacaagatgttaaagtatgccttgaaggagcggtggaacagaaggcacgaaccagcattcgataaatgggtgatcgaggaggccaattggatgactctggataaggatgtgccgcagtccgcagagggtggattcgatgccgtgatttgcctgggcaatagctttgcgcatttgcccgactgcaaaggggatcagtctgagcaccgcctcgcgctcaagaatattgcatcaatggtgagagcaggtggcctcctcgtgattgatcaccgcaactacgatcatatcctgtcaaccggctgtgccccacccggcaaaaatatctactacaagtctgatctcactaaggacgttacaacctcagtcctcatcgtgaacaacaaggcgcacatggtcaccctggactataccgtccaggtacccggtgcagggcaagatggctcgccggggcttagtaagtttaggcttagttactacccacactgccttgcaagttttactgaactcctgcaggctgcctttgggggcaagtgccaacacagtgtactaggggattttaagccatacaaacccgggcaaacctatattccatgctactttattcacgtactgaagcgcacagattag

SEQ ID NO: 118789 - DNA, 1350 bp, Artificial Sequence
  Description of Artificial Sequence: Synthetic coding sequence
atgtatagcttcaacacgctcaggctctatctgtgggaaactatcgttttcttcagtctcgctgcgtctaaagaggccgaagccgcccggagtgcccccaaaccaatgtcgcctagtgactttctggacaagctgatgggacgcaccagcgggtatgacgctaggattcggcccaactttaagggccctcccgtcaacgtctcctgcaatattttcatcaactcattcggtagcatagcagaaacgacaatggactatagagtgaacatttttctcaggcagcaatggaacgatcctaggctcgcatataatgagtaccccgacgactccctagatttagacccttccatgttggactcaatctggaaacctgatctcttctttgccaatgaaaaaggcgcccatttccacgagataactacagacaataagctattacgcatatccaggaacggaaatgtgctgtattctatcagaatcacgctgactctggcctgcccaatggatttaaagaactttccaatggatgtccagacctgcatcatgcagctggagtcgttcggatacacgatgaacgaccttatattcgagtggcaggaacaaggtgctgttcaggttgcagatgggcttacacttccacagttcatcctgaaagaagagaaggacctgcggtattgtaccaagcactacaacacaggtaagtttacttgtattgaggcccggttccacttggagcgtcagatgggctattaccttatacagatgtacataccctctctgctgatagtgatcctgtcatggatctccttctggatcaatatggatgccgctcctgcacgggtaggtctcggcattacaaccgttctgacaatgactacccagagctccggttctcgggcaagcctgccaaaagtgtcctatgtcaaggctatagacatctggatggcagtgtgcttgctgttcgtcttttctgcactgcttgaatacgctgccgttaacttcgtatcacgccagcacaaagaattgctgaggttccgaaggaagaggcggcatcataaggaggacgaagccggggaaggccggtttaatttctcagcctacgggatgggcccggcctgcctgcaggctaaggatgggattagtgtgaagggagccaacaatagcaacacaacaaatcctccccctgcaccctctaaatcccccgaagagatgcgcaagctcttcattcagagagcgaagaagattgacaaaatcagtcgaattgggttcccaatggcttttttgatctttaatatgttttactggattatttataagatagtccgccgagaggacgtgcacaatcagtag

SEQ ID NO: 118790 - DNA, 1374 bp, Artificial Sequence
  Description of Artificial Sequence: Synthetic coding sequence
atgtacagttttaacactctgaggttgtacttgtgggagacgatcgtatttttttccctggccgcctccaaagaagctgaagcagcccgctctgcaccaaaacctatgtcgccctcagactttctggataagctgatgggcaggacgagcggttacgatgcgagaattcgccctaattttaaggggcctcccgttaatgtctcatgcaacattttcataaatagtttcggttccattgcagaaactaccatggactaccgcgttaacatctttttgcgccagcaatggaacgatcctagattggcctacaatgagtacccagacgacagcctggacctggacccttctatgctggattccatttggaagcctgaccttttctttgcaaacgagaaaggtgctcactttcacgaaatcacaaccgataacaagctcctgagaattagccggaatggcaacgtgctgtattcaatccggatcacactaaccctggcttgtccaatggatctgaagaattttcccatggacgtacaaacatgcattatgcaacttgaatcgtttggctacactatgaacgatttaatatttgaatggcaggagcagggcgcagtgcaagtcgcagatggcctgacactgccccagttcatacttaaggaggaaaaagatctgcgatactgtaccaaacattacaataccgggaagtttacatgcattgaggcgaggtttcatcttgagaggcagatgggctattacttaattcagatgtatatcccatccttacttattgtcattctctcttggatctcattctggatcaatatggacgccgctcctgcccgagtcggcctcggaatcacaactgtcttaacgatgactacccagtcctccgggagcagggcctctttgccaaaagtgagctacgtgaaagccatcgacatatggatggctgtttgtctgctgtttgtctttagtgcattgctggagtacgctgccgtcaatttcgtgtcaagacagcacaaggagctgttgcgatttaggaggaagcggaggcatcataagagccctatgctaaacctgttccaggaggatgaggcgggagagggccgctttaacttctctgcctacggcatgggtcccgcatgtctgcaggccaaggacggaatttccgtgaagggagccaacaactcgaatacaaccaaccctcccccagcccctagcaaaagccctgaggagatgcgcaagctgtttatccaacgggccaagaagatagacaagataagccggatcggcttccccatggcattcctcatattcaatatgttttactggatcatatacaagatcgtgcggcgggaggatgtgcataatcaatag

SEQ ID NO: 118791 - DNA, 1101 bp, Artificial Sequence
  Description of Artificial Sequence: Synthetic coding sequence
atggattacagagtcaacattttcctccgccagcagtggaatgaccccaggctcgcatacaacgagtatcctgacgatagcctggatctagacccaagcatgttagacagtatttggaaacctgatctgttcttcgccaatgagaaaggagcacactttcacgaaattaccacagacaataaactcctgaggatctctagaaacggaaatgtcttgtactccatccgaattactttgacgctggcttgtccaatggatcttaaaaatttccccatggacgtgcagacatgtataatgcagcttgagagctttggctacactatgaacgacttgatctttgagtggcaggagcaaggtgcagtccaagtggctgacggattgacactcccacagttcatcctgaaggaagagaaagatctgcggtattgtacaaagcattacaacaccggtaaattcacgtgcatcgaagcacggttccatctggagagacaaatggggtattacctgattcagatgtatatcccctcccttctgattgtgattttgtcttggatctctttttggatcaacatggacgcggcacccgctagggttggactgggcatcacaacagtgttaacaatgacgacccagtccagcggaagccgagcttctctgcctaaggtatcttatgtaaaggccatcgacatctggatggcggtatgcctgctgtttgtcttctccgcccttcttgaatacgctgctgtgaatttcgtctcccggcagcacaaggaactgcttaggttccgccggaagaggcgtcatcacaaagaagacgaagctggcgaaggacgcttcaattttagtgcttacggcatggggccagcctgcctgcaagcaaaagatggaatttcagtcaaaggcgctaataactctaacacaacaaaccctcctcccgctccatcgaagtcaccggaggagatgcgtaagttatttattcagagggccaagaaaattgacaaaatatcacggatcggatttccaatggcctttctgatctttaatatgttctactggatcatttataaaatcgttcgcagggaggacgtccataaccagtag

SEQ ID NO: 118792 - DNA, 309 bp, Artificial Sequence
  Description of Artificial Sequence: Synthetic coding sequence
atgtccgcccgcgtgcggagtaggtcccgtggccggggcgacggccaggaggcccccgatgtagtggcctttgtggcgccaggagagtcccagcaggaggagcctccgacagataaccaggatatagagcccgggcaggagcgcgagggcacaccccccatagaggagaggaaggtcgaaggcgattgtcaggagatggatctcgagaagacccgttcagagagaggagatggaagcgatgtaaaagaaaaaacaccccccaacccaaaacacgcgaaaactaaagaggccggcgatggacagccatag

SEQ ID NO: 118793 - DNA, 1359 bp, Artificial Sequence
  Description of Artificial Sequence: Synthetic coding sequence
atgaatcgacagctggttaatattctgacagctctatttgcttttttcttagagacaaatcacttcagaactgcgttctgcaaagaccacgactcgcggtccggaaaacagccttcacagactctctcgccctctgattttctcgataagcttatgggacgtacgtccgggtatgatgcccgcataaggcctaactttaaggggcccccagtgaacgtgacatgcaacatctttatcaacagctttgggagcattgcggagacaacaatggattatagagtgaacatctttctgcggcagcagtggaatgattctaggcttgcatactctgagtaccccgacgacagtttagacctggatcccagcatgctcgatagtatttggaaacccgacctattcttcgccaacgaaaagggcgctaatttccacgatgtaacaacggataataagttgctaagaatttctaagaacggtaaagtgctgtactctattagattaactctaacccttagttgcccgatggacctcaaaaatttccctatggatgtccaaacttgcactatgcaacttgagagcttcggatacacgatgaatgaccttattttcgaatggctgtccgacgggcccgtacaggtggctgagggactaacccttccccaattcatcttgaaagaagaaaaggagctgggctactgtacaaaacattacaacaccggcaaattcacttgtatcgaagtgaagtttcacctggagcggcagatgggttattatctcatccagatgtatatcccatcgttacttattgtcatcctgagctgggttagtttttggatcaacatggacgctgcacctgctcgggtagcattggggatcacgaccgtccttactatgaccacacagagtagcggtagccgggccagcctccctaaagtttcttacgtcaaagccattgatatatggatggccgtttgcctcctgttcgtcttcgcagcgttactggaatatgctgcggtgaatttcgtctctaggcagcataaagaatttttacgcctgcgacggcggcagaaacgacagaataaagaggaagatgtaacgagagagtccaggttcaatttcagcggatatggcatgggtcattgtctgcaggtgaaggatggcactgctgttaaagccacaccagcaaaccctctgccgcagcccccaaaggatggggatgcaatcaaaaagaaatttgtggatagggcaaagagaatcgacaccatttcccgggcagcattcccacttgccttcctcatatttaacatcttttattggatcacgtataagatcattagacacgaggacgtgcacaaaaagtag

SEQ ID NO: 118794 - DNA, 648 bp, Artificial Sequence
  Description of Artificial Sequence: Synthetic coding sequence
atgaatttgcacatgcgtatgacggccttttgtaaagaccatgactcaagaagcggaaaacagccatctcagacgctctctccctcagacttcctcgataaactgatgggcaggaccagcggatacgacgctagaattcgccctaacttcaaggggccccctgtgaatgtaacttgtaacatattcatcaattcctttggatcagtgacagaaaccacaatggattaccgagttaatatctttttaaggcagcagtggaacgatagcaggctggcctactctgaatacccggacgattccctggatttggacccctcgatgttagactccatctggaagcctgatctcttcttcgctaatgagaagggggctaacttccacgatgtcactacagacaacaagctgctgaggatctcaaagaacggaaaagtattatatagcattaggctgactttgactctttcgtgccccatggatctgaagaactttccgatggatgttcaaacatgtacaatgcagcttgagagcttcggctatacaatgaatgacctgattttcgagtggttatccgacggacctgtgcaggtggccgaaggtctgacactcccacagttcatcctcaaggaggagaaagagttaggatactag

SEQ ID NO: 118795 - DNA, 1092 bp, Artificial Sequence
  Description of Artificial Sequence: Synthetic coding sequence
atggactatcgcgtgaacatctttctcagacagcagtggaacgattctcgcctggcttacagtgaatatcctgacgatagcctggatcttgatccctccatgttagactctatctggaaaccggacctttttttcgcaaatgaaaagggagctaacttccacgatgtcacgaccgataataaactgctacgcatctcaaagaacggtaaggtcctctattcaatccggttaacactgacactaagttgtcctatggacctaaaaaacttcccaatggatgtgcagacctgtaccatgcagctggaatcgtttggatacacaatgaacgacctgatattcgagtggctgtcggatggacccgttcaagtcgcggagggcctcacactaccccagttcattcttaaggaggaaaaggaattagggtattgcactaaacattataacaccggcaagtttacatgcattgaggttaaattccatctagagcggcagatgggttattatctgattcagatgtatattcccagcctcctcatcgtcatccttagctgggttagcttctggattaatatggatgcggccccggctagagtggcactcggcatcaccaccgttcttaccatgaccacccagagcagtgggtcaagggcgtctctgcccaaggtctcttacgtaaaggcgatcgacatttggatggcagtttgtctcttgtttgtgtttgctgctctgttggagtatgcagctgtgaattttgtgtcaagacaacacaaagaatttttaaggctgcgccggcggcagaaacgccagaacaaggaagaggacgttaccagagaaagccggtttaatttcagcgggtatgggatgggccactgcttacaggtcaaggatggcaccgccgtgaaggctacccctgccaatcccttgcctcaacccccaaaggatggtgacgctatcaagaagaagttcgttgatagggctaagcggatcgacacaattagtagggcagccttcccccttgcctttctgatatttaatattttttattggatcacttacaaaatcattcggcatgaggacgtgcacaaaaagtag

SEQ ID NO: 118796 - DNA, 1395 bp, Artificial Sequence
  Description of Artificial Sequence: Synthetic coding sequence
atggcccatgtgcggcattttcggaccttggtgagtggcttctacttctgggaggctgccctgctgctcagcctggtggctacaaaagaaaccgacagcgcccggtcccgctccgcaccaatgtccccctctgatttcctcgataaactcatgggacggacctccggttacgacgcgcgtattcgccccaattttaagggccccccggtgaacgtcacttgcaatatcttcatcaattcctttggtagcatcgccgaaactactatggattatcgggtgaatatcttccttcgacagaaatggaatgaccccagacttgcatactccgagtatcctgacgattccctggacctcgatcccagtatgctggacagcatttggaagccagatctgttcttcgccaatgagaaaggcgccaactttcacgaagttacgactgataataaactgctccgaatattcaagaacggtaacgtactctattctatccggctcacactcactttgtcctgccctatggacctgaaaaattttcccatggacgttcaaacatgcatcatgcagctggaaagcttcggatacaccatgaacgacctgattttcgagtggcaagatgaagctcccgttcaggtggcggaagggctgaccctgccccagttcctgcttaaggaagagaaagaccttaggtactgtaccaaacactacaatacaggaaaattcacatgcatcgaggtccggtttcatctcgagagacagatggggtactaccttatccagatgtacatcccgtctctcctaatcgtgattctgagctgggtgtcattctggatcaacatggatgccgcccccgcaagagtggcgctgggcattactaccgtgctcactatgacaacccagtcatctgggagcagagcaagtttgcccaaggtcagctatgtgaaggccattgatatttggatggctgtgtgcctcctgttcgtgtttagtgctttgctcgaatatgccgcagtgaactttgtgagcagacaacataaggaattacttcgatttcggagaaagcggaaaaacaaaacagaggccttcgcactcgagaaattttacagatttagcgacatggatgatgaggtacgggagagccgcttctccttcaccgcctacggcatgggtccctgcttacaggctaaggatgggatgacccctaagggtccgaatcacccggtgcaggtgatgcccaagtcaccagacgagatgagaaaggtgtttatcgatagagccaagaagatcgacacaattagcagggcttgttttccactggcatttttgatcttcaatatcttttactgggttatctacaaaattctcaggcatgaggacatacatcagcaacaggattag

SEQ ID NO: 118797 - DNA, 1350 bp, Artificial Sequence
  Description of Artificial Sequence: Synthetic coding sequence
atggctcacgtgcgccatttcaggacccttgtgtccgggttctacttttgggaagccgcgttgttactgagcctggtcgcaactaaggagacagattccgcccgttcacggtcagccccaatgtccccatctgattttctcgataagttaatgggccgtacatcgggttatgatgctcgtattcggccaaacttcaagggacctcccgttaacgtcacatgcaatatttttatcaactctttcggcagcatagctgagaccacaatggattatcgagtcaatatcttcctgagacaaaaatggaatgacccccgcttggcgtatagcgaatatccggacgatagccttgatctagatccgtccatgttagactcaatttggaagcccgatttgttcttcgcaaacgagaagggcgcaaatttccatgaggtcaccaccgacaataagctgctcagaatctttaagaatggcaatgttctgtatagtattcgattgacattgactttaagttgtcctatggatttaaagaacttccctatggacgtgcagacatgtataatgcaactcgaatccttcggctatacaatgaatgacctgatttttgagtggcaagacgaagcgccagtgcaggtcgccgagggcctgacgctgccacagtttctactgaaggaggaaaaggacctccgctattgcacaaagcattacaacaccggtaagttcacatgtatcgaagttagatttcacctggaacgccaaatgggctactatctaattcagatgtatatcccttcactcctgattgttattctgtcatgggtgtcgttttggattaatatggatgccgctccagcccgcgtagctctcggcatcacgacagtattgactatgacaacacagagtagcggatcccgagcttccctgcctaaggtgtcctatgtaaaagccatagatatctggatggcagtgtgcctattgttcgtgttcagcgcacttctggaatatgctgcagtgaacttcgtgtcacgacaacacaaagaattattacgcttcagacgcaagaggaagaataaggatgacgaagtgagagagtctagattctccttcactgcctatggcatgggtccctgcctccaggcaaaggacggcatgacgcctaagggtcctaaccaccctgttcaagtcatgccaaagagtcccgatgagatgcgcaaagtgttcatcgatagagccaaaaaaatcgacactatctctagggcttgctttccattggcctttcttatctttaatattttttattgggtaatttataagatacttaggcatgaggatattcatcaacagcaggactag

SEQ ID NO: 118798 - DNA, 1494 bp, Artificial Sequence
  Description of Artificial Sequence: Synthetic coding sequence
atgaagtttctgctcaccaccgccttcttgatcctgatatctttgtgggtggaggaggcttacagtaaggagaagtcatcaaagaagggtaaaggaaagaagaagcaatatctgtgccccagccagcagtcagccgaggaccttgcccgcgtccctgcgaattcgacaagtaatatcttaaatagactgttggtgtcttatgacccgcgcattcggccaaatttcaagggcattcctgtagacgtggttgtcaatatctttattaattctttcggaagcattcaggaaactacgatggactatcgggtgaacatattccttaggcaaaagtggaatgatccacgcttgaaattacccagcgacttccggggcagtgacgcccttacggtggacccaaccatgtacaagtgcctatggaaaccagatttattctttgccaacgagaagtcggctaacttccatgacgtcacccaagagaacatactgttattcatttttagggacggcgatgtgctcgtctctatgcggcttagcataacgctgagttgcccactggatctgactttatttccaatggatacacagagatgcaagatgcagctggagtcttttgggtatactaccgacgatctgcgttttatctggcaaagcggagacccagttcagctggagaagattgccctccctcaattcgatatcaaaaaggaagacatcgagtatggcaactgtaccaagtactacaaggggacaggatattatacctgcgtggaggtcatcttcaccctccgacgccaagtgggattttatatgatgggggtctacgccccaacattactaattgtagttctgagctggctgtcgttttggattaacccagacgccagtgcagccagagtcccgctgggcattttctccgtcctctctctggcctccgagtgtaccacacttgccgctgagcttcctaaggtgagctacgtcaaggccctggacgtgtggctcattgcatgtctactcttcggcttcgcctccttggtcgagtacgccgtggtgcaggttatgctgaacaaccccaaacgcgtagaggctgaaaaagcaagaatcgctaaagccgagcaggctgatgggaagggcggcaacgtggctaaaaagaacaccgtaaatggaacgggtaccccagtgcacatatccacactgcaggtgggggaaacacggtgtaagaaagtttgcaccagcaagagcgatctccgatcgaacgacttcagcatagtgggctcactcccccgggatttcgaactaagcaactatgattgttacgggaaacctattgaggtgaataacggactcggaaaatctcaagctaaaaacaacaagaagccccccccagcaaagcccgtgatcccgaccgccgcaaagcggattgacttgtacgctagggccctcttccccttttgtttcctgttctttaacgtgatctattggtcaatctatctctag

SEQ ID NO: 118799 - DNA, 1494 bp, Artificial Sequence
  Description of Artificial Sequence: Synthetic coding sequence
atgaagtttctgctgaccacagcctttttaatccttatctcactatgggtggaagaagcatacagcaaagaaaagtcgtcaaaaaaaggaaaaggtaagaagaagcagtatttgtgcccatcccagcaatctgcagaggatttggctcgcgtccccgccaattcaaccagcaacatccttaacaggctgctggtgtcatacgatcctcggatacgtcctaatttcaagggcattcctgtagatgtggttgttaacattttcattaatagcttcggctccatccaggagaccacgatggattaccgggtgaacatcttcctgcgacagaaatggaatgacccccgcctgaaactccctagcgatttccgtggctcggacgcactgaccgtggacccgactatgtataaatgtctgtggaagccagatttgttttttgcaaatgagaaatcggccaactttcacgacgttacccaagagaatatactgctgtttattttccgtgacggggacgtgctcgtctctatgcggttgagcatcacactctcatgccccctggatctcaccctctttcccatggatacacagaggtgtaaaatgcaactcgagtcctttggatatactacagacgatctgaggtttatatggcagagtggggatcctgttcagctggagaaaatcgctttgccccaattcgacattaagaaggaggacatcgagtacgggaactgcacgaagtattataaaggaaccggttactatacctgcgtggaagtgatctttacccttaggaggcaggttgggttttatatgatgggagtgtatgccccaacattgctgatagtagttctgtcatggttgagtttttggatcaacccagacgcgagcgccgcaagagtacctctcgggatcttcagcgtgctaagtctggctagtgaatgcactacactcgccgctgaacttcctaaagtgtcctacgttaaagctctggatgtgtggctcattgcctgtctgctcttcggattcgccagcctggtggaatacgcggtcgtgcaggttatgctgaataaccctaaacgtgtcgaggcggagaaggcccgcatcgccaaggcagaacaggctgacggcaaaggggggaacgtcgccaagaaaaacacagtgaacggtacaggaactcctgtgcatatctctaccctgcaagtgggcgagaccagatgcaaaaaagtgtgcacctctaaaagcgatcttcgaagcaacgactttagcatcgtgggatccctgccacgggatttcgagcttagcaactatgattgctatggtaagcctattgaagtcaataacggcctcgggaagagtcaagccaagaataataagaagccgcccccagctaaaccagtaatcccaaccgcagccaagaggattgatctgtacgctagggctctgttccctttctgcttcctcttttttaatgtgatttactggagtatctacctgtag

SEQ ID NO: 118800 - DNA, 912 bp, Artificial Sequence
  Description of Artificial Sequence: Synthetic coding sequence
atgaaattcctcttgacaaccgctttcctgattttaatctccctgtgggtggaggaagcctactctaaagaaaaatccagtaagaagggtaaggggaagaaaaagcagtacctgtgtccttctcagcagagtgctgaagatcttgcgcgggtaccagcaaactctacctccaacattcttaatcggctacttgtctcgtacgatccccgaatccgacccaattttaagggcatccctgtcgatgtcgtagtgaatatcttcattaactcattcggctctatccaggagactactatggattaccgagttaacattttcctacgacagaaatggaatgatccgagacttaaactgcctagtgactttcgtggttcagatgccctgaccgtggaccccaccatgtacaaatgcctctggaagcccgacctgttcttcgctaatgagaaatcagcgaatttccacgatgtcacccaagagaatatactcctttttatattccgggacggcgacgtgttggtgtctatgcggctctccattactctcagttgtcctctcgatctcacattgtttccaatggacacacaacggtgcaagatgcagctcgaatcttttggctacaccaccgacgatctgcgattcatctggcagtctggggaccctgtgcagctggaaaagattgcgcttcctcagtttgacataaagaaagaagatatcgagtatggaaattgcacgaagtactataagggcaccgggtactatacatgcgtggaggtgatcttcacacttcgccggcaggtcggcttttatatgatgggtgtgtatgcacccaccctgctgatagtggtgctgtcctggttgtccttctggattaatccagatgcctccgctgcgcgtgtgcctctgggctggtag

SEQ ID NO: 118801 - DNA, 492 bp, Artificial Sequence
  Description of Artificial Sequence: Synthetic coding sequence
atgatgctaccactccaaggggcacagatgctgcaaatgttggagaaaagtctgaggaaatccctgcccgcaagccttaaagtttatggtacggtttttcacatcaatcatggcaatccttttaaccttaaagccgtggtggataaatggcccgacttcaataccgttgttgtgtgcccgcaagaacaggatatgaccgacgatctggaccattacactaacacatatcagatatattccaaagatccgcaaaattgccaggaatttctcgggtcaccagagttaatcaactggaaacagcatctgcaaattcagagcagccagccatcactcaacgaagctatccagaatctcgcagctataaagtccttcaaggttaagcagacacagcggattctatacatggccgcagaaacagccaaagagcttacgccattcttactgaagagtaagattctgtcccctaacggagggaagcccaaggctatgtag

SEQ ID NO: 118802 - DNA, 891 bp, Artificial Sequence
  Description of Artificial Sequence: Synthetic coding sequence
atgatgttaccattgcagggtgcccagatgctgcagatgctcgagaaatccctgcggaaatccttaccggcctccctgaaagtatacggtacagtttttcacattaatcatggcaatccctttaacctgaaggctgtggttgacaaatggcccgacttcaatacggtggtggtgtgtccccaggaacaggacatgaccgatgatctggaccactacacaaacacttaccaaatttatagcaaggatcctcagaactgccaggagttcctgggatcccctgagctcattaattggaagcaacatttgcagatacagtcgtcccagccctcactgaatgaagctattcagaatctagcagcgattaagtcctttaaagtcaaacagacacaacggatcctgtatatggccgccgagacggctaaggaattaactcccttcctcttgaaatcaaaaattcttagccccaacggaggcaaaccaaaggccattaaccaggagatgttcaaattgtcatccatggacgtgactcacgcacacctggtgaataagttctggcatttcggcggcaatgagaggagtcagcggtttatcgagcggtgcattcagacttttccaacatgctgcctgttgggaccggagggaactcctgtctgttgggatctgatggatcagacaggcgaaatgcgcatggccggcactctaccagagtaccgtctgcatggcctcgtaacttatgtgatctattcgcacgctcagaaactgggcaaactgggctttcccgtctattctcatgtggactacagtaacgaggctatgcagaagatgagctacactctccagcatgtccccatacctcggtcctggaatcagtggaactgcgtgcccctgtag

SEQ ID NO: 118803 - DNA, 891 bp, Artificial Sequence
  Description of Artificial Sequence: Synthetic coding sequence
atgatgttaccgctgcagggcgcccagatgcttcagatgctggagaaaagcctgaggaaatccctgcctgcatcactgaaagtatatggcaccgtgttccacatcaaccatggtaacccttttaatttgaaggctgttgtggataagtggcctgactttaataccgtcgtcgtttgtccccaggagcaggatatgacagacgacttggaccactatacaaacacttaccagatttactccaaggaccctcagaattgtcaggaattcttaggttctccagaactgataaactggaagcagcatctgcagatccagtccagccaacccagcctgaacgaggctatccagaatcttgctgctatcaagagttttaaggtgaaacagacccagcggatcttgtacatggccgcagagacggcgaaagagctgactccgtttctcctcaaatctaagattctgagcccgaatggcggaaagcctaaagctatcaaccaggagatgtttaagctttcgtcaatggatgtaacgcacgcccacctcgttaataaattttggcacttcgggggaaatgaacgcagccaacgcttcatcgagcggtgcattcagacatttccgacctgttgcctcctgggcccggagggaacccccgtttgctgggatctcatggaccaaaccggagaaatgcggatggcaggcactctccctgagtatcggcttcatggcttagtaacttacgtgatttacagccatgcccagaaattaggaaagctcgggtttcccgtttattcccatgtggactactctaacgaggccatgcagaagatgagctatacactccagcatgttcctatccccagaagctggaatcagtggaattgcgtgcctctgtag

SEQ ID NO: 118804 - DNA, 2022 bp, Artificial Sequence
  Description of Artificial Sequence: Synthetic coding sequence
atgcccctaaatcgcactttaagcatgagcagtctacccggactcgaagactgggaagatgagtttgacctcgagaatgctgtcttgtttgaggtggcttgggaggtcgcgaataaggtcggcggaatctataccgtgctgcagaccaaggctaaggtgacgggagatgagtggggagataactacttccttgttggaccttacactgagcagggtgtgagaacgcaagtggagctgctggaggccccaactcccgcactcaagcgcacattggacagcatgaatagcaaaggttgtaaatttctggctcagagtgaagagaaaccccacgtggtggcacactttcacgagtggctggccggagtaggactatgtttatgcagggctcgccggctgccggtggctaccattttcacaacacacgccacactcctgggacgctatttgtgcgctggcgccgtggacttttacaacaatctggagaacttcaacgtagacaaagaagccggcgagcggcagatataccacaggtactgcatggaaagagctgctgctcactgcgctcatgtttttacaacagtgagtcagatcacagccatcgaggcccagcacctgttaaagcgtaaacccgatatcgtaacaccgaatggactcaatgttaaaaaattctctgctatgcatgagtttcagaacttgcacgcgcagtcgaaggcaaggatacaagaattcgtgcggggacatttctatggccatctggactttaatctcgacaagaccctgtacttcttcattgccggaaggtacgaatttagtaacaagggcgcggatgtgtttctggaagcactagcacggttaaactatctgctgcgggtgaacggcagcgaacagactgtcgttgcctttttcattatgccagccagaactaacaactttaacgtggaaaccctgaagggccaagctgtgcgaaagcaactatgggataccgcgaacacggtcaaagaaaaattcggccgcaagctctatgaaagtcttctcgttggcagcctgcctgatatgaataaaatgctggataaagaagattttaccatgatgaaacgagccatctttgccacccagcgccagagctttccccccgtgtgtactcataatatgctggacgattctagcgacccgattttgactaccattagaagaatagggctgtttaactccagcgcagaccgcgtgaaggtaatcttccaccccgagttcctgtcgtctacatcgcctcttctgcccgtggactacgaagaattcgtaaggggctgtcatttaggggtgtttccgtcctactatgagccttggggttacacccctgccgaatgcaccgtaatgggcattccttccattagcacgaaccttagtgggttcggctgcttcatggaggagcacatcgctgatccttctgcttacggaatttatattctggaccgccgttttagatcactggacgactcttgctcccaactaactagctttctgtacagtttctgtcagcagtcacggaggcagaggattatacaacgcaataggactgagcgactgtcggatctgcttgactggaagtaccttgggaggtactacatgtctgccagacatatggcattaagtaaagcatttccagaacattttacttatgagcccaatgaggcagatgccgcacaaggctaccgatatccaaggccggcttccgtgccaccttctccgtctctttctaggcattcaagcccacatcagtccgaagacgaggaggatcctcggaacggccctctagaagaggacggagagagatatgatgaagacgaggaggccgcgaaagaccgacgcaatatcagggccccagagtggcccagacgcgccagctgcacaagcagtacaagtggctctaagaggaatagcgtggataccgcgacgtcctccagcctttccactcctagtgagcccctctctcccaccagctccctgggggaagagcgaaactag

SEQ ID NO: 118805 - DNA, 2214 bp, Artificial Sequence
  Description of Artificial Sequence: Synthetic coding sequence
atgcctttaaatagaacactgtctatgtcttccctgcctgggctcgaagactgggaagacgagtttgacctagaaaacgctgtgttattcgaggtggcttgggaagtagctaacaaagttggcggaatatacacagtgttgcaaactaaggccaaggtgacaggagatgagtggggagataactacttccttgtcggcccttatacggaacagggtgtgcgcactcaggtcgagctactcgaggctccgaccccagctctcaaaaggaccctggacagcatgaattccaaagggtgtaaggtgtattttggaagatggctgattgaggggggacccttggtcgttctcctagatgttggcgcatccgcctgggctttagagcggtggaagggcgagctgtgggacacttgtaatattggggtgccttggtatgatcgcgaagccaacgatgccgttttattcggcttccttacaacatggttcctgggtgaattcctggctcagagcgaagagaaaccccatgtggttgctcacttccatgagtggctagcgggcgttggtttgtgtctctgccgcgccaggcggctgccggtagcaaccatcttcaccacgcatgcaaccctgttaggacgttacctgtgtgccggggcagtcgacttctataacaacttagagaattttaatgttgataaagaggcaggcgaacggcagatatatcataggtattgtatggagcgcgccgcggcccactgtgcccacgtgtttaccactgtaagccagataacggccatagaggcccagcacttactgaaacgtaaaccggacatcgtaacaccaaatgggcttaacgtgaagaaattttcagctatgcatgaatttcagaacctgcatgcacaaagtaaggcacgaatccaggagtttgtgaggggccacttttacggacacctggattttaaccttgacaaaaccctgtatttcttcatcgccggacggtatgagttcagcaacaagggtgctgatgttttcctggaagccctcgctcgcctgaattatctcctgcgagtgaatggaagcgagcagacagtggtggcttttttcattatgcccgcgcgcacaaataacttcaatgtggagaccctcaaaggacaagcggtgagaaaacaactatgggatacagcaaatactgtgaaggagaaattcggtcggaagctgtatgagtctctgctggtaggaagcctgccagacatgaacaagatgttggacaaggaagactttaccatgatgaagagagccatcttcgcaacccagcgtcaaagctttccgcctgtttgcacccataatatgctcgacgattcatcagacccaattttgacaactatcagaagaattggcttgttcaatagttctgccgaccgcgtcaaagtcatattccacccagaattcttgagctctacctcaccgttgttgcctgtagactacgaggagttcgtccgtggctgccacctaggtgtgtttccatcttactatgagccgtggggctacactccggccgagtgcacggttatgggaatacccagtatttcaacaaatttgtccggtttcggctgtttcatggaggagcacatcgccgatccaagcgcgtatgggatatacatcctggacaggcggttccgctccctcgatgatagttgttcgcaacttacctctttcctctactctttttgtcagcagagtagacgccaacgcatcatccagcggaaccggaccgaaagattgtctgatctgctagactggaagtatctcggcagatactacatgagcgcgcggcacatggccctgtctaaagccttccccgaacactttacatatgaaccaaacgaggccgacgcggctcagggctacagatatcctcggcctgcgtctgtgccccccagcccctcactgtcccggcattcttccccgcatcagtctgaagacgaggaggatcctagaaacgggcctctggaggaggatggcgaaagatacgatgaggatgaggaggcagctaaagaccggagaaacattcgagccccagaatggcctagacgagcatcctgcacttcaagtaccagcgggtcaaagcggaacagcgtggatacggccacctccagttctctttccaccccttctgagccgctgagcccaacaagctctcttggagaggagcgaaattag

SEQ ID NO: 118806 - DNA, 708 bp, Artificial Sequence
  Description of Artificial Sequence: Synthetic coding sequence
atgaactccacttggagaacccagtgttcctccaagtggccaggcagatggctgactcgagtgtactttggtagatggctgatcgagggaggccccctcgtggtccttctggacgtcggtgcaagcgcttgggctctcgagcgctggaagggagaactgtgggacacgtgtaacattggagtcccttggtatgacagagaagctaacgacgccgtcttgtttgggtttctgactacttggttcctgggcgaatttctagctcagtctgaggagaagccccacgtggtcgctcattttcacgagtggctagccggagtggggttgtgtctgtgtagggctcgacgtctgcccgtggcgactatatttactacccatgctacccttctggggagatatctgtgcgcaggcgctgtcgacttctacaataacttggagaacttcaacgtcgataaggaggccggggagagacagatctatcacaggtactgcatggagagggctgctgcccactgcgctcacgtattcaccacagtgtcccagatcacagctatagaagctcagcatctcctgaaaaggaaaccggggatctggaccagtacttggactaggccgtatacttcactgagtcccgccgccatgagttcgccaactagggtgctgacctcctcctggaggcactggctgggaagcactatctgctctgagtag

SEQ ID NO: 118807 - DNA, 1974 bp, Artificial Sequence
  Description of Artificial Sequence: Synthetic coding sequence
atgaattccacctggcggacacaatgcagctccaaatggccgggcaggtggttaacacgcgtttacttcggtcgttggctgatcgaagggggccccttggtggtattactggacgttggtgcgagcgcatgggcactggagcggtggaaaggtgagctgtgggatacttgcaacatcggggtcccatggtatgaccgtgaagccaatgacgccgtgctgttcggattcttgactacctggttcctgggcgagttccttgcacagagcgaggaaaagcctcacgtcgtggcccacttccatgagtggctcgctggagttgggttgtgcctttgtagggcccgccgactacctgtggcaacaatcttcactacgcatgccaccctactaggacgatatctctgtgccggagctgtggatttttataataatttagaaaattttaatgtggataaagaggcaggagagcgacaaatataccaccgatactgcatggaacgcgctgccgcccattgtgcccatgtttttactactgtgtcccagattactgctattgaagcccaacacctgctgaagcgcaaacccgacattgttactccaaacgggctaaatgtgaaaaaattctctgctatgcacgagttccagaacctacatgcacagagcaaggccagaattcaggaattcgtccggggccatttctatggtcacctcgacttcaacctcgacaagacactgtatttcttcatagcaggaaggtatgaattctccaataaaggcgccgatgtattccttgaagctcttgcccgccttaattacttactgcgggtgaatgggagcgaacagactgtggtggctttcttcatcatgccagctaggaccaacaacttcaatgtcgaaaccctgaagggtcaggccgtgagaaagcaactttgggacacagcaaacacagtgaaggagaaatttggcaggaagttgtatgaatcgctgctggtgggttctttgccagacatgaataaaatgctcgacaaggaggattttactatgatgaaacgggccatcttcgctactcagaggcaatcctttccacctgtgtgcacccataatatgctagacgactcttcagaccccattctaacaactatcaggaggataggactgtttaattcctctgcagatagagtgaaggtcatctttcaccccgagtttctttcttcaacatccccgctgctacccgtagattatgaggagtttgtgcgcggctgccacctgggagtcttcccctcctattatgaaccttgggggtacaccccagctgagtgcactgtcatgggaataccaagcatcagcaccaacctgagtggtttcggatgtttcatggaggagcatattgccgatccaagcgcttacgggatttacatcttagatcgtcgatttcggagcctggacgactcctgcagccagcttacttcgttcttatacagcttctgccagcagtctcggagacagcgaattattcaacggaaccgcacagagcgcctctctgatctgctggattggaagtaccttggacgatactatatgagtgcacgacacatggcactcagtaaggcttttcccgagcacttcacctatgagcctaacgaggctgacgccgctcagggataccgttaccccaggcctgccagtgtacctccttccccatctctttctagacactcctcaccacatcagagcgaagatgaagaggaccctaggaatggacccctggaggaagatggtgagcgttacgacgaagacgaggaggccgctaaagatcgccgcaatatcagagcccctgagtggcccagaagagcctcttgcacatccagcacaagtggatctaaacggaactctgttgacactgcaacctccagttctttgagtaccccctcggagccgctgagtcctacatcctcccttggagaggagcgaaactag

SEQ ID NO: 118808 - DNA, 1113 bp, Artificial Sequence
  Description of Artificial Sequence: Synthetic coding sequence
atgccagcccgcacaaacaacttcaatgtagagactttaaaggggcaggcggtgcgcaaacagctttgggacaccgctaataccgtgaaggagaaatttggcagaaagttgtacgaaagcctgctcgtcggatcgctgccggatatgaataagatgctggacaaagaggatttcacaatgatgaagagggccatctttgcgacccaaagacaaagcttcccaccagtctgtacgcataatatgttggacgattcatccgatccgattctgaccaccattcggcggattggtctcttcaattctagcgccgacagggtgaaagtgattttccaccctgagttcctttcctcgacttccccgttacttccggttgattatgaagagttcgtccgagggtgtcacctgggagtatttccttcctactatgaaccatggggctacacgcccgccgagtgtactgtcatgggcattccaagcatctctaccaatttgtccggattcggctgttttatggaagagcacattgccgacccaagtgcatatgggatttacattctggataggaggtttaggtccctggatgacagctgttcgcagctgacttcctttctgtactctttttgtcagcagtctcgccgccagagaatcatccagcgcaacagaactgaaaggctctccgacctgctagactggaaatacctgggaaggtattacatgagcgccaggcacatggcactgagtaaagcatttccagagcattttacatatgaacctaatgaagcagacgcggcccaggggtacagatatcccagaccagccagtgtgccccccagcccaagcctgtcccggcactcatctccacaccagtcagaggacgaagaagacccccgcaacggcccacttgaagaggacggtgagcgctacgatgaagatgaagaggcagcaaaggaccggagaaatataagagctccagagtggccaaggagggccagctgtaccagctctacaagcggttcgaagaggaatagcgttgatacagctaccagttcctcattgtccactccttctgaaccactgtcaccaacatccagtctgggggaggagcggaactag

SEQ ID NO: 118809 - DNA, 1002 bp, Artificial Sequence
  Description of Artificial Sequence: Synthetic coding sequence
atgactgatcaggcctttgttaccctgacaacaaatgatgcatacgcaaaaggagctctcgtacttggctcctctctgaagcagcatcggacaaccagacggcttgttgtgctggccacgcctcaggtgagtgacagcatgcgtaaggtgttggaaaccgtgttcgatgaggtgattatggtcgacgtcctagactccggtgatagtgcccaccttacacttatgaaacgacccgagctgggagtgactttgaccaaactgcactgttggagcctaacacagtattctaagtgtgtgttcatggatgcagacactttagttcttgcaaatattgacgatctgtttgaccgggaggagctgtctgcggcccccgatcccggttggcctgactgcttcaactcaggagtctttgtctaccaaccttctgtcgagacatataatcagcttctgcacctcgcctctgagcagggatcttttgacggtggagatcaggggatactcaacacttttttttccagctgggccaccacggatatccggaagcacttgccctttatatacaacctatcttccatctcaatttactcctacctccccgcctttaaggtctttggcgcaagtgctaaggtggtgcatttcctgggccgggtaaaaccttggaactatacctacgacccaaaaacgaaatccgtgaaaagtgaagctcatgatccaaacatgactcatccggagttcttaattctttggtggaacatcttcaccaccaatgtgctgccactccttcagcaatttgggctggttaaggatacgtgcagctatgtgaatgttgaagacgtctcaggagccatcagccatctgagtcttggagagatcccggccatggcgcagcctttcgtgtctagtgaggagaggaaagagcggtgggaacagggacaggccgattacatgggagcagattcctttgataatataaagcggaaactagacacctaccttcagtag

SEQ ID NO: 118810 - DNA, 1053 bp, Artificial Sequence
  Description of Artificial Sequence: Synthetic coding sequence
atgaccgaccaggccttcgtgacgttgaccaccaacgatgcatatgctaaaggggctctggtcctcggcagctccctgaagcagcacaggaccacacgtaggctggtcgtgctggcgacccctcaagtaagcgattcgatgagaaaggtgttagaaacggtatttgacgaggtcatcatggtggatgtgttggactccggtgactccgcacacttgacccttatgaagcggcccgaattgggagtcacacttacaaaattgcactgctggtcactgacccaatacagcaagtgcgtattcatggatgcggatactctggtcttagcaaatatcgacgacctgttcgaccgcgaggagctgagtgcagcccccgatccaggctggcccgactgcttcaattcaggcgtattcgtttaccagccctcagtggagacctacaaccagttgctccatctagcaagtgaacaagggtcttttgacgggggcgaccaaggtatcctgaataccttcttctctagttgggcgacaaccgatatacgaaagcacctgccattcatttataatttaagttctatttctatttactcctacctcccagcttttaaggtgtttggcgcttcagcaaaagtagtgcacttcttaggcagggtgaagccttggaattacacctatgacccaaaaactaaatcggtgaaaagcgaggctcacgaccccaacatgacacaccctgaattccttatcctctggtggaatatttttaccaccaatgtgctgcccctcctacagcagtttggactcgtgaaggacacttgcagttatgtcaatgtgttatccgatctggtgtacaccctggcctttagctgtggcttttgccgaaaagaagacgtctcgggcgccatttcccatctgtcacttggagaaattcctgccatggctcaaccttttgtgtctagcgaggaacgcaaggaaagatgggagcaggggcaggcagactatatgggggccgactcattcgataacataaaaagaaagctggatacatacctgcagtag

SEQ ID NO: 118811 - DNA, 840 bp, Artificial Sequence
  Description of Artificial Sequence: Synthetic coding sequence
atgaccgatcaggcctttgtcaccctcactaccaatgacgcttatgccaagggcgccctcgtgctgggtagcagcttgaaacaacaccgcaccacgagaagactggtggtgctggcaactccacaggtttctgatagcatgagaaaagtacttgaaaccgtgtttgacgaggtcattatggttgatgtattggactccggggatagtgcgcacttgaccctgatgaagaggccggaactgggagtgacactcaccaagttacattgctggagcctgactcagtattctaagtgcgtattcatggatgctgacacgctggtgctggccaacatcgacgacttgtttgaccgggaagaactctccgcagcacccgacccgggctggcctgattgttttaacagtggggtcttcgtttaccaaccgagtgtcgaaacttataatcagctcttgcacctcgccagcgaacaggggagtttcgacggcggcgaccagggcatacttaatactttcttcagcagctgggccacaactgacatcagaaagcaccttccttttatttataacctgtcctcaattagcatttatagttacttgccagcttttaaagtgaagatgtcacaagagccatatcacatctgcccccttgggagaagccagctgtggcatagtcgtctctatcccaggaaaaatgggcggaacgacggcaatagggccaggctcatcatttgggaacagattcctctcacgacatctcgtggcaacctgaccctgaccagtagtaggaacaccgcgttcttttgcgaacacatccattttaccagtttggtcagcgacacatag

SEQ ID NO: 118812 - DNA, 1398 bp, Artificial Sequence
  Description of Artificial Sequence: Synthetic coding sequence
atgagcgagacagagtttcatcacggagcccaggccgggctagaactgctgaggagcagtaactcccccacctccgcctcccagtctgcagggatgaccgtgacggaccaggcatttgtcaccctggctacaaatgacatatactgccaaggtgccttggtgctgggtcaatccttgagaagacatcggctgacccgcaagctcgtcgttctaatcacacctcaggtgtctagcctgctacgggtgatccttagtaaagttttcgatgaggttatcgaggttaatttaatcgactcagctgattatatacacctcgcctttctaaagcgtccagagcttggactgaccctgacaaagctccattgctggacactgactcattactcgaaatgtgtgtttctggatgcggatacacttgtcctttcaaacgtggacgaattgttcgacaggggagagttcagcgcagcacctgatccaggttggcccgactgttttaattcaggagtcttcgtttttcaaccaagcctccacactcacaaacttctcctacagcatgcaatggagcatgggagtttcgacggagctgaccaagggttactgaatagtttcttccggaactggtcgacaacagatattcacaagcacttgccattcatttacaacctgtcttccaacactatgtacacttatagcccagcatttaagcagttcgggtcttcagccaaagtagttcattttctcgggagcatgaagccctggaactataagtataatccgcagtcaggaagcgtgctcgaacaggggtctgctagctcgagccagcatcaggcagcgttccttcacctttggtggactgtgtaccaaaataatgtgttgcccctttacaaatcagtgcaagctggggaggcccgcgcctcccctggtcacaccttgtgccattccgatgtgggcggaccctgcgcagatagcgccagcggcgttggggaaccatgtgagaattctacccctagcgctggcgtgccctgcgcaaactcaccactgggaagcaatcaacctgcacagggattgccagaacctacacaaatcgttgacgaaactctctctttgcccgagggaagaaggtccgaggacatgattgcatgcccagagacggagactccagccgttattacgtgtgatccgttgtctcaaccttccccgcagccagctgacttcaccgagacagagactatcttagtcgatcttgcggtctctgtctcccagatctccatcgaggaaaaagtgaaggagctgagtccagaggaagaaaggagaaaatgggaggagggtagaattgattatatgggtaaagacgcgtttgctcgaatccaggaaaaattggatcggtttcttcagtag

SEQ ID NO: 118813 - DNA, 1506 bp, Artificial Sequence
  Description of Artificial Sequence: Synthetic coding sequence
atgtctgaaactgaatttcatcacggcgctcaggcaggcctggaattgctcagatccagcaactcaccaacctctgcaagccagtccgccggaatgacggtcacagaccaggcgttcgtgacccttgccacaaatgacatctattgtcaaggcgcactggtccttggtcagagccttaggagacacaggctaacaagaaaactggtagtgttgattacacctcaggtctcttcactgctgcgagtgattttgagcaaagtcttcgacgaggtcatcgaagtgaatctgatcgatagtgcggattatattcacctcgcattccttaaaagacccgaattgggtctgacattgaccaagctgcattgttggacccttacgcattactcaaagtgtgtatttctcgacgctgacaccctggtcctgtccaatgtcgacgagctattcgacagaggcgagtttagcgcggctccagaccctggttggcccgattgcttcaacagcggagtcttcgtgttccagcccagtctccacacacacaaactcttgctccagcacgctatggaacatggctcttttgacggcgccgaccaggggttgttaaattctttctttaggaactggagcaccaccgatattcataagcatttaccatttatttacaacctctcttctaacaccatgtacacatacagccctgctttcaagcagttcggttcttccgctaaggtggttcacttcttggggagcatgaaaccttggaattataagtataatccccagtccggctcagtgctagagcagggttcagccagctcaagtcagcatcaggctgccttcctgcatctgtggtggaccgtgtatcagaataacgtgttgccattgtataaatctgtccaggccggtgaggcgcgggcctcaccgggacataccctatgtcacagcgacgttggaggcccatgcgccgatagcgcaagtggcgtgggagagccatgcgaaaattcaactcctagtgccggcgtgccatgtgccaatagtcccctgggatcaaaccagccagcgcaggggttgcctgagccaacgcagattgtcgacgagacgctgtccttgcctgagggtaggcgctccgaagatatgatcgcctgtcctgaaactgaaacgccagcagtcattacctgcgatcccctgagtcaaccatctccacagccggcagattttactgagacggaaaccatcttgcaaccagctaataaggtggagtccgtgtcttctgaagaaactttcgagcctagccaggaactcccagctgaggccctgagggacccctcactgcaagacgctctggaagtggatctcgcagtgtccgtgagccagataagtatcgaggagaaggtgaaagagctgagcccagaagaggaacgacgcaaatgggaagagggaaggatcgactacatgggcaaggatgctttcgcccgtatacaggaaaaattggaccgcttcctgcagtag

SEQ ID NO: 118814 - DNA, 1413 bp, Artificial Sequence
  Description of Artificial Sequence: Synthetic coding sequence
atgtcagttaccgatcaggctttcgttaccctggccaccaacgacatctactgtcaaggcgccctggttctgggtcagtcactgcgccgacatcgactaacgaggaagctggtcgttttaatcactccacaggtaagtagcctgctccgcgtaattctctccaaggtgttcgacgaggtgatcgaagttaatctgatcgactcagctgactacatccatttggcttttcttaagcgacctgagctcggccttacccttaccaagctgcattgttggaccttaacgcactatagcaagtgcgtctttctggatgcagatacactggtcctgtccaacgttgatgagctgtttgatcgaggagaatttagcgctgcccccgatccaggatggcccgactgcttcaactccggagttttcgtgttccaacccagcctgcacacgcataaattactgttgcagcacgctatggaacatggatcatttgacggcgcagatcagggcttgctgaattcattctttaggaattggtcaactacggatattcataagcacctaccgttcatctacaacctgagcagcaataccatgtatacttattctccagcctttaagcagtttggttcatccgccaaagttgtccatttcctaggaagcatgaagccttggaactacaagtataacccacagtccggcagtgttctggagcagggctctgccagctccagtcagcaccaggcagcctttctgcatttgtggtggacggtgtaccaaaacaatgtgctgcctctctacaagtctgttcaggccggggaagcacgggccagcccgggtcacacactgtgtcacagtgatgtcggtgggccttgtgccgactccgctagcggcgtgggcgagccctgtgagaactccaccccctcagctggagtgccctgcgctaatagtcctttaggatcaaatcagcccgcgcaaggcctgcctgagccaacacagatcgttgatgaaaccttatccctgccggagggcagacgttctgaggacatgatcgcctgtcccgaaactgagactcctgccgttatcacctgcgacccgttgtcgcagccttcgccacaaccagcggatttcaccgaaacagagacaattctccagccagctaataaggtcgaatccgttagctctgaggagacttttgaaccttctcaggagttgccagcagaggccttgcgagatccttccttacaggacgccctggaggtggacctcgccgtctcagtgtctcaaatctctattgaggaaaaagtaaaagaactcagccctgaggaagagcggagaaagtgggaagagggtagaattgactatatggggaaagatgctttcgcccgaattcaggagaaactggaccgctttctgcagtag

SEQ ID NO: 118815 - DNA, 417 bp, Artificial Sequence
  Description of Artificial Sequence: Synthetic coding sequence
atgagtgtgactgaccaggcctttgtcaccttggctacgaacgacatatattgtcagggcgcccttgttcttgggcagtctttaaggcggcaccgacttacgcgcaaattagttgtactaattacccctcaggtctctagcctcctccgcgtcatattatccaaggtgttcgacgaggtgatcgaggtgaatcttatagactccgccgactacatacacctggccttcttaaaacgccccgaattggggctgacgctcacaaagctgcactgctggaccttaacccactattctaagtgcgtgttcttggacgctgataccctcgtgctctccaatgtcgacgaactgtttgaccgcggcgagttctccgcagcacccgaccctggatggccagattgtttcaactctggagtgtag

SEQ ID NO: 118816 - DNA, 1293 bp, Artificial Sequence
  Description of Artificial Sequence: Synthetic coding sequence
atgagcgaaaccgagtttcatcatggcgcgcaggctggacttgagctgctgagatcatccaacagcccaacaagtgccagccaaagcgccggcatgacagtcaccgaccaagccttcgtgactttagccacaaacgatatctactgtcagggtgcccttgtgctgggccaatctcttcggcgccaccgtttgacacgaaagctcgtcgtgctgattacgcctcaggtgtccagcctccttcgcgtgattctcagtaaggtctttgatgaggtgatcgaggtaaacttaattgactctgcagactacatccacctggcgttcctgaaaagacctgagctgggtcttaccttgactaaactgcactgttggacattgactcactactcaaagtgtgtgtttttggacgcggacactctggtgctgagcaatgttgatgaactttttgaccgcggggagttttccgcagcacctgaccctggctggccagattgtttcaactccggcgtgtttgtgtttcagccttcactgcacacgcacaaactgcttctacagcatgccatggagcatggttcctttgacggcgctgaccagggtctgctaaacagcttctttagaaactggtccactaccgatatccacaagcacctgccattcatatataatctgtcgagcaacacaatgtacacctactcccccgcatttaagcagtttggatccagcgcaaaggttgttcactttcttggatcaatgaagccctggaactacaaatataacccacagtctgggtctgtactggaacagggcagcgcaagctccagccagcaccaggctgctttcctgcacctgtggtggaccgtgtatcagaataacgtgctccccctctacaagtcagtccaagcaggcgaagctcgggctagccccggacacacactgtgtcatagtgatgtcggtggcccgtgcgcagatagtgcctctggagtgggggagccatgtgagaatagtacaccttctgccggagtgccctgcgccaactctcccctcggatccaaccagcccgcacaagggctccccgaaccgacacagatcgtcgatgagactctaagcttacccgaagggcggcgttccgaagatgttgatctggccgtatctgtgtcccagatctcaatagaagagaaggtgaaggagctgagtcccgaggaggaacgtcgcaagtgggaagaaggcagaattgattatatgggcaaggacgcctttgcccggatccaggagaaacttgacaggtttctgcaatag

SEQ ID NO: 118817 - DNA, 354 bp, Artificial Sequence
  Description of Artificial Sequence: Synthetic coding sequence
atgtacgggaagataattttcgtgctgctactgtctgatactcacaagcgagacacctatgccgcgaccccacgggcacatgaggtgtctgagatatcagtccggacggtctatccacctgaggaggaaaccggggagcgggtgcagctcgcacaccatttctccgaacctgagattaccctgattatctttggtgtgatggctggggttattggcaccatactgctgatctcctacggtattcggcgcctcattaagaagtcaccctctgatgttaagccgttgccatctcctgacaccgacgttcccttgagttccgtagagatcgaaaatccagaaacctccgatcagtag

SEQ ID NO: 118818 - DNA, 453 bp, Artificial Sequence
  Description of Artificial Sequence: Synthetic coding sequence
atgtacggtaagataatctttgtgttgctccttagtgaaatcgttagcatctcagctctgtccacaaccgaagtggctatgcacacctccacatcttcttccgtcaccaaatcctacatttcttcacagactaacgacactcataagcgggatacatatgcggccacccccagggcccacgaagtgtccgaaatttccgtccggacagtttacccaccagaagaggaaacaggagagagagtgcagctggcccaccacttttcggaacctgagatcacactgattatctttggggtcatggctggcgtgatcgggaccattctgctgatctcatacggtatccgtcgcctgataaaaaaaagcccttctgacgtgaaacctcttccatcccccgataccgacgtccctttgtcttcagtcgagatcgagaaccccgagacaagtgaccagtag

SEQ ID NO: 118819 - DNA, 189 bp, Artificial Sequence
  Description of Artificial Sequence: Synthetic coding sequence
atgtatgggaaaatcatcttcgtgctgctcctcagtgagatcgtatccatatccgctctttctaccacagaggtggccatgcacacgagcacctcttcctcggtaaccaaaagttacatttcttcccagacaaacggcgaaagggtgcagctggctcaccattttagcgagcctgatttccataactag

SEQ ID NO: 118820 - DNA, 357 bp, Artificial Sequence
  Description of Artificial Sequence: Synthetic coding sequence
atgtatggtaagatcatctttgtcttattgctgtctgagatagtgagtatatccgccctgtcaaccacggaggttgccatgcacacaagcacctctagcagcgtgacaaaaagttacatttcatcacagacaaatggcgagcgggtgcagctcgcccaccatttttctgagccagagattactcttattatttttggggtcatggcaggagtcatcggtactattctgctgatcagctacggcattcggcggctgattaaaaagagcccctcagatgtcaaacccctgccttctccagacactgatgtccctttgtcctcagttgagattgagaaccccgagacatctgaccagtag

SEQ ID NO: 118821 - DNA, 414 bp, Artificial Sequence
  Description of Artificial Sequence: Synthetic coding sequence
atgtacggtaaaattatcttcgtgctgttacttagcgaaattgtcagcatctcagctctttctaccacagaggtagcaatgcacacaagcacaagctccagtgtgactaagagttatatctcatctcagaccaacgacacccacaagagggatacatacgccgccacaccccgggcccatgaggtgtcagaaatttccgttcggaccgtctacccacctgaagaggagaccgagattacactcataattttcggtgttatggcaggcgtgattggtacaattctcctgatcagttacgggattaggaggctgataaagaaaagtccaagcgacgtaaaaccacttccaagtcctgatactgatgtacctttgtccagcgtcgaaatcgagaaccccgaaaccagtgaccaatag

SEQ ID NO: 118822 - DNA, 258 bp, Artificial Sequence
  Description of Artificial Sequence: Synthetic coding sequence
atgtatggcaagattatatttgttttactgctcagcggggagagagtgcagcttgcccaccatttttctgagccggaaataacgcttataatctttggtgtgatggccggggtgatcggcaccatcttgctgatatcctatggcatcaggaggttaataaaaaagagcccttctgacgtgaagccacttccgagcccagatacagacgtccccctgtccagtgtggagatcgagaatccagagacgagcgaccagtag

SEQ ID NO: 118823 - DNA, 375 bp, Artificial Sequence
  Description of Artificial Sequence: Synthetic coding sequence
atgcacacttctaccagctcctctgtcactaagtcttatatctcttcacagactaatgatacccataagcgggatacatacgccgcaacccccagagcacacgaggtgtccgagattagtgtgcgaaccgtttaccctccggaggaggagactggagagcgggtgcaattggctcatcacttcagtgagcctgaaatcactctgatcatttttggcgtcatggccggggttatcgggacaatcctgctcattagttacggcattcgtagattgataaaaaagtctccctctgacgtcaagcctctgcccagtccggatacggatgtacctctctcgtcagtcgaaatagagaatcccgaaacatcagaccagtag

SEQ ID NO: 118824 - DNA, 276 bp, Artificial Sequence
  Description of Artificial Sequence: Synthetic coding sequence
atgtatgggaaaataatttttgtgttactgctgtccgagatagtgtccatcagcgctttaagtactactgaggttgcaatgcacacatcaacctccagttcagtgacaaagtcttacatatcctcacagaccaatggagaaactggccaactcgtccatcgctttacagtacccgcccctgtggtcatcatccttataatcctgtgcgtcatggctggtatcataggcacaattcttcttatatcatactcgatccggcggctcattaaagcttag

SEQ ID NO: 118825 - DNA, 276 bp, Artificial Sequence
  Description of Artificial Sequence: Synthetic coding sequence
atgtacgggaagattattttcgtgctcctgctgtctgagatcgtgtccattagtgcgctgagcacgacggaagtggctatgcacactagcacatcaagcagtgtcacgaaatcatacatatcgtctcagacgaacggagagactggacaactcgtacacagattcacagtgcccgcgcctgttgtcatcattctgataatcctgtgcgtcatggccggaatcatcggcactattcttctgatctcctacagcatccgtagactgataaaggcatag

SEQ ID NO: 118826 - DNA, 177 bp, Artificial Sequence
  Description of Artificial Sequence: Synthetic coding sequence
atgtacggtaagattatcttcgtgctgctgttgtccggcgaaaccggtcaactggtccatcggttcaccgtccccgctcctgtcgttataatcctgatcatactctgcgtcatggcaggaattattgggacgatactgctgatttcgtatagcatccgtaggctgattaaggcctag

SEQ ID NO: 118827 - DNA, 387 bp, Artificial Sequence
  Description of Artificial Sequence: Synthetic coding sequence
atgtggtcgacaagaagcccaaacagcacagcatggcctttgtcactggagcctgatcctggcatggcttccgcatctactaccatgcatacaacgacaatcgccgagcctgaccctggtatgtcagggtggcctgatggacggatggagacgagcacccccacgataatggatatagtggtgattgctggggtgattgctgctgtcgcgatagtccttgtgtcactgctattcgttatgctcaggtacatgtatcgtcataaaggcacatatcacaccaatgaggcaaaagggactgaattcgccgagtcagcagacgccgctcttcaaggtgaccccgctctgcaggacgctggagactcctctcggaaggagtactttatatag

SEQ ID NO: 118828 - DNA, 324 bp, Artificial Sequence
  Description of Artificial Sequence: Synthetic coding sequence
atggcctccgcaagtacaacaatgcacactaccactattgcggaacctgatcctggaatgtcaggatggcctgatgggaggatggagacgtcaaccccaacaatcatggatatagtggtgatcgcgggagtgatcgcggccgtcgccatagtcctggtgtctctgctctttgtgatgctgagatacatgtacaggcacaaaggcacctaccacaccaatgaggcaaagggaaccgagttcgccgagagtgcagatgccgccctgcagggagacccagcattgcaagacgcaggagactcgtcgcgcaaagaatacttcatctag

SEQ ID NO: 118829 - DNA, 330 bp, Artificial Sequence
  Description of Artificial Sequence: Synthetic coding sequence
atgtggtcaacaaggtcccccaactccaccgcgtggcccctgtccttggaacctgaccccggaatgtctgggtggcccgatgggagaatggagacctcaactcctacgattatggacattgtggtaatcgcaggagtgatcgctgccgtcgccatagttctcgtgagccttttgtttgtaatgttacgatatatgtacagacataaaggaacttaccacacaaatgaggcgaagggaaccgagtttgcggagtctgcagacgccgccttacagggcgaccccgccctgcaggatgcgggcgatagtagccggaaggagtattttatctag

SEQ ID NO: 118830 - DNA, 237 bp, Artificial Sequence
  Description of Artificial Sequence: Synthetic coding sequence
atgtacgggaaaatcattttcgtgctcctgttgtccggcatagtgtctatcagcgcctcttctacaacgggtgtggctatgcatacgagcaccagtagttcagtcaccaagtcttatatcagcagtcagaccaacggcattacgctgatcaactggtgggcgatggctagagtgatctttgaggtgatgcttgttgtggtgggcatgatcatcttaatctcatactgtattaggtag

SEQ ID NO: 118831 - DNA, 168 bp, Artificial Sequence
  Description of Artificial Sequence: Synthetic coding sequence
atgtacgggaagataatattcgtgctgctgttgagcgggattgtgagtatctccgctagtagcacgaccggcgtggcgatgcatacaagcacttccagttccgtcaccaaaagctacatttcttcccagaccaacggggagcgcggccagttggttcatcgcttctag

SEQ ID NO: 118832 - DNA, 237 bp, Artificial Sequence
  Description of Artificial Sequence: Synthetic coding sequence
atgtatgggaaaattatatttgtgctgttgttgagtgggattgtgagtatctctgcctcttcaacaaccggcgtggccatgcacacatccacttcttctagtgtaaccaagagctacatctcatctcagacaaatggcataacacttatcaactggtgggctatggcaagagtcatcttcgaggtaatgctagttgttgtgggtatgatcatcctcatctcctattgtatcaggtag

SEQ ID NO: 118833 - DNA, 180 bp, Artificial Sequence
  Description of Artificial Sequence: Synthetic coding sequence
atgtacgggaagatcatattcgtgctcctccttagtggtatcgtaagcatttcagcctcatcaaccactggtgtggccatgcacacgagtacgagctccagtgtcactaagtcttatatttcaagtcagacgaacggctgcgtgatcggtaacataatttgtagcgacaaaagtaagtag

SEQ ID NO: 118834 - DNA, 1605 bp, Artificial Sequence
  Description of Artificial Sequence: Synthetic coding sequence
atgcctcacttgatggagaggatggtcgggtcaggccttctgtggctggcgctggtttcatgcattctgacacaggcatcagccgtccagcggggatacggcaatccaatcgaagcgagtagttacggcctggatctggattgtggcgctccaggtacgccagaggcgcacgtatgcttcgatccatgccagaactatacactgttggacgaacctttccggtcaacggagaattctgcagggagccagggctgcgacaagaatatgagcggctggtataggttcgtgggcgaaggtggcgttcggatgtcagagacctgtgtgcaggtccatcgctgccaaacagacgcaccaatgtggctcaacggcacccatccggctttaggcgatggaatcaccaaccacacagcgtgcgcacattggtccggcaactgctgtttctggaagacagaagtcctcgtgaaggcttgcccaggcggataccacgtgtacagactcgagggcaccccttggtgcaatctgcggtactgtactgacccaagtactgtcgaggacaaatgtgagaaggcatgtcgtccagaagaagaatgcctcgcactcaactctacttggggctgtttctgtcgtcaagacttgaatagcagtgacgtgcactctctccaaccgcagcttgattgtgggccgcgagaaattaaagtcaaagtcgacaagtgcttgctgggcgggctgggtctgggggaggaggtgatcgcatacctgcgagatcctaactgttccagcatcctgcaaaccgaagaaagaaactgggtgtctgtgacaagtccggttcaagcaagcgcatgtagaaatattctggaaagaaatcagacacacgctatttacaaaaatacactttccctggtgaatgacttcataatcagagatacaatacttaatattaattttcaatgtgcatacccacttgatatgaaagtatcactgcaagcggctctgcaaccgattgtgtcttccttgaacgttagcgtcgacggcaatggcgaatttatcgtacggatggccctgttccaggaccaaaattacaccaacccgtacgagggggacgcagtcgagctcagcgtcgagtcagtcctgtacgtgggagcgatcttggagcagggcgacaccagccggttcaacttagtactccgcaactgttatgcaactccaactgaggataaagcagacctggtcaaatattttataatacgaaattcatgctccaatcagcgcgactctaccatacacgtggaagagaatggccagtccagtgagtccaggttctcggtgcaaatgtttatgttcgccggccactacgatctcgtgtttctgcactgcgagattcacctatgtgatagcctgaacgaacagtgtcagccatcctgtagccgtagccaggtgcggagtgaggttccagcaattgatctggcgagagttctagacttggggcccatcactcggcggggcgcccagagtccaggagtgatgaacggaaccccgtccactgctggatttctcgtggcctggccaatggttctcttaaccgtgctgctggcctggctgttttag

SEQ ID NO: 118835 - DNA, 1164 bp, Artificial Sequence
  Description of Artificial Sequence: Synthetic coding sequence
atgccccacctgatggagagaatggtgggctccggtctgctgtggctcgctcttgtaagctgcatattaacacaggccagcgcagtccaacgcgatcccagcacggtcgaggacaagtgtgagaaggcttgccggcccgaggaggaatgtctggcgctcaacagtacgtggggatgtttctgccgccaggatttaaacagctctgacgtgcattccctacagccccagctcgactgcgggccccgcgaaataaaggtaaaagtggataaatgcttactcggcggactgggtttaggtgaggaggtcattgcctacctccgcgaccccaactgttcctctatacttcaaactgaggagaggaattgggtgtccgtcacgtcaccagtgcaagcctcagcgtgcaggaacattttagaacgtaatcagacccacgctatctacaaaaacacactgtccctggtcaacgacttcataatacgagacacgattctgaatatcaactttcagtgcgcttatccgttggacatgaaggtctccctccaagcagccctgcagcctattgtgtcaagcctcaatgtgagtgtcgatggaaacggagaatttatcgttcgcatggccttattccaggatcaaaattataccaatccttacgagggcgatgctgttgaattgtccgtcgaatctgtcctctatgttggtgccatattagagcaaggggataccagtagattcaacctggtgctgcggaactgttacgcaactcctaccgaggataaagctgatcttgtaaagtacttcattattagaaatagctgctcaaatcagagagactccacaatacatgtggaggaaaacgggcaatcctcagaatcacgcttttccgtccagatgtttatgtttgcaggccactatgacttggtctttctgcactgtgaaatccatctttgtgattcacttaacgagcagtgccagccttcatgctccagatcccaggtacggtcagaagtcccagctatcgacctggcccgagttctggatctggggcccataacccggaggggagcccaatccccgggcgtgatgaacggcacccctagtacagccggatttctagtggcttggccaatggtgctcctgacagtactactggcctggttgttttag

SEQ ID NO: 118836 - DNA, 1173 bp, Artificial Sequence
  Description of Artificial Sequence: Synthetic coding sequence
atgccgcatctgatggaacgcatggttggctcggggctcctgtggctggccctcgtatcatgcatcctcacccaggcgagcgcagtccagagggtgcctagagaccctagtacagttgaggataaatgcgaaaaagcctgccggccagaagaggagtgtttggctcttaatagcacctgggggtgcttttgccgtcaagatctcaacagttcagacgttcatagtctgcagccacaactggactgcggtccccgggagattaaagtcaaagtggataaatgcttactaggcggcctcgggttaggcgaggaagtgatagcttatttgcgggaccctaattgctccagcattcttcaaacagaggagcgcaattgggtctcggtgactagtcctgtccaggcaagcgcttgtagaaacattctcgagaggaaccaaacacacgcaatttacaaaaatacattatccttagtcaatgatttcataataagagacaccattttgaacattaatttccaatgcgcttaccctttagacatgaaagtctctctgcaggccgctctgcaacctatcgtctccagcctcaatgtctccgtcgacgggaacggagaattcatcgtccggatggccctcttccaggatcagaactatacgaatccctacgagggagatgcggtcgagctgagcgttgagtctgtgctatatgtgggtgctattctcgagcagggcgatacctccagatttaacctggttctccgaaactgttacgcaactcccactgaggataaggcggatctagtgaagtacttcatcataagaaactcatgctccaaccagagagattccaccatccacgtggaggagaatggtcaatcatcagagtctcgcttctccgtccagatgttcatgtttgccggacactatgatttagtctttctgcattgtgagattcacctttgcgacagtttgaacgagcagtgccagccttcctgctcccggtcacaggttcgaagcgaagtgcccgcaatcgacctggcacgcgtgcttgacttgggccccattacccggcgcggagctcagtctcctggcgttatgaatggcaccccttccacggctgggtttctcgtagcttggccaatggtcctgctgacagttctgttggcatggctcttctag

SEQ ID NO: 118837 - DNA, 1614 bp, Artificial Sequence
  Description of Artificial Sequence: Synthetic coding sequence
atgccccatctaatggagagaatggttgggtcagggctgctgtggttggctctggtctcttgcatcctgacccaggctagcgccgtacagcgaggatacggcaaccccatagaggcctctagttatggacttgatttggactgcggcgcccccggcacgcctgaagcccacgtctgttttgatccctgccaaaactatacccttttggacgagccattccgctctacggaaaatagcgctggttctcagggttgtgacaagaatatgagtggctggtacagattcgtaggagagggcggagtacggatgtctgagacctgtgtccaggtgcacagatgccaaacagacgcaccgatgtggttgaatggcactcatccggcactaggagatggaattaccaatcacacagcatgtgctcattggtctggcaactgttgtttctggaaaacagaggtgcttgtgaaggcctgccctggggggtatcacgtgtaccgcctggaaggtactccatggtgcaacctgagatactgtacagttcctcgggatccatccacggtggaagacaaatgcgaaaaggcatgccggcctgaagaagagtgcctggcactgaacagcacttgggggtgtttctgcaggcaggatctcaattcgtccgacgtccattcactgcaaccacagctggactgcggcccccgtgagatcaaagtgaaggtggacaagtgtttgttggggggactcgggctgggggaagaagtcatagcgtacctcagagacccaaactgtagctccattcttcagactgaagaaagaaactgggtgagtgtaaccagccctgtccaagcttccgcttgtcgtaatatcctggagcgtaaccaaacccatgcaatctacaagaacacactcagcctagtgaatgatttcattatcagggatacaattctcaacatcaatttccagtgtgcctatcccctcgatatgaaggtgagcctgcaggccgctctgcagccaatagtctcttcacttaatgtgagcgtcgatggtaatggagagttcatcgttagaatggccttgtttcaagatcagaattacaccaacccctacgagggcgacgcagttgaacttagcgtagagagcgtgctgtacgtaggggcgatcttggaacagggggataccagcagattcaacttggtgctcagaaactgttacgccacacccactgaggacaaggcggacttggtaaaatacttcataattcggaacagctgttcgaaccaaagagactcaactatccacgttgaggaaaatggacaaagcagcgagtcccgcttctctgttcaaatgttcatgtttgcaggccattatgaccttgtgtttctacactgcgagatccatctctgcgacagtctcaacgagcaatgtcaaccaagctgttctcgctctcaggtccgttcagaagtacctgcaatagacctggctcgagttctcgatctgggacccattacccggcggggagcacaaagcccaggggttatgaatgggacaccctccaccgccgggtttttggtggcttggcccatggtgctcctcaccgtgttactcgcctggctcttttag

SEQ ID NO: 118838 - DNA, 1548 bp, Artificial Sequence
  Description of Artificial Sequence: Synthetic coding sequence
atgaagataaagtgcgagaagagccggacacagtcatcagcacagcatgttcagcactctgcccactcgacaattgtatgccgcaaacatagccacaatgccgaaacagctggccgtgtggatattgtcagaggcggccccttttttcatcatccactgcggaagtggctgatctctccacccttgaacaaaccctccgtgtggcctcggactccaatcatacccgtccaccagctgaggagagatacctgggtcggcaattgcaacaagaagactgcccatagcaggctccattcccacggatggccagaggaagagcggtttgtgttttcctccgagctgcacggtaaaagcgcatattcaaaggtgacatgtatgccccatctcatggagcggatggtaggttcaggcctcctgtggcttgcgctcgtctcttgcatccttactcaggccagcgctgtgcagagagaccatctggacccctccaccgtcgaagataagtgtgagaaagcttgcaggccagaagaggagtgccttgctctgaacagtacatggggttgtttttgccgtcaagacctgaactcctctgacgtacattcactacagccccagctcgattgcggtcctagagaaattaaagttaaggtggacaagtgtctgcttggcggcctgggtctcggagaagaggtgatcgcctacctgcgggatcccaattgctccagcattttacaaaccgaggagaggaattgggtgtcagtgacatctcccgtgcaggcctccgcatgccgaaacattttggagcgaaatcaaacccacgctatctataagaacactctcagtctagttaacgacttcatcatccgagacacaatcttaaacatcaatttccagtgtgcctaccccctggacatgaaggtgagtctccaggctgcccttcagccaatcgtgtccagcttgaatgtcagtgtagatggaaacggtgagtttattgtgcgcatggccctctttcaggatcaaaattatacgaacccatacgaaggcgatgcagttgagctgtctgtcgagtccgtgctttatgtcggagcaattctggagcagggcgacaccagcaggtttaacctggtactgagaaattgctatgccacccccactgaagataaggccgacctggtgaagtacttcatcattaggaatagctgtagcaatcaacgggattctaccattcatgtggaggagaacggccagtcctctgaaagtagattttccgtacaaatgttcatgttcgccggacattacgatctcgtttttctccactgtgagattcacttatgtgacagcctcaatgagcagtgccaaccatcatgctcgcgttcgcaggttcgtagtgaagtgcctgcaattgacctggcccgcgtacttgatctcggccccattacaagaagaggtgcgcagtcccccggcgtgatgaacgggaccccttcaaccgctggattcctggtcgcttggcctatggtactcctgacagtgctgctggcgtggctgttttag

SEQ ID NO: 118839 - DNA, 1959 bp, Artificial Sequence
  Description of Artificial Sequence: Synthetic coding sequence
atgcccctgttgctcctgcttttgctgctaccttccccactccatccacaccctatttgcgaagtgagtaaagtcgcttcgcacctggaggtgaactgtgacaagcgtaacctcactgccttacctccagacctcccaaaagacactacaatcttgcacttgtccgaaaatctgctttacactttttccctggctactcttatgccctacacccgattgactcagctcaacctcgataggtgcgaactgaccaaacttcaggtggatggcaccttgccagttcttggcacgctggatctctctcacaatcagctgcaatccctgccattgctcgggcagaccctgccagcattgactgtcctggatgtgtcattcaaccgactaacttccctccccttaggtgctctgcgcggtctgggggagctgcaagaactgtatctgaaaggcaacgaactgaaaaccctgcctcctggcctgctgaccccaacccctaaactggagaaactgtcccttgctaacaataacctgacagagcttcctgccggactcctcaatggactggaaaacctagataccctgttattgcaggaaaattcactgtacactatccccaagggattttttggctctcatttgctgcccttcgcgttcttacacgggaacccttggctctgcaattgtgagatcctatattttcgccgatggctccaagataatgctgagaacgtatatgtgtggaaacagggggtggatgtgaaggccatgacctccaacgttgcctcagttcagtgtgataattctgacaagtttccggtgtacaagtatccaggaaagggctgccccacccttggcgacgagggcgacaccgacctctatgattattaccccgaggaagacaccgagggtgataaggttagagctacacgaaccgtggtgaagttccctaccaaagcgcataccacgccatggggcctcttctattcatggtcaaccgcgagccttgatagtcagatgccttctagcctccatcccacacaggagtctacaaaggagcagactacttttcctccgaggtggacccctaactttaccctgcatatggagagcatcacctttagcaagactccgaagtccactaccgaacccaccccttcccctaccaccagcgagcccgtgccagaacctgctcccaacatgacaactctggagcctacaccatcgcccaccacgcccgagcccacctcagagcccgcaccctctcctactaccccagaacctacttcagagcccgctccgtctccgacaacacccgagcccaccagtgagccggctccctcaccgacaactcccgagcccacacccatcccaacgattgctacctcacctaccatactggtctcagccacttctctgatcacccctaagtccacatttctcaccacgactaagccagtatcccttctcgaatcgaccaaaaagactatacctgagcttgaccagccgccgaaactgaggggtgtgctacagggtcatctcgaaagttccaggaatgatcccttcctacatcccgacttctgctgtctgctccccctgggcttttacgtgctcggattgttctggttgctatttgctagtgtcgtgttgatcctactcctgtcttgggtgggccatgtgaaaccccaggcattggatagcgggcagggggccgccttaaccacggcaacccaaacaacacacctggaactccagcgcggacgccaagtgaccgtgcctagggcgtggcttctgtttctcagaggaagtctaccaacatttcgctcctcactgtttctttgggtccggccgaatggtcgcgtaggtcctctggtagctggaagaaggccatctgcgttgagccaaggtaggggacaggacctcttgtccacagtgtcaatcagatattctgggcatagtctgtag

SEQ ID NO: 118840 - DNA, 1881 bp, Artificial Sequence
  Description of Artificial Sequence: Synthetic coding sequence
atgcctttgctgctgttactgttacttctcccctccccactgcatccccacccaatttgtgaagtctccaaagtggctagtcacttggaagtgaactgcgacaagagaaatctgaccgccctgccccccgatttgccgaaagatacgaccattctccatctcagcgaaaacctcctttacacgttttcgttggccactttgatgccatacactcgcctcacccagttgaacctcgacagatgcgagctgacgaagctgcaggttgatgggaccctgcccgttctcggaactcttgaccttagtcataaccagttacagtctttacccctgctagggcaaaccctgccagctctaacagtgcttgatgtgagcttcaatcgccttacatcgctgcccctgggcgcgttaagaggcttgggggagctccaggagttgtacctgaaaggcaacgaactcaagacacttccccccggcttgctgacaccaaccccaaaactggaaaaactgagcctagcgaacaataatttgacggaattgccggccggtctcctgaacggcctggaaaatcttgacactctgttactccaagagaattcactgtataccattcctaaggggttttttggtagtcacttgcttccttttgcattcctccatggtaatccctggctgtgtaattgtgaaattctgtacttccgacgctggctccaagacaatgccgagaatgtatatgtctggaagcagggggtggatgttaaagcaatgacttctaacgtcgcgagcgtgcagtgcgataactctgacaaattccctgtgtacaagtacccggggaaggggtgccctaccctcggagacgaaggcgacacagacctgtacgattactatcctgaggaagataccgaaggagacaaagtccgggccactcggactgttgtgaaatttccaacaaaagcccacaccactccgtggggcttgttttattcctggtctaccgcctctctggactctcagatgccttcaagcctgcacccgactcaagaatctaccaaggagcaaaccaccttccctcccagatggacaccgaacttcaccctccacatggaatcgattaccttcagtaagacccccaagtcgacaacagagccaacgcccagtcctacgacttccgagcccgtgcccgagcccgcacccaacatgactactctagaacctacacccagtcctactaccccggagcctacctctgagcctgcacctagccctacaacaccagagccaacccccatccctaccatcgcaacatcccccaccattcttgtttcagctacatctctgattacgcccaaaagcactttcttaaccaccacgaagcctgtctccctgcttgagagtaccaagaagactataccggaactcgaccagccaccaaagctccggggtgtgctgcagggtcacttggagtccagcagaaacgatccctttctgcatccagacttttgctgtctgttgcctctggggttctacgtcctgggcttattttggctcttgttcgctagcgttgtactgatactccttctctcttgggttggtcacgtgaaacctcaggcgctcgacagcggacagggcgctgccctgacaacagcgactcagactactcatctggagctgcagagggggcggcaggtaaccgtgcctagggcatggctgctttttttaagggggtcgctgcctacctttcgcagttcactgtttctgtgggttcggcctaacgggcgcgttggtcctcttgtggcagggagacgtccaagcgcgctttcacagggtcgggggcaagatcttctcagcaccgtgagtatccggtattcaggccactcgctctag

SEQ ID NO: 118841 - DNA, 621 bp, Artificial Sequence
  Description of Artificial Sequence: Synthetic coding sequence
atgggcagcggtccaagaggagccctcagtctgctcttattactgttggcacctcctagtcggccagcggccggctgccctgctccttgctcgtgcgcaggcaccttagtagactgtggccgcagaggactcacttgggccagccttcccaccgccttcccagtggatacgacagaattggtgctgacagggaacaacctgacggcgttgccccctgggctcttggacgccctgcccgcactccggacggctcacctgggggctaacccctggcggtgcgactgccgactagtgcctttgcgcgcttggctcgcgggccgccctgagcgggccccttatcgtgaccttcggtgtgtcgcgccgcccgcactgcgtggacgcctcctcccttacctcgcagaggacgagttacgggccgcgtgcgcccctggtccactctgctggggggcactggcagctcagttagccctgctgggattggggttgctgcatgccttattacttgtcctactgctgtgccgtctccggaggttgagggctcgcgcacgcgcccgtgccgccgcacgcttatcactcactgatcccctggttgccgaacgtgcggggaccgacgagtcttag

SEQ ID NO: 118842 - DNA, 1230 bp, Artificial Sequence
  Description of Artificial Sequence: Synthetic coding sequence
atgataccgtccaggcacaccatgctccgattcctgccagtcaacgccgcttcctgcccaggggacaggcgtaccatgcttgttaatgtggctgctggggtgcgtgtgttacgagttcccctgagggccggcgggtctggctctctgtccggtttgcggccacccgctattgtttgttacctaccgcttcaaagagcctctgcttcaggcctgttccttgctagacctcaacattgcggccgctgcggacgaggccggggaggtgctgcactcagcttggggagtcccgcctacgcctcgaggtgtcgcgtatcacgggcagcagttttctccccctgggcccccgtttccctagagagcggtcgtgcccccggttgcagccttggtcgcccggggcttcggggggctctggtagtttggctgcaactgggggagacctgggtccggctgagaggcgatttccagcctgcttgtggtgttgttagagtcgaacggttggctggctaccgcgacgctgggcaccaagggcttgacggagccgggcccgccgtctgggttctaagagacgtcgctcaagtgcctgccgaccgaagcgcctactgcggcgcctccctggccggtccacgcggagcgctctccttgttgttgctcctgttagctccaccgagtcgtcccgccgctgggtgtcccgctccctgctcatgtgccggtacattggtggattgtggaaggaggggcctgacctgggcaagtctccctacagccttccccgtagacaccaccgagctagtcctaaccggcaacaatctgactgctttgccacctggtctgctggatgctctgcccgccctgaggacagcacacctgggcgctaatccgtggcggtgtgactgtagattggtgccattgcgggcgtggctggctggaaggccagagagggctccttatcgcgacctcagatgtgtggcccctcctgctctccgtggacggcttcttccatacctcgccgaggacgagctcagagcagcttgtgcacccgggccgctgtgttggggcgctctggccgcccagctggctttgttaggtctcgggctcttgcacgctctgttactggttctgctcctctgcaggctacgcaggttgagggctagggctagagcaagagctgccgccagactcagtttgacagacccactggtcgctgagagggctgggactgatgaatcttag

SEQ ID NO: 118843 - DNA, 534 bp, Artificial Sequence
  Description of Artificial Sequence: Synthetic coding sequence
atgcccgcctggggcgcccttttccttctgtgggctaccgctgaggctacgaaggactgccccagcccctgcacgtgccgagcactggagactatggggctgtgggtggactgtagaggccacggtctaaccgctctccctgccctgcctgcgcgcacaagacatctgctcctggccaataatagcctgcagtcggtgcccccaggggcgttcgaccacctccctcagctgcagacacttgacgtcactcagaatccttggcactgcgattgtagcctgacctatctacggctgtggctggaggataggacacccgaagctttgttgcaggtgaggtgtgcctccccgtctctcgcagcacacgggcccctaggtaggctgactggttaccaactgggctcttgcggatggcaactccaggcctcatgggttaggcccggggtgttatgggatgtcgcccttgttgcagttgcggctttgggcctggccttgctcgcagggctcttatgcgctacgactgaagcactggattag

SEQ ID NO: 118844 - DNA, 987 bp, Artificial Sequence
  Description of Artificial Sequence: Synthetic coding sequence
atgaagccagctatggagaccgctgctgaggaaaacactgagcagtcgcaggagaggaaagtcaactcaagagccgagatggagattgggcgctaccattggatgtacccaggctctaaaaaccaccagtaccacccagtgccaacgcttggcgacagagcttcccctctgagtagtccaggttgcttcgagtgttgtatcaaatgccttggaggcgtgccctatgcaagcttggtcgctactattctgtgcttctcaggcgtagcccttttctgtgggtgcgggcacgtcgcactggccggtactgtcgccattctcgagcagcatttcagtacaaacgccagcgatcacgctctcctgtctgaggtgattcaactcatgcagtacgtgatctatggtattgcctctttcttctttctatatggcattattttgttggccgaagggttctatacgacatcagccgtgaaggagcttcatggagagttcaagacaacggcttgcggacgctgcattagtggaatgtttgtgttcctgacatacgtgctgggagtggcctggttaggcgtgtttgggtttagcgctgtgcccgtgtttatgttctataatatatggtccacctgtgaggtgattaaaagcccccagaccaatggcacaacaggggttgagcagatctgcgtagacattcgccagtacggcatcatcccttggaatgcttttccaggtaaaatctgcggctccgccctcgaaaacatctgcaatactaatgaattctacatgagttaccacctgttcattgttgcctgcgctggagctggcgccacggtgattgccctcatccatttcctaatgatcctatcaagcaattgggcctacctgaaagacgcaagtaaaatgcaggcctatcaagatataaaggccaaagaggagcaggaactccaggatattcaaagcaggagtaaagagcagctgaacagctacacttag

SEQ ID NO: 118845 - DNA, 918 bp, Artificial Sequence
  Description of Artificial Sequence: Synthetic coding sequence
atgaaacctgctatggagactgccgccgaggagaacaccgagcagtcccaggaaaggaaggtgaacagccgcgccgaaatggaaatagggagatatcattggatgtacccagggtctaagaatcaccagtatcaccccgtccccacactgggagaccgggcaagcccgctgagttctcccggatgctttgaatgttgtatcaagtgtctcggcggagtcccctacgcctctttggtcgcaacaattctgtgttttagcggcgtggctctattttgtggatgtggacatgtggcattggcggggacagtggccattttagagcagcacttttccaccaatgcttccgaccacgctctgctcagcgaggtgatccagctgatgcagtacgtcatttacggaattgcatcttttttctttttgtacgggattattctgctggcggagggattctataccactagcgcggtcaaggaattgcatggcgaatttaagacgacggcatgtggcaggtgtatcagcggaatgtttgtcttcctgacatacgttttgggggtggcctggctcggggtgtttggcttcagcgccgtccccgtattcatgttttacaacatttggagcacgtgcgaggttatcaaaagcccgcagactaacgggaccacgggtgtggagcagatctgtgtggacatccgccagtatggcatcatcccatggaatgccttcccaggtaagatttgcgggagcgcgcttgaaaacatttgcaacaccaacgagttttacatgtcctaccatctgttcattgtggcttgtgctggagccggagcaaccgtgattgctctcctcatatatatgatggccaccacatacaactacgcggtacttaagtttaagtctcgagaggactgctgtactaaattttag

SEQ ID NO: 118846 - DNA, 798 bp, Artificial Sequence
  Description of Artificial Sequence: Synthetic coding sequence
atgaagcctgctatggagaccgccgcagaagagaacacagaacaatcccaggagagaaagggctgtttcgaatgttgcataaagtgtctgggcggtgtgccgtacgcatcgctcgtggcgaccattctgtgtttcagcggggtggctctgttttgcggttgcgggcatgtagccctggcagggaccgtggcgattctcgagcaacatttcagtaccaatgcgtccgatcacgccctactgagcgaggtgatacagctcatgcagtacgtgatctacggaattgcctcattcttttttctatacggaatcatcttactggctgaaggtttctacaccacctcagcagttaaagaactccacggcgagttcaaaaccacagcatgcggtagatgcatttccggcatgttcgtctttctcacatacgtcctcggcgtcgcttggttgggagtattcgggttcagtgccgtgcccgtgttcatgttctacaatatatggtcaacatgtgaggtgataaagtcacctcagacaaatggaactaccggagtcgagcagatctgcgtggatattaggcagtacggaattataccatggaatgcctttcctgggaagatttgtggctccgccttggagaacatatgtaacaccaatgagttctacatgagttatcatctctttattgttgcttgcgctggcgccggcgccaccgtgattgctctgctgatatacatgatggcaaccacctataactatgcggttttgaaatttaaatctcgagaggactgttgtacaaagttttag

SEQ ID NO: 118847 - DNA, 540 bp, Artificial Sequence
  Description of Artificial Sequence: Synthetic coding sequence
atgcagtacgtgatttacggcattgcctcttttttcttcctatacggcattatcctgcttgctgagggcttttacacaaccagcgccgtgaaggagcttcacggcgagttcaagacaactgcctgtggccgctgtatatctggcatgtttgtgtttctgacctacgtgttgggcgtggcctggttgggtgtcttcggatttagtgctgttcctgtattcatgttttataacatttggagcacctgtgaggtaatcaaatcgccacagaccaatggcactacaggggtcgaacagatttgtgtggacatcagacaatacggtatcataccttggaacgccttcccaggcaaaatttgtggcagcgcccttgagaacatatgtaacaccaacgaattttacatgagttaccacctttttatagtagcctgcgccggtgccggagctacagtcattgccctgctcatatatatgatggccacgacgtacaactatgccgtcctaaaatttaagagtagggaagactgctgcaccaagttctag

SEQ ID NO: 118848 - DNA, 741 bp, Artificial Sequence
  Description of Artificial Sequence: Synthetic coding sequence
atggggtgctttgagtgttgtattaagtgtcttggcggcgtcccgtacgcctctttagtggcgaccatactttgtttcagcggcgtggccttgttttgcgggtgcgggcacgtggcactggccggaacagttgccatattggagcaacacttctcgacgaacgcttcagatcacgcacttcttagcgaggttatccagcttatgcagtacgtgatctacggcatcgcttctttcttttttctttatggtatcatcctgcttgcggaaggtttctatacaacttctgccgtcaaagagctacatggcgaattcaagacgactgcttgcggccgctgtatctccggtatgtttgtcttcttgacttacgtgttgggggttgcgtggctaggcgtttttggtttcagcgcagtcccggtgttcatgttctacaacatctggtctacttgcgaagtgattaagtcccctcagactaatggcaccaccggcgtggaacagatctgtgttgatatcagacaatatgggatcatcccatggaacgccttcccgggtaaaatctgtgggagcgctctggagaatatatgcaacacaaacgagttctacatgtcataccatctgttcatcgtggcctgcgccggggctggggccaccgtgatcgcactgctgatctacatgatggctactacctacaattatgctgtcctgaaattcaaaagcagagaggattgctgcaccaaattctag

SEQ ID NO: 118849 - DNA, 324 bp, Artificial Sequence
  Description of Artificial Sequence: Synthetic coding sequence
atgaagcctgctatggagactgccgcggaagaaaacaccgaacaatcgcaggaacgcaaaggatgttttgagtgttgtatcaagtgtcttggtggggtgccgtacgcctcactggtggcgactatcttgtgttttagcggcgtggctctgttttgtggatgcggccacgtcgctctggcaggtactgtggcaatcttggagcagcatttctccactaacgctagtgatcacgcactcctgtccgaagtcatccaactaatgcagtacgttatttacggaattgcttcatttttcttcctatatggtatcatactacttgcctag

SEQ ID NO: 118850 - DNA, 909 bp, Artificial Sequence
  Description of Artificial Sequence: Synthetic coding sequence
atggaaattggacggtatcattggatgtatcccggctcaaagaaccatcaatatcacccggtgcctacgctgggagacagagcctcccccctctcctccccaggatgctttgaatgctgcatcaaatgtctggggggcgttccatatgcatccctggtggccaccattctttgtttcagcggggtcgcgctgttctgtgggtgtggacacgtggcactcgctggtacagtggcaatcctcgagcagcacttctcaacgaacgcttccgaccatgcattactgagcgaggttattcagctgatgcagtatgtcatctatggcatagcatcgttcttcttcctctatgggatcatactgctggccgagggattctatacaacctcagccgtgaaggagctgcatggggaatttaaaactacagcttgtggcaggtgcatctctggtatgtttgtgtttctgacttacgttttaggcgttgcttggctcggggtcttcggattctccgctgtgcccgtttttatgttttacaatatctggtcgacctgcgaggtcattaagtctccccagactaatggcaccactggagtggagcagatctgcgtggatattcggcaatatggcatcataccatggaacgcgtttccaggcaaaatctgtggttccgctttagagaacatttgcaacacaaatgagttttacatgagttaccaccttttcattgtggcatgtgcaggggcaggcgcaactgtgattgccctgattcatttcctgatgatcttaagcagcaactgggcctatctcaaggatgcctctaaaatgcaagcatatcaagacatcaaggccaaagaagaacaggagctgcaggacattcagagccggagcaaagaacagcttaacagttatacatag

SEQ ID NO: 118851 - DNA, 1863 bp, Artificial Sequence
  Description of Artificial Sequence: Synthetic coding sequence
atgtccccttctcccaccgctctgttttgtctgggcctgtgcttgggccgcgtgcctgcccagtctggtcctctccccaaaccatccctgcaggctctcccctcttcactggtgcctctggaaaagcccgtgaccctgcgctgccagggaccacctggggtcgacctctataggctggagaagttgtctagcagtaggtatcaagaccaagccgttctgtttatccccgcaatgaaacgatctctcgccggtcgctaccgttgctcgtatcaaaacggctccctctggtctctgccaagcgaccagttggagcttgtggccacaggagtttttgccaagccctctctgtctgcccagccggggcctgccgtgagtagtgggggcgatgttactctccagtgccaaacaagatatggatttgaccagtttgcgctttataaggagggtgatccggccccatacaaaaatcccgaacggtggtatcgcgccagtttcccaattattacggtgacagcagctcatagtggaacgtatcggtgttatagcttcagttccagggacccgtacctctggagcgccccaagtgatcctctggagcttgtcgtgaccggcacctcagttacaccttctcggctacctacagaacccccctccccggtcgctgaattttcagaagcaacagcagaactgacggtgtcttttaccaacgaggttttcaccacggagacttccagaagtatcacagcttcccccaaagagtcagatagtccagcaggcgagtcctgcccacctgtgctgcaccagggccaaccagggccagatatgccccgggggtgtgatcccaataacccagggggagtttctgggcggggcctagcccagcctgaggaggcacctgcggctcagggccagggctgtgcagaggcagcaagcgcgccccccgctcccccagctgatcccgagattaagcggggatctggctggcgccctaccggctgctcacagcctagagtgatgttcatgacagccgagccacaggcccgatcctatccccgtgagggttcctggcacggacgcagactcaaagactggcgtgtgtggtccgtggaggcgggtggacaacggctccagctgtggaagagagggcatgccgctagctcatggtgcagcatccgagaaccttttggacaatgcctctcagtttgtctccctctttgtcttcgcgcaccatctatttgggacgggagaaatctgtggcgtcctcatccacctccttgcacactctggatgacttggtacccaggatggacaacatactggcccctgtcatccacatcactgatctgggcacccgatggttctctccgtttccctgcactccgggtggattccgttccctcgtctgtccaaaatccaccggtgcttccctttggccccttatgcagttgcctggtgttccctcggaatagccacccacatagcatcagccactgtggccttactaatttactgtcaagcctgcggaccggtctagctggcagccttggaatgagtttcatttttctttctgtgaagctggccaggtgccctctcccctttaccctggagaacaaaatcagcctatgcaacatggtgaaaccccatttgtatcagcagaataagaagacccaaaagttggcccgatgcggcggagcaagcttgtactcgcagcagttgcgcggactgagatgggaaaacggactaagcctaggggggcggggatgttccgaactacggtctcaccactgtaccctggcgcgagttaccaaacctgacttcgtttccaaaaatactgggatgaatatgagtattaccctgatttag

SEQ ID NO: 118852 - DNA, 966 bp, Artificial Sequence
  Description of Artificial Sequence: Synthetic coding sequence
atgagcccctcaccaacagccctgttttgtctcggtctgtgtctcgggagagtaccagctcaaagcggacctctgcccaagccaagcttacaggctttgccctcctctctcgttcctctggagaagcccgttacgctcagatgtcaaggacctcccggggtcgacctgtacagactcgagaaactgtcctccagtagataccaggatcaggctgttctgttcatacctgccatgaaacgtagtcttgcaggccgttatcggtgttcataccagaacggtagcctctggtcgctgccctctgatcaactggaactcgtggccaccggagtatttgctaaaccgagccttagcgcccagcccggccctgccgtatcctctgggggagatgttaccctgcagtgtcagactagatatgggtttgaccagttcgctctatataaggagggagatccagccccgtataaaaaccctgaacgctggtaccgagcgtcctttcccatcataactgtgactgccgcccattcgggaacctatcggtgctattccttttcaagcagggacccatacctgtggagcgcccctagcgatccactggagctggtagtgacagagttctcagaggccacagcagagctgacagtatcctttacaaatgaggtgtttactactgaaaccagtcgcagtatcacagccagccctaaggagtctgattcccctgccggaccagccagacaatattatactaaaggaaacttagtccgaatctgcctcggagccgtaattctgattatcctggccggctttcttgccgaggactggcatagcaggcggaagagactacgccacaggggacgggccgtacagcgcccactgcctcccctgccacccctgcccctgactcggaaaagcaacggaggccaggatggaggaagacaagacgttcactctcgaggactgtgctcttag

SEQ ID NO: 118853 - DNA, 1020 bp, Artificial Sequence
  Description of Artificial Sequence: Synthetic coding sequence
atgagtccctcccctactgccctgttttgcctaggactgtgtctggggcgcgtaccagcccagagcgggccactgcccaagccttcccttcaggctttgccatctagcttggtgccccttgagaagcccgtgacgcttcgatgccagggacctcccggagtggatctgtatcgcctggagaagcttagttcctcacgctaccaagaccaggccgttctgttcattcccgccatgaaaaggagcctagcaggccgctatcgatgtagttatcagaatgggagcctgtggagtttacccagcgatcaactggagttggtggccaccggagtgttcgccaagcccagtctttccgcacaacctggaccagccgtttctagcggaggtgacgtgaccctacagtgccagaccagatatgggttcgatcaattcgccctctataaggagggtgatcctgctccctataagaatcctgagcggtggtaccgtgcatctttcccaattatcaccgttactgccgcccattctggtacttacaggtgctacagtttcagctcccgagatccttatctgtggtccgcaccgtctgatcccctagaactggtagtcacaggtactagtgttactccctcccggctgcctacagagcctccgtccccagtggcggagttttctgaggccaccgcagagctgacagtgtcgtttactaacgaggtgtttacgactgagacttccaggtcaatcacagcgtcccctaaggaaagcgacagtccagccggccccgctcgacagtactataccaagggtaaccttgtccggatatgtctgggcgccgtgatcttgataatcttggcgggatttttggcggaagactggcacagtcggcggaagcggctgaggcatcggggacgcgccgttcagcgccctctccctccactgccccccctgcctttgaccaggaagagcaatggcggacaagatggcgggcgtcaggatgtccattcacgagggctgtgcagctag

SEQ ID NO: 118854 - DNA, 1866 bp, Artificial Sequence
  Description of Artificial Sequence: Synthetic coding sequence
atgggcctgctaagcgatcccgttagacgacgagcgctcgccagattggtgttaagattaaacgcccctctctgtgtcctttcgtatgttgctgggatcgcttggttcttggccctggtgtttcctcctctgacacagcggacgtatatgtctgagaatgctatgggatccacaatggtggaagaacagtttgccggaggagaccgtgcaagggccttcgccagagattttgctgcccaccgaaaaaaatctggggcgttgcctgtggcttggttagagcgaaccatgagatctgtgggcctggaagtctacacccagagttttagccgaaagctaccatttcctgacgagacacacgagcggtacatggtttcgggaaccaatgtgtacggaatcctgagggccccacgagcggccagcaccgagtctctcgtgctgaccgttccttgcgggtccgatagcactaattctcaggctgtcggcctactgctggccctggctgcgcacttccgcgggcagatttactgggccaaggatatcgttttcctggtgactgagcatgacctgctcgggaccgaggcatggctcgaagcgtaccatgacgtaaatgttactgggatgcagtccagccctctccagggaagggccggagccatccaggccgcagtggccttggagctgtcttcggatgtggtgacctccttggacgtggctgtggaagggttaaatgggcaactgcccaaccttgacttgctgaacctttttcagaccttctgtcagaaaggcgggctgctatgcactcttcagggcaagctgcagcccgaagattggacatccctggatggcccactacagggtttgcagaccctcctcttgatggtcctgcgccaggcatctgggcgaccacacgggtcacacgggctgttcctgcgctatagggttgaagctctgaccttacgtggcataaactcctttcgccagtacaagtacgatctagttgccgttggaaaagcactagagggtatgtttcggaagctcaaccacctgctagagcgcctccaccagtcattttttctgtacctgctccctggactctcaagatttgtgtccataggcctgtacatgcccgcggtgggattcttactgctcgtgctggggctgaaagctctcgagctgtggatgcaactccatgaagccggaatgggcctcgaggaaccaggaggcgccccaggcccaagcgttccattgccaccatcccagggagtggggttagctagcctcgtcgcaccgctcctcatatctcaagcaatgggcctggccctttatgtcctgcctgttctggggcagcacgtcgctacgcagcattttcctgtggccgaggccgaagcggtcgttctgaccctgctagcgatctacgccgcgggacttgcgcttccccacaatactcaccgcgtggtttcaactcaagcaccagacagagggtggatggcactcaagctcgtggccctgatttatctggccctgcagctgggatgtatagccctaaccaacttcagtctcggttttctcctggccactactatggttccaaccgcagccctcgccaaaccacatggtcctcgcactttgtatgctgccctactggtgctgacgtcacccgccgccaccttactggggtcacttttcctctggcgcgagctgcaggaagcccctttgtctctggcagagggctggcagctgtttttagccgcgcttgcccagggtgtgttggagcaccacacatacggcgcactgttatttcctctgttgtcgctggggttatatccatgttggttgttgttttggaatgtgcttttttggaaatag

SEQ ID NO: 118855 - DNA, 1686 bp, Artificial Sequence
  Description of Artificial Sequence: Synthetic coding sequence
atgggtctgttatccgaccccgtgaggagaagagctctggcccgactggtgttgcggctgaacgcccctctgtgggcattgcccgtggcttggttggagagaactatgagaagtgtgggtctggaggtgtatactcaatcatttagccgcaaactgcctttcccagacgaaacacacgagcgatacatggtttccggcaccaacgtgtatggaatcctccgtgcccccagggctgcctccacagagagcttagtgctgacggtcccatgcggtagtgatagcaccaattcccaggctgtaggcctcctgctggcattagccgctcactttaggggccagatttattgggcaaaggatattgtgttcctggttaccgaacatgaccttctcggaaccgaagcttggctcgaagcctatcatgacgtgaatgtgaccggcatgcagagcagcccattgcagggacgcgccggcgccatccaggccgccgtcgcactggaactaagcagtgacgttgtgaccagtctggacgtggccgtcgaggggctgaacgggcagctccccaaccttgatctcttgaatctgtttcagactttctgtcagaagggcggccttctgtgtaccctccagggcaaactgcagcccgaggattggacttcactagatgggcccctccagggactgcagaccctgctgctcatggttttgcgccaggcaagcgggcgtccccacgggagtcacggcttgttcctcagataccgggtggaagccctgacccttagaggcatcaacagttttcgccagtataagtacgacctggtcgcggtcggcaaggcactggaggggatgtttcggaagttaaatcatttgcttgagcgcctccaccagtcctttttcctgtacctcctgccagggctctcaaggttcgtgagcattggcctgtatatgcctgctgttggtttcctgttgttggtgctgggtctgaaggccctagaattatggatgcagcttcacgaagccgggatgggccttgaggagcccggcggcgcccccgggccctccgtcccgcttccaccatctcagggcgtggggcttgcctctcttgtcgcccccctgctgattagccaggctatggggctcgccctatacgtgctgcccgtgctagggcagcacgtagccacccaacatttccccgtcgctgaggcagaagcagtagtgcttacgcttctcgcaatatacgccgctggcctcgctttgccgcacaacacacacagagtggtcagcacccaggccccagatcgggggtggatggctctgaagctggtagccctcatatacctagcgctgcagcttgggtgtattgccctcactaatttctcactcggattcttactcgcgacaactatggtacccaccgctgccctcgcaaagcctcatggaccccgcacactgtacgctgccctgttagtgctgacatcccctgcagcaaccctgctggggagcttattcctttggcgcgaactacaggaggcacccctgagtcttgctgaaggatggcagctgttcctggcagccttggcacaaggggtgctcgagcatcacacctacggggcgctcctctttccgctgttgtccctcgggctttatccatgctggcttcttttttggaatgtccttttttggaagtag

SEQ ID NO: 118856 - DNA, 555 bp, Artificial Sequence
  Description of Artificial Sequence: Synthetic coding sequence
atgaaggcgctgggggccgtgctcttggctctcctgctttgtggcagacctggcaggggtcaaactcagcaagaggaggaggaggaggacgaagatcacgggcccgatgattatgacgaggaggatgaggacgaggtggaagaggaggagactaacagattgccgggcggacgcagcagggtgctcctgcgctgctacacatgtaagagcttgccacgagacgagaggtgtaacctgactcagaactgctctcatggccaaacatgcaccacattgatcgcacatgggaacactgagtcgggactccttacaacacacagtacatggtgcactgatagctgtcagcccattaccaagacggtcgagggaacacaggttaccatgacatgctgtcagagcagcctttgtaacgtccccccttggcagtccagtcgggtccaagaccctacagggaagggcgccggcgggcctcggggctcgtcagagaccgtgggggctgcattgcttctgaatctcctggctggcttgggtgcaatgggggctagacgcccttag

SEQ ID NO: 118857 - DNA, 582 bp, Artificial Sequence
  Description of Artificial Sequence: Synthetic coding sequence
atggggaaacagaatagtaagctgcggccagaggtgatgcaggacctgctggagtctaccgattttaccgaacacgaaatccaggagtggtacaaggggttcctcagggactgcccgtccggacacttgtcgatggaggaattcaagaagatttatggcaatttttttccatacggcgatgccagcaaattcgccgagcacgtgtttcgtacattcgatgccaacggtgatggtacaattgattttcgcgagttcatcatcgccctgagcgtaaccagtcgcgggaagttagagcaaaaattaaaatgggccttctccatgtatgacttagatggtaacgggtacatttccaaagcagagatgctcgaaatcgtgcaagctatttacaagatggtgtcctctgtgatgaaaatgcccgaggacgaatccactccagagaaacgaaccgaaaaaatcttcaggcagatggacaccaacagagatgggaaattgagtctggaggagtttattcggggcgccaaatctgacccatctatcgtgcgcttattgcagtgcgatccaagttcggcaggccaattctag

SEQ ID NO: 118858 - DNA, 756 bp, Artificial Sequence
  Description of Artificial Sequence: Synthetic coding sequence
atgtccgcatatggtatgcccatgtataagtccggagacctggtttttgctaagttgaaggggtatgcccattggcccgcacgaattgagcacatgacccagcccaaccggtaccaagtgttctttttcgggactcatgaaaccgcctttcttagccccaagagactgttcccttataaggaatgtaaggaaaaattcggaaagcctaacaagagaagaggcttttcggcaggactatgggagatagaaaacaacccgacggtgcaagcttctgactgtccgctcgcaagcgagaagggctctggcgacggaccgtggccagagcctgaggccgccgagggcgacgaggataagcctactcacgcaggcggaggcggggatgaactcggaaagccggatgatgacaagccgacagaagaggagaaagggccactgaagcgctcagctggtgaccccccagaagatgctcccaagaggccgaaagaggcagctcctgaccaggaggaggaggctgaggcagagcgagcagccgaagccgaacgggccgcagccgctgccgccgcgaccgccgtggatgaggaaagcccattcttggtggccgtggaaaatgggtccgctccttcggagcccgggttagtgtgcgagccgccgcagcctgaggaagaggaacttcgagaggaggaggtggcagatgaggaagcttcccaagagtggcacgccgaggccccaggggggggcgaccgagactccctgtag

SEQ ID NO: 118859 - DNA, 531 bp, Artificial Sequence
  Description of Artificial Sequence: Synthetic coding sequence
atgtcggcatttcgactgtggccaggacttcttattatgctgggctctctttgccatcgaggttctccttgtggattgtccacccacgtggaaatcggacaccgagccttagaatttctccagctgcacaatgggcgagtcaattaccgggagttactcctggaacatcaggacgcctaccaggctggaattgtgttcccggattgcttctatccatccatatgcaaaggggggaagtttcatgatgttagtgaatcaacacactggaccccattcctcaatgccagcgtgcattacataagagaaaattacccattgccgtgggagaaggacaccgagaaactggttgcatttcttttcggaatcacatcacacatggccgctgacgtaagctggcatagtctgggcctggaacaaggctttctgagaactatgggagctattgacttccacggatcatattctgaggcacatagcgccggcgatttcggaacagtatatcttcacctgcttaactttttggtggtgtag

SEQ ID NO: 118860 - DNA, 831 bp, Artificial Sequence
  Description of Artificial Sequence: Synthetic coding sequence
atgaacagcaaacgaatgctcttgttggtgttgttcgcattctccttaatgctggtcgaaaggtacttccggaaccaccaagttgaggagctgcgcttgagcgactggtttcacccccgcaagcgaccagacgtaatcactaagacagactggctagcccccgtcttatgggagggcacttttgataggagagtccttgagaagcattacaggcgccggaacatcacagtgggactggcggtcttcgccaccggcaggttcgccgaagagtatctgcgtccattcctgcacagtgcaaataagcatttcatgactggttatcgtgtgatcttctacatcatggtggacgcctttttcaagctcccagatatcgagccatctccccttaggacctttaaagcattcaaggttggcactgaacgatggtggctcgacgggccactggtgcacgttaaatccctcggcgaacatatagcgtcccacatccaggatgaagtagatttcctcttcagtatggcagccaatcaggtattccagaatgagtttggcgtggaaacgttgggtcccctggtggcccaactacatgcctggtggtatttcaggaatacgaaaaattttccttacgaaaggagaccaaccagtgctgcttgcatccctttcgggcaaggagatttttactacggaaatctcatggttgggggtacaccacacaacattcttgattttataaaggaatatctgaacggggttattcacgacataaagaacggcctcaactccacgtacgagaaacacctgaacaagtacttctacctaaataagccaacgtag

SEQ ID NO: 118861 - DNA, 2166 bp, Artificial Sequence
  Description of Artificial Sequence: Synthetic coding sequence
atgctaccccgcggccgccctagagctctcggcgccgccgcgctgctcctgctgctactgctcttgggttttctcctcttcggtggagatctgggctgtgagaggagggaaccaggcgggcgggccggcgccccaggctgctttccagggcccctcatgccgcgagtgcccccagatggccgcctcaggcgggccgcggcactggacggcgatcccggcgctggtccaggcgatcataacagaagtgactgtggacctcagcccccacccccacccaagtgtgaactgctccacgtcgccatcgtgtgtgcgggccacaacagctctagagacgttatcaccctggtcaagagcatgctgttctaccgcaagaaccccttacatctgcatctcgtgaccgatgcagtagcccgcaatatccttgaaaccttgttccatacttggatggtccctgccgtccgtgtaagcttttaccacgctgatcaactaaagccccaagtgagttggatcccaaacaagcactacagtgggctttacggactgatgaagttagtgctccctagtgccttgccggctgagctggcccgggtcatcgtcctggatacagacgtgaccttcgcaagcgatatttcagagctgtgggccttgttcgcccattttagcgacactcaggctatcggccttgtggaaaatcagtctgactggtacctcggaaacctgtggaaaaatcacagaccatggcctgcactgggtcgcggcttcaatactggcgtgatcttgctgcgattggaccgtctccgacaggccggctgggaacaaatgtggaggctgacggcccgccgtgaactgctgtcactgcccgcgacaagtctcgctgatcaggatatctttaatgctgttataaaggagcacccaggactggtgcagcgacttccatgtgtttggaatgtacagttgagtgaccacaccttggcagagcggtgttattccgaagcctcagacctaaaggtgattcactggaattctcctaaaaaacttagagtaaagaacaaacacgtcgaattcttcaggaacttttatctgaccttcctggagtatgatgggaatctcctacggcgggaactgtttgtctgcccctcccagccgccccccggggcggaacaactacagcaggccttggcacagctagacgaggaggatccgtgctttgaattccggcaacagcaactgaccgtccacagggtgcacgtgaccttcctgccccatgagccccctccccctcgcccccacgacgtgaccctagtggcacaattatccatggatcggctgcagatgctggaggctctgtgtcgccattggccaggccctatgtccctcgcactgtatcttacggacgccgaggcgcagcagttcctgcattttgtggaggctagccccgtactggcagccaggcaggatgtcgcttaccacgttgtgtacagggaagggcccctgtaccccgttaaccaactgcgcaatgtggccctggcccaggctctgaccccgtacgtgtttctgtctgacatagattttctgcctgcctacagcctctacgactacctgagggcctccatcgaacaactgggccttggatcacgccgcaaggctgctctggttgtccccgcttttgagactctgaggtacagattctcttttccacacagcaaagtcgagcttttggccttactcgacgctggcacgctgtacacatttcggtatcacgaatggccgagaggccatgcgcctactgactatgccaggtggagggaggcacaagccccgtacagggtacagtgggccgcaaattacgagccctatgtcgtcgtcccccgagactgcccacgctacgatccacggttcgtggggtttggttggaacaaggtggctcacatagtcgaactggacgcacaggagtacgaactgcttgtgcttccggaggcctttacaattcacctgcctcacgcacccagtctggatatatctcggtttagaagttctccgacttacagagattgcttacaggcactgaaggatgagtttcaccaggacttatcacgtcaccacggcgccgcagcccttaaatatttacctgccctacaacagccacagtctcctgccagaggatag

SEQ ID NO: 118862 - DNA, 870 bp, Artificial Sequence
  Description of Artificial Sequence: Synthetic coding sequence
atgtggaggctgacagcccgacgcgaactcttgtccctgccggctacgagtcttgctgatcaggacatttttaatgctgtcatcaaagaacaccccggtctggtacagaggcttccatgtgtgtggaatgtacagctatctgatcatacgctagccgaacggtgttactcagaagcttccgacctgaaggtcatccactggaatagccctaaaaaattaagagtgaagaataaacacgtggagttttttcgaaatttctatttgacctttctagagtatgacggaaacctgcttcgcagggagctgttcgtctgcccctcccagcctcccccgggagcagaacagctgcagcaggctttggctcagctcgacgaggaggatccctgcttcgaatttcggcaacaacaactgacggttcaccgagttcatgtgactttccttccccacgaacccccacctcctcgcccccacgacgtgactcttgtcgcgcagctgagtatggacagactccagatgcttgaggccttgtgtaggcattggccgggacccatgtcgctcgccctgtacttaacagatgcggaggctcagcaattcctgcatttcgtcgaggcaagccccgtattggcagctaggcaagatgtggcttaccatgttgtgtacagggaaggcccactttacccggtcaaccagctgcggaacgtggcactcgcacaggccttaacgccatacgttttcctgagcgatattgattttcttcctgcatacagtctttacgattacttgcgcgaggcacgagctggatttaactcatcaagtacctgcgggtgcgctcatccatctcaccaggcccggtggcccatggtcgtctag

SEQ ID NO: 118863 - DNA, 2166 bp, Artificial Sequence
  Description of Artificial Sequence: Synthetic coding sequence
atgttgccaagaggcagaccccgagccctgggtgctgccgcactcctcctgctgcttttgttactggggttcctgttatttggcggtgatttgggttgtgagcgccgcgagcctggcgggcgagcaggagccccagggtgcttcccagggcctctgatgcctagagtgccgccggacgggcggctacggcgagcagcggctctggatggggatcccggcgccggtcctggtgaccacaatcggagcgactgcgggccacagcccccgccccccccaaagtgcgagctgctgcacgtagccatcgtttgtgctggccataattcgtcccgagacgtgattaccctcgtgaaaagtatgctgttttacaggaaaaacccactgcatctccacttagtcaccgacgccgtggcccgcaacattttggagacactctttcacacctggatggtccccgccgtgcgcgtgtcgttttatcacgctgatcagttaaagcctcaggttagctggatcccaaacaaacactacagtggcctctacgggctgatgaagctggtgctgccgtccgcactccctgccgagctggccagagtgatcgtcttggatactgatgtgacgtttgcttcggacattagtgagctgtgggctctatttgcacatttctccgacacacaggcaatcgggttagttgagaatcagagtgactggtatctggggaatctctggaaaaatcatcgaccatggccagcactgggcagggggttcaataccggcgtgattctgctgcgccttgataggttaaggcaggctgggtgggagcaaatgtggagactaacagcccgtagggaactcttgtctcttcccgccacctcgttggctgaccaggacatctttaacgcagtaattaaggagcaccctgggctcgtccagagattaccatgcgtatggaacgtgcagctgtcagatcatactctggctgagcgctgctactccgaagcttccgatctgaaagtcatccactggaatagcccaaaaaagctgcgggtgaaaaacaagcacgttgagttcttccgcaatttttacttgacttttctcgaatacgacggaaatctattacggcgggagttgttcgtttgcccttctcaaccaccacccggggcagagcaattacagcaagccctcgcgcagctagacgaggaagacccatgtttcgaatttcgccaacagcagctgacagttcacagagtccatgttacgttcctacctcacgaaccgccccccccacgaccacacgacgtgacactcgtagcacagttatctatggacaggctacaaatgctggaggcactatgtcgtcattggccaggccctatgagcctagcattgtatctgacggacgccgaggcccagcaatttctgcatttcgtggaggcttcaccggttctggctgcacggcaggacgtggcgtaccacgtggtatacagggaagggcctctgtacccagtgaatcaactgcgcaacgtggccctggcccaggcactaactccctacgtgttcttgtctgacattgactttctgcccgcttacagtctttatgattacctccgcgcatctatcgaacagctggggctcggctctcggaggaaggctgccctcgtcgttcccgcatttgaaaccttgcggtacagatttagtttcccccatagcaaggtcgaactgctggcccttctggacgccggcacactctatacattcaggtatcacgagtggcctcgaggacatgctcccacggactatgcacggtggagggaggcccaggcaccatatagggtacagtgggccgccaattacgagccatatgtggtggttcccagagattgtccaaggtacgacccacggtttgtaggtttcggctggaacaaggtggcccacattgtggagctcgacgctcaggaatatgagctgctagttctcccggaagcctttacaatccacttgccccacgccccaagccttgatattagtcggtttagatcctctcccacctatcgggattgcttgcaagctttgaaagatgagtttcatcaagacctgagtcgccaccacggcgcggccgcactgaagtatctccccgcgctacaacagccacaatcccctgctcggggctag

SEQ ID NO: 118864 - DNA, 2166 bp, Artificial Sequence
  Description of Artificial Sequence: Synthetic coding sequence
atgctgcctaggggccgtcctagagccctgggcgctgccgcgctactgctgttgcttttgctcctggggtttctgcttttcggaggagacctgggatgcgagagacgagagcctggagggagagcgggcgccccggggtgtttccctggaccactgatgccacgtgttcctccagatggtaggctgcggcgcgcagcagcactagacggggatcctggtgccggccccggagatcacaatcggtcggactgtggaccacagccgcctccaccccccaaatgtgagctgctgcatgtcgccattgtctgcgccggtcacaatagtagcagagatgtaataacactggttaagtcaatgctgttctacaggaaaaaccctttgcacctgcacctggtaaccgatgctgtcgctaggaatatcctcgagactctctttcatacatggatggtacctgccgtccgggtgtcattttatcacgcagatcaattaaaacctcaggtgtcttggataccaaataaacattatagcgggttatatggcctcatgaaactagtgttaccatcagccctgcccgcggaactcgctcgggtgatcgtgttagacactgatgtgacattcgcttcagacatatccgaactctgggcgctgttcgcgcacttcagcgacacacaagctatcggtctcgtcgagaatcaatctgactggtacctcggaaatctctggaagaatcaccggccttggccggctttgggtcgaggctttaatactggggtgattttgctgagattagatcgtttacggcaagccggatgggagcagatgtggcgcctgactgctagaagggagctgctgagcctcccagccacgagtctcgctgatcaggatattttcaacgccgtaatcaaggaacacccaggactcgtacaacggctaccctgtgtctggaatgtgcagttgtcggatcacaccctggctgagcggtgctacagtgaggctagcgacctgaaagttatccactggaactccccaaagaaactgcgagtgaagaataaacacgtcgaatttttccgcaacttttacctaacctttctggaatacgatggtaatctgcttagaagggagctttttgtctgcccgtcacagccacctcccggcgccgaacagctgcagcaagcactagcccagctggacgaggaggacccctgtttcgaatttcggcagcagcagctcactgttcaccgagtgcacgtgacatttctgccacatgaacctccacccccaagacctcacgatgtgactctggtggcccagctgagcatggatcgcctgcagatgctggaggccctgtgccgccactggcccggtcccatgtcgctggccctgtaccttactgatgcagaagcccagcagttcctgcacttcgtggaggcatcgcccgttttagccgcccggcaggatgttgcctatcatgttgtctatagggagggccccctgtacccagttaaccaattgcgaaacgtggccctcgctcaagctctgacaccttatgtattcctgtcagatatagatttcctcccagcctactctctgtatgactatcttagagcctcgatagagcaactgggcctaggctctcgacgtaaagccgccctggtggtgcccgccttcgagacacttcggtaccgattcagctttccccacagtaaggtggagctgctggcactcctggatgcagggacattatacaccttccgatatcacgagtggccacgaggacatgctcccacggactacgctcggtggcgcgaggcccaggctccctatcgagtccagtgggccgccaattatgaaccttacgtggtggtgccgagggattgcccacggtatgacccccgctttgtgggatttggttggaacaaagtcgctcacatcgtggagttggatgcccaggaatatgaattacttgtactcccagaagcctttacaatccacctgccccacgctccaagcttggatatttctagattcaggtctagccccacttatcgcgactgcctccaggcgctcaaggacgaatttcaccaggatctcagcagacatcacggcgccgccgccctgaagtacctgcctgccctccaacagccacaatctccagcgaggggttag

SEQ ID NO: 118865 - DNA, 2073 bp, Artificial Sequence
  Description of Artificial Sequence: Synthetic coding sequence
atgctgccacgcgggcgtcccagggccctgggcgcggccgcccttctgctgctgctactacttctgggcttcctgctgttcgatggccgtttgcgtcgcgcagccgccttggatggagacccaggagctggccctggagaccacaacaggtcggattgcgggccacagcctccccctccccctaagtgcgagctgttacatgtcgccatcgtttgcgccgggcacaattcatccagggacgttatcacactcgtgaaatcaatgctgttttaccgcaagaatcctctccacttacatctggttacagacgcagtagccaggaatatcctggagactttgttccatacgtggatggtccctgctgtgcgggtctccttttaccacgcggaccagctgaaaccacaagtgtcttggatcccgaacaagcattactccggtttgtatggcctgatgaaattggtgttgccctctgctctgcctgctgagctggccagggtcatcgtcttggacactgatgtgacatttgcctcagacatcagtgaactgtgggccttatttgctcacttcagcgatactcaagctatcggtcttgtagaaaatcagtctgattggtatctcgggaacttatggaaaaatcataggccttggcccgccctcggacgcgggttcaacaccggcgtgatactgctgagacttgacaggcttagacaggctggatgggagcaaatgtggaggctaaccgcccgtcgggagctcctaagcctgcctgccactagtctggcagatcaggacatctttaatgcggtaatcaaagagcaccccggtctcgtgcagcggctgccttgtgtctggaatgtgcagctgtcagatcataccctggccgagcgctgttatagcgaggctagtgacctgaaagtgatacactggaactccccaaagaaattacgcgtgaagaataaacatgtggagtttttccgaaatttctatctgaccttcttagaatacgatgggaatctcttaaggagagagcttttcgtctgtcccagccagcctcccccaggtgctgagcagcttcaacaggcgttggctcagctggatgaggaggacccttgctttgaatttcgacagcagcagttgacagttcatcgcgtacatgttacattcctgccacatgagcctcccccccctcgaccgcatgatgtgaccctggtggcccagctgagcatggaccgcctccagatgctggaagcgctctgtaggcattggcctggccccatgtccctcgcactgtaccttacagacgctgaggctcaacagtttcttcatttcgtggaagcttcccctgtgcttgccgcaaggcaagatgtggcgtatcacgtggtatacagagagggtcctctctatccggttaaccagctgcgaaatgtggcacttgcacaagccctgacaccgtatgtgtttctatccgatatagactttttgcctgcctacagcctctatgattatttacgggcctctatcgagcagcttggactggggtcccgacggaaagcggccctggtggtgcccgccttcgagacgttgaggtaccggttctcatttccgcactcaaaagtggaactccttgctctactggacgctggcacgctgtatactttcagatatcatgagtggccgcgcggtcacgctccgacagattacgcaaggtggagggaggcacaggctccctaccgcgttcagtgggcagcgaactatgaaccatacgtggttgttccccgggattgcccacgctatgaccctcggtttgtaggctttggatggaacaaagtggctcacatcgtggagctggacgcgcaggaatatgaactgctcgtcctgccggaggccttcaccatccatctcccgcacgccccaagtttagatataagtagattccgctcctctccaacctaccgcgactgcttacaggccttaaaagatgagtttcaccaggacctgagcaggcatcacggagctgcagcactcaaatatctccctgctttgcagcaaccccagtccccagccagagggtag

SEQ ID NO: 118866 - DNA, 1122 bp, Artificial Sequence
  Description of Artificial Sequence: Synthetic coding sequence
atgagcattttgattatagaggcgttctacggcggcagccataagcagctggttgatcttctgcaggaggaactcggagattgcgtcgtgtatacacttcctgccaaaaagtggcactggcgggcccggacaagtgctctctatttttcacagactattccaatctccgagcactacagaacacttttcgccagctcagtcttgaatttgaccgagctggccgccctcaggccagacctcgggaaacttaaaaaaatactgtacttccatgaaaaccagctaatttatcccgtgaaaaaatgccaagagcgcgactttcagtacggctacaatcagatcttatcttgcctagtggcagatgtagtggtattcaacagtgtgttcaatatggagtcatttctcaccagtatggggaagtttatgaagctgattcctgatcaccgaccaaaagacctggagtcgataattcgaccaaaatgccaggttatttatttccctatccgctttccagatgtaagcaggtttatgccaaaacacaagacgactcacctgaagaaaatgctcggcctaaaggggaacggaggagccgtgctttccatggccttgcccttccagcctgagcagagagacagcgaagatctgctcaaaaatttcaactctgaatgcgatactcactgcggtttagatacagcgcggcaggagtatctggggaatagtctgcggcaggaatcagatctcaaaaaaagcacctcatccgacaactcaagttcccaccacggagagaacaaacaaaatctcacggtggacccttgcgatatcttgggtggggtggataaccagcagcgccttctgcacatcgtgtggccacatcgctggctggaggctgtgtattgtggctgctatccactgtgccccaaagacttagtctatcctgagatcttccccgctgaatatttgtacagtacccctgaacagctctcgaagcgcctgcagaacttctgtaagcgccccgacattatcaggaagcacctgtataagggggagatagcgcctttctcctgggctgcgctccatggcaaattcaggtccctgttgacaaccgaaccaagggaagacctctag

SEQ ID NO: 118867 - DNA, 1377 bp, Artificial Sequence
  Description of Artificial Sequence: Synthetic coding sequence
atgtcaattttgattatagaagctttctatggtgggtcccataagcagctcgtcgatctgctgcaagaagagctgggagattgtgtggtgtacacacttcccgccaagaagtggcactggagagctaggacctcagccctgtatttctcccagacaattccgatcagtgagcattaccggaccttattcgcaagtagcgtcctgaatctgacagaactcgctgcactgcggcccgacttgggaaagctaaagaaaatcctatacttccacgagaatcagctgatttatcccgtcaaaaagtgtcaggagcgggatttccagtatggctacaatcagatattgtcatgcctcgtggcggatgtggtagtgtttaattccgtgtttaatatggagagctttctgacgagtatgggtaagttcatgaaactgattcccgatcatcggccgaaggacctcgagtccataatcaggcccaaatgtcaggtaatctacttcccaatccggttccccgatgtcagtcggtttatgcctaagcacaagacaactcatttgaaaaaaatgctgggcctcaaggggaacggcggggctgtgttgtctatggctttgccatttcaacctgaacagagggattctgaggacctgctgaagaactttaactccgagtgcgatacccattgcggcctggatacggcccggcaggaatacctgggaaattccctgcggcaggagagtgatctcaagaaatcgaccagctccgacaacagctcatcacatcatggtgagaacaagcagaatctgaccgtggacccatgcgacatactcggaggagtggataatcagcagcgcctactgcatatcgtctggcctcatcgctgggagcacgataaggaccctgaaagtttctttaaagtgttgatgcacctgaaggacctaggtctcaactttcatgtcagtgttttaggagagacattcacagacgtgcccgatatcttttcagaggctaagaaagccttaggcagttccgtgctgcattgggggtacctgccctcaaaggacgactatttccaagtgttatgtatggcggacgttgtcatctccacagccaagcatgaattctttggcgttgcgatgttggaggctgtgtattgtggctgctacccactctgtccgaaagatctggtgtacccagagatatttcctgccgaatacctgtattctacaccagagcaactgtctaaacgtttgcaaaatttttgcaagcggccagacatcatccgcaagcacctttacaaaggggagatcgctccattttcctgggcggcccttcatggcaaatttcgatcactgttgaccaccgagccccgagaggatctgtag

SEQ ID NO: 118868 - DNA, 1122 bp, Artificial Sequence
  Description of Artificial Sequence: Synthetic coding sequence
atgtcaatattgataatcgaagccttctatgggggctcccacaagcagctggtggatctactgcaggaagagctgggcgactgtgtggtgtacaccctgccggctaaaaagtggcactggcgcgcccgcacctccgcgctgtactttagtcagaccataccgatttccgaacactacagaaccctgttcgccagcagtgtgcttaacctgacagagttggctgcgctgaggcccgatctcggtaagctcaagaaaatcctgtactttcatgagaaccagcttatctacccagtgaagaagtgccaggagcgggattttcagtatggctataaccagatcttgtcttgtctggtggcggacgtagtagtgttcaacagtgtctttaatatggagagcttcctgacctccatgggcaaattcatgaagcttatacctgatcataggcccaaggacctcgagagcatcatccgtcccaagtgtcaggtgatttatttcccgataaggttcccagacgtaagccgattcatgccaaaacacaaaacaacccacctgaagaaaatgttgggcctaaagggcaatggcggcgccgtcctgtctatggcgctccctttccagcccgagcagcgtgatagtgaggacttactaaaaaacttcaacagcgagtgcgacacacattgtggactggacactgcccggcaagaatacctgggcaactctctcagacaggagtccgatcttaagaagagcacctcctctgataactcaagctcccaccacggtgagaataagcagaatttaacagttgatccatgtgatattctgggtggggttgataaccaacagaggttgctgcacattgtttggcctcatcgctggctggaggcggtgtattgcgggtgctatccattgtgccctaaggaccttgtttatcccgaaatcttcccggcagagtacctgtactctacaccagagcagctttcaaagagactccagaatttttgtaaacggccagacattatacgtaagcacctgtacaaaggggaaatcgctccattctcctgggctgccctccacgggaaatttcgatctctgctgactactgaaccccgcgaggacctgtag

SEQ ID NO: 118869 - DNA, 1377 bp, Artificial Sequence
  Description of Artificial Sequence: Synthetic coding sequence
atgtccatcctgatcatcgaagccttctacggcgggtcccataaacaactggtcgaccttctccaggaggagttgggggactgcgtagtgtacactttgcccgccaagaaatggcactggcgcgcccggacatcagcgttgtacttctctcagactatcccgatatccgaacattaccgcactctgttcgctagtagcgtgctcaatctaaccgagctggctgctctccgcccagacctggggaagctgaagaagatcttgtattttcatgagaaccaactcatctatccggtaaaaaagtgtcaggagagggattttcagtacggttacaaccagatcttgtcttgccttgtggctgacgtcgtggttttcaattcagttttcaatatggagtcattcctcacctctatgggcaagtttatgaaacttattcctgatcacaggccaaaggatctggaatcaatcatcaggcctaagtgtcaggttatctactttccaatcagatttcccgatgtttccagattcatgccaaagcataaaaccacacacctcaaaaagatgctaggtctcaaaggcaatggtggcgctgtgctttctatggccctcccctttcagccggagcagagagacagtgaagacctcttgaagaactttaatagtgagtgtgacacacattgtgggctggacaccgccagacaagaataccttggaaatagcctgaggcaagaatcggacttaaaaaagtccacgtccagtgataacagtagcagccaccatggagaaaacaaacaaaatttgacagttgatccttgtgacattctggggggggtggataaccagcagcgcctcttacatattgtgtggccacatcgctgggagcacgataaggatcctgaaagtttcttcaaagtgctcatgcacctgaaggatctggggttgaacttccatgtcagtgtcttgggcgagacatttacagacgttcccgatattttttctgaagccaaaaaagcactaggctccagcgtgctgcactggggctatctgccttccaaagatgattactttcaagttttatgcatggccgacgtggtgatttcaaccgccaagcacgagttcttcggggtggcaatgcttgaagcagtgtactgtggatgttatcctctttgtcctaaggacttggtctatcctgaaattttcccggcggagtatctctattccactcctgagcagttgtctaaacgtctccagaatttctgtaagcgcccagatatcattaggaaacacctgtacaaaggggagatcgcaccctttagttgggcagcgctgcacggaaagttcagatccctgctcaccacggagccacgagaggacttgtag

SEQ ID NO: 118870 - DNA, 1377 bp, Artificial Sequence
  Description of Artificial Sequence: Synthetic coding sequence
atgagcattttaattatcgaggccttctatgggggctctcacaaacagctggtcgacctgctccaggaagagctgggagactgtgtggtatacacattacctgctaagaaatggcactggcgggctagaacatccgccttatacttcagccagacaattcctatcagcgaacactatcgaactctgttcgcctcttcagtgctgaatctcactgaactagctgcactcagacctgacctgggcaagctcaagaaaatcctatatttccacgagaaccagctaatctatcctgtcaagaaatgtcaggagagagatttccagtatggatacaaccagatactgagctgcctggtcgccgatgtggtcgtgttcaattccgtgttcaacatggaaagcttcctaaccagtatggggaaattcatgaagctgattcctgatcatcgtccaaaggatttggagtcaatcatccgccctaagtgccaggtcatctacttccccatccggtttcctgacgtgtctcgctttatgcccaagcacaaaacaacgcatcttaagaaaatgctgggacttaaagggaacgggggggccgtgctcagcatggctctacccttccagcccgagcagcgcgatagtgaggatctgctgaagaattttaacagcgaatgcgatacgcactgcggtcttgacaccgcaaggcaggagtatctcggcaacagcttgcggcaggagtcggaccttaaaaagagcacatcttcagacaatagctcttctcatcacggagagaataagcagaacttaacggtggatccctgtgacatactgggtggagttgacaatcagcagaggctgttgcacatagtgtggcctcatcggtgggaacatgacaaggatccggaaagcttcttcaaggttcttatgcatctcaaggacctgggtctgaacttccatgtgtccgtgttgggcgagacattcacagacgtacctgacatctttagcgaggcaaagaaggcactcggatcaagtgttcttcactggggttaccttccttccaaagacgactactttcaagtgttgtgtatggcggatgtagtcatcagcaccgctaagcacgaattcttcggcgttgctatgcttgaagcggtttactgcggttgctatccactctgtccgaaagacctagtgtacccagagatttttcctgctgagtatctatactcaacccccgagcagctctccaagagactgcagaacttttgtaagagacctgacattatcagaaagcacctgtataaaggtgagattgccccattctcctgggcagcactgcacgggaagttccgtagtctgctcacaaccgagccaagggaggatctatag

SEQ ID NO: 118871 - DNA, 300 bp, Artificial Sequence
  Description of Artificial Sequence: Synthetic coding sequence
atgtctatcttgattattgaggcattctacggaggttcccacaagcagttagtcgaccttctccaggaggaactgggtgattgcgttgtgtatactctccctgccaaaaagtggcactggcgagctaggacctctgccctgtatttcagccagacaattccaatttctgagcattatcgcaccctattcgcaagttcggtgctgaatctgactgaactggctgccctgagacccgatctcggcaagctcaaaaaaatactgtactttcacgagaatcagctgatctatcctgtaaagtag

SEQ ID NO: 118872 - DNA, 522 bp, Artificial Sequence
  Description of Artificial Sequence: Synthetic coding sequence
atgtccatcctaataattgaggctttctatggcggatctcataaacaactggtggacctgcttcaggaagaactgggagattgtgtggtatacactttgcctgcaaaaaaatggcattggagagccaggacctcggccctctattttagccaaactattcccatcagcgaacactatcggactctgtttgctagtagcgtgttgaacctcacggaactggccgcccttaggcctgatctaggtaaactaaaaaagatattgtacttccatgaaaatcagcttatttacccggtaaaaaaatgccaggaaagggacttccaatatggctacaaccagatcttgagctgtctcgttgcagatgtggtcgtatttaattctgtttttaatatggagtcctttctcacatctatgggaaagttcatgaaactgatccctgatcacaggcccaaggaccttgagagcattataaggccaaagtgtcaagtcatctatttccccatccggtttcctgacgtgtcatag

SEQ ID NO: 118873 - DNA, 1377 bp, Artificial Sequence
  Description of Artificial Sequence: Synthetic coding sequence
atgagcatcttgatcatcgaagcattttatggaggatcgcacaagcagttagtggatctcctgcaggaggaactaggtgactgtgtggtctacactttgcctgctaaaaaatggcactggcgagcgaggaccagcgccctgtacttctcacagaccatacccatctcagaacactatcgcaccctctttgcctcttccgtcctgaacctgaccgaactggctgcattgaggccagacctgggaaagctcaaaaaaatcttgtatttccacgaaaaccaactgatttaccccgtgaaaaaatgccaagagcgtgacttccagtacggatataatcagatattaagctgcctcgtggcagatgttgtggtatttaatagcgtgttcaacatggaaagctttttgacttccatgggtaaattcatgaagcttattccagatcatcggcccaaggatcttgagagtattattagaccaaagtgtcaggtcatatacttccccatccgttttcctgacgtaagccgcttcatgccaaaacataagacgactcatcttaaaaagatgcttggcctcaaaggcaatggcggggcagtgttatcaatggccttgcctttccaacctgagcagagggattctgaagacctgctgaagaacttcaactctgaatgtgacacccactgtggactggatacagcacggcaagagtatctggggaactcccttagacaggagtcagatctgaagaagtctacaagctcagataactcatcttctcaccatggagaaaataagcagaaccttaccgtggacccttgcgatatcttagggggggtggacaaccagcagcgcctcttgcacatcgtatggccccaccgatgggagcacgacaaagatcctgaatcttttttcaaagtactgatgcaccttaaggatcttggcctgaattttcatgtgtccgtgctgggggagaccttcacggatgtgcctgatatcttttcggaagccaagaaggctttgggtagctctgtattacattggggctacctgccctcaaaagacgattatttccaggtgttgtgtatggctgatgtcgttatctccacagccaaacacgaattctttggggttgccatgctcgaggcagtctattgcggctgttatcccttatgccccaaagatctggtgtaccctgaaatttttcccgccgaatacctttactcaacacccgagcagctttcgaaaagactccagaatttctgtaagaggccggacatcataagaaaacacttatacaaaggtgagattgcacccttcagctgggccgctctacacggtaagtttaggagcctgctgactactgagcctcgggaggatctttag

SEQ ID NO: 118874 - DNA, 2220 bp, Artificial Sequence
  Description of Artificial Sequence: Synthetic coding sequence
atgccttcgccaagaccagttctgctgcggggcgctcgcgcggccctgctcctgctgcttcctccccgactgctggcccgtcccagcctgctcctgagaagaagcctgtccgccgcctcctgcccacctatctccctgcctgcagctgccagcagatcaagcatggacggggcaggggcggaggaggtcctcgcaccactgaggcttgccgtccgacaacagggagatctcgtaagaaagttgaaggaggataaggcacctcaagtggatgtcgacaaagcagtggctgaactgaaggcccgaaagcgagtgctcgaggccaaagaactcgcccttcagcccaaggacgacatagtagaccgggcgaagatggaggataccctgaaaagacggttcttctatgatcaagccttcgccatctatggcggagtgtcgggattgtacgacttcggcccagtcggatgtgccctaaaaaataacatcattcaaacctggcggcaacattttatccaggaagaacagatcttagaaatagattgcacaatgctgacgccagaacccgttctcaagacttccggacacgtggataagttcgccgattttatggtgaaagacgtgaagaacggcgaatgtttccgggctgaccacttgctgaaggcccatctgcagaagctgatgtccgataagaagtgcagcgtggagaaaaaatccgagatggaaagtgtgctcgctcagctcgacaattacggccaacaggagctagccgacttattcgttaactataatgtaaaaagtcctatcaccgggaatgatctatccccaccggtttcttttaatttgatgtttaagaccttcatcgggccaggaggtaacatgccgggctacctccgcccagagacagctcaaggtatttttctgaacttcaaacgactgttggagtttaaccagggcaagttgccctttgccgctgcgcaaatcggcaactcatttagaaatgaaatcagtccacgatcagggctaatcagagttagagaattcaccatggccgagatcgaacactttgttgacccgagtgaaaaagatcatcccaaattccagaacgttgccgacttgcacctctatctgtatagtgccaaagcgcaggtttccggacagtcggccagaaagatgcgcctgggcgacgctgtggaacagggcgtcatcaacaatacagtacttggatatttcattggaagaatttatctgtacctgacgaaagtaggtatcagtccggataagctgagattcagacaacacatggaaaacgagatggcccattacgcatgcgattgttgggacgccgaatcaaaaacatcctacgggtggatcgaaatagtcgggtgcgccgatagatcctgttacgacctcagctgccatgcccgggcgacaaaagtgccactcgtggcagagaagcccctgaaagagccaaagacagtgaatgtcgttcagtttgagcccagcaaaggcgccattggaaaagcttataaaaaggatgccaaactagtgatggagtatttagcaatttgtgacgaatgctacattacagagatggagatgctgctgaatgagaagggcgaattcacaattgagaccgagggcaaaacattccagctgaccaaggacatgatcaacgttaaacgctttcaaaagacgctgtatgtggaagaagttgttccaaacgttatagagcccagcttcggacttggtcgtatcatgtacacagtctttgagcatacattccacgtccgagagggggatgaacagcggacgttcttttccttccctgccgtcgttgctccttttaaatgcagcgttctacccctgtcccagaatcaggaattcatgccgtttgtgaaagaactctcagaggcactgacccggcatggcgtttcccataaggtcgacgatagttctggatcaatcggcagacggtatgcacggaccgatgaaattggggtggccttcggagtgacaatcgatttcgatacggtgaacaaaaccccccatactgcaactctgcgagacagagactccatgcggcagattcgtgcagagatcagtgaattgccatctatagtccaggaccttgctaacggtaacatcacatgggcagacgtcgaggcccgatatcctctatttgaagggcaggagacgggaaagaaagagactatcgaagagtag

SEQ ID NO: 118875 - DNA, 555 bp, Artificial Sequence
  Description of Artificial Sequence: Synthetic coding sequence
atggcagaaccccaaccaccatctggaggcctgaccgatgaggccgccctcagctgttgttccgatgcagatccatcaacgaaagactttttattgcagcagactatgcttagagtgaaggatcctaagaaatctctggacttctacacccgggtgctgggcatgaccctaatccagaaatgtgattttccgataatgaagttcagcctgtattttctcgcgtatgaggacaagaatgacatcccaaaggaaaaagacgaaaagatcgcttgggctttgtcccggaaggcaacactggaactcactcataattggggcactgaggacgatgaaacccagtcttaccataatgggaattcggatcccagaggcttcggacacataggaattgcagtccccgatgtgtacagtgcctgtaaaagattcgaggagctcggggttaagttcgttaagaagccagatgatggcaaaatgaaaggcctcgcttttattcaggaccccgacggttattggatagagatcctcaacccaaacaaaatggcaacccttatgtag

SEQ ID NO: 118876 - DNA, 987 bp, Artificial Sequence
  Description of Artificial Sequence: Synthetic coding sequence
atgaggcccgtgcgcctaatgaaagtgttcgtgacaaggaggattcctgctgagggaagagtggcattagcgagagcagctgattgtgaggtcgagcagtgggacagtgacgaaccaatcccggccaaggagctggagcgcggtgtcgcgggggcccatgggttgctctgtttgctcagcgatcatgtggataaacgcattctagacgccgccggagcgaacttaaaagtcatctcaacaatgagcgtaggcattgaccacctggccctcgacgagatcaagaagcggggaatacgggtggggtatacccccgatgtcttgaccgacaccacagccgaactggccgtgtccctgctcctgaccacctgtcgacggcttcccgaggctatcgaagaggtgaagaatggtggctggactagttggaaaccgctgtggctctgtgggtatggacttacccagtccactgtgggcatcatcggtctgggtcggattggccaggcaattgcccgcagactcaaaccgttcggcgttcagcggttcctttacaccgggcgtcaaccacgtccagaggaggccgctgagttccaggccgaattcgtgagtacgccggagctggctgctcaaagtgatttcatcgtggttgcctgctcacttacccccgccactgaagggctgtgcaataaagatttttttcagaagatgaaggagacggccgtgttcatcaatatatcccgcggcgatgttgtcaaccaggacgacctgtaccaagcgctggcctctggaaagatcgcagctgctggacttgatgtgacgtccccagagccacttccgaccaatcacccactgctgacgctgaaaaactgtgtgatccttccacacattggcagcgcaacccacaggacacggaatactatgagtctgctggccgctaacaatctcctggccgggctacggggtgaaccaatgcctagcgagctgaaactctag

SEQ ID NO: 118877 - DNA, 1188 bp, Artificial Sequence
  Description of Artificial Sequence: Synthetic coding sequence
atgcgacccgtgcgcttgatgaaggtttttgtgacccgccggatcccagcagaagggcgagtggctcttgccagagcggctgattgtgaagtggagcagtgggacagcgacgagcctattcccgcaaaagagctcgaaagaggcgtcgctggtgcgcacggtttgttatgtctgctttccgatcacgttgacaaaagaatcttggacgcggctggagccaacctcaaggtgatttcaacaatgagcgttggcattgaccatctcgctttggacgaaatcaagaagagaggtattcgagtcggctacacaccagacgtgctgaccgacactacagccgagctggccgtgtcattgttattgacgacctgtcgaaggctgccggaagccatcgaagaggttaagaacggggggtggacctcttggaagccactgtggctgtgtggctacggactgacccaatcgaccgtgggtattatcgggttaggacgcatcgggcaagctatcgcaagacgactgaagccattcggggttcaacgctttttgtatacggggaggcagccccgcccagaggaagccgccgagttccaggctgaatttgttagtacccccgaactggcagctcaaagtgatttcattgttgtagcctgctccctcaccccggcaacagaaggcctgtgcaataaggacttcttccagaaaatgaaagagacagcagtgtttatcaacattagccgctacccccgggccaccctgccgagcaagcccggggaagagccttcccctctgcttccctccggcgattttctgccccgcgggcttctggttaggccgcaggcagagctagctggtttccataaacccaataatcagctgcgaaactcctgggagtacaccagaccaccctaccgggaggaggagccctccgaatgggcctggccagtatgcttctccgctgtcgcccccacccgaagaggcctggctcattcgagtgtcgccagtggttctgtccctcgagaaccgctgcaggcgcattaccctccaccacagagagccggactggaagacttgaagggcccgctggaagcagcttcacacacagcggagcctggctttgtttggctctggtttagtgacactttgaacctaatgctgctgggcggacagactttgaagctgacatggtcttag

SEQ ID NO: 118878 - DNA, 759 bp, Artificial Sequence
  Description of Artificial Sequence: Synthetic coding sequence
atgctcgggggtgtgcccactctgtgtggaacaggcaatgagacctggaccctgcttgcgcttgggcaggccatagcccgacgtctcaagccatttggcgttcagagatttctttatacaggtcggcagccgcgtccagaggaagctgcggagtttcaagccgaattcgtgtccaccccagagttagcggcccagagtgactttatcgtcgttgcctgcagtctgacccctgcaacagagggtctttgcaataaggactttttccaaaagatgaaggagaccgcggtgtttataaatatatcacggtatcctcgagcaacattacctagtaagcctggcgaagagcctagtccactgctgcccagcggagacttcctgccccggggtctcttggttagaccgcaggccgagttagccggatttcacaaaccgaacaatcagcttagaaattcttgggaatatacacggcccccttaccgagaagaggagccttcggaatgggcgtggcccgtgtgtttctctgctgtggctcctaccagaaggggcttggctcatagttcagttgcctctggctcagtaccccgcgagccactccaggcccattacccaccgccacagcgagccggccttgaagatcttaaaggcccacttgaagccgccagccacactgcggaacctgggttcgtttggctgtggtttagtgacactctcaatctgatgctgctcgggggtcagacactgaaattgacatggtcttag

SEQ ID NO: 118879 - DNA, 1677 bp, Artificial Sequence
  Description of Artificial Sequence: Synthetic coding sequence
atggaacttagggcgagaggctggtggctgctgtgtgcagctgctgccctggtcgcttgcgcccgaggtgacccagcttcaaagtctcggagctgtggagaggttagacagatttacggggctaaaggtttctccctgagcgatgtcccacaggcggagattagcggtgaacatctgaggatctgtcctcagggctacacatgttgcactagtgagatggaagagaatttagcgaaccgtagtcatgcagagcttgagactgcattacgcgattcctctagagtactgcaggctatgctcgcaacacaactgcggagctttgatgaccactttcagcacctcctgaacgacagcgaacgtaccctgcaggcaacatttccaggagcatttggtgagctgtacacccagaacgcaagagcattccgcgatctgtattcagagctcagactgtactaccggggcgctaatttacatctagaggagaccctggccgaattctgggcccggctgctcgagcgactgttcaaacagctgcacccccagcttctgctgcctgacgactaccttgactgccttggtaagcaggctgaggctctcaggccgttcggggaagctccccgggagcttcgcctcagggcgacccgggcattcgtggccgcccggagctttgtgcaggggctgggcgtggcatcagacgtggttcggaaagtggcacaggtccctcttggcccggaatgctctcgcgccgtaatgaaactcgtttattgcgctcactgtctgggagttcccggcgccaggccctgtccagactactgtcggaatgtcttaaagggatgtcttgccaaccaggccgaccttgatgctgaatggagaaacttgctagacagcatggttctgatcacagacaagttttggggtaccagtggcgtggagtccgtgatcggtagcgtgcacacctggctcgctgaggccatcaatgctctgcaggacaatagggacaccctcaccgcgaaagtcatccaggggtgtggcaatcctaaggtcaacccgcaggggcccggccccgaagagaagcgcaggcggggaaagttggccccaagagagcgccctccatccgggactctcgagaagctcgtgagcgaggcaaaggcacagctgagggatgttcaggatttttggatctctttgcccgggacactttgctccgagaagatggctctgtctactgcttctgatgacagatgttggaacggaatggctcggggtaggtacctgcctgaggtcatgggagacggcctcgccaaccaaattaataacccagaggtggaggttgacataactaagccggatatgaccatccgtcagcagattatgcaattgaagattatgactaatagactccgcagcgcctacaacggaaacgacgtagacttccaggatgcttcagatgatggctcagggagcgggtccggcgatggttgccttgacgacctctgtagtcgcaaggtaagccgcaagagtagctcttctcgtactccacttacacatgcattacctggcctgtccgagcaggaaggccaaaaaacaagtgcggcctcctgtccacagcctccaactttcctgcttcccctcctgctgttcctcgctctcactgttgcccgtcccaggtggcggtag

SEQ ID NO: 118880 - DNA, 1743 bp, Artificial Sequence
  Description of Artificial Sequence: Synthetic coding sequence
atggctggaactgttagaactgcttgcctcgtcgtggctatgttgctgtctttggatttccccggccaagcccaaccccccccaccccctcccgacgcgacttgccatcaggtacggtcattcttccagagattgcagcctgggctaaaatgggtgcccgaaacacccgttcctggcagcgatctccaagtgtgcctccccaaaggccccacctgttgtagccgcaagatggaggaaaaataccagctcacagcacgactgaatatggaacagctgctccagtcagcttcgatggagctaaagtttctcatcattcagaatgccgctgtctttcaagaggccttcgaaatagtggttcgccacgctaaaaactacacgaatgctatgtttaagaataattacccctcactgactccccaagctttcgagttcgtgggagaattcttcacagatgtttctctgtacatcctgggcagcgatatcaacgtcgacgacatggtaaacgagttgtttgacagtctattcccggtgatctacacccaactaatgaaccccggcttgcccgattccgccctggatattaacgagtgcctccgaggagcacggagagacctcaaggttttcgggaatttccccaagctaataatgacccaagtgagcaagagtctgcaggtgacacgcattttcttgcaagccctgaaccttgggatagaggtaatcaatacaacggaccacctgaagttcagtaaggactgtggtaggatgcttactcggatgtggtactgttcttattgtcaagggctcatgatggtgaagccctgtgggggatactgcaacgtggtaatgcaggggtgcatggccggagtggtggagatcgataaatactggcgagagtatatcctgtccctggaggaactcgtcaacggtatgtaccgcatttacgatatggagaatgtcttgctggggttgtttagcaccatccatgatagtatccagtatgtacaaaaaaatgcagggaagcttacaacaaccatagggaaactgtgtgcacactcacagcaaaggcaatatcgttcggcttactatcctgaggacctgtttatcgataaaaaggtgctcaaagtggcccatgttgaacacgaagagacactgtccagcaggagaagggaactcatccagaaattaaaatccttcatcagcttttactccgccttaccgggatacatctgttcccattctccagttgccgagaatgataccctgtgctggaatgggcaggagttagtcgagcggtacagtcagaaggccgcgagaaacggaatgaagaatcagttcaatctgcacgagctgaagatgaagggtcccgagccagtggtgagccagattattgataaactgaaacatattaaccaactgctgaggacgatgagtatgccaaagggacgtgtactagacaagaaccttgacgaagaaggcttcgagagtggtgattgtggggacgatgaagacgagtgcatcggcggctccggggatggcatgattaaagtcaaaaatcagctccgcttcctcgccgagctcgcctatgacctcgatgtcgatgatgcgcccggtaacagccagcaggctacacccaaggacaatgagatctccacatttcacaatcttggtaacgtgcattcacctctgaagctcctgactagcatggcgatttctgtggtttgcttcttcttccttgtgcattag

SEQ ID NO: 118881 - DNA, 1812 bp, Artificial Sequence
  Description of Artificial Sequence: Synthetic coding sequence
atggcgggcactgtgagaacagcgtgtcttgtcgttgctatgttattgagccttgactttccagggcaagcccagcccccgccacctccacctgatgccacttgccaccaagtccgctcttttttccaaagactgcagcctggtctcaagtgggtcccagaaacaccagtgccggggagtgacctgcaggtatgcctgcctaagggcccaacctgctgctcacggaagatggaagaaaaatatcagcttaccgcccggcttaatatggagcagctgctccaatctgccagtatggagttgaaattcctcataatacaaaatgccgcagtatttcaagaggcttttgagatcgtagtaagacatgctaaaaactacaccaacgctatgttcaagaacaattacccttctctgactcctcaggcattcgaatttgtcggcgaatttttcaccgatgtgagtctttacatcctggggtccgatataaatgtggacgacatggtcaatgagctgttcgactcactctttcctgtgatttatacccagttaatgaatccagggttgccagattcggccctcgacataaacgagtgtctgaggggagcccgtcgcgacctgaaggtgtttgggaacttcccaaaacttattatgacccaggtgagcaaaagtctccaagttactcgcatatttctgcaggctctcaacttaggcatcgaggtgattaatacaacagaccacctaaagttctccaaggactgtggccgtatgctaactcgcatgtggtactgttcttattgccaggggctcatgatggtgaagccctgcggcgggtactgtaatgtggttatgcagggctgtatggcaggcgtcgtggaaattgataagtactggcgtgaatatatactgagtctcgaggaactggtgaatggtatgtatagaatctatgacatggagaacgttttattggggctcttcagcacgatccacgactctatccagtatgtgcagaagaacgcaggtaaactgacaactacagagaccgagaagaagatctggcactttaaatacccaatattttttctatgtatcggcctggatctacaaattggaaaactctgtgcccattcccagcagagacagtaccgcagtgcctattatcccgaggatctctttatcgacaagaaggtgctcaaagtagcccatgtcgagcatgaagaaaccctctcaagccggcgaagggaactgattcaaaagcttaagtcttttattagtttctattcagcccttcctggctatatctgctcacactcccctgtggcggaaaacgacactctttgttggaatggacaggagcttgttgagcgctacagtcagaaggcagcccgtaacgggatgaaaaatcaatttaatctgcatgaactaaaaatgaagggacccgagcctgtggtttcacagattatagacaagttaaagcacattaatcagctgctccgcacaatgtcaatgccgaaggggcgggtccttgataagaacttggacgaggagggcttcgaatctggtgattgcggggatgacgaagatgagtgcataggcggaagtggagacggcatgataaaagtcaagaatcagctgcgattcctagccgagctcgcgtacgatttagatgtggacgacgccccaggaaacagccagcaagctactcctaaggacaatgagattagcacctttcacaatctgggaaatgtacactcgccactcaaacttctgacttcgatggccatatctgttgtgtgtttctttttcctcgtccactag

SEQ ID NO: 118882 - DNA, 771 bp, Artificial Sequence
  Description of Artificial Sequence: Synthetic coding sequence
taaaagccttgcggcggatactgcaatgtcgttatgcaggggtgcatggccggtgttgtggaaatcgacaaatattggagagagtatatccttagtctggaagaactggtaaacgggatgtatcggatttatgacatggagaacgtgctgctaggtctattttcaactatccacgattctattcagtacgttcagaaaaacgcaggaaaactgaccactaccatcggcaagctctgtgcccattctcaacagcgccagtaccgctctgcgtattaccctgaggacctgttcatagacaaaaaagtactgaaagttgcgcatgtggaacacgaagagacactcagctctcggaggcgggaactaatccagaagctcaaatcctttataagcttttactcggccctcccaggctatatttgctcacatagtccggtggctgaaaatgacactctctgctggaatggccaagaactcgtggagcggtatagccaaaaggccgcaagaaatggcatgaagaaccagtttaatctccatgaactgaaaatgaaagggcctgagccagtggtttcacagattattgacaaattgaaacacattaatcagctcctgcgcaccatgtcaatgcccaaggggcgagtgttggataagaatttagacgaggaaggttttgaatcaggcgactgcggagatgatgaagacgagtgcatcggcggcagcggtgacggcatgatcaaggtaaagaatcaactgagattcttggctgggaactag

SEQ ID NO: 118883 - DNA, 1581 bp, Artificial Sequence
  Description of Artificial Sequence: Synthetic coding sequence
atggccggtacagtgcgcaccgcatgtttggtggttgccatgctgctctctctggactttccagggcaagcacagccacctccgcccccacctgatgcaacttgccaccaggtgcgctcctttttccagcgcctccagccggggcttaaatgggtccctgagacccccgtacccgaagccttcgaaatcgttgtgaggcatgctaagaattacacgaacgcgatgtttaaaaacaactatccctctctgaccccacaggctttcgagttcgtgggagaattctttaccgacgtgagtctctatatcttgggtagtgacattaacgtggacgatatggtaaacgagcttttcgactccctgttccctgtgatatatactcagctaatgaaccccggtctgcccgactcagcgctcgacattaacgaatgtctgagaggcgcaagacgggatctgaaagtctttggcaactttcccaaactgatcatgacacaggtctcaaaatcgctgcaggttacgcggatctttcttcaggctctcaacttagggatagaagttatcaacactaccgaccatcttaagttttcgaaggactgtgggcgcatgttgacgcgaatgtggtactgtagctattgtcaaggcctgatgatggtaaagccgtgtggaggatattgcaatgtagtcatgcaagggtgtatggccggcgtggtcgagatagataagtattggcgcgaatatatcctgagcctggaggaattggtgaacgggatgtatcgcatatatgacatggagaacgtcctgcttgggttgttctctaccatccatgatagcattcaatacgtacaaaagaatgcaggcaagcttactactactattggaaaactgtgcgcccatagccagcagagacaataccggagcgcctactacccagaggatttgtttatcgacaaaaaggtactgaaggtcgcccacgtagagcacgaagaaactttaagcagcaggcgccgggagctgattcagaagctgaagtcgttcatttctttctatagcgcgctgcctgggtacatttgctcccattcaccagtggcggagaacgacactctttgctggaatggccaagaactggtggagagatacagtcagaaggccgcaagaaacgggatgaagaatcagtttaacctccatgaactgaaaatgaaaggccccgagcccgttgtcagccagatcatagataagctgaagcacatcaaccaacttctgaggactatgtcgatgcctaaggggcgcgtcctggataaaaacttggacgaagagggtttcgagtccggcgattgtggcgacgatgaagacgaatgtatcggcggatctggggacggaatgataaaagtgaagaatcagctccggtttctcgcagaactcgcctacgacctggacgttgacgatgcgcctggaaattcccagcaggcaactcctaaagataatgaaatcagcaccttccataacctgggaaatgtgcatagcccactgaagctcctgacaagcatggccatttcggtcgtgtgcttctttttcctcgtgcactag

SEQ ID NO: 118884 - DNA, 1671 bp, Artificial Sequence
  Description of Artificial Sequence: Synthetic coding sequence
atggcacgcttcgggttacccgctttgctgtgtactctggctgtgttaagtgccgctctccttgccgccgagctcaaaagcaagtcttgtagtgaagttagaaggctttatgttagcaaaggcttcaacaaaaatgatgctcccctacatgagattaacggggatcatctgaagatttgtccccaagggtcaacatgctgcagtcaggagatggaggagaagtacagtctgcagtcaaaagatgacttcaagtcagtggtttctgagcaatgtaatcacctgcaggcagtctttgccagccgatacaagaaatttgacgagtttttcaaagagctgttagagaatgccgagaagtccctcaacgacatgttcgtcaaaacgtatggccacctgtatatgcaaaatagtgagctgttcaaggatctttttgtggagttaaagcgatactacgttgtcggtaacgtgaatcttgaagagatgctgaacgatttctgggctcgactcctcgagaggatgttccggctggtaaatagccagtatcatttcactgatgaatacctggagtgcgtctcaaagtacactgaacagcttaagcctttcggggacgtgcctcggaaactaaaactgcaggttaccagagccttcgtcgctgctcgtaccttcgcccagggactcgcagtggccggagacgtagtgtctaaggtgagcgttgtgaaccctaccgctcaatgcacacatgccctgttgaagatgatctactgctcacactgcagaggcctggtgaccgtgaagccatgctacaactattgctccaatattatgcgcggctgcctcgcaaaccagggcgatctcgacttcgagtggaataacttcatcgacgctatgctgatggttgccgagcgcctggaaggcccctttaacatagaatcagtcatggacccgatagatgtgaagatcagcgacgccatcatgaacatgcaggacaattcagtgcaggtcagccaaaaagtgtttcaagggtgcggcccacccaaacccctgcctgccggccggatttcccggagcataagtgagtcagccttttctgctcgcttccgaccccatcaccctgaagagagacccactactgctgctgggacaagcctcgataggttggtgacggatgtgaaggagaaacttaaacaagcaaaaaagttttggtcgtctctgcccagcaatgtgtgcaacgacgagagaatggccgcaggaaatggcaatgaagatgattgctggaacgggaaaggcaagagccggtacctgtttgcagtaaccgggaatggcctggctaaccagggaaacaatcctgaggtacaggttgataccagcaagcccgacatcctgatcttaagacagataatggcattaagagtaatgacatctaaaatgaaaaatgcttacaatggcaatgatgtggattttttcgatatttctgatgagtcctctggagaagggagcggttctggttgtgaatatcaacaatgcccaagcgagttcgactacaatgcgactgatcatgcgggaaagtcagccaacgaaaaagctgattctgccggcgtgaggccaggggcccaggcttacttactgaccgtgttctgtatcctgttcttagtaatgcagcgagaatggagatag

SEQ ID NO: 118885 - DNA, 1461 bp, Artificial Sequence
  Description of Artificial Sequence: Synthetic coding sequence
atggaggagaagtactccctgcagtctaaagacgacttcaagtctgtggtgtccgaacagtgtaatcacttgcaagctgtgttcgctagtaggtacaaaaaatttgatgaattcttcaaggagttgctcgaaaacgctgagaaaagcttgaatgacatgtttgtgaaaacctacggccacctctacatgcagaattctgagcttttcaaagatttgtttgtcgagctgaaacgctactacgtggtgggcaatgtgaacctggaagagatgctgaacgacttctgggctcgcttgctggagcggatgttccgcctggtgaacagccagtaccactttaccgacgaatatctagagtgcgtcagcaagtataccgagcaactgaaaccctttggcgacgtcccccgtaagctgaaacttcaggtgacaagagctttcgttgctgctagaacattcgcccaggggctagctgtcgcaggagatgtggtaagcaaagtttccgttgtaaacccgacggcgcagtgtacacacgctctgctgaagatgatctattgttctcactgtcgagggctggtgaccgtgaaaccttgctacaattactgttcgaacatcatgagggggtgcctcgcgaaccagggagatctcgacttcgaatggaataactttattgacgccatgctgatggtggctgagcgtctggaaggtccttttaatatcgagagcgtgatggacccgatcgatgtgaaaatcagcgatgccattatgaatatgcaggacaacagcgtacaggtctcccagaaggtgtttcagggctgtggccccccgaagcctttgccagccggacggattagcaggtcaatttctgagtccgcgttttccgcacgcttccggccacaccacccagaagagagacctacaaccgcagctgggacaagcctcgaccggctggtgaccgatgtgaaggagaaattgaaacaagcaaaaaaattttggtcttctcttccctcaaacgtttgcaacgatgaacggatggccgcaggcaacgggaacgaggacgattgttggaacgggaaggggaaatctcggtatctgtttgccgtgaccggcaacggtctggctaaccagggaaacaaccccgaagtccaggtggacacctcaaaacctgacatactgattctccggcaaattatggccctgagggttatgacctcaaaaatgaagaacgcttacaacgggaacgatgtggacttctttgatatctctgatgaatccagcggagagggctctggttcgggctgtgaataccagcagtgcccatccgagtttgattataacgctacagaccatgctggcaagtccgctaacgaaaaggctgattctgctggcgtaaggcccggagctcaagcttatttactgaccgtgttttgcattctgtttctggtcatgcagagagagtggagatag

SEQ ID NO: 118886 - DNA, 1653 bp, Artificial Sequence
  Description of Artificial Sequence: Synthetic coding sequence
atggcgagattcggcctgccagcgttgctgtgcacactggccgttctctccgccgctctgttggctgccgagctgaaaagtaaaagctgctccgaggttaggcgactctacgtcagtaagggatttaacaagaacgacgctcccctacacgagattaatggcgaccacgaggatctgtccccaggcttttacctgctgttaagccgcgacgggggatactcactgcagtcgaaggatgattttaagtcagtcgtgtcagaacagtgcaaccacctccaagcggtttttgcctcgaggtacaaaaagtttgacgagttttttaaagaactgttggagaatgccgaaaaatccctgaatgatatgttcgttaagacctatggccacttgtacatgcaaaatagcgaattattcaaagacctgttcgtggaactaaagcgctattatgtcgtggggaatgtaaatctggaagaaatgctaaacgacttctgggccagactgctggagcggatgttcaggttggtcaattctcagtaccactttacggacgagtacttagaatgtgtgtctaagtacacagaacagcttaaaccattcggggacgtgccgcggaagctaaaactgcaggtcacacgagcttttgtcgccgcaagaaccttcgcacagggcctcgccgtggccggcgatgtggtgtccaaagtgtcagttccaagttgtactcacgcactgctcaagatgatatactgctcccattgtaggggtctcgtgaccgtcaaaccctgttataactattgctccaatattatgcgcggctgtttggcaaaccagggagatctggactttgagtggaataactttatagacgcaatgctgatggtcgccgaacgtctcgaggggcctttcaatatagagagcgtgatggaccctatcgacgtcaaaataagtgatgcaatcatgaacatgcaagacaacagcgtacaagtctctcagaaggtgtttcaaggatgtgggccacctaagccgctcccagctggacggattagccggagcatttcagaaagtgccttctcagccagatttagaccgcaccaccctgaagagcggcctacaaccgccgctggcacctctttagacaggttagtcactgacgtcaaggagaaactgaaacaggccaagaaattctggtcaagcctgccgtcaaatgtttgtaacgatgaacgtatggcagcggggaacggcaacgaagatgattgctggaacgggaagggaaagtcgcgatatttgtttgcggttaccggcaatgggctagctaatcaggggaataacccggaagtccaagtggatactagcaagcctgatattcttattttacgacagattatggcgttgagggtgatgacatcaaagatgaagaacgcatacaacggcaacgatgtggacttcttcgatatctccgacgaatcaagcggggaagggagtgggtcaggctgtgagtatcagcagtgtcctagtgaattcgattacaatgctacagatcatgccggaaagtctgcaaatgagaaagctgatagcgccggagtaagaccaggggcccaggcttatttattaacggttttctgtattttattcctagtgatgcagcgggagtggcgatag

SEQ ID NO: 118887 - DNA, 1719 bp, Artificial Sequence
  Description of Artificial Sequence: Synthetic coding sequence
atggacgcacagacttggcctgtgggattccgctgtctgctgctgttggctcttgtggggagtgccaggagcgaaggagtacagacttgtgaggaggttcggaaacttttccagtggcgtctgctaggcgctgtcagaggcttgccagactctccccgagcaggcccggacttgcaagtgtgtatctccaagaagcccacctgctgcaccaggaaaatggaagagcgctatcagattgccgctcgtcaagatatgcaacaattcctgcagacaagctcatctactttgaagtttctgataagcagaaacgccgctgctttccaggaaaccctggagacgttaatcaagcaggctgagaattacacaagtattctgttctgtagcacttaccggaatatggcccttgaggctgccgcctctgtacaagaattcttcacagacgtgggactgtacttatttggcgcggacgttaacccggaggaattcgtgaaccggttcttcgactccctctttcccttggtgtataaccatcttataaatccgggggtcacggactcttctcttgagtattcagagtgtattcggatggctaggcgcgatgtgtccccattcggcaacatcccccagagagtgatgggtcagatgggcaggtcactgctgccctcccgtacctttctccaggccctaaacctaggaattgaggtgatcaatacaactgattatctgcatttcagcaaggagtgttctcgcgccctcttgaaaatgcaatattgtccccactgccaggggttggcactcactaagccctgtatggggtactgccttaatgtcatgagaggctgcctagcacacatggccgagctaaacccgcactggcatgcttacatcaggtcactagaggaactgtctgatgccatgcacggcacatatgatattggccacgtgctgctgaatttccacctcttagtcaacgacgccgttctccaggcacatcttaacggtcagaagttgttggaacaggtgaacaggatctgtggaagacctgtaagaacccccactcagagtcctcgttgctcttttgatcagtctaaagagaagcacggaatgaagactactactcggaatagcgaagaaaccttagccaaccgtcgcaaagaatttatcaactctcttagactttataggtctttctacggcggcttagcagaccagctctgcgctaacgagctggccgctgccgatggtctgccttgctggaatggagaggatatagtgaagtcctacactcagcgagtagtcggtaacggaattaaagcacaatccggaaaccctgaagtgaaagttaaagggatagaccctgtaatcaaccagattatcgataagctgaaacacgtagttcaactgcttcaaggccggtcaccaaaacctgacaaatgggaactgttgcagctgggcagcgggggagggatggtagagcaagtttctggcgactgcgacgatgaagatggctgtggaggaagcgggagtggtgaagtaaagcgcaccctcaagattactgactggatgccagacgatatgaacttctctgatgtgaaacagatccaccagactgatactggtagcacactggacaccaccggagccgggtgcgcagtggcaaccgaaagtatgacattcaccctgatctctgtcgtcatgttgctgcccggaatttggtag

SEQ ID NO: 118888 - DNA, 1668 bp, Artificial Sequence
  Description of Artificial Sequence: Synthetic coding sequence
atgccgtcctggatcggtgctgtgatactccctctgttggggctgctcctaagcctgcccgccggagcggatgttaaggcacgtagttgcggagaagtgcggcaggcttacggagccaagggttttagcctggcagatatcccataccaggagatagcgggggagcacctgcgcatctgcccgcaggagtatacctgctgtacaacggagatggaagataaactctctcaacagtccaagctggagtttgagaacctggtagaggaaaccagccacttcgtaagaacgactttcgtttcacgacataaaaaattcgatgagttctttcgggagttgctggagaatgccgaaaagtctctgaatgacatgtttgtcagaacatacggcatgctttacatgcagaactctgaagtcttccaagacctgtttacagaactcaagcgttattataccggggggaatgttaacctggaagaaatgcttaatgacttctgggcccggcttctggagaggatgtttcagctaattaatccacagtaccacttcagcgaggactatttggagtgcgtatccaagtataccgaccagcttaagccattcggggatgttcctagaaaactcaagatccaggtgactcgggcttttatcgccgcgcggactttcgtgcaagggctgaccgtgggcagagaggtcgccaaccgggtgtccaaggtctcccctactccaggctgcatcagggccctgatgaaaatgctgtattgcccatattgtcgagggcttcctacggttaggccatgtaacaactattgcttgaatgtgatgaagggatgtcttgccaaccaggccgaccttgacactgaatggaatctcttcattgatgcaatgctactcgttgctgagcgcctggagggaccttttaacatagaaagtgtaatggaccccatcgacgtcaagatcagcgaagcaatcatgaacatgcaggaaaatagtatgcaggtgagcgccaaagtgtttcaggggtgtggtcagccgaagcctgctcccgccttgcgtagcgcccgttccgcccccgagaatttcaacaccaggttccgaccatacaatccagaggaacggccgacaaccgccgccggtacaagtcttgaccgactcgtgaccgatattaaggaaaagctaaaactgtccaaaaaagtttggagtgccctcccgtatacgatctgcaaggatgaaagcgtcaccgccgggacaagcaatgaggaagaatgttggaacggccactccaaggcccgttacctgccagaaatcatgaatgacggactgactaaccagattaataatccagaagttgatgtcgacattactcggcctgatacattcatcaggcagcagattatggcacttagagtgatgactaataagttgaaaaatgcgtacaatgggaacgacgtcaattttcaagataccagtgacgagagttctgggagcggctcaggttcagggtgcatggacgatgtctgccctaccgaattcgaattcgtgaccactgaggcccccgccgtagacccggatagacgcgaggtggactctagcgccgcccagcgaggccacagcctgctgtcttggagcctcacttgcattgtacttgcactacagaggttatgtcggtag

SEQ ID NO: 118889 - DNA, 582 bp, Artificial Sequence
  Description of Artificial Sequence: Synthetic coding sequence
atgcaatccctgatgcaggctcccctgttaattgcactgggccttctgttggccgcccctgcccaagcgcacttgaaaaaaccaagtcagcttagttcattcagctgggacaactgcgacgaaggaaaagatcctgcagtgatccgcagtctgactctcgagcccgatccaatcatcgtacctggtaatgtgactctcagtgtgatggggagcacctccgtgcccctttcctccccactgaaggtggacctggtgctggaaaaggaggtagcgggtctgtggatcaaaataccatgcacagattacatcggaagttgtactttcgagcacttttgtgacgtgcttgacatgctgataccaactggagaaccctgccccgaacctcttcgaacctacggcctgccgtgccattgtccattcaaagaagggacgtacagtttgccaaagtcagagttcgtggtcccggacctggagctgccctcttggctaacgactggcaattataggattgagtctgtcctgagttccagcggaaaacggctgggctgcatcaaaatcgccgccagcctgaagggcatttag

SEQ ID NO: 118890 - DNA, 1140 bp, Artificial Sequence
  Description of Artificial Sequence: Synthetic coding sequence
atgggatgcctgggaaattcaaaaactgaggatcagcgcaatgaagaaaaggcccaaagggaggctaacaaaaaaattgagaagcagctgcagaaggataaacaggtgtatagagcgacccacagattgttgttgctgggcgcaggtgagagcggaaaatctactattgtgaagcaaatgcgtatcttgcatgtgaatgggttcaatggcgacgagaaggctactaaggtgcaggacatcaagaacaacctcaaggaggcaatcgaaaccatcgtagctgcaatgtccaatctggtgccaccagtcgagcttgcaaatcctgaaaatcagttccgggtagattacatactgtctgtgatgaatgtgcccgacttcgactttcctccggaattctacgagcatgcaaaagccctgtgggaggacgagggcgtgcgcgcttgttacgagcggtccaatgaataccagctgatcgattgcgctcagtactttctggataaaatcgatgtcataaagcaggccgactacgtgccctccgatcaagaccttctgaggtgccgggttctgacctccggtatttttgagactaaattccaagttgacaaggtgaattttcacatgtttgacgtaggtggccaacgggacgagcgccggaagtggatccagtgcttcaatgacgttaccgctatcattttcgtcgttgcatcatcctcctacaacatggtgatacgggaagataaccagactaacaggctccaggaagctttaaatctgtttaagagcatatggaacaataggtggttgcggaccatcagcgtgatcttattcttgaataagcaggacttgctggcagaaaaggtcctggccgggaagtcaaagatcgaggactactttcctgaatttgcacgctacaccacgcctgaggacgccactccggagccaggcgaggatccccgggtgaccagggctaagtattttattagggatgaatttcttagaatcagcactgctagcggggacggacgacactattgttacccgcattttacatgtgctgtggacactgagaatattcgtagggttttcaatgactgtcgagatataatccagaggatgcatctgcgacagtacgaactactgtag

SEQ ID NO: 118891 - DNA, 1143 bp, Artificial Sequence
  Description of Artificial Sequence: Synthetic coding sequence
atgggctgtttgggtaactccaaaacggaggatcaacggaatgaggaaaaggcccagagagaagcgaataagaagattgaaaagcagctgcagaaggataaacaggtttaccgcgctacccatcgtctcttgctgttgggcgctggcgagtccgggaagagcacgattgtcaagcagatgcgcatactccacgtgaacggtttcaatggcgatagcgaaaaagctaccaaggtccaagatatcaagaataacctgaaggaagcaattgaaacaatcgtcgccgccatgtctaatctggtccctcccgtggaactggctaatcctgaaaatcagttccgcgttgattacatactctcggtcatgaatgtgcccgacttcgatttccccccggagttctacgagcacgcaaaagccctgtgggaagatgagggcgtgagagcatgctacgagcggagcaatgagtaccaactcatcgactgcgcccagtactttctggacaaaatcgacgtcatcaagcaggcagattatgtgccttctgaccaggatctgctgcgctgccgcgtcctaacctccggcatatttgaaactaaattccaggtggacaaagttaactttcacatgtttgacgtcgggggacagagagatgaaagaagaaagtggatccagtgttttaacgacgtaactgccatcatcttcgtagttgcctcctcctcctacaacatggtgataagggaggacaaccagacaaatagactccaggaagcattgaacctgtttaaatccatctggaataataggtggctgcgtaccatttccgtgattctttttctgaataagcaggaccttttggcggaaaaagtactggccggaaagagcaaaatcgaggactactttcccgaattcgcacgctatactactcccgaagatgccacgcctgaaccaggcgaagatccgagagtgacacgcgccaaatactttattcgggacgagttcttgcgcattagcaccgctagtggagacggccgccattactgctatcctcattttacatgcgcggtagacaccgagaatatacgtagggtctttaacgattgcagggatattattcagaggatgcacttgaggcaatacgagctgctctag

SEQ ID NO: 118892 - DNA, 738 bp, Artificial Sequence
  Description of Artificial Sequence: Synthetic coding sequence
atggatcgccgaagccgggcacagcagtggcgacgggccaggcataattacaatgacctatgtccaccgatagggcgtcgagccgccactgctctgctgtggttgagctgcagcatcgccttgctcagggcattagccacctctaatgcgagagcccagcaacgggctgccgcccaacaaagacgctccttccttaatgcccatcacaggagcggcgcccaagtgtttcctgagtctcctgaatctgagtcagatcacgagcatgaagaggcggacttggagctgagcctacccgaatgcctagaatacgaggaggagtttgattatgaaactgaatctgagactgagtcagagattgaaagtgagaccgacttcgaaactgaacccgagacagccccgacaacagaacccgagacagagcctgaagatgatagagggccggtggttccaaagcactccacgtttggccagtcactgactcaaagactccacgcattaaaactgagatcgcctgacgcatccccgtcaagggcccccccaagcacccaagagccccaatcacccagggagggtgaggaacttaaaccagaggacaaagaccctcgggacccagaagagagtaaggagcccaaggaggagaaacagcgtagacggtgcaagcctaagaaacccacaagaagggacgcctctcctgaatccccttctaagaaaggacctattcctatcaggaggcactag

SEQ ID NO: 118893 - DNA, 1188 bp, Artificial Sequence
  Description of Artificial Sequence: Synthetic coding sequence
atgggctgcctgggtaactcaaaaactgaagaccagaggaatgaggagaaggcccaaagggaagccaacaagaaaattgagaagcagctccagaaggacaagcaggtctatcgagcgacacataggctgctgctgctgggggccggcgaatcaggtaagagcacaatcgttaaacagatgcgcatccttcatgtcaacggctttaatggcgaggggggcgaggaggacccccaggcagcccggtccaactcagatgggtcggaaaaagctactaaagttcaggatataaaaaacaatctcaaggaggccattgagactattgtagccgccatgagcaatctggttcctcccgtggaactcgctaacccagaaaaccaattccgcgtggattacattttgtccgtaatgaatgtcccagattttgatttcccacctgagttttacgaacacgctaaggctctttgggaagacgagggagtccgggcctgttacgagcgcagtaatgagtatcagctaatcgattgtgctcagtacttcttggataaaattgatgtgatcaaacaggccgattacgtgcccagtgaccaagacctcctgcgttgtcgcgtgctaacctccggcatcttcgagaccaagttccaggttgacaaagttaacttccatatgtttgacgttggcggccagcgtgacgaaaggcggaagtggattcagtgtttcaatgacgtaaccgcgatcattttcgtcgtcgcttcatcctcgtacaacatggttatcagagaggacaaccagaccaataggttacaggaggctctgaatctttttaagtctatttggaacaatcgctggctgcgaactatctctgtgatactgtttcttaacaaacaggatttactcgctgagaaggttcttgcggggaagagtaaaatcgaagattactttcctgagttcgctcggtacaccactcccgaggacgctacacccgagccgggtgaggatccaagggtgacaagagccaaatatttcatcagagatgagttccttcgcatttccaccgcctcaggggacgggaggcattactgttacccacactttacatgcgccgtagatacagaaaacattcgcagagtgtttaacgactgccgtgatattattcagcgcatgcacttgcgacagtatgaacttctgtag

SEQ ID NO: 118894 - DNA, 738 bp, Artificial Sequence
  Description of Artificial Sequence: Synthetic coding sequence
atggatcggaggtcgcgcgcgcagcaatggcggcgtgcaagacataactacaacgatctatgccctccaatcggccggcgggcagctacggcgctcctgtggctgagctgtagtatcgcacttttgagggctttggcgacatcaaatgcaagggcccagcagcgggccgcagcccagcaaagacggtctttcctgaacgctcatcaccgaagcggcgcacaggtcttccctgagagtccggagtcagagtcagatcacgaacacgaggaggcagacctggagctgtctctcccggagtgccttgagtacgaagaggagtttgattacgagaccgagagtgaaaccgaaagtgaaatagagagcgagactgattttgagactgagcccgagactgcccctaccaccgagcccgagaccgaacctgaagacgaccggggcccggtggtgcctaaacacagtactttcgggcaaagtttgactcagcgcttgcatgccctgaagcttaggtcacctgatgcgagtccatcccgagccccgccgagcacacaggaaccgcagtcccctagggagggtgaggagctgaagccggaggacaaagatcccagagacccagaagagtccaaagagccaaaagaggagaagcagaggcgcaggtgtaaaccaaagaagcctacccgtcgcgatgcctcccctgaaagtccttccaagaagggccccatccccatcaggaggcactag

SEQ ID NO: 118895 - DNA, 483 bp, Artificial Sequence
  Description of Artificial Sequence: Synthetic coding sequence
atgggctgcctgggcaactctaagactgaagaccaaaggaacgaagagaaagcacagagagaggcaaacaaggaggataatcagacaaatagactccaggaggcgctgaacctctttaagtcaatctggaacaataggtggcttagaacaatctccgttatcctgttcctcaacaagcaggacctactggccgagaaggtactggccggtaagtctaagatcgaggactactttcccgagttcgctcgatacactacacccgaggacgcaaccccagagcctggtgaagacccgagggtgactcgcgcgaagtattttatacgtgatgagttcctgcgtatcagtacagcatccggcgatggtcggcactattgttatcctcatttcacctgtgcggtcgacaccgaaaatatcaggagggtttttaacgactgcagggatatcatacagaggatgcatctgcggcagtacgagttgctgtag

SEQ ID NO: 118896 - DNA, 1185 bp, Artificial Sequence
  Description of Artificial Sequence: Synthetic coding sequence
atgggttgcctaggcaactctaagacagaggaccagaggaacgaggaaaaagcccagcgggaagccaataaaaagatcgagaaacaactgcagaaagacaagcaagtttacagggccacacatagactgctgctgctaggagcaggcgagagcggaaagagcactatcgtgaagcaaatgcgtattttgcatgttaatggctttaacggggagggcggagaggaagatcctcaggctgcccggagtaattccgacggcgaaaaagccacaaaagtacaggatatcaagaacaacttgaaagaggcgatagagacaattgtcgcagccatgagtaatctggtgccgcctgtggaacttgccaaccccgaaaatcaatttcgggtggactacattctcagcgttatgaatgtgccagattttgactttccccccgagttctacgagcatgcaaaagcactgtgggaagacgaaggggtccgggcttgctacgagcgttccaatgagtatcagcttatagactgcgcccaatattttttggataaaatagatgtgatcaagcaagccgactatgtgccatcagatcaggatttactccgctgccgagttctgacctctgggatctttgagacgaaatttcaggtcgacaaggtcaatttccatatgtttgatgtaggcgggcaacgcgacgagcgcaggaaatggatacagtgttttaatgacgtgaccgctataattttcgtagtagctagcagtagctacaacatggtgataagggaagataatcagaccaacagattgcaggaagccctgaatctattcaagagcatttggaataaccgatggttacggaccatctctgttattctttttctgaataaacaggatctgctggctgaaaaggtcctcgcggggaagagcaaaatcgaggactatttccccgagttcgctaggtacaccactcctgaagacgctacccccgaaccgggagaagaccccagggtgacaagggctaagtactttatcagagacgagtttctgcggatttctaccgcctcgggggatggcaggcactattgctacccccactttacctgcgcggtagataccgagaatatcagaagggtgttcaacgattgtcgggatataatccagagaatgcacctaaggcagtatgaattgctgtag

SEQ ID NO: 118897 - DNA, 1143 bp, Artificial Sequence
  Description of Artificial Sequence: Synthetic coding sequence
atgggctgcttgggaaactccaagaccgaggatcagcgcaacgaagagaaggctcagagggaagccaataagaagattgagaagcaattacaaaaggacaaacaagtgtatagggccactcatcgcctgctgctactcggcgccggcgaaagcggcaagtcaacaatagtaaagcagatgcgcattttacacgtgaacgggtttaatggggattctgaaaaggcaacaaaagtccaggatattaagaataatctcaaagaggccatcgagaccatcgtcgcggcaatgagcaacttggtgccccctgtggagctcgccaatccagaaaatcagttcagagtcgactacattctctctgtaatgaacgttccagacttcgatttcccgcctgagttttacgagcacgcaaaagctctatgggaagatgagggggtgcgcgcctgttacgagcgaagcaatgagtaccaattgatcgattgcgcacaatacttcctggacaagatcgacgtgatcaaacaagccgattatgtaccatcagatcaggaccttcttagatgccgggtcctgacctctggcatctttgagaccaaattccaggtggacaaggtgaacttccatatgtttgatgtgggcgggcagcgcgacgagcggcgcaaatggatccagtgtttcaacgatgtcaccgccatcatctttgtggtggctagctcttcctacaatatggttatccgggaggacaatcagacaaatcgcctccaggaagcattgaatttgtttaaaagcatttggaacaatcgttggttgaggaccatctcagtgatactctttctcaataagcaggatttacttgctgagaaggtgcttgcgggtaaatctaaaattgaggattactttcctgagttcgcaaggtatacaacccctgaggatgctacgcctgagccgggcgaagacccccgcgttaccagagcgaagtacttcatacgggatgaattcttgaggatatccaccgcaagtggggacggcagacactattgttacccccactttacctgcgcagttgataccgagaacataaggagagttttcaacgattgtcgggatatcattcagagaatgcacctgcgacagtacgaactgttatag

SEQ ID NO: 118898 - DNA, 738 bp, Artificial Sequence
  Description of Artificial Sequence: Synthetic coding sequence
atggaccggagaagccgtgcgcagcaatggcgccgggcacgacataactacaatgacctatgccctccaattggccgtcgagcagctacagccttactgtggctcagctgttcaattgctctgttacgggcccttgccacaagtaacgccagggcacagcagcgagccgctgcccagcagcgccgatctttcctcaacgcccaccatcgcagcggtgctcaggtgtttcccgagagcccggaaagtgaatctgaccacgaacacgaagaggctgacctggaactgtccctccctgagtgccttgaatacgaggaggagttcgactatgaaacagagtctgagacagaatctgagatcgaatccgagaccgacttcgagacagagccggagactgctccgacaactgagcccgagacggagcccgaggatgaccgtggcccagtcgtgcctaaacactccacctttgggcagtccctgacccagcgcctgcacgccctgaaactaaggtccccggacgcttcaccttcccgggccccacctagtactcaggagcctcagtctccccgggaaggagaggaactgaagcctgaagataaagatccaagagatcctgaggagagcaaagagccaaaagaagagaagcagaggagaaggtgcaagccgaagaaaccgacccgccgggacgcctctcccgagtccccttctaaaaagggtcctatccccatcaggcgccattag

SEQ ID NO: 118899 - DNA, 3114 bp, Artificial Sequence
  Description of Artificial Sequence: Synthetic coding sequence
atgggcgtgcgtaattgtctctatgggaataatatgagcggccagcgggacattccccccgaaattggagagcagcctgaacagccacccctggaagcgcccggtgccgccgcaccaggcgctgggccttctccagcagaagagatggagacagaacctccacataacgaaccaattcctgtggagaatgatggtgaagcatgcgggccccccgaggtatcccggcccaacttccaggtcctcaaccctgccttcagggaggcgggggcccatgggtcatatagtcctccacccgaggaagcaatgccatttgaagccgagcaaccgtctctagggggattttggccaactctagagcaaccaggcttcccgtcgggtgttcacgctggacttgaagcttttggccctgcactgatggagcccggggcatttagtggagccagacccgggctgggcggttactcaccccccccagaggaggccatgccattcgaattcgatcagccggcccagagggggtgctcccagctcctcttacaggtgcccgacctggcaccaggcggccctggagccgcaggggtgcccggagcaccaccagaagagccacaagctctgaggccagccaaggctggcagccgcggaggctactcccctccacctgaggagacaatgcctttcgagctggatggcgagggctttggagatgactcgccaccccccgggttaagtcgcgtgattgcgcaggtcgatgggagctctcaatttgctgccgtggccgcttcttcagctgtaagactaaccccagcggccaatgctcctcccttatgggtacccggggccattgggagcccttcgcaggaggccgtaaggcccccgagcaacttcacaggctcctcgccgtggatggaaatttccggtccgcctttcgagattggcagtgcccctgccggcgtggacgacacacccgtgaacatggactctcctccaatcgctctggacggaccgccaattaaagtctcaggcgcccccgacaagcgggaacgcgctgagaggccgccagttgaagaagaagcggctgagatggaaggagccgctgatgcagcagaggggggtaaagttcctagcccaggttatggcagtccagccgccggtgccgctagcgccgacaccgctgcgagagctgccccggccgcgcccgccgaccctgatagtggcgctacccctgaggaccccgattcgggcacagccccagctgatcctgacagcggggcattcgcagccgaccctgacagcggagctgctcctgccgcgcctgcagatccagacagcggtgctgcccctgacgcaccagcagacccagattccggggcggctccggacgccccagctgatcccgatgcaggggccgcccctgaagccccggctgccccagccgcggcagaaacccgagctgcccatgtggctcccgctgccccggacgccggtgcccctaccgcaccggcggcgtcagctacgcgagcagcccaggtgcggcgggctgcttccgcagcccctgcttctggagctaggagaaaaatccaccttaggcctccaagcccagagattcaggcagctgatccaccaacgccaagaccaaccagggcttccgcatggcggggtaagtcggaatctagtcggggcaggcgcgtttattacgacgaaggcgtggcgagtagcgacgacgattcaagtggagacgagagcgatgatggaacctctggttgcctgagatggtttcagcaccgcagaaaccggcgccggcgcaagccccagcgcaatctgcttaggaacttcctggtacaggccttcggtggctgtttcggacgatcagaatctccacagccaaaggccagccgcagcttgaaagtgaagaaagtgcctctggctgagaagcgacgccagatgagaaaggaagccttagagaaacgggcccagaagcgagccgagaaaaaacggagcaaactgatcgacaaacagttgcaggacgagaaaatgggctatatgtgtacccatcggcttctgctgcttggtgccggcgaaagtggaaagtccaccatcgtgaagcagatgcgcattttgcacgttaacggtttcaatggtgagggtggagaagaggacccgcaagcggctaggtcgaattcagacggagagaaggctacgaaagtacaggacatcaagaacaatctaaaggaagctatcgaaaccatcgtggctgccatgtccaatctggtcccacccgtggagcttgccaaccctgagaaccaattccgcgtggattatattctgtccgtgatgaacgttcctgatttcgactttcctcctgaattctatgaacatgcaaaggctctctgggaggacgagggtgtgcgggcctgctatgaaagatcaaacgagtatcagctgattgactgtgcgcaatactttctggataaaatcgacgttatcaagcaggccgactatgtgccaagcgaccaggatctcctgcggtgccgtgtactcacaagcggcatcttcgaaaccaagtttcaggtagataaagtcaattttcacatgttcgatgtcggaggtcagagggacgaacgcaggaagtggatccagtgctttaacgatgtcaccgctatcatcttcgtggtcgcaagtagttcttataacatggtcattcgcgaggacaatcaaacaaataggctgcaggaagcattgaatttgttcaagtccatttggaacaataggtggctccgtacaatcagcgtgatcctctttctcaacaaacaggacctcctagcggaaaaggtgctggctgggaaatcgaagatcgaggactacttcccggaatttgctaggtacacgacacctgaggacgcgacacccgagcctggcgaagaccctcgcgtgacccgagcaaaatactttatcagagatgagttcctcaggatctccacagcaagcggggacggacggcattattgttaccctcacttcacctgcgccgtggacacggagaatattagacgagtgtttaacgactgtcgtgatatcatacagcgaatgcaccttagacagtacgagctgttatag

SEQ ID NO: 118900 - DNA, 342 bp, Artificial Sequence
  Description of Artificial Sequence: Synthetic coding sequence
tgaactacagaaccggagactgagcctgaggatgatcgggggcctgtggtcccaaagcactctacctttgggcagagcttgacacagaggctgcatgcgttaaaattacgcagcccagatgcttcacccagcagagcgcccccttccacacaggaaccccagtcaccgcgcgagggagaggaactcaaacctgaagataaggatcctagggaccccgaggaatctaaggagcccaaagaggaaaaacagaggcgaagatgcaagccaaagaaacccacaaggcgcgatgctagccctgagagcccctcaaagaaaggccctatccctatccgcagacactag

SEQ ID NO: 118901 - DNA, 501 bp, Artificial Sequence
  Description of Artificial Sequence: Synthetic coding sequence
cccgagagcgaatctgatcatgaacacgaagaagcggacttggagctctcactgccagagtgcctggaatatgaggaggaattcgactatgaaacggagtccgagaccgagtcggaaatcgaatctgaaaccgactttgaaaccgagccagagaccgcccccacaacagagcctgagactgagccagaggatgaccgggggcccgtggtccctaaacattctactttcggacagtcactaacgcagcgcctgcacgccctcaagttaaggagcccagatgcttccccctcaagagcgcccccatccacgcaggaacctcagtctccaagagagggagaagagctgaagcccgaggacaaggatccgcgcgatccagaggagtcgaaagagccaaaggaagagaagcaacgccggcggtgtaagccgaaaaagcccacacgcagagacgcaagcccagaatccccaagcaaaaaaggcccaatcccaatccgccgtcactag

SEQ ID NO: 118902 - DNA, 5580 bp, Artificial Sequence
  Description of Artificial Sequence: Synthetic coding sequence
atggttgataaaaacatttacatcattcaaggcgaaattaatatagtggtgggcgccattaaaagaaatgccagatggagcacacatacccctctggatgaggagagagacccactgctgcacagctttgggcacctcaaggaggtcctcaactccatcaccgagttgtccgagattgagccgaatgtttttcttcggccctttttggaagtgattcggagcgaggacaccacggggccaataactggactggctttaaccagcgtgaacaagtttctgtcatacgcactcattgatcccactcacgagggtacagcagagggcatggaaaatatggccgacgctgtgactcatgcaaggtttgtggggaccgatcccgcctcagatgaagtcgtcctgatgaagattcttcaggttttacgcactttactgctgactccagtcggagcacacctaacaaatgagagcgtgtgcgaaatcatgcagagctgtttcagaatctgttttgaaatgcgattatcagagctgctgcgcaaaagtgccgaacacaccttggttgacatggttcagctcctcttcaccagactaccccaattcaaggaagagcctaaaaactacgtgggcaccaacatgaaaaagctgaagatgcgagctggcggaatgtccgattccagcaaatggaaaaagcagaagaggtccccacgccccccccgccacatgacaaaggtgacccctggttcggaactcccaactcctaatgggacgaccctgagttccaacttgacagggggaatgccctttattgacgttcccactcctatctcgagcgcgtcctctgaggcagcttctgctgtcgtgagcccttctacggatagcgggttagagttttcatcacagacaacatctaaggaagacctgacagatctcgaacaaccggggagtccaggatacagcacagctacagaaccgggtagttctgaactgggtgtgcctgaacagcctgacctgcaggagggcacgcacgtggaaaagtctcagagcgcaagcgtggaaagcatccccgaagtgcttgaggaatgtacctcccccgctgaccactccgactccgctagcgtgcacgatatggactatgttaaccccagaggagtgcggttcacacagtccagccagaaggagggtaccgcgctcgttccctacgggctgccatgcattagggaactgttcagatttttaatctccctgactaatccccacgacaggcataacagtgaagtgatgattcatatggggctacatttactgaccgtggccctcgaaagtgcacccgtggcacagtgccagaccctgctgggactcataaaggacgagatgtgccggcacttatttcagctgttatccatcgaacggctgaatctctacgcagcatcgctgcgggtttgcttcctgctgttcgaatcaatgagagagcaccttaaatttcagatggagatgtatatcaaaaaattgatggagattatcaccgtggagaatcctaagatgccttatgagatgaaagagatggccctggaagctatcgtgcaactgtggagaatcccctcttttgttacagagctttatatcaactacgattgtgattactactgtagcaatctgttcgaggagctgactaagctgttatccaaaaacgcttttcctgtgagtgggcagctgtacactacacatttgctgtccctagatgcactgctgactgtgatcgactccactgaggcccactgccaggcaaaggtcctgaatagccttacccagcaggagaaaaaggagaccgcacgtccaagttgcgagatcgttgacggcactagagaggctagtaacaccgagaggaccgcaagtgacgggaaggccgttgggatggcaagcgatatcccgggtctgcatttgcctgggggaggccgtctgcccccggaacacgggaagagcggttgcagcgacttagaggaggctgttgattcgggcgcagacaaaaaattcgccagaaagcctcctcgtttctcatgcctcttgcctgatcctagggagctaatcgagataaagaacaaaaaaaagctcctcatcactggcaccgaacagtttaatcaaaagcccaaaaaagggatccagttcctgcaggagaaggggctgctgaccattccaatggataatacggaggtagcacagtggctcagagaaaatccgaggttggacaaaaagatgatcggcgaatttgtctccgatcgaaagaacatcgaccttcttgagtcctttgtgtctaccttctcgtttcagggcttgcggctggacgaggcactgaggctgtatctggaggcgttccgacttcctggggaggctccggttatccagagacttctcgaggcgtttactgaacgttggatgaattgcaacggctctccgtttgccaattccgatgcttgtttttcgctggcctatgctgtcataatgctgaataccgatcagcataaccataacgtgcgtaaacaaaatgccccaatgacactggaggagttcaggaaaaacctgaagggcgtaaatggtggtaaagactttgaacaggatattttggaggatatgtaccacgccatcaagaatgaggaaattgtgatgccagaggagcagacaggcctcgtccgcgaaaattacgtctggaacgtcctgctgcaccgcggcgcaacacctgagggcatcttcctccgcgtgcccacagcatcctacgacctagatctgtttactatgacctggggccccaccattgcagccctgagctacgtatttgataaatctttagaagaaacaattatccagaaagcaatctctggcttccggaaatgcgcaatgattagcgcccactacggcctgtcagacgtgttcgataaccttattatctccttatgcaaattcaccgccctaagcagtgaaagcatcgaaaatctgcctagtgtgttcggaagtaacccaaaggcccatatagccgcaaagacggtgtttcacctggcccatcgacacggcgatatacttcgagaggggtggaaaaatatcatggaagctatgttgcagcttttcagagcccagctgcttcccaaagccatgatagaagtggaagactttgtcgaccccaatggcaaaattagcctgcagcgcgaggagaccccgagcaaccgcggagagagtactgtcctgtctttcgttagttggttgaccctgtcgggacccgagcagagctcagtcagggggccctccactgagaaccaggaagccaaacgcgtggcattagaatgtatcaagcagtgcgaccctgagaaaatgatcacagaaagcaagttcctgcaattggaaagcctacaagagttgatgaaagctctggtaagcgtgactccagacgaggaaacatatgatgaggaggatgccgccttttgtctggagatgctgctgagaatcgtgcttgaaaacagggaccgagtgggatgcgtctggcagacagtacgcgatcacttgtatcacttatgcgtgcaggctcaagatttttgttttctggtcgaacgggccgtggttggtctgctcagacttgcgatcagactcctacgacgagaggagatctccgctcaagtgctcttgtcactgcggatcctcttactgatgaaaccatccgtcctctctcgggtctcgcatcaggttgcttatggattgcacgagcttttgaagacaaatgctgccaatatccattccggcgatgactgggcaactctatttactctcctcgaatgcataggaagtggggttaaaccacctgctgcacttcaggcaactgcccgagccgatgctcctgatgcaggggcccagtccgattccgaactgccttcctatcatcaaaacgacgtgtcccttgaccgcgggtatacctcagactcagaagtgtatactgaccatggacggcctggcaagatacacaggagtgccactgacgcagacgtggtaaatagcggatggcttgtggtcggtaaagatgatgtcgataacagcaagcctggaccttcgcgtcccggtccttcacccctaatcaaccagtactccctgaccgtgggactggacttgggtccccatgataccaagtctctcctcaagtgtgtggagtcgttaagtttcatcgtgagggacgctgcccacattacacccgacaactttgagctgtgcgttaaaacactccgaattttcgtggaggcttctctcaatggaggctgcaaaagccaagagaagcgaggaaaatctcataaatatgattccaagggaaatcggtttaagaagaagagtaaggaaggatctatgctccgacgccccagaactagttctcagcatgcgagccgcggaggacagtccgacgacgacgaggatgagggagtgccagcctcttatcacacggtctctttgcaggtgtcccaggacctcctggacctgatgcacacattgcatactcgcgccgcctccatttattccagctgggccgaagagcagagacacttagagaccggcggccaaaaaattgaggctgacagtcggacgctctgggcccactgctggtgtccactgctgcaggggatcgcttgtctctgctgtgacgcaagacgccaggtgcgaatgcaggcccttacctaccttcaacgcgccctgctggtccatgatctgcagaagctggacgccctggaatgggagagttgttttaacaaagtgctgttccctttgttgacaaagctactggagaacatttcgcccgctgacgtggggggtatggaggaaactagaatgagagcaagtacactcctgagtaaagtgttcttgcagcatcttagcccactcttgtctctgtccacttttgcagctttgtggctgaccattctggacttcatggacaaatacatgcacgcaggaagcagtgatcttctttctgaggcaatcccagagtctcttaagaatatgctgctggttatggatacagctgaaatctttcattctgccgatgcacgggggggcggtccctctgcactgtgggaaataacatgggagagaatcgactgttttctgcctcatctgcgcgacgagttgttcaagcagaccgtgattcaggatccgatgcccatggagccgcagggtcagaagccgctcgcaagcgcccacctgactagcgcggctggggacacccggactcccggccatccacccccacctgaaatcccttcagagttgggcgcttgcgactttgagaaacccgagtcgccgcgcgcggcttcttcttcttcacccggttctcctgtagcctcaagtcctagcagactgtcgcctacccctgacggacctcccccccttgcacagccgcccctaattctgcagcccctggctagtcctctccaggtgggcgtacctccgatgacactgccaattatcttgaatcctgctctgatcgaagccacatcaccagtgccactccttgccacaccacgccccaccgatcccatccctacaagcgaagttaactag

SEQ ID NO: 118903 - DNA, 1749 bp, Artificial Sequence
  Description of Artificial Sequence: Synthetic coding sequence
atggggggatcaagcccagtaactagcaaggcgatagtcgatgcagatggtaggatatatatcagaaactggcaaggcggcattctgtccgggggatttgagaaaaatcccaaaccaattttcactgaggggaagaaccaactcgaaattcagaacctgcaggaggactgggatcatttcgaacctcttttatcgtcactcttgagacgaatgccagagcttgaaactctcgaaataatgaaactcgtcaattgtcccgagacctttacccccgatatgaggtgtattatgggggaaagcccggccgttcagggatattttgtgctcgctgggatgaacagtgctggactttccttcgggggcggcgccggaaaatatctggcggagtggatggtgcacggctaccccagtgagaacgtatgggagttggacctgaagaggtttggagccctccagagttccagaacattcctgagacatcgcgtcatggaggtgatgcccctgatgtatgatctcaaggtgcctcgctgggatttccagacggggcggcagcttaggacttcccccctctatgaccgcctggacgcacaaggcgctagatggatggaaaaacacgggtttgagagacctaagtattttgtgccccccgacaaggacctgctggcactggaacagtcaaagaccttttataaacctgactggtttgatatcgtagagtctgaagtaaagtgctgcaaagaagctgtgtgcgtcattgatatgagctcattcactaagttcgagataacgagcacaggagaccaggcacttgaagtccttcagtatctgttttccaatgatcttgacgtcccggtagggcacatcgtacacacaggcatgctgaatgagggtggaggctacgaaaacgattgctccatcgcccgccttaataagcggagcttttttatgatcagccctacagatcagcaggtgcactgctgggcgtggctgaaaaaacatatgcccaaggactccaacctcttgctcgaagatgtcacgtggaagtacaccgcactaaaccttattgggcctcgggccgtggatgtcctaagtgagctatcctatgcgcctatgactccagaccatttcccatcgctgttttgcaaggaaatgtccgtggggtacgccaacgggattagagtgatgtccatgacccataccggcgaaccaggcttcatgctgtatatcccaattgagggcatggacttcataggcagagatgccctgctgcagcagaagcaaaacggggtttataagaggctgacgatgttcattctggacgatcacgacagtgacctagacctgtggccatggtggggggagccaatttacagaaatggacagtatgtggggaaaactacttctagcgcctactcctacagtctggaacgacatgtgtgtcttggtttcgtccataatttctctgaggataccggcgaagagcaagtggtcacagctgactttatcaatagaggtgaatatgaaatcgatattgcagggtaccgctttcaggctaaggcaaagctttatcctgtggcctccttgttcacccagaaacgccggaaagatgacatggagcttagtgccttcttagccctgcctcctccacctcccaacatccatagtggcctgttctttccttcgcatccatctctgtctttctcgtggtggcaagaggtgtgcctgaccggccagaagcaggcgccttag

SEQ ID NO: 118904 - DNA, 3540 bp, Artificial Sequence
  Description of Artificial Sequence: Synthetic coding sequence
atggccgcatgtgggcgcgtgcgaagaatgttccgcctgtcagcggcgctgcatttgctgctgttatttgccgccggtgccgagaaacttcccggacagggtgtccactcgcaggggcaaggcccgggcgccaattttgtgtcctttgttgggcaagctggtggaggcgggccagcagggcagcagctgccgcagcttccacaatcctctcagttgcagcagcaacagcagcagcaacagcagcagcagcagcctcagcctcctcagccacctttcccagccggcggtccaccagctaggagaggaggggcaggcgcaggcggtggttggaaattagcagaagaggagtcatgtagagaagacgtcacacgcgtatgtccaaaacacacctggtctaataatcttgccgttctcgagtgtctacaggatgtgcgcgagcccgagaatgaaatctcctctgattgtaatcatctgctgtggaattataagcttaacctgacaaccgatcccaaatttgagtccgtggcaagagaagtgtgcaagtccacgataactgagataaaggaatgcgcggatgaacccgtcggaaagggctacatggtgtcctgcctggtggaccatcgcggaaatatcaccgaataccaatgtcatcagtatatcaccaaaatgacagctataatattctcggactatcgccttatttgtggcttcatggatgattgtaaaaatgatatcaatattctgaaatgcggttcaatacggctgggcgagaaggatgcacacagccagggagaagtggtgagctgcttagagaaggggctggtgaaggaggcggaagaaagagagcctaaaatccaagtctcagagctgtgcaaaaaggccattctcagggtcgcagagttgtcatccgatgatttccacttggatcgccatctgtacttcgcatgccgagacgacagggagaggttttgtgaaaacacacaagctggggagggccgtgtctacaagtgcttgtttaatcataagttcgaagaatcaatgagcgagaaatgcagagaagctctgaccacaagacaaaaactgatcgctcaagactacaaggtgagttatagtctagcgaagtcgtgtaagagcgacctcaaaaagtatcgctgtaatgtggagaatctgcctcggtccagggaggcccggttgtcttacttgctgatgtgccttgagtcagctgttcaccggggcagacaggtcagcagtgagtgccagggcgaaatgctggactacagacgaatgctgatggaggatttcagcctgtcaccagaaatcattctctcctgcaggggggagatcgaacatcattgtagcggactccaccgcaagggacggacgttgcattgcctcatgaaggtggtaagaggcgaaaagggaaacttaggtatgaactgccagcaagcgttacagaccctgatccaagagactgaccctggggcggactacagaattgaccgagcactgaatgaggcatgtgagtcagtcatccagactgcctgcaagcatatacgttccggcgacccaatgattctgtcctgccttatggaacatttatacacagagaagatggttgaggattgcgagcacagactgctagagcttcaatattttattagccgtgactggaagcttgaccccgtcctataccgaaagtgtcagggagatgcatcacggctttgccacactcacgggtggaatgaaacctccgagtttatgccccagggcgccgtgttcagctgcttgtatagacacgcctatcgtaccgaggaacaaggaaggcggttgagcagagagtgtcgcgctgaagtgcagcggattctgcatcaaagagctatggacgtaaagctggatccagctctacaggacaaatgtctcattgatctcgggaagtggtgcagcgaaaagacggaaactgggcaggaactggagtgcctccaagatcacttggacgatctggtggttgagtgcagggacattgtcggtaacttgacggaactggaatcggaggacattcaaatcgaagcgttactgatgcgggcctgcgaaccaattatccagaacttttgtcacgatgtagccgataatcaaatagattccggggatctcatggagtgcctgattcaaaacaagcaccaaaaggacatgaacgagaagtgcgccatcggagtgactcactttcaactggtgcagatgaaagactttcgtttctcttataagtttaagatggcgtgcaaagaagacgtgctgaagctgtgtcccaatatcaagaagaaagtggatgtggtcatttgtctgtcaacgacagttaggaacgacacacttcaagaggctaaagaacaccgggtttctctgaaatgcagacggcagctaagagttgaagagcttgaaatgacggaggatatcaggcttgagcccgatctgtatgaggcgtgcaaatctgacatcaagaatttctgttctgcagttcaatatggaaatgcacaaatcatcgaatgcctgaaggagaataagaagcagttgtcaacacgctgtcaccagaaggtgttcaagttgcaagagacagagatgatggaccccgaactcgactatacccttatgagagtttgtaagcagatgattaaaaggttctgccctgaggcggactccaagaccatgcttcagtgcctgaagcagaacaagaactctgaactaatggatcccaaatgtaaacaaatgattaccaagagacagatcactcaaaatactgattatcgcctgaatcctatgctgcggaaggcatgcaaagccgacatacccaagttttgtcacggtatactgaccaaggccaaagatgattctgagctggaagggcaggtgatctcctgtctgaagctgcggtacgcggaccagaggcttagcagtgattgcgaagaccagatccgtatcatcatacaagaatctgccctcgattaccgactcgaccctcagctccagctccattgctcagatgagatcagttcattatgtgccgaagaagcggcggctcaggaacagacaggccaagtagaagaatgccttaaggtgaacctgttaaaaataaaaaccgagctgtgcaaaaaggaggttttgaacatgctgaaggagtcgaaggcggatatatttgtcgaccctgtcctgcacacggcctgcgctttggacattaagcatcattgtgccgctattactcccggtcggggtaggcagatgagttgcttgatggaggcactcgaggataagagagtgaggctacagcccgaatgtaagaagagactcaacgacagaattgagatgtggtcctacgccgccaaggtggccccagctgacggcttttctgatctggccatgcaggttatgacatccccaagcaaaaactatattctgtccgtgatctccggatctatttgcatactgttcctgattggtctaatgtgtggtaggatcacaaaaagagtcaccagagaattgaaggacagatag

SEQ ID NO: 118905 - DNA, 3579 bp, Artificial Sequence
  Description of Artificial Sequence: Synthetic coding sequence
atggccgcctgtgggagagtcaggaggatgttcagactgtctgcagccctgcacttgctgcttttgtttgccgctggagcagagaaactccccggccaaggcgtccacagtcagggccagggacccggtgccaattttgttagtttcgtggggcaagcaggcggcggcgggcccgccggtcagcaacttccgcaactgcctcagtccagccagctgcagcagcagcagcagcagcagcaacagcaacagcagccacagccaccacagccaccatttcctgctggaggacccccagctcgaagagggggcgctggggcgggaggcgggtggaagctcgcagaggaagagagttgcagagaggacgttacacgcgtgtgtccaaagcacacctggagcaataacctcgcagtgctagaatgcctacaggacgtaagggaactgctgtggaactataagctcaaccttacaaccgatcctaaattcgaatccgtcgctcgcgaagtttgtaagtccacaattactgagattaaagaatgcgcggacgaacctgtgggaaagggatatatggttagctgtctcgtggatcacagagggaacattaccgagtaccaatgtcatcaatacattacaaagatgaccgccatcatcttctccgactatagactgatttgcggtttcatggatgattgcaaaaatgacataaatatattgaaatgtggaagtatacgcttgggagaaaaggatgcgcattctcagggcgaggtggtaagctgcctggaaaaggggctcgtgaaggaagccgaggagcgggagcctaagattcaggtctcggaactgtgcaaaaaggccatcttgcgcgtagccgagctgtcatctgatgatttccatctagaccggcatctttatttcgcatgcagagatgaccgggaacgtttttgcgagaatacacaagccggcgagggacgcgtttataagtgtctgtttaatcataaattcgaagaaagcatgagcgagaagtgcagagaagcactgacaaccaggcaaaagctgatcgcccaggattataaggttagctattccttggctaagtcctgcaagtcggacctcaaaaaatatagatgtaacgtggagaacctgcctcgctccagagaggctagattgagttaccttctcatgtgcctcgagtcagctgtgcatagagggcgccaggtgtcctccgaatgtcagggagagatgcttgattacagacgcatgctgatggaagatttttcactctctccagagattattttgtcctgccgaggcgaaattgaacatcattgctcaggtctacatcgaaagggcagaactctccactgtctcatgaaggtcgttagaggcgagaagggaaatctgggaatgaattgccagcaagccctgcaaacactgatccaagaaaccgatccaggcgctgattacagaatcgacagagcgctcaatgaggcatgcgaaagcgtgatacaaactgcctgtaagcatatcagaagcggggatcctatgatcctcagctgcctgatggagcacctgtatacggaaaagatggtggaagattgtgagcacaggctgctggaattgcagtatttcataagtcgagactggaagctcgaccctgtgctctatcgtaagtgccagggggatgcctctagattatgccacactcatgggtggaacgaaacatctgaattcatgccccagggtgctgttttctcatgtctttacagacacgcgtatcgcactgaggagcagggccgacgcctgtctagagagtgcagggccgaagtccagcggatcctccaccaacgtgccatggatgttaagctcgaccctgcgctgcaggacaagtgcctgatagacctcggtaaatggtgttccgaaaaaaccgagacaggtcaggaactggagtgcctgcaggaccacttggatgatttggtggtggagtgtagagacatagtcggcaacctaaccgaactcgagagtgaggacatccagatagaagcgttattgatgagagcctgtgaacctattatccagaacttctgtcatgacgtggcagacaatcagattgacagcggggacctcatggagtgtctgatccagaataaacaccagaaagatatgaacgaaaaatgtgctatcggagtaacccatttccaattagtacagatgaaggactttcggttttcttacaaattcaaaatggcttgcaaggaagacgtgctaaagctttgcccgaatattaagaagaaagtcgatgtggtgatttgcctatctacgaccgtgaggaatgatacacttcaagaagctaaggagcaccgcgtgagtttgaaatgccggaggcagctcagagtcgaagaactggagatgactgaggatatcagacttgagccagatttatacgaggcctgtaaaagtgacatcaaaaatttttgcagcgcagtccagtacggtaatgcacagattatcgaatgcttgaaggagaataagaagcagctgagcacacggtgccatcaaaaggtattcaagctccaggaaacagagatgatggaccccgaactggattatacacttatgagagtttgcaaacagatgattaaaagattctgtccagaagcagacagtaaaaccatgcttcagtgtttgaaacagaacaaaaacagtgagctcatggatcccaagtgtaaacagatgattactaaaagacagatcacccagaatacagactacaggctcaaccctatgctgagaaaagcatgcaaagccgacattcctaagttttgtcatgggattttgacgaaggccaaggacgacagcgaattagaagggcaggtcattagctgcctgaagctacgctatgccgatcagcgcctgtctagtgattgtgaagaccaaattagaataataatccaggagtccgctctcgattaccgcctggacccacagcttcagctccattgcagtgatgagatcagcagtctgtgtgctgaagaggctgccgcacaggaacaaactggccaggttgaagagtgcctgaaggtgaacctgctcaaaatcaagactgagctgtgtaagaaagaagtcctaaatatgctaaaagagagtaaagccgacatctttgtggacccagttctgcacaccgcttgcgccctagacatcaaacaccattgcgctgcgattacccctggtcgaggaaggcaaatgtcgtgtctgatggaggctctagaggataaaagggtgcgactgcagcccgagtgcaaaaagcgcttaaacgaccgcatcgagatgtggagctatgccgctaaggtggcccctgcggacggatttagcgatctggctatgcaggtcatgacgtccccttccaaaaattatattctgtcggtgatcagcgggtctatctgcattctttttctgattggcctgatgtgcggcagaattacaaagagggtgacaagggaactgaaagatcgactacagtaccgcagtgagaccatggcatacaagggtctggtgtggagccaggacgtaaccggctcacctgcatag

SEQ ID NO: 118906 - DNA, 2091 bp, Artificial Sequence
  Description of Artificial Sequence: Synthetic coding sequence
atgggaaacggcatgtgttcacgtaagcagaagcggatcttccagacgttgcttctcctgacagtggtgttcggatttttatacggcgctatgctctactacgagttgcagacacaattacgtaaagccgaagcagtggccctgaagtaccagcagcaccaggagagtctgtcagctcagctccaagtggtttatgagcataggagcagactggagaagtcattacagaaagagcgactcgagcacaaaaaggccaaagaagatttcctggtctacaaactggaggcacaggaaacccttaacaaggggcggcaggatagcaactcccgctactccgcgcttaacgtacagcaccagatgctgaagagtcagcacgaggagctgaagaaacagcatagtgacctcgaagaggaacacaggaagcaaggagaggatttcagccgcacttttaatgaccataaacagaagtatctgcagcttcagcaggagaaggaacaggaactgagtaagctcaaagagaccgtatacaatctcagagaggagaataggcagcttcgaaaagcccaccaggatatccacactcaacttcaggatgtgaaacagcagcacaaaaacttgctatcagaacatgagcagcttgtggttaccttagaggaccacaaatccgccctggcagccgcccagacccaagtggctgaatacaagcaactgaaagatacactcaatagaattccatctcttcgcaaacctgaccccgctgagcagcagaatgttacccaggttgctcacagcccccaaggctacaacacggctagggagaagccaacaagagaggttcaagaggtgtcacggaacaatgatgtttggcagaatcacgaggctgtgcctgggagagctgaggacaccaagctgtacgcccctacacataaggaggccgagtttcaagccccacctgaacctattcagcaggaagtagaacgacgggaacccgaagaacatcaggtcgaggaagaacacaggaaggctttggaggaagaggagatggaacaagtgggccaggcagagcatctggaggaggagcatgatcccagcccagaggaacaggatcgggagtggaaggaacagcacgagcagcgggaggcagctaatctgctggaggggcacgcaagggccgaggtgtacccaagcgcaaagcccatgatcaagttccagagtccatatgaagaacaattagagcagcaaaggctggccgtgcagcaggttgaagaggcccaacagctgcgcgagcaccaggaagctctgcaccagcagaggctccaggggcatctcctcaggcagcaggagcagcagcagcagcaggtggcaagagagatggcccttcagaggcaagccgagctcgaggagggtcgcccccagcaccaagagcagcttcgccagcaggcccattatgatgccatggataatgatattgtacagggcgccgaagatcaggggattcaaggtgaagagggcgcttacgaaagagataaccaacaccaggatgaagcagagggagaccccggcaaccgccatgagccaagggagcagggtcccagagaggccgatcccgaatcggaggcggaccgagccgccgtcgaagacattaacccggcggatgatccaaataaccagggtgaagatgaattcgaagaggctgagcaagtgcgagaggaaaatctgccagacgaaaatgaagagcagaaacagtccaatcagaaacaggagaacacagaagttgaggagcatttggtgatggcggggaaccccgaccaacaagaggataacgtggacgaacaataccaagaggaagccgaagaagaagtccaggaggacctcacagaagaaaaaaagcgcgagcttgagcacaacgccgaagagacctacggcgaaaatgatgagaatacagacgacaagaataacgacggggaagagcaagaggtaagagacgataaccggcccaagggccgagaggaacactacgaggaggaagaggaagaagaggaggacggagccgctgtcgcagagaaatcccatagacgcgcagagatgtag

SEQ ID NO: 118907 - DNA, 897 bp, Artificial Sequence
  Description of Artificial Sequence: Synthetic coding sequence
atgacctctctcacccaacggagttccggtttggtgcagaggcggactgaagcatcacgcaacgctgctgacaaggaacgggccgccggggggggagccggaagctctgaggatgatgctcagagtagaagagacgaacaagatgatgatgataaaggggactctaaggaaactagactgaccctgatggaggaggtactgctgctaggcctcaaggatcgagagggatacaccagcttttggaatgactgtatctcaagcggtctgcggggttgcatgcttattgaactggctctacggggtcgcctgcagctcgaagcatgcggtatgaggaggaaaagcttgctgacccgaaaggtgatttgcaaatctgatgcacccacaggcgatgttctgctcgatgaggcccttaagcacgtgaaagagacccaaccccctgaaacagtgcagaactggatcgaactgctaagcggcgaaacttggaatccgctaaagttacactatcagctgcggaacgttcgggagcgtctagccaaaaacctggtggaaaaaggcgttctcactactgagaagcagaatttcttactctttgacatgacaacacatccactgactaataacaacataaaacaaaggctgataaagaaagtgcaggaagcagttctggataaatgggttaatgacccccatcgtatggatcgaagactgctcgctttaatatatctggcacacgcgagcgatgtacttgaaaatgcctttgcaccacttctcgatgaacagtatgatcttgcgactaagcgcgtaagacagctgctcgatttagacccagaagtggaatgcctaaaagccaatacaaacgaggtgctctgggcggttgttgccgctttcacaaagtag

SEQ ID NO: 118908 - DNA, 846 bp, Artificial Sequence
  Description of Artificial Sequence: Synthetic coding sequence
atgacatcactgacccaacgatcctccggtttggtgcaaagacggaccgaggcgagtcgaaacgctgcagacagtagacgagatgagcaagacgacgatgataagggcgattcaaaagagacacgcctgaccctcatggaggaggtgctgctcctcggcctgaaagatcgcgaaggatacacgtctttctggaatgactgtatttccagcggcctccgcggatgtatgctcatagagctggcccttcgcgggcgtcttcagctagaggcttgtggaatgagaaggaaaagcctgctgacacggaaagttatctgtaaatccgacgcacctactggggacgttcttttggacgaagctctaaagcacgtgaaagagacgcagcctcctgagaccgtccagaattggatcgagttactttccggtgagacctggaatccccttaagcttcactatcagctcagaaatgttcgagagcgcctggctaagaatctggtagagaagggggtgttaacaactgagaagcagaacttcctgctctttgacatgacaacccaccctcttacaaataataatatcaagcaaagactgattaaaaaggtccaggaggccgtgctggacaaatgggtgaacgacccacatcggatggacaggcggctgttggctcttatctacttagcacacgcctccgacgtgctggagaacgctttcgccccgcttctggacgagcagtacgacctggccacgaagcgggtgcggcagttgttggacctggatcccgaggtggagtgtctgaaagcaaataccaatgaggtgttatgggctgtggtggccgcttttactaaatag

SEQ ID NO: 118909 - DNA, 858 bp, Artificial Sequence
  Description of Artificial Sequence: Synthetic coding sequence
atgaccaccctgacccatagagccagacgtacagagatttctaaaaattcagaaaaaaaaatggaatccgaggaagactccaactgggagaagtcaccagacaacgaggactcaggcgactccaaagatattcgcctaactctgatggaagaggtcctgttgctcggcctaaaagataaggaaggctacacatcattctggaatgactgtataagctctgggctccggggcggaatactgatagagttggcaatgcggggaaggatctacctggagccgcctacaatgcggaaaaagaggctgctggatcgcaaagtcctgctgaagagcgactccccgacaggcgatgtactcctcgacgagacgctaaagcatattaaggccaccgagcccaccgagacagtccaaacctggatcgagctcctaacaggagaaacctggaaccctttcaaactccaatatcagctcagaaatgtgcgggaacgtattgctaagaacctcgtcgaaaagggaattctgaccacggaaaaacagaattttttgctcttcgacatgacgacgcatccggttaccaacactaccgagaaacagcgattggtgaagaaactgcaagattcggtgctcgaaagatgggtaaatgacccccagcgtatggataagaggaccctggccctattggtcttggcccatagcagcgatgtccttgagaatgttttctcctcgctgactgatgacaagtacgacgtggcgatgaacagagccaaggacttagtggaattagacccagaggtagaaggaactaagccaagcgcgactgagatgatttgggccgtgttagctgctttcaacaaatcgtag

SEQ ID NO: 118910 - DNA, 924 bp, Artificial Sequence
  Description of Artificial Sequence: Synthetic coding sequence
atgactacacttactcatagggcccggaggaccgagatctcaaagaatagtgagaaaaagatggagagtgaagaagacagcaactgggagaaaagcccggataacgaagacagcggtgattctaaagacatcagattaacgcttatggaagaagtcctgttgctcggcctcaaggataaagaggctaatattaactcctggatcactcggtggctcactcccgtgatacccgccctttggggcgccgagggttataccagcttttggaacgattgcatttcaagtggcttacggggtggaatcctgattgaacttgcgatgcgcggccgcatctatctggaaccccctacgatgagaaaaaagcgactcctggaccgcaaggttctgctcaaatcggattctcccacaggagacgtgctcctcgatgagacacttaagcacatcaaggcaacagagccaaccgagaccgtccagacctggattgaactgctgactggagagacctggaacccctttaagctccagtatcagctgcggaatgttagagagcgaattgccaaaaaccttgtggagaagggtattctcactactgagaagcagaactttctgttgttcgatatgaccacacatccagtcaccaacacaacagaaaaacagcgccttgtgaagaaactacaagacagtgtactggagaggtgggtgaatgatccacagcggatggacaagaggaccctagccctgctggtgctagcacactcatccgacgttctagagaatgtatttagtagcttgaccgatgacaaatacgacgtggccatgaatagggccaaggacctggtggaattagaccccgaggttgagggaacaaaaccttcagccaccgagatgatatgggccgttctggcggcattcaacaagagctag

SEQ ID NO: 118911 - DNA, 810 bp, Artificial Sequence
  Description of Artificial Sequence: Synthetic coding sequence
atgacgacactgacacacagagctcggcgtaccgaaatctccaagaattctgaaaaaaagatggaatcagaagaggactcgaattgggaaaaatcacctgacaatgaggactcaggcgactcgaaggatatccgccttaccctgatggaggaggtactgcttctgggactaaaagataaggaggcaaacattaattcgtggattactaggtggctgacacctgttattccggctctgtggggagcagaaggctataccagtttttggaacgattgcattagcagtgggctaagaggggggatcttgattgagctggccatgaggggaagaatctatctagagccaccaacaatgcgaaagaagagactacttgaccggaaggtcttactgaagagcgactctcctaccggggatgtactcctggatgaaacactgaagcacatcaaagcgacagagccaaccgaaacggtacagacttggatcgaactgctgactggggaaacctggaatcctttcaaactccagtatcagctgcggaatgtccgcgagcgtattgccaaaaacctcgtggagaagggcatattgacgaccgagaagcagaacttcttactctttgacatgacaacccaccccgtgacaaacaccactgaaaaacaaagactggtaaaaaagttgcaagactccgtgctcgagcggtgggtcaacgacccccaaaggatggataagagaactcttgcgctgttggtgctagctcattccagcgatgtgcttgagaatgtgttctcttctctaacagatgacaagtactag

SEQ ID NO: 118912 - DNA, 726 bp, Artificial Sequence
  Description of Artificial Sequence: Synthetic coding sequence
atgaccactctcactcaccgagcccggaggaccgagatctctaagaactctgagaagaaaatggaaagcgaagaagactctaattgggaaaagtcgcccgataacgaagacagtggcgattctaaggacataaggttgactctgatggaggaagttttactgctgggtcttaaggataaggaagtcttgcttaagtcagattcacctacaggcgatgttctgttagacgaaactttgaagcacatcaaagcaacagagccaacagagacagttcagacctggattgagctgctgaccggggagacttggaatcccttcaaactacagtatcagctccgtaatgtgcgcgaaaggatcgctaaaaatctggtcgaaaaggggattctcaccactgaaaaacagaacttcctgctgtttgatatgacgacccaccccgtaacaaacaccactgaaaagcagcgcctagtcaagaaactgcaggactcagtactggaaagatgggtgaacgatccacaacggatggacaaaaggactctcgccctgctggtgttagcacattcaagcgatgtgttggagaatgtgtttagtagcctcaccgacgataaatatgacgtggccatgaatagagccaaagatctcgttgagctggatccggaagtggagggaacaaagccatccgctactgagatgatttgggctgtactggccgcttttaataaaagctag

SEQ ID NO: 118913 - DNA, 1323 bp, Artificial Sequence
  Description of Artificial Sequence: Synthetic coding sequence
atgggcctcggcgtgtcagctgaacagccagccggcggcgccgaaggcttccacctgcatggcgtccaggaaaacagcccagcccagcaggcaggcctggagccatatttcgatttcatcatcacgattggacatagcaggttgaacaaggagaatgacaccctgaaggcccttctgaaggccaacgtagagaaacctgtcaagttggaagtttttaacatgaagaccatgagagtgcgggaagtagaggtggtgccgtctaacatgtggggcgggcaaggcctgttgggggcttccgtcaggttctgtagctttcggcgggccagtgagcaggtgtggcacgtcctggacgtggagccctcttctccagctgctctcgccggcctcaggccatatacagattatgtggtcggttcggatcaaatcctgcaggaaagcgaggattttttcaccctgatcgaatcacacgagggaaaacccttaaaactcatggtgtataatagcaagtctgactcctgtagagaggttacagtgactccaaacgcagcttgggggggggaaggatccctcggatgcgggatcgggtacggctacctgcacagaattcctactcagcccccttcttaccataagaagcctccaggaacacctcctcccagcgccctgccgctgggtgccccaccaccagatgctcttcctccgggcccaactcctgaggactctccttctctagaaacaggatccagacaatctgattacatggaagctttgctgcaggccccggggtccagcatggaggatccccttcctggaccagggtctcccagccatagcgcccccgatcccgatggcttaccccacttcatggaaacaccgcttcaaccccctccccctgtccaaagggtgatggaccccggctttttggatgtgagcgggatctccctcttggataattccaacgcttccgtctggcctagtctgcctagcagcacggagctgaccactactgcagtctcaacttccggccctgaagatatctgctcaagcagtagtagtcacgagcggggtggtgaagctacgtggtctgggtctgagttcgaagtaagcttcttagactctcctggagctcaggcccaggcagatcatctgcctcagctcactcttccggatagcctgacatctgctgcatccccggaggacggcctcagcgccgagttgctcgaagcccaagcagaagaagagccagcgtctacagaggggcttgacaccgggactgaagccgaagggcttgatagtcaggcgcagatttcaactaccgaatag

SEQ ID NO: 118914 - DNA, 4143 bp, Artificial Sequence
  Description of Artificial Sequence: Synthetic coding sequence
atggcgtccggccgcgatgaacggccgccgtggcggctaggccggttactcttgcttatgtgcctgctgctgctgggaagctctgctagagcagcacatatcaaaaaagctgaagccacaacgacgacaacttctgctggtgcagaggctgcagagggccagttcgaccgctattaccatgaagaggagttggagtccgccctaagagaggctgcagctgccgggctccctggacttgcacgattgttttccatcggccggagtgttgaaggacggcctctctgggttcttcgactgactgcaggcctcggatcattgattcctgagggcgacgccggacctgatgctgcaggccctgatgccgcggggccactgctgcccggacggcctcaggtgaagctcgtgggtaacatgcacggcgatgaaaccgtcagtcgccaagtactaatttatctggctcgggagctagctgctggttacaggaggggagatccaagacttgtccggctgttaaacaccacagacgtgtacctccttccgtcccttaatccagacggctttgaacgcgcacgggagggtgattgcgggtttggcgacggagggccttccggcgcatctggccgcgataattctagaggtcgcgatctgaaccggtcatttccagatcagttcagtacaggagaaccacccgctttggatgaggttccagaggtgcgcgccctgatcgaatggatccggcgaaataagtttgttttatctggtaatttgcacggggggagtgtagtggcctcttatcccttcgacgactccccagagcacaaggctaccgggatttacagcaaaacctccgacgatgaggtgttcaagtacctcgctaaagcttacgcaagcaaccacccaattatgaaaactggcgagcctcactgtcccggcgatgaagacgagacattcaaagacgggatcaccaacggggcccattggtatgatgtcgaaggtggaatgcaggattacaactacgtatgggctaattgcttcgagatcactttggaacttagctgctgtaagtatccacccgcttctcagctacgccaagaatgggagaacaatcgagagagtctgatcacactcatagaaaaggtgcacatcggtgtcaaaggtttcgtgaaggatagcatcacaggctctggcctggaaaacgcaaccatatctgtggccggaattaaccacaatatcacaactggccggttcggagatttctaccgcttactcgtgccgggcacctacaacctgactgtggtcctaacaggctacatgcctcttaccgtgaccaacgtagttgtcaaagagggccctgcaacagaagttgatttcagcctgcgacccactgttacctctgtaatccccgacactactgaagccgtctccactgcctcgaccgtggcaattccaaatattctgagcggcactagctccagttaccagccgatccagcctaaggatttccatcaccaccactttcccgatatggaaatcttcttgagacgcttcgcaaacgagtatcccaacatcactaggttatatagtctcggcaaatctgttgagagccgggagctctatgttatggaaatctcagataatccgggtgtgcatgaacctggtgaacccgagttcaagtacattggaaatatgcatgggaacgaagtggtaggcagggaattacttctgaatctaatcgaatacttatgtaaaaacttcggcacagatcctgaagtgaccgatctcgtccacaacacacgcatccacttgatgccaagcatgaatcccgatggatacgaaaaatctcaggagggggatagtatatccgtaatcggccgaaacaattccaacaactttgacttgaaccggaacttccctgatcagtttgtgcagattacagatccaacgcaaccagaaacaatcgcagtgatgagttggatgaagtcatatcccttcgtactgtctgccaacctacacgggggctccctcgtcgttaattatccttttgatgatgatgaacagggcctcgctacatactctaagagccctgacgatgctgtgtttcagcagattgccctgtcttatagcaaggaaaattcacagatgttccaaggccggccctgcaagaatatgtacccgaacgagtacttcccgcatgggattaccaatggcgcctcatggtacaacgtgccaggcggcatgcaagattggaattacctccagaccaattgcttcgaagtcactatagagttaggttgcgtgaaataccctcttgagaaggagctgcctaacttttgggagcagaacagaagatctctaattcaatttatgaagcaagtacaccaaggagtccgcgggtttgtgctcgacgccacagatggacgcggaattctcaacgcgactatctcggtcgctgagatcaatcatccagtaactacgtacaagactggcgactactggagattactggttcctgggacttataagatcactgcgtccgcacgggggtacaatccggtgacaaaaaacgtcacagtgaagtcagagggcgctatccaggtcaactttaccctcgtcagatcttctacagactccaataatgagtccaaaaaagggaaaggggcctcctcatccactaatgatgcctcggatcccaccaccaaggagttcgagacattaataaaggatctctcagccgagaacggactcgaatcactcatgctgcgatcgtccagtaatcttgccttggctctataccgctatcattcatacaaggaccttagtgaatttcttcggggactggttatgaattacccacacataaccaatctgactaacctcggacagtccaccgaataccggcacatttggtcattggagatttctaataaacctaatgtttccgagcctgaggaacccaaaattcggtttgtagcagggatccatggaaatgcccctgtgggaacagagctgttactggcactggccgagttcctttgcttgaattacaagaaaaacccggcggtcacccagctggtggacagaactcgcatcgtcattgttccctcactcaatccggatgggcgggagagggcgcaggagaaagactgcacctccaagatcggacagaccaacgctcgcggaaaggatctcgacactgatttcactaataacgctagtcaacctgagaccaaggcaatcatagagaacctcatccagaaacaagatttctcactgagtgtggctctggatggcgggtccatgctggtgacatatccatacgataaacctgtacagactgttgagaacaaagaaactctgaagcacctggcaagtctatacgctaataaccatccctccatgcacatggggcagcccagctgcccaaataagagcgatgaaaacatccctgggggggtgatgcgtggagctgaatggcatagtcacctagggagtatgaaggattactccgtgacctacggacactgccctgagattacagtctatacatcctgctgttacttcccatccgcagcccgactcccgagcctttgggccgacaacaagagatccctgttatctatgttggttgaggtacataaaggggtgcacgggttcgtcaaagacaagaccggcaaacctatttctaaggcggttatcgtgttaaacgaagggataaaggtgcagactaaagaaggtggctacttccatgtgttgcttgcacccggtgtccataatattatcgccatcgcagacggctatcagcagcagcactcgcaggtatttgttcatcacgacgctgccagctccgtggtgattgtttttgataccgacaacagaatcttcgggctcccacgtgaattggtcgtcacggtcagtggcgccactatgtccgcactcattctgaccgcctgtatcatctggtgtatatgtagcataaagtccaataggcacaaagacggatttcataggctacgtcagcaccatgacgaatacgaggacgaaatcagaatgatgagcacgggttccaagaaatcccttctatcccacgagttccaggacgaaactgacactgaagaggaaaccttgtattctagtaaacattag

SEQ ID NO: 118915 - DNA, 558 bp, Artificial Sequence
  Description of Artificial Sequence: Synthetic coding sequence
atgtttgaaactatggcaatagagatcgaacagttacttgcccgactgactggcgtgaacgacaaaatggctgaatatactaattccgccggagtccctagcctcaatgccgccttgatgcatacgcttcaaaggcacagagatattctgcaggattatacccacgagtttcacaagaccaaggctaactttatggcaatccgtgagagggagaatctcatgggctcagtgcgcaaggacattgaaagctacaagtcgggcagtggagttaacaatcggcggacagagttattcctgaaagaacacgaccacctgagaaacagtgataggttgattgaagagaccatcagcatagcaatggcaaccaaggaaaatatgacaagtcaaaggggtatgctgaagtccatccacagcaagatgaatacactggcaaatcggttcccagcagtaaattccctgattcagcgcattaacttaaggaaaaggcgcgattcactgattctgggaggagtgattggcatctgcactattttattactcctgtacgcgtttcattag

SEQ ID NO: 118916 - DNA, 525 bp, Artificial Sequence
  Description of Artificial Sequence: Synthetic coding sequence
atggctgccggaacctcgagttattgggaggacttgaggaaacaagcacggcaattagagaacgagcttgacctcaagctggtctcctttagtaagctgtgcactagttattcacattcctcaacacgagacggacggcgggattcctctgataccaccccccttctgaacggcagctcccaggatcgcatgttcgagacaatggctattgagatagaacagttgcttgccaggctgactggggttaacgataaaatggctgaatacactaactctgccggcgttccaagcctgaatgcagctcttatgcacaccttgcagagacacagagatatactgcaagattacacacacgagtttcacaagacaaaggcaaattttatggcaatacgagaacgggagaacctgatgggcagtgtcaggaaggatatcgaaagctacaagtctggctccggggtcaataaccgccggaccgagttgttcctgaaggagcatgatcacctgcgcaaaggcttccagtggtag

SEQ ID NO: 118917 - DNA, 747 bp, Artificial Sequence
  Description of Artificial Sequence: Synthetic coding sequence
atggccgccggaacctctagttactgggaggaccttcggaagcaggccagacagctggaaaatgagctcgatctgaagctggtgagcttctcaaaactgtgtacctcctactcccacagttcaacccgggacggacgacgcgacagctcagatactaccccccttctgaacgggtcaagtcaggatcgcatgttcgagacaatggccatcgagatcgagcagctgttggccaggctgacaggcgttaacgataaaatggctgaatacaccaacagtgctggtgtaccaagtctgaatgcagcattgatgcacactttgcagagacacagggatatattacaggactacacacacgagtttcataagacgaaggctaatttcatggccatccgcgagagggagaatttgatgggatccgtccgcaaagacattgagtcatataagtccggtagtggtgttaacaaccgaagaaccgagttatttctgaaagaacatgaccatttgcggaacagcgaccgcttgattgaagagactatctctattgcaatggccacaaaggaaaatatgacctcccaacggggtatgctgaagtccatccactctaaaatgaacacgttggccaataggttccccgccgtgaatagcttaatccaaagaattaacctacgcaagcgtcgggacagcctcatactgggcggggtgatcgggatctgtactatactgctgctgctctacgcatttcactag

SEQ ID NO: 118918 - DNA, 528 bp, Artificial Sequence
  Description of Artificial Sequence: Synthetic coding sequence
atggccgctggcacatcttcatactgggaagacttgagaaaacaagcccggcagctggaaaacgaactagacctgaaactggtgagcttctccaagctctgtacctcttactcgcattcctctacacgggacggcagacgggataggtactcaagtgacaccacccccctcttgaatgggtcaagtcaagaccgcatgtttgagaccatggccatcgaaatcgagcagctcctcgcacgcctgacgggagttaatgataaaatggccgagtatactaacagtgcgggggtcccctccctgaatgccgctctgatgcataccctccaaagacatcgggacatactgcaggtgatctattgggcccgcgatgtctttatcattaccggcgtctgggtcttctttttcaacccctgtataggatatgttcatatctatctgaagggacagcgcgaaaagagcgaaaagattaatgccatgctgaagggcttagtgttacttttctttggagtcactatcatcaagttctag

SEQ ID NO: 118919 - DNA, 558 bp, Artificial Sequence
  Description of Artificial Sequence: Synthetic coding sequence
atgtttgagaccatggcaatcgagattgaacaactcttggcccgcctcacaggcgtcaatgacaaaatggccgaatataccaatagcgccggagtgcccagcctcaacgccgcgttaatgcacaccttgcagcggcaccgggatattctccaagattacacccacgagttccacaagacaaaagccaactttatggccatccgtgagcgagaaaacctcatgggctcggttcggaaggatatcgaaagctacaagtcggggtctggcgtgaacaatcggcggacagagctgtttttaaaagagcacgaccacctccgcaactcagaccggctgatcgaagagaccatctctatcgccatggcgactaaggagaatatgacatcccagcgcggaatgctcaaaagtatccattctaaaatgaatacgctagcaaaccgattccctgcggttaactctttgatccaaaggatcaacctccgtaagaggagggactcactgatactaggcggagtgattggaatctgcacaattctactgcttttatatgccttccattag

SEQ ID NO: 118920 - DNA, 1350 bp, Artificial Sequence
  Description of Artificial Sequence: Synthetic coding sequence
atgacttcattttatagtacaagctcatgccccttgggatgtactatggctcccggagcgcgcaatgtgttcgttagccctattgacgtcggatgccaacccgtggccgaggccaatgcagctagtatgtgcttattggccaacgtcgcgcatgcaaaccgtgtgagggtggggtctactcctttgggaagaccttcactgtgtctgcctcccaccagtcacacggcctgcccgctgcccggaacttgtcatatcccagggaatatcggtatctgtggcgcatatggcaaaaacactctgaacggtcatgagaaagagactatgaagttcttgaacgacagattagccaattatcttgaaaaggtgagacaattagagcaggaaaatgccgaactggagactacactgcttgaaaggtctaaatgtcacgaaagcacagtgtgtccagactatcagtcatattttcgcacgatcgaagagctgcagcaaaagatcctgtgttccaaagcggagaacgctagattgattgtgcagatagacaatgcgaagttggctgctgacgatttcaggatcaaactggaatccgaaagatccttgcaccaattggtggaggccgataagtgtggcactcagaagctcttggacgatgcaacccttgccaaagccgacttagaagcacagcaagaaagcctgaaggaggaacagctctctctcaaaagcaatcatgagcaagaggtgaaaatcttgaggagtcagcttggcgaaaaattccggatcgagctggatatagagcccacgatcgaccttaacagagttctcggcgagatgcgtgctcagtacgaggcaatggtggagacgaaccaccaagatgtagagcaatggtttcaggctcagtctgagggcatcagtctgcaagccatgtcctgctccgaagaactgcaatgttgccagagtgaaatccttgaactccgctgcaccgtcaacgctctagaagtggaacgccaggcccagcatactctcaaagattgcctgcagaattcgctctgcgaagccgaagacagatacggcacagaactggctcagatgcaaagcttgatcagtaacctcgaagagcagctgagtgaaattcgcgcggacctggagaggcagaaccaagaatatcaggtcctcctcgatgtgaaggcccggctggaaaacgaaatcgctacatacaggaatttgctcgaatctgaggattgtaagttgccctgcaacccatgttccacacctgcttcctgcacaagttgtccttcttgcgggccagttaccgggggaagccccagcggacatggcgcgtctatgggacgctag

SEQ ID NO: 118921 - DNA, 639 bp, Artificial Sequence
  Description of Artificial Sequence: Synthetic coding sequence
atggatccactgttccagcagactcacaagcaggtgcacgaaatccagtcttgcatggggagactggaaacagcagataaacagtctgtacacattgtggagaatgagatccaagcctcaatcgatcagatctttagccggctagagcgtctcgagatcctgtcatcaaaggaacccccaaacaaacggcagaacgctcggctgcgagttgaccagctgaagtatgacgtgcaacatctgcaaactgccctccgtaactttcagcatcgacgccacgcgcgcgaacagcaggagagacagcgtgaagagttgctgtctcggacctttactactaatgatagcgatacaacaatacccatggacgagtccttacagttcaacagttctttgcagaaggtacataatggtatggacgatcttattctggacggacataatatcctggacgggctgagaacccagcggctgacactgaaaggtactcagaagaagatcctggatatcgcgaacatgttaggcctgagcaatactgtaatgaggctgatcgagaaaagagcgttccaggacaagtactttatgataggcggcatgttgctgacttgtgtagttatgtttctggtggtacagtacctcacgtag

SEQ ID NO: 118922 - DNA, 588 bp, Artificial Sequence
  Description of Artificial Sequence: Synthetic coding sequence
atggatcccctgttccagcaaacgcataaacaggttcacgagattcagtcctgcatgggcagactggaaactgctgataagcaatctgtgcacattgtggagaatgagattcaagcaagcatcgatcaaatcttcagcagactggagcgcctggagattctgtcgtcaaaggagcccccaaacaagcgacagaacgcacggctgcgggtggaccaactgaaatacgatgtgcagcatcttcaaacagcactacggaattttcagcaccgtcgtcacgcgagagagcagcaagaacggcaaagggaggagcttcttagcagaacatttaccactaacgattcggacactactattccaatggacgagtcactacagttcaactctagcctgcagaaggtgcataatggtatggacgacctgatcctggacggacataatatcctagacggcttacggacgcagaggttgaccttgaaagtaggtagtctgctgggggaccgcgaaaaagcttcttgtttcagtctcattcaacagttcagcaactgtgtgtatattctgattacttgtccccagatagtgatattctag

SEQ ID NO: 118923 - DNA, 699 bp, Artificial Sequence
  Description of Artificial Sequence: Synthetic coding sequence
atggacccactgtttcagcagacccacaaacaggtgcacgagattcaatcatgcatgggaaggctcgagacagccgacaaacagtccgtgcacatcgtcgaaaatgaaattcaggccagtattgatcagatcttcagtcggctggagcggctggagatcctaagctcgaaagagccgcctaataaaagacagaacgctcgccttagggtggaccagctgaagtacgacgtacaacatctacaaacggctctgaggaactttcagcacaggagacacgcgcgggaacaacaggagaggcaacgggaagagctcctgtcaagaaccttcactactaacgattcagatacaacaattccaatggacgaaagcctgcagtttaactcatcgttacaaaaggtccacaacgggatggatgacttgatcctcgatggccacaacattctcgacggactgagaactcagcgcctgaccctgaagggcactcaaaaaaagattttagatatcgcaaacatgctgggccttagtaacactgtgatgaggctgattgagaagcgggctttccaggataaatacttcatgatcgagaccaggagccaccacgtggcccagaacggccccgagctgctgtcgtccagggacccgccagcctccgctagtagaagcgccgggatcattgagttctccgagaaaataacctag

SEQ ID NO: 118924 - DNA, 984 bp, Artificial Sequence
  Description of Artificial Sequence: Synthetic coding sequence
atggcagcggcggctgccatggcagagcaggaaagtgcaaggaacggtgggagaaatcgcggcggcgttcagcgagtggaaggtaagctcagagcctctgtggaaaaaggagactattatgaggcccaccagatgtaccgaactctctttttcaggtatatgtcacagagtaagcacactgaagcccgtgaactgatgtattcaggagccctgttgtttttcagccacggtcagcaaaactccgccgccgacctctctatgctcgtcctggagagcttggagaaagccgaagtggaggtagctgatgagctattggagaatctcgcaaaggttttctcccttatggatccaaattccccagagagggtgacctttgtttccagggcgcttaagtggagctccggtggttctggcaagttaggacatccgcgcctacatcaattactggctcttacactttggaaggagcagaattactgcgagtctcgctaccattttctgcacagcgctgatggcgagggatgcgccaacatgctggtggagtatagcacttcgagagggttcagatctgaagtcgatatgttcgttgcgcaggccgtcttgcagttcctctgtctgaagaataagtccagcgcctctgtcgtcttcactacttatactcaaaagcatcccagcattgaggatggccctccgtttgttgagccccttcttaatttcatctggttcctgctgctggctgttgatggaggaaagttaaccgtgtttacagtgctttgcgagcagtaccagccttccttgcggagagaccccatgtacaatgagtatctggatagaattggacagctgttttttggcgttccgccgaaacagacctcaagctacggagggttactggggaatctgctcaccagcctcatgggttctagtgaacaggaggatggtgaagaatcacccagtgacggttcccctatcgagctggactag

SEQ ID NO: 118925 - DNA, 1779 bp, Artificial Sequence
  Description of Artificial Sequence: Synthetic coding sequence
atggctctccctgaagaggcaaaaattaaggacgcctaccacatgttgaagcggcaaggaatcgtgcagtcagacccacctattccagtcgaccggacactcatcccaagcccacccccgcgcccaaagaatcccgtgttcgatgacgaagagaaatccaaactgctggcaaaactgctgaaatccaagaatcctgacgacctccaagaggcaaacaaattgattaagtcaatggtaaaggaggacgaggcccgcatccaaaaggtgacgaaacgcttgcacactctggaagaggtcaataacaatgtgcgacttttgtctgagatgctgctccattatagccaggaagacagctcagatggagatcgagagttgatgaaggagctcttcgatcagtgcgagaataaacgccggaccctcttcaagcttgcctcagagacagaggataatgacaactctctgggagatattttgcaggcctctgacaacctgtctcgagtgatcaactcttataaaacgattattgaggggcaagtcattaacggcgaggtggctactttgaccctcccagattccgagggaaacagtcagtgcagcaatcaaggaacattaatcgatctcgctgaactcgatacaacaaactcgctatcttccgtacttgctccggcccccaccccccctagttcagggatcccaatcctgcccccaccacctcaggctagtggaccccctaggagccgcagcagctcacaggcggaggccaccctgggaccttcttccacttccaatgcgctttcgtggctggacgaggaactgctgtgcttgggattagctgaccccgctccgaatgtcccaccaaaggagtccgccgggaatagccaatggcatctgctgcaaagagaacagagtgaccttgatttcttttctcccaggccgggaactgcggcttgtggcgctagtgatgcaccactcctgcagccctcggccccttcctcctcatcttcgcaggcccccttacccccaccttttcccgcccctgtggtgccagcttccgtgccggcaccttccgcagggtcctcgttattctcaaccggcgtcgccccagctttggctccgaaggtggaacctgcggtgcctggccaccacggactcgcactgggcaatagcgctctacatcatctggacgccctcgatcagctcctagaggaggctaaggtgacctctggcctagtcaagccaaccacgtcacccctgataccaaccaccacacctgccaggcccttattgcccttcagtaccggtccaggtagtccactgttccagcctctctccttccaatctcaggggagtccgcctaagggccccgagttgtccttggcttcgatacatgtgcccctggaatcaataaaacctagtagtgccctgcctgttacagcctacgacaagaacggttttcgtatcctgttccactttgccaaggagtgtcccccagggcgccctgatgtgttggtggtggtagtttccatgctgaatacggctcccctacccgtgaaaagcatagtgcttcaggccgctgtgccaaaatccatgaaggttaaactgcagccgccttccggtaccgagttaagtccattttcaccaatacaacctccagccgccatcacacaggtgatgctgttggcaaaccctctgaagaaacaggtcctgtcatttctggggaaagcttgtctgcagccctgggggcaagccatcttgctgaccacctcatgcctggcatag

SEQ ID NO: 118926 - DNA, 1956 bp, Artificial Sequence
  Description of Artificial Sequence: Synthetic coding sequence
atgaagaattgtggcagacggtttcataacgaggtagggaagttcagatttctgaacgagctcattaaagtcgtgtcccccaaatacctaggggatagagtgagcgagaaggtgaaaacgaaagtgatcgagctactgtatagctggaccatggccctgccggaagaggcaaaaatcaaggatgcatatcacatgctcaagcgtcagggcattgtacaaagcgaccccccaatcccagtggatcgaactttaataccgagcccccctcctcgccccaagaatcccgtgtttgacgacgaagaaaaaagcaaactgctcgctaaactcctaaaaagcaagaatcccgacgatctccaggaggctaataagttgataaagtctatggtcaaggaagacgaagcccgcattcagaaagttacaaagagattacacacacttgaagaggtgaacaacaacgttcggctgctgtccgagatgttactccattattcacaagaagactcttcagatggggaccgagagctgatgaaagaactcttcgatcagtgtgagaataagaggagaacgttgtttaagctcgccagcgagacggaggataatgataattccctcggcgatattctgcaggccagtgataatctgtcacgagtcattaattcctacaagaccatcatcgagggccaagtgatcaacggagaggtggcaaccctcacactacctgattcagagggaaattctcagtgttcaaatcagggcaccctcattgacctggctgagctagatactactaatagcctttcctccgtattggcaccagcccctacacccccgtcaagcggcattccgattctcccgccacctccccaggcaagcggtccgcctcgatccaggtctagctctcaggcagaagctaccctgggcccatcctccactagtaacgctctgtcctggcttgatgaggagctgttgtgcctgggcctcgcggaccctgcacccaatgttccacctaaggaatctgcgggcaactcccagtggcacctgctgcaacgagagcaaagcgacttggattttttttcccctaggcccggcaccgcggcatgcggtgcctccgatgctcctctcctgcagcccagcgcgccctctagcagttcatcgcaggcccctcttccccccccattccctgcccctgtcgtgccggccagtgtgcctgccccctccgctgggtcttcactgttctcaacgggcgtggcacctgcccttgcacccaaggtcgagcccgccgtccctggtcaccacgggctggccctcgggaactcagctctgcatcatctggatgcactggaccagctccttgaagaggcaaaggtgacctccggtctcgtcaagcccaccaccagtcccttgatcccaacgacgacaccggctagaccactgctgcccttctccacaggccctggtagccctctgtttcaaccgctgtcttttcagtcccagggaagccccccaaagggccctgagctgagcttagcctccattcacgtaccgctggagagcatcaagccatccagcgccctgccagtcacggcttacgacaaaaatggcttcaggatattgttccattttgctaaagagtgcccaccaggaagacctgacgttctggtagtcgtggtctcaatgttgaacaccgcccccctgccagtcaagtccattgtgttgcaggcagctgtgccaaagagtatgaaagtgaaactccagcccccatccggcaccgaactgtcccctttcagtccaatccagcccccggccgccataactcaggtaatgctgttggccaatcccctcaaggaaaaggtgagactgagatacaaactgaccttcgcgctgggcgaacagctgagcactgaggtgggagaagtcgatcagttcccccccgtggagcaatgggggaatctgtag

SEQ ID NO: 118927 - DNA, 1365 bp, Artificial Sequence
  Description of Artificial Sequence: Synthetic coding sequence
atgtcagcaggtgggccatgccccgctgcagctgggggcggaccaggtggagcttcctgtagcgtcggtgctcctggaggcgtctccatgttccgctggcttgaagtgctggagaaagaattcgataaagcattcgtcgatgtggatctgctcctgggagaaattgatcctgatcaagccgacatcacctacgaaggaaggcaaaagatgacatctctctcctcctgttttgcacagctctgccacaaggctcagtccgtttcccagattaatcacaagttagaggcacaactagttgatctgaagtccgagctcaccgagacccaggccgaaaaagtggtgctggagaaagaagtccacgatcaactcctccaacttcactccattcagctgcagctgcatgcgaaaacaggccagagcgcggactctgggacaattaaagccaaactggaacgcgagctggaggctaataagaaggaaaaaatgaaagaggcccagctggaagccgaagtcaagctgctgcgcaaggagaacgaggctctccgccggcatatcgcagtcctgcaggctgaggtctacggcgctcgactcgccgcgaagtacctggataaagaactagcagggcgcgtgcaacagattcagttgctgggccgagatatgaaaggtccagcacacgacaagttgtggaatcagctggaagctgagatccatttgcacaggcacaagactgtcattagggcatgcaggggtaggaatgacttgaaaagacccatgcaagccccgcctggacatgatcaggatagcctgaagaagtcacagggggtgggacctatccgtaaagtgttactgttgaaagaagaccacgagggactgggaatctccattacagggggaaaggagcacggcgtccctatccttatttctgaaatccatcccggacagcctgcggatcggtgcggtgggctgcacgtcggagatgcaatcttggccgttaatggggtcaatttgagggacaccaaacacaaagaagcagtgaccatcctatcccagcaaagaggcgaaatcgaatttgaagtggtgtatgtggcccccgaggtggattcggacgatgagaatgtggaatacgaagacgagagtggacaccgttaccggctctacctggatgaattggagggaggaggcaatcccggcgctagttgtaaggatacttctggagagatcaaggtgctgcagggattcaataagaaagctgttaccgatacacacgagaacggcgacttgggaactgcttctgagactccactggacgacggagccagtaaactggatgatctgcatacgctgtatcacaaaaaatcctactag

SEQ ID NO: 118928 - DNA, 1389 bp, Artificial Sequence
  Description of Artificial Sequence: Synthetic coding sequence
atgagcgccgggggcccttgtcccgcggcagccggtggtggccctggcggggcttcctgctccgtgggtgcccctggaggcgtgtctatgtttcggtggctagaggtgctggaaaaagagttcgataaagccttcgttgacgtggacctgctgctgggtgagattgaccccgaccaagctgatattacctacgagggacgtcagaagatgacaagcttgagttcatgctttgctcagctgtgccataaggcacagagtgttagccagatcaatcataagctcgaagctcaactcgtcgaccttaagagtgaactcacagagacacaggcagagaaagtggtgttggaaaaggaagttcacgaccagttactccaactgcactcaatccagttgcagctacacgctaagacaggtcagtctgctgactcaggtaccatcaaagcaaaactcagcggcccatcagtcgaggaactagagcgtgaattggaggcaaataaaaaggaaaagatgaaggaagcccaattagaagccgaagtgaagctgctcagaaaggagaacgaagccctcagaaggcacatcgcagttctgcaagcggaggtttacggagcacggttggcagccaagtatttggacaaagagctcgcaggacgagtacagcagatacagttgttgggccgggatatgaaaggcccagcacacgataaactgtggaaccagcttgaggccgagatacacttgcaccgtcataagaccgtcatcagagcgtgccgcggcaggaacgacctgaagaggcctatgcaggctccaccgggacatgatcaggacagcttaaagaagtcccagggcgttgggcctatcaggaaggtccttctgctgaaggaggaccatgagggcctgggaatcagtatcaccggaggaaaggaacatggggtccccatcctgatctctgaaattcacccagggcagcctgccgatcggtgcggcggtctgcatgtgggagacgcaatacttgcggtgaacggagtgaatctccgagacactaaacataaagaggccgtgacaattttgtcccaacagcggggcgagatcgagtttgaggtggtgtacgtggcaccggaggtggatagcgatgatgagaacgtggagtacgaggacgaatctggccatcgctatcgtctctacttggacgagctggaaggcggggggaacccaggcgctagttgcaaggacacctccggggagattaaagtcctgcaaggcttcaataagaaagcggtgaccgacacacacgagaatggagacttagggactgcgtcagagacccccctcgacgacggggcctctaagttggacgatctgcacacactctaccacaagaagtcttactag

SEQ ID NO: 118929 - DNA, 1389 bp, Artificial Sequence
  Description of Artificial Sequence: Synthetic coding sequence
atgagcgcgggggggccctgcccggccgctgccggagggggccctggaggggcctcatgttcggtcggagctcccgggggcgtgagcatgttccgctggctggaagtgttggaaaaggagttcgataaggcgtttgtggacgtggacttgctactgggggagatcgaccccgaccaggcggacattacctacgagggccggcaaaagatgacatcactgtccagttgttttgcccagttgtgccataaagcgcagagtgtttcacagatcaatcataagttagaagcacagcttgtggaccttaaaagtgagttgaccgaaactcaggccgaaaaggttgtcctggagaaagaagttcatgatcaactgcttcagttgcacagcattcagctgcagttgcatgcgaagactggacagtcagccgattctggtaccatcaaagcaaagctggtgagtcgctcatccagcaagatggaaagggaactggaggccaataagaaagaaaaaatgaaagaagctcaattagaagccgaagtaaagctgttgaggaaggagaatgaggccctgaggcggcatatcgcagtccttcaggctgaagtgtatggtgcccgactcgcggcaaaatacctcgataaagagttagctgggagagtgcagcaaatccagctgctaggccgggacatgaagggcccggctcatgataagctgtggaatcagcttgaggccgagatccacctccaccgacataaaaccgtgattcgcgcgtgtaggggcagaaatgatctgaagcgaccgatgcaggctccacctggccacgaccaggattcactgaaaaaatcacagggtgtaggacccattcgcaaagtcctgctgctcaaggaggaccacgaaggcctgggcatatcaatcactggggggaaggagcatggggtccccatcctgatcagtgaaattcaccctgggcagcccgcagaccggtgcgggggcctgcacgtaggggacgcaatcctggctgtcaacggagtcaatctgagggataccaagcacaaggaagcagttaccatattgagtcaacagcgaggagagattgagtttgaagtggtgtatgttgccccagaggtggactcagacgacgagaacgtcgagtacgaagacgagtccggccataggtataggctgtacctggacgagctggaaggaggagggaatccaggagcttcttgcaaagacaccagcggggaaattaaggtcttacagggctttaacaaaaaggctgtcacagacacacacgagaacggcgacttgggcactgcttcagagacacctttggatgatggagccagcaaactggacgatcttcacacactctaccataaaaagtcctattag

SEQ ID NO: 118930 - DNA, 1659 bp, Artificial Sequence
  Description of Artificial Sequence: Synthetic coding sequence
atggaacccgctatggagccagagaccttggaagcgagaataaaccgggctactaatccgttgaataaagagcttgactgggctagtataaatggtttttgtgagcaactgaacgaagatttcgagggcccacctctggcaacccgattgctggcccataagattcagtcgcctcaggagtgggaggcgatccaggccttaaccgttctggaaacctgcatgaagtcgtgcggcaagaggtttcatgacgaggtagggaaattcagattcctcaacgagctcatcaaggttgttagccccaaatacctcggttcccgaaccagcgagaaggtgaaaaacaagattctcgaattgctgtatagctggaccgtcggattgccggaggaggtcaagatcgccgaagcatatcagatgctcaagaagcaaggcatagtgaaatccgacccaaagcttccagatgatacgactttccctcttcctccacctcggccgaaaaatgttatcttcgaagacgaggagaagtcaaagatgttagctcggctccttaaatcaagccacccagaagatctgagagctgccaataaactcattaaggagatggtacaggaagaccaaaagcgtatggaaaagatcagcaagagggtcaacgctatcgaggaggttaacaataatgtaaaactcctgaccgagatggttatgtcacactcccaaggcggtgccgctgctggaagcagtgaagacttaatgaaggagttatatcagagatgcgaaagaatgcgcccaacgctgtttcgcctggcctcggatacagaggacaacgacgaagccctcggtctctcagatccaacgccaccttccggtccctctttggacgggacgggctggaattctttccagagcagcgatgcaaccgagcctcccgccccagcactggcacaagctccaagcatggaatcccgcccacccgcacaaacatcgctgcctgccagcagcgggctcgacgacctagacctgcttggaaaaactctgctccagcagagcttgccaccggaatctcagcaagtgcggtgggagaaacagcagcccactccacggcttacgctgagggatctgcagaacaagagttcttcttgttcaagcccctcgagcagtgctacatctttgctgcacacggtctcccctgaacctcctcgcccaccacagcagcctgtacctaccgagctgtccttggcaagcatcaccgtccccttggagtccatcaaaccctcaaacattctgccagtaaccgtgtatgatcagcatggcttcagaattctgttccattttgcccgcgatcctctccctggcaggagtgatgtactggttgtagtcgtatccatgctgagtaccgccccacaacccatcagaaatattgtattccaaagtgccgttccgaaagtgatgaaagtgaaactgcagcctcctagcggtaccgagctgcctgcgtttaatcccattgtccacccctcggccatcacgcaggtactcctcctggctaaccctcagaaggaaaaggtgcggctgagatataagttaacctttaccatgggcgaccaaacatacaacgagatgggtgatgtcgaccagttccccccacctgaaacatgggggagtttgtag

SEQ ID NO: 118931 - DNA, 117 bp, Artificial Sequence
  Description of Artificial Sequence: Synthetic coding sequence
atgaagtcctgcgggaaaagattccatgacgaggtcggcaagttcaggttcctgaatgagctgatcaaagtagtttctcctaaatatctaggcagtaggacctctgaaaaggtgtag

SEQ ID NO: 118932 - DNA, 1821 bp, Artificial Sequence
  Description of Artificial Sequence: Synthetic coding sequence
atggagcctgcgatggagcccgagacccttgaagcccgcataaatcgggctacgaaccccctcaacaaagagcttgactgggcttcaattaatggcttttgcgaacagttgaatgaggacttcgaaggccccccactggcaactaggctgctcgcccacaagatacagtccccccaggaatgggaggccatccaggcccttacatacttgggctccaggacatccgagaaagtaaaaaacaaaatactggagctcctttactcctggacagtcggattgccagaggaggttaaaattgctgaagcctatcaaatgcttaagaaacaggggatagtaaaatccgatccaaaactgcccgacgatacaacttttcctctgccaccaccacgaccaaaaaacgttatctttgaagatgaagagaagtccaagatgttggcaagattgcttaagtcttcccaccccgaggacttaagggcggcaaacaaactaatcaaagaaatggtgcaggaagatcaaaagagaatggagaaaatatcaaaaagggttaatgccattgaagaagtgaataacaacgtaaaactgctgaccgagatggtcatgtcacactcccagggcggagctgccgcaggatcttccgaagacctgatgaaggaactttaccagcgatgcgagagaatgcgacctaccttgtttaggctggcaagcgacacagaagataacgatgaggcactggcagagattcttcaggcgaatgataatctgacacaagtgattaacctgtataagcaactggttcggggcgaagaagtgaatggcgatgcaaccgctggcagcattcctggaagtacatctgcgctcctggacctgtccggcctcgacctgcctcctgccggcaccacataccctgcgatgcctacacgccctggcgaacaggcttctcccgagcagccatcggcaagtgtgtccttattggatgatgaacttatgagcctcggacttagcgaccctacacctccttccgggcctagcctggacggaactggttggaactccttccagtcttccgatgccaccgagcccccggcccccgcgctcgcgcaggcgccatctatggaaagccgcccccccgcgcaaacaagtttgcctgcttccagcggattagatgatctggacctgcttgggaagacactcctccagcagtctctgccccccgaatcacagcaggtccgatgggagaaacagcagccgacccccagactaacactccgggatcttcagaacaagtcaagcagttgttcgtccccatcaagtagcgctacatcgttgctgcacaccgtatccccggaacctccaaggccaccacagcagcccgtgcctacagagctctctctggcttcaataacagtaccgctggagtctattaaacccagtaatattctgccagtgacagtttacgatcagcacggattcaggattctgttccacttcgctcgtgatcctctcccagggcggagcgacgtgttggtggtcgtggtgtctatgctgtccaccgctccacagcctattagaaatatcgtgttccagtctgctgtaccaaaggtaatgaaggtgaagctccagccaccatccggtacagagctgcctgcttttaaccccatcgtgcacccgtccgccatcacccaagtgcttctgcttgccaaccctcaaaaagagaaggtgagattgcggtacaaactgacctttaccatgggtgaccagacatataatgaaatgggagacgtggaccagttccctcccccagaaacgtgggggagtctgtag

SEQ ID NO: 118933 - DNA, 1920 bp, Artificial Sequence
  Description of Artificial Sequence: Synthetic coding sequence
atggagcctgcaatggagcccgagaccttggaggcgagaattaacagagccaccaatccactcaataaggaactagactgggctagcatcaatggcttctgcgagcaactaaacgaggacttcgaaggccctcctctggcgactaggctactggcccacaaaatacagtctccacaggagtgggaggctatccaggcactgaccgtcctggagacatgtatgaagtcttgcggaaagcgcttccatgatgaggtcgggaaatttcgctttctaaatgagctgatcaaggtggtttctccaaagtatttgggttcccggacaagcgagaaagtcaagaacaagatactcgagctgctttatagctggaccgtgggcttgccagaggaagtaaaaatcgccgaagcctatcaaatgctgaaaaagcagggcatagtaaaatctgatcctaagctcccggacgacaccacatttccactgccccctcccagaccaaagaacgtaatttttgaagacgaggaaaaaagcaagatgttggctaggctcctcaagagcagccaccccgaagatctccgggccgccaataagctcattaaggaaatggtacaagaggaccaaaaaaggatggagaaaatcagcaagcgtgtgaatgctatcgaggaggttaataacaatgtgaaattgcttacagaaatggtcatgagtcactcacaaggaggtgccgcagccgggagctctgaagatttgatgaaggaactctatcagagatgtgaacgcatgcgcccgaccctattcagactcgcctcagacaccgaagacaatgacgaggccttggcagagattttgcaggcaaatgataatctgacccaagtaattaatctctataagcagctggtcaggggggaggaggtgaacggagatgcaactgctggtagcataccaggctccacctccgccctgcttgatctttccggtcttgacctgccccctgcagggactacttaccccgcaatgcctactaggccgggcgagcaggcatcaccagaacagcctagcgcaagtgtgtctctgctagacgatgagctgatgagcttgggcttatcggatcctaccccaccatcaggccccagcctggacggaaccggatggaactccttccaatcatctgatgcaactgaaccccccgcccccgcccttgcccaagctcctagcatggagtctcgtccccctgcacagacctccctgccagcgtcctcaggactagacgaccttgatttgctggggaagaccctgctgcagcagagcctacccccggaatcccagcaagtcagatgggagaagcagcagccaaccccccgcctgacactgagggacctgcagaacaaaagcagttcttgcagtagtccctcatcctccgctacctctctgctccacactgtgtccccagaaccacctcgtccacctcaacagcctgttccaacagagctgtccctagcctctattaccgtccccttggaaagcatcaaaccttctaatatcctgcccgtaacagtctacgatcagcacggtttcagaatcctgttccattttgcacgtgaccctctgccggggaggtcagatgttctcgtggtagttgtgtccatgctgagcaccgccccgcagcccatccgcaacatcgtgtttcagtctgctgtccccaaggttatgaaggtaaagctgcagccaccgagcggcacagaattaccagcattcaatcctatcgtacacccgtctgctataacacaggtgctgttgctagcaaacccccagaaggagaaggtgaggttgaggtacaaactgacctttacaatgggcgatcagacgtataatgagatgggcgacgtggatcagttcccccctccagaaacgtggggttccctctag

SEQ ID NO: 118934 - DNA, 1971 bp, Artificial Sequence
  Description of Artificial Sequence: Synthetic coding sequence
atggaacctgcaatggaacctgaaaccttggaggcccgtattaaccgcgccactaaccctctgaataaagaactggactgggccagtatcaacggcttctgcgagcaacttaatgaggattttgagggcccccctctcgcgacacgtctgctggctcacaagatacagtcgccccaagaatgggaagctatccaggctctcaccgtcagacgaggtgaggctactatccgaccgccaccgtgtgacgacacaaaagtgttggaaacctgtatgaaatcgtgcggcaaacggtttcacgacgaggtgggaaagttccgcttcctaaatgaactcataaaggtcgtctcacctaaatacctgggaagccgcaccagtgagaaggtcaagaataaaattcttgaactgctgtactcctggaccgtggggctgcccgaagaagtcaaaattgctgaggcttaccagatgcttaaaaagcaaggcattgtgaaaagcgaccccaagctgcctgacgacacaaccttccccctgcccccgcctcgacccaagaacgtaatttttgaggacgaggagaagtcgaaaatgttagctcgtttgctgaagagctcccatcctgaagacctgcgggcagctaacaaactcattaaggagatggtgcaggaggatcaaaagcgcatggagaagattagtaagcgagtcaatgccatcgaggaagtcaataataacgttaagcttctgacagaaatggtgatgtcgcactcccagggaggcgctgccgctggctcaagcgaagatctcatgaaagagctttaccagaggtgcgaacgaatgcggccaaccctgtttcgactggccagtgatacggaagacaacgacgaggcactggccgagatcttacaggccaacgacaatctcacgcaggttatcaacctatacaagcagttggtgaggggggaggaggtgaatggcgacgccaccgctggatccatccctgggtctacgtctgccctcctggatctgtctggtctggacctaccgcccgcaggtaccacttacccagctatgcccactcggcccggcgagcaggcatcgcctgaacagcctagcgcttcagtgtccttgcttgatgatgaactgatgagccttgggctctccgaccctactccccccagcggaccgtctttggacggaaccgggtggaattcgttccaatcaagcgatgctacagagccccctgcacctgccctcgctcaggctccctctatggagagtcgcccacctgcccaaacctctttgcctgcctcttcaggactggacgacttagacctgctcggtaagaccctgttacagcagagtttacctcctgagagtcagcaggttcgctgggagaagcaacaaccaaccccgagactcacactaagagatttgcagaacaagtcctctagctgctctagtcccagcagttctgctaccagcctgctacacactgtcagtcccgaaccgccccgtcccccacagcagcccgttcctaccgagttgtcccttgcaagcatcaccgtccctctcgaatcaattaaaccttctaacatcctcccagtgacggtgtacgatcaacacgggttccgcattctgttccactttgctcgtgacccactacctgggcgtagcgacgtattagtcgtcgtggtttccatgctgtcaactgctccccagcccattagaaatatcgtgtttcagtctgccgtgcccaaagtcatgaaggtcaaattgcaaccaccaagtgggacagaactgcccgcgttcaaccccatagtccatccctctgcaattacacaggtacttttgctggctaacccacagaaggaaaaagttaggctcaggtacaagctgacttttaccatgggggatcaaacatacaatgaaatgggtgatgttgatcagttccctccgcctgagacgtggggatccctgtag

SEQ ID NO: 118935 - DNA, 1701 bp, Artificial Sequence
  Description of Artificial Sequence: Synthetic coding sequence
atgaaaagctgcggtaaacgattccacgacgaagtgggcaagttccgctttcttaacgaactaatcaaagtggtttcgcccaagtatctggggtctcgcacttccgagaaagtgaaaaacaagatcctcgaactgctgtactcttggaccgtggggctaccagaggaggtgaagattgctgaggcttatcagatgctcaaaaaacagggcattgtcaagagtgaccctaagctgcccgacgatacaacttttcccttacctcctcctagacctaaaaacgttattttcgaggacgaggagaagtctaaaatgcttgcccggcttctaaagagttcccatcccgaggatctgagagcagctaacaagctgataaaagaaatggtacaggaagaccagaaaaggatggaaaaaatcagtaagcgggtgaacgctatagaggaagtgaataataatgtcaagctgctgacggaaatggtgatgagccattctcagggcggggctgccgcaggatcctccgaagaccttatgaaagaattgtaccaacggtgtgagcgaatgagacctacactctttcgcctcgccagcgatacagaggataatgatgaggccctagctgaaatacttcaggccaacgataacctgactcaggttatcaacttgtacaagcagctggtgcggggagaggaagtgaatggtgatgcgacggcagggtcaatcccaggctcgacttcggcactgctcgacctgtcgggtttggacctgcctccagccggaactacttaccctgcaatgccaacgcggccaggcgagcaggcgtctcccgaacagccctctgcttccgtgtctctgctggatgatgagttaatgtctttaggcttgtcagatcccacaccaccatcaggcccctcactggacgggaccgggtggaatagcttccagtcctctgacgccaccgagccccccgctcccgctctggctcaggcccctagtatggagagtcgcccgccagcacagacatcactcccggctagttccggtctagacgacctggacctgctgggcaaaacactgctgcagcagtctctgccccccgagagccagcaggtaaggtgggagaagcagcagccaacgccccgcctgacccttagagatttgcagaataaatcctcttcatgttcttctccatccagttcagcaacttctctgctacatacagtgtcccccgagcctccaaggcccccccaacagcccgtgccaaccgagctcagcttagccagcatcacagtgcccctggaatccatcaaacctagtaatattctgcccgtcacggtctacgaccagcacgggtttcggatactgttccactttgctcgtgaccctctgcccgggcggtccgatgtactggttgtggttgtctctatgttatccacggcccctcaaccaataaggaacattgtattccagtctgccgtccctaaggtgatgaaagtcaaactacagccgccctctggtacagaacttcctgcttttaatcccatcgtacaccccagcgccattacccaggtcctgcttcttgcgaatccacaaaaagagaaagttcggctcagatacaaattaaccttcaccatgggagaccagacttacaacgagatgggcgacgtggatcagttccccccacccgagacgtggggtagcttatag

SEQ ID NO: 118936 - DNA, 123 bp, Artificial Sequence
  Description of Artificial Sequence: Synthetic coding sequence
atgaagagttgcggcaaaaggtttcacgacgaagtgggcaagtttcgcttcttgaatgagctcataaaagtcgtcagccccaagtacttaggctccaggacaagtgagaaggtgaaaaactag

SEQ ID NO: 118937 - DNA, 330 bp, Artificial Sequence
  Description of Artificial Sequence: Synthetic coding sequence
atgaagtcatgcggcaagcgcttccacgacgaggtaggcaagtttagattcctcaacgagctcatcaaggtggtgtcccccaaatatcttgggtctagaacctccgagaaagtcaagaataagatcctggagctgctgtacagctggacagtggggttgcccgaggaagtcaagatcgcagaggcataccagatgctaaaaaaacaaggaatcgtgaaaagcgatccgaagctgcccgacgacaccacctttccgctacctccaccccgacctaagaacgtgatttttgaagacgaggagaagtccaagatgctggctcgcttgttgtag

SEQ ID NO: 118938 - DNA, 270 bp, Artificial Sequence
  Description of Artificial Sequence: Synthetic coding sequence
atggagccggccatggagccagagacattagaagcgcgcataaatcgggcaactaaccccctgaacaaagagctggattgggcatctatcaatggattttgtgagcaattgaacgaagatttcgaggggccaccactggccactcggctgctcgcccataagatccagtcaccacaggaatgggaagcaatccaagccctaactgtcagaagaggagaggccaccatccgtccccccccctgtgatgacacgaagggcggccaggactag

SEQ ID NO: 118939 - DNA, 330 bp, Artificial Sequence
  Description of Artificial Sequence: Synthetic coding sequence
atgaaatcatgtggtaagagatttcatgacgaggtggggaaattccggtttctcaacgaactcatcaaggtggtttcccctaagtatctcgggtcaaggacgtccgaaaaggtgaaaaataaaatccttgaacttctgtattcatggactgttggtcttcccgaggaggtaaaaatcgctgaagcataccagatgctaaaaaaacagggcatcgtcaagagtgacccaaaactccccgacgatactactttcccactgccccccccaagaccgaagaacgtcatatttgaagacgaggagaagagcaagatgctggctagattactgtag

SEQ ID NO: 118940 - DNA, 327 bp, Artificial Sequence
  Description of Artificial Sequence: Synthetic coding sequence
atgaaatcctgtggcaagcggtttcacgacgaggtggggaaattccggttcctgaacgaattgatcaaggtcgtgtcacccaaatatttgggaagcagaacttcggaaaaagtaaagaacaaaattctggagctcctgtatagctggaccgtggggttaccggaggaagtcaaaattgcggaggcttatcaaatgctcaagaagcagggtatcgtgaagtctgatcctaagctgcccgatgataccacattccccctgccccccccgaggcctaaaaacgtcatttttgaagacgaggagaagagtaagatgctcgcacgtttgtag

SEQ ID NO: 118941 - DNA, 57 bp, Artificial Sequence
  Description of Artificial Sequence: Synthetic coding sequence
atgaagagttgtgggaagcgctttcacgacgaggtcgggaagttcaggtttctttag

SEQ ID NO: 118942 - DNA, 183 bp, Artificial Sequence
  Description of Artificial Sequence: Synthetic coding sequence
atgaaatcgtgcgggaaacgattccatgacgaagtgggaaagtttcgatttttgaacgagcttattaaggttgtaagccccaaatacctggggtctcgcaccagcgagaaggtgaagaataagatccttgagctgctctattcctggaccgtgggtctccccgaggaggtcaagattgcatag

SEQ ID NO: 118943 - DNA, 87 bp, Artificial Sequence
  Description of Artificial Sequence: Synthetic coding sequence
atgaaaagttgtggaaagcgattccacgacgaggtaggcaaatttaggttccttaatgaactgattaaggtcgtgtcgccaaagtag

SEQ ID NO: 118944 - DNA, 741 bp, Artificial Sequence
  Description of Artificial Sequence: Synthetic coding sequence
atgacacccgggactgctaacagggccaccaatcctctcaacaaggaactggattgggcctccatcaacggcttctgcgaacagctcaacgaagattttgagggccctcccctcgctaccagactgttggcacacaagatccagtcgcctcaagagtgggaggccatacaggcccttaccgttctcgagacctgcatgaaatcttgcggtaaaagattccacgatgaagtgggcaagttcaggttcctgaatgagttgataaaagtcgtgtctcccaagtacttggggagcaggacaagtgagaaggtgaagaataagatcctggagctcttgtacagctggacggtgggcctgccagaagaagtaaagatcgccgaagcatatcagatgctgaagaagcaagggatcgtgaaaagtgatcccaagttgccggatgacactacatttcccttaccccccccaagacccaagaacgtgatcttcgaggacgaggaaaagtccaaaatgctggccagattattaaaatcatcgcatccagaggacctccgggctgctaataagctgatcaaggagatggtccaagaggaccaaaagcgcatggaaaagattagcaagcgagtcaatgcgatcgaagaggtcaacaacaacgtgaaattattaactgagatggttatgagtcatagccaagggggcgctgcagccgggtccagcgaagacctgatgaaagagctttatcaatag

SEQ ID NO: 118945 - DNA, 213 bp, Artificial Sequence
  Description of Artificial Sequence: Synthetic coding sequence
atgaagtcctgcggaaagagatttcacgacgaagttggaaagttcagattcctgaacgagctgattaaggtggtcagtccaaaatacctcgggtcacgaacctcagaaaaagtcaaaaacaaaatcctggaactgttgtattcttggacggttggcctgccggaggaagtaaaaatcgctgaagcatatcagatgctcaagaagcagggctag

SEQ ID NO: 118946 - DNA, 2172 bp, Artificial Sequence
  Description of Artificial Sequence: Synthetic coding sequence
atggcagaggctgaaggtgagagcctggaatcatggctgaacaaggccacgaaccctagtaaccgccaagaggattgggaatatataataggattctgcgatcagattaacaaagaacttgaagggccacaaatcgcagtacgcttgttagctcacaaaatccagtctccacaggagtgggaagcgctgcaggctctcacggtccttgaggcatgcatgaaaaattgtgggcggagattccacaacgaggtgggtaagttcagattcctgaatgagcttattaaggttgtcagccctaaatacctgggcgaccgtgtgagcgaaaaggtcaaaacaaaagtaattgagctcctgtacagctggaccatggccctgcccgaggaagctaagattaaggatgcataccacatgttgaaacgccagggtatcgttcagagcgatccacccatccccgtcgaccgcacactcatacccagccctccgccgcgcccaaagaaccctgtcttcgacgatgaggaaaagagcaagctcctcgcaaaactgctcaagtcaaagaacccagacgatttgcaggaggctaataaactgatcaagtccatggtgaaggaagatgaggcgaggattcagaaagttaccaagcgcttgcatacactggaggaggtgaataacaacgtccgcctcctgtcggagatgctgctgcattactcacaggaggattcatcagatggggacagggaactgatgaaggagctgtttgaccagtgtgagaacaagagacgtacgctgttcaaactcgcgtcagagactgaggacaatgataattccctcggtgatatcttgcaagcgtccgataacttgagtagagttatcaattcatacaaaaccatcatagaaggtcaggtaatcaacggggaagttgccaccctcactctgccggacagtgagggcaattctcaatgctccaaccaagggacactaattgatttggctgaactcgacaccactaatagtttgtctagcgtgctcgccccggcccctacccctccaagtagcggtatccccattttgccaccaccccctcaggcgagcggccctcctaggagtcgctcatcctcacaggcagaagcaaccctgggccccagcagcacctctaatgccctgtcctggctcgatgaggagctgctctgcctgggactagccgatcccgctcccaatgtgccacccaaagaaagcgctggtaactcacagtggcacttactccagcgtgagcagagcgatttggattttttctcgcccaggccgggcactgcagcgtgcggcgcctcggacgctcctttgctccagccttcggccccctcttcgagctcctcccaggcccctctgcctccgccttttcctgctccagtggtgcccgcttctgtgcctgctccgagcgccggatcctcattattcagtacaggcgtcgcccctgccttggcccctaaagttgagcctgccgttcctggccaccatggcttggcccttggaaactcggcccttcatcaccttgacgctttggatcagctgttggaagaagccaaagtaactagtggcctagttaagccaaccacctccccgttaattcccaccaccactcccgcacgccccctcctcccctttagtacggggcctggctcccccttgttccaaccattaagctttcagtctcagggttccccgccaaaaggacccgagctgagtctggcaagcatccacgtgcccctggaatccataaagccttctagcgccctacccgtcactgcatacgataaaaacggctttaggatactatttcactttgccaaggagtgccccccagggaggccagatgttctggttgtcgtggtgtcaatgttaaataccgcgcccctccccgtcaagtctatcgtactccaggccgctgtgcctaagagcatgaaggtgaagctccagcccccttccggcacagagttgtcacccttcagtccaatccagccccccgccgccatcacacaagtcatgttactggccaatcccttgaaagaaaaagtgcgcttgagatataagttgacctttgccctgggcgagcagctcagcacagaagtcggcgaagttgaccagtttcccccagtggaacagtgggggaacctgtag

SEQ ID NO: 118947 - DNA, 2073 bp, Artificial Sequence
  Description of Artificial Sequence: Synthetic coding sequence
atggcggaagccgaaggcgaaagtttagaatcttggttgaacaaagcgaccaacccgagcaaccgccaggaggactgggagtacatcatcggcttctgtgaccagatcaataaagaattggagggcccacagatagctgtccgactgctcgcacacaagatccagtcaccgcaggagtgggaggctctccaggccttgacatacctcggagatcgggtctccgagaaggtcaagaccaaggtgattgagttgctgtattcctggacaatggcccttccagaagaggctaagataaaggatgcttaccacatgctcaagaggcagggcattgtacagagcgaccccccaattccggtcgatcgtaccctgatcccatcccctcccccacggcctaaaaaccctgtgtttgatgacgaggagaaaagtaagctccttgccaagttattaaaatcaaaaaacccagacgatctgcaagaggccaacaaacttataaaatctatggtaaaggaggacgaggctaggattcagaaggtcaccaagcgactgcatacactggaagaggtgaataacaatgtgagactgctctctgagatgctcctccactactcccaggaggatagctctgacggagaccgagaactgatgaaggaactgtttgaccagtgcgaaaacaaacggcgaaccctttttaagctcgccagcgaaaccgaagacaacgataattccttgggcgacatcctgcaagcgagcgataatctgagcagggttatcaattcttataagactatcatagaaggccaagtcatcaatggcgaagttgccacattgactcttccagattctgaggggaacagtcaatgttccaatcaggggaccctaatagacctcgccgagctcgatacgactaactccctgtcatccgtgctggcacctgcccctacacctccatcctcgggaatccccatcttgccaccacctccccaggctagcgggcctccacggagccgctcctccagtcaggctgaagccactctgggcccttcttctactagtaacgctctgtcttggcttgatgaggagcttctgtgcttgggactagccgatcctgcacccaacgtgcctccaaaagagtcggctggaaattcgcagtggcacttattacagagggaacagagcgacctggacttctttagcccacggcccggcactgctgcgtgtggagcctctgacgcccccctactacagccctctgctcccagctcgagctccagccaggcccccctgcccccaccattccctgcccccgtggtgcctgcctcagtccccgcgccttctgccgggagttccctgtttagcaccggcgtagctcctgccctggcacctaaggtggagcccgcagttcccggacaccatgggctggcgctggggaatagtgcactccaccacctagacgccctggatcagctgctagaagaggcgaaggtgactagcggactcgtgaaacccactaccagtcctctgatcccaaccaccaccccagcacgacccctgctgccattcagcaccggccctggaagccctctgttccaaccactgtccttccagtctcaaggctctccgcccaaagggccggagttgtccctagcgtcaattcatgtgcccctcgaatccatcaaacccagcagcgcccttcccgtgacagcctacgataagaatggcttcaggattcttttccactttgctaaagaatgtcctccgggccgccctgatgtgctcgtggtcgtggtatctatgttaaacacagcccccttaccggtcaagagcatcgtgctgcaggcggccgtaccaaagtccatgaaggtgaaacttcagcctcccagtggtaccgagttgagcccgttttcaccaatccagcctcccgctgcgataacacaggtgatgctcctggcaaacccactgaaggagaaggtgagactgaggtataaactcacatttgcattaggtgaacaattatctactgaggtaggagaggtggatcagttccctccggtggagcaatggggtaacctctag

SEQ ID NO: 118948 - DNA, 1956 bp, Artificial Sequence
  Description of Artificial Sequence: Synthetic coding sequence
atgaaaaattgcgggcgccgcttccacaatgaagtcggaaagtttcgttttctcaacgaactcatcaaggttgtgtcccctaaatacctaggagaccgagtgtccgaaaaggtcaaaacgaaggtgattgagctgttatatagttggaccatggcactgcctgaagaagcaaaaattaaggacgcataccacatgctcaagaggcaggggatcgtgcagagtgacccccctattcccgtggacagaaccttgatcccatctccaccaccacggcctaaaaacccagtgttcgatgatgaagagaagtcaaagttactggcaaagctcctgaaatcaaagaaccctgacgatcttcaggaggccaataagttaatcaagtccatggttaaggaagacgaggcgcgcatccagaaagtgaccaagcgactccacacgcttgaagaggttaataacaacgtacggcttctctctgagatgctgttgcactactcacaggaggatagcagtgacggtgacagagagttaatgaaagaactctttgatcagtgcgagaacaagaggaggactctgtttaaattggcctctgaaaccgaagacaatgataattccctgggagatattctgcaggcgtctgacaacctcagccgtgttataaacagttataaaacaatcatagagggacaggtgataaatggggaggtggcaactctgaccttgcccgacagtgagggcaatagccaatgcagcaaccaggggactctaatcgatctggccgaacttgataccacgaactcactttcatctgtcctcgctccagctccaacgcctccaagctccggaatccctatcttgcctcctccccctcaagcgtccggacctccaaggagtaggagcagctcacaggctgaggccactctggggccttcctcaacttcaaacgcactgtcatggctggatgaagagctgctctgtctgggcctggccgacccagccccgaatgtcccccctaaagagagcgccggaaattctcagtggcaccttttacagcgtgagcagagtgacctcgacttcttttcgccccgccccggtaccgccgcctgcggcgcttccgacgcgcccctcctgcagccgtctgctccctcgagcagtagttcccaggccccgttgccaccacctttccccgcacccgtcgtgccagcttcagtccctgccccatccgctggtagctctctcttttccacaggggtggctcccgcgctggctccgaaggttgagccagcggtgcctggccaccacgggctggcgctcggcaactctgcactgcaccatctggacgctctagatcagctactcgaggaagccaaggtgacatctggactcgtcaagccgacaacatcccccctcattcccacaaccacccccgctcgcccgcttctgcctttctcaacaggacccggttcacccctctttcaaccgctttcattccaatctcagggaagcccaccaaagggccctgagctctccttggccagcattcacgtgccattagagtcaattaagccaagcagcgccttacctgttactgcttacgataagaacggctttcgcatcttattccacttcgctaaagagtgcccgcccggacgacccgacgtgctggtggtagtggtgtcaatgcttaataccgctccgctgccagttaagtcaatagtgctgcaggctgcagtccccaaatcaatgaaagtcaagctgcaaccaccaagtgggaccgaattgagtcccttctcaccgatccagccacccgcagccattactcaggtgatgctgctggcaaatccgctgaaggaaaaagtccggttgaggtacaaactgaccttcgctctgggcgagcagctgtccacagaggtgggcgaggtcgaccagttcccacctgtggaacagtggggcaacctctag

SEQ ID NO: 118949 - DNA, 462 bp, Artificial Sequence
  Description of Artificial Sequence: Synthetic coding sequence
atggcagaggccgagggagagtctctggagagctggctgaataaggctaccaacccaagcaatagacaggaggattgggaatacattattgggttttgcgatcagataaacaaagaattagaagggccccagattgctgtgcgactgctggcccataaaatccaatccccccaggagtgggaggccctgcaggccttgacggtcctggaggcatgtatgaaaaactgtggtcggagatttcataatgaggtcgggaagttcaggttcctgaacgagctcataaaggttgtgtcccctaaatacttaggcgatagagtgtctgaaaaagtaaaaacgaaggtcatcgaactactgtactcctggaccatggctcttccagaagaggcaaagattaaggacgcgtatcatatgctgaaaaggcaggcattctcccaagccgctgagaaacagaagcccagatag

SEQ ID NO: 118950 - DNA, 1806 bp, Artificial Sequence
  Description of Artificial Sequence: Synthetic coding sequence
atggccctgcccgaggaggcaaaaataaaagacgcctatcacatgctgaaaaggcagggtattgtgcagagtgacccccccatcccagtagataggacattgattccttcgccaccgccacgtccaaaaaatcccgtgttcgatgatgaggagaaatcaaagctgctggctaaactgctgaaaagcaagaatccagacgacctacaggaggcaaacaagctcatcaagagtatggtaaaagaggatgaggcccggatccaaaaagttaccaagcgcctccatactcttgaggaagtcaacaacaatgtgagactgctgagtgagatgctgcttcactattcacaggaagacagtagcgacggggatcgcgagctgatgaaggaactgttcgaccagtgcgagaacaaacgccgaactctttttaagctggctagtgagactgaggacaatgacaactcactgggggacatccttcaagccagtgacaacctgtcccgcgttatcaacagctacaagaccattattgaaggtcaggttatcaatggcgaggtcgctactctgactctgcccgacagtgaagggaattctcagtgtagtaaccaggggaccctgattgacctggccgagctagacacaaccaattctctatccagtgtgctcgcccctgcgcctacgcccccatcctccggcatacctattctcccacctccgccacaagcctccggccccccacgaagcaggtctagctcccaagcagaggcaaccttgggcccatcatcaactagcaatgccctctcatggctcgacgaagaactcttgtgtctgggccttgccgatccagcaccgaacgtgcctccgaaggagtctgcaggtaactcccagtggcacctactccagagagagcagagtgacttagacttcttctcgcctaggcccgggaccgctgcgtgcggagcgagcgacgcaccactgttacagccgagcgctccctcctcctccagctcccaggcacccctccccccaccgtttcctgccccagtggtgccagcatctgtgcccgcccccagcgcgggatcgtccctgttttcaaccggcgtggcccccgcactcgccccgaaagttgagccagctgtgcccgggcaccacggactggccctgggaaattctgccttgcatcatctggatgccttggaccagcttctggaggaggcaaaagtgacatcgggtcttgtgaagccaacaacatctcccctgattcctaccacaacaccagccagaccgcttctcccattctccaccggccctgggagtccactatttcaaccactgtcattccagtcacagggcagcccgcctaagggacccgaactgtcactggcctcaattcacgtgcctctggaatctatcaagccatcatctgccttgccagtgacggcatacgataaaaatggtttcagaatcctgttccatttcgcgaaggaatgcccgcccgggagaccggacgtcctggtggtggtcgtctcaatgttgaataccgctcccctcccagtcaagagcatcgtcttacaggcggccgtgcctaagtcaatgaaggtcaagctccagccacccagcggtactgaactctcgccattcagccccattcagcccccggccgccattacacaggttatgctattggcaaacccgctgaaagagaaggtccggctgcgatacaaactgaccttcgccctcggagaacagcttagcaccgaggtgggggaggtcgatcagttccctccagtggagcaatgggggaacctgtag

SEQ ID NO: 118951 - DNA, 918 bp, Artificial Sequence
  Description of Artificial Sequence: Synthetic coding sequence
atggccgccggtttggcaagactgttgctcctcctcgggttgtcagctgggggtccggcccccgctggcgccgcaaagatgaaggttgtcgaagaacctaacgcttttggtgtcaacaaccctttccttccacaagcatcaaggcttcaggcgaaacgggatccctcccctgtttccggccctgtccatctgttccgcctgagtggcaagtgcttctccctcgtggaaagcacctacaagtatgagttttgccccttccataatgtcacccagcacgaacagactttccgctggaatgcttacagcggcatcttgggaatttggcacgagtgggagatcgccaacaatacttttaccggcatgtggatgagggacggcgatgcctgccgttcaagaagccgacagagcaaggtggagctcgcctgtggcaagagcaacaggcttgctcacgtcagtgaaccgtctacatgcgtttacgccctcacatttgagacgcctctcgtctgccatccccacgccctgttagtctaccctacactgccagaggccctgcagagacagtgggaccaggtggagcaggacctcgccgatgagttgatcacaccccagggtcatgaaaagctgttgcgaacactctttgaagacgcggggtacctgaagacaccagaagaaaatgagccaacacagctggagggggggcctgactcactgggatttgagacactcgagaactgtcggaaagcccacaaagaactgtccaaagagattaagcggctcaaagggctcctgactcagcatggcataccctacactcgcccaacagagacatctaacctggagcacctcggccacgaaacccctcgggccaaatccccagagcagcttcggggggaccccggcctcagggggtctctttag

SEQ ID NO: 118952 - DNA, 4497 bp, Artificial Sequence
  Description of Artificial Sequence: Synthetic coding sequence
atggacggggcttctgcagagcaggacggcctgcaagaagatagatcccactccggaccatcaagcttgcccgaggccccattaaagcccccggggcctttggttcctcctgaccagcaggacaaagtgcagtgcgcggaggtaaaccgggcctccaccgagggcgagagtcctgacggcccaggacagggtggattgtgtcaaaatgggccaacacctccttttcctgaccccccaagctccctcgacccaaccactagtcccgtgggccctgacgcatctccaggcgtggccggctttcacgataatctccggaaatcacaagggacaagtgccgaaggttccgtccggaaggaagctctgcagagcctgcgtctttccctgccaatgcaggagacgcagctatgttccaccgattccccattgcccctggagaaagaagaacaagtgcgactgcaggctcgtaagtggttagaagagcaactgaaacagtatcgcgtcaaacgtcagcaagagaggtcttcacagcccgctaccaagacaagactgttcagcacgctggaccctgagctgatgcttaaccccgaaaacctgccgcgcgccagcaccctcgcgatgacgaaggagtactcatttctgcgcacctccgtgccgagaggacccaaagtagggagcctcggcctgccagctcacccccgagaaaaaaagaccagcaaatcatcgaaaattcgttctttagctgattatcggacagaggatagtaacgctggaaattctggcggcaatgttcctgcccctgatagtactaagggcagcctcaaacagaaccgttcttccgctgcttccgtagtctcagagatttcactctctccagatactgatgataggttagaaaatacctctctcgctggggatagtgtgtccgaagtagatgggaatgattccgacagttcttcatactcgtccgcatcgactcgtgggacctacgggattctgagcaagacagtggggacgcaagacacaccctacatggtgaacggacaggaaatacctgcggatacgctgggacagttcccatctattaaggacgtcttgcaggccgcagccgccgagcatcaggaccaaggccaggaggtgaatggcgaggttcgatcgcgccgggactctatctgcagtagtgtatctctggagtcatcagctgctgaaacccaggaggagatgttgcaggtgctgaaggaaaagatgcgcctggagggccagctggaggctctctcactggaggcttcacaagcgctcaaagaaaaagctgagctgcaggcgcagcttgctgctctctctacaaaactgcaggcccaagttgaatgctcccatagcagccagcaaaggcaggactccctctcatccgaggtcgataccctgaagcagtcttgttgggatctggagagagcaatgacagacctgcaaaatatgttagaggctaagaatgcaagtctcgcttccagcaacaacgacctgcaggtggccgaggagcagtaccagcgtctgatggcaaaagtcgaggacatgcagcgttctatgctctctaaagataatacagtgcacgacctaaggcagcagatgactgcactccaatcacagctacagcaggtgcaattagagcgaactaccctgaccagtaagttgaaagcaagtcaggccgaaatctcctcgcttcagagtgtaagacagtggtatcaacaacagcttgccctggcccaggaagctagagtgcgattgcagggggagatggctcatatacaggtgggccagatgacccaggcgggacttctggagcatctgaagttggagaatgtgtcgctgagtcagcaactaacagagacccagcatcgatctatgaaggaaaaaggccggatagcggcccagctgcagggaatagaggcagacatgctcgatcaggaagctgcattcatgcagattcaagaggcgaagaccatggtggaggaggacctgcagcgtcggctggaggaattcgaaggagagcgagagcggttgcagagaatggccgattctgcggcgtctctagaacaacagctcgaacaagtcaagctgaccctgctgcaaagggaccagcagctcgaggcccttcagcaggagcacctggacctaatgaagcagctcactctgacccaagaagccctccagagcagagaacagagtttagacgcactgcagacacattatgacgagttacaggcccggctgggagagttacagggcgaggccgcttccagagaagataccatttgcctgctgcagaacgagaagatcattttggaagcagctcttcaggccgccaagagtgggaaagaggagctcgaccgaggggctcggcggcttgaagagggtacagaggagacgagcgaaacgttagagaaactgagggaggagttggccatcaaaagcggacaggtggagcatctgcagcaagagaccgccgcattgaaaaagcagatgcagaagatcaaggaacagtttcttcaacagaaagtaatggtcgaggcctatagacgggatgcgacctctaaggaccagttgatttctgagcttaaagcgacacggaagcggctggactcggagctgaaagagcttcgccaggagctaatgcaggtccatggcgagaagaggacggctgaggccgaactgtctcgactccatcgagaagtcgctcaggtgagacagcacatggccgatctggagggacacttgcagagtgcccagaaagaaagagacgaaatggagacacacctgcagagtctgcagtttgataaagagcagatggtggccgtgacagaagctaacgaggcgctgaaaaaacagatagaagagctgcagcaggaagctaggaaagccataactgaacagaagcaaaagatgaggcgcctgggctccgacttgacttctgcgcagaaagagatgaaaactaagcacaaggcatatgagaacgccgttggcattctgagtcgtcgtctccaggaagccttggcagctaaagaagccgccgatgccgagctcgggcaattgagggcacaaggcggctcatccgattcctccttagcactccacgagcgaattcaggccttagaggccgaattacaggccgtcagtcattccaagaccctcctagaaaaagagctccaggaagttattgctctcaccagccaagagcttgaagaatcaagagaaaaggttttggagctagaggacgagttgcaggagagtaggggtttccggaaaaagatcaagaggctggaagagtcaaacaaaaagcttgcactggaattggaacacgaaaaagggaagctgacaggactaggtcagagtaacgccgccctgcgggaacataacagcatcttagaaacagctctggctaaacgcgaagctgatctggtacagctgaacctgcaagtgcaggctgtgttacagcgcaaggaagaagaggatcgccagatgaagcacctcgttcaggcgctacaggcctcacttgaaaaagagaaggagaaagtgaattcgcttaaagagcaagttgccgccgccaaagtcgaggcgggccacaatagacgccactttaaagccgcatcgctagaactgtcagaagttaaaaaagagctgcaggccaaggagcacttagttcaaaaattgcaagcagaagcagatgatttgcagatccgcgaaggtaagcatagccaggaaatcgcccagtttcaggcggagttagccgaagcccgcgcgcaactccagctgctccaaaagcagctcgacgaacagctgtcaaagcagccagtgggaaaccaggagatggagaacttgaaatgggaggttgaccagaaagagcgagagattcagagcttgaagcaacagctggatctcacagaacagcagggaaggaaagaattggagggactccagcaactgctgcaaaacgtcaagtctgaactggagatggctcaagaagatctcagcatgacacagaaggataagtttatgctgcaggctaaggtgtcagagctgaaaaataatatgaagaccctgcttcagcagaatcaacagttgaagctggatcttcgaagaggcgcagcaaaaacgcgcaaggagcccaaaggcgaggcttcttctagtaacccagcaactcccataaagattccagattgccctgtgccagcttccctcctggaagaactgttacgtccccctccagcagtaagcaaggagccacttaagaacctaaactcctgcctccagcagctcaagcaggagatggacagcctacagagacagatggaggaacacgcccttaccgtgcacgagtcgcttagcagttggactccactggagccagctactgcatcgcccgttcctcccggaggtcacgccggaccccggggtgatccccagcgccatagtcagagccgggcgagcaaagagggtcccggcgagtag

SEQ ID NO: 118953 - DNA, 4173 bp, Artificial Sequence
  Description of Artificial Sequence: Synthetic coding sequence
atggacggagccagcgcagagcaagatggcctgcaggaagacaggtcgcatagcgggccctcgtctctgcctgaggcccctctgaagccacccggtccgctggtgccccctgaccagcaagataaagtccagtgtgcagaggttaacagagcatcaacagagggcgagagtcctgacggccccggccagggcggattatgccaaaatgggccgacgcctccattcccagatccaccttcaagcctcgatcccactaccagccccgtgggccctgatgccagtcccggagtggccggattccatgacaacctccggaaatcccaggggacctctgccgagggctcagtccggaaagaagccctgcagtccctaaggctcagtcttcctatgcaagaaacacaactttgtagcacagacagtccgctgccgttggaaaaagaggagcaggtaaggctgcaggctagaaagtggcttgaagagcagctcaagcaatatcgcgtaaagcggcagcaagagcggagctcacagccagccacaaaaactcgactctttagcacattggatccagagctgatgttaaaccctgaaaatcttcctagggcaagcacactagctatgacaaaagagtattcatttttgcgcacaagtgtcccaaggggtccaaaagttgggagcctcggacttccagcacatcccagggagaagaagacctcaaagagtagtaagatcaggagcctcgccgattataggaccgaagattccaatgcaggcaactccggtggcaatgtccccgccccggactcgaccaaagggtcactgaaacagaataggtcatcggccgcttccgtggtctccgagatctcgctctcccccgacacagacgatcgattagagaatacttctctggcgggcgacagtgtgtcagaagtcgatggcaacgattctgactccagcagttacagcagcgcttcgacaagggggacgtatggcatcctgtccaagacagttgggacccaggataccccctacatggtcaatgggcaggaaatacccgccgacactctgggccaatttcccagtattaaagacgtcctccaggccgctgctgccgaacaccaggatcaaggacaggaagtgaacggggaggtacggagtagacgggactctatttgttccagtgtttccttggagtcttccgctgccgagacccaggaggagatgcttcaggtgttgaaggagaaaatgcggcttgagggccaactggaagccctgagcctggaggcctcacaagctcttaaagagaaagcagagctccaggcgcagctggctgcgctctccactaagctccaagcccaggtggaatgcagccattcctcccagcagcggcaggatagtttgtcctcagaggtggacaccctcaaacagtcttgttgggaccttgagcgcgcaatgaccgatttgcagaatatgctggaagccaagaatgcgtcgctggcctcgagtaataacgacctgcaggtagcagaggagcagtatcaacggctaatggccaaagtggaggatatgcaaaggagcatgctctccaaagacaacactgtacacgatctgcgtcaacagatgaccgcacttcagtcccagctccagcaagtccaactggagcgcacaacactgacctcgaagcttaaggctagtcaagccgagatttcaagcctccaatcagtgagacagtggtaccagcaacaacttgctctcgcccaggaggcccgggtgcgtctgcagggcgaaatggcccacattcaggtagggcagatgactcaggccggcctcctggaacatctcaaactcgagaacgtttccctttctcaacaactcactgagactcagcataggtccatgaaagaaaaggggcgcattgcggcccagctgcagggtatcgaggctgacatgctggatcaggaggccgccttcatgcaaatccaggaggctaagaccatggtggaggaagacctgcagcgtagattggaggagtttgaaggggagcgagagagactccagagaatggctgacagcgccgcttccttagagcaacagctggaacaggtaaaattgaccctgctccagcgcgatcagcagctggaggcattgcagcaggagcacctggatctgatgaaacagctgacactgacgcaagaggcactgcagagtagagagcagagcctcgatgccctgcagacacactacgacgaattgcaggcgcgactgggcgagctacaaggcgaagcagctagccgggaagacaccatctgcctgcttcagaatgaaaaaataatcctggaagccgcactccaagccgccaaatctggcaaagaagaattagaccgtggcgcgcgcaggttggaagagggtactgaggagacgagtgagactctggagaagctacgggaagaattggcaatcaagtctggacaggtggagcatctgcaacaagaaacggccgccctgaagaagcagatgcagaagattaaggagcagttcctgcagcagaaggtcatggtcgaggcttatagacgggacgccacctcaaaggatcagctgatctctgaactcaaagccacacgaaagcgccttgactctgaactcaaggagttaaggcaggaactcatgcaggtccacggagagaagaggacggcggaggccgagctaagtcgcctccatcgcgaagtggcccaggtcaggcagcacatggcagatttggaaggccatctccaaagcgcccagaaggaaagagatgagatggaaacacacctgcaaagcctgcagttcgataaagagcagatggtggctgttacagaagctaatgaggctctcaagaaacagattgaagagctccaacaggaggccaggaaagcgattacagagcagaagcagaagatgagacgccttggcagtgatctgactagtgctcagaaagaaatgaaaaccaagcacaaggcctacgagaatgcagtaggaatcctcagtcggcggctgcaggaagccctggccgccaaggaagcggcagacgctgaacttggacaactccgggcacagggagggagttccgattccagcctcgcgctgcatgagaggatccaagctctggaggccgagctgcaagctgtgagccatagcaaaacactgctcgaaaaagagttacaggaagtcatcgccctgacgagccaggaactcgaggagagcagagaaaaggtgttggaacttgaggatgagttgcaggaatcccgcggcttcagaaagaagatcaaacgcctcgaagaatctaataagaaactggccctggagctggaacacgaaaaagggaagctaacaggactgggacaatcaaacgccgcccttcgagagcacaactctattctggagactgcccttgcgaagcgcgaggcagatctcgtccagctgaacctgcaggtgcaggctgtgctgcagaggaaagaagaggaagacaggcagatgaagcacctcgtccaggccttgcaagccagtctcgagaaagaaaaagagaaagtgaatagtttgaaggaacaggtggccgctgcaaaggtggaagcgggccacaacaggcggcactttaaggccgcctccctggaactgagcgaggtgaaaaaggaactgcaggcaaaggagcacttagtgcagaagctccaggccgaggccgacgatctccaaattagggaaggaaaacactcacaagagattgcacagttccaagccgaactggcagaagctagagcacagcttcagctcctccagaagcagcttgacgagcagctgagcaagcagcccgtcggaaatcaggagatggagaacttgaaatgggaagtggatcagaaagaacgcgagattcagtccctgaaacagcagctcgatcttacggaacagcaggggagaaaggaactcgaggggcttcaacagctgctgcagaatgtgaaatctgagctggagatggcacaggaggatctctccatgacgcagaaggacaaattcatgctacaggcaaaagtaagtgagttgaaaaataatatgaaaactctccttcagcagaatcagcagctgaaactcgatctgagacgcggagcggccaagactgtgctcagacccgcatcccttccaggttag

SEQ ID NO: 118954 - DNA, 3405 bp, Artificial Sequence
  Description of Artificial Sequence: Synthetic coding sequence
atggacggcgcctctgccgagcaagacggtttacaagaggaccggtcgcactctgggccatcctctcttccagaggcacctctgaagccccccgggccactggttccaccagatcagcaggacaaagtccagtgtgcagaggtgaatcgtgcctcgactgaaggagaaagcccagacgggccaggacaggggggactctgtcagaacgggccgacgccaccttttcccgatcctccaagttcactggaccccactacatcaccagtgggacccgatgcgtcccctggcgtggcagggtttcacgacaacctgcgaaagagtcagggtaccagcgcagaagggtctgtgcgtaaggaggcccttcagtcgctcagattgtccctgcccatgcaggaaactcagctgtgctccacagatagccccctccccttagagaaggaggagcaagttcgcctgcaagctagaaagtggctggaagaacaattgaagcaataccgcgtgaagcggcagcaggagcgatcttctcagcccgccactaagacacggctcttttccacacttgatccagagctcatgctcaaccccgagaacctgccacgggcctccacactagctatgaccaaggagtattcattcctgcggacctccgtgccccggggacctaaagtgggtagtctggggttacccgcccatccgagagaaaagaaaacctccaagagcagcaagatccgtagcctcgccgattacaggaccgaagacagcaatgctggcaactctggagggaatgttcctgctcctgacagcaccaagggctctctgaagcagaacaggagcagcgccgccagcgtcgtatccgaaatatcgctatcccctgataccgatgacagactggaaaatactagcctggcaggcgattcagtcagcgaagttgatggtaatgactctgatagcagttcctacagctcagcatcaacgcgcgggacctatgggatcctttccaagaccgtagggacccaggataccccttacatggtcaatggccaagaaatacctgccgatacactgggacagtttccatccatcaaagacgttctccaggccgcagccgccgagcatcaggaccaaggtcaggaagtgaacggcgaagtgaggtccaggcgcgactccatctgctcatctgtttctctcgaaagtagtgcagcagaaacccaagaagagatgcttcaggtcctgaaagaaaagatgcgtttggagggccaactggaagctctgagtctggaggcttcccaagccctgaaagagaaagcggagctgcaagcacagctggctgccctgtccaccaaactccaggctcaggtcgagtgtagccatagttctcaacagaggcaagactcactgtccagcgaagttgacacgctgaaacagtcgtgctgggatctggagcgggctatgaccgatctccaaaacatgctcgaggctaaaaacgcgtcgctcgcatcctctaataacgacctccaagtcgccgaggagcagtatcagcggctgatggccaaggttgaagacatgcagcgcagcatgttgtcaaaggacaataccgtgcatgacctacggcagcagatgaccgcactgcaatctcagctccagcaggtgcagctggagaggactactttgacctcaaaattgaaggccagccaggcggaaatcagcagtctgcagagcgtccgtcaatggtatcaacagcagctggctctggctcaggaagccagagtccggctccagggcgagatggcccacatacaggtgggtcagatgactcaggcagggctgctggagcatctgaaactagagaatgtgagtctgtcccaacagcttaccgagacccaacacagatctatgaaagaaaagggccgcatagccgcacagctccaagggatcgaggccgacatgttggatcaggaggctgcattcatgcaaatccaggaagcgaaaaccatggtggaggaagacctacaacgacggctggaagagtttgaaggggaacgtgaaagactgcagaggatggccgatagtgccgcaagccttgaacagcagttggagcaagtcaaactgacactgctccagcgggatcagcaactggaggctctgcagcaggaacacttggatctcatgaagcagctcacactgacgcaggaagctctacagtcacgcgaacagtccctggacgccctgcagacacattatgatgaactgcaagctcgcttgggtgagctgcagggggaagcggcatcgcgggaagatacgatctgtctgctgcagaatgaaaaaattattctggaggcagcactgcaggctgctaagagcggaaaggaggaactggacagaggcgcaagaagacttgaggagggcaccgaagaaacatctgagacgctggaaaaactaagagaagagctggccatcaagagcgggcaggtggagcacttgcaacaggagacagccgcactcaagaagcagatgcaaaaaatcaaggagcaattcctacagcagaaagttatggtggaggcttatagacgggacgcaacatctaaggatcaattaatctcagagttgaaagccaccaggaagcggcttgactctgagctgaaggagctgaggcaagagctaatgcaggtccatggggaaaaacgcaccgcagaggctgaactctctcgccttcatcgggaggtggcacaagtacggcaacatatggcagacttggaaggccacctgcagtctgctcagaaggaacgagacgagatggagacccacctgcaaagcctccagttcgacaaagaacagatggttgctgtcactgaggccaatgaagcactgaagaaacagatcgaggagctccagcaggaggccaggaaggccataacagaacagaagcagaagatgcggagactgggtagtgacctgacctccgctcagaaggagatgaagacaaaacacaaagcatatgagaacgcagtgggaatcctgagtaggagactgcaggaagctttagctgctaaggaagctgcggacgcagaactgggtcagctccgggctcagggaggcagttcagacagtagcctggctctgcatgagcgaattcaggcgctggaggccgaactccaagctgttagtcacagtaagactttactcgaaaaggaacttcaggaagtgattgcactgactagccaggaacttgaggagtcccgggaaaaggtgttggagctagaagatgaggtccgccccggtcacttgctttggagacagcggggggccgggcacgtctcaccagggcatgccgccacaagggagactcgacggactaagctgcaccgggtgccatctgtcgctacctttggagtggctacgttttag

SEQ ID NO: 118955 - DNA, 6693 bp, Artificial Sequence
  Description of Artificial Sequence: Synthetic coding sequence
atgtttaagaagttgaagcagaagatcagcgaggaacagcagcagctgcagcaggccttggcccctgcccaagctagctccaacagcagcacccctactcggatgcgatcccggacctcttcgttcaccgagcagctggacgagggaacacccaacagggaaagtggggacactcagtcctttgctcagaagctacaactgagagtcccatcagtggagagcctgtttagatctccgatcaaggagtctctgtttcggtccagctccaaggaatcccttgtgcgaaccagttcacgcgagagcctgaacaggttggatctcgacagttcaactgctagcttcgacccacctagtgatatggattcagaggctgaagatttggttgggaattctgattctctgaataaagaacagctgatccagagattacggcgcatggagagaagcctcagctcgtatcgcggcaaatattccgagctcgtcacggcgtatcaaatgttacagcgtgagaaaaagaaactacagggaattctgagtcaatctcaagacaagtctctgcgccgtattgctgaacttagggaggaactccagatggaccagcaggccaagaaacacttgcaggaagaatttgatgccagcttggaggagaaagaccagtatatttcggtcctgcagacacaggtgtccctccttaagcagagattacgcaatggcccgatgaacgtagatgtccttaagccccttccccagttggaacctcaggccgaggtctttacaaaagaggagaatcctgagtctgatggcgagccagttgttgaggacggaacctccgtgaaaacgctggagacactgcagcagcgtgtcaagaggcaggagaacttacttaagcgctgtaaagagacaatacagtctcacaaagagcagtgcacccttttaacgtccgagaaggaagccctgcaggagcagctggatgagcgtttgcaggaactggagaaaatcaaggaccttcacatggccgagaagaccaagttaattactcaattgcgtgatgcgaaaaacttgatcgaacagttggaacaggacaaaggcatggtcatcgctgaaacaaagagacaaatgcatgaaactttggaaatgaaggaagaagaaatcgcccagctcaggtcccggatcaaacaaatgacaacccagggcgaggagttgagagagcagaaggaaaagtcggagcgggctgcttttgaggagctggaaaaagccctatccacagcccagaaaaccgaggaggcccgacgaaaactaaaggccgaaatggatgagcagataaaaaccatcgaaaaaacatctgaagaggagcgaatctcccttcagcaggaactgtcccgtgtgaagcaggaggtggttgatgtgatgaaaaaaagcagcgaggagcaaattgcgaagctgcagaaattgcatgagaaggagctggctcgaaaggagcaggagctgactaaaaagctccaaaccagggaaagagagttccaagagcagatgaaggtagctttagagaaatcccagagcgagtacctgaaaatctcccaggagaaggagcagcaggagtcactggcgctcgaggaactcgaactccagaagaaggccattctcactgaaagcgaaaataaactgcgtgatctgcaacaagaggcagagacttatagaactaggatactggagctggagtccagcctagaaaagtcactgcaggagaacaagaaccagagcaaagatctggccgtgcatctggaagccgaaaagaataagcataacaaggaaattaccgtcatggtggaaaaacacaaaaccgaactagagagcttaaagcaccaacaagacgctctatggaccgaaaagctgcaggttctgaaacagcagtaccagaccgagatggagaaactgcgtgagaagtgtgagcaggaaaaggagacacttttaaaagacaaggagatcatctttcaagcccacatcgaggaaatgaatgaaaagaccctcgaaaagctggacgtaaagcagacggaattggagagcttgtctagcgagttgagtgaggtcctcaaggcgcgccacaaacttgaggaagaactgtcggtgctgaaggatcagacagacaaaatgaaacaggagttggaggctaaaatggacgagcaaaagaaccaccaccagcagcaggtggattccatcattaaggagcatgaggtcagcatccaacgtaccgagaaggcacttaaggatcagatcaatcagcttgagctcctgctcaaggaaagagacaaacatctgaaggaacaccaagcccacgttgaaaatttggaggcagatattaagcgcagcgaaggtgagctgcagcaggcttctgcaaagctggacgtgtttcagtcttaccagtcggcaacacacgaacagaccaaggcatacgaagagcagttggcccaactccaacagaaactcctggacctggaaaccgaaaggatcctgcttaccaagcaggtcgccgaggtggaagctcaaaagaaggatgtctgtacagagctggacgcacataagattcaggtgcaggatttgatgcagcagttggaaaagcaaaattccgaaatggagcagaaagtgaagtcgctgacccaggtctatgaatctaagcttgaagacggaaataaggagcaggagcagaccaagcagatacttgtcgagaaagagaatatgatcctgcaaatgcgcgaaggccaaaagaaagagattgagattctgacccaaaagctgagcgccaaagaagattccattcatatattgaatgaagagtacgaaacaaagtttaagaaccaagaaaagaagatggagaaggttaaacagaaagccaaggagatgcaggaaaccctcaaaaaaaaactgctagatcaggaagccaagttaaaaaaggaattggagaacacagcacttgagttaagccagaaggagaaacagttcaacgccaaaatgcttgaaatggcacaagccaatagcgccggtatttccgatgctgtttcacgacttgaaacaaatcagaaagagcagatcgagtcgttaacggaagtgcacagaagggaactgaatgacgtgatcagcatttgggagaagaaacttaaccagcaggctgaggagctacaagagatacatgagattcagctgcaagagaaggagcaagaggtggccgaactgaagcagaaaattttattattcggatgtgaaaaagaagagatgaataaagaaatcacatggctaaaagaggaaggcgttaagcaggataccaccctcaatgagttacaggaacagctgaaacaaaaaagcgctcatgtgaactcacttgcccaggatgagaccaaactgaaggcacacttggagaagcttgaggtcgacctcaacaaatctctcaaggagaatacttttttgcaggaacagttggttgagctcaagatgctggccgaagaggataaaagaaaagtgagcgaacttacctccaagctgaaaacaacggatgaggagttccagtccctgaagtcatcccacgaaaagagcaacaaaagcctcgaggacaagagcttggaattcaagaagttgagcgaagaactggccatccagttagacatctgctgcaagaagaccgaggccctgctggaagctaagaccaacgaactcataaacatttcatccagcaaaacgaatgccatcttatcaagaatcagccattgtcagcatcggaccacaaaggtgaaggaggctctgctcatcaagacgtgtactgtgtccgagctggaagcccagctgcggcagctgacagaagagcagaacaccctgaacatcagctttcagcaagccactcatcaattggaggagaaagaaaaccaaatcaaatcgatgaaggcagacattgagtctcttgtaactgagaaggaagcactacagaaagaagggggcaatcaacagcaggccgcttctgagaaggagtcctgtattacccagctcaagaaggaactgtctgagaacatcaacgccgttactctgatgaaggaggagctgaaggaaaaaaaagtcgaaattagctctctctctaagcagctgaccgacctcaacgtgcagctccagaactccattagtctgtcagaaaaggaggctgccatatcttctctgcgcaagcagtacgacgaggaaaagtgtgagttactcgatcaggttcaggacctgagtttcaaagtcgatacacttagtaaagagaaaatttcggccctggagcaggtggacgattggtctaataaattttcagagtggaaaaagaaggcccagtcaagatttacacagcaccagaatacagtcaaagagctgcagatacagctcgagctgaaatccaaagaggcctacgaaaaggacgaacaaattaatcttctgaaggaagaattggaccagcaaaacaaaaggttcgattgcctgaagggcgaaatggaggatgacaagagcaaaatggagaagaaggagtcaaacctggaaaccgaattgaaatcacagactgctcgcatcatggagttggaggaccacataacgcagaagaccatagaaattgagagcctgaatgaggttctaaaaaattataaccaacagaaggacattgagcataaagaacttgtgcaaaagctgcaacacttccaggagcttggagaggagaaggataatagagttaaggaggccgaagagaaaatccttaccctggagaatcaggtttattcaatgaaagccgagctggaaacgaaaaaaaaggagctcgagcacgtcaacttgtcagtcaagtcaaaggaggaagaactgaaggcgctagaagatcgactcgagagcgaatccgccgctaagctcgctgagcttaaaagaaaggctgagcagaagatagccgccattaagaaacagctgctgagtcagatggaggagaaagaagagcagtataaaaagggcaccgaatcccacctaagcgagttgaataccaaattacaagaaagagagcgcgaggtccatatcctagaggagaagctgaagtcggtcgagtctagccaaagtgagaccctcatcgtaccacgaagtgctaagaatgtggcagcttatacggagcaggaggaggctgatagccaaggctgtgtccagaaaacctatgaggaaaaaatctccgtcctccagcggaacttaactgaaaaagagaagctgctgcagcgcgtgggacaggaaaaagaagagactgtgagctcccactttgagatgcggtgtcagtatcaggagcgtctgatcaagctcgagcacgccgaggctaagcagcacgaggatcagagcatgataggacatctgcaggaagaattggaggagaagaacaagaagtattcacttatcgtggcccagcacgttgagaaggagggaggtaagaacaacattcaggccaagcagaatctcgagaatgtgttcgacgacgtccagaaaacattgcaggagaaagagctcacatgtcagatcctcgagcagaagattaaggagcttgatagttgcctggttagacagaaggaagtccatagggtcgaaatggaggagctcacttcaaagtatgagaaactccaagcactgcagcagatggacggacgcaataaacctacagaactcctggaagagaataccgaagaaaagtctaagagtcaccttgtccagcctaaattgcttagcaacatggaggcacagcacaacgacctggaatttaaattggctggagccgagcgcgagaaacagaagcttgggaaggagatagtcagactccagaaggaccttcggatgttgagaaaggaacaccagcaggagctggagattctgaagaaggagtatgaccaggaacgggaggaaaagatcaaacaagagcaggaggacctggaactgaaacataactccacgcttaaacagctaatgcgggagttcaacacacagttggcccagaaggagcaggaattagagatgacaatcaaggagacgataaacaaggcacaagaggtggaagccgaactgctggagtctcaccaggaagaaacgaaccagcttctcaagaagattgccgagaaggacgacgatctgaaacgaaccgccaagagatacgaggagatcttagacgcacgtgaggaagaaatgacggccaaggtgcgggacctacagacacagctggaagagctccagaagaagtaccaacagaagctagaacaggaggagaatcctggaaacgacaacgtaactattatggagctccagacccagctagcccagaagactactctcatctctgatagcaaactcaaagagcaagagtttcgagagcagattcacaacctggaggacagattgaaaaaatacgagaaaaacgtttacgcaacaaccgtaggtaccccatataagggaggcaatttatatcacactgacgtgagcctctttggagagccaacagaatttgagtatctgcggaaggtattgttcgagtatatgatggggcgcgagacaaagacgatggctaaggtgatcactacagtcctgaagtttcctgacgatcagactcagaagatccttgagagggaggacgcgagactgatgttcacatccccacggtccggtattttttag

SEQ ID NO: 118956 - DNA, 6732 bp, Artificial Sequence
  Description of Artificial Sequence: Synthetic coding sequence
atgttcaaaaagctgaagcagaagatttcagaagaacagcagcagctgcagcaggccctcgcacctgcacaggcttccagtaattccagcacgcctaccaggatgaggagccggacgtccagcttcaccgaacagctggatgagggaacaccgaatcgcgagaacgcttctacacatgcaagcaaatctcccgattcagttaatggcagcgaacccagcataccccagagcggtgatactcagagcttcgctcagaagctgcaactgcgagttcccagcgtcgagagcctgttcagatcaccgatcaaggaatccctgtttcgcagcagttctaaggagtctttggtgagaacatcctcccgcgagtctctgaaccgtttagatttagacagctctaccgcctctttcgatccaccttccgatatggattccgaagcagaagatttggtcggaaacagcgactctctgaacaaggagcagttaatccaaaggctcagacggatggaaagatctctctcttcttaccggggcaagtatagcgagttagtgacagcttaccaaatgctgcaaagggagaagaaaaagctgcaggggatattaagtcagtcgcaagacaagagcttgaggcgaatcgcggagctgcgggaggagttgcaaatggatcagcaggcaaaaaagcatctgcaagaggagtttgatgccagcctggaagaaaaagatcagtacatcagcgtgctccagacccaggttagccttcttaagcagaggctaaggaatggacctatgaatgtggacgtgctgaagccactccctcagttggagcctcaagccgaggtgttcaccaaagaggagaatcccgagagcgacggcgagcctgttgttgaagacggcacgtctgtgaagacgttagagaccctccagcaacgagttaagcggcaggaaaacctactaaagagatgtaaagagacgatccagtcacacaaagagcagtgtacgctgctcacctctgaaaaggaagctttacaggagcaattggacgagaggctgcaggaactggaaaagatcaaagacctgcacatggccgaaaagactaaactgatcacccagctgagagacgccaaaaacctgatcgagcagctggaacaggataaggggatggtcatcgcggagacgaagaggcagatgcacgaaactctggaaatgaaggaggaagagatcgcacagctgcggtcaaggattaagcagatgaccacccagggggaggaattgagggagcagaaggagaagtccgagcgggctgcttttgaggagctggagaaggccctgtcaaccgctcagaaaaccgaggaggcccgcaggaaactgaaggccgaaatggacgaacagattaagacaatagagaagacatcggaggaggaacgtatctctctgcagcaggagctgtcacgcgtgaaacaggaggtggtcgacgtgatgaaaaagtccagtgaagagcaaattgccaaattgcagaagttgcatgaaaaagaactagccaggaaagaacaggagttaactaaaaagctgcagaccagggagcgggaatttcaagaacaaatgaaggtagcccttgaaaagtcccagtcggaataccttaaaatatctcaggagaaggagcaacaggagtccctagctctcgaggagcttgagttgcagaagaaagcaatccttacggagagtgagaacaagctccgggatctgcagcaggaggcagagacttaccgcaccaggatactggagttagaaagctctctggagaaatcgctgcaagaaaataagaatcagagcaaggatctcgccgtacacctagaggctgaaaagaacaagcataataaggagatcaccgtgatggtggaaaaacacaagactgaactcgaatcactgaaacaccagcaggatgccctgtggactgagaaactgcaggtgctgaagcagcagtaccagacggaaatggaaaagcttcgcgagaagtgtgagcaggagaaagaaacactgttgaaggataaagaaataattttccaggcccacattgaagagatgaacgagaagaccctggagaagctggacgtgaaacagaccgaacttgaatctctgagcagtgaactgtccgaagttctgaaggctagacacaaactcgaagaagaactgtcagtgttaaaggaccaaaccgacaagatgaaacaggaactcgaggctaaaatggatgaacagaaaaaccaccaccagcagcaagtggactccatcattaaagagcatgaagtgagtattcaaagaaccgaaaaggccctgaaggatcaaatcaaccaactggagctgctgctgaaggagagagacaaacatttaaaggaacaccaggcccacgtggagaaccttgaagctgacatcaaacgcagcgagggcgaactccagcaagcttctgctaagctggatgtcttccaatcataccagtcggcgacacacgaacagacaaaagcctacgaggagcagctggcacaattacagcagaagctattggacctggagacggagcgaatcctgctaacaaagcaggtagccgaggtagaagctcaaaaaaaggacgtgtgcaccgaattggacgcccataaaatccaggtccaggacctaatgcagcaacttgagaaacagaattcagaaatggagcagaaagttaaatctctgacccaggtgtatgagagcaaacttgaagacggtaataaagagcaagagcagaccaagcagattttagtggagaaagagaatatgatccttcaaatgagagaggggcagaaaaaggagatcgaaatactaacacagaagctgagcgccaaagaggattcaatacacattttgaacgaggagtacgaaaccaaattcaagaaccaggaaaagaagatggaaaaagtaaagcaaaaagccaaagagatgcaggaaaccctgaagaagaagctgctcgaccaggaagcaaagctcaagaaagagttggaaaatactgctcttgagctgtcccagaaggagaagcagtttaacgctaaaatgctggagatggctcaggccaacagtgccggtatttccgacgccgtatcgcggctggaaaccaatcagaaagagcagatcgaatctctgactgaggtgcatcggcgggagcttaatgatgtcatcagcatctgggagaaaaagttgaaccagcaggctgaggagctccaggagatccatgaaatccaattacaagagaaagaacaggaagtggccgagctgaaacagaaaatcctcttattcggctgtgagaaggaagagatgaacaaagagattacatggttgaaagaggagggggtcaaacaggataccaccttgaacgaactccaagaacagctcaaacaaaaatcagctcacgtgaactccttagcccaggatgagaccaaactcaaggcccacctagagaagctcgaagtggatctgaataagagcttgaaagaaaacacttttctccaggagcaactggtggagctgaagatgctggcagaggaagacaaaagaaaagtttccgagttaacatcaaagctgaaaaccactgatgaggagttccaatccctgaagagctcccacgagaagtccaataagtcacttgaagacaagtccctcgagttcaaaaaattatcagaggaactggccatccaattagatatctgctgcaaaaaaaccgaggcactactggaagctaaaacaaacgaactcatcaacatcagcagtagcaaaaccaatgctatcctgtcaaggatctcccactgccaacataggaccaccaaagtcaaggaggctctacttatcaaaacttgtactgtgagtgagctggaggcccagctccgtcagttgacagaagaacagaatactctgaacatctcttttcagcaggcaactcaccagctggaagaaaaagaaaatcagattaagagtatgaaagccgacattgaatcactcgttactgagaaagaggctttgcagaaggaagggggaaaccagcaacaggctgcgagcgaaaaagaatcttgtatcacacagctgaaaaaggaactttccgaaaacatcaacgccgtgacacttatgaaggaggaactcaaggagaaaaaggtcgagatcagctcactctccaaacagttgaccgacctaaacgttcagctgcaaaactcaatttcgctgagcgagaaagaggcggcaatttcctcgctgcgtaaacagtacgatgaagaaaagtgtgagctactcgatcaggttcaggacctttcattcaaagtggataccctgtccaaggagaagataagtgctctggagcaggtggatgactggtccaacaagttctcggaatggaagaaaaaagcccagtctcgattcacgcaacatcagaataccgtgaaagagctgcagatccaactagagctgaagtccaaggaggcctacgagaaggacgaacagatcaatctcctcaaggaggaactggatcaacagaacaagcgatttgattgtcttaaaggagaaatggaggacgacaagtccaaaatggagaagaaagagtccaacctggaaacggaactgaaaagccaaaccgcaagaatcatggaactcgaagatcatatcacgcagaagacaatagagatcgaatctctgaatgaggtcctcaagaattacaaccagcagaaggacatcgagcataaggaacttgtgcagaaattacaacacttccaggagctaggggaagagaaggataatcgcgtcaaagaagccgaagaaaagatcctgacattggagaatcaggtgtacagtatgaaagccgaactcgagaccaagaaaaaggagttggaacacgtgaatcttagcgtgaagagcaaagaagaggaattaaaggctctggaggatcgcctagagagcgaatcagcagcaaagctggctgaacttaagaggaaagctgagcaaaagatcgccgcaattaaaaaacaactactgagccagatggaagagaaggaggagcagtataagaaagggacagagagccatttgtctgaactcaacaccaaattgcaggaaagggaaagggaagtacacatactagaggaaaagctgaaaagcgtcgagtccagtcaatccgaaacgctgatcgttcctcgatccgcgaaaaacgtcgccgcatataccgagcaggaggaagccgactcacagggctgcgtgcagaaaacatatgaagagaagatcagcgtgctgcagcgcaaccttaccgaaaaagaaaagctattgcaacgggtgggccaggaaaaggaagaaactgtgtcttcccactttgagatgcggtgccaataccaggagcggctgatcaaactggaacacgccgaggccaagcagcatgaggaccagagcatgatcgggcacctgcaggaggagctggaggagaaaaacaagaagtatagcctcattgtcgcccagcacgtagagaaggaaggcggcaagaataatattcaagccaaacagaatctggaaaacgtgttcgacgacgtccaaaaaaccctgcaggagaaagaattgacctgccagatcttggaacaaaagataaaggagttggatagttgtctcgtgcgacaaaaagaagtgcaccgggtggagatggaagagctgaccagtaagtatgagaaactgcaggcactgcagcagatggacggtcggaacaaacccacagagctgctggaggagaacaccgaggagaagagtaaatcccacctcgtccaacctaaactactgtctaatatggaggcccagcacaacgacctagaattcaagcttgccggtgccgagcgagagaagcagaagctggggaaggaaatcgttcggctccagaaagatttgcgtatgctcagaaaggagcaccagcaagagctggagattctgaagaaggagtacgaccaggagcgagaagagaagataaagcaggaacaagaagacttggaattgaagcataactcgactttaaagcagcttatgagggaatttaatactcagttggctcagaaagagcaggaactcgagatgacgataaaggaaacaattaataaagcccaggaagtcgaagctgagcttctggagtcccaccaggaagagactaatcagctcctgaagaagatcgccgagaaagacgacgatttaaagcgaaccgctaagagatacgaggagattctggacgcacgcgaggaggagatgacggcaaaagtgcgcgacctccagacccagcttgaggagctgcaaaagaaataccagcagaagctggagcaggaggagaacccaggcaatgataatacacagctggcgcagaaaacaacattaatctctgatagcaagctgaaagagcaggagttccgggagcagatccacaacttggaagaccgcctgaaaaaatacgaaaaaaatgtctacgccaccacggtgggaacaccatacaaggggggaaacctttaccacactgatgtttctctttttggggagcctactgaatttgagtatctaagaaaggtactgttcgagtacatgatgggaagggagaccaagacaatggccaaggtgattaccacggtgcttaaattcccggacgaccagacgcagaaaattctcgagagagaggatgctagactgatgtcgtggctgcgcagtagcagctag

SEQ ID NO: 118957 - DNA, 2196 bp, Artificial Sequence
  Description of Artificial Sequence: Synthetic coding sequence
atgtcgtggtttgtggatttagcagggaaagctgaggaccttctgaatcgggtagatcagggagccgccaccgctctttctcggaaggacaatgcctcgaacatatatagtaaaaatactgactacactgagttacatcaacagaacacagacctaatttatcagaccggcccaaagtcaacatatattagcagcgctgccgataacatcaggaatcagaaagcaaccattctggctggaaccgccaacgtgaaggtgggaagccggactcctgttgaggcgtcacacccagtggagaatgcttctgttccacgcccctcctctcacttcgttcggcgcaaaaaatcagagccagacgacgaactgctctttgattttctgaactcatctcagaaggagcctaccgggcgcgtagagatcaggaaagagaagggcaagacaccagttttccagtcatcccagacttctagcgtctcctctgtcaacccaagcgtgaccactataaagactatcgaggaaaactcatttgggagtcagacacacgaggctgcttctaattctgacagttcccacgagggccaagaagagagctccaaagagaacgtatcctctaacgccgcttgtcccgatcacacacccacccccaacgatgacggcaagagtcacgagctgtctaatctgagactggagaaccagctgcttcgcaacgaggtacagtctctgaatcaggagatggcttctctgttacagcgatcaaaagaaactcaggaagagcttaacaaggcacgggcccgcgttgaaaaatggaacgccgatcactcaaaaagtgatcgcatgaccagaggccttcgcgcccaggtggacgatttaacagaggcggtcgccgcaaaagacagccagttagcagtgctcaaagttaggcttcaagaggcagatcagctgctaagcactagaaccgaagcactggaggcactgcagtccgaaaaatctaggatcatgcaagaccagagcgaaggcaactccttgcagaatcaggctctgcagaccttccaggaaagattgcacgaagctgacgcgacattaaaaagggaacaggagtcctataaacagatgcaatctgaattcgctgctagactgaataaggtggagatggagaggcagaacctcgctgaggctattactctggcggaaaggaaatattctgatgagaagaaaagggttgacgaattgcagcaacaggtaaaattatacaagttaaacctggagtcctctaagcaggaattgatcgattacaagcagaaggctacaaggatactgcagtcgaaagaaaaactgatcaactccctgaaggagggcagcggctttgagggactcgattccagcaccgcgtcttctatggagctggaagagctgaggcacgagaaagaaatgcagagagaggagatccaaaagctgatggggcagattcaccagttaagatcggaactgcaagacatggaagcacagcaggtcaacgaagcagagtccgcgagagaacaactgcaggatctgcatgaccaaatcgccggccagaaggcctctaaacaggaactggaaacagagctggagagattgaaacaagaatttcactacatagaggaagacctgtaccgaaccaagaatactctacagagtcgtatcaaggatagagacgaagagatccagaagcttcgcaaccagctgacgaataagacccttagtaactcttcacagtcagaactggagaacagattacaccaactcaccgaaaccttaatccagaagcaaacaatgctggagtcgctgtccactgaaaaaaattccctggtgttccagctagagcggctggaacagcagatgaactcagccagtggctcaagctccaacggctcctcaattaacatgtctggaattgataacggcgaagggacccggctgagaaacgtccccgtcctgtttaacgacactgaaactaatctggctggcatgtatggaaaggtccgcaaggctgcctcatcaatcgaccagtttagtatcaggcttggaatcttcctcaggaggtacccaattgccagagttttcgtgatcatctacatggccttgctgcatctctgggtcatgatcgtgctgctgacatacaccccagagatgcatcatgatcagccatacggcaaatag

SEQ ID NO: 118958 - DNA, 2076 bp, Artificial Sequence
  Description of Artificial Sequence: Synthetic coding sequence
atgtcctggttcgtcgatctcgccggtaaggctgaggatctactaaacagagttgatcagggggctgccactgcattaagtaggaaggacaatgcaagcaacatctatagtaagaataccgactatacagaactccaccagcaaaatacggatctgatttatcagacaggcccaaaatccacctacatttcatctgctgccgataatatcagaaaccagaaggcaaccattctggccggtactgccaacgtgaaagtagggagtcggactccggtcgaggcttctcacccagtcgagaacgcaagcgttcctcgccccagctctcatttcgttagacggaaaaaaagcgagccagatgacgagctcttattcgactttctcaactcttcccaaaaggagccaacggggcgggtggaaatcagaaaggaaaaaggtaaaacaccagtgttccagtcctctcaaacctcatccgtgtcatctgtcaaccctagtgtgaccactatcaagactattgaggagaattcttttggctcccagacgcacgaggccgccagcaacagcgactcaagccatgaagggcaggaagagtcctctaaggagaacgttagctcgaatgcggcctgccctgaccacacccctactcctaatgatgatgggaagagccacgaattaagtaaccttagactggagaatcaactgctcaggaacgaagttcagtccctgaatcaagaaatggcctcactcctccaacgatcaaaggagacacaggaggaattgaataaagccagggctcgcgtcgaaaagtggaacgccgaccacagtaaaagtgatcggatgacccgaggactgagggcccaagtggacgacctcaccgaggccgtcgccgctaaagactctcagctagccgtgctcaaagtgcgactccaggaggcggaccaattgctttccacaaggacggaagccctggaggccctccaaagcgaaaaatcccggatcatgcaggatcagagcgagggaaactctctgcagaatcaggcccttcagacgtttcaggaacgcttgcacgaagctgacgcaactttaaagagggagcaggagagctacaagcaaatgcaaagcgaatttgccgccaggttaaacaaagtggaaatggaaaggcagaatctggccgaggccatcactttggccgagaggaaatacagcgacgaaaaaaagagggtggacgagctgcagcagcaggtgaaactttacaaattaaacctggagagttctaagcaggaacttatcgattacaagcagaaggctacacgcattctccagagcaaggaaaagctgataaactcactgaaagaggggtctggattcgaggggctcgactctagcactgcctcaagtatggagctggaagaactccggcacgaaaaggagatgcaaagagaagagatccagaagcttatgggacagatccaccagctcaggtccgagttgcaggacatggaagcccagcaggtcaacgaggccgagagcgctagagagcagttacaagatttgcatgaccagattgcaggccaaaaagccagtaaacaggaactcgagacagagctggaacgactgaagcaagagttccactacatcgaagaggatctgtaccggacaaaaaataccctgcaatccaggatcaaagatcgggatgaagagatccagaagctcagaaaccagttgacaaataagaccctgagtaactcaagtcagagtgagcttgaaaacagattgcaccagcttacagagaccttaatccaaaagcagacaatgctagagagtctcagtacagagaagaattctctcgtcttccagttagaacggcttgagcagcagatgaactccgctagcggaagttcatcgaatgggtccagcattaacatgtcaggtattgataatggagaaggcacaagactgcgtaacgttccagtcctgttcaacgatacagagacaaacctggctggcatgtatggtaaggtacggaaggccgccagttccattgaccaattccggttatgtttcaccagcggctcctag

SEQ ID NO: 118959 - DNA, 1923 bp, Artificial Sequence
  Description of Artificial Sequence: Synthetic coding sequence
atgtcctggttcgttgatctcgccggaaaggccgaagacctcctaaatcgtgtcgaccagggggccgctactgccctgtcaagaaaggacaatgccagtaatatctacagcaagaacaccgattataccgagctccaccagcagaataccgatttgatctaccagacgggacctaaaagtacatatatctcttcagccgctgataacatacggaaccaaaaagccactattaagacaattgaggagaactcattcgggagtcagacacatgaagctgcctcgaactcagacagttcccacgaaggtcaagaggaaagctcaaaggaaaatgtctcatcgaacgctgcctgcccagatcatactccgaccccaaacgatgatggcaagtcccacgagctgagcaatttaaggcttgagaatcagctgctgagaaatgaggtgcaatcattgaaccaagaaatggcctcgctcctccaaagaagcaaggaaactcaggaagagctgaacaaggcccgagctagggtggagaagtggaatgcagatcatagtaagagcgacaggatgacacgtggcctccgcgcacaagtagatgatcttacggaggctgttgctgccaaggatagtcagttggccgttcttaaagtgcgccttcaggaagcagaccagctcctatctactcgcacggaagcactcgaggccctccaaagtgagaaatcaagaattatgcaggatcaatctgagggcaattcactccagaatcaggccctccaaacctttcaggaacggcttcacgaagccgatgcgactttaaagagagaacaggagagctataagcagatgcagtcagagttcgcggcacggctcaacaaggtggagatggagcgccagaacttagccgaggcgattaccttggctgagaggaaatattctgacgaaaagaagagggtcgacgaacttcagcagcaggtcaaactgtataaacttaatttagaatcgtcgaagcaggaacttatagactacaaacagaaagccacaagaattctgcaaagcaaggagaaactgattaacagcctgaaagagggctctggcttcgaaggacttgacagctctaccgctagctctatggaactggaggagctgcgtcatgagaaggaaatgcaacgggaggagatacagaagctcatgggtcagatccaccaacttagaagtgaacttcaggatatggaggctcagcaggtaaatgaagctgagagcgcacgtgaacagctccaagatctgcacgaccagattgctggccagaaagccagcaagcaggagttagaaacagaactcgagcgtctgaagcaggagttccattatattgaagaggacttgtataggaccaagaacacactgcagagtaggatcaaagatagagatgaagagatacaaaagctgcgcaatcagctgacgaataagacgttatccaattcctctcagtccgaattggagaaccgcctccatcagctgaccgagactctcattcagaagcagaccatgttggagtccctgagtacggagaagaatagtctggtctttcaactcgagaggcttgagcagcaaatgaattcggcatctggttcttccagtaacgggtcctcgataaatatgtccgggattgacaatggggaggggacacgcctcagaaacgtgccggtgctatttaacgacaccgagactaacctggccggcatgtatggtaaggtcaggaaggcagcgtctagcatcgaccagttcagcatcaggttaggtatcttcctgagaaggtatcccatcgcacgggtgtttgtgattatctatatggctctcctgcatttgtgggtgatgatagttctgctcacatacactccagagatgcaccatgaccaaccgtatggaaaatag

SEQ ID NO: 118960 - DNA, 504 bp, Artificial Sequence
  Description of Artificial Sequence: Synthetic coding sequence
atggccaccgaggtacacaatctgcaagagctcaggcgaagcgcctcactcgccactaaagtgttcatccagagggactattccgacggcaccatttgccagttccagacgaaatttccaccagagctcgactcacggatcgagaggcaactctttgaggaaactgtgaaaactctgaacggcttctatgccgaggccgaaaagattggggggagctcttacttggaaggctgcctggcctgtgctaccgcgtactttatctttctctgtatggagacacactatgaaaaggtgctgaagaagataagtaggtacatccaggagcagaatgaaaaaatattcgccccccgcggtctccttcttacagatccggtggaaagaggaatgcgcgttatcgagatatctatctacgaggatagatgctcatccggcagcagttcctctggttcgagcagcggctcagggagtagttccggtggcggagggggagctggtgcacgctag

SEQ ID NO: 118961 - DNA, 1812 bp, Artificial Sequence
  Description of Artificial Sequence: Synthetic coding sequence
atggccgaagaaaccggacagtccaaattggctgctgcgaaaaagaaatttaaagagtactggcagcggaataggcctggtgttccggccgccgctaagcgcaacaccaaggctaacggcagcagccccgaaaccgccgcgagtggcggctgtcatagttctgaggcttcatctagcgcctcgagctctctgcacgctaggcagtccccttgtcaagaacaggctgctgtcctaaattccagatccatcaaaatttcacgacttaatgacaccattaagtccctgaagcagcagaaaaagcaggttgagcaccagctggaggaggagaaaaaagccaataatgagaaacagaaagctgaacgcgaactcgaggggcaaattcagagactgaataccgaaaagaagaaactaaataccgacctttaccacatgaaacactccttaaggtacttcgaggaagaatcaaaggacctggcagggcggcttcaacgatcatctcagaggattggcgaactagagtggtcactctgcgccgtggccgccacacagaagaagaagcccgacggtttcagcagccggtctaaggctctgctgaaacgacaactggaacagtcaatccgggagcagattctgctgaagggccacgtcacccaactcaaagaatctttgaaggaggtgcagttggaaagggaccagtatgccgaacaaatcaagggggaaagagcccaatggcaacagcggatgcgaaaaatgtctcaagaagtgtgtaccctgaaggaggagaagaagcacgacactcaccgcgtcgaagagctcgagcgctccctctctaggctgaaaaaccaaatggccgagcctcttcctcccgacgcccccgccgtgtcaagcgaggtggaactgcaggacctgcgtaaggagctcgagagggtcgccggcgaattacaggctcaggtagagaataatcagtgcatcagcctgctcaataggggccagaaggagcgcttgcgggagcaggaggaacggttgcaggaacagcaggagaggctgagggaacgtgaaaaaaggctgcaacagttagcagaacctcagagcgacttggaggagctgaaacacgagaataaatccgccctccagctggagcagcaagtgaaggagctgcaagaaaaactcggacaggtgatggagacgctaaccagtgcagagaaagagccagaagccgccgttcctgcgtccggcacaggtggcgagagcagcggtctgatggatttgctcgaggaaaaggcagatctccgagagcatgtggaaaaacttgaacttggctttatacagtaccgcagagagaggtgccatcagaaggtacataggctgctgaccgagccaggggactccgccaaggacgcctcgcccggaggcggacaccaccaagcggggccagggcagggcggagaagagggtgaagctgccggcgccgcaggcgacggtgttgctgcttgcggttcttacagcgagggtcatggtaagtttctggccgctgccaggaacccggctgccgagcccagtccaggtgcccccgctcctcaggaactaggggctgctgacaaacatggcgatctctgtgaagcatctctgacaaactctgtggaacctgctcagggcgaagctcgcgagggctcctcgcaggacaacccgaccgcacagccggtcctgcagcttttaggcgagatgcaggaccaccaagaacatcccggactaggatctaattgttgcgtgccttgcttttgttgggcatggctgccgcggaggcggaggtag

SEQ ID NO: 118962 - DNA, 1485 bp, Artificial Sequence
  Description of Artificial Sequence: Synthetic coding sequence
gaaaagaaggcaaataacgagaagcagaaggcagagcgtgagttggaagggcaaatccagcgcctgaataccgaaaaaaaaaaactgaatactgatctatatcatatgaagcacagcttgaggtacttcgaggaagagagtaaagatctcgcaggtcgacttcagaggtcttcccagaggataggtgaactggagtggtccttgtgtgccgtggcggctactcagaagaaaaagcctgacggcttttcaagccgctccaaggctctgctcaaaagacaacttgaacagtccattcgggagcagattcttctgaaaggccatgtgacacagttgaaggaaagtctgaaagaagtgcagctcgagcgtgaccagtacgcagaacagattaaaggagagagggctcaatggcaacagcgaatgcgcaagatgagccaagaagtttgcactttgaaagaggagaagaagcacgatacccaccgagtcgaagagctagagagaagcttgtcccgcctcaaaaatcagatggctgagccactgccccctgatgcccctgccgtgtcctcagaagtagagctacaagatctaaggaaagagctcgagcgtgtggctggcgagctgcaggcccaagtcgagaataaccaatgtatcagtttgttaaaccggggccagaaggagagactgcgggagcaggaagagaggctacaggaacagcaggaaaggctcagagagcgagagaagcgattacagcagcttgcagagccacagagcgaccttgaggagcttcacgagaataaaagcgctctgcaactggaacaacaggtgaaagaactacaagaaaaactcgggcaggttatggagactctgacaagcgccgagaaggaaccagaagctgccgtcccagcctccggcaccggcggggaaagcagcggcctgatggatctgctggaagagaaagcggatttgcgagagcatgtggaaaagctcgaactgggctttattcagtatcggcgtgaacgctgccaccagaaggtccacaggctgctgaccgagcctggagactcagcgaaggatgcctccccaggcgggggccatcaccaggctggtcccggccagggcggcgaagaaggggaagccgcaggcgctgccggagatggcgtggctgcttgtggctcatactcggagggacacggaaaatttttggccgccgccagaaatcccgctgccgagccctctcctggagcacctgcacctcaggaacttggcgccgctgataagcatggagatctgtgtgaagcttccctaaccaattccgtcgagcctgctcagggagaggcacgcgaagggtcaagtcaggataacccaaccgcccagcctgttctccagctgctcggggaaatgcaagatcaccaggagcaccctgggctgggcagcaattgctgtgtgccgtgtttctgctgggcttggctgcctcgacgacgccgctag

SEQ ID NO: 118963 - DNA, 1812 bp, Artificial Sequence
  Description of Artificial Sequence: Synthetic coding sequence
atggccgaagaaactggccaaagtaaacttgctgccgccaagaaaaagtttaaggaatattggcagcgaaataggcctggagtccctgctgctgcaaagcgaaacacgaaagctaacggctcttcacctgagactgcagcatctggaggctgtcattcaagcgaagcatcttcctcagcctcgagctctctgcacgccaggcagtccccctgtcaagaacaggcagcagtgctgaactcccggagcataaagatcagtcgcttaaacgacaccattaaatcgctgaagcagcagaagaaacaggtggaacaccagcttgaggaagagaagaaggccaataacgagaagcaaaaagccgagcgggagcttgaaggacagattcagaggttaaacaccgaaaaaaagaagctcaacaccgatctctatcacatgaaacacagcctccggtacttcgaagaagagtcgaaggacctcgccggtagactgcagcggtcctctcagaggatcggggaactggaatggtccttgtgtgccgtggccgccactcagaagaagaagcctgacggatttagttccagaagcaaggcactcctgaagagacagctcgaacagagcatcagagagcagatactgctcaaagggcatgtcacccagctgaaggagtccctcaaggaagtccagctggagagagatcagtacgccgagcagataaagggagagagggcgcaatggcagcagcggatgcgtaagatgtcccaggaggtctgcacgctgaaggaagagaaaaagcacgatactcatagggtcgaggagttggaacgtagcctgtcacggctcaagaaccaaatggccgagccgctcccccccgacgcacccgccgtttcctctgaagttgagcttcaggatctacggaaggaattggagcgggttgccggggagctgcaggctcaagttgaaaacaatcagtgcatcagtctactgaatcggggccagaaggagcgactccgagagcaagaagaaaggctacaggaacagcaggagcgccttagggaacgggagaagcgactccaacagctggccgagcctcaatcagaccttgaggagctgaagcatgagaataaaagcgctctacagctggagcagcaggtgaaggagctccaagaaaagttaggccaggtgatggagacactgaccagtgcagagaaggaacccgaggccgccgtccctgccagcggcaccgggggcgagtcctccggcctgatggacctgctggaggaaaaggcagaccttcgtgagcacgtggaaaaactggagttgggatttattcagtatcgcagggagcggtgtcaccagaaggtgcaccgcctgctgactgagcccggagattccgctaaagacgccagtccgggaggcggacatcatcaggctgggccaggccaggggggcgaggaaggcgaggcagctggtgcggcaggagatggcgtggcagcatgcggatcatatagcgagggccacggtaagttcttggcagctgcacgtaatcctgctgccgagccatctccaggagcccccgccccacaggaacttggcgctgctgacaaacatggcgacctgtgtgaggcctcactcactaatagcgtggaaccagcacagggggaggcacgcgaaggttcctcccaagacaaccccactgcccagccagtcttacagctgctgggcgagatgcaggatcatcaagaacacccaggcttgggaagcaattgttgcgtgccgtgcttttgctgggcgtggctgccccggaggagacggtag

SEQ ID NO: 118964 - DNA, 1902 bp, Artificial Sequence
  Description of Artificial Sequence: Synthetic coding sequence
atgttacccgtcgatggcgaggagcggaagtccgaagggtccgatacagaaggcgataggacctcgccttgcgccggccctacatctagcgctacactgaaagatctggaagtcggcggttctggttggcgttgcagcgaccccgctggacagcccagtaatctgttgccccagagggggttgggtgcacccttgcctgctgaaacagcgcatacacagccctcacctaacgatcgcagcctttatttgtcgcccaagtccagctccgccagtagttcccttcatgctcgacagagcccatgtcaggaacaggcagcggtcctgaatagccggagcatcaaaatcagccggctcaacgacacgattaagtcgctgaagcagcaaaagaaacaggtggaacatcaactggaagaagaaaagaaggcaaataacgagaagcagaaagcagagagggaactcgaaggccagatccaacgcctcaacactgagaaaaaaaagctcaacaccgatctttatcacatgaagcactccctgaggtatttcgaggaggagagcaaagacttagcgggacgccttcaacgctctagccaacgaatcggggaactggagtggtccctgtgcgccgtggccgccacacagaagaagaaaccagatggattttcatctcgttcaaaggccctgctgaaaagacagcttgagcagtccatccgcgaacagattttactgaagggccatgttacacagctgaaagagagcttaaaggaagtgcagttggagcgagaccagtacgccgagcaaatcaaaggagagcgcgcccagtggcagcaacgtatgcgcaaaatgtcccaggaggtgtgcaccctgaaggaagagaaaaagcatgacacccatagggtggaggaactggagagaagcttaagccggctcaagaaccagatggctgagccattacctccggacgcaccggcagtttccagcgaagtggaactgcaggacctgcggaaagagctggagagggtcgcaggggagctgcaggctcaggtcgaaaataatcaatgcataagtctgctgaaccgcggtcagaaagaacgcctacgggaacaggaagagagacttcaggagcagcaggagcgactccgcgaaagggaaaagcggcttcagcagctggccgaacctcagagcgatttagaggagctcaagcacgagaataagtcggcactgcagcttgagcagcaggtgaaagaattacaagagaagttgggccaagtaatggaaactctgacatcggcagagaaggagccagaggcagcagtgcctgcatctggcacgggtggcgagtcctctgggctcatggatttactcgaagagaaggctgatcttagggaacatgtcgagaagctggaactgggtttcatccagtacagaagggaacggtgccaccagaaggtccaccggctgctaacggaacccggcgacagcgccaaggacgcctccccgggcggcggccatcatcaagccgggccaggtcaaggtggggaggagggagaggctgccggggccgccggggacggagttgctgcttgtgggtcttactcagaaggtcacggtaagtttctcgcagccgctaggaacccagctgctgagccctctccgggagcccctgctccacaggagctcggagctgccgacaagcacggagatctttgcgaggcctctctcactaacagcgttgaaccagcgcagggcgaagcacgcgagggcagtagccaggataatccaactgctcagcctgtgctacagctgctgggggaaatgcaggatcaccaggaacatccaggattgggcagtaactgctgcgtgccttgtttttgctgggcttggttgcctaggcgccggcgctag

SEQ ID NO: 118965 - DNA, 9780 bp, Artificial Sequence
  Description of Artificial Sequence: Synthetic coding sequence
atgctttctcggctaagtggcttggccaacgtggtcctccatgaactgagtggcgatgacgataccgatcagaacatgagagctccgctggatcctgaacttcaccaagagtcagatatggaattcaataataccacgcaggaggatgtccaggaacggctagcctacgcggagcaactggtggtcgaattgaaggatattattcggcagaaagacgtccagctgcagcagaaagatgaagccttacaggaagagcgaaaggcagccgacaataagatcaaaaaactcaagctgcatgccaaagcaaaattgacaagcttaaataagtatatagaagagatgaaggcacaaggtggtacagtcctcccgacagagccccagagtgaagaacagttgtcaaaacatgataaatcctctaccgaagaagaaatggagattgagaaaattaaacataagctgcaggaaaaggaagagttgatatcaactctacaggctcagctgacacaagcacaggcagagcagcctgctcagagtagtactgaaatggaagagtttgtcatgatgaagcagcagctgcaggagaaggaggaattcatctctacactccaggcgcagctatctcagacacaggctgaacaggccgctcagcaggttgtcagggaaaaggatgcgaggtttgagacacaggttaggctgcacgaggatgaactcctccagctagttacccaggctgacgtagagactgaaatgcagcaaaagctgagggtgctgcaacggaaattagaagagcacgaagaatccctcgtgggcagagcccaggtagtggatttactccaacaagagttaactgctgccgaacagaggaatcagatcctgagccagcaactgcagcagatggaggcggaacacaatacgctgcgtaacaccgtggagacagaacgcgaagaatctaaaatcctccttgagaagatggagctggaggtcgctgaacgcaaactgtcattccataatctgcaggaggaaatgcatcatctgctcgaacagttcgaacaggctggacaagcacaggctgagctggagtctcgatactcagctctggaacagaagcacaaagcggagatggaagagaaaacctcacacattctttctctgcagaagacaggacaagaactgcagtcagcctgtgacgcccttaaagatcagaattcgaaactactccaagacaaaaacgaacaggccgttcagtctgcgcaaactatccaacaacttgaggaccaactgcagcaaaagagcaaggagatctcccagttccttaaccgactccctctgcaacagcacgagaccgcctcacagacctcattcccagacgtgtataacgagggaacccaggctgtcactgaggagaacattgcttccttgcagaagcgggtcgtagaactggaaaatgaaaagggtgccctcttattgtctagcatcgagttggaagagctaaaggctgagaatgagaagctgtcctcacagatcaccctgctcgaggcccagaaccgcactggtgaggcggatagggaagtaagcgaaatcagcatagtagacatcgccaacaagcgcagctcctcagcggaagaatcaggtcaagatgtcttggaaaatacctttagccaaaaacacaaggagttgagcgtgctgctgctggagatgaaggaggcccaagaagagattgcatttctgaaactacagttgcaaggcaagagggcagaggaggctgaccacgaagtcttggatcagaaggaaatgaagcagatggaaggggaggggattgcccccataaagatgaaagtctttctcgaggacacagggcaggattttcccttgatgccaaacgaggaatcaagcctgcccgcagtcgagaaggagcaggccagcacagaacaccaatcacgcactagtgaggaaatctccctgaatgacgccggcgtggagctaaagagcaccaagcaggacggcgataagtcactttcagctgtgccagacatcggacagtgtcatcaggacgaactggagcggctcaagagtcaaatcctagaactggagttgaactttcataaagcacaggagatttacgagaagaaccttgacgaaaaagccaaggagataagtaatctcaaccagctcatagaagagttcaagaagaatgccgataataacagttctgcattcacagccctctccgaggaacgtgaccagctactgtcacaggtgaaagagctctctatggtgacagagctacgggcacaggtcaagcaacttgaaatgaatctcgcagaagcggaaagacagcgccggttggattatgaatcacaaaccgctcacgacaacctgttgaccgaacagattcacagtttaagtatcgaagccaaaagtaaagacgttaaaattgaggtgctgcagaatgagctggacgatgtccagctccagttctctgaacagagtactttgattcgatccctccagagtcagctacagaataaggaatccgaggtcctcgagggggccgagcgcgtgagacacatctcatcaaaggtggaagaattatcacaagccctgtctcaaaaagagctggagattaccaagatggatcagcttctgctcgagaaaaagcgggacgtagaaacactgcaacagacgatcgaagagaaggaccaacaagttaccgagatcagttttagcatgacggagaaaatggtgcagctgaatgaagaaaagtttagcctcggggtggagatcaaaaccctgaaggaacagctgaatctgttatctagggcagaggaagccaagaaagagcaggttgaggaggataacgaggtcagcagcggactgaaacaaaactatgatgaaatgtctccagccggccagatcagcaaagaagagctccagcacgagttcgaccttctgaaaaaggaaaatgagcagaggaagcgcaagctgcaggcggctctcattaacagaaaggagcttctccagcgcgtgtctcgcctcgaggaagaactcgctaatcttaaagacgaatctaagaaggagatcccactgtctgaaacagagcggggagaagtcgaggaggataaggagaacaaggaatattccgagaagtgcgtcacctccaagtgccaggagattgaaatatacctcaaacagactataagcgaaaaggaggtggagctgcagcatataaggaaggatctagaggagaagctggcagcagaagagcagtttcaggccctggtgaagcaaatgaatcagacgctccaggataagacgaaccaaatagacctgcttcaggcagaaatctcagaaaaccaggcaataattcaaaaactcataacatcaaacaccgacgcaagcgacggcgactccgtcgccttggtgaaagagacagttgtaattagccctccctgtacaggatcttccgagcactggaagcctgagctggaggagaaaatcctggctctggagaaggagaaggaacagttacagaaaaagctgcaggaagctttgacatcccggaaggcgatccttaaaaaggcacaggagaaagaacggcatttgagggaggagctaaagcagcagaaggacgattataaccgcctacaggagcagttcgatgaacagtcaaaggaaaatgagaatatcggcgatcagttaaggcaactccaaatccaggtgagagagagcatcgatggaaaactgcccagcaccgatcagcaggaatcttgctcatcaacccccgggctcgaagaacctctgtttaaagccaccgaacagcatcacacccagcctgtgttagagtctaatttgtgcccggactggccttcccactcagaggacgcatcagcactgcaaggggggacatctgtggcccagattaaagcccagttgaaggaaatcgaggcggagaaagttgagctggaactcaaggtctcctccacgacctcagagctcaccaagaagagcgaagaggtgttccagctccaagagcagattaataaacaaggactggagatcgaatcgctgaaaacggtgagtcacgaagccgaggtccatgccgagtcacttcagcagaagcttgaatctagccaactgcagatcgctggccttgagcacctcagggaactgcaacccaaactagacgaactccaaaagctcatcagtaagaaagaagaagatgtcagttacctgagcggccagctatcagagaaagaagctgcgttgactaaaattcagacggagattatcgagcaggaagacctgatcaaggcactgcatacacagctggaaatgcaagccaaggaacatgacgagaggatcaagcagcttcaggtggaattatgtgagatgaagcagaaacccgaggagatcggcgaagagtctcgcgcaaaacaacagatccaaaggaagctgcaggcggccctgatctcacggaaggaggctctgaaggagaacaagtctctgcaggaggaattgagcctggcgcgaggaacgattgagcgcctcacaaaaagtctggcagacgttgagagccaggtctctgcccagaataaggagaaagataccgtgctgggccgcctcgcattgctacaagaggaacgagacaagctcattaccgagatggatcggtccttgttggagaatcaatccctgtcttccagctgtgagagcttaaaactggcgttggaaggtctgaccgaggataaggagaaactggttaaggagattgaatcactgaagtcttcgaagatagccgaaagtacagaatggcaggaaaagcataaagagttgcagaaagagtacgagatcctcttgcaaagctacgagaacgtaagcaacgaggccgagcggattcagcatgtggtggaagccgttcgtcaagaaaaacaggaactgtacggaaagctccgcagtaccgaggcaaataagaaagagactgagaaacagctgcaggaagccgaacaggagatggaggagatgaaagaaaagatgaggaaattcgccaagtctaaacagcaaaagatcctcgagctggaagaggaaaatgaccggctgagagccgaggttcaccctgctggcgatactgcaaaggagtgcatggagactctgcttagcagcaacgctagcatgaaggaagagttggaacgggtgaagatggagtacgagacccttagcaagaagttccagagcctcatgtctgagaaagactccctgagcgaagaggtccaagacttaaagcaccagatcgaggggaacgtaagtaagcaggcgaatttagaggccacagaaaagcacgacaatcagacgaacgtaaccgaagagggcacccagagtatcccgggagagactgaagagcaagacagcttatctatgagcacacgccccacctgtagcgagagcgtgccctctgctaagagtgctaatcctgccgtttccaaagattttagtagccacgatgaaattaataattacctccagcaaatcgatcagctcaaagagaggatcgcaggtctggaggaagagaaacagaaaaacaaggaattctcccaaaccctggaaaacgagaagaataccctgctgagtcagatttccactaaggatggtgaactcaaaatgctccaggaggaagtgactaaaatgaacttactcaaccagcagatccaggaggaactttctcgggtcacaaaactgaaggaaaccgctgaggaggagaaagacgatctggaggaacgattgatgaaccagttagcagagctcaatggaagcatcggtaactattgtcaagatgtgaccgatgcccagattaagaatgagctattggagagcgaaatgaagaacctaaaaaagtgcgtcagcgagttagaggaggaaaagcagcagctggtgaaagaaaaaacaaaggtcgaaagcgaaattcggaaggaatacctggaaaaaatccagggggcccagaaggagcctgggaataaatctcatgctaaggagctgcaagaacttctgaaggagaagcagcaggaggtcaagcagctgcagaaagactgcattagatatcaagagaagatcagtgcactcgagcgcacagtgaaagccctggaattcgtgcagacggagtcacagaaagatttagagatcactaaagagaacttggcacaggcagtggagcacaggaaaaaagcccaggcggagttggcgagttttaaggtgctcctggacgacacccaaagtgaagccgcccgtgtgctcgctgataaccttaagctcaagaaagagctgcaaagcaataaggaatccgtgaagtcccaaatgaagcagaaagatgaggacttagaacgaaggttagagcaggccgaggagaagcatttgaaagagaagaaaaacatgcaggaaaagctggacgcgctcaggagggagaaagtccatctggaagagaccatcggcgaaattcaagttactctcaacaagaaagataaagaggtgcaacagttgcaggagaatctggattcgacagtcacccagctggctgccttcaccaaatccatgagttcccttcaggatgaccgagacagggtgatcgacgaggctaaaaagtgggaaaggaagttcagtgatgccattcagtccaaagaagaggagattcgcctgaaggaagataattgctccgtgcttaaagaccaactgcggcagatgtcaatacatatggaagaactcaaaataaatatctctcgcttggagcacgacaaacagatctgggagagcaaagcacagacagaggttcagctccagcagaaagtttgcgacacattgcagggagagaacaaagaactcctgtctcaactcgaggaaactcggcacctttatcattcctcccagaatgaactggctaagctggaaagcgagctcaagtcattgaaagaccaactgacagacctgtctaattccctcgagaaatgcaaggagcagaaggggaatcttgaaggcatcataaggcagcaggaggccgacatccagaactctaagttttcctatgagcagctcgagaccgatcttcaggcatctagggaacttacatcccgtctgcacgaggagatcaacatgaaagagcaaaagattattagcctcttgtcgggaaaggaggaggcaatccaggtcgcaattgctgaactgagacaacagcacgacaaggagatcaaagagctggaaaacttactatcccaggaagaggaggaaaatattgtgctggaggaggaaaacaagaaggcagttgataaaactaaccagctgatggaaacattaaagacaatcaagaaggaaaacatccagcagaaagcccagctggatagtttcgtgaaatctatgtctagcctgcagaatgacagggataggattgtgggagactaccaacagttggaggagcggcatctgtccatcatcctcgaaaaggatcagctcatacaggaggccgctgcagagaacaacaaactgaaggaggagattagaggtctccgatcacacatggatgatcttaacagcgaaaatgctaagctcgacgccgaactgattcagtatcgagaggacctcaaccaggtgatcacgattaaggattcccagcaaaagcagctgttggaggtgcaactccaacaaaataaagaacttgaaaacaagtacgccaagctcgaagaaaagttgaaggagtcagaagaagcgaatgaagacctacgtagaagcttcaacgctctgcaggaggagaagcaggacttatccaaggagatcgagtctctgaaagtttctatttcgcagctcacccggcaggtgacagcgctccaggaagaaggcactctcggcctatatcacgcacagctcaaggtgaaagaagaagaggtacatcgtttatcggccttgtttagctcctcccagaagagaattgccgaactggaagaggaactggtatgcgtacagaaagaggcagccaagaaggtgggcgagatcgaagataaattgaagaaggagctgaaacacctccatcacgacgcaggcattatgagaaacgaaactgagacagctgaggaaagggtagctgaactggctcgagacttggtggagatggagcagaagctacttatggtgactaaggagaacaaggggctgaccgcgcagattcagagttttggtcgtagcatgtcttccttacagaattcacgggaccacgccaatgaggaactggatgagctcaagcgtaagtacgatgcatctctgaaagagctcgcgcaactgaaggaacaggggcttctgaacagagagagggacgcgctgctgtctgagaccgcattctccatgaactctaccgaagaaaactcactcagtcatctggaaaagctgaaccagcaactgctgtccaaagacgaacagcttctgcatctctcttcacagctcgaggactcttataaccaggtccagtccttttccaaggccatggcttccctacagaatgagcgcgaccatttatggaatgaactggagaagttccgtaaatccgaagagggaaaacagagatccgccgctcagcctagcacatctccagccgaggtacaaagcctgaagaaggctatgagtagcctgcagaacgaccgagatcgactattgaaggagcttaagaaccttcaacaacagtacctgcagattaatcaagagatcaccgaattacaccctctgaaggcacagctccaggagtatcaggacaaaaccaaggcattccaaattatgcaggaggaattgcgccaggaaaacttatcctggcaacacgaactgcaccagctacgaatggagaaatcctcctgggaaatccatgagaggagaatgaaagaacagtacttgatggctatcagtgacaaggaccaacagttaagtcacctccagaatctgattagagagctgcgaagttcgtcgagtcaaactcagccactgaaggtgcagtaccaacgtcaagcctctcccgagacatcagcgtcaccagatggtagccagaacttggtgtatgagacagagctgctaagaacacaattaaatgacagcctgaaagaaattcatcagaaagaactacgcatccagcagctgaacagcaatttctcacaactgctcgaagaaaagaatacactctctattcagctgtgtgacaccagccaaagtctccgtgagaatcagcagcattacggcgacctgctgaatcactgcgccgtactcgaaaagcaagtgcaggaactccaggccggacccctgaatatagacgtggctcctggtgctccccaggagaaaaacggcgtgcaccggaagtccgatcccgaagaattgagggaacctcagcagtcattctcagaagcccaacagcagttgtgtaatacaaggcaggaagtcaatgaactgagaaaactgctagaggaagaacgagatcagcgcgtggctgctgagaacgccctgtctgtggcagaggagcagatccgacgcttagagcatagcgagtgggacagctctcgcactcctattatcggttcttgtggcactcaagaacaagccctgctcattgatttgaccagcaattcttgtcgacgcactcgttccggcgtcgggtggaaacgcgtgttaagatccctatgccattccagaacccgtgtcccattgttggcagccatctacttcctcatgattcacgtgctgctcattctgtgcttcacaggacacctctag

SEQ ID NO: 118966 - DNA, 2919 bp, Artificial Sequence
  Description of Artificial Sequence: Synthetic coding sequence
atgaaagcccaaggcggtacggtgttgccaactgagcctcagagcgaagagcagctttcgaaacatgacaaatcgtctaccgaggaagagatggaaatcgagaaaatcaaacataagctgcaggagaaggaggagctcattagcacgctgcaagcgcagctgacgcaagcacaggccgaacagcctgcccagaaactgcgcgttctccaaagaaagttggaagagcacgaggaaagcctggtcggacgcgcccaggtggtggatcttctgcagcaggaactcacggctgccgagcagcgaaaccagatcctgtcccagcaactgcagcagatggaagcagagcataatactctgcgcaacacggtagagaccgaaagggaagagtctaagatcctgctggagaagatggagctagaggtggcggaacggaaactgtccttccataatcttcaggaggagatgcaccacctgcttgagcagttcgaacaggctgggcaggctcaggcagagttggagtcacggtattccgccctggaacagaagcacaaggctgaaatggaggagaagacctcccacatcctgtctctgcagaagacaggacaagaacttcagtccgcttgcgacgctctgaaggaccagaatagtaagctactccaagacaagaatgagcaggctgtccagtccgcacagaccattcagcaactcgaggaccagctacagcagaaatccaaggagatctcccagttcctgaacaggctgcccctgcagcagcatgagaccgcttcccaaacaagttttcccgatgtatataatgagggcacgcaggccgtcactgaagaaaatatcgccagccttcaaaaacgggtggttgaactggaaaacgagaagggtgcactgctcctttcctccattgagctggaggagctcaaggccgaaaatgagaagctgtcctctcaaataacactgctagaagcccagaatcgtaccggcgaagcggaccgggaagtgagcgagatcagcattgttgacattgcaaacaaacggagttctagtgctgaggaaagtggtcaggacgtactagaaaacactttttcccagaagcataaagaactcagtgttttgctgctggagatgaaagaagcacaggaggagattgccttcctgaaacttcagctgcaaggcaagcgcgccgaagaggccgatcatgaagtgttagaccagaaagaaatgaagcaaatggagggcgaggggattgcccccataaaaatgaaggtgtttctggaggacaccggacaggattttccccttatgcccaacgaggaatcctcgctgcctgcggtcgagaaagaacaggcatcgactgaacaccagtctaggaccagcgaagagatttcgctgaacgatgccggggtggaactgaaaagtaccaagcaggatggagataaatcactatccgctgttcccgatattggacagtgtcatcaagacgagctcgagagattgaagtctcagatcctggagctcgagctgaacttccataaagctcaggaaatctatgaaaagaatttggacgaaaaagccaaagaaataagtaatctgaatcagttgatcgaagaattcaaaaagaacgctgacaacaatagttccgctttcaccgccttatcagaagagcgggaccagctgctgagtcaggtgaaagaactcagtatggtcactgagctccgggctcaagtaaaacaattggagatgaatcttgcagaggctgaacgacagcgtcgcttggactacgagtcacaaaccgcacacgataatctattgaccgagcagattcactctcttagcattgaagccaagtctaaggacgtgaaaattgaagtcctgcaaaacgaactggacgacgtccaattacagttctccgagcagagcactctgatcaggagtctccaaagtcagctccagaacaaggaatccgaagtgctagagggggctgaacgagttcggcatatctctagtaaggtcgaggaactgagtcaggcacttagccaaaaggaacttgaaatcactaagatggatcagctgctcttagagaagaaaagggatgtggagacactgcagcagacgatcgaagaaaaggatcagcaggtaacggaaatttccttctctatgactgagaagatggttcagctgaacgaagagaagtttagcctcggcgttgagattaagacactgaaagaacagctgaacctactgagccgggccgaggaggctaaaaaagagcaggtcgaggaagataatgaggtaagctcagggctcaagcagaactacgatgaaatgagccctgccggtcagatttccaaagaggagctacagcatgagtttgatctgttaaaaaaggaaaacgagcagagaaaacgcaagctgcaggcagccttgattaatcgcaaggaactcctgcagagggtctcgagattggaagaggagctagctaaccttaaagacgaaagtaagaaagagattccccttagcgaaacggaacgcggtgaagtggaggaggataaggagaacaaggagtactccgagaagtgtgtaaccagcaaatgccaggagattgaaatctaccttaagcaaaccatctccgagaaagaggtggaattgcagcacatacgcaaagatttggaggaaaagctggccgcagaggagcagttccaggcactcgtcaaacagatgaatcagaccctccaggataaaacaaatcagattgacctcctccaggccgagatatctgagaatcaagctataattcagaaactcatcacctcaaacacggatgcaagcgatggtgactctgtggctctggttaaggagacagttgtgatttcgcccccatgtacaggctcctctgagcactggaagccatag

SEQ ID NO: 118967 - DNA, 126 bp, Artificial Sequence
  Description of Artificial Sequence: Synthetic coding sequence
atgcttagtcgcctgagcggcctggcgaatgtagtcctgcatgaacttagcggggacgacgacacagatcagaacatgcgcgccccactcgatccggaactccatcaggagtcagatatggagtag

SEQ ID NO: 118968 - DNA, 4923 bp, Artificial Sequence
  Description of Artificial Sequence: Synthetic coding sequence
atgctctcaaggctcagcgggcttgccaatgtggtgctacatgagctgagcggggacgatgacacagaccagaatatgcgagctcctttggaccctgaactacatcaggaatctgatatggagtttaataatactacccaagaggacgttcaagagaggctggcttatgctgagcagttagtggtcgagctcaaagacattattcggcagaaagatgtccagctccagcagaaggatgaggcactgcaggaagagcggaaagcagcggataataaaatcaaaaaattaaaactccacgcaaaagccaaactgacctccttgaacaaatacatcgaagaaatgaaggcacagggcgggaccgtactgccaacagaaccacagtccgaagaacagctgtcaaagcacgataagtccagcactgaggaagaaatggagattgaaaaaataaaacacaagttacaagaaaaggaagaattaattagcacactgcaggctcagctgacacaggctcaggccgagcagcccgctcaatcttctactgagatggaggaattcgttatgatgaagcagcagctacaggagaaggaagagttcatctctacactgcaggcacagcttagtcagacccaagcagaacaggccgctcagaaactgagagtgctgcagagaaagttggaggaacatgaagaaagtctcgtaggcagggcacaggtggtcgatctcctgcagcaggagctgactgcggccgagcaaaggaaccagattctgtcccaacaactccagcaaatggaggcagaacataacactctgaggaacaccgtggagactgaacgcgaggaaagtaagatactgctggaaaaaatggagctcgaggtggccgaaagaaaattgagctttcataacctacaggaggaaatgcaccacctgttggaacaattcgagcaagctggccaagcccaggcagagctggagtcccggtatagtgcacttgagcagaaacacaaggccgagatggaagagaagacctcacatatcctgtccctgcagaaaactggacaggaactgcaaagcgcttgtgacgccctgaaagaccagaattcaaagctgctgcaagacaagaacgagcaggccgtgcagagcgcacaaactatacagcagcttgaagaccagctgcaacagaagtctaaggaaatttcacaattcctgaataggctgcccctccaacagcacgagaccgcttctcaaacatccttcccagatgtgtataatgagggcactcaggctgttactgaggaaaacatcgcaagcctgcaaaaacgcgtagtggagctggaaaatgaaaagggtgccttgttgctcagcagcatcgaacttgaagagctcaaagcagaaaatgagaagctctcctctcagattaccctgcttgaggcccagaaccggaccggggaagcggaccgagaggtgtccgaaatctccattgttgatatcgccaacaaaagatcttcgagcgctgaggagagtggccaagatgtactcgaaaacaccttcagtcaaaaacataaggaacttagcgttttgctcctggaaatgaaggaagcacaggaggagatcgcttttttgaagctgcaactacagggaaagagagccgaagaggctgatcacgaagtgctggaccagaaggagatgaagcagatggagggcgagggaatcgctccaattaaaatgaaggtcttcctggaggacaccggccaggactttcccctgatgccaaacgaggaatcgtcactgcctgcagtggagaaggaacaagcctcaactgaacatcaaagtcgcacaagtgaggagatttccctgaatgatgccggtgtggaactgaaatccactaaacaagatggcgacaagtctcttagcgcagtgcctgacatcggacagtgccaccaggacgagctagaaagactcaagtctcagattctggagttggagctgaattttcacaaggcacaggagatatacgagaagaacctagacgagaaggccaaagagatctccaacctaaatcagctcattgaggaatttaaaaagaacgctgataataactccagcgcctttactgccctgtcagaagagagggaccagctgctctcacaggtgaaggagctgagcatggtaactgagctgagggcccaggtcaagcagttggagatgaatcttgcagaggctgaacgtcaaagaaggctggattacgaatctcagacagcccatgataatttgctgactgagcagatccacagtctctctatcgaagctaaatccaaagacgttaaaatcgaagtgctccagaatgagcttgatgacgtccagctgcagttttcggagcagtctaccctgatacggtctcttcagagccaactccagaacaaagaatcagaggtgctggagggtgcggagagagttcgacacatcagtagcaaggtcgaggagctgagccaggccttgtcgcagaaggaactggaaatcacgaagatggatcagctactcctcgagaaaaaaagagacgtggagacgttgcagcagactattgaggagaaggaccagcaagtcacagaaatatcgttctctatgacagagaagatggtacagctgaacgaggaaaaattttccctgggcgtcgagatcaaaactctgaaagaacagctgaatctcctgtcacgggctgaagaggcaaagaaagagcaggttgaagaagataacgaagttagtagcgggctcaaacagaactacgacgagatgtccccagccggacagatcagtaaagaggagctgcaacatgaatttgacctgctaaaaaaagagaacgagcaacggaaacgcaagcttcaggccgccctgattaaccgaaaggagctgctgcagcgcgtcagtaggctggaggaggagctcgcaaaccttaaggacgaatcaaaaaaggagattcccttaagcgagactgagcgaggagaagtcgaagaagacaaggagaataaggaatattctgagaagtgtgtaacctcaaagtgccaggaaattgagatctacctgaagcagaccatctccgaaaaagaagtagaacttcagcacatacgaaaagacctggaggagaaactcgctgccgaggaacaatttcaggcactagtcaagcagatgaaccagacattgcaggacaaaacaaatcagatagatctgcttcaggctgaaatcagcgagaaccaggctatcattcaaaaattgatcactagcaatactgatgcatctgatggagattccgtggcacttgtgaaagagacggtagtgatttccccgccttgtactgggtcttctgaacactggaagcccgaacttgaagagaagatactcgccctcgaaaaagagaaggagcaattgcagaagaaactccaagaggccttgactagccgaaaagccatccttaaaaaagcccaggagaaggaacgtcatttaagagaagagttgaaacagcaaaaagatgactacaacagactgcaggagcagtttgacgagcagagcaaagagaacgagaatatcggagaccagctgaggcagcttcagattcaagtgcgtgagtcgatcgatggtaaactgccctccacagaccagcaggaatcctgttctagcactccagggctcgaggagccgttgtttaaagcgaccgaacagcaccatacacagccagtgctggagtccaatttatgtcccgactggccttctcattcagaagacgcctcagctctgcaaggcggcacatctgtggcacagattaaggcccagttaaaagagatagaagcggagaaggtggaactcgagcttaaggtgtcctctactaccagcgagttaactaaaaaatcggaggaggtttttcaactccaggaacagataaataagcagggcctggagatcgaaagtctgaaaacggtgtcccatgaggccgaggtccacgcagagtctctgcagcaaaagttagaatcatcacagctgcagatcgcggggctcgaacaccttagagaactgcagcccaagctggacgaattgcagaaactaatttctaagaaagaggaggatgtctcatacctctctggccagttgtcagagaaggaagcagcactcaccaagattcagaccgagattatagagcaggaagacctgatcaaggctctgcatacacagctggagatgcaagcaaaagagcacgacgagagaatcaagcaactgcaggtcgaactgtgcgagatgaaacagaaacccgaggaaattggagaggaaagtagggcgaaacaacagattcagagaaagctccaagccgcactgatctcgaggaaagaggcacttaaggagaataagagtctacaagaagaactgtctctcgctcggggcacgattgaaagactgacgaagtctttggccgacgtcgaaagtcaagtgagtgcccagaacaaggaaaaagatactgtgcttgggagattggcactgcttcaggaagaaagggacaagctgatcacagagatggatcggagccttctcgagaaccagtctttatcatcttcatgtgagtcactgaaacttgcactggaaggcctgacagaggacaaagaaaagctggtgaaggagattgaaagtctcaagtcctctaaaattgccgaatctactgaatggcaggagaagcataaagaactccaaaaggaatatgagattctcctgcagtcttacgagaacgtctcaaatgaggccgaacgtattcagcacgtagttgaggccgtgaggcaggaaaagcaggaactctacgggaaactgaggagcactgaggccaataaaaaggaaacagagaaacagttacaggaggccgaacaggagatggaagagatgaaggaatag

SEQ ID NO: 118969 - DNA, 9810 bp, Artificial Sequence
  Description of Artificial Sequence: Synthetic coding sequence
atgcttagtaggttgtccgggctcgccaacgtggtcttgcatgagctaagcggcgatgacgacaccgatcagaacatgagagccccactggatccggaactgcatcaggagagtgacatggaattcaataacacaacccaggaagacgtacaggaaaggctggcttatgcagagcagttggtggtggaactcaaggacatcattcgacagaaggacgtacagctgcaacaaaaggatgaagccttgcaagaggaacggaaagctgcggataataaaatcaagaaacttaagcttcacgctaaagccaagctgaccagtctgaataagtatatagaggaaatgaaggcacagggcggaaccgtgttgcccacagagccccaatccgaagagcaactctctaaacacgataaatcttctactgaagaagaaatggaaatagaaaaaattaagcataaacttcaagaaaaggaggaactgatctctacccttcaggcgcagctcactcaggctcaggcagagcagcctgctcagagtagtaccgagatggaagaatttgtgatgatgaagcagcagcttcaggagaaagaggaattcatcagcactctccaggcacagttgagccagacacaggcagaacaggctgcacagttgtcgtcaatgcagcaagtcgtcagggagaaggacgcacggtttgagactcaggtcaggctgcacgaagatgagcttcttcagctggtaacacaagccgacgtagaaaccgaaatgcagcagaagcttagagttctgcagcgcaaactggaagagcatgaagaaagtttagttggcagggctcaggtagtggatttgctccaacaggaactgactgctgccgagcagcggaaccagatccttagccagcagctgcagcagatggaagcagaacacaacaccctgcgcaataccgtggagaccgagcgggaggaatcaaaaatactcctggaaaagatggagcttgaagttgctgagcgtaaactcagcttccataatctgcaggaggagatgcaccacttgctggaacagtttgagcaagctggacaggcgcaggcggagctggaaagccggtattcggcactggagcagaagcacaaggctgaaatggaggagaaaacctcgcacatactgtccctgcagaagacaggccaggaattacagagcgcctgtgatgctctcaaagaccaaaactcaaagctgctgcaagacaagaatgagcaggccgtccagtctgcacagaccatccagcagctcgaggaccaactgcagcagaaatccaaggagatcagccagtttctaaatcgtttgcccctgcaacagcacgagaccgctagtcagacctcctttcccgacgtatacaacgagggcacccaagctgtgaccgaagagaatatcgcaagtttgcagaaacgggttgtggagttggagaacgaaaaaggcgcactgttgctttcctctatcgagctagaggagctcaaagcggagaacgaaaagctatccagccagataacccttctggaggcacagaatcgaaccggtgaggccgacagggaggtatccgagatctcaatcgtcgacattgctaacaaacggagtagttcagccgaagagtcaggtcaggacgttttagaaaacacattcagtcaaaagcacaaggaactgtctgtgctattgctggagatgaaagaggctcaggaagagatcgcctttctaaaactacagttgcagggaaagcgcgctgaagaagccgaccacgaagtgctggaccagaaggagatgaagcaaatggaaggggagggcatcgcgccaatcaagatgaaagtattcctggaggataccggtcaggatttccctctaatgccgaacgaggagagctccctgccagctgtagagaaagaacaggcatcaacggagcaccaatccaggactagcgaggaaatctcactcaacgatgcgggtgtggagctgaagtctaccaaacaagatggggacaaatccctcagtgctgtgcctgacatcgggcagtgccaccaggacgaactggaacggttgaagagtcagatactggagttggagctgaacttccataaggctcaagaaatctacgaaaaaaatttggacgagaaggctaaggaaatcagtaatcttaatcagctcattgaggagttcaagaagaacgccgacaacaattcaagcgcgttcaccgctctgagtgaagagcgcgaccagctcctctctcaagtcaaggagctgagtatggtgactgagcttcgtgctcaggtgaagcagctggagatgaacttagctgaagccgaacggcaaagacggttggactatgagtcacagactgcccacgacaacctgctcaccgagcagattcattccttgtccatagaggcaaagagcaaggacgtcaaaattgaagtgctccaaaacgaactagacgatgtacagttgcagtttagcgagcaatcaacattaattaggagcctgcagagtcagttacaaaataaagagagtgaggttttggaaggcgcagagcgagtcaggcacatctctagtaaggttgaggaactgagccaagcattgtcgcaaaaagaattggagatcacaaagatggaccagttgctcctcgaaaagaaaagagacgtagagacgctgcagcagaccatcgaagagaaagaccagcaagtgacagagattagttttagcatgactgagaaaatggtacaactcaacgaggagaaattttccctaggggtggagattaagactctgaaggagcagctgaacttactgtctcgcgccgaggaggccaaaaaggagcaagtggaggaggataatgaggtgagttcaggtttgaagcagaattacgacgagatgtcgcccgcgggccagatttcaaaagaggaactccagcacgaatttgatctgttgaaaaaagaaaatgaacaacggaagcgcaagttgcaggctgcccttataaaccgcaaggaactgcttcaacgcgtcagcagactagaagaagaattggcaaacctcaaagatgaatcaaagaaagagattcctttaagcgagaccgagaggggcgaggtcgaggaagataaggagaataaggagtactccgagaagtgcgtgacatccaaatgccaggaaatagaaatctatttgaaacagacaatctctgagaaggaagtggaattgcagcacatccggaaggacctggaggagaaacttgcagcagaggagcagtttcaggctctggtgaagcaaatgaatcaaaccctccaggataagaccaaccagatcgacctcctccaggctgaaattagcgagaaccaggcaatcattcagaagctgattacttccaatacagatgcctctgacggcgacagcgtggcccttgtcaaggaaaccgttgtgatttcacctccctgcacgggctcgagtgagcactggaagcctgaactcgaggagaaaattttagccctcgagaaggaaaaagagcaattgcagaaaaagctgcaggaagccctgacaagccggaaggccatcctcaaaaaggcacaggagaaggaacggcacttgagagaggaattgaaacagcagaaagacgactacaacagactacaggagcagttcgacgaacagagcaaggaaaatgagaatatcggcgaccagcttagacagttacagatccaggtcagagagtccatcgatggtaagctacctagcacggatcagcaggagagttgtagctctactccaggactcgaggaacctctattcaaagcaactgagcagcatcatacacaaccagtgctggagagtaacctgtgccccgattggcccagccatagcgaggacgccagtgccctgcaagggggcacctctgtcgcccagatcaaggcacaactaaaggagattgaggcagaaaaagttgaattggaacttaaagtcagttcaacgacctctgagctgaccaaaaaatcggaagaggtgttccagctccaggaacaaataaacaagcaaggtttagaaatcgagagtctgaaaactgtatctcacgaggcagaagtgcatgcagagagccttcagcagaaactcgagagctcccaactccagattgctggtctagaacacctgagagaactgcaacctaaactcgacgagctgcagaaactgatctccaagaaggaagaagacgtatcctacctgagcggccagcttagcgaaaaagaagctgcactgacaaagattcagacagaaataattgaacaggaggatctgatcaaggccctgcacacccagctggaaatgcaggcaaaagagcatgatgaaagaatcaaacagctccaggtggaactttgcgagatgaaacagaaacctgaagagatcggtgaggaatctagggcgaagcaacaaatccaacgcaagcttcaggccgcgctgataagccgaaaagaggccctgaaagagaataagagccttcaggaagaactgtctctcgcgcgaggaacgatcgaaagattgaccaaaagccttgctgacgtcgagtctcaggtctccgcacaaaacaaggagaaggatactgttttggggcgcctcgcgctcttacaggaggagcgtgataagctaattactgagatggacagaagccttttagagaaccagagcttgtcgtcgagctgcgagtccctgaagcttgcactagagggacttacagaggacaaagagaagctcgtgaaggagatcgagtccctgaagtctagcaaaatcgcggagtccacggaatggcaagagaagcataaagagttacaaaaggagtatgaaatcttactgcagtcatatgagaacgtttctaatgaagccgaacgtatacaacacgtggtggaagcagtgcggcaggaaaaacaagaactctatgggaagcttcggagcaccgaagctaataaaaaagagaccgagaaacaactgcaggaggccgaacaagagatggaggaaatgaaagaaaaaatgcgcaaattcgcaaaatcgaagcaacagaagatactagaacttgaagaggagaacgatagactccgcgccgaagttcaccctgccggtgatacagctaaagagtgcatggagacactgctctcaagcaacgccagcatgaaggaagagctggagcgggtcaaaatggaatacgaaaccctgtccaaaaagtttcagtctctcatgagcgagaaggattccctttctgaagaggtccaggatctaaagcatcagatagagggcaacgtcagcaagcaagctaatctcgaagctacagagaaacatgacaaccagactaatgtgaccgaggaggggacacagtcaatacccggcgagactgaggagcaagacagcctctccatgtctacgcggcccacctgctccgagtctgtgccctcggctaaaagcgcaaacccggcagtaagcaaggacttcagctctcacgacgagattaacaactatctccagcaaatcgatcagcttaaagaacgaatcgccgggctggaagaggaaaagcagaaaaacaaagagtttagccagactctggagaacgaaaagaacaccctgctcagtcagatctctacgaaagacggggagcttaagatgcttcaggaagaggtgactaagatgaacctactaaaccagcagatccaggaggaattaagtagagtgactaagctcaaggagaccgctgaagaggagaaggatgacctggaggaaagactgatgaatcagcttgccgagctgaatggttcaatcggcaactactgccaggacgtgactgacgctcagatcaaaaatgagctccttgagtcagaaatgaagaacctgaagaaatgcgtgtcggagctagaggaagagaaacagcagctggtaaaggagaagacgaaagtggagagtgagatccgaaaggaatacttggagaagattcagggcgcgcaaaaggagccgggcaataagtcccacgccaaggaactccaggaacttctcaaggaaaaacaacaggaggtgaaacaactgcagaaggattgtatccggtaccaggagaagatctctgccctcgagcggaccgtgaaagccttggagttcgtccaaactgaatctcaaaaggatctggagataactaaggaaaatctggctcaggcggtggaacaccgaaagaaagcacaggctgagctggcctctttcaaagtgttgctggacgatacccagagcgaagcagccagagtgctggcagacaacttaaaactgaagaaagagctgcagagcaataaggagagtgttaagtcccagatgaagcagaaggatgaggacctcgagcggcggctagagcaggctgaagagaagcatctcaaagagaagaaaaatatgcaggagaaattggatgccctcagacgtgagaaggtccatctagaggaaacaatcggtgagatccaggtcaccctgaataagaaagacaaagaagtccagcagctgcaggaaaatcttgattcaactgtgacccagctcgcagcatttacaaaaagtatgtcctcactgcaagacgatagggaccgggtaatagacgaggcgaagaagtgggaacgcaaatttagtgacgctatccaatcaaaggaggaggagatacgactaaaggaggacaattgctcagtactgaaagatcagctgaggcaaatgagcatccatatggaggagctgaagataaatatctcgcgactggagcatgacaagcagatttgggagagtaaagcgcaaaccgaagtacagctccagcagaaagtgtgtgatacactgcagggggagaataaagagctgctgtctcaacttgaggagaccagacatttgtatcactcctcccagaacgaactagctaaacttgaaagtgagctgaaatccctaaaggatcagctcacagaccttagtaactccctggaaaagtgcaaagaacagaaaggaaacctggaaggaatcattaggcaacaagaagcagatatacagaattcgaaattttcctacgagcagctggagactgacctccaagcaagccgcgagctgacaagccggctccacgaagaaatcaatatgaaggaacagaagatcatctctttacttagcggcaaggaggaggcaattcaggtcgcaatcgctgagctgcggcagcagcacgataaagagattaaggagctagagaacctgctgtcacaagaggaggaagaaaatatcgtacttgaggaagagaacaaaaaggccgtagataagacaaatcagctcatggagactctgaaaactatcaaaaaggaaaatatccagcagaaggcccaactggattctttcgtcaagtccatgagtagcctgcagaatgaccgagaccgaatcgtgggagactaccagcagctcgaggagagacacctctcaattatcctggagaaagaccagctcattcaagaggctgccgctgaaaataacaagctgaaggaagaaattagaggtctccggtcccacatggacgatctgaatagcgagaatgccaaactggatgccgaactgattcagtatcgcgaggatctgaatcaggtaattacaatcaaggattctcaacaaaagcagttactggaggttcagcttcagcagaacaaggagctggagaataagtatgccaagctcgaggagaagcttaaggaaagcgaggaggccaacgaggacctcaggaggtctttcaacgcacttcaagaagaaaaacaggatttgagtaaggagatcgagtccctcaaagtgagcatttcgcaactcacgagacaggtgacagcccttcaggaagaaggtactctgggcttgtatcatgcccaactgaaggtgaaggaggaggaggtgcaccggctctctgctctgttttcaagttcccagaagcggattgcggagctagaggaggaattggtatgtgtgcaaaaggaggcagctaagaaagtgggcgaaatcgaggataagctcaagaaagagcttaagcacctgcaccacgacgcagggatcatgcgtaacgaaaccgagactgcagaagagcgggtggccgaactggctagagacctggttgagatggagcagaagctattaatggttaccaaggaaaacaaaggattgactgcccagatccagagctttgggcgctccatgagcagtctgcagaattcacgtgatcacgccaatgaggagcttgatgaactcaagcgaaaatatgacgccagcctgaaggaactggctcagcttaaagaacaagggttgttaaaccgggagcgggacgccctactctctgagactgccttcagtatgaacagtactgaggagaatagcctcagccaccttgagaagctcaaccagcagcttttgagcaaggacgagcagctgctgcacctgtcctctcagttagaagacagttataaccaggtccagagtttttccaaagctatggccagccttcagaatgagagggaccatctctggaatgaactggagaagtttaggaagtcagaagaggggaagcagagaagcgctgcccaaccaagcaccagccctgccgaggtacaatccctgaagaaagccatgtcaagtctccaaaacgaccgagatcggctgttaaaagagttgaaaaacctccagcagcaatacctacagattaatcaggagatcacagaacttcatcctctgaaggctcagttacaggaatatcaggataagactaaggctttccagatcatgcaagaggagttaagacaggaaaatctctcttggcagcacgaactgcatcagctgcggatggaaaagtcaagttgggagatccatgaacggcggatgaaagagcaatatctaatggcgatttctgacaaggaccaacaactatcacacctccaaaatttaataagggagctccgatcctcgagtagtcagacccagccactgaaggtgcaataccagcgacaggctagtcctgagacttcagcttcccccgacggatcccagaatctcgtgtatgagacggaactcctccgcacccaactcaacgactccctaaaggagattcaccagaaagaattacggatccaacaacttaattccaacttcagtcagctgttagaggagaaaaacacgttgtctatacagctgtgtgacaccagccagtctcttcgagagaaccaacagcactacggggatctgctgaatcattgtgctgtgttggaaaagcaggtccaggagctacaagctgtttcaaaggagaagggtccgctgaatatagacgtcgcccccggggccccccaagagaagaacggcgttcacagaaagtctgaccccgaagaactgagagaaccccagcaatcttttagtgaggctcagcagcagctttgtaacacaaggcaagaggtgaatgaattaagaaagcttctagaggaggagagagatcagagagtggccgcagagaatgccctttccgtggccgaggaacagattagacgcctggagcactcagagtgggatagcagcaggactcctatcatcggctcatgcggaacacaggagcaggccttgctcattgacttgactagcaactcctgtcgaaggaccaggagcggggtcggatggaaaagagttctcaggtctctgtgtcatagccggacgcgtgtgcctttgcttgcggcgatatactttctcatgatccacgtcctcctgatcttatgctttacgggtcacctgtag

SEQ ID NO: 118970 - DNA, 741 bp, Artificial Sequence
  Description of Artificial Sequence: Synthetic coding sequence
atgtcgtgggccgcggtcctggcagttgcggccgctagattcggccacttttggggctgtcgctggcctggacctatggctcagggatgggctggattctcggaggaggaacttaggcgtctcaagcagaccaaggatccattcgagccccaacgtcgcctgccagctaaaaagtctaggcagcagctgcaaagggagaaggcactggtggagcaaagtcagaaattgggcctgcaagacggaagtacatctctgttgccagaacagcttttgtccgctcctaagcagcgggtcaatgtgcagaaacctcccttttcctctcctaccctcccttcgcacttcacactgacatctcctgttggagacggacagccacaaggaattgagtcccaaccgaaggagctgggactggaaaatagtcatgacggccacaataatgttgagattctgccacccaagccagactgcaaattggaaaaaaagaaggtggaactccaggagaagagccgctgggaagtactgcagcaagagcagagactaatggaagagaaaaacaaaagaaagaaagccctgttagctaaagcaatcgctgagcgatctaagagaacccaagccgaaacgatgaagcttaaacgaatccagaaagaactccaggcccttgacgatatggtcagtgccgatattgggatcttacgaaatcgcatcgaccaagcctcccttgattactcatatgctcgatag

SEQ ID NO: 118971 - DNA, 1185 bp, Artificial Sequence
  Description of Artificial Sequence: Synthetic coding sequence
atgtcctgggccgcagtgctggcagtggcagccgctaggtttggccacttttggggttgtcggtggcctggacctatggctcagggctgggctgggttttctgaggaagagctccgacggctcaaacagactaaggacccatttgagccacaacgacgattgccagcaaaaaaatcacggcagcaactgcagagagaaaaggcactggttgagcaatcacaaaagctcggcctgcaagatgggagcacgtctctgctgcccgagcagctgctgagcgctccgaagcagcgcgtgaatgtgcagaagcccccattctcttccccgacgctaccatcacacttcactctaaccagcccagtgggagacggacagcctcagggtatagagtcccagcccaaggagctcggtctcgagaacagccatgacggacataacaacgtcgaaatcttacccccaaaacccgactgcaagcttgagaagaaaaaggtggaattgcaggaaaaaagtcggtgggaagtgctccagcaagaacagcgtctgatggaggagaaaaataagagaaagaaagcactactagctaaggccattgccgagcggagcaagagaacccaggctgaaacaatgaagttgaagcggatacaaaaagagctccaggccctggatgacatggtcagcgccgacatcggaatcctccggaatcgtatagatcaagcttcgctggattattcatatgcacgcaaacgattcgaccgagccgaagcagagtacattgcagcgaaactggacatccagaggaagacagaaatcaaggaacagcttaccgaacatctgtgtaccattattcaacagaacgaattgaggaaagctaagaaactggaagagctcatgcaacagttagatgttgaggcggatgaggagactctcgagctggaggtcgaggtggaacgtttactgcatgagcaagaggtggaaagtagacggcctgttgttagactggagcggccttttcaacccgctgaggaatctgtgactctggaattcgcgaaggaaaatcgcaaatgtcaggagcaagccgtgtctcctaaggttgatgaccagtgcggcaattcgtcctccattccttttttgagtcccaattgtcccaaccaggagggaaatgacatatctgcagccttggccacatag

SEQ ID NO: 118972 - DNA, 861 bp, Artificial Sequence
  Description of Artificial Sequence: Synthetic coding sequence
  Description of Combined DNA/RNA Molecule: Synthetic coding sequence
atgcctctggatgcaacgtggaatataactgtgcagtggctcgctgttgatatagcatgtaggaccctaatgttcctgaagctgatggctacatattccgccgccttcttgcctgtagtaattgggctagatcgacaggccgctgtcctgaatccgctgggatctcggtctggcgtacgaaaacttctgggtgccgcctggggattgagcttcttgctcgctttcccccaattgtttcttttccataccgtgcacugagccgggccagtaccatttactcagtgcgtgacaaaagggagcttcaaggcccagtggcaagaaacgacttacaacctattcacattctgctgtctatttctgcttccattgaccgccatggccatctgttactctcgtattgtcctctcagtgtccaggccccagacccggaaaggctcacacgcccccgccggggagttcgctctgcctcgatcctttgataattgtcccagggttcgattgcgcgcactgcgtctggccctgctgatccttctgacttttattctgtgctggactccatactacctgctcggtatgtggtactggttcagccctacgatgttaacagaggtgccgcccagcctatcacacatactttttctccttggcctgttgaacgccccattggacccactcttgtacggtgccttcacgctgggctgtcggagaggtcatcaggagttgtccattgacagctctaaggagggttccggcagaatgctccaagaagaaatacacgcatttcggcagctcgaagtgcaaaagacagtgacctcaagacgagccggggagaccaagggaatatccattacatccatttag

SEQ ID NO: 118973 - DNA, 879 bp, Artificial Sequence
  Description of Artificial Sequence: Synthetic coding sequence
  Description of Combined DNA/RNA Molecule: Synthetic coding sequence
atgagcgcaggtaatggtaccccctgggacgccacttggaatattaccgttcagtggctagcagtggacattgcctgccggacactgatgtttcttaagctgatggctacctattccgcagccttcctgcctgtagtgattgggctggataggcaggcagctgtccttaaccccttggggtcaagatcgggcgttaggaagttattgggcgccgcctggggtctctctttcttgctagcgtttcctcagctgttccttttccacaccgtgcacugagccggcccagtgcccttcactcagtgcgtgacaaaagggagcttcaaggcacagtggcaggaaaccacctataatctgttcaccttctgttgtctgttcctgctccctcttaccgcgatggctatatgctatagccggattgtgctatccgtttctcgaccccaaacgagaaagggtagccatgcacctgctggcgagttcgccttacctcgatccttcgataattgccctcgggtgcggctacgtgcccttcgtttggctctactcatcttgctcacatttattctatgttggactccatactacttgttaggcatgtggtactggttctcccccacaatgctcaccgaagtaccccccagtctgtctcacatcctcttcctgctcggtcttctcaacgcacctttagaccctctgctgtatggggcttttacactgggatgtcgcagaggacaccaggagctctccattgattcttcgaaggaaggatccggtcgaatgcttcaggaagagatccacgctttcaggcagctggaagtacagaagaccgtaacttcaaggagggcgggagaaacaaagggcatttctatcacctcgatctag

SEQ ID NO: 118974 - DNA, 363 bp, Artificial Sequence
  Description of Artificial Sequence: Synthetic coding sequence
atggctagttctcggcggggcctcttactactcctgctgctgaccgctcacctgggcccatcagaagcccagcattggtctcacgggtggtatccaggtggaaaacgagcactctcatccgcacaagatcctcagaatgcactcaggccacccgggagagcattggacactgcggccggcagccccgtgcagaccgcacacggactaccttcagacgccttggcccctctcgatgattcgatgccctgggagggaaggacaacagctcagtggtccctgcatagaaagaggcacttggcccggacccttctgacagctgcccgagaaccacggccagctcccccatcatccaataaggtgtag

SEQ ID NO: 118975 - DNA, 342 bp, Artificial Sequence
  Description of Artificial Sequence: Synthetic coding sequence
atggcttctagtcgcaggggtttgctgctcctgttgcttctgaccgctcatttgggaccttcagaagcccagcactggagccatggctggtacccgggcggcaaaagggcattgagcagcgcccaagacccccagaacgccttacgtccccccgccgggagtccagtgcaaacagcacatggcctgccctctgacgccctggcccctcttgatgatagcatgccctgggaagggaggaccactgcacagtggtcattgcaccgcaaaaggcacctggccaggaccttgcttacagccgccagggagccacgacctgctccgcccagcagcaacaaagtctag

SEQ ID NO: 118976 - DNA, 339 bp, Artificial Sequence
  Description of Artificial Sequence: Synthetic coding sequence
atggcaagcagccgtagagggttactcctgctcttgcttctcaccgcccaccttgggcctagcgaggcacagcactggagccatgggtggtacccgggcggcaagagggccctctcctcagcccaggatccacaaaatgcactaagaccccctggctcccctgttcagactgctcatggcttgccctctgatgcattggccccgctggacgattctatgccttgggagggtagaactactgcgcagtggagcctccatcgcaaacggcacctggccaggacactactcacggctgcccgggagccgaggcctgcgccgccatcctctaacaaagtttag

SEQ ID NO: 118977 - DNA, 339 bp, Artificial Sequence
  Description of Artificial Sequence: Synthetic coding sequence
atggccagtagtagacgaggactgctgctgctgcttttgctgactgcacatctcgggccttccgaggcgcagcactggtcacatggctggtatcctggcggcaagagagctctatcttcagcccaggacccacaaaacgctttaagacctcctgggtccccggttcagacagcacacggcctgccttccgatgccctcgcacccctcgacgatagcatgccttgggagggaaggactaccgcacagtggagcctgcaccgaaagcgacatctggcccgcacacttcttacagctgcccgtgagccgcgcccagccccaccttcgagtaataaggtttag

SEQ ID NO: 118978 - DNA, 342 bp, Artificial Sequence
  Description of Artificial Sequence: Synthetic coding sequence
atggccagttctaggcggggtttgctcctacttttgctactgaccgcacacctaggcccctccgaagctcagcattggagtcatggctggtatcccggtggcaaaagggccctgtcctccgcccaggaccctcaaaatgcactgaggccacccgccgggtcccccgtgcagaccgcccacggactgcctagtgatgcactggccccactggatgattctatgccttgggagggacggacaaccgcccagtggagcttgcaccgtaaacgtcatcttgcaagaactttgctgaccgctgccagagagcctcgccctgcccccccctccagcaataaagtttag

SEQ ID NO: 118979 - DNA, 945 bp, Artificial Sequence
  Description of Artificial Sequence: Synthetic coding sequence
atgtacaaaatggaatactcatatcttaacagcagcgcctacgagagctgcatggcagggatggatacgtccagccttgcaagcgcttacgcggacttctcgtcatgctcacaggcgtcagggtttcagtataaccccatcagaacaactttcggcgcaacaagcggttgtccctccttgacacccggctcatgttcacttggcactctacgcgatcaccagtccagtccctacgcggctgtcccctacaagctattcaccgaccacggcggcttgaatgaaaagagaaagcaacgaaggattcgcacaacatttacctctgctcagttgaaggagctggagcgtgtattcgcggaaactcattatccagatatttatacccgggaagagttggctctcaagattgatctgacagaagctagagttcaagtgtggttccagaataggcgagcaaagtttaggaagcaagagagggcagccgctgccgcagcggcggcagcgaagaacgggtcgtccgggaaaaaaagcgactcatcaagagatgacgaatcaaaagaagccaagtccacagatccagactcaacaggtggaccaggccccaaccccaaccccactccgagctgtggtgctaatggaggcggtggtggagggccatccccagccggggctcctggagccgcaggccctggcggcccgggaggagaacccgggaaaggcggggccgcagctgccgccgctgctgcggccgccgccgcagccgcagcagccgctgctgccgcgggcgggctcgcggccgccggaggacctggacagggatgggcaccagggcctggtcctatcacatcgatccctgatagtctaggaggaccgttcgccagtgttctcagcagccttcagcgcccaaatggcgcaaaggctgctctggtcaagagcagcatgttttag

SEQ ID NO: 118980 - DNA, 750 bp, Artificial Sequence
  Description of Artificial Sequence: Synthetic coding sequence
atggccaactccgcttcccccgaacagaatcagaaccactgcagcgcaataaacaattcaatccctctcatgcaaggcaaccttccaactctgacactgtcagggaagatccgagtgacagtcacgttttttctgttcctgctgtcagctactttcaacgccagtttcctcctcaaactccagaagtggactcagaaaaaggaaaaaggaaagaagctcagccgcatgaaactgctgctcaaacatcttaccctcgcaaatttactggaaaccctcattgtgatgccactggatggcatgtggaatattacggttcagtggtatgcgggagagctcctgtgcaaggtgctctcctatcttaaactgttctctatgtacgcgcccgccttcatgatggtggtgattagtctagatcgtagcttggctatcacccgtccattagcgttgaaatctaatagtaaggtggggcagtccatggtcggcctggcatggatactgagctccgtgtttgcaggccctcagctgccattgcaccatccttcgtttcatcatgcagacctgcagtgtaaaaaccatttgcacccagatacaggacccagcagcggaccaccaaggactaccacggagagtgtccaggagcagtacacaaaatcgacagccgaggatagtaaaaacgatggatgcatttgccactttatttattgcctgctggactctctcctgtgtccacggaatctggtactcgtctag

SEQ ID NO: 118981 - DNA, 2055 bp, Artificial Sequence
  Description of Artificial Sequence: Synthetic coding sequence
atggaagagaacttgatcagtatgagagaggatcattcattccacgtgcgctaccggatggaggcatcttgcttggaactcgcactggagggcgagcgcctgtgcaagtctggggattgtagagccggcgttagcttcttcgaggccgccgtgcaagtaggcactgaggacttgaagacactctccgcaatctacagccagctgggtaatgcctacttctacctacacgactatgcaaaggcgctggagtatcaccaccatgacctgaccctcgctagaaccatcggtgatcagcttggcgaggcaaaggcttccggaaatctggggaataccctgaaagtgcttgggaatttcgacgaagctatcgtctgctgtcaacggcatttagacatctcacgcgagctaaatgacaaggttggcgaggccagggccctttacaatctgggaaatgtctaccacgccaaggggaagtccttcggttgtccaggacctcaggatgtaggcgaatttcctgaggaggtccgcgacgcactccaagcagcagtggatttctacgaagaaaacctgagcctggttaccgccttgggcgaccgcgctgcgcagggtagagccttcggcaacctgggcaacacgcattatctactcggcaattttcgagacgccgttatagcgcacgagcaaaggcttctcatagctaaggaatttggtgacaaagctgccgagagacgagcttatagcaatttgggcaacgcatacatctttctcggagagtttgaaacagcctctgaatattacaaaaagacattgttattggccagacagttgaaagaccgcgcagtggaggcgcagagttgctacagcctgggaaatacatatactcttctgcaggattacgaaaaagcaatagattaccatctgaaacacctcgcgattgcccaggagctcaacgacaggatcggcgagggccgtgcgtgctggagcctgggcaacgcgtacacagcattgggcaatcacgaccaggccatgcacttcgctgaaaagcaccttgagatctctcgggaggtaggtgacaagagcggagagctgactgctcggcttaacctgagtgacttgcagatggtgcttggattgtcttactctacgaataacagcataatgagtgaaaatacagaaatcgattctagcctcaatggggttaggccgaagttaggtcgaagacattcaatggagaacatggaattgatgaagctgacacccgaaaaggtgcagaactggaatagcgagatactggcgaaacaaaaacccctgattgccaagcccagcgcaaagctgctgtttgtcaaccgcctcaagggaaagaaatataagaccaatagctctacaaaagtgctccaggatgcttcaaattcaatcgaccacagaattccaaatagccaacgcaagatctccgccgataccatcggagacgaaggtttcttcgatctgctgtccaggtttcagtccaatcggatggacgatcaaagatgctgcctgcaggagaaaaactgtcacacagcttcaacaaccacctcttctaccccacctaagatgatgttgaaaacaagcagtgtgccagtagtgtcccccaacacagatgaatttttggatcttttagcatcatcacagtcacggagactagacgaccagcgcgcaagtttctctaatctgcccgggctgaggttaacacagaattcacagagcgtactttctcacttgatgacgaacgataataaagaagcagatgaagatttctttgacattctggtaaaatgtcagggatctcggctggatgatcaaaggtgcgcacctccaccggccacgacgaagggtcctacggtgcccgatgaggattttttcagcctgatattgaggtcacagggtaagagaatggacgagcaacgcgtcctgctccagagggaccaaaacagggatactgactttggtctcaaagattttctgcagaataacgcactgttggaatttaagaattccggaaagaagtccgccgatcattag

SEQ ID NO: 118982 - DNA, 2055 bp, Artificial Sequence
  Description of Artificial Sequence: Synthetic coding sequence
atggaggagaacctcatctccatgagggaggatcattctttccatgtgcggtatcggatggaggccagttgtttggagctggcactagagggcgagcgcttgtgtaagtctggggactgcagagctggggtctctttcttcgaggctgccgtgcaggtaggtaccgaggatctgaagactctgagcgccatctactcccagctcggaaatgcctatttctacttgcatgactacgcaaaagctctcgagtaccaccaccatgatctgacattggcccggacgattggcgatcagttgggagaggccaaggcaagcggcaaccttgggaatacattaaaggtcctcggcaatttcgacgaagccatcgtgtgctgtcaacgtcacctggacatctctcgcgagctgaacgacaaggtcggagaggcccgggcactgtacaatctcggaaacgtctatcacgccaagggcaagtcttttggttgtcctggccctcaagatgtgggtgagttccctgaggaagtgagggatgcactccaagctgctgtggatttctacgaggagaacctgtctctagtcacggccctcggcgatagagccgcacagggtcgggcgtttggaaacctgggaaatactcactacctgctggggaacttccgcgatgccgttatcgctcacgaacagagactgctaatcgctaaggagtttggggataaggccgccgagaggagagcgtatagcaatctgggaaatgcatatatcttcctcggcgagtttgagaccgcatcagagtattataagaaaaccctgcttcttgccagacagttaaaagatcgagctgtcgaagcccagagctgctattcactggggaacacatacacgctgctgcaggactatgaaaaggccattgactaccacctcaagcatcttgcaattgcccaggagctcaatgaccggattggcgagggacgggcctgctggagcctgggtaacgcttacacggcactcggcaaccatgatcaagcgatgcatttcgccgaaaaacacctggagatctccagggaggttggagataaatccggagaactcaccgctagacttaatctgagcgacctccaaatggtgctgggcctgtcatattccacgaacaatagtatcatgagcgagaatacagaaatcgactcttcactcaacggggtgaggcccaagctgggcagaaggcattctatggaaaatatggagctcatgaagttgaccccggagaaagtacagaattggaatagcgaaatcctggccaaacagaagcccctgattgctaagccaagtgctaaattgctgtttgtgaatcgcttgaagggaaagaaatataagacgaacagcagcacaaaggtgctgcaggatgccagcaactctatcgaccaccgcattccaaactcccagcgaaagatcagcgctgataccattggcgatgaaggtttttttgatctgcttagtagattccagtctaacaggatggacgaccagagatgctgtttacaggaaaagaactgccacaccgcctcaactaccacctcttctactcccccgaagatgatgctgaaaacatctagtgttcctgtggtcagtcctaatactgacgagttcctcgaccttctggcatctagccagtctaggaggcttgacgaccagcgcgcttctttcagcaatctgccaggactgcgcttgactcaaaattcccagagtgttctgtcacatttaatgaccaacgacaacaaggaggccgatgaggatttttttgacatactagtgaagtgccaaggttcccggttagacgaccagcgatgcgctccacctcccgccacaacaaaaggaccaacagttccagatgaagatttcttcagcctgatcttacgcagccagggtaaacggatggacgagcagagagtgctgctgcagagagaccagaacagagatacggacttcggattgaaggactttctgcagaataatgcgctgctagaatttaagaacagcggtaaaaagagtgctgaccactag

SEQ ID NO: 118983 - DNA, 228 bp, Artificial Sequence
  Description of Artificial Sequence: Synthetic coding sequence
atggaagaaaatctgatttctatgagggaggaccactcttttcacgtcagataccgtatggaggcctcttgcctcgagctggctttggaaggcgagaggctgtgcaagtctggagactgtcgggctggcgtgagcttcttcgaggccgctgtccaggttggcacagaagatttaaagacactctctgcgatttatagccaactggggaatgcttatttctatctatag

SEQ ID NO: 118984 - DNA, 642 bp, Artificial Sequence
  Description of Artificial Sequence: Synthetic coding sequence
atggaagagaacctcataagcatgcgtgaagaccactcgtttcacgtaaggtacagaatggaagcctcatgcctagagctggcactggagggggaacggctctgcaaatcgggtgattgtagagcaggagtgagttttttcgaggcagcggtacaggtcggcaccgaggatcttaaaaccttgagcgctatatactctcaacttggaaatgcctacttctacctgcacgactacgccaaagcgttagagtatcatcatcacgacctcaccctcgcacgcactatcggcgaccaactgggggaagcaaaagcatccggcaatctcgggaatacactaaaggtccttggaaacttcgacgaagcaatagtgtgttgccagcggcaccttgacatatcacgagagctaaatgataaagtcggtgaagcaagagccctgtataatctgggcaatgtgtaccacgccaagggaaagtcgttcggatgtcctggcccccaggatgtgggggagttccctgaggaagtgcgcgacgctttgcaggctgccgtcgacttttacgaggagaacttatcattggtgacggcccttggcgacagggctgctcagggacgggcctttgggaatctaggaaatacacattattag

SEQ ID NO: 118985 - DNA, 159 bp, Artificial Sequence
  Description of Artificial Sequence: Synthetic coding sequence
atggaagagaatcttatttccatgagggaggatcactcttttcatgttcggtatcgcatggaggcctcctgtttagagcttgctttggaaggggagcggctctgcaaatcaggggattgccgcgctggagtgtcgttctttgaggcagccgtgcagtag

SEQ ID NO: 118986 - DNA, 1290 bp, Artificial Sequence
  Description of Artificial Sequence: Synthetic coding sequence
atggctagcctctgggaatccccccaacagtgtatcatcctcagccccctgtcaggatggtggttttccattgggatcagtattctgacaagcagcgccctggtactgaaaccccaaatgctgaaaggagaactccagaccagacccagccagcgcccctccagaaaggcctttagacgtaataactttgagtatacactcgaggctagcaagtcactgcgccagaagccaggagactctaccatgacatacctgaacaagggccagttctatcccattaccctaaaagaagtatcctcatctgaaggtattcaccacccaatttcaaaagtgagaagtgttattatggtcgtgttcgctgaagataagtcaagggaagaccaactgcgccactggaaatattggcatagtcggcagcacactgcgaagcagagatgtatcgacatcgcagattacaaagagagcttcaacaccattagtaacattgaggagatcgcctataacgccatctcatttacttgggatatcaatgacgaggcaaaggtctttattagcgtgaattgcctgtcaaccgactttagctcccaaaaaggagtgaaagggttgcctctgaacatacaggtggacacatacagctacaataaccgcagcaataagcctgtgcacagggcttactgccagattaaggttttttgcgataaaggcgccgagcgaaagattagggatgaggagcgcaagcaatccaagcgcaaggtctcagacgttaaggtgcccttgcttccctcgcataaaaggatggacatcacggtgttcaagccattcatcgacctcgacacccagcctgtgctgttcattcccgatgttcacttcgccaacctccagaggggaacacacgtgctaccaatagcctctgaggaactggagggcgagggatccgttctgaaacgaggaccctatggtacggaagatgactttgcggtgccccctagcactaagcttgccaggatcgaggaaccgaagagggtcctgttgtacgtcaggaaagaaagcgaagaagtctttgatgcccttatgttgaagacgccttctctgaaaggactgatggaagctatcagtgacaagtacgatgtgcctcatgataagattggaaagatcttcaagaagtgtaaaaagggtatactcgtcaacatggacgacaacatagtcaaacattactcaaacgaggataccttccagttacaaattgaggaggccggcggttcctataaactcactctgaccgaaatctag

SEQ ID NO: 118987 - DNA, 1857 bp, Artificial Sequence
  Description of Artificial Sequence: Synthetic coding sequence
atgacgcaggagtacgacaacaaacggcctgtgctggttttacaaaacgaggcgttgtaccctcagcgtcgaagctatacctccgaggatgaagcttggaaatcttttctcgaaaacccgctgaccgccgccacgaaagctatgatgtctatcaacggggatgaggactcagccgccgctctcggattgctctacgactactataaagtgcccagagaacggcgctcttctacagccaaacccgaagtggagcatccagagcctgatcatagcaagcgcaatagcatccctatcgtcaccgagcagcctctcatcagtgccggcgagaaccgcgttcaagtcctgaagaatgtcccattcaacattgtgcttccccatgggaatcagcttgggatcgacaagagaggacacctgacagcccccgacacgaccgtcacggtttcgatagctaccatgcccacccattcaattaagactgaaacccagccacacggcttcgcagtcggaattccccccgcagtgtatcacccagagccaacggaacgcgtagtggtgttcgatagaaatttgaatacggatcagtttagttctggcgcccaagcccctaacgctcagagacgcacacccgattcaacgttttccgagacctttaaggagggcgtgcaggaagtgttcttcccaagtgatctgagcctgagaatgcctggcatgaatagcgaggactatgtgttcgactcagtgtccggaaataactttgagtataccttagaggcctctaagtccctacgacaaaagcctggggacagtaccatgacatacctgaataagggtcagttttatcccataacacttaaagaggtgtcctcctccgagggtatccaccatcctatatctaaagtgcgctccgtcatcatggtcgtgttcgcggaagataagagccgggaggaccagctcagacactggaagtattggcactcgagacagcacaccgccaagcagcgatgtatagacattgccgattacaaggaatccttcaacaccatatccaacatcgaggaaattgcgtacaatgcaatttctttcacatgggacattaacgacgaggccaaggtgtttatctcagtgaactgcctttctactgatttctcttcccagaagggcgtgaaaggtctgccactgaatatacaggtggacacttatagttataacaatcgcagtaacaagcctgttcaccgtgcatattgtcagattaaagtattctgcgataagggggccgagaggaagatcagggacgaggagaggaaacagtctaagcggaaagttagtgatgtgaaagtacccctgttgccttcacataaacgtatggatataactgtgttcaagccgttcatagatctggatactcaacctgtgttgtttatcccagatgtgcactttgctaatctgcagcgggggacccacgtgctgcctatcgcaagcgaggagcttgaaggcgagggatcggtgctgaaaagagggccatacggcacggaggacgacttcgccgtccctccgtcaacaaagctagcacgtatcgaggagcccaagcgtgtgcttctgtatgtgcggaaggagtcagaggaggtatttgatgccctgatgctgaaaaccccttcactgaagggacttatggaggcaatctcggacaagtacgacgtccctcacgacaaaatcggaaaaatcttcaaaaagtgtaaaaaggggatcttggttaatatggatgacaacatcgtgaaacattacagcaacgaggacaccttccagttgcagattgaggaggccgggggctcatacaagctgactctgacggaaatctag

SEQ ID NO: 118988 - DNA, 1857 bp, Artificial Sequence
  Description of Artificial Sequence: Synthetic coding sequence
ttgccgaaggaggtcgagaacaagaggccggtactggtcctacagaacgaggcattatatccacaacggcgaagttatacatctgaagacgaggcatggaagtcatttcttgaaaatcctctgacagctgctacaaaggctatgatgtccatcaatggggatgaggactccgcagcagcgctcggactgctgtatgattattacaaagtccctagagagcgcagatcaagcactgccaagcccgaagtcgaacatccggaacctgaccacagcaagcgcaatagcattcccatcgttaccgaacagcctctgatttccgccggggaaaacagagtgcaggtgcttaaaaatgtgcctttcaacatcgtcctaccccatggaaatcagctgggcatcgataagcgaggacatttgacggccccggacactactgtgacggtctccattgcaaccatgcctactcattctatcaaaacagaaactcagccacacgggttcgccgtcggcattccccctgccgtgtaccatcccgagccaacggagagggtggtagtcttcgaccggaatctaaataccgaccagttttcctccggtgcccaggcgcctaatgcccagcgccggacgcctgatagtactttctccgaaacttttaaagagggcgttcaagaggtattttttccctctgatctgtccctacgaatgccaggaatgaattctgaagactatgtttttgactcggtctccggcaataactttgagtatacactggaagcatctaagtccttaagacaaaagcctggcgactccactatgacttacctgaacaaaggtcagttttatcctattacgttgaaggaggtgtcaagctccgaaggcatccaccaccccataagtaaggtgcggtctgttatcatggtggtgttcgcggaggataaatctcgggaagatcagctacgacattggaaatactggcacagccggcagcacacagctaagcagcggtgcatagatatcgctgattacaaggagtcattcaacacgatttccaatattgaagagatcgcgtataacgccattagcttcacctgggatataaatgacgaggctaaggttttcatctctgtgaattgcctgagcactgatttttcctctcagaaaggggtgaaagggctccccttaaacattcaggtcgacacttattcatacaacaatagatctaataaaccagtgcaccgtgcctattgccaaattaaggtcttttgcgataaaggggccgagaggaagatcagggacgaagaacggaagcagtctaagcgaaaagtgtctgatgtaaaagtgcccctgctccccagccacaagagaatggacatcaccgtgttcaagcctttcatagaccttgacacccagccagtgctcttcatccctgacgtacacttcgccaacctgcagaggggcacacacgtgctaccaatcgcctctgaagagcttgagggggaagggtccgtcctgaaacgaggtccttacggcaccgaggacgattttgccgtgcctcctagcacgaagctggcacggatcgaggagcctaaaagagtgctgctctacgtgagaaaggagtctgaagaggtattcgacgccctcatgttgaagacaccctccctgaaggggctgatggaagccatatccgataagtacgacgtcccccacgacaaaataggcaagatcttcaagaaatgtaaaaaggggattctagtcaatatggatgataacatcgtgaagcactattcgaacgaggacacattccagttgcaaatagaggaggccggtggctcttacaaactgacgctgaccgagatctag

SEQ ID NO: 118989 - DNA, 1878 bp, Artificial Sequence
  Description of Artificial Sequence: Synthetic coding sequence
atgtcacaggaatcagacaataataaaaggcttgtggccttagtgccgatgccgtccgatccccctttcaacacaaggcgagcctatacatccgaagacgaagcctggaagagctacttggaaaatccgctcactgctgcaaccaaggctatgatgtccattaatggcgacgaagactccgctgcggcactgggtctgctatatgactactacaaggttcctcgcgataaacgactgctctctgtgtcaaaggcaagtgattcacaggaggatcaggaaaagcgaaattgtctggggacctctgaggcccaaagtaatctgtctggaggcgaaaaccgggtccaggttttaaagaccgtgcctgtcaaccttagcctgaaccaagatcatttggaaaactccaaaagggaacagtactcaatctccttccctgaatcaagcgctattatcccagtgtctggaatcactgtcgtcaaagccgaagactttacccccgtttttatggctcccccggtccattaccctcggggcgacggcgaggagcagcgcgtggtgatctttgaacagacacaatatgacgtgccaagcttggcaacccactcagcatacctcaaggacgaccagaggtctacccccgattcaacgtatagtgaaagctttaaggacgccgctaccgagaaatttcgctctgcatccgtaggtgcagaggagtatatgtacgaccagacatccagtggcacctttcagtatacccttgaggccaccaaatccctgcgtcagaagcaaggagagggccccatgacctatctgaacaagggacagttttatgccattactctgtcagagaccggcgataataaatgctttagacaccctatatccaaagtccggagcgtggtgatggtggtgtttagcgaagataagaacagagatgaacaactcaaatattggaaatactggcactcacgacagcacacagcaaagcaaagagtgctggatattgccgattataaggagtcatttaacaccatcggaaacattgaggaaatcgcctacaacgccgtgagtttcacctgggacgtgaacgaggaggcaaaaatttttattactgtgaattgcttatcaactgatttctctagccaaaaaggagtgaaaggccttccacttatgatccagatagacacctattcttacaataaccggtctaacaaacccatccacagagcatattgtcagatcaaagtgttttgtgataagggagctgaaaggaagataagagacgaagagaggaaacagaacaggaagaaaggcaagggccaagcctctcagacccagtgcaactcctcgtcagacggtaaattggcagccattcccctgcagaagaaatcagacatcacctatttcaaaacgatgcctgatttacattctcagcctgtgttgtttattccagatgtccattttgctaacctccagcgcacaggtcaggtctactacaacacagacgacgaacgcgagggaggcagcgttcttgtgaagaggatgttcagacccatggaggaggagtttgggcctgtgccaagtaaacagatgaaggaagaggggaccaagcgtgtcctgctctacgtaaggaaagagacagacgacgtgttcgacgccctcatgctaaagtcacctacggtcaagggactgatggaggcaataagtgagaagtacgggctgcccgtggaaaaaattgctaagctctataaaaaaagcaaaaaaggcatactggtcaatatggatgataatataatcgaacattattccaatgaggatacgtttattttgaacatggaatctatggtggaggggttcaaagtaactctgatggaaatttag

SEQ ID NO: 118990 - DNA, 1830 bp, Artificial Sequence
  Description of Artificial Sequence: Synthetic coding sequence
atgccctcggacccccccttcaacacccgccgggcttacactagcgaggatgaggcttggaaaagttacctggaaaatcctctgaccgctgcgaccaaggctatgatgtcaatcaacggtgacgaggactccgctgccgctttgggtcttttgtatgactactataaggtcccaagggataaaagactactttccgtctctaaggcaagtgatagccaggaagatcaagaaaaacggaactgcctcgggacctccgaagcccaaagcaacctttctggcggcgaaaatagggtccaggtacttaagacagtgccagttaaccttagtcttaaccaggaccacctggaaaactccaagcgcgaacagtattctatttcattcccggagtccagcgccatcattccggtcagtggaattaccgtcgtgaaggcggaggactttacaccagtgtttatggcccctcccgtccattaccctcggggggacggggaggagcagagggtcgtaatttttgaacaaacccagtatgacgtgccttcattggcaactcacagcgcgtacctgaaagacgatcagcgttctacccccgactccacatacagtgagtcattcaaagacgctgctacggagaagttccgctcagcaagtgtcggggcggaggagtatatgtacgatcaaacttcttctggtacctttcaatatactttggaggccacaaaaagcctcaggcagaaacagggggagggaccgatgacctacttaaacaaagggcagttctatgccattacgctctcagagaccggagataataaatgctttcgacaccccatctcaaaggtgcggagtgtggtcatggtggtattttccgaggacaaaaatagggacgaacagctgaaatattggaagtattggcactctcggcagcacactgccaagcagagggtattagacatcgctgactataaagagtcatttaacactattgggaacatcgaggagattgcttataacgctgtctcttttacctgggacgttaatgaagaagcgaagatcttcataacagtgaactgcctgtctactgatttctcttctcagaaaggagtgaagggactgcctttaatgattcaaattgatacgtactcctataacaaccggagcaataagcccatccacagagcttactgccaaataaaggtgttttgcgacaagggtgctgaacgcaagatcagggacgaagagcgtaagcagaatcgcaaaaaggggaaggggcaggcctctcagacccaatgcaattcatcaagcgacgggaagctcgcagccatcccgttgcagaaaaagtctgacatcacgtacttcaaaaccatgcctgatctccactcgcaacctgtgttatttatcccagatgtgcatttcgccaacctccaacggactggtcaggtttattacaacacagatgacgaacgcgagggaggatctgtcttagtaaagcgcatgttcagacctatggaggaggagtttggacctgtccctagtaagcagatgaaggaggaaggtactaaacgcgtactgctgtatgtcagaaaggagacagatgatgtctttgacgccctgatgcttaagagtcctacggtgaagggcctgatggaggctatttcagagaagtacggtttgcccgttgagaagatcgctaagctctataagaaaagtaagaaaggtattttggtcaatatggacgataatatcattgagcattactccaacgaggacacattcattctcaacatggagagcatggtagaagggttcaaagtgactctcatggagatttag

SEQ ID NO: 118991 - DNA, 1878 bp, Artificial Sequence
  Description of Artificial Sequence: Synthetic coding sequence
atgggtaaagatggaagatcaaataaacggctggttgccttggtgcctatgccctccgacccgccatttaatacccgacgcgcctatacaagtgaggatgaagcctggaagagctatctggagaatccattgacagccgcaactaaagcgatgatgtccatcaacggggatgaagactccgctgccgccctgggccttctatacgactattacaaggtacccagagacaaaaggctgttgtcggtgagcaaggcaagcgacagtcaggaagatcaagaaaagcgcaactgtctggggacttcagaggcccagtccaaccttagcggtggcgagaatagggtccaggtgcttaagaccgtgccagtgaatttgagccttaaccaggatcacctggaaaacagcaaaagggagcagtactctatcagtttccccgagtcatccgccatcattcctgtgtctggcataaccgtggtgaaggccgaggatttcacccccgtgttcatggcgccccccgtccactatccacgaggcgatggggaggagcagcgcgtggttatttttgagcagacacagtacgatgtgccttcactagccactcacagcgcatacctgaaggacgatcagcgaagtacccccgactcaacttatagtgagtcgttcaaggatgccgccactgagaagtttcgcagtgcctcagtgggcgccgaagagtatatgtatgaccagactagcagcggtacctttcaatacactctggaggccacgaagtccttgagacagaagcagggggaagggccgatgacctacctgaataaaggacagttttatgcgatcactctttcagagacaggtgacaacaagtgcttccggcatccaatatccaaggtccgaagcgtggtgatggtggtgttctccgaggataagaacagagacgaacagctaaagtattggaagtattggcattcccggcagcacaccgccaagcagagagtgttggacattgccgactataaggagtcttttaataccatcggaaacatcgaggagatcgcctataatgccgttagcttcacgtgggatgtgaacgaggaagcaaagattttcattactgtgaactgccttagcacagatttttcaagccagaaaggagttaagggcctgcctttgatgatccagatcgatacctattcctacaacaatcgatctaacaagcccatccatcgcgcatactgccaaataaaagttttctgtgacaagggagccgagcggaagatacgcgacgaggaaaggaaacaaaaccggaaaaagggaaagggccaggcttcacagacccaatgcaacagttcttctgatgggaagctggccgcgatccctctacaaaaaaagagtgatatcacctattttaagaccatgcccgatctccactcccagcctgtactgttcatccccgatgtgcactttgccaatttacagagaacaggccaggtgtattacaacacggacgacgagagagaggggggaagcgtcttggtgaaacgcatgtttagaccaatggaagaggaattcggccccgttcccagcaaacagatgaaggaagagggcaccaaaagggtgctgctgtatgtacgaaaggagacggacgatgtattcgatgcccttatgctgaagagtcctactgtcaagggactcatggaggcaattagtgaaaaatacgggctgcctgtggagaagatcgctaagctatacaagaagtctaagaaagggattctggtgaacatggacgacaacatcatcgagcactatagtaatgaagatacgttcatcctcaatatggagtccatggttgaaggattcaaggtgaccctgatggagatctag

SEQ ID NO: 118992 - DNA, 21 bp, Artificial Sequence
  Description of Artificial Sequence: Synthetic coding sequence
atgtcccaggaatcggactag

SEQ ID NO: 118993 - DNA, 1737 bp, Artificial Sequence
  Description of Artificial Sequence: Synthetic coding sequence
atgctccgccgcctggacaaaatcaggtttaggggccacaagagagatgactttcttgatctggcggagagcccaaacgcctcggacaccgagtgctccgatgaaataccgcttaaagttccgcggacgtcacctcgcgacagcgaagaactaagggacccagccggaccgggcacattaataatggcaactggcgtccaggactttaatagaactgagttcgatcgtctgaacgagatcaaaggtcacttggaaatcgcgttactggaaaagcactttttacaggaggagctgcgaaaacttagagaagagacaaacgccgaaatgttacgccaggagctggacagagagcggcagcggagaatggagcttgagcagaaagtgcaggaggtgctgaaagcaagaacagaagaacaaatggcacagcagccacccaagggtcaggcccaggcttctaacggtgccgaacggcgatcccagggcttgtcttctcgccttcagaagtggttctacgaaaggttcggcgagtacgtggaggatttcagatttcagcccgaagagaacaccgtcgaaacagaagaaccactttcagcacggaggctgaccgagaatatgcgtaggctgaagcgaggtgcaaagccagtaacaaacttcgtgaagaacctgagcgcattgtccgattggtactccgtttatactagtgccattgcattcacagtctacatgaacgcagtttggcacggatgggccattccactgttcctgttcctggctatccttcggcttagcctcaattacctgatcgcgagaggttggcgcattcagtggagcatcgtccccgaggtgtctgagcctgttgagccacccaaggaggacctgacagtaagtgagaaattccaactggtgttggatgtcgcgcagaaagcccagaacctgtttgggaaaatggctgatatcctagagaaaatcaaaaacctttttatgtgggtgcagcccgagattacccagaaactgtatgtggccctgtgggccgccttccttgccagctgcttcttcccctataggttagttggccttgcagttgggttatatgccggcattaagttcttcctcatcgacttcatctttaaaaggtgcccacgcctccgcgcaaagtatgatactccatacatcatctggcgatcactccctactgacccccaactcaaagagagatcctccgcggccgtgtcccgccggctccagacaaccagctctcgatcctatgtacccagcgcccctgctggattgggaaaggaagaagacgccggtaggttccattccaccaaaaaagggaacttccacgagatctttaacctcacagagaacgagcgcccccttgccgtttgcgagaatggatggcgctgttgcctcatcaatagggaccggaagatgcctacggattacattcgcaatggtgttctgtacgtcaccgagaattacttgtgtttcgagagcagtaagtccggatccagcaagcggaacaaagtgataaaactggtggatatcacggacatccagaagtacaaggtcttatctgtcctgccaggctcaggtatgggaattgcagtatcgacccccagtactcagaaaccactggtcttcggggccatggttcacagagacgaagcgtttgagacaattctgagccagtacataaagattacctccgcggcggcatccggaggagacagctag

SEQ ID NO: 118994 - DNA, 1737 bp, Artificial Sequence
  Description of Artificial Sequence: Synthetic coding sequence
atgttgcgcagactggacaaaatccgcttcaggggccacaagcgagacgactttttggatcttgcggaaagcccaaatgcctctgacaccgagtgctctgatgaaatccctctaaaagttcctcgaacttctcctcgggattctgaagagcttcgcgacccagctggtcctggaacccttatcatggccacaggagtgcaagacttcaacagaacagagttcgatcgcctgaatgagatcaagggccatctcgagatcgctctgctcgaaaagcattttctccaagaagagctgcgcaagctccgagaggaaaccaacgcagaaatgctgaggcaggagctggaccgagaaagacagagacgtatggaactggagcagaaagttcaggaggtcctaaaagctcgaactgaagagcagatggcacagcaaccaccgaaagggcaagcccaggcatccaacggagcagaaagacggtctcagggcctctcctcacggctgcaaaaatggttttacgaacgcttcggcgagtatgtagaggactttcgattccaacctgaggagaacaccgttgaaacagaggaaccgctgtcagctcggcggctgacggagaatatgcgcagactgaagagaggggctaagccagtgactaactttgttaaaaacttgtccgcgttatctgattggtatagcgtctatacaagtgccatcgcctttaccgtgtacatgaatgctgtatggcatggatgggcaataccactgttcctgtttctagccattcttcgactctcactgaattatctcattgcgcgaggatggcgtatccagtggagtatcgtacccgaggtgagtgaaccagtggaaccacctaaggaggacttaacggtatccgagaagttccagctggtgctggatgttgcgcaaaaggcacagaacctatttggaaaaatggccgacattttagaaaagataaaaaatctatttatgtgggtgcagccggagatcacgcaaaaactgtatgtggccctgtgggccgccttcttggccagctgctttttcccttatcgtctcgtcggcctagccgtcgggctctacgcaggcattaaattcttcctaatagattttattttcaagaggtgcccgcgcctgagagccaagtacgatacaccctacattatatggcggtctcttcctaccgatcctcagctaaaggaacggagcagcgcggctgtgtcccggagactgcagacaaccagctcccgctcatacgtgcccagcgctcctgcagggttagggaaagaggaggatgccggaagatttcacagtacgaagaaaggaaattttcatgagattttcaatctgacagagaacgagaggccattggctgtgtgcgagaacggctggagatgttgcctgataaaccgagatcgcaaaatgcctacagattacatcagaaacggggtgctatatgtgacagaaaactacctctgtttcgaaagtagcaaatcgggtagttccaaacgaaataaagtgattaagctcgtcgatattaccgacatccaaaaatacaaggtgctcagcgtgctgcccggcagtggaatgggcatcgcagtatccactccaagcacacaaaagcctctcgtgttcggcgccatggtgcatcgcgatgaggcatttgaaaccattttatcccaatacataaagatcacatccgcagccgccagtggcggtgactcttag

SEQ ID NO: 118995 - DNA, 102 bp, Artificial Sequence
  Description of Artificial Sequence: Synthetic coding sequence
atgctgaggcggctggacaagatccgattcagggggcacaagagggacgactttctcgaccttgctgagtcgcccaacgcctcagatacggagtgtagttag

SEQ ID NO: 118996 - DNA, 1782 bp, Artificial Sequence
  Description of Artificial Sequence: Synthetic coding sequence
atgtggaccctagtatcgtgggtcgccttgactgctgggctcgtggcaggcactaggtgcccggatggccagttttgccccgtcgcctgctgtctcgatcctggcggggcgtcatattcgtgttgccgccctctcctagataagtggcccaccactctgtcccgccacttggggggcccctgccaggtggatgctcactgttccgccgggcatagttgcatctttacggtttcaggcaccagttcttgctgtcccttccccgaggcagtggcatgcggtgacggccaccactgttgcccacgcgggttccactgctccgccgatggcaggtcttgctttcaaaggagcggcaacaattcagttggggccattcagtgcccggactctcagtttgaatgccccgatttttcaacttgctgtgtcatggtggacggctcctggggatgttgtcccatgccgcaggcttcatgttgtgaggacagagtccattgttgcccgcacggcgccttttgtgatcttgtgcacaccagatgcataaccccgaccgggacccaccctttagccaaaaagctacccgctcagcggaccaatagagccgtggctctgagctccagtgtcatgtgtcccgatgcgcgcagcagatgtcctgatgggagtacctgttgtgagttgccaagcggtaaatacgggtgctgccctatgcctaatgcgacatgctgtagcgaccacctgcactgttgtcctcaggatactgtatgtgacctaatacagtctaaatgcttatctaaggagaacgctaccactgatctattgaccaagctgccagcccatacggtgggtgacgtgaaatgtgatatggaggtgagttgtccagacgggtacacttgttgtcgcctccaatccggggcttggggttgttgtccatttacacaggctgtctgttgtgaggaccacattcattgctgccctgcaggcttcacatgtgatacacagaaaggcacatgtgagcagggtcctcaccaggtcccatggatggaaaaggccccagctcacctttccttgcccgacccacaggccttgaagcgcgacgtgccctgcgacaacgtttctagttgcccttcctccgatacttgctgccaactgacttccggagaatggggctgttgtcccattccagaggccgtctgttgcagcgaccatcagcattgctgccctcagggctatacttgtgtcgctgaaggccagtgccaacgcggtagcgagatagtggcaggtctggagaaaatgccagcaaggcgcgcttccctgtcccacccgcgcgatattgggtgtgatcagcacacttcatgccccgttggccagacctgttgtccaagcctcggtggttcctgggcatgttgccagctcccccatgccgtttgttgcgaggaccggcaacattgctgtccagctggctatacttgcaacgtcaaggcacgctcatgcgaaaaggaggtggtctctgcccagcctgccactttcctggcccggtcaccacatgttggcgtgaaggacgtggagtgcggggaaggtcacttttgccacgataatcaaacttgctgcagggacaatcgtcaaggttgggcgtgctgcccatatcggcagggagtatgctgcgctgatcgacgacactgctgcccagctggattccgttgcgctgctcgcggtaccaagtgtctccggcgcgaggctccccggtgggacgcccctttacgcgatcccgccctgcgacaattgttatag

SEQ ID NO: 118997 - DNA, 1317 bp, Artificial Sequence
  Description of Artificial Sequence: Synthetic coding sequence
atgtggacgcttgtaagctgggtcgcactgaccgcgggcctggtagccggtacgcggtgtccggacggacagttctgcccagtggcctgctgcctggatcctggaggcgctagctactcatgctgccgcccgttgctcgataaatggcctacgaccctttctcgacatctggggggaccatgtcaagtagatgctcactgctctgcgggacacagttgtatctttacagtatcaggaactagcagctgttgcccttttcccgaagctgtcgcatgcggcgacggtcatcactgctgtcctcggggctttcattgctctgcagatgggagaagttgctttcagagaagcggtaacaactcggtcggagccatccagtgcccagacagccagttcgagtgcccggacttttcaacgtgctgtgttatggtagacggcagttgggggtgctgccctatgcctcaagccagttgctgcgaagatcgtgtccattgctgtccccacggagccttctgcgatctggtccacacaaggtgtattacccccacagggacacatccacttgctaaaaagctcccggcccagcgaaccaatagggcagttgctctgtcttcctcggtgatgtgccccgatgcccgttcccggtgtcccgacggatcaacctgctgcgagcttccaagtggcaagtacggatgctgccccatgccaaacgctacttgctgctccgaccacctgcactgctgtccacaagacaccgtgtgcgacctcatccagtctaagtgcctgagtaaagagaacgcaaccacagatctgcttacgaaactgcccgcacatactgtgggggatgttaagtgtgatatggaggtctcatgcccagacggttatacctgctgtcggctgcagtcaggggcctgggggtgttgtccattcacccaggccgtatgctgcgaagatcatatccactgttgtcctgccgggtttacttgtgatacacagaagggaacttgcgagcaagggccccaccaggtgccatggatggagaaggcgccagcccacttgtcactccccgacccccaggcccttaaacgggacgttccttgtgacaatgtgagcagctgtccctccagtgacacttgttgtagggataaccggcagggttgggcctgttgcccgtatcggcaaggggtttgttgcgctgaccgacgccattgctgtcctgccggtttccggtgcgcggcccgaggcactaagtgtcttcgacgggaagcccccaggtgggatgcaccactgcgtgatcccgctctgcgccagttactgtag

SEQ ID NO: 118998 - DNA, 1242 bp, Artificial Sequence
  Description of Artificial Sequence: Synthetic coding sequence
atggctatcaccgctgcacacggtgcctcaactgccgtgcagactggagaccccgctagcaaggatcaggtgactacgccttgggtgccaagctcagctcttattgtgagctccaatgctcgcactagccctagggccgttctgtggagcatggcaccgggcggggcagctccctgtcctagacttcccgccgtgaaaacaggttgtactgccgtgtgtgatttgatccaaagcaaatgccttagtaaggagaatgccaccactgacctccttaccaaactacccgctcacactgtgggggatgtcaaatgcgacatggaggtgtcttgcccagatggttatacctgctgtcggctgcagtcgggagcctggggctgttgcccttttacccaggccgtgtgctgcgaggatcacattcactgttgtcccgctgggttcacgtgcgatacccagaaggggacgtgtgagcaggggcctcatcaggttccatggatggaaaaggccccagctcatctgagcttgccagatccacaagcccttaagagagacgttccttgtgataatgtgagcagctgtccaagcagtgatacgtgttgtcagcttaccagtggggagtggggatgctgtccgatccccgaggctgtttgttgctcagaccaccagcattgctgtccgcagggatacacgtgcgtggccgagggccaatgccagcgagggtcagaaattgtagccggtttagaaaagatgccagctcgcagagccagcctctcccacccgcgggatattgggtgcgatcagcacacatcctgtccggtcggacagacctgttgccccagcttaggaggcagctgggcttgctgccagctgcctcacgccgtttgctgcgaggatcggcagcattgctgtccggcaggatacacctgtaacgttaaagctcgcagttgcgagaaagaagtggtgtccgcccagccggccacctttcttgcccgctctccacacgtaggagtgaaggatgtggagtgcggagaaggccatttttgccacgataaccagacctgctgcagagacaatcgccagggctgggcctgttgcccatatcgccagggcgtctgctgcgctgatcgacgccactgttgtcccgcaggcttcagatgcgcagcacgtggaacgaagtgcttacggagagaggcccctcggtgggacgccccactgcgtgatccggccctgcggcagcttctttag

SEQ ID NO: 118999 - DNA, 789 bp, Artificial Sequence
  Description of Artificial Sequence: Synthetic coding sequence
atgcgtaattcctaccgctttctcgcctcctcgttgtcagtcgttgtgagcctgcttctgattccagaggatgtctgcgaaaagataataggcgggaatgaagtcacaccccactcaaggccttacatggtgctgttgtccctagatagaaagactatttgtgccggcgccttaatcgccaaggactgggtgctcacggccgcccattgcaatctgaacaagcggtcccaggtcatactgggggcccattcaataaccagagaggagcctacaaagcagattatgctggtgaagaaggagttcccttacccatgttatgaccccgctacgcgcgaaggcgacttaaagctgctgcagcttatggaaaaggccaaaatcaacaaatatgtcacaatccttcacttgccgaagaaaggcgatgatgtgaaacccgggactatgtgccaggtggcgggatggggtaggacccataactcggcatcatggagtgacactcttcgtgaggttaatattacaattatagatagaaaggtttgcaacgatagaaatcattacaacttcaacccagtgattgggatgaatatggtatgtgctggcagtctccggggcggccgggactcatgcaacggtgactcaggatccccactcctgtgcgagggcgtgttccggggagtcactagctttggcttggagaataagtgtggcgatcctcggggtcccggggtgtacatcctcctgtccaaaaaacatctcaactggattattatgaccataaagggggcagtttag

SEQ ID NO: 119000 - DNA, 741 bp, Artificial Sequence
  Description of Artificial Sequence: Synthetic coding sequence
atgcaaccctttctcctgcttctggccttcctgctgacacccggagctggcacagaagaaataatcggaggtcatgaggctaagccacattctcgaccctacatggcgttcgtgcagttcctacaggaaaaatctaggaaacggtgcggaggtatcctggtgaggaaagattttgtcttgaccgccgcacattgccagggctcctcgatcaatgtcactttaggtgcccataacattaaggagcaggagagaacacaacaattcattccggtgaaacgaccaattccccacccagcatacaatccaaaaaatttcagcaacgacattatgctgctgcagctggaacggaaagctaaatggaccaccgccgttagacctctgagactgccaagcagtaaggcccaggtgaagcccggtcagctgtgcagtgttgctggatggggttacgtgtccatgtccactctcgctacaaccctccaggaggtgctgctgactgtacagaaagactgccaatgcgaacgactgtttcacggaaattactcgagagctacggagatctgtgtgggtgatcccaaaaaaacacaaacgggcttcaaaggtgatagtggaggaccactcgtgtgtaaggatgtcgcccaggggatcttatcttatggtaacaagaaaggcactccaccaggggtgtacattaaagtgagccatttcttaccgtggattaaaaggaccatgaaacgtctgtag

SEQ ID NO: 119001 - DNA, 459 bp, Artificial Sequence
  Description of Artificial Sequence: Synthetic coding sequence
atgcagcccattctgctgctgctggcctttttactactcccacgtgcggaccaactggaaaggaaagctaagcgaacaagagctgtgcagccactcagactgccatcaaacaaagctcaggtcaaaccaggtcagacctgttctgtggcgggatggggccagaccgcacccctgggtaaacacagtcatacacttcaggaagtaaagatgaccgtccaggaagataggaagtgtgagagtgacttacgtcactactacgatagcacaattgagctctgtgtcggcgatcccgaaattaaaaaaacctccttcaagggtgacagcgggggcccgctggtttgcaacaaggtcgcacagggtatcgtatcctatggacgcaataatggcatgccccccagagcttgcacgaaagtaagtagcttcgtccattggataaagaaaaccatgaagagatattag

SEQ ID NO: 119002 - DNA, 609 bp, Artificial Sequence
  Description of Artificial Sequence: Synthetic coding sequence
atgcaaccgatcctgctgctgctggcatttctcttactaccccgggcagacgctggagagatcattggaggacatgaggcaaaacctcacagtcgcccttacatggcttacctgatgatctgggaccagaagagtcttaagcggtgcggaggcttccttatcagagatgacttcgtgcttactgcggcccactgttgggggaggctcgaaagaaaagccaagcgcactcgggcagtgcagcccttgcgtctcccctccaacaaagcccaagtgaagcccgggcagacatgcagtgtggctggatggggtcagacggctcccctgggcaagcacagccatacgctccaggaggtcaaaatgacggtccaggaagacagaaaatgtgagtctgacctgagacactattatgacagcactatcgaactgtgcgtcggagatcctgagattaagaagacctctttcaagggcgacagtgggggaccactcgtatgtaacaaagtggcccaggggattgtgtcctatggtcggaataatggtatgcctcctagagcatgcacaaaggtaagctcgttcgtacattggatcaagaaaaccatgaagaggtactag

SEQ ID NO: 119003 - DNA, 846 bp, Artificial Sequence
  Description of Artificial Sequence: Synthetic coding sequence
atgaagtccttgagtctcctacacctgttcccactgcctcgggccaaacgtgagcagggcggaaataactcgagcagcaaccagggttccctgcccgagaagatgcaacccatacttctgttattagcctttctgcttctaccaagggccgacgctggcgaaattataggtggccacgaggccaaacctcatagccgtccatacatggcttatctcatgatctgggaccaaaagtctttgaagaggtgcgggggttttctcattagggacgattttgtgttaacggccgcccattgctggggttcaagtattaacgtgacacttggcgcacataacatcaaggaacaggaacctacccagcaattcatccctgttaaaaggcctatcccccatcccgcctataaccccaaaaacttcagcaatgacataatgttgctgcagttagaacgaaaggctaaacgaacccgcgctgtccagccattgcgactaccctcaaataaggcgcaggtgaaaccagggcagacctgttccgtggcgggttggggccagacagctcctctgggcaagcatagccacaccctccaggaggtaaagatgactgtccaggaggaccgcaaatgcgaatctgatttacgtcattattacgacagtactatcgaattgtgcgtcggagaccccgaaatcaaaaaaacttcattcaaaggcgacagtgggggccccctggtatgcaacaaggttgcgcagggcatcgtttcttacggccggaacaacggcatgcctccaagagcatgtacaaaggttagctcatttgtgcactggattaagaagaccatgaagaggtattag

SEQ ID NO: 119004 - DNA, 708 bp, Artificial Sequence
  Description of Artificial Sequence: Synthetic coding sequence
atgcagacatttcctagcggcgagattattggaggccacgaagccaaaccccattccaggccatacatggcctacttgatgatctgggatcagaaatctttaaagagatgtggaggatttctgataagggacgacttcgtgctgaccgctgcacactgctggggctcttccattaacgtgacactaggggctcataatattaaagagcaagaaccaactcagcagttcatcccggtgaagcgacctattccccacccagcctacaatcccaagaactttagtaacgatatcatgctgttacagctggagaggaaggccaaacgcacgagagctgtgcaacctcttaggctaccaagcaataaggcccaggtgaagccgggtcagacctgtagcgtggccggctggggccagacagcccccttgggcaagcatagccataccctgcaggaagtcaagatgaccgtacaggaagatagaaagtgcgaatctgacctgaggcactattatgatagcactattgagctatgcgtgggagacccagaaataaaaaaaaccagctttaagggggactctggtggtcctctggtgtgtaacaaagtagcccaaggcattgttagttacgggcgcaataatggcatgcctcctagagcttgtaccaaagtcagcagtttcgtgcattggatcaagaagactatgaagcggtattag

SEQ ID NO: 119005 - DNA, 483 bp, Artificial Sequence
  Description of Artificial Sequence: Synthetic coding sequence
atgcagcccttcctccttctgttggcatttttactgacacccggagccggcaccgaggagattataggtggccacgaggctaagcctcattctcgaccttacatggccttcgtgcaatttctacaggaaaaatcccgaaagagatgtggagggatactcgttaggaaggattttgtgcttacggctgcccattgtcagggtagctccatcaacgtgacgctgggagctcataacataaaagagcaggagcggacccagcaatttataccggtcaagaggcctatcccacaccctgcgtacaatcctaagaattttagcaatgacataatgctgttacagggggactcggggggtcctctcgtatgtaaagacgtcgcccaaggcatcttaagctatggtaacaaaaaaggcacccctcctggcgtgtatatcaaagtttctcatttccttccatggattaaacggactatgaagcgcctttag

SEQ ID NO: 119006 - DNA, 768 bp, Artificial Sequence
  Description of Artificial Sequence: Synthetic coding sequence
atgcaacccctattgttgctgctggccttcctcctgcccaccggggccgaggctggagagattattgggggtagggagagccggccgcattctcgcccatacatggcctatctccagatccagagtcccgccgggcagagtagatgcggagggttcctcgtgagagaagatttcgtcctgactgccgcacattgctggggttccaatatcaacgttacgctgggtgctcataatattcaacgcagggagaacacgcagcagcacattacagcccggcgcgctatccggcacccccagtataaccaacgcaccattcagaatgacatcatgctccttcagctctcccggcgggtccgccgcaatcggaacgtaaatccagtcgcccttccaagggcacaggagggactccgacctggtaccctgtgtactgtcgctggttggggacgtgtgagtatgcgccgcggcacagatactctgagagaggtgcagctccgcgtccaacgcgacaggcagtgtctgcgcatatttggttcttatgatcccaggcgccagatctgcgtgggtgacaggagggaacgcaaagccgcctttaaaggagatagcggaggccctctgctgtgcaacaacgtggcccacggtattgtttcctacgggaagtcctccggtgtgcctcctgaagtcttcaccagggtcagtagcttcttaccgtggattagaactacgatgcggtccttcaaacttctggaccagatggaaacgcccctctag

SEQ ID NO: 119007 - DNA, 348 bp, Artificial Sequence
  Description of Artificial Sequence: Synthetic coding sequence
atgcagccctttttattgctcctggccttcttgctcacaccaggtgccggtactgaagaaatcattggaggccatgaggccaaaccccatagcaggccatacatggcctttgtacaatttcttcaggagaaaagtagaaagcggtgcggcggtatcctcgtccggaaagattttgttctgacagcagcacattgccaaggacggggggacagtgggggaccgctcgtgtgcaaggacgtggcgcagggaatcttgagttacggcaacaagaaaggtaccccacccggcgtgtatataaaggtctcccactttctcccatggatcaaaagaactatgaaacggctatag

SEQ ID NO: 119008 - DNA, 774 bp, Artificial Sequence
  Description of Artificial Sequence: Synthetic coding sequence
atggaagcctgtgtgagcagccttctcgttcttgccttaggggcattatccgtcgggtcatcattcggcacccagatcatagggggccgggaagtaatcccacactccagaccgtatatggccagtctgcagcggaacggttctcacctgtgcggaggagtcttggtgcatcctaagtgggtgttaacggccgctcactgcctggcccaacggatggcacagctgcgactggtgctgggcctgcacacccttgactctcccgggttgacgtttcatatcaaggctgcaattcaacatcccaggtacaaacccgtacctgccctggagaacgatcttgcattgttgcagctggatggaaaggtgaagccctctcgcactatccggcccctggccctaccgtccaaaaggcaggtcgtcgccgctggcacccgctgcagcatggctggatggggcttgactcaccagggtggtcgtctgagccgagtgttgagagaactggacctccaggtattagatacccgcatgtgcaacaactctaggttttggaacggtagcctcagtcccagcatggtatgtcttgctgcagactccaaggatcaagcgccatgcaaaggcgacagcggagggccgttggtgtgcggtaaaggccgcgtgctagctcgcgtgctgtcctttagctcccgggtttgcacggacatcttcaagccacccgttgctacagccgtcgcgccatacgtttcttggatcagaaaggtgacaggaaggtctgcctag

SEQ ID NO: 119009 - DNA, 3108 bp, Artificial Sequence
  Description of Artificial Sequence: Synthetic coding sequence
atggccgcagaaactctaaacttcggacctgagtggctgcgagcgttaagtggaggcggctcagtcgcgtcaccaccgccatcgcctgccatgccgaagtacaagctggcggattaccgatacggcagggaagagatgttggctctgtacgtgaaagagaacaaagtccccgaggaactgcaggataaggagttcgctgccgtgcttcaagacgagcctctccagcctttagctctggaacctcttacagaggaggagcaacgcaattttagtctgagcgtgaatagtgtggccgtcctgagactgatgggcaaaggggcaggcccacccctcgcaggaacctccaggggcaggggcagcacacggtctagaggccggggcagaggggatagctgtttctatcagaggagtatcgaagagggcgacggcgccttcggccgcagtcctagggagatccagcggagccaatcgtgggatgacagaggtgagaggcgctttgaaaagagcgcgcgtagggacggagcccggtgcggattcgaggagggcggagcaggcccaagaaaggagcacgctaggagcgacagtgagaattggcgttcacttcgggaggaacaagaagaggaggaggagggaagttggcgtctgggggcaggcccccgccgagacggagatcgatggaggagtgcgtcccctgacgggggtccgagatccgctgggtggagagaacacggcgagaggcggcggaaattcgagttcgacttgcggggtgacagggggggatgtggagaggaggagggccgcggtggaggtggcagctcccatctcagacgctgccgggcacctgaggggtttgaggaagataaagatggccttcccgagtggtgcctggatgacgaggatgaagagatgggtacattcgacgctagtggtgctttcctcccactgaagaaaggtcccaaagagccaatacccgaagagcaagaacttgattttcaggggctggaggaagaagaggagccaagcgaaggactcgaagaagagggacccgaagctggggggaaagaactcacacccctgccaccccaagaggagaagtccagctcgcccagcccattgcccactctcggccctctgtggggaacgaatggagatggcgacgagaccgcagaaaaagagccaccagctgcggaggatgatatccgaggtattcagctgtctccgggagtaggatccagcgccgggccccctggagatctggaggatgacgagggactaaagcacctgcagcaggaggctgagaagctggtggcctccctgcaagacagctcactggaggaggagcagtttaccgcagcaatgcaaacccagggtctgcgtcatagcgcggccgccacagcgctgccgctgtcacacggggctgcaagaaagtggttctataaggacccccaaggggaaattcaggggccatttaccacacaggagatggccgaatggtttcaggcagggtacttcagtatgtccttactggttaagagggggtgtgacgagggcttccagcccctcggggaagtgatcaaaatgtggggcagagtgcccttcgcacccggcccaagcccgcctcctttacttgggaacatggaccaagagagactcaagaagcagcaagagctggctgctgcagctctgtatcagcagctgcagcaccagcaattcctgcagctggttagtagtcgccaacttcctcaatgtgctttgagggagaaggctgccctgggcgacctgacaccccctccccctcccccccctcagcagcagcagcaacagcttaccgcctttctgcaacagctgcaagccctgaagcccccacggggtggagatcagaaccttcttcctacaatgagcaggtcattgtctgtgcctgactctggccggctgtgggacgtccacacttctgcctctagccagtccggcggggaggctagtctgtgggacatcccgattaatagctcaacacaggggccaatcctggaacagctgcagctgcaacacaagttccaggaacggcgcgaagtcgagctgagggccaagcgcgaagaggaggagaggaagaggagagaggagaagcgccggcagcaacagcaagaagagcagaagcgaaggcaagaagaggaggaactctttcgacggaaacacgtgcggcagcaggagctgctactgaaactccttcagcagcaacaggccgttccagttcccccagcaccctcctctcctcccccgctgtgggcaggcctcgccaagcaaggcttgagcatgaagactttgctggaattacagttggaaggagagcggcagctgcacaagcaaccaccaccaagagagccagccagggcccaagctcccaaccatagagtccagcttggcgggctcggcaccgcccccctcaatcagtgggtaagcgaagctggccctctgtggggaggaccagataaaagcggtggcggctcttccggactgggcctgtgggaagatacgccaaagtccggcggctcattggtcaggggcttaggcctgaaaaatagccggtccagcccgtcactgagcgattcgtattctcaccttagcggcagaccgatacgtaagaaaaccgaggaggaggagaagctacttaaacttcttcaaggaattcctcggccccaagatggatttacacaatggtgcgagcagatgctgcatactctgtccgcgactggctccctggatgttcccatggcggtcgcaatcctgaaggaggttgaatctccttatgacgtacatgactatatccgaagctgtctgggcgataccctggaggccaaagagtttgccaaacagttccttgagagacgggccaagcagaaggcttcacaacaacggcaacaacagcaagaggcttggctatcatccgccagcctgcaaaccgcttttcaggccaatcacagcactaagctgggccctggcgaaggcagtaaagccaagaggagagcactcatgttacatagcgaccctagtatactcggatattcactccacggaagcagtggcgaaattgagtctgtggatgactattag

SEQ ID NO: 119010 - DNA, 2265 bp, Artificial Sequence
  Description of Artificial Sequence: Synthetic coding sequence
agttcctttccttcaccgagactcccacaggttttccatcgacttgacgatgaagatgaagagatgggaacattcgatgcatctggggcttttctccctcttaagaaaggacctaaggagccaattcccgaggagcaagagctcgattttcagggtctggaggaagaggaagaaccgtcagagggactggaggaagaagggcctgaagccgggggaaaggaactcacgccgctccctccccaggaagagaaaagctctagccccagcccgctgccaactctggggcctctttggggaaccaatggggatggggacgaaactgctgaaaaagaacccccagctgcagaggatgatattcgcggcatccagctgagcccgggcgtgggctccagcgcaggcccaccaggagaccttgaggatgacgaaggcctcaagcacctgcagcaggaggccgagaagctcgtcgcctctctgcaggatagcagtcttgaggaagaacagttcactgctgccatgcaaactcagggcctgcggcactcggccgcagctactgcactgccgttgagccatggggctgcgcggaaatggttctacaaagatcctcagggggaaatacaggggccttttacaacacaagaaatggccgagtggtttcaggcaggctactttagcatgagtctactggttaaaaggggttgcgatgaaggctttcaacccctgggcgaggtgattaaaatgtgggggagagtcccatttgcaccaggaccatccccacccccattgctcggaaacatggaccaggaacgacttaagaagcagcaggagctcgccgccgccgcgctctaccaacagctccagcaccagcaattcctccagctggtgagttcccgacaactacctcagtgcgcccttcgcgagaaagcagccttgggagatctgacacctcctccgccaccacccccacagcaacagcagcaacaactcacagcgtttctgcagcagctccaggcccttaagccaccacgggggggggaccagaatttgctgcctacgatgagtaggagcctgagcgtgcctgatagtggaagactgtgggacgtgcacacatcagccagcagccaaagcggtggtgaggcgtccttgtgggatattcccatcaactcttccacccaaggcccaatcctggaacagctgcaactgcagcacaaatttcaggagcgacgggaggtggagctgagggcaaaaagggaggaagaagagaggaagcggagggaagaaaagcgccgccagcaacagcaggaagagcaaaagagaagacaggaagaagaagagctttttcgccggaaacacgtgaggcagcaggagctcctgctgaaattactgcaacagcagcaggcagtgcccgtgccccccgcgcccagctcacctccacctctgtgggcagggctggctaaacaaggcctgagtatgaaaactctcctcgagctgcaattggaaggtgaaagacaacttcacaaacagcccccacctcgagaaccagccagagctcaggccccaaaccatagagtccagctggggggcttaggcactgctcctctcaaccaatgggtttcagaggctggccccctctggggtggtcccgataaaagcggcggaggaagctcaggattgggactgtgggaggatacaccgaagagcggaggcagcctcgtgagagggctagggctcaagaacagcaggtctagtccctctctgtccgattcttacagtcatctgagcggaagacccatacgcaaaaagaccgaggaggaagaaaaacttctcaaactgttacaggggatacctcgtcctcaagacggtttcacccaatggtgcgaacagatgctacacacactgtccgctaccggtagcctggatgtacctatggcagtagcaatcttaaaggaagtggagtcaccgtacgacgtgcacgattatatcaggtcttgcctgggcgacacattagaagccaaagagtttgcaaaacagtttctggagaggagggctaaacagaaagcatcccagcagcggcaacagcagcaggaggcctggttatctagcgcctcccttcagactgcctttcaagcgaatcattcgaccaagctcggaccgggggagggctctaaagccaagaggagggcgttaatgctccacagcgacccctctattctcgggtacagtctgcacgggtccagcggtgaaattgaatccgtggatgactactag

SEQ ID NO: 119011 - DNA, 3900 bp, Artificial Sequence
  Description of Artificial Sequence: Synthetic coding sequence
atggccgcagaaactcaaacactgaattttggccccgaatggctgcgcgctctctcgtccggtggatccattacaagcccccctttgagtccggccctgcccaaatataaactcgccgactaccgctacggcagggaggaaatgcttgccctttttctcaaggataataaaatcccttccgatcttcttgacaaggagttcctccccatccttcaggaggaacccttaccccccctggccttggtaccctttaccgaagaggaacagcgcaatttctcaatgagtgtgaattcagcagccgtcttgcgtttgacgggcaggggaggcgggggcactgtagtgggggcccccagggggcgtagctcttcaagaggaaggggaaggggcagaggcgaatgtggattttaccagaggagttttgacgaagtggagggcgtgttcgggcgcgggggggggcgtgaaatgcatcgctcccagtcctgggaggagcggggcgatcggaggttcgagaagccgggaagaaaggatgtgggaagacccaacttcgaggaaggagggccaaccagtgtaggccggaaacacgaatttatcagatctgagagcgaaaactggcgaatatttcgggaagagcagaacggggaagatgaggacggaggatggcgcttagccgggagccggcgagatggtgagagatggcgccctcatagcccggatggtcccaggtccgctggttggagggagcacatggagcgtcgacggagatttgagttcgatttcagagacagggatgatgagagagggtaccgccgcgtacgctctggttcaggctcgatagacgacgatcgggattccttaccggaatggtgtctcgaagacgcagaggaagaaatgggtactttcgattcatctggtgcattcctgtccctgaagaaagttcagaaagaaccaatcccggaggagcaggaaatggacttcagacctgttgatgagggtgaggagtgtagcgactcagaggggagccacaatgaggaggccaaagagcctgataaaacgaataagaaggaaggggaaaaaacggaccgcgtcggagtagaggcatcagaggagacaccccagactagctcatcatccgctaggccgggtacaccatctgaccatcagagccaggaagcatcacagtttgagcgtaaggatgagcccaaaaccgaacagacagaaaaggccgaggaagagacaagaatggagaactccctgcccgctaaggtgccaagcagaggcgatgagatggtggcggatgtacagcaaccccttagccagattcctagcgacacagccagcccgcttctcattctcccccctcccgtgcctaacccatcgcctacgttaagacccgtcgaaacaccggtggtgggtgccccgggtatgggttctgtcagcacagagcccgatgacgaggagggtctgaaacatctcgagcaacaggctgagaaaatggtggcgtaccttcaggatagtgccctggatgatgaacggctcgcttcaaaattgcaggaacatcgcgccaagggcgtgtccatccccctcatgcacgaagccatgcagaaatggtactacaaagacccacaaggcgaaatccagggcccctttaataaccaggagatggccgagtggttccaggcaggttacttcacaatgagtttgctcgtgaagagggcttgtgatgaatccttccagcccctgggagatatcatgaaaatgtggggccgagtgccatttagtcccggccctgcaccacctccacatatgggagagctcgaccaggaaagattgacgcggcagcaggaactaactgccctttaccaaatgcaacacctccaataccaacaatttctgatccagcaacagtacgcccaggtgctggcgcagcagcagaaggcagccctgagttcacagcagcagcagcagcttgccctgctgctgcaacagtttcaaaccctgaaaatgcggatcagcgaccagaatattatcccctccgtgaccagatcagtctcggtcccagacacgggatctatctgggaattacaacctaccgccagccaacctacagtatgggagggcggatccgtgtgggatctacctttagacaccaccactcccggaccagccttagaacagctgcagcagttagaaaaagcaaaggctgccaaactcgaacaggagcgtcgcgaagccgagatgagggctaagcgcgaggaggaggaacgaaagcgtcaggaggaactcagacgccagcaagaagaaatacttaggagacaacaagaggaggagcgtaagaggcgtgaagaggaagaactggccaggcggaagcaggaggaagctttgagacgtcagcgggagcaagaaattgccctccggagacagcgcgaggaggaagagagacagcaacaggaagaggcccttagaaggcttgaggagaggcgtagggaagaagaggaaagaagaaaacaagaggaacttcttcgcaagcaggaggaggaagcagcaaagtgggcacgggaggaggaagaggctcagcgacggctggaagaaaatcgtctgcgaatggaggaagaagccgcacgtctccgccacgaggaagaagaacgcaaacgcaaagagctagaggtacagcgccagaaggaactgatgagacaaaggcagcagcagcaggaggccctgagacgcctccagcaacagcaacagcaacagcaattggctcagatgaagcttccatctagctctacctgggggcagcagagcaacactaccgcttgccagtctcaggcgaccctgtctctcgctgagatccagaaactggaggaagaaagggagagacagttaagagaggaacagcgtcgccagcaaagggagttaatgaaagccctccaacagcagcagcagcagcagcagcagaagctctccggatgggggaacgtgtcaaagccaagcggtaccactaagtcactgcttgaaatccagcaggaggaggctaggcaaatgcaaaaacagcagcagcagcaacagcagcaccagcagccaaatagggccagaaataacacccacagtaacctgcacaccagcatcgggaacagcgtctgggggtctattaacactggccctccgaatcagtgggccagcgacctggtgtcaagtatatggtctaatgcggacactaagaactcgaacatgggattctgggacgatgctgtgaaagaggtcggaccaaggaacagcactaataaaaacaaaaacaacgccagtcttagtaagagcgtaggcgtgtccaaccgccagaacaagaaggtggaagaagaggagaagttactgaagctgtttcaaggggtgaacaaggctcaagacggatttacccagtggtgcgagcaaatgctgcacgccctgaacaccgccaacaaccttgatgtccccacattcgtgagtttcctgaaggaggtcgagagcccatatgaggtgcacgactatatacgtgcctatcttggagacaccagcgaggcaaaagaatttgccaagcaatttttggaacggagagccaagcagaaggccaaccagcagcgtcagcaacaacaattgccacagcagcaacaacagcaaccacctcaacaacccccacaacagcctcagcagcaggattcagtttgggggatgaaccactcaacactgcattcagtctttcagaccaaccagtctaacaaccagcaaagcaatttcgaagccgtgcaatctggaaagaagaagaaaaagcagaaaatggtgagggcggaccctagcctgctgggttttagcgtcaatgcatctagcgagcgccttaacatgggtgaaattgagacacttgatgattactag

SEQ ID NO: 119012 - DNA, 3966 bp, Artificial Sequence
  Description of Artificial Sequence: Synthetic coding sequence
atggcggccgagacacaaaccctgaacttcgggccagagtggcttagggccctcagcagtggtggctccatcacgagcccacccctgagccccgcccttcctaagtataaactggccgactacagatacgggagggaggaaatgctggccctgtttctaaaagacaacaaaatcccctccgaccttctcgataaggaattcctccccatcctgcaagaggaacctctgccacctttggccctggtgccatttacagaggaggagcagagaaacttctccatgagtgtcaatagtgccgccgtactgcgcttaaccgggaggggcggcgggggaaccgtagtgggagccccaagggggcgaagctcctcacgtgggagaggacgtggccgcggggaatgcggattttatcagagatcttttgatgaggttgaaggcgtcttcgggagggggggcgggagggagatgcatcgcagccagagctgggaggagagaggggacaggaggtttgaaaagcccgggcgtaaagacgtcgggaagaagaacggttattattgcatgtatagccctgtcctgctgctgggccagcctctttgccaaggtaggcccaacttcgaggaaggcgggcctacgagcgtggggcgcaaacacgaattcatccgaagtgagtcggagaattggagaatctttcgagaagagcagaacggagaggacgaggatggcggctggcgtctagccgggagccggcgagacggcgagaggtggcgccctcacagtcccgatggaccgaggtccgctgggtggagggaacacatggaacggaggaggcggttcgaatttgatttccgggaccgcgatgacgagcgaggataccggagagtgcggtcaggctccgggtctattgacgatgaccgagatagtctcccggaatggtgcttagaagacgctgaagaggaaatgggtacctttgacagctctggcgccttcctgtctctgaagaaggtgcaaaaggaaccaattccagaagaacaagaaatggattttcgcccagttgatgaaggagaagaatgctccgatagcgagggttctcataatgaggaggctaaagagcctgacaagacaaacaaaaaggagggcgagaagactgaccgcgtgggcgtcgaagcctccgaggagacaccacaaacttcgtcttcatcagctcgccctggcacaccgtctgaccatcagtcacaggaagcgtctcaatttgaaaggaaagatgagcccaagaccgaacagaccgagaaagccgaggaggaaactcgtatggagaattcactaccagctaaagtcccttctcgaggcgacgaaatggtagccgatgtccagcagcccctgtcccagattccctccgatacggcctcccccctcctgatactccccccaccagtgcccaacccatctccaacattgagacctgtcgagacacctgtggttggggcccccggaatgggaagcgtgtctacagagccggatgatgaggaagggcttaagcacctggaacagcaagcagaaaagatggtggcctatctgcaggattccgccttggatgatgagcgcctggcgtctaagctccaggagcaccgagccaaaggagtttctatcccgctcatgcacgaggcaatgcagaagtggtattacaaggacccccagggcgagatccaggggccgtttaataaccaagagatggctgaatggtttcaggccggttactttacaatgagtctgttggtcaaacgtgcctgtgacgagagcttccagcccctgggtgacatcatgaagatgtgggggcgggtgcccttctcccctggccccgcaccaccgccccatatgggcgagctggatcaggagcggttgaccagacagcaggagttaacagccctgtaccagatgcagcatctgcagtatcaacagtttttgatccagcagcagtatgcccaggtgctggcccagcaacagaaagcagcgttatcctctcagcaacagcaacagctggccctgctcctccagcagtttcaaacactgaagatgaggatctctgatcagaacattatcccgtctgtgacccgttccgtcagcgtcccagacactggctcaatctgggagttgcagcctaccgcatcacaaccgacagtgtgggaggggggaagtgtttgggatctgccccttgacactacaacccctggccctgccctcgagcagctgcaacagttggagaaggccaaggctgctaaacttgagcaggagcgccgcgaagcggagatgagagcaaagcgagaagaggaggagcgcaaacggcaagaggaactgcgtaggcagcaggaagagatacttcgtcgccagcaggaagaagagcggaaacgtcgggaggaggaggaactggctcgccgaaagcaggaagaagccctccggcgccagagagaacaggaaatcgcgctgcggcggcagagggaggaggaggagcgtcagcagcaggaagaggcccttaggcgactggaggagaggcggcgtgaagaagaggaacggcggaagcaggaggaactgctcaggaagcaggaggaggaagcggctaaatgggcccgcgaagaggaagaggctcagcggcgactggaggagaatcggctgcggatggaagaagaggccgctcgcctgcggcacgaagaggaagaacgaaaaagaaaagagttagaggtccagcgtcagaaggaactgatgcggcaacggcaacagcagcaagaagccttacgaagactccagcagcaacaacagcagcagcagctggcccaaatgaagttgcctagttccagcacatggggtcaacagagtaacacaacagcatgtcagtcgcaggccacactctctctggccgagatccaaaagttagaagaagagcgggagaggcagttgagggaagaacagcgcagacagcaacgggaactgatgaaggcactccaacagcagcagcagcaacaacagcagaagctcagcggatgggggaacgttagtaaacccagtggcactacaaagtctctgctggagatccagcaggaggaagccagacagatgcaaaagcagcagcagcagcagcaacagcaccagcaacctaatagggcccgaaacaacacacattctaatctgcacaccagcatcgggaacagcgtgtggggctctatcaacacgggccctcctaaccagtgggcgtcagacctggtgtcctctatctggtccaacgcagacactaagaatagtaacatgggcttctgggatgatgcggtaaaagaagtggggcctcgaaattcaaccaacaaaaacaagaataatgcctccctgtccaagtctgtaggtgtctcgaataggcagaataagaaggtggaagaagaagaaaaactcctgaagctgttccagggagttaataaggcccaggacggattcacccaatggtgcgaacaaatgcttcacgcgctcaacaccgccaataacctggatgtgccaacgtttgtcagcttcttgaaagaggtggagtccccatatgaagtacatgattacatacgggcatatctgggcgatacatctgaggccaaggagttcgccaaacagttcctggaacgtcgagcgaaacaaaaagcgaatcagcagcggcagcagcagcagctgcctcagcaacagcagcagcagccgccccagcagcctccacagcagccgcagcaacaggattccgtgtggggcatgaaccattccacgctgcactcagtgttccagactaatcagtcaaataatcagcagtctaacttcgaggcggttcagtccggtaagaagaaaaaaaagcagaagatggttcgagccgacccatccctgcttggattttctgtgaatgctagctccgagcggctgaacatgggtgaaattgaaaccctcgacgactattag

SEQ ID NO: 119013 - DNA, 3966 bp, Artificial Sequence
  Description of Artificial Sequence: Synthetic coding sequence
atggcagcagagactcagaccctcaacttcggtccggagtggcttcgcgctctgtcttctggaggctccatcacgagtccgccactgagcccagcactgcccaagtacaaactggcagactaccgatatgggcgcgaggagatgctagctttgttccttaaagacaacaaaattccaagcgatctgctggataaggagttcctccccatcctccaggaagagcctctgcccccgcttgctttagttccctttacagaagaagaacagcgtaacttttccatgagcgtgaattccgcagcagttctgcgccttacaggaaggggcggcggcggcaccgtagtaggcgcccctcggggcagaagcagcagtcgagggcgtggtagagggcgcggagagtgcggcttttatcagcgtagcttcgacgaggtggaaggagtgtttggcagggggggtggacgggaaatgcaccgtagccagtcttgggaggagcggggtgacagacgattcgaaaaacctgggcggaaggacgtgggtaagaaaaatggttattattgtatgtactctccagtcctgctgcttggtcagccactttgtcaaggccggccaaacttcgaagagggcgggccaacatctgtgggaagaaagcatgagttcatccggtctgaatccgagaattggagaatttttagagaagagcagaacggcgaggacgaggacggagggtggcggcttgcggggtccaggcgggacggtgaaagatggaggccacattcaccggacggccctagatctgccggctggcgggagcatatggaaagacgaagaagatttgaatttgacttcagggatcgggatgatgagcggggttatcgtcgggttaggtcgggctccgggtctatcgatgacgacagggactcgctccccgaatggtgtctggaagacgctgaggaggagatgggcactttcgacagctccggggctttcctcagtttgaaaaaagtccaaaaagagcccattcctgaggaacaggaaatggattttaggccggttgacgagggagaggagtgtagtgattccgagggttcccacaacgaggaagccaaggaacccgataagaccaataaaaaggagggggaaaagacagaccgcgtgggggtcgaggcaagtgaagagactcctcagactagcagcagcagcgcaaggcctggaacaccctctgaccaccagagtcaggaagcctctcaattcgaaaggaaagatgaaccgaagaccgagcagacggaaaaagccgaggaggagacgaggatggagaacagccttcccgccaaggtgccttccagaggggatgagatggtcgcagacgtgcaacagcctctgtcccagatcccatccgatacggcttccccactgttaatattgcctccacccgtgccgaacccttctccaaccctgcgtccagtggagaccccggtggtcggtgccccagggatgggatcagttagcacagaacccgatgatgaggagggactgaaacatctggagcaacaagccgagaaaatggttgcctacctccaggacagcgccctggacgatgagcggctggcctctaagctccaagagcatagagctaagggagtgtctattccactgatgcacgaggcaatgcagaagtggtactacaaagacccccagggggagattcagggcccatttaacaaccaggaaatggccgagtggtttcaggcggggtatttcacaatgtcgttattagtgaaacgcgcttgcgatgaaagttttcagcccctgggcgacataatgaagatgtggggacgggtgccattctctccaggtcctgctccccctccccacatgggcgagttagatcaggagcgacttacccgccagcaggaattgaccgctctgtaccagatgcagcacctgcagtatcaacagtttttaatccagcagcagtacgcccaggtcctcgcgcagcaacagaaggcagcactatcctcacaacagcagcagcagctcgctctcctgctgcagcaattccagacattgaagatgcggatctcggaccaaaatatcattccatctgtgacccgcagcgtgtccgtccctgataccgggtcaatttgggaacttcagcccaccgcctcccagcccaccgtgtgggaggggggctccgtgtgggatttaccactggatacaaccactcctgggcctgcgttggaacagctccagcaacttgagaaagccaaggccgctaagctggagcaagagaggagggaagcggagatgcgagctaaacgcgaggaggaagaaaggaaacggcaagaggagctccggcgacaacaggaggagattttaaggcgacagcaagaggaagagcgtaagcggcgggaagaggaggagctcgcccgcagaaaacaagaagaggccctcaggaggcaaagggagcaggaaatcgcattgcgacgccagcgggaagaggaggagcgccagcagcaggaagaggctctgcggcggctcgaggagaggcgccgcgaggaggaagaaaggcgcaaacaggaggaactattgagaaagcaggaagaggaggccgccaagtgggctcgtgaagaagaggaggcccagaggcgactcgaagaaaataggcttagaatggaagaagaggcggccagacttcgacatgaagaggaggagagaaagcgcaaggagctggaagtgcagcggcagaaagagcttatgagacagcggcagcagcaacaggaggccctgaggagactgcagcaacagcaacagcagcagcagctggctcaaatgaagctgccatctagctctacctggggccagcagtcgaacaccacggcatgtcagtcacaggctacattgtctttagccgaaattcagaagttggaagaggagcgagaaagacaacttcgagaggaacagagaagacagcagagagagctgatgaaggcgttacagcagcagcagcagcagcaacagcagaagctctctgggtggggaaatgtgtcaaaaccttcaggtacgactaagagtttattggaaattcaacaggaggaagctagacagatgcaaaagcagcagcagcaacaacagcagcatcagcagcctaaccgagcaagaaacaacacccacagcaatcttcacacttctataggaaatagtgtctgggggagcataaacacaggcccaccgaatcagtgggctagtgacctggtcagttcgatttggtcaaatgccgacaccaaaaattctaatatgggcttctgggatgatgccgtaaaagaggtagggccacggaacagtacgaataagaacaagaataatgcttccctgtctaaaagcgtcggcgtgagcaataggcagaacaagaaggtggaggaagaagagaaactgttaaagctgttccagggggtcaacaaagcccaagatggattcacgcagtggtgtgaacaaatgctgcacgctctcaataccgctaataacctagacgtcccaacgttcgtttctttcttaaaggaggttgaatccccctacgaggttcacgattacatcagggcctacctgggcgacacctctgaggcaaaggagttcgccaagcagtttctggagcgccgagccaaacagaaggctaatcagcaaaggcagcaacagcaactaccgcaacaacagcagcaacagcccccccagcagcctccccagcagccgcaacagcaggacagcgtctgggggatgaaccatagcaccctgcatagcgtgttccagaccaatcaaagtaacaaccaacagtctaacttcgaagccgtgcagtccggaaaaaagaagaagaaacagaagatggtgcgggcagacccatcgctgctaggcttttcagtgaacgccagtagcgagcgactgaacatgggtgagattgagactttggatgattactag

SEQ ID NO: 119014 - DNA, 3900 bp, Artificial Sequence
  Description of Artificial Sequence: Synthetic coding sequence
atggcagccgagacgcagacactgaattttggccctgagtggcttcgcgccctgtctagcggcgggtccataaccagtccccctctcagcccagctcttcccaagtataagctggctgattataggtacggccgcgaggagatgctggccctgtttctcaaggacaacaagatcccatcagacttgctggataaagagttcctgccaattctccaggaggagcctcttccaccattggctctggtccctttcactgaggaggaacagcgtaatttttctatgagtgtgaattccgctgcagtcctgcggctgacgggtaggggaggcggcggcaccgtggtcggcgcacctcgggggcggagctcctcccgcggacggggcaggggacgcggtgagtgcgggttttaccagcgcagctttgacgaggtcgaaggcgtgtttggtcgcggcggtggtagagagatgcaccggtcccagtcttgggaggagcgtggagatagacggttcgaaaagcccggccgcaaagacgtcggaaggcccaattttgaggaaggtgggcctaccagcgtcggacgtaaacacgagtttattcggtccgagagcgagaattggcgcatcttccgagaagaacagaatggtgaggatgaggacggaggctggcgactggccggttctcgtcgcgatggagagagatggcggccacattcacccgacggcccaaggtctgccggctggagagaacatatggaaagacggcgacgctttgaatttgatttccgcgatcgagacgacgagcgagggtatcgccgggtacggagcgggagcggctccattgatgatgatcgcgacagtttgcccgagtggtgcctggaggacgccgaggaggagatgggtacatttgactccagcggcgccttcctctcacttaagaaggtccagaaggaacctataccagaagaacaagaaatggatttcagaccggtagacgagggggaggaatgttctgatagtgaggggtctcacaacgaagaggccaaagagcccgataagaccaacaaaaaggagggggagaagaccgaccgggtcggggttgaagcctcagaggagactccgcagaccagttcgtcttctgctcgaccaggcaccccatcagaccatcagtctcaggaggccagccaattcgaaaggaaggacgaaccaaagaccgaacaaactgagaaggctgaggaagaaaccaggatggagaactccctcccagccaaggtgccctctcgtggcgatgaaatggttgcagatgtccagcagccattgagtcagatcccatctgacacggcttcaccactgctgatcctgccaccgcctgtacctaatccaagccccactttgagacctgtcgaaactcccgtcgtgggagccccgggcatgggcagtgtcagcacagaacccgacgatgaagagggactcaagcatctggagcaacaggcagagaaaatggtcgcctatctgcaggattccgcccttgacgatgaacggctggcctccaagctccaggaacaccgtgcgaaaggtgtgtccatacctctaatgcatgaagctatgcagaaatggtattataaagacccgcaaggggaaattcaaggccccttcaataatcaggagatggctgagtggttccaagccggctactttacaatgtcactgctggttaaacgcgcatgtgacgaatcgtttcaacctctgggcgatatcatgaaaatgtggggccgcgtaccattttcaccggggcctgcccctccccctcacatgggggaattggatcaagaaagactgacacgccagcaggaactgacagccctctaccagatgcagcaccttcagtatcaacagtttcttattcagcagcagtatgctcaggttttggcacaacagcagaaggccgcactctcctctcagcagcagcaacagttagcgctcctcttacaacaatttcaaaccctgaaaatgagaattagtgatcagaacatcataccgagcgtgacaagaagtgtcagcgtgcctgataccggcagtatctgggagctccagcccactgcaagtcagccaaccgtgtgggagggagggtcagtttgggatcttccactcgacaccaccactcccggcccagccctcgagcagctccagcagttagaaaaggccaaagccgctaagcttgaacaggagaggagggaggcagagatgagagcaaagcgggaagaggaagagagaaagcggcaggaggagctgcgtcggcagcaggaggaaatcctcaggcggcaacaggaagaagagcggaagaggcgagaggaagaggaactggccagaaggaagcaggaggaggccttacgcaggcagagggagcaagaaatcgctttgcgtaggcaaagggaagaagaagagcgccagcagcaggaagaagcccttcggagactggaagaacgcaggcgcgaggaagaggaacgtcggaaacaggaagaacttctccgaaagcaagaggaggaggctgcaaagtgggcacgggaggaggaagaggcccaacgccgccttgaggagaaccgtctaaggatggaggaggaggctgcaagactgcggcatgaagaagaagagcgcaagcgtaaggagctcgaagttcagcgacaaaaggagctgatgcgtcagaggcagcagcaacaggaagcgctcaggaggctgcagcagcagcagcagcagcagcagctggctcagatgaagctgccgagctctagcacttggggtcaacagagcaatacaacagcttgtcagagtcaggccaccttgtccctagccgagatccagaaattggaggaggaaagggagcggcaactccgagaggaacagagacgccagcaacgcgaactgatgaaagccttgcagcagcagcaacagcagcagcaacaaaagctgtccgggtggggtaacgtgtccaaaccctccgggacaaccaaatccctgctggaaatccagcaggaggaagccagacagatgcagaaacaacagcaacagcaacagcagcatcaacaacccaaccgggcccggaataatacccactcaaatctgcacacctctattgggaactctgtgtgggggtctatcaataccggtcctccaaaccagtgggcctcagacctagtgtccagtatctggtctaatgcagataccaaaaatagtaatatgggtttctgggacgacgccgttaaggaagtgggccccagaaattccacaaataaaaacaagaacaatgcctccttaagtaaaagcgttggggtatcaaatcggcaaaacaaaaaggtggaagaggaggaaaagctgttgaagttgttccagggtgttaacaaggctcaggatggctttacccagtggtgtgaacaaatgcttcacgccctaaatacagccaacaacttagacgttcccacgttcgtttcatttcttaaggaagttgagagcccatacgaagtgcatgactacatcagggcgtatctgggggatacctctgaagctaaggagttcgcgaaacagtttctcgagcgacgggccaaacagaaggccaaccagcagagacagcagcagcagctccctcagcagcagcaacagcagcccccacagcagcctcctcagcagccacaacagcaggattctgtctggggaatgaaccactcaaccttacactccgttttccaaacaaatcagtctaataatcaacagtcgaattttgaagccgtgcagagcggcaagaagaagaaaaagcaaaaaatggttagggcagacccttccctgctggggttctccgtcaatgcctcaagtgaacgcctcaacatgggtgagattgagacgctggatgactattag

SEQ ID NO: 119015 - DNA, 2163 bp, Artificial Sequence
  Description of Artificial Sequence: Synthetic coding sequence
atggcggccgagacccagaccctcaattttgggccggagtggctgcgcgccttgtcgtccgggggctcgattacctccccacccctgtctcctgccctgccaaagtacaagttggccgattaccggtatggacgtgaggaaatgttggcccttttcctgaaagataacaaaattccatccgacctgctggataaggaattcctccccattttgcaagaggaacccctgcctcccttggcccttgtcccctttacagaggaggagcagagaaacttttccatgagtgtaaattcagctgctgtgctccggctcacaggtagggggggaggggggacagtggtcggggcccctagggggcggagcagttcgaggggtcgtgggaggcccaattttgaagaaggagggcccacgtccgtaggcagaaagcacgagtttattcgtagcgagtccgaaaattggcgaatatttcgggaagagcagaatggtgaggatgaagatggggggtggaggcttgcgggcagtagaagggatggtgaacgatggcgaccccactctcccggctggagggagcacatggaacgtcgtaggagattcgagttcgattttagggatcgcgacgacgagaggggctaccgcagagtgcggtcaggctcaggttcaattgacgacgatcgcgatagcctgccagaatggtgtctggaggatgcagaggaggagatgggcactttcgatagctcaggagcttttctctccctgaagaaggtccagaaggaacctattccagaagaacaggaaatggacttcaggcccgtggacgagggagaagaatgttctgattctgaagggagccacaacgaggaggctaaggagccagacaagaccaacaaaaaagaaggggagaaaacggacagagtaggggtggaggcctccgaggagactccccagacatcctccagttctgcgcggcctggcactccaagcgaccaccaatcacaagaggccagtcagttcgagaggaaagatgaacccaaaactgaacagaccgaaaaggcagaggaagagactcgcatggagaacagtctcccggccaaagttccatcgaggggcgacgaaatggtggccgacgttcagcagccattgtctcagattccctccgacaccgccagtcctctgctgatactgccaccaccagtgcctaaccctagcccaaccctcaggcctgtggagactcccgttgtcggcgctccagggatggggagtgtgtccaccgagcccgatgacgaggagggcctcaagcatttagaacagcaggcagagaaaatggtggcgtacctgcaagattcagcactcgacgacgaaaggctcgccagcaaactgcaggaacacagggcaaagggtgtcagcatcccgctaatgcatgaggcgatgcagaaatggtattacaaagacccccaaggtgagattcaggggcctttcaataaccaggagatggccgagtggtttcaggcagggtattttacaatgtccctcctggttaaacgagcgtgtgatgagagttttcagccactgggtgacatcatgaaaatgtgggggcgggtgccattctcccccggccccgctccccccccacatatgggggaactggatcaggaacgcttgacacgtcaacaggagctgacagcactgtatcaaatgcagcatctccaatatcagcagttcctgattcagcaacagtacgcacaggtgctggctcaacagcagaaagctgcattgagttcccaacagcaacagcagcttgccctgctgcttcagcagttccagaccttgaagatgagaattagcgaccagaatattattccatccgtcacaagatcagtcagtgtaccggatacaggcagtatctgggaactgcagcctactgcttcacaacccactgtgtgggagggtggctcagtttgggacctaccactcgataccaccactcccggcccagctctcgaacaactgcaacaactggagaaggccaaggcagctaagctcgagcaggagcgccgggaggccgagatgcgagctaaaagagaggaggaggagagaaagcgccaggaggaactgcggcgccagcaggaggagattcttcgcagacagcaggaagaagaacggtag

SEQ ID NO: 119016 - DNA, 282 bp, Artificial Sequence
  Description of Artificial Sequence: Synthetic coding sequence
atggccgcagagactcaaacgttgaattttggccccgagtggctgagggctctgagttccggaggcagcattacctcccctcccctgagcccagcactgccaaaatataaattggcagattatagatatggtagggaggagatgctggctcttttcctgaaagataacaagattccttctgatctgcttgataaggagttccttccaattctgcaggaggaacccctcccccccctggcactcgttcctttcaccgaagaagaacagcggaacttctcttag

SEQ ID NO: 119017 - DNA, 303 bp, Artificial Sequence
  Description of Artificial Sequence: Synthetic coding sequence
atggccgcggagacccagaccctcaactttggtcccgagtggctgcgggctctaagtagcgggggctctattacatcccctcccctcagccccgctctgccgaagtacaaactggccgactacaggtacggccgcgaggagatgctcgccttattcctaaaagataacaaaattccgtccgacctgcttgacaaggaatttttgccgattctgcaggaagagccactgccgccacttgccctggtgcctttcaccgaggaagagcagaggaatttcagcatgagcgtgaactccgctgcatag

SEQ ID NO: 119018 - DNA, 42 bp, Artificial Sequence
  Description of Artificial Sequence: Synthetic coding sequence
atggcagcggaaacacaaactctgaatttcggtccggagtag

SEQ ID NO: 119019 - DNA, 348 bp, Artificial Sequence
  Description of Artificial Sequence: Synthetic coding sequence
atggccgctgagacacagactctcaacttcggccctgaatggctccgagcgctttcttctggaggttccattacctcccccccattaagccccgctctgcccaagtataaacttgctgactaccgatatggacgggaggaaatgctggcgctcttccttaaggacaataagatcccttccgatctgctggataaagagtttctgccgatactgcaagaggagccactcccaccattggcccttgttccctttaccgaggaagaacagaggaacttttccatgtctgtaaacagcgccgcagtgctgcgtctcaccggtcggggaggtggagggaccgtggtgggctag

SEQ ID NO: 119020 - DNA, 321 bp, Artificial Sequence
  Description of Artificial Sequence: Synthetic coding sequence
atggccgctgaaacacagactttgaatttcgggcccgagtggctgcgcgccctgagcagtggcggaagcatcacctcaccgcccctgagtccggcgttacctaagtacaagctggctgactaccgttacggaagagaggagatgctggccctgtttcttaaggacaacaaaatccccagcgacttgcttgataaagagttccttcccatcctacaggaggagccgctccctccgctggccctcgttcctttcaccgaagaagaacaaaggaatttctccatgagcgtgaacagcgccgctgtcttgcggctcaccggatag

SEQ ID NO: 119021 - DNA, 342 bp, Artificial Sequence
  Description of Artificial Sequence: Synthetic coding sequence
atggctgccgaaacccagacactcaacttcgggcctgaatggctccgtgccctgtcatctggcggctccataacgagtccccccttgtccccagcccttccgaaatacaagttggctgactatcggtacggacgcgaagaaatgttggcactgtttctgaaggacaataaaataccgtctgatctcctggataaggagtttttgcccatcctgcaggaagaaccacttcctccgctggcccttgtcccattcaccgaagaagagcaaagaaatttcagtatgtccgtcaattccgccgcagttctgagactaaccggacggggcggaggaggcacagtctag

SEQ ID NO: 119022 - DNA, 2619 bp, Artificial Sequence
  Description of Artificial Sequence: Synthetic coding sequence
atgaccaagctccccgacgatcccggtagacctaactttgaggagggagggccaacctctgtcggcagaaagcatgaattcattcggtcagaatcggagaattggcgcatctttagggaagaacaaaacggggaggacgaagatggcggatggaggctggccggctcgcgccgggacggtgaacgctggcgaccccactcacccgatggcccacgttcagccggctggagagaacacatggaaaggagaaggcggtttgagttcgatttccgagatcgcgacgacgagaggggctatcggcgggtgaggagtggctccggtagtattgacgacgatcgggattccctgcccgaatggtgcctagaagacgctgaagaggaaatggggacttttgactctagcggggcattcctctcgttgaaaaaggttcagaaagaacctatcccagaggagcaggagatggatttccgcccagtggacgaaggtgaagaatgctcggacagtgagggatctcacaacgaggaggcaaaggagcccgacaagaccaataagaaggagggggaaaagacagaccgcgtgggcgtggaggccagtgaggagacaccccaaacatcctcgagctccgccaggccaggaactccctctgaccatcagtcccaggaagcttcccagttcgaaagaaaggacgagcccaaaacggaacagacagaaaaagccgaggaggagacacgcatggagaactccctgcctgccaaggtgcccagcaggggagacgagatggtggccgatgtccagcagcccctttcccagatcccctcggacaccgccagcccactactgattctcccccctcccgtgcccaacccatcccctacactgaggccggtagagacacccgttgtgggtgcgcccggcatgggtagcgtgagcacagagccggatgacgaagaaggcctgaagcacctggagcaacaggcggaaaagatggtggcttatttacaagactccgcactcgatgacgagcgtctggcatctaagctccaggagcaccgggcaaagggcgtgagcatcccactcatgcatgaagccatgcaaaagtggtactataaagatccccagggagaaattcagggcccattcaataatcaggagatggctgagtggttccaggctggctactttaccatgagtctattggtaaaacgcgcatgtgatgaatcatttcagccattaggagatatcatgaagatgtggggcagagtcccatttagtccaggccccgcaccccctccgcacatgggagagcttgatcaggaaagacttacacgacagcaggaactgactgccctttaccagatgcaacacctgcagtaccagcagttcctgatccagcagcagtatgcccaggtgctggcacagcaacagaaagccgccctcagcagccagcaacagcagcagcttgctttgctcctccagcagttccagactcttaaaatgcgcatttccgatcagaacataataccgtccgtgacacggtccgtctcggtgccagacactgggtctatctgggagctgcagcccacagctagtcagccaacagtgtgggaaggcggcagcgtatgggatctgccgctggataccacaacccctggaccagccttggaacagcttcagcagctcgagaaagccaaggcggcaaagctcgaacaggagcgacgcgaggcggaaatgagggccaaacgggaggaagaggagagaaaacgtcaagaagagctgagacggcagcaggaggagatcctgaggcgtcaacaggaagaggagcgaaagcgtcgagaagaagaggagcttgcgagaaggaagcaggaagaggctctacgccgccagagagagcaggaaatagccttgagacggcagcgagaagaagaagagcgccagcagcaggaagaagctcttcgcaggttagaagagaggcggcgagaagaggaagagcgacgtaagcaggaagagttacttaggaaacaagaagaagaggcggccaagtgggcgcgagaagaggaagaagcccagagaaggttagaagagaacaggcttcgcatggaggaggaggcggcccgcctgcgtcatgaagaggaagaaagaaaaagaaaggagcttgaggttcaaagacaaaaggagctcatgcgacagcgacagcagcagcaggaagccctaagaagactgcaacagcagcaacagcagcagcagctcgctcagatgaaattaccaagtagctccacctggggccagcagagcaacacaacagcgtgccaatctcaggctacactgagcttagcagagattcagaaattggaagaagaacgggagagacagctaagggaggaggagtcaagtgcatcattttgcttttatgcaacagccaaggcgcctgccgagggagtcgatgagtcttcaagtgcagccgcagccacagccacagccgaaactctgcgcctaggggaatgccagcaaaccttcagataccacgagatcagttccggcgacccagccggacgtggacaggctaacgcaaaagccgctgcagctgcagcagccacgccagcgactaaacagagttcttag

SEQ ID NO: 119023 - DNA, 2364 bp, Artificial Sequence
  Description of Artificial Sequence: Synthetic coding sequence
atggcagcggagacccagaccctcaatttcggaccggagtggttgcgggcactttcctctggtggcagtatcaccagcccacccctatcccctgctctgccaaaatacaagctggctgactaccgttacgggagagaggagatgctagcactcttcctgaaagacaataaaataccaagtgatctactggacaaagagttcttacctatactccaggaggaacccctgcccccactggctctggttccatttaccgaagaggagcagaggaattttagcatgtctgtcaactccgcagcggtcctgagacttacggggaggggagggggaggaactgtcgtaggagcaccccgtggtcgaagctcctcccgtgggcggggccggggccggggcgagtgcggattctatcagaggtccttcgatgaagttgagggcgtgtttggcagaggcggtgggcgcgaaatgcaccgctctcagagctgggaggagcgcggcgataggcgattcgaaaagccaggacgcaaagatgtgggccgacccaacttcgaagagggaggacccaccagtgtaggacgcaagcatgagttcatccgctctgagtccgaaaattggaggattttccgtgaggagcaaaatggcgaagacgaagacgggggctggagacttgcaggcagtcggagagacggtgaacgctggcgtcctcacagccctgacggaccccgcagcgccggttggcgggagcacatggagcgacgacgcagattcgagttcgattttcgagacagagatgacgagcgaggctaccgaagggtgcggagtggctctgggtctatcgacgacgaccgcgattctctgcccgagtggtgcctagaagatgctgaggaagagatgggcacgtttgactcctctggcgcttttctctcgcttaaaaaggttcagaaggaacctattccggaagagcaggagatggacttcaggccagttgatgagggtgaagaatgttcagactcggaggggagccataacgaagaggccaaagaacccgataagacgaacaaaaaagagggcgaaaaaacggatcgggtaggggtcgaagcctccgaagagactccccagacatcatcatcgagtgcaagacctggcacaccatccgatcatcagtctcaggaggcctcccagttcgaacggaaagatgaaccaaagaccgaacaaactgagaaggcagaggaagagacaaggatggaaaacagccttcctgcaaaggtaccttcacgcggcgacgaaatggttgcagatgtgcaacaacccctttctcagatccctagtgacacggccagccctctcttgatactgcctcctccagttcccaacccatctccaaccctacgcccagtggaaacccccgtggtcggtgcgcccgggatgggctccgtgagcacagagcccgatgatgaagagggcttaaagcacctggagcagcaggccgagaagatggtagcctatctgcaggattcagctcttgacgacgaacggctcgcaagcaaactccaggagcatcgagccaagggcgtatccatccccctcatgcacgaagccatgcaaaagtggtactataaggatccccagggggaaatccagggcccgtttaacaaccaagaaatggcagaatggtttcaggcagggtattttactatgtccctcctggtgaaacgcgcctgcgatgagtcctttcagcctctgggggatataatgaagatgtggggaagggtgccgttcagcccagggccagcacccccaccacacatgggtgagttagaccaagaacgtctgactagacagcaggagctaaccgctctgtaccagatgcagcacctgcagtaccagcagtttttaattcagcagcagtacgcccaggtgctggcccagcaacagaaggcagcactttcatcccagcaacagcaacaactggcactcttactccagcagttccagacactgaaaatgagaattagcgaccaaaacattatcccgtctgtgacaaggtctgtgagcgtgcctgacacaggttccatctgggagctgcagccaaccgcttcgcagccgactgtgtgggagggtggctccgtctgggatctacccctggacacaaccacccccggaccggcactggagcagctccagcaactggagaaggctaaagccgcgaagctggagcaggagagaagagaagctgaaatgcgggctaagagggaggaagaagagaggaagcgacaggaagagcttcgccgccaacaagaagagattctaaggagacagcaggaggaagagcgtaagaggcgcgaagtggggaagagggacagttag

SEQ ID NO: 119024 - DNA, 3882 bp, Artificial Sequence
  Description of Artificial Sequence: Synthetic coding sequence
atggccgcagaaacacagactctgaactttgggcctgaatggctccgcgccctgtctagcgggggctcaatcacctccccccctttgagtccagcactacctaaatataagttggctgactacagatacggccgcgaagagatgcttgccctgtttctgaaggataacaagataccttctgatcttctcgataaggagttcctccctatacttcaagaagaaccactcccaccccttgccctggtgcctttcacggaagaggaacaacggaactttagcatgtcggtaaactctgccgcagtccttcggctgactggccggggcggtgggggcacggtggtgggtgccccacgtggaaggagttcttcaagggggaggggtagaggtaggggtgagtgtggcttttatcagcgcagcttcgatgaagttgagggcgtctttggcagggggggcggacgggaaatgcaccgatcacagtcatgggaagagcggggggaccggcgatttgagaagccgggaaggaaagatgtgggtcgccccaacttcgaggaggggggccccacatctgtgggaagaaagcacgagtttattagatcagaatctgagaattggcggattttcagggaagagcagaacggtgaggacgaagatgggggctggcgcctggcaggcagccgacgcgacggcgaacgctggcgcccacactctccgggatggcgcgaacacatggaaagacgacgacgcttcgaatttgattttagggatagagatgacgagcgtggataccgcagggtcagatctggttccgggtccattgatgacgaccgggacagtttgcccgaatggtgcctggaagacgccgaagaggagatgggtacctttgatagcagcggtgccttcctgtctctcaaaaaggtgcagaaagaaccaataccagaagaacaggaaatggactttcgacctgtagacgagggtgaggagtgctcggattcagaggggtcgcacaatgaggaagctaaggaaccagataagacgaacaaaaaagaaggcgagaagacggacagagtcggagtggaggcctccgaggagactcctcagacttcgtcctcgtctgctcggccagggacaccttctgaccaccagagtcaggaggcatctcagtttgaacgcaaagacgaaccgaagacagagcagacggagaaagccgaagaggagactcggatggaaaactccctgcccgccaaggtgccctcacgtggggacgagatggtggccgacgtgcagcaacccctcagtcagatcccttcggacaccgccagtcccctccttatcctgcctcccccagtcccaaatccgtcaccaacccttcgtcctgtggaaacgcctgtagtgggcgccccaggcatgggctccgtatccaccgagcctgatgatgaagaaggcctaaaacacctggagcagcaagcggagaaaatggtggcttatctgcaggattccgccctggatgatgaaaggctggcctctaaactccaggagcaccgggccaaaggcgtatcaatccccctgatgcatgaagccatgcagaaatggtattacaaagatcctcagggtgaaatccagggaccatttaacaaccaggagatggcagagtggtttcaggccggatatttcactatgtcactgttggtcaaacgagcctgtgacgagagcttccagcctctcggcgacatcatgaagatgtggggccgggttccgttttctcctgggccagctccccctccccacatgggggaactggatcaggagaggcttactaggcagcaagaactgaccgccttgtatcagatgcaacatctgcagtatcagcagttcctgattcaacagcagtacgctcaggtcctggctcagcagcagaaggcagctcttagcagtcaacaacaacagcagctggcgttgctgctccagcagttccaaacacttaaaatgcgcatctccgaccaaaacattataccctccgtgacacgatcagtttctgtccccgacaccgggtccatatgggaactgcagcccactgcttctcaaccaactgtttgggagggtggtagcgtctgggacctgccattagatactaccaccccaggccctgccctagagcagctacagcagctcgaaaaagcaaaagccgcaaaattagagcaggagcgccgggaggctgaaatgcgtgccaagcgcgaggaggaagagaggaagaggcaggaggaactacgtaggcaacaagaggagatactgagaagacaacaggaggaagagcgtaaaagacgagaagaggaggaacttgcgaggcgcaagcaggaagaagccctgcgccgccagcgggagcaggaaattgctctgagacggcagcgcgaggaagaggaaaggcagcaacaggaggaagctcttagacgattggaggagagacggcgggaggaggaagagaggcgaaagcaggaggagctgcttcgaaagcaggaggaagaggctgcaaagtgggctcgagaggaagaggaagcacagaggaggctggaggaaaataggctccgaatggaggaggaagctgctaggctccggcacgaagaagaggagcgcaagcgcaaagagctggaagtgcagaggcagaaagagctgatgaggcagcggcaacagcagcaggaggcgttgcgaaggctgcagcagcagcagcaacagcagcagcttgcccagatgaagctgccctctagcagcacttgggggcaacagtctaacactaccgcctgtcagtcccaggctaccctctcactcgccgaaattcagaagttggaggaagaaagggaacgccagttaagagaagagcaaagacgtcagcagcgggagctcatgaaggccctgcagcaacagcaacagcaacagcagcaaaagcttagcggatggggcaacgtgagtaaacccagcggtaccacaaaatcactcttggagattcagcaggaagaggcaagacaaatgcagaaacagcagcagcaacagcagcagcaccagcagcccaatcgagctagaaacaacacacacagcaatctacatacttcgatcggaaacagcgtgtggggcagtatcaatactgggccaccaaatcagtgggcttcagacttagtcagtagtatatggtctaatgcagatactaagaactcaaatatgggcttttgggacgacgccgttaaagaggttggtcctcgcaatagcacaaacaaaaacaagaataatgcctcactgtctaagtctgttggtgtcagtaaccgccagaacaaaaaggtggaagaagaggagaaacttttaaaattgttccagggggtcaacaaggctcaggacggctttactcagtggtgcgagcaaatgctgcacgctctgaacacagcaaataacttggatgtgccaaccttcgttagcttcctgaaagaggtggaatccccatatgaggtgcatgactatatccgggcctatctcggcgatacgtctgaggccaaagagtttgccaaacagtttctggagcgccgagccaagcaaaaagccaaccagcaacgccagcagcagcagctgccgcaacagcagcagcagcaacccccccagcagcccccacagcagccccagcagcaggattccgtttggggtatgaatcactcaaccctgcactcagtgtttcagaccaaccagtccaataaccaacagagtaacttcgaggctgtgcagagcgggaaaaagaaaaagaagcagaagatggtaagggccgatcccagcctcctcggattcagcgtcaatgcaagtagcgaacgcctgaacatgggtgagatcgaaactctggatgactactag

SEQ ID NO: 119025 - DNA, 3963 bp, Artificial Sequence
  Description of Artificial Sequence: Synthetic coding sequence
atggcagccgagacacaaaccttaaattttggtccagagtggctgcgcgctttgtctagtggtggatcgataacaagcccgcccctgtcccccgccctaccaaaatataagctcgcggattatcggtatggaagagaagagatgttggcactttttctgaaagataataaaatcccctccgacctgcttgacaaggagtttttaccaatcctgcaagaggagcccttaccacctctcgctctggtgcctttcactgaggaggaacagaggaacttttctatgtcagtaaattccgcagcagtcctgcgactgacagggcgtggggggggtgggaccgtcgtgggagccccccgaggtcgatctagttcacgggggagagggcgaggaagaggagagtgtggcttctaccagagaagttttgatgaggtggagggcgtgttcggccgcggcggaggccgcgaaatgcacagatcccagagttgggaagaacgcggagacaggaggttcgagaagccaggcagaaaggatgtggggaagaagaatggctactactgtatgtactctccagttctgcttttgggccaacccctttgtcagggacggcccaattttgaagaagggggccctacctctgtcggccggaagcacgagtttatccgaagcgaatcagagaactggcgcatttttagagaggagcaaaatggggaggacgaggatggcggttggcgcctagccggatcaaggcgcgacggcgaacggtggcgcccacattctccagatggaccacggagcgctgggtggagggaacacatggagagacggcgccgtttcgagttcgactttagagaccgagatgacgaacgagggtatagacgggttagaagtggaagcggctcgatagacgacgaccgtgacagcctgcctgagtggtgtctggaggacgcagaagaagaaatgggtaccttcgactctagtggggcattcctcagcttgaaaaaggtgcagaaagaaccaatcccagaagaacaagaaatggacttcaggccagtagacgagggggaggagtgctcagactccgagggaagccataacgaggaggccaaggagcctgataaaaccaataaaaaagaaggtgagaaaaccgaccgggtgggcgtagcttccgaggagaccccccagacttcctcctctagtgccagacccggaactcctagcgatcaccagagtcaagaggcttcacagtttgagagaaaggatgaacccaaaacagaacagacagagaaggcagaggaagagacacgcatggagaacagcctgcccgccaaagtgccatcccggggggatgagatggtggccgatgtacaacagccgctttcacaaatccctagcgacacagcctctccattactgattttgcccccccctgtccccaacccctcaccaaccctaaggcctgtggaaactccagtggtgggtgcacctggtatgggttctgtgagcacagagccagacgatgaggaaggactgaaacacctcgagcagcaggcagagaagatggtcgcttaccttcaagacagcgccctcgacgacgagaggttggcttctaagctgcaggaacatcgcgccaagggagtgagtataccgctgatgcatgaggccatgcagaagtggtactacaaagacccccagggggaaatccagggacctttcaacaatcaggaaatggcggagtggtttcaggccggatactttactatgagcctacttgtaaaacgcgcatgcgatgaaagttttcagccgctcggagacattatgaagatgtggggaagagtgcctttttctccgggccctgcacctcctcctcacatgggagaattagaccaggagagattaactaggcagcaggagctgacggctctgtatcagatgcagcacctgcaataccagcagttcctgattcaacagcagtatgcccaggttctggcccagcaacagaaggccgccctctcatcccagcaacagcagcagctggccctgcttttacagcagtttcaaacacttaagatgcggattagcgatcagaacatcattccttctgtgactcgatcggtgtctgtcccagataccgggtctatttgggagcttcagcccaccgcttctcagcccaccgtgtgggagggcggttcggtctgggatctgcccctcgatactacaactcctggacctgccctcgagcagctgcagcagctcgagaaagccaaagccgcaaagctggaacaagagaggagggaagccgagatgcgtgcaaagcgcgaagaggaggaaaggaaacggcaggaggagctgaggaggcagcaagaggaaattctccgtcgacagcaggaagaagagagaaagcgaagggaggaggaagagttagcccggagaaagcaggaggaggctttgcgtcgccaacgagagcaggaaatcgcccttcgcagacagagggaagaagaggagaggcagcagcaggaggaggccctgcgtcgtctcgaagaaaggcgccgagaagaagaggaacggaggaagcaagaggaactcctgaggaaacaggaagaggaggccgctaagtgggctcgagaagaagaagaagcacagcgacgcctagaggagaatcgcctacggatggaagaggaggcagcaaggcttcgccacgaggaagaggaaaggaaacggaaagagcttgaggtccagcggcagaaggagctgatgaggcaacggcagcagcagcaggaggcactgcgacgcctgcagcagcagcagcagcagcagcaactcgcccaaatgaaacttccatcaagcagtacatgggggcagcagagcaacacaaccgcttgccaatctcaggccactctttctcttgccgagatccagaaactcgaggaggaaagagaaagacaactgcgagaagaacaacgtcgacagcagagagaactgatgaaagccctgcagcagcagcagcagcagcagcagcagaagctgtcaggatggggcaacgtttctaagccttccggcaccacaaaatcactcctggagatccagcaggaggaggcaaggcaaatgcagaagcagcagcagcaacagcagcaacatcagcaaccaaaccgggcaagaaacaatacccatagcaatctgcacacctccataggcaattccgtgtggggctcaatcaatactggcccaccaaaccaatgggcttcagaccttgtctcctccatctggagcaatgctgataccaagaattcgaacatgggtttctgggatgatgcagtgaaggaagttggtccgagaaattctaccaataagaacaagaacaatgcaagcctctctaaatccgtaggcgtgagtaatcgtcaaaacaagaaggttgaggaagaggagaaattattgaagctgttccagggagtaaataaggctcaggatggattcacacagtggtgtgaacaaatgctgcatgccttgaatacagcaaataaccttgatgtcccgacttttgtcagtttcctaaaagaggtcgagtccccttacgaggtgcatgattacatcagagcttacctgggggacacctctgaggctaaggagtttgcaaagcagtttcttgagagacgggccaagcagaaagccaaccagcaacgacaacagcaacagttgccccaacagcaacaacagcagcccccgcaacagcctccccagcagccgcagcagcaggacagtgtgtgggggatgaatcattccaccctgcacagcgtgttccagaccaaccagtctaacaatcagcagtccaactttgaagctgtgcagagtggaaaaaagaagaaaaaacagaagatggtccgggcagacccttcgcttcttgggtttagtgtcaacgccagttccgaacgtctgaatatgggtgaaattgaaaccttggatgactattag

SEQ ID NO: 119026 - DNA, 2085 bp, Artificial Sequence
  Description of Artificial Sequence: Synthetic coding sequence
atgagtgggggcgaggtggtgtgttcggggtggctccgtaagagtccgcctgaaaaaaagctgaaaagatatgcatggaagaggagatggttcgtgttgcgttctggtcgcctaaccggtgatcccgatgtcctggagtactataagaacgatcatgccaaaaaacctatccgcattatcgacttgaacctgtgtcaacaggttgatgcaggattgacatttaacaaaaaagagttcgagaactcatatatattcgacatcaataccattgataggatcttctaccttgtggcagattcggaggaggagatgaataaatgggttcgatgtatttgtgacatctgcggtttcaacccaaccgaggaggacccagtaaaacctcccggatcttctcttcaggcaccagccgacctgccattagcaatcaatacggcccctccaagcacacaggccgatagttcaagcgccaccttaccccctccctatcagctgatcaatgtcccacctcatctggagacgcttggaattcaggaagacccacaggactatctgctcttgatcaattgtcagtccaagaagcctgaaccaactcggacccatgcggatagcgccaagagtaccagcagcgagaccgactgtaacgataatgtccctagccataagaacccagcctccagccaatctaaacacggtatgaatggcttcttccagcagcaaatgatttacgacagcccgccttcacgggcccccagtgcatcggtagactcgagtctgtacaacctgcctaggagctactcgcacgacgttctccctaaggtaagtccaagctctacagaggcggacggcgagctttacgtgtttaatacccccagtggaacttccagcgtggagacccagatgaggcatgtgtcgatctcctacgacatacccccaacccccggtaacacttatcagatccctaggacctttcctgaggggactctgggccagaccagtaaactggatacaatccctgacattcctcccccaaggcctccgaagccacatccggcccatgaccggagccctgtagaaacatgctccatcccccgcactgcctcagataccgatagctcgtattgtatacccacggccggcatgtctcccagccgtagcaatacaatctcaacagtagacctgaacaagttgaggaaggacgccagctcgcaggactgttatgatattcccagagccttcccttcagaccgatcttctagcctcgaaggcttccacaaccacttcaaagtgaaaaacgttctcaccgtcgggtcagtatcctcggaagaactcgatgagaactacgtgccaatgaacccgaattctcctcccaggcagcactcttcctcattcaccgaacccatccaggaagcgaattacgtgccgatgactcctgggacctttgatttctcttccttcgggatgcaggtccctccgcctgcacacatgggcttccgttcttcccccaaaacccctccccggcgccccgttccagtggctgactgtgagcctcctccggtcgacaggaatcttaagcccgacagaaaagtgaagccagccccacttgaaatcaagccgttaccagagtgggaagagcttcaggctcccgtgcgaagcccgatcacgagatctttcgcccgcgactccagccggtttcccatgtccccaaggccagattctgtgcattctactacctccagttcagactctcacgattccgaagaaaattacgtacccatgaaccccaacctgagttcagaagaccccaacctattcggttcaaacagtctggatgggggaagctcaccgatgattaagcccaaaggagataagcaggtggagtatctggacctggaccttgacagtgggaagtcgacaccccctcgcaaacaaaagtctagcggcagtggatcctccgtagcggacgagagggtggactatgttgttgtcgaccagcagaagacactcgcgctaaaatcaacacgtgaggcttggaccgatgggcgacagagcaccgagtccgaaacccctgctaaatcagtgaagtag

SEQ ID NO: 119027 - DNA, 2175 bp, Artificial Sequence
  Description of Artificial Sequence: Synthetic coding sequence
atgtcaggtggggaggttgtgtgttcagggtggctgcgtaaatcccctcctgaaaagaaactgaagaggtacgcttggaaaaggcgctggtttgtcctgaggagcggccggctcaccggcgatcctgatgtgctcgagtattataaaaacgaccatgctaagaagcctattcgcataattgacctcaacctgtgtcagcaagtggatgccggacttacattcaacaagaaagagttcgaaaactcttacatttttgacatcaataccattgaccgcatattttatttagttgctgatagcgaggaggaaatgaacaagtgggtgcgctgcatatgtgacatctgtggctttaacccgacggaggaagatccggtgaaaccgcccggatcatccttacaagctcccgccgatctgcccctggccattaatactgcacctcccagcactcaggctgacagctccagcgctaccttgccaccaccgtatcagctgattaatgtgcctccacatcttgagacactgggcattcaggaagatcctcaggattacctgctgctcatcaactgtcagagtaagaagccagagccaacaagaacccatgccgattctgcaaaaagcacgtcttccgagactgactgcaatgataatgttcccagccataagaatcctgcaagtagccagtccaaacacggtatgaacggtttctttcagcagcaaatgatttatgactccccacccagcagggcgccctccgcttccgtggacagctccctttacaatctgccacggtcatactcacatgatgttctgcccaaggtctcaccaagctccactgaagccgacggggagctgtatgtattcaacacgccctcaggcacatcatcagtcgaaactcagatgagacacgtttccatatcttacgatataccacctacacccgggaatacatatcagatacctcgtactttccccgagggtacgttaggccagacgagtaagctggatacgattcccgacatccctcccccacgtccgcctaagcctcaccccgctcacgatcgctcacccgtggagacatgttccattccacgtacagcaagcgacacagattcctcttattgtattccaaccgccggcatgtcaccatcgaggagtaacacaatttctacagtggacctgaacaagctccgtaaggacgcctcatcccaggattgctatgatatacccagggcattccccagcgaccgatctagctccttggaaggcttccacaaccacttcaaggtcaaaaatgttctcacagttggttctgtctcttcggaagaattggacgaaaattatgtcccaatgaatccaaactctccacccaggcagcactctagttcttttacagagccaatccaagaagcaaactatgtgcctatgacgcctggaaccttcgacttctcttctttcggaatgcaggtccccccccctgctcatatgggatttaggtcatcgcccaaaactcctcctcggcggcctgtgcctgtagctgattgcgaaccaccgccggtggatagaaacctgaagcccgatcgcaaagggcagtcccccaagatactgagattaaagcctcatgggttggagcggacagactcccaaaccattggagacttcgctacgcgtcgcaaggtgaaacccgctcctttagagataaagccgctgcctgagtgggaagaactgcaggcccctgtcaggtcccccatcacccggtcgtttgctagagacagttcccggttccccatgagtccacgtccagatagtgtgcattcaacaacctctagctcagattcccacgattctgaggagaattatgtgccaatgaatccaaacctcagtagtgaagaccccaatctgttcggctctaactccctagacggagggtccagccccatgatcaagccaaaaggggataaacaggtcgaatacctggacctggatctggattctgggaaatcgactccccctaggaaacaaaagagtagtggtagcggaagctctgtggccgacgagagagtcgattacgttgtcgtggaccagcagaagaccttggccctcaaatctacacgagaggcctggactgatggcagacaatctacggagtctgagacaccagcaaagtccgtgaagtag

SEQ ID NO: 119028 - DNA, 1776 bp, Artificial Sequence
  Description of Artificial Sequence: Synthetic coding sequence
atgaacaaatgggtgcgatgcatctgtgacatctgcgggttcaacccaacggaagaggacccggtgaaacctccaggttcctctttgcaggcccccgcggacttgcctctggcaatcaacactgccccccctagtactcaagccgattcctcttccgccaccctaccaccaccttaccagcttattaacgtgcctccccatcttgaaacgctagggatacaagaggacccacaggattacctcctcctgattaactgtcagtcaaagaaaccggagcctacgcgaacgcacgctgattccgccaagtctacaagttccgaaacagactgtaacgacaacgtaccctctcataagaatccagcttcctctcagtccaaacatggcatgaacggctttttccaacagcagatgatttacgacagtcccccttcaagagcgccctctgccagcgtggatagctccttatacaatctgccccgcagctactcccacgatgtgcttcccaaagtctccccgagtagtacggaggccgatggggagctgtacgtgtttaatacaccttccggcacaagcagtgtggagacacagatgcgacacgtgtccatatcatacgacattccaccaacgcccggtaacacataccagatcccccgaactttcccggaaggcaccctcggtcaaacatctaaacttgacactatccccgacatccctccgcctcgaccaccaaaaccacatcccgcccatgaccgatcccctgtggagacgtgttctatccctcgtaccgctagcgacactgattccagctattgcattcccaccgccggaatgagccctagccggagtaacacaatctctacagttgatctgaataaactaaggaaggatgccagcagccaggactgttacgacattccacgggcctttccatcggaccgttcttcctctctggagggtttccataatcacttcaaagtgaaaaatgtcttaactgtcggctcagtgtcgtcagaggaactggacgagaactatgtgcctatgaatccaaacagcccaccacgccagcatagctcgagctttaccgaaccaatacaggaggcaaactatgttcccatgacccccggaacattcgatttctcctcatttggcatgcaggtgcccccccctgcccacatgggattccggtccagcccaaagacacccccaagacgcccagtaccagtggccgactgcgagccaccccccgtggaccgcaatttaaagccagaccggaaagtaaaaccggcccccctagaaatcaagccgcttcccgagtgggaggaactacaagcccccgtgaggagcccaattactcgctcattcgctcgtgactcgtcacggtttcccatgtcaccccgtccagattccgtgcactcaaccactagtagttctgacagtcacgattcagaagagaattatgtacccatgaacccaaacttgagctcagaggatcccaatctgttcggatccaacagtctggatggcggaagctctccgatgatcaagcccaaaggggacaaacaggtggaatacttggacctcgatttagattccggtaaatcaacgcctcctaggaagcagaagagctccggaagcggtagctcagtcgctgatgagcgcgtggactacgtggtggtagaccagcagaaaactctggccctgaagagtacacgggaggcctggaccgatggcaggcaaagcacggagagcgaaacacccgcaaagagcgttaaatag

SEQ ID NO: 119029 - DNA, 1917 bp, Artificial Sequence
  Description of Artificial Sequence: Synthetic coding sequence
atgagcggggatccggatgtactcgaatactataaaaacgaccatagtaagaaacccctgaggatcatcaacttgaacttctgtgaacaagtcgatgccggcttaaccttcaataaaaaggaactccaggatagtttcgttttcgacatcaagacctctgaacggacattttacctagttgccgaaacagaggaggacatgaataaatgggttcagtccatctgccagatctgtggatttaaccaagccgaagaatcaacggattctctgcgcaacgtaagcagcgccggtcatggcccaaggtcctcccccgcagagttgtcgtcctcctcccagcacctgctcagagagagaaagtcaagtgccccttcccactcatcacagcccacattattcacattcgagcccccggtttccaaccacatgcagcccacactttcaacaagcgcaccccaagaatacctgtatctccaccagtgcatcagcagaagggccgaaaacgcaagatctgccagcttctcacaggggaccagggcatcgtttttgatgagaagcgatacagccgttcagaagctagcccagggaaacgggcattgtgttaatggaatctcgggacaagtccacggcttctactcactgcccaagcccagccggcacaacacagagtttcgggacagcacatacgatctgcctaggtctctggcctctcatggacacaccaaaggttccttgacaggcagcgagaccgataacgaggatgtctacactttcaagacgccaagtaacacactttgcagagaattcggcgacctgcttgtggacaacatggatgtccccgccacgccccttagcgcataccaaatcccgaggacctttactctagataaaaaccataatgccatgaccgtcgctacacccggcgactctgctatcgctccccctcctaggccgcccaagccaagccaggcagaaacccctcgttgggggtcaccacaacagcgccctccaatcagcgaaaactcacgctcggtcgccgccaccatacccagacggaatactctgcctgcaatggacaactcccggttacaccgtgcatcgagttgcgaaacctacgagtatccgcagaggggcggtgagtccgctggacggtctgccgagtcaatgagcgacggcgtcgggagcttcctcccaggaaagatgattgtggggcgttccgattctacgaacagcgaagacaattacgttccaatgaatccgggctcatcaactctgctggcaatggaaagagctggggataatagccagagcgtatacattccaatgagtcctggggctcatcattttgatagcctggggtatccttcgacaaccctaccagtccatcgaggtccttcgcgcggatctgaaattcagcctccacctgtaaatcgcaacctgaagccagatcgaaaggccaagcccacccctcttgaccttcggaacaataccgttatagacgagctgcccttcaagtcgccaatcacaaagagttggtcaagggccaaccatacattcaatagcagttcctcacagtattgtaggccaatttccactcagagtatcacgtccaccgattcgggtgatagcgaggaaaactacgtcccaatgcagaacccggtatccgcctctcccgtgccaagcggaactaactccccagccccaaaaaaaagtaccggctccgtggattacctggctctggacttccagccaagttcaccatcccctcatcgaaaaccgagtacatcatccgtgaccagcgatgagaaagtggattatgtccaggtcgataaagagaaaacgcaagcactgcaaaacaccatgcaggagtggactgatgtgaggcagagctccgaaccaagcaaaggagcaaagctctag

SEQ ID NO: 119030 - DNA, 2031 bp, Artificial Sequence
  Description of Artificial Sequence: Synthetic coding sequence
atgtctggaggcggcgatgtggtctgtacaggttggctgcgcaaatctccacctgaaaagaagctgaggcgctacgcctggaaaaaacgatggttcattctgagatcgggccgtatgtccggggatccagatgtacttgagtactacaagaatgatcattcaaagaagcccctcaggatcatcaatttaaacttttgtgagcaggtggacgccggtctgacatttaataagaaagaactgcaggacagtttcgtgttcgacattaagacttcggagcgaacattctacttggtggcggaaacggaggaagacatgaataaatgggtgcaatctatttgccagatctgtggttttaatcaggctgaagagagcactgactcattgcgaaatgtgtcctctgctggacatggaccgcgaagtagtcccgccgagctgtcttccagtagccaacacctgctgagggagcgaaagtcctctgccccctcgcattctagccagcctaccctctttacttttgagcctccagtgagcaaccacatgcagcctactctcagcacatcagctccccaggaatacttgtatctgcatcagtgcatcagcagaagggctgagaatgcccgctctgccagctttagtcagggtaccagagctagctttcttatgaggagcgacacggccgtgcagaagctggcacaggggaatgggcactgcgtcaacgggatctcagggcaagtgcacggcttttactccctgcccaaaccgagccggcacaacacagagttccgagactcaacatatgacctgcctcgctcactggccagtcacgggcacacaaaggggtcactgaccggaagtgaaacggacaatgaggatgtgtacacatttaaaacaccatcgaatacgctgtgtagggaattcggtgacttgctggtggataacatggacgtccccgccaccccactttccgcctatcagattcctcgaacatttactctggacaaaaatcataatgccatgaccgtcgcaacgccaggcgactcggctatcgctccaccccccaggccccccaaaccaagccaggctgaaacaccaaggtgggggagcccgcaacagcggcccccaatcagtgagaacagccgcagcgtagcagctacaattccgaggcgaaacactctccctgccatggacaattcaaggcttcacagagcatctagctgcgaaacctatgagtacccccaacgtgggggcgagtcagccggacgctcagccgaatccatgtccgatggggtcgggtcttttctgcctggtaagatgatcgtagggagatcagactcaactaacagcgaagacaattatgtgccaatgaatccgggtagcagcactttgctggcaatggaacgagcgggcgataacagccagagtgtttatattcccatgtcccccggtgcacaccatttcgactctctgggctaccctagcacaacccttccagtgcatcgcggcccatcgaggggctcagaaatccaaccgcccccagttaataggaacttgaagccagaccgaaaagctaagccaacccctctcgatctgagaaataatactgtgatagacgagctgccatttaaatcccccatcaccaagagctggtcccgagctaaccacacgttcaatagcagtagttcccagtactgtcggcccatctcgacgcagtccatcacatctaccgatagtggtgattctgaggaaaattacgtccctatgcagaaccccgttagtgcatcccccgtccccagcgggactaactcaccggccccaaaaaagagtacagggagtgtagattacctggcactggatttccagccatcctctccctcaccccatagaaaaccttcaaccagcagcgttacttccgatgagaaggttgactatgtgcaggttgacaaagagaagacccaggctttgcagaatactatgcaggaatggactgatgtaagacagagcagcgagccttcaaaaggcgccaagttatag

SEQ ID NO: 119031 - DNA, 396 bp, Artificial Sequence
  Description of Artificial Sequence: Synthetic coding sequence
atgagtggggaccctgatgtattagagtattataaaaacgaccacagcaagaaacctctccgcattataaatttaaacttctgcgaacaggtagacgcaggattaacttttaataaaaaggaactccaggactcctttgtgtttgacatcaagacgtccgagaggactttctatttagtggcagagacagaagaagatatgaataagtgggtccaaagtatatgtcagatttgcggatttaatcaggccgaggagagcaccgattccctgcgcaatgtgtcttccgccggccatggaccccgctctagtcccgctgagctctcatctagctcccagcacctccttagggagcggaaaagctccgcccctagccacagcagccagccaactctctag

SEQ ID NO: 119032 - DNA, 309 bp, Artificial Sequence
  Description of Artificial Sequence: Synthetic coding sequence
atgtccggcgatcccgatgtgctggagtattataagaacgatcactccaaaaagccccttcgtatcataaacctcaatttctgtgaacaggtcgacgccgggttgactttcaacaaaaaggaactacaggactcttttgtgttcgacatcaagacctccgagcgcactttttatctggtagctgagaccgaggaggatatgaacaagtgggtgcagtccatctgccagatttgcgggtttaaccaggcggaagaatcaaccgattcactccggaatgtgtcctccgctggacatggaccccgttcctag

SEQ ID NO: 119033 - DNA, 993 bp, Artificial Sequence
  Description of Artificial Sequence: Synthetic coding sequence
atggaagctgttgccaagttcgattttacggccagcggtgaggacgagttgtcttttcacactggtgacgtgctgaagatcctgagtaatcaggaagaatggtttaaggctgagctgggaagtcaggaggggtacgtccctaagaacttcatcgacatccagttcccaaagtggttccatgaaggactgagtaggcaccaagctgaaaatctgctcatgggaaaggaagtgggcttcttcataattcgtgccagccagagctccccaggagacttctcgatcagtgtgcgacacgaggatgacgtgcaacacttcaaggtgatgagagataataaaggcaattacttcttatggacagaaaagtttccaagcttgaacaagctggtggattactaccgcactaattcgatcagtcggcagaagcagatattcctgcgcgacaggacacgcgaagatcagggtcaccgcggcaacagcctagaccgtcgatcacaggggggcccccatctatccggggccgtgggggaggaaattcgtccatctatgaaccggaagcttagcgatcacccgccgaccctacccctgcagcagcaccagcatcaaccccaacctccgcaatatgcgcccgcccctcagcagttacagcaaccaccgcagcagagatatctgcaacatcatcactttcaccaagaaaggcgcgggggctcactggatatcaacgatgggcattgtggtactggacttgggtctgaaatgaacgcagcactgatgcaccgtaggcacaccgatccagtccagttgcaggctgcaggaagagtcagatgggctagagccctgtacgacttcgaagcactggaagatgacgagctgggttttcactctggtgaggtcgtggaagtgctcgactcaagcaacccatcttggtggacaggccgccttcataataaattgggcttgttcccagcgaattacgtggctccgatgacaagatag

SEQ ID NO: 119034 - DNA, 654 bp, Artificial Sequence
  Description of Artificial Sequence: Synthetic coding sequence
atggtctcacggcgcccccttagtacccccggacgcgagctgacacacggacagggcggctggttactgcatcacccaggtcagccagagttgcctcgcgggctcctacatctgtgccaggggcacaggggtaattctctggatcggagatcgcagggcggtcctcatcttagtggcgccgtcggggaggagatccgcccttctatgaaccgcaagttgtccgaccaccctcctacgcttcccttgcaacagcatcaacaccagcctcaaccaccgcagtatgcacctgcaccacaacaactgcagcaacccccacagcagcgatatctccagcatcaccatttccatcaggagcgtagaggggggtctttggatataaatgacggccactgcggcaccggcctagggtctgagatgaacgccgctctcatgcataggagacatacggaccccgtccaacttcaggcagccgggcgggtgcggtgggctcgcgcactttacgatttcgaagctctggaggacgatgagttaggtttccatagtggagaagtggtggaggtgctggattcttctaacccaagttggtggaccggaagactacacaacaaactcgggctcttcccggccaactacgtggctccgatgacacggtag

SEQ ID NO: 119035 - DNA, 993 bp, Artificial Sequence
  Description of Artificial Sequence: Synthetic coding sequence
atggaggcagtggctaaatttgacttcaccgcctcgggcgaagatgagttatcttttcacactggcgatgtcctgaaaatcctgagcaatcaagaagagtggtttaaggccgaactcggatctcaagagggctatgtcccaaaaaactttatcgacattcagttccccaagtggtttcatgagggtctgtctcgacatcaggccgaaaacctgttaatgggcaaagaagtgggatttttcatcatacgcgcctctcagagctcacccggggatttttctatcagcgtgaggcacgaagacgacgtacaacacttcaaagtaatgcgcgacaataagggaaattattttttgtggaccgaaaaatttccctcactaaacaaactcgtggactactataggactaacagcatttcgagacagaaacagatctttctgcgcgaccgtaccagagaggatcagggccatcgggggaacagtctcgaccgccgaagccagggggggccccatttaagcggagcagttggggaagaaatcaggccgagcatgaatcgcaagctgagtgatcacccacccacgctacctctgcagcaacatcaacaccagccccagccaccacagtacgctccagctcctcagcagctgcaacagcctcctcagcagcgatatctccagcatcaccacttccaccaggaacggaggggcggatctctggatatcaatgacggtcactgcggaaccggtctgggatctgagatgaatgctgctcttatgcacaggcggcacaccgaccctgtgcaactccaggccgctgggagagtcaggtgggcacgcgccttgtacgactttgaggctctggaggacgacgagctggggttccactcaggggaagttgtggaagttcttgattcctccaaccccagctggtggaccggccggctgcacaacaaattgggactatttcccgctaattacgtggccccaatgactcggtag

SEQ ID NO: 119036 - DNA, 294 bp, Artificial Sequence
  Description of Artificial Sequence: Synthetic coding sequence
atggaggcagtagccaagttcgacttcacagcttccggcgaggacgaactcagctttcataccggcgatgtgttaaaaattctctctaatcaggaggaatggtttaaagccgagctggggtcccaggagggttacgtgccgaagaactttatcgatatccagttcccgaagtggttccacgaaggtctcagtaggcatcaggctgagaatctgctgatgggcaaagaagttggcttctttataattcgggcaagtcagtcttctcctggggacttttctatctctgtaagatag

SEQ ID NO: 119037 - DNA, 795 bp, Artificial Sequence
  Description of Artificial Sequence: Synthetic coding sequence
atgttggaatttgtgtccctgctagcccgcaaagattctaacaactcggtgtcaaagccccggcataaactgaaccctttctcttctaagaggcacgaagacgacgttcaacattttaaagtaatgcgggacaacaagggaaactatttcctctggacagaaaagttcccgagcctgaacaaattggtggactattataggaccaatagtatttcacgccaaaaacagatctttttgcgggatcgaactagggaggatcagggccataggggtaattctctggaccgcaggtctcagggagggccccacctctctggggcagtgggcgaagagatccggccttctatgaataggaagctgagtgatcatccacccactttgcccttgcagcagcatcagcaccagccccaacctccccagtacgctccggcacctcagcagctgcagcagccacctcaacagcgctacctccagcaccaccattttcaccaggaaagaaggggcgggtctttggacattaatgatggtcactgcgggactgggcttggcagtgagatgaacgccgccctgatgcatcgacggcacactgaccctgttcagctgcaggccgcaggtcgtgtccgttgggctcgggcattatacgacttcgaagcactggaagacgacgaattgggattccactcaggcgaagtcgtggaagtcttggattccagtaaccccagctggtggactggcaggcttcacaataagctgggcttgttcccagccaattacgtcgctccaatgactaggtag

SEQ ID NO: 119038 - DNA, 837 bp, Artificial Sequence
  Description of Artificial Sequence: Synthetic coding sequence
atggaggccgttgctaaattcgactttactgcctctggagaagatgaactatcctttcacacaggggacgtcctgaagattctcagcaaccaagaagaatggttcaaggccgaactgggatcccaggaaggatacgtgcccaaaaactttatagatatccagttccctaagcacgaggacgatgtgcaacatttcaaggtgatgcgagacaataaagggaactatttcttatggaccgagaagtttccctccttaaataaactcgttgactactatcgcacaaatagcattagccgccagaagcagatctttctaagggaccgcaccagagaagaccagggccaccgcgggaacagcctagatcgtcggagccagggcggaccacatttgtctggggcagtgggggaggagatcagaccttcaatgaatcggaaactatccgatcatcccccaaccctcccgctccagcagcaccagcaccagcctcagcctcctcagtacgcgcctgccccccaacagctccagcagcccccccagcagcgttaccttcagcaccatcatttccaccaggagaggcggggtgggagtctggatattaacgacgggcactgtgggacagggctggggtccgagatgaacgcggctctcatgcaccgcaggcacaccgacccagttcagttgcaggccgcagggagagtcagatgggcccgcgccctgtatgacttcgaagctttggaggaggttctggacagcagcaatccatcttggtggacgggaagactgcacaacaagcttgggctatttcctgcaaattatgttgcacccatgacgcgctag

SEQ ID NO: 119039 - DNA, 915 bp, Artificial Sequence
  Description of Artificial Sequence: Synthetic coding sequence
atgctcgagttcgtctcgctgcttgcccgcaaggactccaataacagcgtgtccaaaccaagacataagctgaacccattcagctcaaaacgctggttccacgagggactcagccgccaccaggcagagaatctgctgatggggaaggaagtgggcttcttcatcatcagagccagccaatcctcccccggcgacttcagtatttccgtgcgacatgaagacgatgtacaacattttaaagttatgagagataataaaggaaactacttcctttggacagaaaagtttcccagcctgaacaagctagtggattattataggacgaattctatcagtcggcaaaagcagatctttctgagggataggaccagggaggatcaaggacatagagggaattcactggataggcgaagtcaggggggtcctcatctatcaggggccgtgggcgaagagatccgcccttcgatgaataggaagttgtccgatcaccctcccacgctccccctacagcagcaccagcatcaacctcaacccccacagtacgccccagcccctcagcagttacagcagcctccgcaacaaagataccttcaacatcatcacttccatcaagaacgacggggaggcagcctcgatattaatgatggtcactgtggtacgggcttgggtagcgagatgaacgctgcgttgatgcatcggagacacaccgacccagttcagttgcaagctgctggacgggttcggtgggcacgggctctgtacgacttcgaggccctggaggacgacgagctgggctttcacagcggggaggtcgtggaggttctagactcctccaatccaagttggtggacgggccgcttgcataacaaactgggcctgtttcccgctaactacgtggccccaatgacaagatag

SEQ ID NO: 119040 - DNA, 777 bp, Artificial Sequence
  Description of Artificial Sequence: Synthetic coding sequence
atggggaaggaggtggggttcttcattatcagggcttctcagagcagccccggcgacttttccatttcagtccggcatgaagacgacgtgcagcacttcaaggttatgcgtgataataaaggtaactattttctgtggacggagaagttcccgagcctcaataagctcgtcgactactacagaaccaattctatttcacgccagaagcagatattcctgcgggatcgaactagggaggatcagggtcaccggggcaatagcttagacagacgttcgcagggtggaccccacttgtccggagcagtaggcgaggaaattcgcccatccatgaataggaaactcagcgaccacccacctacattaccattgcaacaacatcagcatcagcctcagccaccccagtatgcacctgcccctcaacagctccaacagccaccacagcagagatacttacagcaccatcatttccaccaggagcgccggggcggctcactcgatatcaatgatggacactgtggcacaggactgggctctgagatgaacgcagccctgatgcaccgtaggcacactgatccagtacaactgcaggctgctggcagagttcgctgggcacgcgcactgtatgacttcgaagctctcgaagatgatgagctgggcttccatagcggtgaggtggtcgaagtgttagattcctccaatccttcctggtggaccggcaggctacataacaaactcggcctgttccctgccaattacgtggcaccgatgacccgctag

SEQ ID NO: 119041 - DNA, 507 bp, Artificial Sequence
  Description of Artificial Sequence: Synthetic coding sequence
atgttttggaagctcagcttgtctttgttcctggtggccgtgctggtgaaggttgccgaggcacgcaagaaccgcccggctggtgcgattcctagtccttataaagacgggtcatcaaacaattcagagagatggcagcaccagatcaaggaggtgcttgctagttcccaggaagccctggtggtgaccgagaggaaatacctaaaaagcgactggtgcaagacccagcccctgaggcagacggtatcggaagagggatgtcggtctcgcactattttgaatagattctgctatggacagtgcaactctttctatatcccccgtcatgtgaagaaagaggaggaaagtttccagagctgtgccttctgtaagccccagagggtgacgagcgtcctggtggaactagagtgtccaggcttagaccctccttttcgattgaagaaaatacaaaaagttaagcagtgccgctgtatgagcgtaaatttatccgatagcgacaagcaatag

SEQ ID NO: 119042 - DNA, 1443 bp, Artificial Sequence
  Description of Artificial Sequence: Synthetic coding sequence
atggcgggcacgcggtgggtgctaggagcgctgctgcgaggttgtggctgcaattgcagctcctgcaggcgaaccggagctgcttgcttgccgttctatagtgccgctgggtctattccatctggcgtctcagggaggaggagattgctcctgctcctcggagcggccgcagcagcggcaagccagacaagggggctgcagaccgggccagtgccacccggcaggctggccgggccacctgcggtggccacatctgctgcagcagctgccgcagctagctacagcgctctccgcgccagtttgctcccacaaagcctcgctgccgctgcagcagtccccacccgctcctacagccaggaatccaaaactacatacctggaggacctgccacccccccctgagtacgaactggccccatctaagctagaggaggaagtggacgacgtgttcctcatccgcgcacaaggccttccatggtcctgtacaatggaggacgtgctgaattttttctccgattgccgtattcggaatggcgagaatgggatccattttctcctgaatagggatggcaaacggaggggggatgcacttattgaaatggaaagcgagcaagacgttcagaaggctttagagaagcatcgaatgtatatgggacagaggtacgttgaggtttacgaaatcaataatgaggacgtggacgccctgatgaagagtctgcaggtgaagagttcccctgtagtgaatgacggggtggtgagactccgaggactgccttattcttgcaacgagaaggatatcgtcgacttctttgccgggctgaatattgtcgacatcacgtttgtgatggactatagaggcaggagaaagacaggcgaggcatacgtgcagttcgaagaacctgaaatggcgaatcaggccctgctgaagcaccgcgaggaaatcgggaacagatatatagaaatctttcccagtcgccgaaacgaggtgaggacacatgtgggtagctacaaaggcaagaagatcgcaagcttcccgacagccaaatacataactgagcctgagatggtctttgaagagcatgaggtgaacgaggacatccagcctatgacagcctttgaatcagagaaagagattgagctgccaaaggaggtcccagaaaagttgcccgaggctgccgactttgggacaaccagctccttgcattttgtgcacatgagaggattacccttccaggcaaatgcccaagatataatcaatttctttgcaccactgaaacctgttcgcatcactatggagtacagcagtagtggaaaagccactggcgaagcagacgtccacttcgaaacacacgaagatgcagtcgcagcgatgctgaaagacaggagtcacgtccatcaccggtacattgagttgtttctgaatagttgtccaaaaggtaagtag

SEQ ID NO: 119043 - DNA, 957 bp, Artificial Sequence
  Description of Artificial Sequence: Synthetic coding sequence
atggaggacgtgctaaacttcttttccgactgtaggatccgtaacggagaaaatggaattcattttctgttgaatcgcgatggcaaaaggagaggtgatgctctgatagagatggagtcggagcaggacgtacagaaagcactggagaagcacagaatgtacatgggacagcgatacgtcgaagtctatgagattaataacgaggatgtcgatgctctaatgaagagtctgcaggtgaagtcctcccccgtggtaaacgatggcgtggtacggctgcgaggcctcccttattcttgtaacgaaaaggacatcgtcgacttttttgccggcctcaatattgtggatatcaccttcgtgatggactatagagggagacggaagacgggcgaggcgtatgtgcagtttgaagagcctgagatggccaaccaggcactgttgaagcacagggaagagatcggaaaccgatatatcgaaatcttcccttctagaagaaacgaggttcgcacccacgtcgggagctataagggaaagaagatcgcttccttccccactgcaaaatacatcaccgaaccagaaatggtattcgaagaacatgaggtgaacgaggatatccagcctatgacagccttcgagagcgaaaaagagatcgagctcccgaaagaagtcccagagaaactccctgaggccgccgacttcggcactacctcttcactacactttgtccatatgaggggcctgccatttcaggctaatgctcaagatatcattaactttttcgcccctcttaagcccgtgaggatcacaatggagtacagttcctctgggaaggcaacaggtgaagcggacgtgcactttgagacgcatgaagatgccgttgccgcaatgctaaaagacaggtcccatgtgcatcaccgatacatcgaattgttcctcaacagctgccccaaagggaagtag

SEQ ID NO: 119044 - DNA, 1362 bp, Artificial Sequence
  Description of Artificial Sequence: Synthetic coding sequence
gcggcagccgtgcctaccaggagttactcccaagtgcgcggccgacgagaaggtcctggggcaaggagtctgcctggaagagttcatgcgccacctcggccgtccgtgcccccgtgcgctccccggggtcacgccaggggctctgcgacactggccgctcacccaccccctagtacgctgtgcagttactgggccctggagcaggggaaactttcacaagcatccgggctactcctcgtgctcttctctccaagagttagtggacgcctgggtagcgagagcaagaccacctacctggaagacttaccgcctcccccagagtatgagctggccccttccaagctcgaagaagaggtggacgatgtctttctgattagagcgcaggggttaccatggtcctgcactatggaggatgtgctgaatttcttttcggactgcagaatccggaatggggagaatggcattcacttcctgcttaatagggacggcaagcggcgcggggacgccctcattgaaatggagtccgagcaggacgtgcagaaggcactggaaaagcatcgaatgtatatgggtcagaggtacgtcgaagtctacgagatcaataacgaagatgtggatgctttgatgaaatcattgcaggtgaaaagttcacctgtggtcaacgacggggtggttcgtttgcgaggactcccttactcttgtaatgaaaaggacattgttgactttttcgctggtctcaacatcgtggatattacattcgtgatggactatcggggtagacggaaaacaggcgaggcctatgtgcagttcgaggagcccgagatggcaaaccaggccctcctgaagcatagagaggagattggcaaccgatatattgaaattttcccttcccggagaaacgaggtccgtactcacgttggctcctataaaggtaaaaaaattgctagcttccctactgcaaagtacattacagagcctgagatggtgtttgaagagcatgaagtaaacgaagacatccaaccaatgacagccttcgaatcggagaaggagatcgaactgccaaaggaagtgccggagaagttgccagaggcagccgacttcggtacgacaagctcattgcactttgtgcatatgcggggactaccatttcaagctaacgcacaggacatcatcaatttctttgcacctctcaagccagtcagaatcacaatggaatacagcagttctggaaaagcgacaggggaagccgacgttcactttgaaacccacgaggacgccgtcgccgcaatgctcaaggacaggtcccacgtacatcataggtacatcgagctcttcttgaacagctgtcccaaagggaaatag

SEQ ID NO: 119045 - DNA, 957 bp, Artificial Sequence
  Description of Artificial Sequence: Synthetic coding sequence
atggaggatgtgctgaacttcttctcagattgcaggattagaaatggggaaaacggcatacacttcctgctgaacagggatggaaaaaggaggggtgacgccctgattgagatggagagcgaacaagatgtgcagaaggctttggagaagcatagaatgtatatgggacagcggtatgtggaagtgtatgagattaataatgaagatgtggatgctctgatgaaatcgctgcaggtgaagtcctcgcccgtagtgaatgatggagtcgtgagactccgtggattgccttatagctgtaatgaaaaggacatcgtggatttcttcgcaggcctgaacatcgtggacattactttcgtcatggactatcggggacggaggaagacaggagaggcctatgtgcagttcgaagaaccagaaatggcaaatcaggccttgctgaaacatcgcgaggagattggcaacagatacatcgagatttttcctagtcgaaggaatgaagtgagaacccacgtgggcagttacaaaggcaagaaaattgcttccttccccaccgctaaatacatcacagaacctgagatggtgttcgaagagcacgaagtaaatgaagacattcagcccatgacagcttttgaatccgagaaggagatcgaactgccgaaagaagtaccagagaaactacctgaagccgctgactttggcacaaccagtagcctccactttgtgcatatgagggggttgccatttcaggcaaacgctcaagacataattaactttttcgcccccctgaagcccgtccgaattaccatggagtacagcagttcagggaaggcgaccggcgaggcagatgtccacttcgaaacccatgaagatgccgtggccgccatgctgaaggataggagccatgtgcatcatagatatattgaactatttttgaatagctgccccaagggaaagtag

SEQ ID NO: 119046 - DNA, 1254 bp, Artificial Sequence
  Description of Artificial Sequence: Synthetic coding sequence
taacctcccccttctaccttatgttcctattgggcactcgagcagggtaagctctcccaagcatccgggctccttttggtcctgttctcacccagagtgagcggcagactgggatcagtgtcggtggccggcgtgaacgtggaggcccttttccctgcctggccaatggagtcgaagaccacatacctggaagacctgcctccacccccagaatatgaactggccccttcaaaactcgaagaagaggtggacgatgtgttcctgataagagctcagggcctgccttggagttgtacaatggaagatgtgctgaatttcttcagcgattgccgtatccgaaatggtgagaacgggatccactttttattaaatcgagatgggaaaagacgcggggatgcattgatcgaaatggaatctgagcaagacgtgcaaaaagcactcgaaaaacaccgaatgtacatgggccagcggtatgtcgaggtgtacgagattaataacgaggatgtggatgccctgatgaagtccctgcaagtaaagtcctcacccgtggtaaatgacggggtagtgaggctccgcggtttgccttattcgtgtaacgagaaggatatcgttgacttctttgctgggctgaatatcgtggacatcacgtttgtgatggattatcgtgggcggcggaagactggagaggcgtacgtgcagttcgaggagcccgaaatggctaaccaggcactccttaagcaccgtgaggagataggcaacagatacatcgagatattcccatctcggcgtaatgaggtgagaacacacgtcgggtcctataaagggaaaaagattgccagctttcccacggcaaagtacatcactgagcctgaaatggtgtttgaggagcacgaggtgaacgaggacatccaacccatgacagcatttgagtcagagaaggaaatcgaactccctaaagaagtacctgagaaactacccgaagctgccgacttcggcaccaccagcagtctacacttcgtgcatatgaggggcctgccctttcaggccaacgcacaggacatcatcaatttttttgctccattaaaacccgtccgcatcactatggaatattcttcaagtggtaaggccacaggtgaagccgacgttcattttgagacacacgaggacgctgtggctgccatgctgaaagaccgttctcacgtgcaccaccggtatatcgagctgttcctgaattcatgtcctaaggggaaatag

SEQ ID NO: 119047 - DNA, 1239 bp, Artificial Sequence
  Description of Artificial Sequence: Synthetic coding sequence
atggccggaactagatgggtgctgggggcactattgagaggttgtgggtgtaattgcagctcttgcaggcgcaccggcgctgcatgtctgcccttctattccgccgcaggctcaattccggctgcagcagtcccgacaaggtcttactcacaggaatctaaaaccacttatctggaagatctgccaccacctcccgagtatgagctggccccctctaaattagaggaagaagtggacgatgtcttcctgatcagagcccagggactgccctggtcctgcaccatggaagatgtgctgaacttcttcagcgattgccgtatccgaaacggggagaacggcatccatttcctgctcaatagagacggcaaacgacgcggggacgctctcatcgagatggagtctgagcaggatgttcagaaggccctcgagaagcacaggatgtacatgggccagcgctacgtggaggtctatgaaatcaacaacgaggacgtagacgctctcatgaagagcttgcaggtcaaaagctcacccgtcgtgaatgacggagtggtgcggttgcggggtctcccatactcatgtaatgaaaaggacatcgtggacttctttgcggggctcaacatcgtggacatcacatttgtgatggactaccgcggcagacgaaagactggcgaagcttatgttcagttcgaagaacccgagatggcaaatcaggctctgctaaaacaccgggaggaaatcggaaatcgctatatcgaaatttttccctctagaaggaacgaggtgcgtacccacgttggcagttacaaaggtaaaaaaattgcttcattccccaccgcgaagtacattaccgagcctgaaatggtgtttgaggaacatgaagtgaatgaggacattcaacccatgaccgccttcgagtctgaaaaagagatcgagttgcccaaggaggtccctgagaagctgccagaagcagccgatttcgggacaactagttctctgcattttgtacacatgcgtggtttaccattccaagccaacgcccaggatatcataaacttctttgctcctctaaagcccgttagaattactatggagtacagcagtagcggtaaagctaccggggaagcggatgtgcactttgagacccacgaagacgccgtggctgcgatgctgaaggataggtctcatgttcaccaccggtatatcgagttattcctgaactcctgcccaaagggcaagtag

SEQ ID NO: 119048 - DNA, 1089 bp, Artificial Sequence
  Description of Artificial Sequence: Synthetic coding sequence
atggagtctaagaccacatatctggaagacttaccgccaccacccgaatacgaattagctccatctaaacttgaagaggaggtggacgacgtgtttctgatcagagcacaggggctgccatggtcctgcactatggaggatgtgctgaatttcttctctgactgtaggattcgaaacggagagaatggaatccacttcctgcttaatagagatggcaagcggcgcggcgatgcattaatagagatggagtcggaacaggatgttcagaaagccctggaaaaacaccggatgtatatggggcagaggtatgtcgaggtgtacgaaatcaacaatgaggatgtggatgccctgatgaagtccctgcaggtgaagtcatctcccgttgtgaacgacggcgtggtgagactccggggcctaccatacagctgcaatgaaaaggacattgtggatttttttgctggactgaacatcgtggacataactttcgtgatggactatagagggagaagaaaaaccggggaggcatatgtccagttcgaagaaccggagatggctaaccaggctctcctgaagcaccgggaggagataggcaaccgctatatagagatatttcctagcaggaggaacgaggtgcgcacacatgtgggatcatacaagggcaagaagatcgccagctttcccaccgctaaatatatcaccgagccagagatggtgtttgaggaacacgaagtgaacgaggatatacagcccatgaccgcatttgagagcgagaaagagattgaactgccaaaggaggtgccggaaaagctgccagaagctgccgatttcggtacaacttctagcctgcacttcgtacacatgcgcggattgcctttccaagcaaacgcgcaagacatcataaatttcttcgcaccgttgaaacctgtgcggatcactatggagtatagcagctccggcaaggcaaccggggaagccgatgtgcacttcgaaactcacgaggatgccgtggcagctatgctaaaagatagaagtcatgtccatcacaggtatattgagcttttcttaaacagctgccctaaaggaaaatag

SEQ ID NO: 119049 - DNA, 1401 bp, Artificial Sequence
  Description of Artificial Sequence: Synthetic coding sequence
atgctaaggtctactagtaccgtgacattgctcagcggaggagctgccaggaccccaggtgcaccgtccaggagggccaatgtctgccggctccgtctaaccgtcccccccgaatcccccgtgcccgagcaatgcgagaaaaagatagagcggaaggagcagttgttagatctgagtaacggcgaacctacgaggaaactgcctcagggagtcgtgtatggcgtggtgaggcgatcagaccaaaaccagcaaaaagagatggtcgtttacggctggagcacaagtcaactcaaggaagaaatgaattacataaaagatgttagagctaccctggaaaaagttcggaagcgaatgtacggagactacgatgagatgcgacagaaaattcgccagctgactcaggaactttccgttagtcatgcacaacaagaatatctagaaaaccatattcagacacagtcgagcgctctggaccgctttaacgctatgaattccgcactcgcctccgactctattgggctccagaagactcttgtggatgtgacattggagaattccaacattaaagaccaaatccggaacctacaacagacctatgaggcctccatggacaagcttagggagaaacagcgacagctggaggtggcccaggtggagaatcaactattgaagatgaaggtggagtcgagtcaggaggccaatgctgaagtgatgagggaaatgaccaagaagctctacagccagtatgaggagaaactgcaagaagagcagaggaagcactccgctgagaaggaagctctgctcgaggaaaccaactcatttcttaaggcaattgaggaagctaacaagaagatgcaggctgccgagatttcgcttgaagaaaaagaccagaggatcggggagttggaccggctgatcgagcgcatggagaaggaaagacaccagctacagctgcaattgctagagcatgagacagaaatgagtggagaactgactgattctgacaaagagcggtatcagcagctggaggaagcatccgctagtttgcgcgagagaataagacacctggatgatatggttcattgccagcagaagaaagtgaaacagatggtcgaggagattgagtcgttaaaaaaaaagctccagcagaaacagttactgatactgcagctgctcgaaaaaatctccttcttagaaggagagaataatgagttgcaatccagactcgactatctgacagagacccaggccaaaacggaggtggaaacccgcgagatcggggtggggtgtgatctgctaccctcgcagacaggtaggacccgggaaatcgtaatgccttcaaggaattatactccctatactcgcgttttggagctgacaatgaagaagacactgacctag

SEQ ID NO: 119050 - DNA, 1194 bp, Artificial Sequence
  Description of Artificial Sequence: Synthetic coding sequence
atgctgcgctccacatcgacggttacgctgttgtccgggggagccgcaagaacccccggcgcccccagtcgacgagctaatgtgtgtcgcctcaggttgaccgttccccccgagtcgcctgttcctgagcagtgcgagaaaaagatcgagcgtaaggagcagctgctggacctgtccaatggggagcctacccgtaaattgcctcagggcgtggtgtatggtgtggtcaggagatctgaccagaatcaacagaaggaaatggtggtgtatggctggtctacatcacaacttaaagaggaaatgaattatatcaaggacaagacactagtcgacgtgacattagagaatagtaacataaaagatcagatccgtaacctccagcagacgtacgaggcatccatggacaaacttcgagagaaacagagacagctggaggtcgctcaagtagaaaaccagttgctgaaaatgaaggtggaatcatcccaggaggctaacgccgaagtgatgagggagatgaccaagaagctatactcgcaatacgaagaaaaacttcaagaggaacagcgtaaacatagtgctgagaaggaagccctgctggaagagaccaactcctttctcaaagctattgaagaggccaataagaagatgcaggcagcggaaatctctctggaggagaaagaccagcggatcggtgagctcgacaggctgatcgagcgcatggaaaaagagagacaccagctgcagctgcaactgctggagcacgaaactgagatgagcggcgaattgaccgactctgacaaggagaggtaccaacaactagaagaggcatctgccagtttacgtgaacgtattaggcaccttgacgacatggtgcactgccagcaaaaaaaggtgaagcaaatggttgaagagatcgagtcccttaaaaagaagctgcagcagaagcagcttctgatcctgcagctccttgaaaagatcagctttctcgaaggagaaaacaatgagctgcagtcacgactcgattatctgaccgagacccaagctaagaccgaagttgagacgcgggaaatcggggttgggtgcgatctcttaccttcacagaccggccgaacccgggagatagtaatgcccagtagaaactacactccttacaccagagtgcttgagctgacaatgaagaagacactaacatag

SEQ ID NO: 119051 - DNA, 1248 bp, Artificial Sequence
  Description of Artificial Sequence: Synthetic coding sequence
atgctccgttctaccagtaccgtgacacttctgtctggcggggcagcacgaactccaggagcaccttcgcgccgagccaacgtctgccggttgcgactgaccgtgcctcccgagtccccagtccctgaacaatgcgaaaaaaagattgagcggaaagagcaactgctagatctctctaacggtgagccaaccaggaaacttccccaaggggttgtgtatggtgtcgtgagacggagtgatcagaatcaacagaaggagatggttgtgtatggttggtcaactagccaacttaaagaagaaatgaactacattaaggatgtatctcacgctcagcaggaatacttagagaaccatattcagactcagtccagtgcactggaccgctttaacgccatgaactccgccctggcgtctgattccatagggctgcagaagactctagtggacgtgactctggagaatagtaacattaaggatcagatccggaatctccagcagacttacgaggcttccatggacaaactcagagaaaagcagcggcagctggaggtggcccaggtggaaaatcagctcttaaagatgaaagtggagtcctcccaggaagctaatgctgaggtgatgagagagatgacgaaaaagttatattcgcaatatgaggaaaagctgcaggaggagcagcgaaaacacagcgctgaaaaagaggccctattagaagagaccaacagcttccttaaggctatcgaggaggctaacaaaaagatgcaagctgccgagatttctctggaggagaaagaccagagaatcggagagctcgatagattaattgaacgcatggagaaagagcgtcaccagcttcaattacagttgctggaacacgagacagagatgtcaggagagctcaccgattctgataaggaaagatatcaacagctggaggaagcaagcgcatcgttgcgagaacgtattagacacctggatgatatggttcattgtcagcagaagaaggtgaaacagatggtggaagagaataatgaattacaaagtaggttagactatctcaccgagacccaggccaaaacagaagtggagactagggagatcggcgtaggttgtgacctcctgccccggcagtcaagaaagtttgagaaagttctcaacgaattcgtacagctcttgcctttgccccaccatctgctctgggctttcggcaacgtttgttggagacgccatttcgggcttctgcagtag

SEQ ID NO: 119052 - DNA, 1317 bp, Artificial Sequence
  Description of Artificial Sequence: Synthetic coding sequence
atgctgcgctccacttccacagtcaccttgctgagcggaggagctgcccggacacctggggcccctagcaggcgcgccaacgtgtgtcggctgcgactaacagtcccacctgagtcacccgttcccgagcaatgcgagaaaaaaattgagagaaaagagcagctgttggacctgtctaatggagagcctacccggaagctgcctcagggagtcgtatatggcgtggtgcggaggtctgaccaaaatcagcagaaagagatggtggtttacggctggagcacatcccagttaaaagaagagatgaattacataaaggacgtcagggctactctggagaaagtcaggaaacggatgtacggtgactatgacgaaatgcgccaaaaaattagacagctgactcaggagctgtccgtctctcatgcacagcaggaatatctcgaaaaccatattcaaacccagtcgtctgcactggaccgctttaacgctatgaattcagcactcgcctccgattctattgggcttcagaagacactggtcgatgtgactctcgagaatagcaatatcaaggaccaaattcgaaatctccaacagacttacgaggcctcaatggataagcttcgggagaagcaacgccagctggaagtggcccaagttgagaatcagctgcttaaaatgaaggtagagtctagccaggaagcaaacgctgaagtcatgcgcgagatgaccaaaaaactgtacagccagtatgaagagaaactccaggaagagcagcgcaaacactctgctgaaaaggaagctctgctcgaggagaccaattccttcctgaaagctatcgaagaggctaataaaaagatgcaggcagccgagattagcctggaagaaaaagatcagcgtattggggagctggacagattaatcgagcgcatggagaaggagcggcaccagctgcagctgcaactgctggagcacgagactgaaatgtccggggagctgactgactccgacaaggaacgatatcaacagttggaagaggcctccgccagcttaagggagcgaatccgccatctggatgacatggtacattgccagcagaagaaagtgaagcagatggttgaagaaaacaacgaactgcaaagtagactggactacttgaccgagactcaggcgaaaacagaggtagaaacacgcgaaatcggggttggttgcgatcttctgccatcacagacagggagaaccagagaaatagttatgccatctcgaaattataccccatatacgcgcgtcctggagcttaccatgaagaaaactttaacatag

SEQ ID NO: 119053 - DNA, 1338 bp, Artificial Sequence
  Description of Artificial Sequence: Synthetic coding sequence
atgttacggagcacatccaccgtcaccctgctgagcggaggcgccgcaaggacccctggtgcccctagcagaagagccaacgtgtgtagactgagactcaccgtgcctcccgaaagcccagtgccggaacagtgtgaaaaaaagattgagagaaaggagcagctgttggatctgtcaaacggcgagcctacccgaaagttgccccagggcgtggtctatggagtggttcgccgttccgatcagaaccagcagaaagagatggttgtgtacggttggtcaaccagtcagctgaaggaagagatgaactacattaaggacgtgagagctacactggagaaagtgcgaaagcgcatgtacggggactatgacgaaatgagacaaaaaatcaggcaacttactcaggagctatcagtgtcccatgcccagcaggaatacctcgagaatcacattcagactcagagcagcgccttggatcgtttcaacgccatgaacagcgcccttgcctcggattctataggcctacaaaagacgctggtcgatgtgacgctggagaactctaacatcaaagatcagatccggaacctgcagcagacctacgaggcctccatggataagttgagggaaaagcagcgccagctggaagtggcccaagtggagaaccaactcttgaaaatgaaggtcgaaagcagccaggaagcgaatgctgaagtgatgcgggagatgacaaaaaaattgtattcccagtacgaggaaaaacttcaggaggagcagcgaaaacatagtgccgagaaagaggctctgttagaggagacaaactccttcctgaaagccatcgaagaggccaacaagaagatgcaagccgcagaaatttcactggaagaaaaagatcagcggatcggggagctggatcgattaatcgagcggatggaaaaagaaaggcaccagctccagctccagctgctggagcacgagactgaaatgagtggcgaactgactgactccgacaaggagcgttatcaacaactggaagaagctagcgctagcctccgggagcgcattcgccacctcgacgatatggttcactgccagcaaaagaaggtaaaacagatggtcgaggagatcgaatccctgaaaaagaaactgcagcaaaaacagctcctcattctgcagctcctcgagaagattagtttcttagagggggagaataacgagttgcagagcaggttagactacctgacagagacccaagcgaagacagaagttgagacacgcgagatcggagttggttgtgatctgctgcctagacgatgcaaacagagcagccagcgcaagaattag

SEQ ID NO: 119054 - DNA, 1653 bp, Artificial Sequence
  Description of Artificial Sequence: Synthetic coding sequence
atgctgagatcaacctccacagtgaccctgctgagcggcggcgccgcccgaaccccaggtgccccatcaaggagagctaatgtttgtagactgcgactgactgtgcctcctgagtcacccgttccagagcagtgtgagaaaaaaattgagcgtaaagagcaattattagacctgagcaacggcgaacccacaaggaaactgccgcaaggggtggtgtatggcgtggtgaggcgcagcgaccagaatcagcagaaagagatggtggtttatggctggtctacctctcagttaaaagaggaaatgaactacataaaagacgtgagggcaaccttagagaaagtgcgcaaaaggatgtacggcgactacgatgaaatgaggcaaaaaatccgccagctaacccaggaactaagtgttagccacgcccagcaggagtatctggaaaaccacatccagacgcaatctagtgcactggaccgctttaacgctatgaactctgccctggcgtcagacagcattggtctccaaaagactctcgtagatgtcactctggagaattccaacattaaggatcagatccggaacttgcagcaaacctacgaggcttccatggataaattacgggaaaaacagagacaactggaagtggcccaggtggaaaatcagcttcttaagatgaaggtcgagtcttcgcaagaggccaacgccgaagtgatgagggaaatgaccaagaagctgtattcacagtatgaggagaagcttcaggaggagcagcggaagcactcagccgagaaagaggcactgctggaggagacaaactccttcttaaaggccatcgaggaggccaacaaaaagatgcaggctgcagagatttcgctcgaagaaaaagatcaaagaataggagagttagatcgcctcatagagaggatggaaaaggagagacaccaactgcagttgcagctgctggaacatgaaactgagatgtctggcgaactgacagattccgacaaggagaggtaccagcagttggaagaggcgtccgcttcactcagagagagaatcaggcacctcgatgatatggtccattgtcagcagaagaaagtgaaacagatggtcgaagaaatcgaatcgctgaagaaaaaacttcagcaaaagcagctgctgattctccaactgttggagaaaatctcattcctcgaaggggaaaataacgaactgcagtcacgattggattacctgacagaaacccaggccaaaactgaagttgagacacgtgagatcggggtggggtgcgacctcttgccgcggctgcccttccgacagaatgattcatcaagccactgtcagaagagtggcagtccaatttcctctgaggagcgccgcaggcgtgacaaacaacatctcgacgacatcaccgctgcaaggcttctgcctctgcatcacatgcccacccagttgctgtccattgaggagagcttggctttacagaaacagcaaaagcagaactatgaggaaatgcaggccaagctggccgctcagaaactcgctgaaaggctgaacatcaaaatgcggagctataatcccgaaggcgaaagctcaggcaggtaccgggaggtgagggacgaggatgacgactggtcctctgacgagttctag

SEQ ID NO: 119055 - DNA, 1308 bp, Artificial Sequence
  Description of Artificial Sequence: Synthetic coding sequence
atgctgcggagcacctctacagtcactctcctgtctggaggggctgccaggaccccaggtgcacctagccgccgcgccaacgtgtgcagactgagactgacagtgcctcccgaaagtccagtccctgagcagtgcgaaaagaagattgagagaaaggagcagcttcttgaccttagcaatggagagcctacccggaagttgccgcagggcgtggtgtatggcgtcgtcagacggagcgaccaaaatcaacagaaggaaatggttgtttacggctggagtacttcccagctgaaagaagagatgaactacataaaagacgtgtcgcacgcgcagcaggagtatctcgaaaatcacatccagacgcaatcctccgccctagatcgcttcaacgcaatgaattctgccttggcctcggacagtatcgggcttcagaagacactcgtggacgtgacactggagaactctaacatcaaggaccagattcggaaccttcaacagacctacgaggcaagcatggataagctccgagagaagcagcgccagctcgaggtggcccaagtcgagaaccagctgctaaagatgaaggtggaatccagccaggaagccaatgccgaggtgatgcgagagatgacaaagaagttgtatagtcagtacgaggagaaactgcaggaggaacaacggaagcactccgcggagaaggaagctctcctggaagagaccaatagcttcctcaaggccatagaggaagccaacaagaaaatgcaggccgcagagatcagcctggaggagaaggatcagcgcatcggcgagttggacaggctcatcgaaaggatggaaaaagaacggcatcagcttcagctccagttgctggagcacgaaacggagatgagcggggagttaacagacagcgacaaggaacggtaccagcaactggaggaggcaagtgcctcgcttagggaacgcattcggcatttggacgatatggtgcactgtcagcaaaagaaggtgaaacagatggtcgaagagatagagtccctgaagaaaaagctgcagcagaagcagttgctgattctgcagctgctcgaaaaaatcagttttctggaaggcgaaaacaacgaactgcagtctcgcctggactatctaactgagacacaggccaaaacagaagtggagactagggaaatcggtgtgggttgtgacctcctgcctagccaaaccggacgcacgcgggagattgttatgccttccaggaactacaccccctatacgcgcgtgctggagctgacaatgaagaaaacactcacctag

SEQ ID NO: 119056 - DNA, 1401 bp, Artificial Sequence
  Description of Artificial Sequence: Synthetic coding sequence
atgttaaggtctacctctaccgtgaccctgttgtccgggggggcagcacggactccaggagcgccaagtcggcgcgccaatgtatgtcggctgcggctgacagtacccccagagtctcctgtgcctgagcaatgcgaaaagaagatcgaacggaaggaacagctgctggacctctcgaacggtgaaccgacaaggaagctacctcagggggtcgtttacggtgtggtgcggaggtccgaccagaaccagcagaaagagatggtggtgtatgggtggtctaccagtcagttaaaggaagagatgaattatataaaggacgtgcgggccacactggagaaggtgcgaaagcgcatgtatggggattacgatgaaatgaggcagaaaattaggcagctaacccaggagctatcggtgagccatgcacagcaagagtacctcgagaatcatattcagacacagtcgtcggcactggacaggttcaacgcaatgaacagcgccctggcatcagactcaataggactgcagaaaacactggtggatgtaactctggagaattccaatattaaagatcagataaggaacctgcagcagacttatgaggcctccatggacaagcttagagaaaagcagcgccagctggaggtggcgcaggtcgaaaaccagctgctgaaaatgaaggtggaaagcagccaagaggctaatgcagaggtgatgcgcgaaatgacgaagaaactgtatagccagtatgaggagaagttgcaagaggagcagcgcaaacactcagcggagaaggaggctctcctagaggagaccaattcattccttaaggcgatcgaggaagcaaacaagaaaatgcaggcagccgagatcagtctggaagaaaaggatcagcgcataggggagcttgatcgtctcattgaacggatggagaaggaaaggcaccagcttcaacttcagttactagagcacgagactgagatgtccggggagctgacagactccgataaagagcggtaccagcagctcgaggaagcatctgcctctcttcgagaaaggattaggcacctagacgacatggtgcattgtcagcaaaaaaaggttaagcaaatggtggaagaaatcgagagtctgaagaagaagctgcagcagaagcagttgttgattctgcagttactcgagaagatctcattccttgagggggagaataacgaacttcagagtcgtttggattatttaaccgagacacaggccaagacggaggttgagactcgtgagatcggagtcgggtgtgatctgctgccttcccagaccggaagaaccagagaaattgtaatgcccagtcgcaactacacaccttacactcgtgtcttggaactcactatgaaaaagaccctcacttag

SEQ ID NO: 119057 - DNA, 1317 bp, Artificial Sequence
  Description of Artificial Sequence: Synthetic coding sequence
atgctgcgctccaccagcaccgtgacactgctaagcggaggcgctgcccgcactcctggggcacctagccgccgggcaaacgtttgccgattgaggctcaccgtgcctcccgagtccccggtcccagagcagtgcgagaaaaagatcgagaggaaggaacaactcttagacctgagcaatggtgaaccaacaaggaagctcccacaaggggtcgtctacggagttgtccgacggtccgaccagaatcagcaaaaagaaatggtcgtgtatgggtggtcgacctctcagttaaaggaagagatgaactacataaaggatgtgcgtgcaacactcgagaaggtgaggaaacggatgtacggagattacgacgaaatgcggcagaaaataagacagctcacccaggaactgtctgtgagtcacgcgcagcaggagtacttggaaaaccacattcagacacagtctagcgcccttgatagattcaacgccatgaattcagccctggcatctgattctatcggcttgcagaagaccctcgtggacgtcactctggagaatagcaacatcaaagaccaaattcgaaatctccagcaaacttatgaagcctctatggacaagctgcgcgaaaagcagcggcagctggaagttgcccaggtagagaaccaactcctgaagatgaaggtcgagagcagtcaagaagccaacgccgaagtgatgagagagatgacgaaaaagctgtacagccagtacgaagaaaagctgcaagaagagcagcggaagcactccgccgagaaggaggcactcctggaggagaccaattcattcctgaaggcaatcgaggaggcaaataaaaagatgcaggccgccgaaattagcctagaagaaaaggaccagagaattggagaactggaccggctgatagagaggatggaaaaagaacggcatcagctgcaactccaacttctcgagcatgaaactgagatgtctggcgagctgacagactcagacaaagagcgctaccagcagctcgaagaggcttccgcctcactcagggaaaggataagacacctcgatgatatggtccactgtcagcagaaaaaagtcaaacagatggtggaagaaaacaacgagctgcagtctcggctcgactatctcacagagacccaggctaaaactgaggtcgagactcgcgagattggagtgggctgcgatttgctgccctcccagactggcagaaccagggagatcgtgatgccgagtcgtaactacacaccttatacgcgcgtgctggaattaaccatgaagaagactcttacttag

SEQ ID NO: 119058 - DNA, 1401 bp, Artificial Sequence
  Description of Artificial Sequence: Synthetic coding sequence
atgttgcggagcacatcgaccgtgaccctgctgagtggtggtgccgctagaacccctggagcaccctccagaagagccaatgtgtgtagattgaggcttacagtcccaccagagtcccctgtgcccgagcagtgtgagaaaaaaatcgagagaaaggaacagctactcgatctgtccaatggagaacctacgcgcaagctgccccagggcgttgtgtacggtgtcgtgcgaaggagtgaccaaaatcagcagaaggaaatggtggtatatggatggtctaccagtcagctgaaggaggagatgaattatatcaaggacgtcagagccacactggagaaagtgcgaaagcggatgtacggcgattatgatgaaatgcgccaaaagattcgtcagctcacccaggaactctccgtctcccatgcgcagcaggagtatcttgagaaccacattcaaacgcagtcttctgctctggatagattcaacgctatgaattccgccctggcttcggattctatcggccttcagaagaccctggtggatgttacacttgagaattctaatataaaggaccagataagaaacctccagcagacgtacgaggcctctatggacaagctgcgtgaaaaacagcgccagctagaggtggctcaagtggagaaccaactactaaaaatgaaggtcgagtcttcgcaggaggcaaacgcggaggtcatgagagaaatgaccaagaaactgtactcacagtatgaggagaagctgcaggaagaacagcgcaaacatagtgcagaaaaggaggctttacttgaggagacaaatagtttcctgaaggctattgaggaagccaacaagaagatgcaggcagctgagattagcttggaggagaaagaccagagaatcggcgaactggaccggctgattgagcgtatggagaaggagagacaccaactccagctgcagctccttgaacacgagaccgagatgtcaggagagcttactgactctgacaaggagcggtatcaacagctggaggaggccagtgcgtcgctgcgggaaagaattaggcaccttgacgacatggtccactgccagcagaagaaggttaagcagatggtggaagagatagagagcctgaaaaaaaaactgcagcagaagcagctacttatcctccagctcttggagaagatttcttttttggaaggagaaaataatgagcttcagagccgtttggactacttgactgaaactcaggccaaaaccgaggttgaaacaagagaaattggagttgggtgcgacttgcttccaagccaaacaggtaggacccgagagatcgtcatgccatctcgtaactacactccctatacgagagtattggagttgactatgaagaagacacttacctag

SEQ ID NO: 119059 - DNA, 2328 bp, Artificial Sequence
  Description of Artificial Sequence: Synthetic coding sequence
atggagaagtttgggatgaactttggggggggcccttcaaagaaggatcttctggagaccattgagacccagaagaaacagctcctccagtaccaagctcgcctgaaggacgtcgtgagagcatacaaatctttgcttaaagagaaagaagctctagaagcgtcaatcaaagtgctgagcgtctcccatgaggctgacgtgggtctggccggggtgcagttgcccggactcacatttccggactccgtggacgacagatgctctacccattctgaggattctacaggcactgcaactagcctcgacactgctgcaagtctgacatcaacgaagggagagtttggagtcgaggacgaccggccagcacgtgggcccccccccccaaaaagtgaagaagcgagttggagtgagtcgggagtcagctcaagcagcggcgacgggccctttgctggcggcgaggtggacaagcgactgcaccagctgaaaacccagcttgcaactttgaccagcagcctggcaaccgttactcaggaaaaatcccgaatggaagcttcatatcttgcagacaaaaagaagatgaagcaggacctagaggacgccagcaataaagctgaggaagagcgggctagactcgagggagagctcaagggactgcaggaacagatcgcagaaactaaagcaaggctcatcacgcagcagcacgatagggcccaggagcagtccgaccatgcgctgatgctcagggagctgcagaagctcttgcaggaggaaaggacccaacgccaggatttagaactgagactcgaggagacgcgagaggccctcgctgggcgcgcctacgccgctgagcaaatggaaggcttcgaactccagaccaagcagctaactagggaggtggaagagttaaagtctgaactgcaggctattcgggacgaaaagaaccagcctgacccaagactgcaggagttgcaggaggaagccgcgcggctcaagagccactttcaggcacagttacaacaagaaatgagaaagacagctctggccgaggatcagctaagacagcagagtcaggtcgaagagcagagggtggctgccttagaaaaccaaatcagcgaggtttctgaactgcttggcacatacgagaaagctaaacaaaaagaccagttggccattcagaagctcaaggagcggatcctccaattagatctggagaacaagactttagctttggccgccagtagccggagccccctcgacagtcacggcgaggagtcctctctcgacgtcaacgtcttgaaggacaagatggagaaacttaaacggctactccaagttgccgcccggaagagccaggtgaccctcgacgtagaaaagctgtgtgatctggaaataatgccctcatcagaagcagcagacggcgaaaaagcgacagctctgtactatcagcaggagcttaaacagctcaaggaggagttcgaacggtataagatgagagcccaggttgtactgaagagtaagaatactaaggacggtaacctggggaaggaattggaggcagcacaggaacaactggctgagctaaaggagaaatacattagtttgagattatcctgtgaggaactagaacaccagcatcaacaagaggctgacgattggaagcaggaactggctagattacagcagctccaccgccaggaactagaaagatgtcagctggatttcagggaccgtaccctgaagctcgaagaggaactccacaaacagagagacagagccctcgctgtgctgacagagaaagacctggagctggaacagctgagatctgtggcgttggcgtcaggacttccaggacggcgaagccctgtgggcggcggaggcccgggagatccggccgacacaagctcttcggattcgctgacgcaggcactgcagctagcagctgccaatgaacccactttttttctctacgccgagcagttggcacggaaggaggtcgaaataacctcactgagaaagcagaagcatcgcctcgaggtcgaagtacaccagttgcaagatcggcttctggaagagggtgaaaggcatagagaggaggtcgctgcattgcaaagtcatattgagaaaaacattagagatcagtcccgcgaaggtgccaatctggagtacctaaaaaatatcatttataggtttctgacattacctgattctctcggccgccaacagacattgaccgcaatcctgaccattctgcacttttcccccgaggaaaagcaggtgataatgaggctgcccacgtccgctagctggtggccctctggaaagcgatag

SEQ ID NO: 119060 - DNA, 5055 bp, Artificial Sequence
  Description of Artificial Sequence: Synthetic coding sequence
atggaagacctggtccaggacggcgtggcatcccccgccaccccagggacaggcaaatccaaactggaaacactgcccaaggaggatcttatcaagttcgccaagaaacagatgatgctcatccagaaggctaagtccaggtgtacagagctggaaaaggaaatcgaggagctccggtctaaacccgtcacagaaggaaccggtgacatcatcaaggcgctgactgagcgcctcgacgctctcttgctggagaaagcagaaaccgagcagcagtgtctgtcattaaagaaggaaaacatcaaaatgaagcaggaggttgaggattcagtaaccaaaatgggcgatgcacacaaggaactggagcaatctcacataaactatgtgaaagagatcgaaaatcttaaaaatgagctgatggccgtgagatcaaaatacagcgaggacaaggctaatctacagaaacagttggaagaagccatgaatacccagctggaactcagcgaacagctcaagtttcagaacaattccgaagataatgtgaagaaattgcaggaggaaattgaaaagatacggcccggattcgaagagcaaattttatacctccagaaacaactggacgccacgacagatgagaagaaggaaaccgtgacacagcttcaaaatattatcgaggccaacagccagcactatcagaagaatattaacagtcttcaggaagaactactgcaactgaaagcaatccaccaagaggaagtcaaggaattgatgtgccagatagaagcctctgctaaggaacacgaggcagaaatcaataagctgaacgagttaaaagagaacctagtgaaacagtgcgaggcatccgagaaaaacatccaaaaaaagtatgagtgtgagctggagaaccttagaaaggccacatcaaacgcaaaccaggataaccagatctgctctatcctgctgcaggaaaacactttcgtcgaacaggttgtcaacgagaaggtcaagcacctcgaggatactctaaaggaacttgagagccagcattccattctgaaggacgaggtaacctatatgaacaatctgaaacttaaactggaaatggacgcccagcatattaaggacgagttctttcatgaacgtgaggatcttgagtttaagatcaacgagctgctgcttgcaaaggaagaacagggatgcgtgattgagaagcttaaatcagaattagcagggctcaacaaacaattttgctacaccgtggagcagcacaatcgggaagtacagagtctgaaggaacagcatcaaaaagaaatctctgagttgaatgaaacgtttttatcagattctgagaaagaaaagcttacccttatgttcgaaattcaaggactgaaggagcaatgcgaaaacttgcagcaggaaaagcaggaggcaattctgaactacgagtcgctccgcgagataatggaaatcctgcaaacagagttgggtgaatcggcaggcaagatttcccaagagttcgagtccatgaaacagcagcaggcgagtgacgtgcatgagctccagcagaaactgcgaactgcattcaccgagaaagacgcgttactcgaaactgtgaatcggcttcagggggagaacgaaaaacttctgtctcagcaggagctcgtgccggaactcgagaacaccataaaaaatctgcaagaaaagaatggggtgtatctgttgagtctatcccagcgagataccatgttgaaggagctggagggaaaaatcaactctctgacagaagaaaaggacgactttattaacaagttgaagaactcccatgaggagatggataattttcataagaaatgtgaaagggaggagcgcctcattctcgagctgggcaagaaggtagaacagaccatacaatacaacagtgagctcgagcaaaaagtgaacgagctgactggggggctcgaagagactctgaaggagaaggaccagaacgaccaaaaacttgagaagcttatggtgcagatgaaggtgctatccgaagataaggaagttctctctgccgaagtcaagtcactgtatgaggagaacaacaaactgtctagcgagaagaaacagcttagtcgcgacctggaggtcttcctgagtcagaaagaggatgttatcttaaaagagcatattacacagctggaaaagaagctacagctgatggtggaggaacaggataacctaaacaagctgctggaaaatgaacaggtacagaaactctttgtaaagacccagctgtatggctttctgaaggaaatgggcagcgaagtgtctgaggattctgaggagaaggatgttgttaacgttcttcaggccgtaggggagagcttagccaaaattaatgaagagaagtgcaatttggcattccagagggatgaaaaggtactcgagctggagaaagagattaaatgtttgcaggaagagagtgtggtccagtgtgaggagctgaaatcactgctgagggactatgagcaggaaaaggtcctgcttcgcaaagagcttgaagaaatccagagcgagaaggaagcattgcagagcgatctgttagagatgaagaacgcaaacgagaagaccaggcttgaaaaccaaaatctgttgatccaggttgaggaggtctcacagacttgctcaaagtctgagattcacaatgaaaaagagaagtgttttatcaaggagcacgagaacctgaagcctctgctggaacagaaagaacttagggacaggcgagcagaactgatcctactcaaggactcattggctaaaagtccctcagttaagaatgaccccttaagttccgtaaaagaactggaagagaaaattgagaacctcgaaaaagagtgcaaggagaaggaggaaaagatcaataaaataaaactggtcgctgtcaaagccaagaaagagctcgactcctctagaaaggagacacagacagtgaaagaggagcttgagtccctgaggagcgagaaagatcaactgtcagccagtatgcgggatcttattcagggagccgagagttataagaacctcttgctggaatacgagaagcagtctgaacagctggatgttgaaaaggagcgcgctaataactttgagcaccgcatcgaagacctgacccgccaattacgcaactctaccctgcagtgcgagactataaattcagacaacgaggacctgctcgcaaggattgagacgctacagtcaaacgccaaactcttggaggtgcaaattctggaagttcagcgcgcaaaagccatggtggacaaggagcttgaagctgagaagttgcagaaagaacagaaaattaaggagcacgccactaccgtaaacgaactcgaagaacttcaagtgcagcttcagaaacagaaaaagcagctgcagaagactatgcaggaacttgagctggtcaaaaaagatgcgcagcagaccactctcatgaatatggaaatcgccgactatgaacggctgatgaaagagttgaaccaaaagctgaccaataaaaataacaaaatcgaggatcttgaacaggagatcaagattcagaagcagaaacaggaaacactgcaggaggagatcacaagtctccagtcaagcgtgcaacagtatgaagagaaaaacaccaagatcaagcagctcctcgtgaagacgaagaaggagctggccgactctaaacaggccgagaccgaccatttaatcttgcaggcaagtctaaaaggcgagctggaggcatcccagcagcaagtggaggtttataaaatacaactggccgagattacctctgagaagcacaagattcacgaacacctgaaaacatcagcagaacagcatcagagaaccctgagcgcctatcagcagagagtcaccgccctccaagaggaatgccgcgcagctaaagcagaacaggccactgtgaccagcgagtttgagagttacaaggtcagggtccacaacgtcttgaaacaacaaaaaaataaaagtatgtctcaagctgagactgagggcgccaagcaggagcgtgaacaccttgagatgctaatagatcaactcaagattaagcttcaggactcccagaacaatctgcagattaatgtcagcgaattgcagactctacagagcgagcacgacactttgctagagcggcacaacaaaatgctccaggagacggtgagtaaggaagccgagttgcgggagaaactctgttccatccagagcgagaatatgatgatgaagtccgaacacacccagaccgtctctcagctgaccagccagaacgaggtgctgcgtaattcttttcgtgaccaggtgcggcatctacaggaggaacataggaaaaccgttgaaaccctgcagcagcagcttagcaaaatggaagcccagcttttccagttgaaaaacgaacctaccacacgttctccagtaagtagtcagcagagtctgaagaatcttcgtgagagaaggaacaccgatctcccccttctggacatgcacacagttaccagggaagaaggagagggtatggagaccactgacaccgaatcagtgtccagcgcaagcacttatactcagtcactagaacaactgctgaacagcccagaaactaagctcgagccgcctctgtggcatgccgaattcacgaaggaagaattggtgcagaaactgagctctactacaaaatctgcagaccatttgaacggtctgttgcgagagacagaagcaacaaatgccatactgatggagcagattaaattgctcaagagtgagattcgtagacttgagagaaaccaggagcgagaaaagagtgcagcgaacctggagtatcttaagaacgttctgctgcagttcatctttctgaagcccggtagtgagagagagcgcctcctccctgtcatcaatactatgttacaactctcacccgaggaaaaagggaagctggcagccgttgctcagggggaagaggaaaacgcctccagaagttcaggttgggctagctatctgcactcctggtctggcttgcgttag

SEQ ID NO: 119061 - DNA, 2052 bp, Artificial Sequence
  Description of Artificial Sequence: Synthetic coding sequence
atgtgtcagatcgaggcctccgccaaggaacacgaggctgaaatcaacaagttgaacgaactcaaggagaatcttgtgaagcagtgcgaagccagtgaaaaaaatattcagaagaagtatgagtgtgaactggaaaatttaaggaaagcaacttcaaatgccaatcaggacaaccagatttgctcaatcctgttgcaggagaacaccttcgtcgagcaggtagtaaatgagaaggttaaacatctggaagacacactaaaggaactggaaagtcagcactccatcctgaaagacgaggtcacgtatatgaataacttaaaacttaaattagaaatggacgctcaacacatcaaggacgaattcttccatgagagggaggacttagagttcaaaataaatgagttgttgttggcaaaggaggaacagggttgcgtgattgaaaaacttaaaagtgagcttgccggcctgaataaacagttttgctacactgttgaacagcataaccgcgaagtccagtccctgaaagagcagcaccagaaagagatctccgagctgaacgaaacttttctgtccgattctgagaaggagaagctcactctcatgtttgaaatccagggcctgaaagagcagtgtgaaaacctccagcaggaaaaacaggaggcaatcctcaactatgagagcctgagagagatcatggagatcctgcagactgaacttggagaaagcgccggaaagatctcccaggagttcgagtccatgaagcagcaacaggcctctgacgttcacgagcttcagcagaagttgcggactgcttttaccgagaaggatgcgctgcttgagaccgtgaaccgcctccaaggggaaaacgagaagttgctctcccagcaggagcttgtccccgaactggaaaatacgatcaaaaatttgcaggaaaaaaatggagtgtatcttctgtcccttagccagagagacacgatgttgaaggagctcgaagggaagatcaattctctgaccgaagagaaggatgattttattaataaattaaaaaatagccacgaagagatggataactttcataagaagtgcgagcgcgaggaaagacttattctggagcttggcaagaaggtagaacaaacgatccagtataatagcgagctggaacagaaggtcaatgaactgacaggaggcctggaggagactctcaaagaaaaggatcaaaacgatcagaagttggaaaagttgatggtccagatgaaagtcctttctgaagacaaggaagtcctctccgccgaagtcaaaagtttgtatgaggagacaattaattcagtccagaagaagcaactttctcgagacttggaggtttttctgagtcagaaagaagacgttattctgaaagaacacatcacccaattagagaagaagctacaacttatggtggaagaacaggacaacctcaataaattgttagaaaacgaacaggtacaaaaacttttcgttaaaacacaactctacggcttcctcaaggaaatgggaagtgaggtcagtgaggactcagaggagaaagacgtcgttaatgttttgcaggccgttggggaatcactggcaaaaattaatgaggaaaagtgcaatctggcttttcagagggacgaaaaggtactggaactagagaaggagattaaatgtctccaagaggaaagtgtggtccaatgtgaggagctgaagtctttacttcgtgactacgaacaggagaaggtcctgttgcgtaaagaactggaggagattcagtcagaaaaggaggcactgcaaagcgacctgctggagatgaaaaatgctaacgaaaaaacccggcttgagaaccaaaacctcctgatacaggtggaggaggttagtcaaacatgcagcaagagcgaaatccacaatgaaaaggagaagtgctttattaaggaacacgagaacctgaagcctctcctggaacagaaggagctgcgcgacagacgggctgaactcatcttacttaaggactctttggctaaaagtcctagcaagaagtag

SEQ ID NO: 119062 - DNA, 1347 bp, Artificial Sequence
  Description of Artificial Sequence: Synthetic coding sequence
atggaagatctggtccaagatggcgtggcatcacccgcgactccgggcacagggaagtcaaagctggaaacactgccaaaagaggacctcatcaaatttgcgaagaaacagatgatgctcatccaaaaggcaaagtcgaggtgcactgaattagagaaagaaattgaggagctgcgctctaagccggtcacagaagggaccggtgatataattaaggctctaaccgaacggctggatgcgttacttttggaaaaagcggaaacggagcaacaatgcctgagcttaaagaaagaaaacattaaaatgaaacaggaagtagaggactccgtgactaaaatgggagacgcccataaggagcttgagcagtcccatattaactatgttaaagaaatcgaaaatttgaaaaatgagttaatggccgttcggtctaaatacagcgaggacaaggctaatcttcagaagcagctggaggaggctatgaacacacaactcgaattgtccgaacagctgaaatttcagaataattctgaagacaacgttaagaaattgcaggaggaaatcgagaagataagacctggctttgaggagcaaattttgtatttacagaagcagctggatgccactacggacgagaagaaggaaaccgtgacacagctacagaatatcatcgaagccaactcccagcactaccaaaaaaacattaacagtctgcaggaggagctactccagctcaaggctatccatcaagaggaggtcaaggagctaatgtgtcaaattgaggcgagcgcaaaagagcatgaagctgaaatcaacaagctgaacgagttgaaggaaaatctggtgaagcaatgtgaggcttccgagaagaacatccagaaaaaatacgaatgtgagctcgagaacttacgcaaggccacgtccaacgcgaaccaggacaatcaaatctgctcgattctcctgcaggagaacacctttgtcgagcaggtggttaacgaaaaagtgaaacatctggaggacacactcaaagagctggaatctcaacactcgatcctgaaggatgaggtaacctacatgaataacctgaaactgaaactggagatggacgcccaacatataaaggatgagtttttccatgagagggaagacctcgagtttaagattaacgagctgctacttgctaaagaagagcagggctgcgtaatcgagaaattgaaatctgagctggcaggcctgaacaagcagttttgctacaccgtcgagcaacacaatcgggaggtgcaaagtttgaaagagcagcatcagaaggagataagtgaactaaacgagacgtttctgtctgactcctag

SEQ ID NO: 119063 - DNA, 1878 bp, Artificial Sequence
  Description of Artificial Sequence: Synthetic coding sequence
atggcccaggctctgagtgaagaagaatttcagcgcatgcaggctcagctgttagaactgcgaacaaataactaccagttgagtgatgaactacgcaaaaatggtgtcgagctcactagcctgcggcagaaagtggcttacctggataaggaattttctaaggctcaaaaggccctgagtaagagcaaaaaggcccaggaggtggaggtgctgctctctgagaacgaaatgctgcaagcaaagctccactcccaggaggaagactttagactccagaattccacactcatggcagaattctccaaagaaagatatggaaaagaggctggcaagttctcagccgtcagtgaaggccagggggaccccccagggggtccagctcctactgtcctcgcaccaatgcctctcgccgaggttgagttgaagtgggagatggaaaaggaggagaagaggctgctgtgggagcagctccaggggctcgaatcctcaaagcaagctgaaacgagtcgtttacaggaggaactggcaaagctttcagagaaactgaagaaaaagcaggagtccttctgtcgcctccaaaccgagaaggaaacactgttcaatgactccaggaacaagatagaagaactccagcagcggaaggaggctgaccataaagcccagctggctagaacccagaaactacagcaggagctggaagcagctaatcagagcctggcagaactgagggatcagaggcagggtgagcgcctagaacacgcggccgcgctgagggccctccaggaccaggttagtatacagtcggctgacgcccaagagcaagtggaaggcttgcttgctgaaaacaacgccttgcgaacatcccttgccgcactggagcaaatccagaccgccaaaacacaggagttgaacatgttgagggaacaaactaccggactcgccgcagagcttcaacagcaacaagccgagtacgaagaccttatgggacagaaggacgaccttaatagtcagctgcaggaatcgctgagggcaaactcgcgcttgctggagcagttacaagagatcggtcaggagaaggaacagttgacacaggagcttcaagaagctaggaagagtgcagagaagagaaaagccatgttggacgagctagctatggaaacactgcaagagaagtctcagcacaaggaggaacttggggctgttaggctgaggcatgaaaaagaggtcctaggtgtgagagcaaggtacgagcgcgagcttcgtgagcttcacgaagataaaaagcgtcaggaggaggaactgcgcggccagattcgtgaagaaaaagcaagaacccgcgagctggagacactgcagcagactgtggaagaactacaggcccaggttcattccatggatggtgcgaaggggtggttcgaaagaaggctcaaagaggcagagggcaaggaggaagagctccaggatgtaagagatcagctcgagcaggcacaggaagaacgcgactgccatctgaagacaatcagtagcctaaagcaggaagtgaaggatactgtcgacggacagcgaattctggaaaagaaggggtccgccgcgctgaaagacttgaaacgtcagctccacctggaaagaaaacgcgcagacaaactccaggagcgtctgcaagatattttaactaattctaaatctcggagcggactggaggagctggtgctgtccgagatgaatagcccctccagaacacaaactggagactccagctctatctcctcttttagctacagagagatcctgcgcgaaaaagaatcatccgccgtgcctgctcgggtccgaggcaaggaggaacctacggccccagcgagtctgaaccctaagatttag

SEQ ID NO: 119064 - DNA, 2433 bp, Artificial Sequence
  Description of Artificial Sequence: Synthetic coding sequence
atggcgcaggccctttcggaagaggagttccagagaatgcaggcccaactgcttgaattgcggacaaacaattaccaattatcagatgagctgcgaaaaaatggggtcgagcttacgagtttgcgccagaaggtagcatacctggacaaggagttcagcaaggcgcaaaaggcactgagcaagagcaaaaaggctcaggaggtcgaggtgctgctgtctgagaatgagatgctgcaagccaagcttcactctcaagaggaagactttagactgcagaacagtacacttatggccgagtttagcaaactgtgctcgcagatggaacaactggaacaggagaaccaacagctgaaagaaggggccgcgggagccggagtcgctcaggccggacctctcgtcgacggcgagttgctgcgactgcaggctgagaacacggcacttcagaagaatgttgcggccctccaggagaggtacggaaaggaagccgggaaattctctgcagtgtccgaaggccagggcgacccacccggtgggcctgccccaacggtacttgcccctatgccacttgctgaggtggaacttaagtgggagatggagaaagaggagaaaaggcttctgtgggagcagctccaagggcttgagtctagcaaacaggcagaaactagtagactccaggaagagctggctaaactttctgaaaaattaaaaaagaagcaggaatctttctgtaggcttcagactgaaaaagaaaccttgtttaacgatagtcgaaacaagatcgaagaactgcagcagcggaaagaggctgaccacaaggctcagctggctagaacccagaaactgcagcaggaactcgaggcggccaatcagtccctagcagagctccgggaccagagacagggagagcgactggaacacgccgccgccttacgtgctctgcaggaccagatccagactgccaagactcaggagctgaatatgctgagggagcagaccaccggactggcagccgagctacaacaacagcaggcggaatatgaggatcttatgggccagaaagacgatcttaattctcaattacaggagagcttgcgggctaacagtaggctgctggagcaactccaggagatcgggcaggaaaaagagcagctgactcaggaattgcaggaggccagaaaatccgcggaaaaaagaaaagcgatgctggacgagctcgccatggagacccttcaggagaagtctcaacataaagaagaactcggggccgtacggctacggcacgagaaagaggtgcttggggtgagggccagatacgagcgggagctgcgcgagctgcatgaagacaagaagagacaagaggaggagctgcgaggacagataagggaggaaaaagcccgaacgagagagcttgagacgcttcaacaaaccgtggaggagttgcaggcccaagttcattcaatggatggtgccaaaggctggttcgagcggagactgaaagaagctgaagagagcttgcagcaacagcagcaggagcaagaggaggcgctcaagcaatgccgtgaacagcatgcggcagagctaaagggcaaggaagaagaactgcaggacgttcgggatcagctggagcaggcccaggaagagcgtgattgccatttaaaaacgataagctcactcaagcaggaggtcaaagatacagttgacggccaaaggatacttgaaaagaaaggaagcgccgccctgaaagacttgaaaagacagctacatctggaaagaaaacgggccgataagttacaagagcggctacaggacatcctgacgaattcaaagtccagatcaggcctcgaggaactggtgctgagcgaaatgaatagcccttctcgcactcaaaccggcgattcgtcaagcatcagttcattttcctaccgggaaatcttacgagagaaggaatcgtcagccgtgcctgcgaggtccctctcttcatctccccaagctcaaccaccacgacctgccgagctgtcagacgaagaggttgccgaactgttccagagactcgctgagacgcaacaggagaagtggatgctggaggagaaagtaaagcacctcgaggtgtcctccgcaagcatggcagaggacttgtgccgcaagagcgccataattgagacatacgttatggactccaggattgatgtcagcgtggctgcggggcacactgacagaagcggactgggcagcgtgcttagagatctagtcaagcccggcgatgagaatctgcgcgaaatgaacaaaaagctgcagaacatgctggaggaacagctgacgaagaacatgcacctgcacaaagatatggaggttctatctcaggaaattgtacggctgtcaaaagaatgtgtaggaccaccagatcctgacctggagcctggggaaacctcctag

SEQ ID NO: 119065 - DNA, 2526 bp, Artificial Sequence
  Description of Artificial Sequence: Synthetic coding sequence
atggcgcaggcgttgtccgaggaagagtttcaacgcatgcaggcccagctgttggaattacgcaccaataactaccaacttagcgacgagctcagaaagaacggggtagagctgacttctctacggcagaaggtggcttatctggacaaagagtttagcaaagcccaaaaggcgctgtcaaagagcaaaaaagctcaggaagtggaggttctcctgtccgagaacgaaatgctgcaggccaaactgcacagccaggaagaagactttcgattacagaattcaactctgatggcagagttcagcaagctgtgttctcagatggaacagttggaacaggaaaaccagcagctcaaggagggtgccgccggggccggtgtcgcccaggcaggacctctggtggatggagagcttctgcgtctgcaggcagagaacactgctttgcaaaagaatgttgccgccctgcaagagagatacggcaaagaagccggcaagttttctgccgtgagcgaggggcagggtgaccctcccggaggtcccgcccctacagtcctcgcccccatgcccctagcagaagtggaattgaaatgggagatggagaaagaagaaaagaggctgctgtgggagcagttgcaggggttggaaagtagcaaacaggcagagacctccaggcttcaggaggaactggctaagctgtctgaaaagctgaaaaagaagcaggagagtttctgcagattgcagactgagaaggagactctgttcaatgactccagaaacaagattgaagaacttcagcagagaaaggaggccgaccacaaggcccaactggccagaactcagaagttgcagcaggaactggaggcagcaaaccaaagtcttgccgagctccgggaccagcggcagggggaaagactcgagcacgccgctgctttacgagcactccaagaccaagtctcgattcagtctgctgatgcccaggaacaagttgagggactgctagctgagaataatgccctccggactagcctggccgcactcgagcagattcagacagccaaaacccaggaactaaatatgcttcgcgagcaaactacaggcctggcagctgaattgcaacagcagcaggccgagtatgaagatctaatgggccagaaagacgatctcaactcacagcttcaggaaagtcttagagctaactcgcgccttctggagcagctccaggagatcgggcaggaaaaagaacagcttacccaggaactgcaggaggcacgtaagtccgctgagaagagaaaggctatgctcgatgagctagcaatggagaccctgcaggagaagtctcagcacaaagaagaactgggcgccgttagattgcgacatgaaaaggaagtgctgggcgtgcgggcgcgttacgaacgcgagttacgcgagctccacgaggacaaaaagcgtcaggaagaagaactgagaggccagattcgggaagagaaggcccggacccgcgagctagagactctgcagcagactgtggaagagctgcaggcgcaggtccattccatggacggggccaagggctggtttgagaggaggctgaaagaggccgaagagtcccttcagcagcagcagcaggaacaggaggaggccctcaaacagtgtagagaacagcacgcagcagaacttaaggggaaagaggaagagcttcaggacgtcagggatcagctagagcaggctcaggaggagagggattgccatttgaaaacgatctcgagtctcaagcaggaggtgaaggatacggtggacggccaaagaatcctggagaaaaaaggaagcgccgctttaaaagatttgaaacgtcagctccacctggaaagaaagagggcagacaaattgcaggagaggctgcaggatatactgacgaactctaaatctcgcagtggactggaagagctggtcctatctgaaatgaattctccatcccgtacccaaactggtgactcgagctcaatttctagcttttcttatagggaaatcctcagagagaaggagagcagcgccgtcccggcccggtccctgtctagctctccccaggctcaaccgccccgtcctgctgagctgtctgacgaagaagtcgccgagttattccagcggctggccgaaacacagcaggagaagtggatgttggaagaaaaggtgaaacacctagaggtgtccagtgcaagcatggctgaagacctctgtcgcaagtcggcaattattgagacgtatgttatggattctcgtatcgacgtcagcgttgcggccggacacactgacaggtccgggcttggatccgtcctccgagatttagtgaagcccggagacgagaatcttagagagatgaataaaaaactccagaacatgcttgaagaacagctgacaaaaaacatgcatctgcacaaagacatggaagtactgagtcaagagatcgttagactcagcaaggagtgcgtcggcccccctgatccggatttggaacccggagaaacatcatag

SEQ ID NO: 119066 - DNA, 2391 bp, Artificial Sequence
  Description of Artificial Sequence: Synthetic coding sequence
atggctcaggctctatccgaggaagagttccaaagaatgcaagcacagctccttgagctgaggactaataactatcagctcagcgacgagctcagaaaaaacggcgttgaactcacatccctgagacagaaggtggcctatctcgataaagaattttctaaggcccagaagctctgctcccagatggagcagctggagcaggagaatcaacagttaaaagagggcgctgctggggccggcgtggcacaggccgggcccctcgtggacggcgagctgctgagactgcaagctgagaatacagctttacagaagaatgtagccgcgcttcaagaaagatacggcaaagaggccggtaagttttctgcagttagcgagggtcagggagaccctcctggtggcccggctcccacagtgctcgctcctatgcctctggcagaagtggagcttaagtgggagatggaaaaagaagaaaagagactcctttgggaacagcttcagggacttgagagctcaaagcaagcagaaaccagccggctgcaagaggaattagctaagttgtccgaaaagctcaagaagaaacaggaaagcttctgtcggctccagacagagaaagagacactgttcaacgattccaggaacaaaattgaggagctgcagcagcggaaggaggccgatcacaaggctcagctggctagaacgcagaagctgcagcaggaactggaagcggcgaatcagtccttggccgagctgagggatcagagacaaggtgaacggctggaacacgcagccgctctgagagctctgcaggaccaagtgtccattcaatcagctgatgcccaggagcaggtcgagggtctgttagctgagaataacgcccttcggacctcccttgccgcactcgagcaaatccaaaccgcaaagacgcaggagttaaacatgctccgagagcagacaaccgggctggccgctgaactgcaacagcaacaggctgagtatgaagacctcatgggccagaaggatgacctcaactctcagctccaggagtctctgagggccaatagccgcttgctcgagcagctacaggaaatcgggcaagaaaaagagcagctaacgcaggaactgcaggaggcgaggaaaagcgcagaaaagaggaaggctatgttagacgaacttgccatggagacgttacaagaaaaatctcagcacaaggaggagttaggggcagtgaggttaagacacgagaaagaggtcttaggtgttcgggcccgttatgagcgggagctgcgtgaactgcacgaggacaagaagcggcaggaggaggagctacgcggccagatccgggaggaaaaagccagaacaagagaactcgaaacactgcagcaaaccgtagaggagctgcaagcccaggtgcactccatggatggcgcaaaaggatggtttgagcgcaggctgaaggaggctgaggaatcactgcaacagcaacagcaggaacaagaagaagccttgaaacagtgtagggaacaacacgcggccgaactgaaaggtaaagaggaggagcttcaggacgtgcgggatcagttggagcaagcacaggaagagcgagactgtcacttaaaaactatatcctccctaaagcaggaggtgaaagatacagtggatggacaacgaattctagagaagaaagggagcgctgcactgaaagatctgaaaaggcaattgcatctcgagcgaaagagagcggacaaactgcaggagaggttgcaggatatcctgaccaatagcaagtctaggagtggactggaagagctggtgttgtccgagatgaatagcccatcaaggacccaaaccggggacagttccagcattagcagcttcagctaccgcgagattctcagggaaaaggagtcatcggccgtgcccgcacggtcattaagtagtagcccacaggcacagccccccagacccgctgagctgtcggatgaggaggtcgctgagctgttccaaagactagccgaaacacagcaggagaagtggatgttggaagagaaagtcaagcacctagaggtgagctctgcttctatggcggaggatttgtgccgaaagtctgccatcatagagacatatgtgatggatagccggatcgacgtgtcagtggccgcgggacacaccgatcggagcgggctgggatctgtactgagagacctagttaagcccggagatgagaatcttcgggagatgaataagaaactccaaaatatgctggaggaacagttgacaaagaacatgcacttgcataaggatatggaagtgctatcacaggagatagttagactgtctaaagagtgcgtgggcccaccagatcctgaccttgaacctggcgagacaagttag

SEQ ID NO: 119067 - DNA, 2433 bp, Artificial Sequence
  Description of Artificial Sequence: Synthetic coding sequence
atggcccaagcactgtccgaggaagaatttcaaaggatgcaggcccagctcctcgagctgcgaaccaataattaccagttgagtgacgaactgcggaagaatggggtggagctcacctcgctgagacagaaggtcgcttatctagacaaagagttctcgaaggcccagaaaagccctggcccctgtctgccactacaggaggtagaagtgttactgtctgagaacgaaatgctgcaggccaaattgcacagccaggaggaagattttcggttgcagaattcaaccctgatggccgagttctctaagctgtgttcccaaatggaacaactcgagcaggaaaatcagcaactcaaggagggtgctgctggagctggagtggcgcaggccgggcccctggtagacggtgagctcttaaggttacaggcagagaatactgcactacagaaaaatgttgcggcgctccaggaacgctacggaaaggaggctgggaagtttagcgcagtctcggagggccagggagacccccccggcggcccagcaccgactgttctggccccgatgcccctggccgaagtcgagctgaaatgggaaatggaaaaggaggaaaaacgccttctctgggagcagctacagggactcgagagctctaaacaggccgaaacctctcgactccaagaggagctggccaagctcagtgaaaagctcaaaaaaaagcaggaatcgttttgtagactgcagacagaaaaagagacgctctttaacgatagtaggaacaagatcgaagaactacagcaaaggaaagaagcagatcacaaggcacaactggcaaggactcaaaagctccagcaggagctggaggctgcaaaccagagcttggccgagctcagagatcaacgccaaggcgaaagactcgaacatgccgctgcactaagagccttgcaggaccagatacagactgccaaaactcaggaattgaacatgcttcgtgagcaaaccactgggctggccgctgagcttcagcagcaacaagctgagtatgaagaccttatgggacaaaaggatgacctgaacagccagctgcaggaaagtctgcgcgctaactccagactgctggaacagctccaagagatcggccaggagaaggagcagttgacccaggaattgcaggaagcccgcaaatcagccgagaagaggaaagccatgctagacgagctggcaatggagacactgcaggagaagagccagcataaggaggaacttggggctgtgaggttgcgccatgagaaagaagtgctaggggtgcgcgctcgatacgagcgagagctccgagagcttcacgaagataaaaagaggcaggaggaagagttaagaggacaaattcgcgaagagaaggccagaaccagagaactcgaaaccttacagcagaccgtcgaggagctgcaggctcaggtgcacagcatggacggtgccaagggctggttcgaacggcgtctgaaggaggctgaggaatccttgcagcagcagcagcaggagcaagaagaagccctaaagcagtgtcgggagcaacacgccgctgagctgaagggcaaggaagaggagttacaggacgtccgggatcaactggaacaggcccaggaggagcgggactgccatcttaagaccatttcttcattgaagcaagaggttaaagataccgtggatggacagcggatcttggaaaagaagggcagcgccgccctcaaggacctgaagcgacagctgcacctggagaggaaacgcgcagataaactgcaggaaagacttcaggatattttaactaactcaaaaagtcgtagcggacttgaggagctagtcctgagtgaaatgaactccccttctagaacacagacaggggattccagttcaattagcagtttctcatatcgtgaaattctgagggaaaaggagtcctcggctgtgcctgccagatcgctctccagctcaccgcaggcccagccgcctcgccccgctgaattgtctgatgaggaagtagccgagctcttccagcgcctcgctgaaacacagcaggagaagtggatgctcgaggagaaggttaagcacctggaagtgtcaagcgcaagcatggcagaagacctgtgtagaaagtccgccattattgagacatacgtgatggatagccggattgatgttagcgttgccgctggtcatacagatcgttccggactgggctctgtgctgcgcgacctagttaaacccggggacgagaatctaagagaaatgaataaaaaactgcagaacatgctggaggaacaactgacgaaaaacatgcacttgcacaaggatatggaggtgctcagccaggagattgtgaggctctctaaagaatgtgttggtccacccgaccctgacctagaacctggcgaaacaagctag

SEQ ID NO: 119068 - DNA, 1425 bp, Artificial Sequence
  Description of Artificial Sequence: Synthetic coding sequence
atgaaacgggtgctggtcctattgctggcagtcgcttttggacatgcgttagaaagaggcagagactatgagaaaaataaagtctgcaaggaattttcccacctgggtaaggaggattttacctcactctctttagttttgtactctagaaagtttcccagtggcacttttgagcaagtgtcccagctcgtgaaagaagtggttagcctgacagaggcatgttgcgcagagggggctgacccagactgctacgacacccgcactagcgcgttgtccgcaaaatcttgtgaatccaactctcccttcccagtccatcccggaacggcggaatgttgtaccaaagaagggctggagagaaaactctgcatggctgcactcaaacaccagccccaggagtttcccacgtacgtggaaccaaccaatgatgagatctgtgaagccttccggaaggaccccaaggagtatgcaaatcaatttatgtgggagtacagcaccaattacggccaagcaccattgtcacttctcgtgagctacaccaagtcttacctgagcatggtggggagctgctgcacctccgcctcccccaccgtctgcttcctcaaagaacgccttcagctgaagcatctctccttgctcacaacactcagcaaccgggtttgttcccagtacgccgcttatggcgaaaagaaaagcaggctcagcaatctgatcaagttggctcagaaggtgcccaccgcggacctagaggacgtgctacctctggctgaagacattacaaacatattgagtaagtgttgtgagagcgctagcgaggactgcatggccaaagagttacccgagcacacagtgaagttgtgcgataaccttagcacaaaaaactctaagttcgaagactgctgtcaagagaagaccgcaatggacgtattcgtctgcacatacttcatgcctgcagcccagttaccagaactgccagatgttgaattacctacgaataaggatgtgtgcgatcccgggaacaccaaggtcatggataagtatactttcgaactctccagaagaacccatctcccagaggtttttttgtcgaaggtgctggagcccactttgaagtctttgggcgaatgttgcgatgtagaggactccacaacttgtttcaatgcgaagggaccattgctgaagaaggaactgtcttcattcattgataaagggcaggagctgtgcgctgattactcagagaatacatttaccgagtacaaaaagaagctggccgagcggttaaaggccaaattgccggatgccactccaaccgagctagccaaactcgtgaataaacatagcgatttcgcaagtaattgttgctcgattaattctccccctctgtattgtgacagcgagatcgacgcagagctgaaaaacattctctag

SEQ ID NO: 119069 - DNA, 438 bp, Artificial Sequence
  Description of Artificial Sequence: Synthetic coding sequence
atgaaaagagtcttggtgctgcttttggccgtcgcatttggacatgcactcgagaggggccgagattacgagaagaacaaagtgtgcaaggagttcagccacctcggcaaggaggattttacaagtttgagcttagtcctgtactcacggaaattcccctctgggacctttgagcaagtgtcccagctggttaaagaagtcgtgtccctgacagaggcctgttgcgccgaaggagccgatccggactgctacgatacaaggacatctgctctgtccgctaagagctgtgagagtaactccccatttcccgtgcatccagggaccgccgaatgctgcactaaagagggcctggaaaggaagctgtgcatggccgccttgaaacaccagccgcaagagttccctacgtacgtggagcctactaacgatgaaatctgctag

SEQ ID NO: 119070 - DNA, 1482 bp, Artificial Sequence
  Description of Artificial Sequence: Synthetic coding sequence
atgctgtggtcctggtccgaggagagaggcggcgctgcacgtctcagcggccgaaaaatgaagagagtgttggtactcttgcttgccgtggcgttcggacatgctttggaacgagggagagactacgagaagaacaaggtatgcaaggaatttagccatctggggaaggaggactttacctccctgagtctcgtactgtacagcaggaagttcccatctggaacattcgagcaggtctcacagctggtgaaagaggtagtgtcgctgaccgaggcctgctgtgccgagggagccgatcctgattgttatgacactcgtaccagtgctctgtccgcgaaaagctgtgaaagcaattccccttttcccgttcacccgggtacagcagagtgctgcacaaaggagggcctggaaagaaagctgtgcatggcggctctaaaacatcagccacaggagttccccacttatgtagagccaacaaatgacgaaatctgtgaggcattcaggaaagaccctaaagagtacgcaaaccagtttatgtgggagtactctactaactacggtcaagccccgttatcacttcttgtgagctacaccaaaagttacttgtccatggtggggagctgctgcactagtgccagtccaactgtttgttttttaaaagagaggttacaactaaagcacctttctctcctgaccactcttagcaatagggtatgctcacagtacgctgcttatggggagaagaagtctagattgagtaacctgatcaagttggcacagaaggtgcccacagctgatctcgaggatgtccttccgctggccgaggatatcacaaatattctgagcaaatgctgtgaatccgcctccgaggattgcatggctaaggagttgcccgagcacacggtaaagctgtgtgacaacctctccacaaaaaactccaagttcgaagactgctgtcaggaaaagaccgctatggacgtgttcgtgtgtacctactttatgcccgccgctcaactacccgaacttcccgacgtggagctccctaccaacaaagatgtgtgtgatccaggaaataccaaggttatggataaatacacttttgagctttccagacgaacacacctgcctgaggtgttcctgtccaaggtcctcgagcccaccctcaagagcctgggggaatgctgtgacgtcgaagatagcacaacgtgcttcaacgccaaaggccctttgctgaaaaaggagctgtcatcattcattgataaagggcaagagctgtgtgcggattatagcgaaaatacgttcacggagtacaaaaaaaaactggccgaacgattaaaggcgaaactccccgatgcgacccctacagaactggctaaactggttaacaaacacagtgactttgccagtaactgctgctctataaactccccccccctttattgtgattcagagatcgatgcagagttaaaaaatatcttgtag

SEQ ID NO: 119071 - DNA, 669 bp, Artificial Sequence
  Description of Artificial Sequence: Synthetic coding sequence
atggctgcatccgttaggcaggcacggtctctgctcggggtagccgctacgctggccccggggtccaggggttatagagcacggccgcctcccagaagaagacccggcccacggtggccagatcccgaggatctgctgacaccccggtggcaactgggcccccgctacgccgcgaaacagtttgcacgctatggagctgcctccggcgtcgtcccgggctccctgtggccatctccagagcagctgcgggagttagaggctgaagagcgtgagtggtatcctagcctggccactatgcaggagagcttgcgcgttaagcagcttgccgaagagcagaagcgaagagagcgggaacagcacattgcagagtgcatggccaaaatgccacaaatgatcgttaactggcagcagcagcaacgggaaaattgggagaaagctcaagcagataaggaacggcgggcacggctgcaggccgaggcccaggagctgttaggataccaagtcgatccccgatctgctaggttccaggagctgctgcaggacctagagaaaaaggaacgtaaacggcttaaagaagagaaacagaagagaaaaaaagaagcccgagcagcagccctggccgccgccgtagcacaggatcccgcggcttctggggcgccatctagctag

SEQ ID NO: 119072 - DNA, 1038 bp, Artificial Sequence
  Description of Artificial Sequence: Synthetic coding sequence
atggtcgcggccctgctgggcgggggaggagaagcgagaggaggcactgtacctggggcgtggctttgtctgatggctcttcttcagctgcttggcagcgctccccgcggaagtggcctggcgcacgggcgacgcctgatctgctggcaagccctcctgcagtgtcagggggaacccgaatgctcctacgcatacaaccaatatgctgaggcctgtgcgccagtgctggcccaacacgggggaggtgacgctcccggtgctgctgctgccgcattccctgccagtgctgcttcgtttagctcacgctggcgctgcccctcccattgcattagtgccttgattcagctgaaccacacccggaggggcccagctcttgaagattgcgactgtgctcaggatgaaaattgtaagtccactaagcgggccattgaaccttgtctacctcggacttccggtgggggggctgggggacctggcgccgggggggtaatgggttgtaccgaagcccggaggcggtgcgacagggattcaaggtgtaacctggccttaagcaggtacttaacatattgtggtaaggtgtttaacggcctgaggtgtacagacgaatgtcgcaccgtgatagaagacatgcttgcaatgccgaaagctgccctgttaaatgattgcgtgtgtgatgggctcgaaaggcctatctgtgaatcagtcaaggaaaatatggcaagactttgtttcggagccgaactgggcaatggtcccgggtccagcggctctgacggcggtctggacgactactacgatgaggactatgatgatgaacagagaactggcggagccggaggtgagcagcctctggatgatgacgacggggtgccccatccaccgagaccagggagcggggctgccgcgtccgggggaaggggagatctaccatacggccctggcaggagaagttcaggcggaggaggaagactggctccgagaggtgcctggacacccctggcaagcatactactgctcctgctgggacccttgttctag

SEQ ID NO: 119073 - DNA, 942 bp, Artificial Sequence
  Description of Artificial Sequence: Synthetic coding sequence
atgtgtactgctctcagccctaaggtgcgctccggccctggactcagcgacatgcatcagtatagccagtggttagctagtcgccatgaggctaacctcctgcctatgaaagaggacctggctctatggctaacgaatctgctcgggaaagaaattactgcggagaccttcatggaaaaacttgacaatggagcactgctgtgccaactggccgaaactatgcaggaaaagttcaaggagagcatggacgctaataagcccaccaagaacctgccactcaaaaagattccctgcaaaactagtgccccctccgggagttttttcgcaagagacaacaccgctaacttccttagttggtgtagagacttgggggtggatgaaacctgcctcttcgagtcagaaggcctcgtcctgcataaacagcctcgcgaggtctgcctgtgtctcctggagctgggacgtatagcagcccgctacggggtggagcctcccggacttatcaagctggagaaggagatcgagcaagaggagaccctgtcagcgcccagcccatctccctcccctagcagcaaatcatctggtaaaaagtcgacaggtaatctcctggacgatgctgtaaaacgtatctccgaggaccctccttgtaaatgccccaataaattttgcgtggagaggctgagtcagggacgttaccgggtcggtgaaaagatcctcttcattaggatgctccacaacaaacatgtgatggtgagagtgggagggggctgggagacatttgccggctatctcttaaaacacgatccttgcagaatgctgcagattagccgggtcgatggcaagacctcacctatccagagcaagtcccctaccttgaaggacatgaatccagacaactaccttgtggtgtccgccagctacaaggccaaaaaggaaatcaaatag

SEQ ID NO: 119074 - DNA, 942 bp, Artificial Sequence
  Description of Artificial Sequence: Synthetic coding sequence
atgtgcacagcgctctcaccaaaggtcagatccgggccaggactgtcagatatgcaccaatatagccagtggctagcctcgagacacgaggcaaatttgctgccaatgaaggaggatctggccctgtggcttacgaacctcctggggaaggagatcacagctgagacctttatggagaagctcgacaacggggccctgctgtgccagctggcagagacaatgcaagagaaattcaaagagtctatggatgctaacaaaccgacaaagaatctccctctgaagaagatcccatgtaaaacttctgcacccagcggatcattctttgcaagggacaacacagcaaactttttgtcatggtgtagggacttgggcgtcgacgaaacttgtctgttcgagagcgagggactggtcctgcataagcagcccagagaagtgtgcctgtgcctacttgagctgggccgcatcgccgcgcgttacggcgtggaacccccaggtctgattaaacttgaaaaagagatagaacaggaggaaactttgtctgcccccagcccatctccctccccttctagcaagagctctgggaaaaaatcgactgggaatctgctcgatgacgcagttaaacggatatctgaagatccaccctgtaaatgccccaacaaattctgcgtggagaggttatcacaaggccggtatagagtaggggagaagatcctttttatccgcatgctccacaacaaacatgtcatggtgcgcgtggggggcggatgggagacttttgcggggtatctgctcaaacacgatccctgccgcatgctgcagatatctcgggtagatggcaagacatctccaatccaaagcaaaagcccaaccctcaaagatatgaacccggacaactacctggtggtgtccgcctcctataaggctaaaaaggagataaagtag

SEQ ID NO: 119075 - DNA, 942 bp, Artificial Sequence
  Description of Artificial Sequence: Synthetic coding sequence
atgtgcactgctctgtccccaaaggtgagatcaggccccggcctgtcggacatgcatcagtactctcaatggctggcctctaggcatgaggccaacctactccccatgaaagaggatctggctctctggctgacaaatctgctggggaaagagatcaccgccgagacattcatggagaagctggacaatggtgcacttttatgtcaattagcagaaacaatgcaggagaaattcaaggagagtatggatgctaataagcccactaagaacctgccactcaagaaaattccctgtaagacctcggccccttccgggtctttttttgcgcgagataacacagctaatttcctgtcttggtgccgtgacctgggagtggatgagacatgcttgttcgaatctgaaggattagtcttgcacaaacagcctagagaggtatgcctgtgccttctcgagcttggtcgcatcgccgccagatacggggtggaacccccaggccttataaaactcgagaaagaaatcgagcaagaagagactttatccgccccttcccccagccctagtccaagctccaagagttccggcaagaaatccacaggcaatctcctggatgacgccgtaaaaaggatctcggaagacccgccttgtaagtgtcctaataagttttgtgtggagaggctttcccaagggagatatcgagtaggagagaagatcttgtttatccgtatgctccataacaaacatgtcatggtccgggttggtggtgggtgggaaaccttcgctggctatctgttgaaacacgatccctgccgcatgctgcagatcagcagagtcgacggcaagacttcacctattcagtcgaaatcccctactctcaaggacatgaaccccgacaactatcttgtcgtcagtgcctcttataaagcaaaaaaggagattaagtag

SEQ ID NO: 119076 - DNA, 546 bp, Artificial Sequence
  Description of Artificial Sequence: Synthetic coding sequence
atgtgcacagccttgtcgcctaaagtaagaagcgggcccgggttgtccgatatgcatcaatactcacaatggctggcttcccgtcacgaggccaatctgctccccatgaaggaagatctggccctatggctgaccaatctcctcggcaaggaaattactgccgagactttcatggagaagctggataacggcgccctgctttgccagctcgcagagactatgcaggaaaagtttaaggagtccatggacgccaataagccgactaaaaatctgccactcaagaagattccttgtaagacaagcgccccatctggatctttcttcgcccgggataacacagccaactttctgagctggtgtcgtgatctcggcgtcgacgaaacttgccttttcgaaagcgagggcctcgtgctgcataaacagcctagggaggtgtgcctctgtctacttgagctggggcgtatagccgcaaggtacggcgtggagccccccggcctgattaaactagaaaaggagatcgaacaggaagagaccctttctgcctag

SEQ ID NO: 119077 - DNA, 618 bp, Artificial Sequence
  Description of Artificial Sequence: Synthetic coding sequence
atgtgcacagcactgtcacctaaggtgcgcagtggcccaggtctctcggacatgcaccagtattcacagtggctggcaagtagacatgaggccaatctgctgcccatgaaggaggacttagccttatggcttactaacctcctgggcaaggagattacagccgaaacctttatggagaagcttgacaatggtgccctgctgtgccagctggccgaaaccatgcaggagaagttcaaagagtcaatggatgctaacaaacctaccaagaaccttcccctcaagaagatcccatgtaaaacctctgccccatccggaagtttcttcgctagagacaacaccgctaattttctcagctggtgcagagatctaggagtcgacgaaacatgtttgtttgaatcagagggtctcgtactgcataagcagccccgagaggtgtgcttgtgcctgctggagctggggcgcatagccgcgaggtacggcgttgaaccacctgggctcatcaaactggaaaaagagatagaacaggaggaaaccctcagtgctccctccccaagccctagtcccagcagtaagagctctgggaagaaaagtaccggcaatttactagacgatgcatag

SEQ ID NO: 119078 - DNA, 411 bp, Artificial Sequence
  Description of Artificial Sequence: Synthetic coding sequence
atgtgtacagcgttaagtcccaaagtccgcagtgggcccggactaagcgacatgcaccagtattcccagtggctggcctcacgccacgaagcaaacctgttgcctatgaaggaggacttagccctgtggctcactaacctgttgggcaaagagatcaccgctgagacatttatggaaaagctggacaacggagccctgctctgtcagctcgccgaaaccatgcaagaaaagttcaaggagagcatggacgcgaacaagcccactaagaatctgcccttaaagaaaatcccttgtaagacttcagcaccgtctgggagtttttttgcccgcgacaacacagcaaactttttatcctggtgccgcgatctgggagtggatgagacatgcttgtttgagagtgaaggcttatag

SEQ ID NO: 119079 - DNA, 468 bp, Artificial Sequence
  Description of Artificial Sequence: Synthetic coding sequence
atgtgtacagctttgtcccctaaggtgaggagcggccctgggctgagcgatatgcatcaatacagccagtggctagctagcaggcacgaggcaaacttactacctatgaaggaggacctggccctatggcttacaaacttactgggcaaggagatcaccgcagaaacttttatggaaaagctcgataacggcgctctcctatgtcagctcgcagagacaatgcaggagaaattcaaagaatcaatggatgcgaacaagcccaccaagaacttgccactgaagaagatcccctgtaagacctctgcgccttctggatcctttttcgctagggacaacaccgcaaacttcttgtcatggtgccgtgatctcggggtcgacgagacctgtctgtttgagtctgagggtctggtgctccacaaacagccacgggaagtgtgtctgtgcctgctcgagttgggacgaatctag

SEQ ID NO: 119080 - DNA, 2043 bp, Artificial Sequence
  Description of Artificial Sequence: Synthetic coding sequence
atggctgatcccgtggcaggaatcgccggatccgccgcaaagtctgttcggcccttcagaagttccgaggcatatgtcgaagcaatgaaggaggacctggcagagtggttgaatgcactatatggcctcgggttgcctgggggtggcgatggatttctgaccggcttggctacaggtacaaccttgtgccagcacgctaacgcagtcactgaggcagcgagagccttggctgctgcccgccctgctaggggtgtcgccttccaggctcattccgtcgtgcctggatcctttatggccagagataatgtggccaccttcattgggtggtgccgcgtggaactaggcgtgcccgaggtcctcatgtttgagactgaagatctggtgctgcgcaaaaacgagaagagcgtcgtactgtgcctcttggaagtggcacggcgcggtgcccgcctgggcctgctcgcccctagacttgtacagttcgagcaggagatcgagagggaattacgcgccgcccccccagctcccaatgccccggcggccggcgaggacactactgagacagctccggcccctggcacccccgctagagggccacggatgactccatcagacctcaggaacctcgacgagctggtgagagaaattctcggacgatgcacctgcccggaccagtttcccatgatcaaggtgagcgagggtaagtatagggtgggtgacagcagcctcctgattttcgtgcgcgtgcttcggtcccatgtgatggtccgtgtgggcggtggttgggatacactggagcactatttggacaagcacgacccatgccggtgctcttcaactgcacataggccgccacagcctagagtctgcacgtttagcccccagcgagtgagccctactacttctccccgccccgctagtcccgtgcctggcagcgaaagacgcgggagcagaccggagatgacccctgtctcgcttcgcagcacaaaagagggtcccgagacgccacctcggccgagagatcagttacctccccacccgaggtcacggaggtatagcggagattcggacagcagcgcgagcagcgcgcaatcaggtcctctcggcacacggagcgatgataccggcacagggccacgccgtgagcgccctagtcggcgcctaaccactggcaccccagcctctccacgtcggccaccgctaaggagccagagtcgcgataggctggatagaggccgcccaagaggcgcacctggaggtagaggggctcagcttagtgttccatctcctgcaaggcgtgctagaagccagtcaagggaagaacaagctgtcctcctcgtaagaagggatcgcgatggtcaacatagctgggtgcctaggggacgtggaagcggagggagcgggagaagcactccccagactccccgggcccggagtccagcggctccacgactcagcagggtctcctccccaagtcccgagctgggcacaactcccgctagcatctttaggactcctctgcagctagacccccagcaggaacagcagctcttccggagattagaagaggagtttctggccaatgcacgcgctttggaagcagtcgcttctgtgacacccacaggccccgccccggacccagcccgggcccctgacccacccgcacctgacagtgcctattgcagttcatcatctagctcctcttctctttccgtgctcgggggcaaatgcggacagcctggcgacagcggacggactgcgaacggtctgcctgggcccagaagtcaggcgcttagtagttcctccgacgagggcagcccgtgcccaggtatgggaggtcccctcgacgcccccggatcccccctggcttgcacagaacccagccggacttgggcgagaggccgtatggacacccagcccgataggaagcctagtagaatccctacccccagaggccccaggagacccagcgggcctgctgaacttggcacctggcacgctcttcactccgtcactcctagagcggagcccgattcttggatgtag

SEQ ID NO: 119081 - DNA, 1014 bp, Artificial Sequence
  Description of Artificial Sequence: Synthetic coding sequence
atggccgacccagttgccgggattgctgggtctgccgctaagagcgtccgcccatttcggtcgtctgaggcatatgtggaggcgatgaaagaggatttagctgagtggctcaacgcgctctatgggctgggtctgcccggaggtggggacggtttcctgacaggcctcgccacaggtacgacactgtgccagcatgcaaatgcagtgacagaggccgctcgggctctagcggcagcacgcccagcccgtggcgtcgccttccaggctcatagcgtcgtccctggctcatttatggctagagacaacgtcgccacgtttattgggtggtgtagggtggagcttggtgtgcccgaggtcctaatgttcgagactgaagatctggtgctgcgcaagaacgaaaaatccgtagtgctatgtctcctggaggtagcacgcagaggcgcccgtctgggccttctcgccccacgcctggtgcagtttgagcaagaaatcgaacgtgaactccgggcggccccgcctgctcctaacgctcccgctgcaggcgaggacaccactgaaactgctccagccccgggaacacccgcccgcggacccagaatgactccctcagacttgcgaaacctggacgagctggttagggaaatcttgggacgctgcacctgccccgaccaattcccgatgattaaagtgtccgagggcaaataccgtgtaggagacagttccctcctgatcttcgtccgcgtcctcaggtcccacgtcatggtgcgagtaggcggtggctgggacacattagagcactacctggataagcacgatccctgcaggtgcagctcaactgcacacaggcctcctcagccccgcgtctgcaccttcagcccccagcgtgtgtcgcccactacctcgccgcgtcccgcatcacccgtccccggctccgaaagaagaggaagtaggccggagatgacgcccgtctcgctgagatccactaaggagggccccgagacccctcctagatag

SEQ ID NO: 119082 - DNA, 990 bp, Artificial Sequence
  Description of Artificial Sequence: Synthetic coding sequence
atggctgaccctgttgctggaattgccgggtcagctgccaagtctgtcagacccttccggtctagcgaggcatacgttgaagcaatgaaagaggacctggccgagtggctgaatgctttgtatggcctgggtctgcccggtggcggtgacggttttctaactggattggcaactggaaccaccctctgccagcatgccaatgccgtgactgaggctgcacgggcgttagcagcagcccgaccggctcggggcgtggcctttcaagcacactccgtcgtgcccggctctttcatggccagagacaacgtggcaaccttcatcggctggtgtcgggtggagttgggagtgcccgaggtccttatgtttgaaactgaagacctggtactcagaaagaatgagaagagcgtggtgctctgtctgctggaagtggcccgccggggagcccgtctcgggcttctcgcacctcgactggtccaattcgaacaggaaatcgagcgggaacttcgcgcagcaccacctgctccgaatgcccccgctgctggggaggacactactgaaaccgccccggcacctggcacccccgctcggggcccccgcatgacacctagcgatctgaggaatttggatgagctggttagggaaatccttggccggtgtacctgtccggaccagttccctatgattaaagtctccgagggcaaatatagggtaggcgatagctccctattgatatttgtgagggtactacgctcacacgtgatggttcgggtgggcgggggatgggacacactcgagcattacttagacaagcatgacccctgccgctgctcttcaactggccccggcatttcttgtcctccgatacctgctccggcagccaccccgggcacggttactccccagcccccacctccccgtgccgccccgctggtgcctgcagtgatgactcaggcccttgcgccaggtggatccgaccctgcagggggctag

SEQ ID NO: 119083 - DNA, 1614 bp, Artificial Sequence
  Description of Artificial Sequence: Synthetic coding sequence
atggctgaccccgtggccgggatcgctggctctgccgccaaatctgtaagaccctttcgtagttctgaagcctacgtggaggccatgaaagaagacctagctgagtggcttaatgccctctacggactgggattgcctggagggggggacggttttcttacaggccttgccaccgggacaaccctgtgtcagcacgcaaacgctgtcactgaggccgcacgggccctagcagctgcacgtcccgctcggggggtggcctttcaagctcattccgtggtacccgggtccttcatggcccgtgataacgttgccaccttcattggatggtgcagggtcgaattgggcgtgcctgaggttctgatgtttgagaccgaggatctggtgttaaggaagaacgaaaaatcagtggttctctgcctgctggaggtcgccaggagaggcgcccgcctgggactactggccccacgactggtgcagtttgaacaagagatcgagcgagagctgagggccgccccgcctgccccaaacgccccagctgccggggaagatacgactgagaccgcccccgcccctggtacccccgcccggggccccagaatgaccccgagcgatttgagaaacctcgacgagttggtgcgcgagatccttggtcgttgtacgtgcccagatcagtttcctatgattaaagtttccgagggaaagtacagggtgggggactctagtctattaatcttcgtgcgcgtgcttaggtctcacgtgatggtccgagtgggtggtggttgggataccctagagcactaccttgataaacacgatccatgcagatgtagtagcactgcccacagacccccacagcctagggtttgcacctttagcccacagcgcgtttctcctactacatcaccccgccctgcctccccagtgccaggttcagaaagacggggatcacgccccgagatgacaccagtctccctgaggagcacgaaggaagggccggaaactcctcccagacctcgagatcaactgcccccccacccgcgctcaagacggtatagtggggactctgactcctctgcctcctcggctcagtccggccctctggggacccgctccgatgacacaggaaccggaccgaggcgagagaggccctcccggcgtcttacgactggtacccccgcctctccgagaaggcccccagcctgcgccgcgtctccggagacaggctggatcgctgctgggcctggcggacctcaggaggccggagagccctcatgcagatctccagcactcccagggggacccggtgcccgggcggctagatctaggctatgttgtttatgtgctggaatcgagacaggtagcacccacggctgtcaaggtgcaggggccgtgggcgctcgagccggggccccacctcggctccctgtaccggcagcactccagcatccaggatttcctggcagcccagctcccgtgcagagttgggcacctcaccgcccagcgagctccgctcatccctgctcctccactaggtcccgatcctcatcgtgttccggcgcttggaaaaggtcaagctggccaatgcccgggccactgaggctgctactggcatag

SEQ ID NO: 119084 - DNA, 1614 bp, Artificial Sequence
  Description of Artificial Sequence: Synthetic coding sequence
atggccgatcctgtggctgggatcgccggaagcgccgcaaaaagcgtaaggccttttagaagcagtgaggcttacgtggaggccatgaaagaagacctcgctgagtggttgaacgccctgtacggactgggcctccctggcgggggggacggattcttgactgggcttgcgaccggaacaaccctgtgtcagcatgccaatgccgtgactgaggctgcgagagccttggcagcagctagacccgcccgaggcgtggccttccaggcgcacagcgtcgtgcctggtagctttatggcaagagataacgtcgcaacatttatcggatggtgccgcgtggagcttggcgttcctgaggtgctcatgttcgagacggaggatttggtcctccggaaaaacgagaaatccgtcgttctctgcctgttggaggtggcaaggagaggcgctaggctgggtctcctggcaccaaggcttgtgcagtttgagcaggagatcgagagggagctgcgcgccgcaccacctgcccccaacgcccccgccgcaggggaggataccaccgaaaccgctccagcccctggaacgcccgctcgcgggcctaggatgacaccgtctgacctgaggaacctggatgagctggtgcgggagattttgggccgatgtacatgtcctgaccagttccctatgatcaaggtcagtgaaggcaagtacagagtgggcgacagctcactcctgatttttgtaagggtcctgcggtcacatgtgatggtgagagtgggcgggggttgggatacgctggaacattacctggacaagcacgacccttgcaggtgcagttctacagctcatcgcccaccccagccaagagtctgcacatttagtcctcaacgcgtttctcccacgactagtccacgacctgcctcccctgtccccggctctgagcgtcgcggttcccggccggaaatgactcccgtgtcactccgcagcaccaaagagggaccagagacccctcctcgacctagagatcagttgccgccccatccaagatctagacggtatagcggagactccgattcatcagcctcttccgcgcagtcaggccccctcggcacccggagcgatgatacagggacaggacccagacgggaacgccccagcaggagattaaccacaggtacaccggcctcgcctaggcggccacctgcttgtgctgcgagccccgagacaggctggattgcggccggtccaggaggccctcaggaggctggggagccatcctgccggtccccagccttgcccgggggacccggggctagagccgcgcggtcacgcctgtgctgcctgtgcgcaggcatcgaaacaggctcgacccacggatgtcagggagccggcgccgtgggcgcccgagccggtgcccctccaaggctccctgtgcccgctgcccttcagcatcccgggtttcccgggagtccggccccggtgcagagctgggctccccatcgtccagcatcttcggcacacccttgttcctcgactcgttcaaggtccagctcatgcagcggcgcctggaagcggagcagttggcccatgcctggacctctccgcctgttgcttgcttag

SEQ ID NO: 119085 - DNA, 1614 bp, Artificial Sequence
  Description of Artificial Sequence: Synthetic coding sequence
atggcagatcctgttgcaggtattgctggcagcgcagcaaagtccgtgaggccattccggagctccgaagcatacgtggaggctatgaaggaggaccttgcagagtggttgaatgcactatatggacttggactccccggcggcggcgatggcttcttgacgggtctcgccacagggactaccctgtgtcagcacgctaatgcggtaacagaggccgcaagggcactcgccgcggcgcgccccgcaagaggcgtggcatttcaggcccactccgtggtcccaggtagtttcatggctcgtgataacgtggccaccttcatcggttggtgtcgggtggagctgggagtaccagaggtgctgatgttcgagactgaagacctcgtcctcaggaaaaacgagaagagtgtcgtgttatgcttgttggaggttgcacgccgtggagcaaggttgggcctgctcgctccaagactggtccagttcgagcaagagatcgaacgggaactgcgcgccgctcccccagcccctaacgctcctgcagctggggaggataccaccgagactgcgcctgctccaggaactccagcccggggccccagaatgacacctagtgatctgcgaaacctagatgagttagtgcgtgaaattctggggaggtgtacatgtccagaccagttccccatgataaaagtctcagagggcaaatatcgggttggcgacagctcacttctgattttcgttcgagttttgcggtcacacgtcatggtgagggttgggggtgggtgggatactctggaacactatctcgacaaacacgacccgtgcaggtgctcttctactgctcacaggccaccccagccaagagtctgcacttttagcccacagagagtttccccaactaccagtcccaggccagctagcccggtacctggatctgagcggcggggaagtcgacccgagatgacacctgtgtccctgcggtccaccaaggaagggcctgagactcccccccgcccgcgggatcagctcccccctcatcccaggtcccggcgctacagcggcgatagtgattcaagcgcatcatcagcccagagcgggcctctgggcacccgtagcgatgatacgggtactggccctagacgggagaggcccagtcggcggctgacaactgggactcccgccagcccgcgacggcctccggcttgcgcagccagtcctgaaactggatggatcgcagccggacccggaggaccccaggaagcaggtgagccttcttgccggagtccagccctgcccggtggccccggtgccagagctgcgagaagtagactgtgctgcctctgtgccggcattgagacaggaagtacacacgggtgtcagggcgccggggcggtgggggctcgcgccggggccccaccccgccttcccgtaccagctgcattgcagcatccaggattccctggctcaccagcccccgtccagagttgggcaccccatcgtcccgccagcagcgcccacccctgcagcagtacgcgcagcagaagctcgtcatgttctggtgcttggaagcgctcgtcttggccgatgcccggacccctgcgactcctgctcgcctag

SEQ ID NO: 119086 - DNA, 417 bp, Artificial Sequence
  Description of Artificial Sequence: Synthetic coding sequence
atggcagaccccgtggccggcatcgcgggctccgcagcaaaatccgtgcggccctttagaagttccgaggcgtacgtagaggccatgaaggaggatctggcagaatggctgaacgccctgtatgggcttggtctgcccggaggaggggacgggtttctcacagggctcgcgacaggcacaaccctctgccagcacgccaacgctgttacagaggctgcacgagccttggccgctgcccgccctgccagaggcgtggctttccaggctcattcagtggttcctgggagtttcatggcaagagataacgtcgcgacttttatcggatggtgtcgtgtagagctaggcgtgcctgaggtcctgatgttcgagactgaggatctcgtgcttcgcaaaaatgagaaaagcgttgttctgtag

SEQ ID NO: 119087 - DNA, 432 bp, Artificial Sequence
  Description of Artificial Sequence: Synthetic coding sequence
atggctgaccctgttgcagggatagctgggagcgctgctaaatcagtaagaccctttcgcagctcagaggcctacgtggaagctatgaaggaggacctcgctgagtggctaaacgccttatatggattgggactgcccggagggggagatggctttttgactgggttggctactggaaccactttatgccagcacgcaaatgcagttaccgaggctgctcgagctctggctgccgcccgacccgctagaggcgtggctttccaggctcattctgtggtgcctgggtcatttatggcacgggacaatgtggctacatttattggttggtgccgcgtggagctcggcgtcccagaagttctgatgttcgagaccgaagaccttgttctgcgcaaaaatgaaaagagtgtagtgctgtgtctgttggaagtttag

SEQ ID NO: 119088 - DNA, 1614 bp, Artificial Sequence
  Description of Artificial Sequence: Synthetic coding sequence
atggccgacccggtggcgggaatagcgggctccgcagctaagtctgtgagaccatttcgttcctccgaagcctatgttgaggcaatgaaggaggatttggcggagtggcttaacgccctgtatggattgggcctgcccgggggcggggatggcttcttgaccgggctggcaacaggtacaactctgtgccaacacgccaacgccgtcaccgaagcagctcgagcactggctgcggctagacccgcccgcggggttgccttccaggcccacagcgtggtgcccggtagtttcatggctagggacaacgtggccaccttcatcggatggtgtagggtggagctcggcgttcctgaggtgctgatgttcgagaccgaggacctggtgttgagaaaaaatgaaaagtccgtggtgctgtgccttctagaggtcgcacggaggggagcaagattgggcctgttggctccacgcttggtacagttcgagcaggagattgagagagagctgagagctgccccacctgcccccaatgccccagcggccggggaggatacgacagaaaccgcacccgctcccgggacaccagcccgggggccgcgcatgacgccatccgacttacggaatctggatgagttggttagagaaatcctgggaaggtgcacgtgccctgaccagttccctatgatcaaggtttctgagggcaagtaccgggtcggagattctagcctgctcatattcgtgagggtgctaagaagccatgtgatggtcagagtcggaggtgggtgggatacgttggagcactacctggataaacacgatccctgcaggtgcagttctacagctcatcggccccctcagcctcgcgtctgcaccttctccccacaacgggtttcacctaccacttcaccgcggccagcctctccggtgccagggtccgagcggaggggctctcggccagagatgacacctgtctctttgcgcagcaccaaagaaggccctgaaactcctccccgcccacgggatcaactgccaccgcaccctcgaagccgaagatattctggcgattcagactcctccgccagttcagcacaatctggcccgctgggaaccaggagtgatgatacgggaaccggaccacgtcgagaaagaccaagcaggcggctcaccaccggcacgcccgcaagccccaggaggccgccagcatgtgccgcctcaccggagacaggctggattgccgcgggtcctggtgggcctcaggaggccggggaaccgtcctgtagatcacctgcccttcctggcggccccggagcaagggccgcccggtccaggctgtgctgtctgtgtgcagggatcgaaactggatcaacgcatgggtgccagggtgctggtgcagtgggagcccgggcgggagctcctccgcggcttccagtgcccgcagccctgcagcatccagggttccccgggtcccccgctcctgtccaaagctgggcgcctcatcggcccgcgagttcagcccatccttgctcatctaccagatcacggagcagcagttgttctggagcatggaagcgttccagctggcctatgcctggtcccctgcggctgctactcgcttag

SEQ ID NO: 119089 - DNA, 2037 bp, Artificial Sequence
  Description of Artificial Sequence: Synthetic coding sequence
atggccccaagtctgagtccgggaccagctgcgctgagaagggccccccagctcttgcttcttctgttggcagcagaatgcgcgctcgccgcactgctgcctgctagagaggccacacaattcctgaggccgaggcagcggagggccttccaggtgttcgaagaagctaagcaagggcacttggaacgagagtgtgtcgaggaactttgcagcagggaggaggctcgagaggtgtttgaaaacgaccccgagaccgattatttctaccctaggtatctcgattgcattaataagtacgggtccccttatacaaaaaacagtggttttgccacttgtgtgcaaaacctgcctgaccagtgtacacccaatccatgtgaccgcaaggggactcaggcgtgccaggatttgatggggaactttttctgtttatgcaaggctggttggggaggacggttatgtgacaaggatgtgaacgagtgctctcaggagaatggggggtgcctgcaaatttgccataacaagcccgggtcatttcattgttcttgtcactccggcttcgagctgagtagcgatggacggacatgccaggatattgacgaatgtgctgactcagaggcctgtggtgaagctcgctgtaagaatttgccgggatcctactcttgtctgtgtgatgaaggcttcgcctactcaagccaggaaaaagcatgcagggatgtcgatgagtgcctgcagggtcgctgtgaacaggtgtgtgtgaatagtcccggatcttacacctgtcattgcgacggacgagggggtcttaagctgtcccaggacatggacacttgtgaagatatacttccatgcgtgcctttctccgtcgccaaaagcgtgaaaagcttgtatttgggccggatgttctccggaacccccgttattaggctgcggttcaaacggctgcagccaacccggttggtggcagagtttgacttcaggacatttgacccagagggcattctgctttttgcagggggccaccaggactccacatggattgttctcgccttgagagccggtaggttagaactgcagttgcggtataatggagtggggcgcgtgacatcgtctgggcctgtgatcaatcacggaatgtggcagaccatctctgtagaggagctcgctagaaacttagtgataaaagtaaaccgggatgcggtgatgaaaatcgcagttgcaggtgacctgtttcagcctgaaaggggcctgtatcatctcaacctgaccgtgggagggatccccttccacgaaaaagacttggtacagcccatcaacccacggctcgatggctgtatgcgttcctggaattggctgaacggagaagatactactatacaggaaactgttaaggtgaacacgcggatgcagtgttttagtgtgactgagaggggatctttctatcctgggtctggcttcgcgttttatagtctcgactatatgcgcacgccactggacgttggaaccgaatcaacgtgggaagtggaagttgtagcgcatatacggccagcggccgatacaggtgtcttattcgcgttatgggccccggacttgagagccgttcctctgagcgtggcgctggtggattaccattccactaaaaagctcaaaaagcaattagtagtcctggcagtggaacatacggctctagcactgatggagattaaagtctgcgacggacaggagcacgttgttactgtctccctgagagacggtgaagcaactttggaagtggacgggacgcgtggccagtccgaagtgtcagccgcccagctgcaggagagactggccgtactggagcgccacctgcgttcgccagtacttaccttcgccgggggactcccggatgtgcctgtgacaagtgctcctgtgacagccttctatagagggtgcatgacactggaagtaaaccgtcgtctgctggatctcgacgaagctgcctataagcactcagatattactgcccattcatgccctcccgtggaaccagccgcagcctag

SEQ ID NO: 119090 - DNA, 1875 bp, Artificial Sequence
  Description of Artificial Sequence: Synthetic coding sequence
atgtgcatgtgccaagcctctccccccccagccgccttggctggatgtctcctgtctagctgcgtgcaacccgctagggagcatgggggcgccttctcaaaggcggagtggttaagtaattgtattaacaagtacggctcgccttacacgaagaattccgggtttgccacatgcgtgcagaatttgccagatcagtgcaccccgaacccgtgtgataggaagggaacccaggcatgccaggatttaatgggaaactttttctgtctctgtaaggcgggctgggggggacggctttgcgataaggatgtgaatgaatgcagccaagagaacggaggctgccttcagatttgccacaataagccgggtagcttccactgttcctgtcattcgggtttcgaactcagttccgatgggcgcacttgccaagacatcgatgaatgtgcagacagtgaggcctgcggagaggcacgttgcaagaatttgcctggctcttacagctgcctgtgcgatgaaggctttgcctactcctcccaggagaaggcatgcagggacgtggatgagtgcctgcagggacgctgtgaacaggtctgtgtgaactcccccggcagctatacatgccactgcgatgggaggggtggcctgaaattgtcccaggacatggacacgtgtgaagacatcctcccatgcgtgccatttagtgtggccaaaagtgtaaaaagcctatacttgggcaggatgttctccgggacacccgtgattcgactaagatttaaacggttgcaaccaacccgattggtggccgaattcgattttaggaccttcgatccagagggaatattgctcttcgcagggggccatcaggacagtacatggatagtgctcgctctgagggctggacgattagagctacagttgagatacaacggtgtgggtagggtgaccagctccggccctgtgattaatcatggcatgtggcagaccatttcagtggaagagctcgctcgaaatctggtgatcaaagttaaccgtgatgccgtcatgaagattgctgtggccggggatctgttccagcccgaaagaggactgtaccatctgaacctcacagtggggggaatcccctttcacgaaaaagacctggtgcagcctattaaccctcgcctggatggctgcatgcggagttggaattggcttaacggggaggataccacgatccaggaaaccgtcaaagtcaacaccaggatgcagtgcttttccgtgacagaacgtggttcgttctatccgggttcgggctttgccttttatagcctagactatatgaggaccccactggatgtgggcacggagtcaacctgggaagtggaagtagtggctcatattcgcccagcagccgatactggcgtactttttgctctatgggctcccgatctgcgagctgttccactgagcgtggccctggtcgattatcactcgacaaaaaaactgaaaaaacagctggttgtcctcgctgttgagcacactgcccttgccctcatggagataaaggtctgtgacggccaggagcacgtggtgacagtgtctctgagagatggcgaagccactctggaggtcgacggaactagaggacagagcgaggtatcagctgcccagttacaggaacggctagctgtcctggagcgacacttacgttcgccggtcttaaccttcgctgggggccttcccgatgtacccgttacctctgcgccagtcactgcattttatagaggttgtatgacccttgaagtcaatcggcgacttttggatctcgatgaggccgcatataagcactccgacataaccgctcactcatgcccacctgttgaacctgccgctgcctag

SEQ ID NO: 119091 - DNA, 2166 bp, Artificial Sequence
  Description of Artificial Sequence: Synthetic coding sequence
atggccccttcgctgagccccggcccagccgccttaaggcgcgccccacagttactgctgctgcttctcgcagcagagtgcgccttggccgcactgttgcctgcaagggaggcaacccaattccttagacctagacagcgaagagctttccaagttttcgaagaagccaaacagggccatttagaaagggagtgtgtggaggaactttgtagtagggaggaagcacgggaagtgtttgaaaatgaccccgaaactgattatttttaccctaggtatcttgattgtatcaacaagtatggatctccctatactaagaatagcggttttgctacttgcgtgcagaacctgccagaccagtgcacgcctaacccttgtgacagaaaaggtactcaggcatgccaggatttaatgggcaattttttctgtctctgcaaggcaggctggggcgggagactctgcgataaagacgtgaacgagtgcagtcaggagaacggtggctgcttgcagatatgtcacaacaagccagggtccttccattgttcctgccatagtgggttcgagctatctagcgacggcagaacatgccaggatattgatgagtgtgccgattctgaggcctgtggggaggcccgttgcaagaacctgcccggaagctacagctgcctgtgcgacgaagggtttgcctatagctcccaagagaaggcatgcagggatgtggatgagtgcttacagggtcgctgcgaacaagtgtgcgtcaatagccccggatcatacacctgtcactgtgacgggcgcggggggctaaagttgagtcaggacatggatacttgcgagctggaggcggggtggccacttccgcggcaccgacgtgacagtgggcctgccgccaggcctggccgcggggcacagggttcacggtcagaaggtcacatccccgataggagaggccccagaccatggcaggacatcctcccatgtgtcccctttagcgtggccaaaagtgtgaagtccctgtatttgggccgaatgttctcaggcacccctgtgatacggctgagattcaaaagacttcaaccaactagactggtggccgaatttgacttcaggacttttgatccagaggggattctgctgttcgccggcggtcaccaagacagtacttggatcgtgttggccttgcgggctgggcgtctcgagctccagcttcgatataatggtgtcggccgcgttaccagctcaggccctgtcatcaatcacggcatgtggcagaccatcagtgtggaggagctggctcgtaatctggtcatcaaggtgaatcgagacgctgtaatgaagatagcggttgctggcgacctgtttcagccagaaaggggcctctaccacctgaatcttacggtcggcggcatcccctttcatgagaaagacctagttcagcctattaaccctcgactggacggatgcatgaggagttggaattggctgaacggcgaggataccactatccaggaaacagtgaaggtaaatacacggatgcagtgcttttcggtcacagagagaggatcattctatccaggctcagggtttgccttctattcattagactatatgagaactccactggatgtgggaaccgaaagtacgtgggaggtggaagtcgtggcgcacattaggcccgccgcagacactggagtgcttttcgcgttgtgggctcctgatcttagagctgtgcccctctccgtggctctggttgattaccattcgaccaaaaagctgaaaaaacaactggtcgttctggccgttgaacacactgccctcgccctgatggagataaaggtgtgtgacgggcaagagcatgtggtgacggtgtccctgagagatggtgaggcaaccttagaggtggatgggacccgcggccagtccgaggtgagtgctgctcaactgcaagaacgtctggccgtccttgagcgccaccttaggtcccctgtactgactttcgctgggggtcttcctgatgtgccagtcacttcagcacccgtaaccgccttctatagagggtgcatgacgcttgaagttaacagacggttacttgatctggatgaagccgcctataagcacagcgatattactgcgcacagttgcccacccgttgaacctgccgctgcttag

SEQ ID NO: 119092 - DNA, 1140 bp, Artificial Sequence
  Description of Artificial Sequence: Synthetic coding sequence
atgttctccggtacccctgtcatccggcttagattcaagcggttacagcccactcgactagtggcagagtttgattttagaaccttcgaccccgaggggatactgcttttcgccgggggtcatcaggactcaacttggattgtacttgctctgcgggccggacgactggaactacagttgcggtacaatggagtcgggagggttactagctcgggcccagttattaatcacggaatgtggcaaactatcagcgtcgaggagcttgccaggaacttggtcattaaagtgaatagggacgccgtgatgaagattgccgtggcgggtgacctttttcagcctgaaaggggcctctaccacctgaacttaacagttggaggtatacctttccatgagaaagatctcgtccaacccataaacccccggctggatgggtgtatgagatcctggaattggctaaatggagaagatacgacaatccaggaaacagttaaggtgaataccaggatgcagtgctttagcgtcactgagagagggagtttctatcccggaagtggcttcgctttttattccctagactatatgagaacccccttagatgtgggaaccgagagtacctgggaggttgaggtggtagcacacatccggccggccgctgacacaggcgtgttattcgcgttgtgggcccctgacctgagggcggttccactgagtgttgcactggtcgactatcactccactaagaaattaaaaaaacaacttgtcgttttagctgttgaacacacagcacttgcactcatggagattaaggtctgcgacgggcaggaacacgtggtaaccgtatccctgagagacggggaggccactttagaagtggacgggacaagaggccaatctgaagtctccgcagctcagttgcaggagcgcctggcagtgctcgaacgtcacctgcgaagccccgtgctgaccttcgcaggcggccttcctgatgtacctgttacctctgcccccgtcacggctttttatagaggatgcatgactctcgaggtgaatagacgcctcctggatctagacgaagcagcttacaaacatagcgatattacagcacacagttgccccccagtggagccagccgctgcctag

SEQ ID NO: 119093 - DNA, 1218 bp, Artificial Sequence
  Description of Artificial Sequence: Synthetic coding sequence
atggacacttgcgaggacatccttccttgtgtgccatttagtgtggccaagagtgtgaagagcctgtacctggggcgtatgttcagcgggactcctgtaatccgcctgagattcaagaggcttcaacctactcgactggtggctgagttcgattttagaacgttcgatcctgaaggcatcctacttttcgccggcgggcatcaggattctacatggatcgtcctagctctccgggcaggccgccttgagcttcaacttcgatacaacggagttggtcgggtgacgagtagtggacctgtaatcaatcatggcatgtggcagacgatttccgttgaagagctggcacgtaatctggtcatcaaggtcaatagggacgccgtcatgaaaatcgccgtcgccggagatctatttcagcccgaacggggactttaccatttgaacttaacagtaggtgggattccatttcatgagaaagatctggttcagccaattaaccctaggctggatggctgcatgcggtcttggaactggcttaatggggaggatacaaccattcaagagactgttaaggtaaacacgcgaatgcagtgtttttccgtgactgagcggggttccttttatccagggtccggatttgccttctactctcttgactacatgaggacccccttagacgtggggacggaaagcacgtgggaagtggaagtagtcgcccatattcggccagccgcggacactggagtcttatttgcactctgggcaccggaccttcgcgccgtccctctcagtgtagctctggtggattaccattctacaaaaaagcttaagaagcagctcgtggtccttgcagtcgagcacactgccctagctcttatggaaataaaggtctgcgatgggcaggagcacgtcgttaccgtgagccttagggacggcgaggcaactctagaagtagacggcactagagggcagtctgaggtatctgccgcacagcttcaggagcgccttgcagtgttggagcggcatctccgcagccctgtgctcacttttgctggtggcctccccgacgttccagtaacctctgccccagtcacggcattttacagggggtgcatgacacttgaggtgaaccgccgcttactcgacctggatgaggccgcgtataaacactccgatatcaccgctcattcatgtcccccggtggaacctgccgcagcttag

SEQ ID NO: 119094 - DNA, 1431 bp, Artificial Sequence
  Description of Artificial Sequence: Synthetic coding sequence
atgagcggcgcccgctgtagaacactgtaccctttcagcggggagaggcacggccaggggctacggttcgccgccggagagcttatcaccttgctgcaggttcctgacggagggtggtgggagggggaaaaagaggacgggctacgtggatggttccccgctagctacgtacagctgctcgagaagcccggaatggttccgccccctcctggagaagaaagccagaccgtgatacttcctcccggatggcagagttatttgtctccgcaggggcggaggtattacgtcaataccactacaaacgagaccacttgggagcgaccttctagcagtccaggcataccagcctcacctggcagtcatcgcagtagcctgccccctactgtgaatggttaccatgctagcggcactccggcccaccccccggaaactgcccacatgagcgtgaggaagtccacaggagattcgcaaaacttagggagcagcagtccctccaaaaaacagtccaaagagaacaccatcacaatcaattgcgtgacatttccccatcccgacacaatgccagagcagcagctgcttaagcccacggaatggagctattgcgattacttttgggcagacaagaaggacccccagggaaatggaactgttgccgggtttgagcttctgctgcagaaacagctcaagggcaagcagatgcaaaaggaaatgtctgagttcatcagggaacgcattaaaatagaggaagattatgctaagaacctggcaaagctgtcacagaatagccttgcttcacaagaggaaggatcgttgggagaggcgtgggcacaagttaaaaagagtttggcggatgaagcggaagtccacctgaaattctctgctaaactccattccgaggttgagaaaccactgatgaacttcagggagaacttcaagaaggatatgaagaagtgtgaccaccatattgccgacctgaggaagcagcttgccagccgctacgctagcgtggaaaaagcgcgtaaagctctgaccgaacgccagcgcgaccttgagatgaaaacacagcagctcgagatcaagctgtcaaataaaactgaagaagacataaaaaaggcccggcggaagtctacccaagctggagacgacttgatgaggtgcgtggatctgtacaaccaggcacagtctaaatggtttgaggagatggtcactaccacccttgaactggaacgattggaggtggaaagggtcgagatgatccgtcaacatttgtgccagtacacccagctccggcatgagacagacatgtttaaccagagcactgtcgagccggtggaccaactactccgcaaggtggacccagcaaaggatcgcgagttgtgggtgcgcgaacataaaacgggtaacattcggcctgtggatatggaaatctag

SEQ ID NO: 119095 - DNA, 1251 bp, Artificial Sequence
  Description of Artificial Sequence: Synthetic coding sequence
atgaagccaggcatggtgcccccgcccccaggagaggaaagccagactgtgatccttccccctggttggcaatcctacttgtcgcctcaaggacgcaggtattatgttaataccacgaccaacgagactacctgggaacgcccctcctctagcccaggaatccccgcttcacctggatcacaccgctcatccctgccgcccaccgtcaacggataccatgccagcggcacccccgcacatccacccgagacggcccacatgagtgtgaggaaatctaccggggatagccagaatcttggatcttctagtccctcaaagaagcagtccaaggaaaacacaattactatcaactgtgttacctttccccatcccgatactatgcctgaacaacagctgctcaagcccacagaatggagttattgcgattacttttgggcagataaaaaggaccctcagggaaacggaacggtggccggctttgaactgttgctgcaaaagcagttgaaaggcaagcaaatgcagaaagaaatgtctgaattcattcgagagaggatcaagattgaagaagactatgcaaagaatctggccaagctgagtcagaattccctggccagccaagaggagggcagcctgggcgaggcctgggcccaggtcaagaaatctctcgcagacgaggcagaagtccatttgaagttctcagcgaaactgcacagcgaggtcgaaaaacctctaatgaattttcgcgagaatttcaaaaaagacatgaagaagtgcgaccaccatatcgccgacctacggaaacagctcgccagcaggtacgcctccgtggaaaaggcacggaaagcgcttaccgagagacaaagggacctggaaatgaaaacccagcaattagaaatcaagctgtccaacaaaacggaagaagatatcaagaaagctcgccggaaaagtactcaggccggagacgatctcatgcgctgcgtggacctgtataatcaagcccagagcaaatggttcgaggagatggtgacaaccacgctcgagcttgaaaggttggaagtggaaagagtggagatgattaggcagcatctgtgtcagtacactcagcttaggcacgaaacagacatgttcaatcagagcacagtcgagcctgttgatcagctgcttcggaaagtggatcctgctaaggacagagagctctgggttcgggagcataagacaggcaacatccgaccagtcgatatggaaatctag

SEQ ID NO: 119096 - DNA, 1011 bp, Artificial Sequence
  Description of Artificial Sequence: Synthetic coding sequence
atgtccaatatggagaattcgtttgacgatgtgtcatgccttagcccacagaacctgggctcctcatcgccctctaagaagcaaagcaaagagaacacaatcactatcaattgtgtgacattcccccatccagacacgatgccagagcagcagctactgaaacccacagagtggtcttattgcgattacttttgggcggacaaaaaggatccccagggcaatggaacagtggcaggcttcgagctgctgcttcaaaagcagcttaaaggaaaacagatgcagaaggagatgtccgagtttattagagagaggatcaaaattgaagaagactacgccaagaatctggccaagctctcacagaactctctcgccagccaggaggaaggaagcctaggagaggcgtgggcgcaagtgaaaaagtccctggccgacgaagccgaagtgcacctgaaattctcagctaagctgcatagcgaagtggagaaacctctgatgaacttccgggaaaattttaaaaaggacatgaagaaatgtgaccatcatattgcagacctgcgcaagcagctggccagcaggtacgcatccgttgagaaagcgaggaaggccctgacagaacgacaaagagacctcgaaatgaagacccaacagctggagatcaaacttagcaacaaaacagaggaggacatcaagaaagcacgccgcaaaagcactcaagccggcgatgacttgatgaggtgcgtggatctatataaccaggcgcagtctaaatggttcgaagagatggtaacaaccacactagaactcgagaggctggaggtagagagagtcgagatgatccggcagcacctttgtcagtatacacaactgagacatgagacagatatgtttaatcagtccaccgtggaacctgtcgatcaactcttacggaaagtcgacccggcaaaagatagggaactttgggttcgggagcacaaaaccgggaatattaggccagtggacatggagatctag

SEQ ID NO: 119097 - DNA, 1248 bp, Artificial Sequence
  Description of Artificial Sequence: Synthetic coding sequence
aagcccggcatggtgccccctccacctggggaggaatcacagactgtgatcttgcctccaggatggcagtcctacctaagtcctcagggccgccgctactacgttaataccacaaccaacgaaaccacttgggaacggccgtcctccagcccgggcatccctgcgtctcccggcagccacaggagttcactgcctccaacagttaacgggtaccacgcatctggtacacccgcccaccctcccgagaccgcgcacatgagtgtgcgcaagtccacaggcgactcccagaatctgggctctagcagccccagtaaaaagcagtctaaggaaaacacaattaccatcaattgcgtcaccttcccccacccggataccatgcccgaacagcagctgctcaagccgacggagtggagctattgtgattacttttgggctgataaaaaagatccccagggcaacggcacagtcgccggttttgagctcttgctacagaagcagctgaaggggaaacagatgcagaaggagatgagcgaattcattcgagaaagaataaaaatagaagaggactacgccaagaatctcgccaagttgagccagaacagtcttgcatctcaagaggaggggtcacttggcgaggcctgggcccaggtgaagaagtctttggcagatgaagccgaagtgcatctgaagttcagcgctaagcttcattcggaagttgagaagcccttgatgaattttagagaaaatttcaaaaaagacatgaaaaaatgcgatcaccatattgctgacctgcgcaagcaattggcttctagatatgcctctgtggagaaggcaaggaaggccttaaccgagcgccagagagatcttgaaatgaagacccaacagctggaaattaagctcagcaacaaaaccgaagaagatataaagaaagcccgcaggaaaagcactcaggccggcgacgacctgatgaggtgcgtggacctctataatcaggcccagagcaagtggtttgaagaaatggtcacaacaacactggagctggagaggcttgaagttgaacgcgttgagatgattcgccagcacctatgccagtacacccagctgagacacgaaacggatatgtttaaccaaagcactgtcgagcctgtagatcagctccttaggaaggtcgaccctgcaaaggatcgggagctgtgggtgagggaacataagacagggaacatacggcctgtggacatggagatctag

SEQ ID NO: 119098 - DNA, 1251 bp, Artificial Sequence
  Description of Artificial Sequence: Synthetic coding sequence
atgaagcctgggatggtgccaccaccacctggagaggagagccagaccgtgattctgccccccggttggcagtcatatttgtcaccgcaaggacgtagatactacgtgaatacaacaaccaacgaaacaacttgggaacgaccttccagcagtccggggataccggcctctcccgggagccatcggagctccctgcctcctacagtgaacggctaccacgctagcgggaccccagcccacccacccgaaaccgcccatatgtctgtaagaaagagcactggtgactcacagaaccttggaagctcaagtcccagtaagaagcagtcaaaagagaataccattactattaactgcgtaacctttccacatcccgatacgatgcccgaacagcagctgttgaaacccactgagtggagttattgtgattacttctgggccgataaaaaggatccccaggggaatggtactgtggcaggattcgagctcctcctgcaaaagcagttgaaagggaagcagatgcaaaaagagatgagcgaatttatacgtgagaggatcaagattgaagaagattacgccaaaaaccttgcaaagttgtctcagaactccctagcgagccaggaggagggcagcctcggcgaggcctgggctcaagtcaaaaagtcgttggccgacgaggcagaagttcacctcaaattctctgctaaactgcattccgaggtggagaaacccctgatgaactttagagagaatttcaagaaagatatgaagaaatgcgaccaccatatcgccgacctcaggaaacagctggcttctagatacgcttctgttgagaaggcccgaaaagccctgacagaaagacagagagaccttgagatgaagacacagcagcttgagattaagctgagcaacaagaccgaggaggacattaaaaaagcaaggcgaaagagcacacaggctggagacgatttgatgagatgcgtggatttatacaaccaggctcagtcgaagtggtttgaggagatggtaacaaccacccttgagctggagaggctggaggtggaaagggtcgaaatgatccggcaacacctatgtcagtatactcaactgcgccatgagacagacatgtttaatcagtcaacggtagagcctgtggaccagctgcttcgcaaagtggatccggctaaagaccgtgagctctgggtaagagaacataaaacaggcaacatacgccccgtggacatggagatatag

SEQ ID NO: 119099 - DNA, 546 bp, Artificial Sequence
  Description of Artificial Sequence: Synthetic coding sequence
atggtgcctccacccccaggggaggaatctcagactgttatcttacctcccggctggcagagctacttgagtccacaggggagacgctattacgtgaacaccactacaaacgagactacatgggagaggccctcttcctcaccgggtatacccgccagccctgggtctcacagatcaagtctgccacccactgtgaatggctaccatgcttccggaacacctgctcatccccctgagacagctcacatgtccgtgaggaagagcacaggagactcccagaacctggggagcagtagcccatcaaagaagcagagtaaggaaaacacaatcactgaactggaaaggctggaggtcgaacgcgtcgagatgatccgccagcacctgtgccagtatactcaactgaggcacgagaccgatatgttcaatcagtccactgtggagcctgtcgaccagttacttcgtaaggtggacccggccaaggatagagaactctgggtcagggagcataagaccggaaatattcggcccgtagacatggaaatctag

SEQ ID NO: 119100 - DNA, 873 bp, Artificial Sequence
  Description of Artificial Sequence: Synthetic coding sequence
atgccagaacagcagctgctgaaacctacagaatggtcgtattgcgattatttctgggcggacaaaaaagaccctcaggggaatggtacagtggccggattcgagctgctgctccagaagcagctgaaaggaaaacagatgcagaaggagatgagcgaatttattagagagagaattaagatcgaagaagattatgccaaaaatctggctaaactgagccaaaacagcctggccagccaggaggagggctcactgggagaggcttgggcccaagtgaaaaaatctctggccgacgaggcagaggtccacctgaagttcagtgctaaacttcacagtgaagtcgaaaagccgctgatgaacttccgggagaacttcaaaaaggacatgaaaaagtgcgaccatcacattgctgatctgaggaagcagctcgcaagcagatacgccagcgtggaaaaagcacggaaagcattaacagagaggcagagagacctagaaatgaaaacccagcagctggagattaagcttagtaataagaccgaagaagacatcaaaaaggcacggcgcaaatctacccaggccggagacgatttaatgcgatgcgtagatttatataaccaggcccagtccaagtggttcgaggaaatggtgaccaccaccttagagctcgaacggttagaggttgaacgtgtagagatgattcggcagcacctctgccagtatacacagttgcgtcatgagacagatatgtttaatcaatctactgtggaacccgtagatcagctgttaagaaaggtggatccagcaaaggatcgcgaactttgggtgcgcgagcataaaactggaaacattagacccgtggacatggagatatag

SEQ ID NO: 119101 - DNA, 378 bp, Artificial Sequence
  Description of Artificial Sequence: Synthetic coding sequence
atgaagactcaacagctggaaataaaattgtccaacaaaactgaagaagacatcaagaaggctaggcgcaaaagcacacaagcaggcgatgatcttatgcggtgcgtggatttatacaatcaggcgcaatctaaatggttcgaggagatggttaccaccacactggagctcgagagattggaggtggagcgggtagagatgatcagacaacacctctgccaatatacacaactgcgacatgagactgatatgttcaatcagtccacagttgaacccgtcgatcagttactgcgaaaagtggaccctgccaaggaccgggagttgtgggtaagagaacataagaccggaaacattcgcccagtagatatggagatttag

SEQ ID NO: 119102 - DNA, 1011 bp, Artificial Sequence
  Description of Artificial Sequence: Synthetic coding sequence
atgagtaacatggagaactctttcgacgatgtttcttgcttgagtcctcagaatttaggcagttcttcaccatcaaaaaaacagagcaaagaaaatactatcactatcaattgcgtgacgttcccccatcccgacaccatgccggagcaacagcttctgaagcctacagaatggtcctactgcgattatttttgggctgacaagaaagatccccagggtaatggcaccgtagccgggtttgagcttttgctccagaagcagctcaaggggaaacaaatgcaaaaagaaatgtccgagttcatccgcgagagaattaagattgaagaggattacgctaagaacctggctaagttatcacagaacagtctcgcaagccaggaagagggttcacttggtgaggcttgggcccaagtgaaaaagtcactggctgatgaggcagaagtacatcttaagtttagtgccaaactgcactctgaggtggagaaaccgttaatgaattttagggaaaactttaagaaagatatgaaaaagtgtgaccaccatattgctgatctccgtaaacaattggcctcccgttatgcaagcgtggagaaggccaggaaggcactgacagaaagacaacgtgatctggagatgaaaacccagcagctcgaaatcaaactgagcaataagacagaggaggacatcaagaaggcgaggcgtaagagtactcaagccggcgacgatctgatgcggtgcgtagatttgtataaccaggctcagtccaagtggtttgaagagatggttaccaccaccttagagttggagaggttagaagtggaaagggtggaaatgatccgccagcacctctgtcaatatactcagctgaggcacgagaccgacatgttcaaccaaagtacggtagagcccgtcgatcagctgctgagaaaagtggatcctgccaaggatagagaactgtgggtcagggagcataagactgggaatatccgccctgtcgacatggaaatctag

SEQ ID NO: 119103 - DNA, 1437 bp, Artificial Sequence
  Description of Artificial Sequence: Synthetic coding sequence
atggcgccaaagaaaaaaggtaaaaagggaaaagcgaaaggaacgcctatcgtcgatggactggctcctgaagacatgtcaaaggagcaggtggaagaacatgtgtcaaggatcagagaagagctcgacagggagagggaagagaggaattacttccaattggagcgagacaagatccacacattttgggagatcactagaaggcagcttgaagaaaagaaggccgaactgcggaacaaagatcgagaaatggaggaggccgaggagaggcaccaggtggagatcaaagtttacaagcagaaagtaaagcacctgctgtatgaacatcaaaacaatctcactgagatgaaggctgaaggcactgttgttatgaaactggctcagaaagaacaccgaatccaagagtccgtacttcgaaaagatatgcgggccttgaaggtggagctgaaggaacaggagctcgcaagcgaggtggtggtgaaaaatctgcgcctaaagcacacagaggagattactaggatgcgcaacgattttgagagacaggtgagagaaatcgaagcgaaatacgataagaagatgaaaatgctgcgggatgagctagatctgcgccggaagaccgagctgcacgaagtggaagagcgtaagaatggccaaattcacaccctgatgcagaggcatgaggaggcctttaccgatataaaaaattactataacgatattaccttaaacaacctggcactgataaatagtcttaaggaacagatggaagatatgaggaaaaaagaggaccaccttgagcgagagatggcggaagtctccggacagaataagaggctggcggacccccttcaaaaggctagggaggaaatgtctgaaatgcagaaacaactcgccaactacgagcgcgataagcaaatccttttatgtactaaggcaagattgaaagtccgggaaaaagaactgaaagacctgcagtgggagcatgaagtgctcgagcagaggttcactaaggtccaacaggaaagggacgagctgtatagaaaatttaccgctgctatccaagaagtgcagcagaaaactggcttcaagaaccttgttcttgaaaggaagctacaggccttaagtgccgcggttgaaaagaaggaagtacagttcaacgaagttctagctgcatccaacctcgatcctgctgccctgactttagtctcacgtaagctggaggatgtgcttgaatcaaagaactccacaatcaaggacctccagtatgagttagcccaggtctgcaaggcccacaacgatctgttaaggacgtacgaggcaaagctgctcgcgtttggaatccccctggacaatgtcggctttaagcccctcgaaactgcagtcataggacagacactcggacaggggccagccgggttagtgggtacacccacttag

SEQ ID NO: 119104 - DNA, 1362 bp, Artificial Sequence
  Description of Artificial Sequence: Synthetic coding sequence
atgtctaaagagcaggtcgaggagcatgtctccaggattagggaggaactggacagggaacgggaggaacgaaactacttccagttagaacgagacaagatccacactttctgggagataacaaggcgccagctggaagagaagaaggcagagttgcgtaacaaagaccgcgagatggaggaggctgaggagcggcatcaggtggagatcaaggtgtataagcaaaaggtcaaacacttgctgtacgaacaccagaacaacctgacagaaatgaaagctgaaggaacagtcgtgatgaagctggcgcagaaggagcatcgtatccaggaatctgtgttacgcaaggatatgagggcgctgaaagtcgaattgaaggagcaggaactggcatccgaggtggtggttaaaaatctcagattgaagcataccgaggaaatcacccggatgcgcaacgatttcgagcggcaggtccgtgaaatcgaagccaaatacgacaaaaaaatgaagatgctgcgggacgaattagacctgcggcgaaaaacagagctacacgaggttgaggaacgtaagaacgggcagatacataccctgatgcaaaggcacgaggaagctttcacagacattaagaattattataacgacatcaccctcaataacttagccctcatcaattcactgaaagagcagatggaggacatgagaaaaaaggaagatcatttagagcgggagatggccgaagttagtggccagaacaagcggctagccgatcctctccagaaggcccgggaagaaatgagcgagatgcaaaagcagctcgctaattatgagcgggataaacagattcttctttgtacaaaagctcgcctcaaggttagggagaaagagcttaaggatctccagtgggagcatgaggtgctcgaacaaaggtttactaaggtacagcaggagcgtgacgaactttataggaagttcacagctgcaattcaggaagtccagcagaaaaccgggtttaagaacctggtgctcgagaggaaactccaagctctgagtgctgcagtggaaaagaaagaggttcaattcaacgaggtgcttgccgcctctaacttggatcctgctgcgctcaccctggtctcaaggaaactggaagatgtcctggagagcaagaattctaccattaaagacctccaatacgaattggcccaggtgtgtaaggctcacaacgatctgctgcgtacttatgaagcgaagttgctggcctttggcattccgctggacaatgtcggattcaagcctctcgaaaccgctgtaatagggcaaaccctcgggcaggggcccgcaggcctcgtcgggacacccacctag

SEQ ID NO: 119105 - DNA, 525 bp, Artificial Sequence
  Description of Artificial Sequence: Synthetic coding sequence
atggcccccaagaagaaggggaagaaagggaaagccaaagggacacctatcgtggatggcctcgcccccgaggacatgtccaaggagcaggttgaggaacacgtcagcagaataagggaagagctcgatcgcgaaagagaggaacggaactattttcagctcgaaagggataaaatacatactttttgggagataacccgccggcagctggaagagaagaaggcagaacttcgcaacaaagaccgagaaatggaagaggcggaagagagacaccaggtcgaaataaaggtgtacaagcaaaaggtgaaacacctgctctacgaacaccagaataatctcacagagatgaaggctgagggtacggtggtgatgaaattagcacaaaaggaacaccggattcaggagagtgtcctgaggaaggacatgagagcactgaaggttgaactcaaggaacaggagctagccagcgaagtggtggtaaagaacctccggctgaagctgcgaccctctatgatcaggcgatag

SEQ ID NO: 119106 - DNA, 1149 bp, Artificial Sequence
  Description of Artificial Sequence: Synthetic coding sequence
atggtcgaggagcacgtttcccggatccgggaggagttagatagagagcgtgaggaacgtaattacttccaactggagcgggacaaaattcacactttttgggagattaccagacgtcaattagaagagaagaaggctgaactcaggaacaaagacagggagatggaggaggcggaagagcggcatcaggtggaaataaaagtttataaacaaaaggtaaagcatctgctgtacgaacaccaaaataatcttacagagatgaaagccgaaggaaccgttgtgatgaagctcgcccagaaagagcatcgtattcaggagagtgtgttgagaaaggacatgcgggcattaaaagtggagctgaaagaacaggagctggcgagcgaggtggtcgtgaaaaacctgaggctcaagcacactgaagagatcaccaggatgcgcaacgatttcgagcgccaggttcgcgagatcgaagcaaagtacgataagaagatgaaaatgttacgtgacgaactagatctgagaaggaagacagaactgcatgaagtagaagaacgaaaaaacgggcagatacatactttgatgcagcggcacgaagaggcattcacagacattaaaaattattacaatgacatcacacttaacaacctagcattaatcaattcccttaaagagcagatggaagatatgagaaagaaagaagaccacttggaacgggagatggccgaggtgagtggccaaaacaagagactggcggatcccctccaaaaagcacgagaggaaatgtcagaaatgcagaaacagctggccaattacgagagagataagcagattcttttgtgcaccaaggctcgtttgaaggtgcgagagaaagaattgaaggatcttcaatgggagcacgaggtcttggaacagcggttcacaaaggtccagcaggagagggatgagctgtataggaagttcacagcagctatccaggaagtgcagcaaaagacaggatttaaaaatttggtcctcgagaggaaattacaggcattaagcgctgccgtcgagaagaaagaagtgcaatttaacgaggtacttgcagcatccaacctggaccctgctgccctgaccttggtgtcacgcaagctcgaaacgtttttctgctag

SEQ ID NO: 119107 - DNA, 717 bp, Artificial Sequence
  Description of Artificial Sequence: Synthetic coding sequence
atgctctgctgtatgcggagaactaaacaggtggagaaaaacgacgacgaccagaagatagagcaggatggcatcaaacccgaagataaggcccacaaggctgctaccaagatccaggcgagcttcaggggacacattaccagaaaaaagctgaaaggcgaaaagaaagacgacgtccaagctgcggaggccgaagccaacaaaaaggatgaagccccggtcgccgacggcgtggagaagaaaggggaaggcacaactacggctgaggccgctccagccactggcagtaaacctgacgagcccggcaaggccggcgagactcctagtgaggagaagaagggagagggcgatgctgcaactgagcaggccgccccacaggctcctgctagcagcgaagaaaaggcgggctctgcagaaacagagtcagcaactaaggcttcgacggataattcacccagttcaaaagcggaagatgcccccgcgaaagaggagcctaaacaagctgacgtccctgctgctgtgaccgcagctgccgccaccacccccgccgcagaggacgccgccgccaaagcaaccgctcagccacctactgagacaggtgagagcagtcaggccgaggagaacatcgaggccgtcgacgaaactaagcccaaggagtctgccagacaggacgaagggaaggaggaggagcctgaagctgatcaggaacacgcctag

SEQ ID NO: 119108 - DNA, 825 bp, Artificial Sequence
  Description of Artificial Sequence: Synthetic coding sequence
atgacgaaatcatgcagtgagttatgtcaccctgccctgcactttctaccttgcttggggggacttcggaagaacctgcagcgcgctgtgagaccttctccctattcgctgggatttctcacgttctggatcagtcgggttgaaaagaatgatgacgatcaaaagattgaacaagatggtatcaaaccagaggacaaagcccacaaggcagctaccaagattcaggcatcttttcggggtcatattacaaggaagaagctgaagggcgaaaaaaaagatgatgttcaggcagccgaggcagaggccaataaaaaggatgaagcgcccgtcgctgatggtgtggaaaaaaaaggggagggaacgacaacggcggaggccgctcccgctaccggctccaagccagatgagccaggcaaagcaggggagacaccgtccgaggaaaagaaaggggaaggtgatgccgcaaccgagcaggctgctcctcaggcccctgctagctcagaagagaaagctgggagcgccgagaccgagtctgctacgaaggccagtaccgataattccccctccagcaaggctgaggatgcgcccgccaaggaagaaccgaaacaggccgatgtgccagccgctgttacagctgctgcggccacaacacctgccgcagaagatgcagccgccaaggctaccgcccagccacctactgaaaccggagagtcaagtcaggccgaggagaatatcgaagccgtggacgagaccaaaccaaaggaaagcgcacggcaggacgaggggaaggaggaagagcccgaagccgaccaggagcatgcatag

SEQ ID NO: 119109 - DNA, 1119 bp, Artificial Sequence
  Description of Artificial Sequence: Synthetic coding sequence
atgccgcccccccagcaggggccatgcggccatcacctgttgctgttactcgccctcctgttgcctagcctaccgcttacccgcgctccagtcccacccgggcctgcggccgccctactgcaggccttggggttacgcgatgaaccacagggtgccccgaggctgcgaccagttccccctgtgatgtggaggcttttcagacggagggacccccaagagactcgatctgggtcacggcggacttcacctggggtaacactgcaaccttgccatgtagaagagctgggggtagctggaaatatagtgaggcatatcccggatcgcggtgctcccacgagggctagtgaacccgctagtgccgcaggccactgtcctgaatggaccgttgtctttgacttgtctgctgtcgagcccgcagagagacccagccgtgccaggctagagctccgcttcgcggccgccgctgccgccgcgcctgagggcggatgggaactgagtgtggcgcaagccggacagggcgctggcgccgacccggggccggtcctccttcggcaactggtccccgccctaggccctcctgttcgagccgagctgctcggtgctgcgtgggcaagaaacgcctcttggccacggagtctgcgccttgccctcgcccttagacctcgcgcacctgcagcatgcgccaggttagccgaagcttctctgctcttagtgactcttgatccgagattgtgccatccgttagcccggccccgcagagatgctgaaccagtgttagggggcggtccggggggggcttgtcgagcgagaagattgtatgtgtccttccgtgaagtcggatggcatcggtgggtcatcgcccctagagggttcttggccaattattgccagggccagtgcgcgctccccgtcgccctctccggatcaggaggtcctcccgcccttaaccacgcagtgctgcgggccctaatgcatgccgccgctccaggcgccgctgacctgccatgttgtgtcccagcgcggctcagccctatttctgtcctgttttttgacaactcagacaacgtggttctgaggcagtacgaggatatggtggtcgacgagtgtgggtgcaggtag

SEQ ID NO: 119110 - DNA, 1224 bp, Artificial Sequence
  Description of Artificial Sequence: Synthetic coding sequence
atggtgctggcagcaccccttctgttgggattcctgctgctggccctcgagctcaggcccaggggcgaagccgcagaaggccccgccgctgcagcggccgcagccgccgccgccgctgccgccggtgtcggaggcgaacggtcctctcgtccagcacctagtgtcgctccagagcctgacgggtgccccgtgtgtgtttggagacagcacagtcgtgagctcaggcttgaaagcattaagagccagatcctttccaagttacgcctgaaagaagcaccgaatatctccagggaggtcgtgaagcagctcctccccaaggcacctcctcttcaacagatcctggaccttcacgatttccagggagacgcattgcagccagaggattttctcgaggaagacgaataccatgcaactacagaaactgttatatccatggcgcaggagacggatccagctgtacagaccgacggtagccctctgtgctgtcattttcacttcagcccgaaagtcatgttcacaaaagtgctgaaggcacagctttgggtgtacctgcgtcccgtgcccaggcctgctacagtgtatttgcagatcttgagactgaagccattgacaggagagggcaccgctggcggagggggggggggaagaagacacatacgtattcgaagtctgaagattgagctgcactcccgaagcggccactggcagtctatcgacttcaagcaggtactgcactcttggtttcgccagccgcaatccaattggggcatagaaatcaatgcatttgacccgagcggaacagacctggccgtgaccagcctgggacctggagcagagggcctccatccttttatggagcttagggttctggaaaacaccaaacggtcacgccggaacctcggactggactgtgatgagcattctagcgagagcaggtgttgccgttaccccctgaccgtggactttgaagcttttgggtgggactggattattgctcctaaacgttataaggccaactactgttcaggtcaatgtgagtacatgttcatgcagaagtatccgcacacacacctggtgcagcaggcaaaccctcgcggatcagccggcccatgctgtacaccgacaaaaatgtcaccgatcaacatgctgtacttcaatgacaagcagcaaatcatatatggaaaaatccctggaatggtcgtcgacagatgtggttgcagctag

SEQ ID NO: 119111 - DNA, 1143 bp, Artificial Sequence
  Description of Artificial Sequence: Synthetic coding sequence
taggccgcggctgcagccgccgccgctgcggccgccgcagccggagtcggcggtgaacggagttctcgtccagcaccatccgtagcccctgagcccgatggatgccctgtgtgcgtgtggagacaacactcccgggaactcaggctggagtcaatcaagagccaaatcctgtccaagctaagacttaaagaggcccctaatatcagcagagaagtggtaaagcagctcctgccaaaagccccaccccttcagcagatcctcgaccttcacgacttccagggagatgccctgcagccagaagactttctcgaggaggacgagtaccatgccactacggagactgttatttcaatggcgcaggaaaccgatcctgccgtacagaccgacgggagccccctttgttgccattttcatttctcccccaaggttatgtttactaaggtgctgaaggcccagctctgggtttatctgcgtcctgttccacggcccgccacagtgtacctgcaaatactacgcttgaaaccattaactggcgaaggcactgcaggcgggggaggagggggtagacgacacatcaggatacgatccctgaaaattgaactgcacagcaggtctggccactggcagtccattgactttaaacaggtgctgcattcctggttccgccaaccacaaagcaattggggtattgaaatcaacgcgttcgaccccagtggaactgatttggccgtaacctccctaggccctggcgctgagggcttacacccctttatggagctgcgcgtcctggagaacacaaaacggtcaagacggaaccttggcctggactgtgatgagcactcatcagagtcacggtgttgtagatatcccctgaccgtggatttcgaggcttttggttgggactggatcatcgctccgaagaggtacaaagccaactattgttcgggccaatgtgaatacatgtttatgcagaaatacccccacacgcaccttgtgcaacaagctaaccctcggggtagcgctggtccttgttgtacccccacaaaaatgagtcccattaacatgctgtacttcaatgataagcagcagatcatatatggcaagatccccggaatggtcgtcgacaggtgcggttgcagttag

SEQ ID NO: 119112 - DNA, 927 bp, Artificial Sequence
  Description of Artificial Sequence: Synthetic coding sequence
atgccagggcaggagctccgtaccgtcaacggatcccagatgctccttgtgctgctggtgcttagctggctgcctcacggtggggccctctcgttggcagaagccagcagggcctccttcccaggcccatccgagctacacagcgaggatagcaggtttcgcgaactgaggaagcgctacgaggatctgctgacgcggctgcgcgcgaatcagtcctgggaggactctaataccgatctggttcctgcccccgccgtgcggatcctgacacctgaagtccggctggggtctggaggccacctgcatctgagaattagcagggccgcccttcctgagggcctgccggaggctagccgactgcacagggctttgtttcggctgagcccaactgccagccggtcgtgggatgtaactaggccactgaggcgacagctttcgctcgctcgcccccaggctcctgcattgcacctgcgcttgtctccccccccatcccagtctgaccagttgctagcggaatcatcatcagcccggccgcagctggagctgcacctgaggccccaggccgcgcgtggccgcagacgggcacgcgcccgaaacggggaccactgtcctctgggacccggaagatgttgccgacttcacaccgtgagagccagtctggaggatctgggctgggcagactgggtgctctcacccagggaggtacaagtcacgatgtgtattggtgcgtgtccatctcagttccgggccgcgaacatgcacgctcagattaaaacttcactccataggctgaaaccagacactgttcccgctccatgctgtgtgccagcctcatacaaccctatggtgctgattcaaaagactgacacgggtgtcagcctgcagacgtacgacgaccttctcgcaaaagactgccattgcatttag

SEQ ID NO: 119113 - DNA, 927 bp, Artificial Sequence
  Description of Artificial Sequence: Synthetic coding sequence
atgcccggccaggaactccgcaccgtcaatggaagccagatgctgcttgtgctgctcgttctgagttggttgcctcacggaggcgccttgtctttagccgaagcctcccgtgcttctttcccaggaccctcagaactacacagtgaagattctaggtttcgggaattgaggaaacgctacgaggacctgctgactcgtctcagggcaaaccagtcttgggaagactccaacactgacctggtccctgccccagccgtaagaatcctgactcctgaagtccgcttgggtagcggagggcacctccacctccgaatctctcgagcggctttacccgagggcctacctgaggcttcccggctgcacagggcattgttcagactgagccctaccgcttctcggtcctgggatgtgacccgacccctgcgtcggcagctaagcctggcgagaccgcaggccccagctctccacctgcgcttaagccccccaccatcgcagtccgaccaattgctcgctgagtcttccagcgcaaggccccaattagagctacacctacgccctcaggccgctaggggcagacggagagccagagctcgcaatggggaccactgccccttgggtccgggaaggtgttgccgcctccataccgtgcgcgcctctctcgaggacctgggctgggccgattgggttctgagtcccagggaagtccaggtgacaatgtgcatcggcgcgtgtccctcccaattccgggctgcaaacatgcatgcacagataaagacaagcctgcaccgactgaaacctgatacagtacccgcgccttgttgcgttcctgctagttacaatcctatggtcctcatccagaaaactgacaccggcgtttccttgcaaacgtacgatgatctgcttgccaaggactgccactgcatctag

SEQ ID NO: 119114 - DNA, 1290 bp, Artificial Sequence
  Description of Artificial Sequence: Synthetic coding sequence
atgtgccccggcgccctgtgggtcgctcttcccctactaagccttcttgccggatctctgcaaggaaagcctcttcaatcatgggggcgcggatccgccggggggaacgctcactccccgttgggtgtcccaggtggaggactcccagaacatactttcaacctgaaaatgttccttgagaacgtgaaagttgatttcctgagaagcctgaatctctccggggtgccctctcaggacaagacacgggtggagcctccacagtacatgatcgatctgtacaataggtacactagcgataagtcgaccacccctgcttctaatattgtccgcagcttcagcatggaggacgcaatctccatcaccgccactgaagatttcccctttcagaagcacatcctgctgttcaacattagcatcccaagacacgaacagattactagagctgagctgcgcctttatgtctcctgccagaatcatgttgatccttctcacgacctgaaaggctccgttgtgatttatgacgtcctcgatggtactgacgcctgggatagtgcgaccgagactaagactttcttagtgagtcaggacatccaagatgaggggtgggagacgctggaagtgtctagcgcagtcaaaaggtgggtgagatcggatagtacaaaaagcaaaaacaagttggaggtaaccgtcgagagccatcgaaaggggtgtgacacattggatatatcagtcccaccaggatccagaaacctcccattttttgtggtgttttccaacgatcattcaagcggtactaaggaaaccaggctggagctccgtgaaatgataagtcacgagcaggagagtgtgctgaaaaagctgtcaaaagacggtagcactgaagccggagaatccagccatgaggaagataccgatgggcacgttgcagcgggatctacccttgcaagacggaagagatccgccggagctggtagccactgccaaaagacgtctttgcgcgtaaattttgaggatatcggatgggatagttggataatagccccgaaggagtatgaggcctacgagtgtaagggcggctgtttcttcccactcgctgatgacgttacccctacgaaacacgctattgtacaaaccctggtgcaccttaagttccctactaaggtcggaaaagcatgttgcgttcccaccaagctgagtcctatatctgtgctgtataaagacgacatgggcgtcccaacactcaagtatcactacgagggtatgagtgttgctgagtgcgggtgtcgctag

SEQ ID NO: 119115 - DNA, 1095 bp, Artificial Sequence
  Description of Artificial Sequence: Synthetic coding sequence
atgctgagattcctgcctgacctggcttttagctttcttctgattctggcgttgggccaggcggtgcagtttcaggagtatgtattcctgcagttccttggtctagacaaagcacccagcccacagaaatttcaacccgtgccgtacattctcaaaaaaatcttccaagaccgggaagctgcggcgaccaccggcgtgagtagggacctttgttatgtaaaggagctcggcgtgcgtgggaacgtgttgcgcttcctgcccgaccagggcttttttttgtatcctaagaaaatctcccaagcctcgtcatgcctccagaaactgctttattttaacctctccgcaattaaagaaagagaacaactgactcttgcccaactcgggctggatctgggcccaaacagctactataatcttggccccgaattggaactcgccctattcctcgtacaggaacctcatgtatggggccagactacccccaaacctggaaaaatgttcgtcttaagatctgtcccttggcctcaaggggccgtgcacttcaatctgttagatgtggctaaagactggaacgacaatccgcgcaaaaattttggcctttttttggagatcctggtcaaagaagatagggatagcggcgtgaacttccaacctgaagacacgtgtgcaagattgcggtgcagtctgcatgcctcccttctcgtggtgacactgaatccagaccagtgccatccttctcgtaagagacgcgctgccatccctgttcccaagctgtcctgcaaaaatctctgccaccgtcaccagctgttcataaactttagagacctgggctggcacaaatggataatagcaccaaagggctttatggcgaactattgtcacggagaatgtccgttcagccttaccatcagtctcaactcatctaactacgcttttatgcaggcactgatgcatgccgtggatccagaaataccccaggctgtgtgcatccccaccaaactgagtcctatctctatgctgtatcaagacaataatgataacgtcattctgagacactacgaagacatggtggtggacgaatgtggctgcggctag

SEQ ID NO: 119116 - DNA, 1506 bp, Artificial Sequence
  Description of Artificial Sequence: Synthetic coding sequence
atgaggctgccgaaactgctgacattcctgctgtggtacctggcttggctcgacctcgagttcatctgcacagtcttaggggcacctgaccttggccagagacctcaaggaacacgtccagggctagcgaaagccgaagctaaagagagacctcccctggcacgaaacgtctttcgaccaggagggcatagctacggcgggggggccaccaatgcgaacgcccgggctaagggcggtacgggccagactggggggctgacccagccaaaaaaggatgagcctaaaaaactacctccgagaccaggtgggccagaacccaaacctggtcatccgcctcagactcgacaggccactgcccggacggttacacccaagggccagctgcctgggggtaaagctcctccaaaagcaggcagcgtgccctcaagctttctgttgaaaaaggctcgtgagcccggtccaccaagagagcctaaggagccatttcgcccacctcccatcacgcctcacgagtacatgttgagtctgtaccggaccctctcagatgctgatagaaaaggtggcaatagcagcgtgaaattggaagccggcctggctaacacaataaccagcttcatcgataaaggccaggacgataggggacctgtggttcgcaagcagcggtacgtatttgacatttccgcactcgaaaaggatggcctgctgggcgccgaactgagaattttgcggaagaaaccttccgacaccgccaaacccgccgcccccggtggcggcagggcagcgcagttaaaactctcttcctgcccgtccggtaggcaaccagccagcttactggacgtccgctctgttccaggcctggatggctccggatgggaagttttcgatatttggaagttatttcgaaattttaaaaattctgcccagctgtgtctggagctggaggcgtgggaacgcggcagagctgtcgatctcaggggtctcggttttgaccgagccgctcgccaggttcatgaaaaagccctgttcctggtcttcggccgaacaaagaagcgtgacctgttcttcaatgagatcaaggccagaagtgggcaggacgacaaaacggtatacgaatatctgtttagccagcgacggaagcgcagggctcccctggcaactaggcaggggaaaagacccagcaagaacctaaaagctaggtgtagtcgcaaagcgctgcatgtgaatttcaaggatatgggctgggatgattggattattgcacctcttgagtatgaggccttccattgtgaggggctgtgcgaatttcccctacgctcacacctcgagcccacaaatcacgccgtgattcagacgttaatgaatagcatggacccggagagtacaccaccgacatgttgcgtgccaactcgtctaagtccaattagtattctgtttatcgattcggctaacaatgtggtctacaagcaatacgaagacatggtggtggaatcctgtggctgtcgatag

SEQ ID NO: 119117 - DNA, 1506 bp, Artificial Sequence
  Description of Artificial Sequence: Synthetic coding sequence
atgcgactgccaaagcttctcacattcttgctctggtatttagcctggctcgacctggaattcatttgcacagttctcggtgcccccgacctggggcagcggcctcagggcacacgtccggggctggcaaaagctgaggctaaagagagacctcccctggcacggaatgtgtttcgccccggaggtcattcctacggcggcggcgcaacgaatgcgaatgcccgagctaagggaggtacaggtcagacgggcgggctaacacagcccaaaaaggatgagccaaaaaagctgccacctcggcccggaggacccgaacctaagcccggtcaccctccccagacacgtcaagcaaccgcgcgaaccgtcacccctaagggacaactgcccggcggcaaggcaccacccaaggccggctccgttccgtccagcttcttgctgaagaaggctagagagccaggacccccaagagagcccaaagaaccctttcggccaccccccataaccccccatgaatacatgttgtcactgtaccggacactgagtgacgccgaccgcaaaggcgggaattcttccgtgaagctagaggccggtctcgccaataccatcacctcattcatcgataaaggccaggacgaccgggggccggttgtacgaaaacagagatacgtcttcgacatatctgccctggagaaagacggcctcctgggagcagaactgcgaattcttcgaaagaagccgtccgatacagccaagcccgccgctcccgggggcggccgggccgcacagcttaaattgtctagttgcccctcaggcaggcaacctgccagcctcctggatgtgcgctctgtgcccggcctagatggctccggctgggaggtcttcgacatctggaaactctttagaaatttcaaaaacagcgctcaactgtgtctggaactggaagcctgggagcgaggaagagcagtggatctccggggactggggttcgaccgggcagccaggcaggtacacgaaaaagccttgttcctggtgtttggccgtactaagaagagggatctattctttaatgaaataaaagcgcgcagcggacaggacgataagactgtgtatgagtacctgttctcccaacgacggaagaggcgagcaccactggccactagacagggtaaaagaccctcaaagaatcttaaggcccgttgttcacggaaggcgctacatgtaaatttcaaagacatgggttgggatgactggattatagctccactggagtatgaggcgtttcattgcgaaggcttatgtgagtttcctctgaggtcccatcttgagccaacgaaccacgccgtgattcagactctgatgaattcaatggatcctgagagcacacctccaacttgctgtgtgcccactcgtttgtccccaatctcaatcctgtttattgatagtgcaaataatgtggtttacaagcagtacgaagatatggtagtcgaaagttgcgggtgtcggtag

SEQ ID NO: 119118 - DNA, 1368 bp, Artificial Sequence
  Description of Artificial Sequence: Synthetic coding sequence
atggacacgccaagggtgttattatccgccgtgttcctcatcagcttcctgtgggatctcccaggcttccagcaggctagcatatccagctcctctagctcagcggaattaggctcgacgaagggcatgcgatcacgaaaagagggcaaaatgcagagagcgccacgggactcggatgctggaagagagggacaagaacctcagccgcggcctcaggatgagccccgagctcagcagcctagggcccaggagccacccggccggggccctagggtcgtgccccatgaatacatgttgtctatttacagaacctacagtattgcagaaaaactgggcattaacgcgtcatttttccaaagtagtaaaagcgctaatacaattactagctttgtggatagaggattagatgatctctcccatactcctcttaggcgccaaaagtacctctttgatgtgtccatgctgtccgataaggaggaacttgttggagccgaactccgtctcttcagacaagcaccttcagccccttggggcccaccagctgggcccctacatgttcagctgttcccatgtctgtccccgcttctgctggacgcccgcaccttggacccacagggggccccgccggccggctgggaggtttttgacgtgtggcagggactgcgccaccagccttggaaacagctgtgtctggagctgcgggccgcttggggggagctggatgctggcgaagccgaagcccgagctaggggtccacagcagcccccccctcctgatctgagatccttggggtttggccgacgtgtgagacccccacaggaaagggccctgcttgtggtgttcacaagaagtcagagaaagaatctctttgctgagatgcgcgaacaacttggatctgccgaagccgccgggcccggagcaggggccgagggcagctggccgccgccctcaggcgctcccgacgccagaccctggttaccctcacctgggaggagaaggcgcagaaccgcctttgcttcacggcatggtaagcgacacggtaaaaagagtcggctgcgatgtagcaagaaaccactccacgttaattttaaagagttgggttgggacgattggattattgctccactcgagtacgaagcgtatcactgtgaaggcgtttgtgattttccactacgatcgcacctggagcccacaaatcatgcgataattcagaccttaatgaattccatggaccctggctctactcctccttcctgttgtgtgccaaccaagctcacccccatttcgatcctttacatcgatgccggcaataacgttgtctacaagcagtatgaagatatggttgtggagtcctgtggctgtcggtag

SEQ ID NO: 119119 - DNA, 1062 bp, Artificial Sequence
  Description of Artificial Sequence: Synthetic coding sequence
atggacacccctcgcgtcctactgtccgctgttttcctgattagtttcctctgggaccttcccggtttccagcaggcaagcatatcttctagctctagcagtgcagaactgggaagtactaaagggatgaggtctagaaaagagggcaaaatgcagagggcccctcgggattctgatgctggccgggagggccaggagccacagccgcgaccacaggatgagccccgtgcccaacagccacgtgcccaggagccaccaggaagagggcctagggtggtgccacacgaatatatgctaagcatttatcgcacctacagtatcgctgaaaagctagggatcaatgccagcttcttccagtcttcaaagagtgctaataccattacctcctttgtcgatcgcggcttggatgatctgtcccataccccacttagaaggcagaaatacttatttgacgtgtctatgctctcagataaggaggaattagttggtgctgagctgaggttgtttcggcaagcaccatccgctccttggggtcctcctgccggtccgctgcacgtccagctctttccttgcctgtcaccgctgctgcttgatgcacgcactttagacccccagggcgctccgccagcagggtgggaggtctttgacgtgtggcagggactcaggcaccagccatggaaacagctgtgccttgaactcagagcggcctggggcgagctagatgctggcgaagcggaggccagagctaggggtcctcagcagccacccccaccagatctccgcagcctgggattcggacggcgtgtgcggcctcctcaggaacgagctctcctggtggtgtttacgaggagtcagaggaaaaacctctttgcccccggtgtcagaggtctgtctcttcgcgggtgtatgcgcttaccggcagctctcgcacccggcgcacaccagccccgtcaccacccagatgcagatgagcttcatggccctcggcttcacccagcgcagctcctccgtgcacaccagatagactcacaccagcacagcattcacagacgtggccagtag

SEQ ID NO: 119120 - DNA, 816 bp, Artificial Sequence
  Description of Artificial Sequence: Synthetic coding sequence
atggatacaccccgtgtgctgctgagcgcggttttcttgattagctttctgtgggatctacctggatttcaacaggccagtatctctagtagttcgagctcggccgagttgggctccactaagggtatgagaagcagaaaggaaggtaaaatgcaaagagcacctagagattctgacgctggacgagaaggtcaggagcctcaaccgcgtccgcaagacgagccacgggcccagcagcccagagcacaagagccccccggtaggggaccccgcgtcgtccctcatgaatacatgctttccatctaccgaacctatagcattgcagagaagctggggatcaatgcatctttttttcagagcagcaaaagcgcgaatacaattacgtcctttgtcgacagggggcttgatgacctgagtcacactccgctcaggaggcagaaatacctattcgatgtgtcaatgctgagcgataaggaagagctggtcggagctgagctcaggcttttccgacaggcaccctctgcaccttggggtccgcccgcaggccccctgcatgtgcagcttttcccctgtctgtcccctcttttgcttgatgctagaacactggatccccagggtgcaccacccgccggttgggaggtcttcgacgtgtggcagggcttacgccatcagccttggaaacagttgtgtttggaactccgtgccgctcccggcccggccgagtcaggcctgcgacctgaaggcgcagcctctccgggtgccgggcccgccgggggaatccaccagataccggctgccgcttgcccgcccaactag

SEQ ID NO: 119121 - DNA, 1353 bp, Artificial Sequence
  Description of Artificial Sequence: Synthetic coding sequence
atggacttgagtgccgcagccgccctttgcctctggctcttgagtgcttgcagacctcgggacggcttagaggccgcagctgtcctccgggcagcgggtgctggacccgtcagaagccctggcggcggcggaggcggcggtgggggaggcaggactctagcccaagcagccggagccgctgctgtccctgcagccgcagtgccccgcgcacgggccgccagacgggccgctggatcaggctttagaaacggctcggtcgtccctcatcattttatgatgtcgttgtaccgatccctggcaggacgcgcaccagccggggcagcagccgtcagcgcctccggccatgggcgcgctgatacaataactggcttcactgaccaggccacacaggacgagtccgcagccgagacaggtcagtctttcctgttcgatgtttctagtttgaacgatgccgacgaggtcgtgggcgcagagctgcgcgtgctaaggcggggaagcccggaaagtggccccggctcgtggacaagtccaccactgttgctgctgtcaacatgccccggtgctgcaagagcccccagactgctgtacagccgagcagccgagcctctggttggtcagcgttgggaagcctttgatgtcgccgacgccatgcgtagacaccggcgcgagcctcgccctccacgcgcattctgtctgctgctgcgcgcggtggctggcccagttccaagccccttagcattacgacgacttggatttggctggccgggaggcggcggaagcgccgccgaggagagagccgtgctggtcgtcagttcgcggacacagagaaaagaatccctttttcgtgaaatccgggctcaagccagagctctgggcgcagccctggcctcagaacctttacctgacccaggaacagggactgcctcgcccagagccgtcattggtggtcgccgcaggcgcagaactgcccttgccggaacccgtacagcgcaaggctctggcggaggagctggcagaggacacggacgccgaggaaggtcccgctgctcgagaaaaccactgcacgtcgactttaaagagctggggtgggacgactggattatcgcacccttagactacgaggcgtatcactgcgaaggtttgtgcgacttccccctccgctctcacctagagccaacaaatcacgcaatcatccagacgctgcttaattccatggcccccgacgcagcgccagctagttgttgcgtcccagctcgattgtcccctattagcattctgtacatagacgctgccaataacgtcgtgtataagcagtatgaagatatggtggtagaggcgtgtgggtgccgctag

SEQ ID NO: 119122 - DNA, 1269 bp, Artificial Sequence
  Description of Artificial Sequence: Synthetic coding sequence
atgccccgaagcttcctggtgaaatctaagaaagcacattcatatcaccagccgcgcagccccggtccagattacagtcttcggcttgaaaacgtacccgctccgagccgggcagatagcacgtcaaacgcaggcggagccaaggccgaacctcgcgaccgccttagtccagagtcccagcttactgaagcccctgatagagcgtccgcctcccccgattcctgtgagggttccgtgtgtgagaggtcttctgagtttgaagatttctggcgccctccttcaccttctgcctcaccagcctccgagaaaagcatgtgcccgtcattagacgaagcccaaccttttccacttccattcaagccttacagttggtccggtctggcgggctccgatttgcggcacttggttcagtcctatcggccatgtggcgctctggagaggggcgcaggtctggggttattctgtgagccagccccggagcccgggcatcccgctgctctctatggaccaaaacgagccgccgggggggctggggccggtgctccaggtagctgcagcgccggggctggggctacagccgggccaggacttggcctgtacggggatttcggcagcgccgccgccggcctctatgagagacctacagctgcagctgggctgttgtacccagagcgaggacatggactgcatgccgataagggagctggtgtcaaagtggagtctgagctcctgtgtactagactgttactcggcggaggctcttacaaatgcataaagtgtagtaaggtgttctccacccctcacgggcttgaggtgcacgtgcgtcggtctcactcggggacgcggccatttgcctgtgaaatgtgcggtaaaacttttggccacgctgtctccctcgaacagcacaaagcagtgcattcccaggagcgcagctttgattgcaagatatgcggcaaatcgttcaaaaggagcagtacgttgagcacacatcttcttatacactctgatacgagaccttacccatgtcaatattgcggcaaaagattccatcagaagtccgatatgaaaaaacacaccttcattcacactggtgagaaaccacacaagtgtcaggtgtgcggaaaagccttttcccagtcatcaaatctcatcacacacagtcgaaagcatacaggcttcaaaccgtttggatgtgatttgtgcggaaaagggttccaacgcaaggttgacctcaggcgacaccgagagacacagcatggcctcaaatag

SEQ ID NO: 119123 - DNA, 1269 bp, Artificial Sequence
  Description of Artificial Sequence: Synthetic coding sequence
atgcctcggagcttcctggtaaagtcaaaaaaggcccattcatatcatcagccaagatcacctgggcctgattactccctccggctggaaaacgttccagccccgtcgagggctgacagcaccagcaacgccggaggggcgaaggccgagcctcgggatcgccttagccctgagtcccagcttactgaggctccagaccgggcaagcgctagccctgattcctgcgagggttccgtttgtgaaagaagtagcgagttcgaggacttttggaggccgccttccccttcagcctctcctgcttccgaaaagtccatgtgtccctctctggatgaggcccaaccattcccacttccattcaagccctattcatggtctggcctggctggctctgacctacgccatctcgtgcagtcgtatcgcccttgcggtgctctggagcggggcgctgggcttggcctgttttgcgaacccgcccccgaacccggtcacccggcagcgttgtacgggccaaaaagagctgcaggtggggcaggtgcgggagctcccggatcctgcagtgcaggcgccggagccacggcgggaccgggtcttgggctgtatggcgacttcggctccgcagctgccgggttgtacgaaaggcccacagcagcggcaggcctgctctaccctgaacgaggacacggactgcatgccgacaaaggtgctggtgtgaaagtggaaagtgagttgctctgcacgaggctgctgttggggggtggctcatataaatgcatcaagtgtagtaaagtgttcagcactccacacggtctcgaggtgcacgtaagaaggtctcacagcggtacgaggccattcgcatgtgagatgtgtgggaaaaccttcgggcatgcagtgagcctggaacagcataaggccgttcattctcaggagcgttcttttgactgtaagatttgcggaaagtccttcaaaaggagctcgactttgagtactcatctgctgatccatagcgacactagaccatacccgtgtcagtactgcggtaaacgatttcatcagaaatctgatatgaaaaaacacacttttatacacactggagaaaaaccacacaaatgccaggtgtgtggtaaggccttttctcagtcttctaatctgatcacccattcccgaaagcacaccggctttaagccctttggatgcgatctctgtgggaaggggttccagagaaaagttgacctgaggcgccatcgggaaactcagcatggactgaaatag

SEQ ID NO: 119124 - DNA, 1269 bp, Artificial Sequence
  Description of Artificial Sequence: Synthetic coding sequence
atgccaaggtcatttctggtgaagtctaaaaaagcacactcctatcatcagccgcggtcacctggacccgactattccctgaggctggagaatgtgccggccccttcgagagccgattccacgtcaaacgcaggtggggctaaggctgagcctcgcgacagattaagccctgagagccagctgacggaagctccagatcgagcctccgcctctccagactcctgtgagggcagcgtctgtgaacgcagcagcgaattcgaggacttctggcgccctccttctccctcggcctctcccgcaagcgagaagtccatgtgcccgagcctcgacgaggcgcagccctttccccttccattcaaaccatactcctggtccgggcttgcagggtccgacttacgacatctggtccagtcgtacaggccctgcggcgctttggagagaggtgcgggtctggggctattttgtgagcccgcgccagagccaggtcacccagcagccctgtacggcccaaagcgggctgcaggtggagcgggcgcaggtgcacctggttcctgctctgcgggggcaggggctacggcaggcccagggctgggactgtatggggacttcggctccgccgcggcaggactatatgagcgacctacagcagcagcgggcctgctgtatcccgaacgcggtcacgggttacacgcagataagggggccggagtgaaggtcgaaagcgaacttctgtgtacccgcctgttgctggggggcggatcttataagtgcatcaagtgctctaaggtctttagcaccccacacggactcgaagtgcatgtgcgcagatcccacagtggcacccggccatttgcttgcgagatgtgtgggaagacctttggtcatgccgtgagcctggagcaacataaagccgtgcactcacaggaaagatctttcgattgtaaaatatgtgggaagagtttcaagcgttcctctacactgtcgacccatctgttgatccattccgataccagaccctacccttgtcagtattgtggaaagcggtttcatcagaaatccgacatgaaaaaacatacattcatccacacgggtgaaaaaccacacaagtgccaggtctgcggtaaagccttttcacagagctctaatctcatcacacactctcgcaagcataccggctttaagccatttgggtgtgatctctgcggcaagggcttccagaggaaggtagaccttaggagacatcgagagacccagcacggattaaaatag

SEQ ID NO: 119125 - DNA, 993 bp, Artificial Sequence
  Description of Artificial Sequence: Synthetic coding sequence
atgccgcgatcctttctcgtgaagtccaaaaaggctcatacatatcatcagccacgggtccaggaggacgaacccttatggccccctgccctcactcctgtccctagggatcaggctccctcgaactcaccggttctgtctacattgtttccgaatcagtgcctcgattggactaacttgaaacgcgagccagagctagaacaagaccagaatctggctagaatggcccccgctccagagggaccaatcgtactatccaggccgcaggacggtgactctcctctgtccgattcccctccattctataagcctagtttcagctgggatacgctcgccaccacctatggccattcatataggcaggccccttctactatgcaaagcgcattcctcgaacattcagtatctctgtacggatcacccttagtgccatctacagagcctgccctcgactttagtcttcggtactcgcccggcatggacgcataccactgcgtcaagtgtaacaaagtattctctacgccccatggcctggaagtgcacgtgcgacggagtcacagtggaactagacctttcgcatgtgatatttgcggtaagacctttgggcatgccgtgtccttagagcagcacactcatgtccatagtcaagagcgaagcttcgaatgtcgtatgtgtgggaaagctttcaaacgctcatctacactctctacacacctactgatccatagtgacactcggccatacccctgtcagttctgtggcaaaaggttccaccagaagagcgacatgaagaaacacacctatattcacacaggggagaaacctcacaaatgtcaggtttgcggaaaggccttcagccagtcatccaacttaataacccacagcagaaagcacactggctttaaaccattctcctgcgagctgtgtactaagggtttccagaggaaggtcgacctcagaagacaccgggagtcgcagcataatctgaagtag

SEQ ID NO: 119126 - DNA, 993 bp, Artificial Sequence
  Description of Artificial Sequence: Synthetic coding sequence
atgccgcgaagctttttagtgaagtccaagaaggctcacacttaccaccaacctcgagtacaggaggacgagcctctgtggccacccgctcttacgcccgtgcccagggatcaggctccctcaaattcccctgtcctgagcaccctgtttcctaatcaatgcttggattggacaaatctaaagcgggagcctgagttagagcaggaccagaacctcgcgagaatggcccccgctccagaagggcccatcgtgttaagtcgcccacaggatggcgacagtcccctcagcgattcacctcccttctataaacctagcttctcatgggacacactggccacaacatacggacattcctacagacaggcaccttccaccatgcagagcgccttcctggaacacagtgtgtccctgtacggatccccattggtgccgtcgacagagcctgccctcgatttctccctgcggtactctcctggaatggacgcgtaccactgcgttaagtgcaacaaagtgttcagcacgccacacggactggaagtccacgttcggcggtctcatagcgggacccgcccatttgcttgtgatatttgcggaaagaccttcggccacgccgtgtccctcgagcaacatacgcatgtgcatagccaggagcgatcctttgagtgtcggatgtgtggcaaggcctttaaacggtcctccacgctgagcacacacttgctgattcactccgacacaaggccctacccatgtcaattttgcggcaagcgcttccaccagaagtccgacatgaaaaagcatacatatatccacaccggggagaagccacacaagtgtcaggtttgcggaaaggccttttcacaatcatcaaacttgattactcattcccgtaagcatacaggatttaaacccttttcctgtgagctttgcaccaaagggtttcagcgaaaagtagacctgaggagacatcgcgagtcccagcacaacctgaagtag

SEQ ID NO: 119127 - DNA, 855 bp, Artificial Sequence
  Description of Artificial Sequence: Synthetic coding sequence
atgccccgctccttcctggttaagtctaagaaagcccacacataccaccagccaagagtgcaggaagacgagccactgtggccgccagctctgacgcctgtccctagggaccaggccccttcgaacagcccggtgctatcaacactgtttccaaaccagtgtcttgattggacaaatttaaaacgggagcctgagctggaacaggaccagaatttagcgaggatggcccctgcacctgagggccccatcgtgctttctcggcctcaggatggcgattcacccctgtctgactctccacccttctacaaaccctctttctcatgggacacattggccaccacttacggacactcttacagacaggccccctccactatgcaaagtgcatttcttgagcacagcgtgtccctctatgggagccctttagtgcctagtactgagcctgctctcgacttctccttgcgatactcccccgggatggatgcctatcactgcgtgaagtgcaataaagagcgctcctttgagtgtcgcatgtgcggcaaagcctttaaacgaagctctacattgagcactcacctgttgatccatagtgacacccgcccctatccttgtcagttctgcggaaagcggttccaccaaaaatctgacatgaagaagcatacctacattcacacaggcgagaaaccacacaagtgtcaagtgtgcggtaaggcattctctcagtcaagtaatcttattacccactcccgcaaacacacgggatttaaaccgttttcatgcgagttgtgcaccaaaggttttcagaggaaagttgatcttcggaggcatagagaatcacaacacaacctgaaatag

SEQ ID NO: 119128 - DNA, 855 bp, Artificial Sequence
  Description of Artificial Sequence: Synthetic coding sequence
atgccccggagcttcctcgtcaaaagtaagaaggcccacacctaccatcagccgagggtgcaggaggacgaacctctgtggccacccgctctcacgcctgttcctcgggatcaagcaccaagtaattcccccgtactgagcacactctttcctaatcagtgcctggattggacgaacttgaaaagagaacccgagctggagcaggaccagaatctcgcccggatggcaccggccccagagggaccaattgtcttgagtcgcccgcaggacggggattcccctctctcagattctccgcccttctataagccttcgttttcctgggacactctagcaaccacctatggacacagctaccggcaggctcctagcaccatgcagagcgccttcttggagcattcagttagcctgtacgggtctccactggttccatccaccgaaccggccctcgatttttcactgaggtactcaccggggatggatgcgtaccactgcgttaagtgcaataaagagcgttcttttgaatgtcgcatgtgcggaaaagccttcaagcgcagctctactctgagcacacacctgctcattcatagcgataccagaccctatccttgtcagttctgcggaaaaaggtttcaccagaaaagcgacatgaagaagcacacttatatacacacgggggaaaagccccataaatgtcaggtctgcgggaaagcattttcccagtctagcaacctgattacccacagcaggaagcacactggtttcaagccttttagctgcgaactttgcaccaagggcttccaacggaaggttgatctgcggcgacatagggagtcacaacacaacctcaagtag

SEQ ID NO: 119129 - DNA, 993 bp, Artificial Sequence
  Description of Artificial Sequence: Synthetic coding sequence
atgccccgctcgttccttgtgaagtctaagaaagcccacacctatcatcagccgcgcgtgcaggaggatgagcccctgtggcctcccgccctgaccccagtgccacgcgaccaagccccttcgaacagtcccgtgctgtcgaccctgttccccaaccaatgtctggactggacgaacctgaagcgggagcctgagctggaacaggaccaaaatcttgctcggatggcccccgccccggaaggtccaatcgttctttccagaccccaggacggagatagtccactgtcagactcccccccattctataagccgtcttttagctgggacaccctggctacaacctatggccactcttataggcaggcaccctccaccatgcagtcagccttccttgaacattcagtctctctgtatggatcacctctcgttcccagtaccgagcccgctctagatttttctctgaggtattcacccggcatggatgcctaccattgtgtgaagtgcaacaaggtctttagcactcctcacggcctcgaggtgcacgtgcgcaggtcccactccggtacccgacctttcgcctgcgacatatgtggcaaaactttcggtcacgcagtttcactggagcagcacacccacgtgcattctcaggagcgttctttcgagtgtcgcatgtgtggtaaggcctttaagcggtcatccaccctaagcacccacctcctgatccattccgatacaagaccctatccgtgtcagttttgcggtaaacgattccatcagaagagcgacatgaagaagcacacttatatacacaccggcgaaaagccccacaagtgccaggtgtgcggaaaggcattttcccagtcaagtaacctcattacacacagtcgcaaacatacgggctttaaacccttttcctgcgagctatgtactaaaggcttccagaggaaggtggatttacgcaggcatcgggagagtcagcacaacctcaagtag

SEQ ID NO: 119130 - DNA, 855 bp, Artificial Sequence
  Description of Artificial Sequence: Synthetic coding sequence
atgccccggtccttcttagtgaagtccaagaaggcgcacacctaccaccagcctcgggtccaggaagacgagccactgtggcctcccgccctgaccccagtccctcgagaccaggcacccagtaattcaccagtcctttcgaccctgttcccgaatcagtgccttgactggacaaacctcaaaagggaaccggagttggaacaggaccagaacttggctcggatggcccccgcccctgagggccctatagttctctctcgaccgcaggatggggactcacctctcagtgactcccccccattttataaacccagcttctcctgggataccctcgcaacaacctatggacacagctacaggcaggctcccagtaccatgcagtctgccttcctagagcattcggtatcattgtatggatcccccctcgtgccctcaaccgagccggccctggatttttccctccggtattctccaggaatggatgcctatcactgcgttaagtgtaacaaagagcgcagctttgaatgcaggatgtgcggcaaagccttcaaacgctctagtacattatccacccacctgctgatccacagcgatacgaggccttacccttgtcaattctgcggaaagaggttccatcagaagtctgacatgaaaaagcatacttatatccatactggggagaagccccacaagtgccaggtctgcggtaaggcctttagtcagtcctccaatctgataactcactcgaggaaacacaccggtttcaaacccttttcctgtgagctgtgcactaagggattccagcgcaaggtggatctccgcaggcaccgagagagccaacacaatctgaagtag

SEQ ID NO: 119131 - DNA, 1623 bp, Artificial Sequence
  Description of Artificial Sequence: Synthetic coding sequence
atgaccacaagccttcaagatggccaatccgctgcttcacgcgctgctgctcgcgattccccgttggcggctcaagtgtgcggagctgcccagggccgcggtgatgcccacgacctggcaccagccccatggctccacgctagagcgctattgcctttacctgatggcactcgggggtgtgctgctgatcgcaggaaaaagaaagatcttgacgtgccagagatgcccagtatccctaaccctttccctgagctgtgctgctcacctttcacgtccgtccttagtgctgacctgttcccaaaagccaacagtagaaagaaacaagttattaaagtctactccgaggatgagacatcgcgcgctctggacgtgccctctgatattaccgcccgagatgtttgccagctactcatattaaaaaatcactacatcgatgatcactcatggaccctcttcgagcacctaccacatattggagtcgagaggactatcgaagatcacgaacttgtaattgaagtgttatcgaactggggcattgaggaagagaacaagttgtactttaggaaaaattacgctaagtacgaatttttcaagaacccaatgtacttttttcctgaacatatggtgagctttgcaacagagactaacggagaaatctctccgacccagatcctgcagatgtttctcagttccagcacttatccagaaattcacggatttctgcatgcaaaggagcaaggaaagaagtcttggaagaagatctacttcttcctgaggcgatctggactttacttttctacgaaaggaacctctaaggagccaaggcacctgcaattcttttcagagttcgggaattccgatatctacgtgagtctggctggtaagaaaaaacatggagctcccaccaattatgggttctgtttcaagcccaataaagccgggggccctcgcgatctcaagatgctttgcgccgaagaggagcagagccgcacatgctgggtgacagccatccggctcctgaagtatggtatgcagttgtatcaaaactacatgcatccatatcagggccgctcaggatgctcttcacagtccatttcacctatgcgctctataagcgagaactccctggtagcgatggatttcagcggccagaaaagcagagtgattgagaaccccacagaagcccttagcgtggctgttgaggaaggtctcgcctggagaaaaaagggttgcttgaggctggggactcacgggagccctactgcatcctcacaaagctcggccacaaacatggccattcacagatcacagccatggtttcaccacaagatcagtcgggacgaagcacagcggctaattatccagcaagggctcgtggacggcgttttcctcgtgagggactctcagtccaaccccaagacattcgtcctgtctatgagccatggtcagaaaatcaagcactttcaaatcatccccgtcgaggatgacggagaaatgttccacacgctcgacgatggccatactcggtttactgacctgattcagctggtggagttctatcagctgaataagggcgtgctcccttgtaagctcaaacattactgcgcacgaatagccttgtag

SEQ ID NO: 119132 - DNA, 1362 bp, Artificial Sequence
  Description of Artificial Sequence: Synthetic coding sequence
atgtctttgtcagcaagaagggtaacactgcctgcaattaccccaattatcttacagaagcgggttattaaggtgtactcagaggacgagacaagccgagctctcgacgtgcccagcgacattacagcaagagatgtgtgtcagctccttattttgaagaaccactatattgatgatcattcatggacgctcttcgaacatcttccccatatcggcgtggagaggaccatcgaagaccatgaacttgttatcgaagtcctctcaaattggggcatcgaggaggagaacaaactctactttaggaagaattacgctaagtatgaatttttcaaaaatccaatgtacttttttccagagcacatggtttcctttgcaaccgagactaacggagagatctccccaactcagatcttgcagatgtttttgtcctcatcgacctaccctgagatacacgggttcctgcacgccaaagaacagggcaagaaatcctggaagaagatatactttttcctacggcgctccgggctgtacttttcgaccaagggtaccagtaaggaaccacgccatctgcagttcttttcagaatttggtaattcggacatatacgtgtctttggccggaaaaaagaaacatggagcacctactaattacgggttctgcttcaagccaaacaaagctgggggcccacgggatctcaaaatgttgtgcgcggaagaagagcagtcaaggacctgctgggttacggccatccggctcttgaaatacggcatgcagttgtaccagaattacatgcacccttaccagggacggtccggatgctcctcccagtccatcagccccatgcggagtatctccgagaactccctggtggcaatggacttctcaggtcagaagagccgcgtcatagagaatcctaccgaggccctatcggtcgctgttgaagagggtctcgcttggcggaaaaagggatgcttgcggcttggaacccacggctcccccacggcctccagtcagagctcagctactaatatggctatccacagaagtcaaccttggttccaccacaaaattagcagggatgaggctcagaggcttatcatacaacagggcctggtggacggtgtgtttttagtgcgcgattcccagtcgaaccccaaaacattcgtgctgagcatgagccatgggcagaagattaagcacttccagataatccctgtggaggacgatggcgaaatgttccacactctcgacgacggacatactcgttttacagatttgattcagttggtggagttctatcagcttaacaagggtgtgctgccttgtaagctgaagcattactgcgcccgaatcgcactgtag

SEQ ID NO: 119133 - DNA, 1599 bp, Artificial Sequence
  Description of Artificial Sequence: Synthetic coding sequence
atggagttagacctgtcacctcctcatctgagctcttcccctgaagacttgtgtccagcacccggcaccccccccgggactcccagacctccagatacgccactccctgaagaggtcaagcgcagccagccattgctgatacccactacagggcgaaaactgcgagaggaagagaggagagctacgagtctcccctccatccccaaccctttccccgagctctgttctccgccctcacagagccctatattaggtgggccaagctccgctaggggcctgttacctcgagacgcaagccggccacacgtcgtgaaggtgtactccgaagacggggcttgcagaagtgttgaagtggcggctggcgctactgctagacatgtatgcgaaatgctggtccaaagggcccacgcgctgtcggatgaaacgtgggggttagtagaatgtcatccacatcttgctctggaaagaggccttgaggatcatgaaagtgttgtggaagtccaggcagcatggcctgtgggcggcgacagtagattcgtgttccgcaagaacttcgctaagtacgagctgtttaagtcaagtcctcacagcctcttccctgagaagatggtctctagctgcctggacgcgcacactgggatcagtcacgaagacctgatccaaaactttctaaatgctggcagtttccctgagattcaggggttcctgcagcttcggggatcagggagaaaattatggaaacgattcttctgtttcttacgcaggagcggtctttattactctacgaagggaactagcaaggacccccggcatctccagtatgtggccgacgtcaatgaaagtaatgtgtatgtagtcactcagggccggaagctgtatggaatgcccacagacttcgggttttgtgtaaagcccaataagctgcgcaacggacacaagggacttagaattttctgctccgaagacgaacagtctaggacatgctggcttgccgcgtttcggctcttcaaatacggagtgcaattatataaaaactatcagcaggcccagagccgccacctgcacccctcctgcttagggagcccaccattgcgaagcgcatccgacaacactcttgtagcaatggacttttctgggcacgccggacgcgtcattgagaatccgcgggaagccctctctgtggctctggaggaagctcaagcttggcggaaaaaaactaatcacagactctcactgcccatgccagccagtggcacgtcattgtctgcagcaatccacaggactcagctgtggtttcacgggcgcatttctcgtgaggagagtcagcgactgatcggacagcagggcctggtggatggcctgtttctagtgagagaaagtcagcggaacccacagggatttgtgctatcactgtgccatttacagaaggtgaaacattacctgatccttccgagtgaggaagaaggtagactgtacttcagcatggatgacggtcaaacccgattcacggatctgctccaactcgttgagtttcatcagttaaaccgggggattctgccatgccttcttcgccactgttgtactagagtagcattgtag

SEQ ID NO: 119134 - DNA, 1344 bp, Artificial Sequence
  Description of Artificial Sequence: Synthetic coding sequence
atggagctcgacctgtcgccaccccacctctccagctccccagaggacctctgcccagcccccggaacaccccccggcacgcctcgaccgcccgacactccactgccagaagaggtcaaaaggagtcagcctctcctgattcctactaccggccgaaagttgcgagaggaagaacgccgcgcgacgtcccttccgtcgatcccaaaccctttcccagagctgtgttccccaccttctcagtctcctatactgggaggaccatcctcagcacggggcctgctgccccgagacgcctctagaccccatgtggtgaaggtgtatagcgaagatggcgcctgcagatccgtggaggtcgccgctggcgctaccgcccgacacgtttgtgaaatgctcgtgcagcgggcacatgccctctcagacgaaacttggggattagtcgaatgccatccccaccttgctctggaaagagggttggaggatcacgagtccgtggtggaagtgcaggccgcctggccagtaggaggtgacagtcggttcgtgtttagaaagaatttcgctaaatatgagctattcaagagcagcccgcacagtttatttccagagaaaatggtgagctcatgcttagacgcacatactggcatttcccacgaggacttaatccagaactttctgaacgccggctcatttcccgagatacagggcttcctgcaattgagagggagcgggcggaagctgtggaagagattcttctgcttcttgcgccgctccggactgtactacagtactaaggggaccagcaaggaccccagacatctgcaatacgtggcggatgttaatgagtccaatgtgtacgtggtgactcaaggtcgaaaattatacggaatgcctacagactttggcttctgcgtcaagcctaataagctcaggaacgggcataaaggtctgcggatcttctgttccgaagatgagcaaagccgcacttgttggcttgctgcttttcggttgtttaagtatggcgtccagttgtacaaaaactatcagcaggcccagtcccgtcacctgcacccttcatgcctagggtcccccccactgaggagcgcctctgataacaccctcgtcgcgatggacttcagtggtcacgcgggcagggtgatcgaaaatccccgtgaagccctctcagtcgccctcgaagaagcacaggcttggcggaaaaagactaatcaccgactctctctaccaatgccagcctctggtactagtttgtcagctgcatgcagctggtcaggacgggtttccggcacccctcgggcattatccagtctttgcgcaacgtgccgcaagtag

SEQ ID NO: 119135 - DNA, 1344 bp, Artificial Sequence
  Description of Artificial Sequence: Synthetic coding sequence
atggaacttgacctgagtccacctcacctttccagctctccagaggatctttgccctgcacctggtaccccacccggcactccaaggcccccggacacccccttgcccgaggaggtgaagaggagccaaccattgctcatcccaactactgggcgtaagcttagggaggaggagaggcgggcgaccagcctaccttcaataccgaaccctttccccgaactgtgcagcccaccctcccagtcccctatcctggggggccctagttccgccaggggtctgctccctagagatgcttccaggccccatgtagttaaagtctatagcgaggacggcgcatgtcgctccgtggaggtggctgccggcgctacagcgcggcacgtgtgtgagatgctggtgcaacgcgcacatgctctgtcggacgagacctggggcctggtggaatgtcacccacatctcgcacttgagagagggctcgaggaccacgagtccgtcgtggaagtccaagccgcatggcccgtggggggggacagccgtttcgtcttcagaaagaatttcgccaagtacgaactgtttaagagctcgcctcactctttgttccccgaaaaaatggtcagttcttgcctggacgcccacaccggcatatctcacgaagacctcatccagaacttcctgaatgctggctcctttcctgaaattcagggattcttgcagctgcggggtagtggcagaaaactctggaagaggttcttttgctttttaaggcgctctggtctgtattattcaacaaaaggcacctccaaggatccccggcacctccagtacgtagcagacgtgaacgaatcaaatgtttacgtggtgacacagggaagaaaactttatgggatgcctaccgatttcgggttctgtgtgaaacccaacaaactgcggaacggccataagggcctgaggatcttctgttcggaagatgagcagagccgcacgtgctggctagctgcttttagactctttaagtatggcgtgcaactctacaagaattaccagcaggcccagagtagacatctgcatcctagctgtctcggctctccccctctgcgctctgccagtgataacactctggtggctatggatttttccggtcatgccggtagggtgatcgaaaacccccgtgaggcactgtcagtcgccctcgaggaggcgcaggcttggaggaaaaaaacaaaccaccgcctgagcttgccaatgcccgcaagtggtacttcattgtccgccgcatgttcttggagcgggagggtgagtggaactccacgcgcgctcagtagcctttgtgcgacttgtcgtaagtag

SEQ ID NO: 119136 - DNA, 1599 bp, Artificial Sequence
  Description of Artificial Sequence: Synthetic coding sequence
atggaactggatttgagtccgccccatctttcctcctcgcccgaagacctctgtccagcaccgggtaccccccccggcacccctaggccgccagacactcctttgcccgaggaggtgaaacgatcacagccactcctgattcccactactggcagaaaactgcgggaggaggaaaggagggcaacgtcccttccttcgattccaaatcctttccccgaactttgtagtcctccttctcaatccccaatcctcgggggtcctagctcagcgaggggccttctgcctcgggacgccagccggcctcacgtggttaaagtttatagtgaggatggcgcgtgcagaagtgtagaggtggctgccggcgctaccgcgaggcacgtgtgtgagatgctcgtccagcgggcccacgctctgtctgacgagacctggggactggttgaatgccacccacacttagctctggagagaggcctggaagaccacgaatcagtcgtcgaagtgcaggctgcctggcctgtgggcggcgattcccgttttgtgtttcgtaagaactttgctaaatatgagctgtttaaaagcagcccccactcactgtttccggagaagatggtgtcctcctgtctggacgcccacactggaatcagtcatgaggacctcatccaaaattttctgaatgcaggaagctttcctgagatccaagggtttctacaattgagaggttctgggcggaagctctggaagcgcttcttttgcttcttgcggaggtccggcctctactattctactaaggggacttctaaagatccgaggcacctacagtatgtggccgatgttaacgagagcaacgtatacgttgttacccaaggaaggaaactctacggtatgcctaccgactttggtttctgcgtcaagcccaacaaactgagaaacgggcacaaggggctcagaattttctgctcagaagatgaacagagccggacgtgttggctggcagcattcaggcttttcaaatatggcgtgcagttgtacaagaattaccagcaagcccagagccgccatttacatccctcctgcttggggagccctccccttaggtctgccagcgataacacccttgtcgccatggacttttccggccacgcaggcagggttattgaaaatccccgcgaagcactgtccgtcgcgttagaggaagcacaggcttggagaaaaaagacaaaccaccgccttagtctacctatgcctgcttcaggaaccagcttgagtgcggccatccacaggacccagctctggttccatggcaggattagtcgtgaggagagccaacgcttgatcggtcagcagggcctggtggacgggctctttctcgtccgcgagtcacagagaaatccgcaaggctttgttctaagtctgtgtcacttacaaaaggttaagcactacctcattctcccttcagaggaggagggacgcctctatttttccatggatgatggacagactaggtttacagatcttctgcagttggtagagttccaccagctcaataggggaattctcccttgcctcctgaggcattgttgtacaagggtggccctctag

SEQ ID NO: 119137 - DNA, 1599 bp, Artificial Sequence
  Description of Artificial Sequence: Synthetic coding sequence
atggaactggacctgagtccaccacatctctccagctctcctgaagacctgtgccctgcaccaggtacccccccagggacccctaggccacccgacacgccgctacccgaggaggtaaaacgttctcagccgctgttgattcccaccactgggcgcaaactgagggaggaagagagacgggccacctctttgccctcaatccccaatcccttcccagaactctgctctccacctagtcagtcccccattttagggggaccatctagcgcccgaggactccttcccagggacgctagtcgaccccacgttgtaaaggtctacagcgaggacggcgcttgccgaagcgtagaggttgccgcaggcgccacagcccgtcacgtttgcgagatgttagtacaaagggcgcatgccctttctgacgaaacctggggcttagtcgaatgtcaccctcacctggctctcgaacggggcttggaagatcacgaatctgtcgtagaggtgcaggccgcttggcctgtcggcggtgattcgaggttcgttttccgcaaaaatttcgctaaatacgaactcttcaagtcatcgccccattcactatttcccgaaaagatggtatcatcctgtcttgacgcccacaccggtatttctcatgaggatttaatacagaacttcttaaacgctggctctttcccagagattcaaggattcctgcagttacgcggcagcgggagaaaactttggaagaggtttttctgtttcctgcgccgctcagggctctattatagcactaaggggacttcaaaggaccctcgccacctgcaatatgtggccgatgtgaacgaatcaaatgtctacgtggtcacccagggcagaaaactgtatgggatgccaaccgactttggcttttgcgttaagccaaataagttacggaacggtcacaaaggtctgcgtattttttgctccgaagatgagcagtctaggacatgttggctcgccgcctttcgactttttaagtatggtgtgcagctttataaaaattaccagcaggcccagtcccgccatctgcatccctcatgtctgggatccccaccactgagatctgcaagtgacaacacactggttgcgatggacttcagcgggcatgcaggccgagtgattgagaaccccagagaagcattatctgtggctctggaggaggcacaggcttggaggaaaaagaccaatcatcgcctgtcgctaccgatgccggcctctggaacatctctgagcgccgccattcacagaacacagctctggtttcatggacgaataagtcgggaggagagtcagcgcttaattgggcagcaagggttggtggacggcttattcctcgtgagggagagccagagaaacccccaggggttcgtacttagcctctgccaccttcagaaagtcaagcactacctgatcctcccctccgaggaggaaggccgtttgtatttctcaatggacgacggccagaccagatttacggacctgctacagttggtagagttccatcaactcaaccgcggtatcctaccgtgtctgctgaggcattgctgcacacgcgtcgcactctag

SEQ ID NO: 119138 - DNA, 1668 bp, Artificial Sequence
  Description of Artificial Sequence: Synthetic coding sequence
atgggcaagtggcgtccagggcagggtcacacaacgggaagtgtgaaacctctctcgtgctccgacgcaatggaactagatttgagcccaccacacctgtctagtagtcctgaagacttatgtcctgcacccggtactccaccgggaacccctcggccacccgatacccctctccccgaggaagttaaaagatcccaaccattgctgatcccaaccaccggccgtaaactccgcgaagaggaaaggagagcaacttccctgccctcgataccaaatcccttccccgagctctgctcaccccctagtcagagccccatcttgggcggtcctagttcggcaagggggctccttcctcgggacgcctcaaggccacacgttgttaaggtatactctgaagatggcgcgtgtcggagcgttgaagttgccgccggtgccacagcccgccatgtctgtgaaatgcttgttcagagagcgcacgcgctctccgacgagacttggggcctggtcgagtgtcatccacacctggcgctcgagcgcggcttggaagaccatgagtctgtcgtggaggttcaggccgcctggcctgttggtggggatagccgttttgtgtttaggaaaaattttgcgaaatacgagttgttcaaaagttccccacatagcctgttccccgagaaaatggtgagctcatgtctcgacgcccatacaggtatcagtcatgaggatttgatccaaaattttctgaatgcggggagttttccagaaattcagggctttctgcagctcagggggtcagggcgaaaactgtggaagcgattcttctgctttctgcggcggtctggcctgtattactcgacaaaagggacaagcaaagaccccaggcatctgcagtacgttgcggatgtgaatgaaagcaatgtctatgttgtgacccaaggccgcaaactatacggcatgcctaccgacttcgggttttgtgtgaagccgaacaaactccggaacggccacaaaggtctcagaatcttttgttccgaggatgagcagtcacgcacctgctggcttgcagcgtttaggttgtttaagtacggggtgcagctgtataaaaattaccagcaggcccagtctcgacacttgcacccctcctgcttgggctccccgccactgcgttccgcatccgataatacactggttgcaatggacttttccgggcacgcaggcagagttatcgagaacccccgcgaagctctatcagttgcccttgaagaagcccaggcatggcgcaaaaagactaatcaccgattatctcttccgatgcctgcgagcggcacctctctctccgcggccattcacaggacccagctgtggtttcatggccgcataagcagagaagagtctcagcggctcattgggcagcagggtctagtagacggcctgttcctagttagggagtcccagcgcaatcctcagggtttcgtcctgtctttatgccacctccagaaagtaaagcactacttgattttaccctccgaagaagaaggcaggctctatttttctatggacgatggccagacaagatttacagatctccttcagcttgtggagttccaccagctgaaccgcgggatactaccctgcctcttaaggcactgctgtacgcgcgtggccctgtag

SEQ ID NO: 119139 - DNA, 618 bp, Artificial Sequence
  Description of Artificial Sequence: Synthetic coding sequence
atggctgctcctggggaaaggggccgtttccacggcggtaatttgttcttcctgccaggcggcgcaaggtctgagatgatggatgatctggccactgacgctcggggacgcggtgcaggaagacgtgacgcagccgccagcgcctctactcctgcgcaggctcccacctcagactctcctgtcgccgaggacgcatctcgccgaagaccctgtagagcttgcgtggatttcaagacctggatgaggacacagcagaaacgagacactaagttccgggaggactgtccgcctgacagggaggaattgggtcggcattcatgggctgtgctgcacacactcgcggcctattacccggaccttcctacgcccgagcagcagcaggacatggcgcagtttattcacttgttttcgaaattttacccatgcgaagaatgtgctgaggatctgagaaagcgcctgtgccgaaaccaccccgacacgcgtacccgtgcatgcttcacccaatggctgtgccatcttcacaatgaagtgaatcgaaaacttggcaaacccgattttgactgtagcaaggtagatgaacggtggcgggatggctggaaagatgggtcgtgcgactag

SEQ ID NO: 119140 - DNA, 285 bp, Artificial Sequence
  Description of Artificial Sequence: Synthetic coding sequence
atgcgcacccagcagaagcgagacactaaattcagagaagattgtccccctgatcgcgaagaactgggaaggcattcatgggccgtgctacacacactggccgcatattaccccgacctgcctacgccagagcagcaacaagatatggctcagtttattcacctgttcagcaagttttatccttgtgaagagtgcgcagaggatctgaggaagagactgtgtcggaatcatcctgacacccgcacacgagcttgcttcaccgtggcggtcccccccgcccagtag

SEQ ID NO: 119141 - DNA, 1629 bp, Artificial Sequence
  Description of Artificial Sequence: Synthetic coding sequence
atgagcccctgtccagaagaggccgcaatgcgccgggaggtagtgaagagaatagaaacagtcgtcaaagacctatggcccacggctgatgttcagattttcgggtcattttccacaggcctgtatctgccaacctctgacatagatttggttgttttcggcaagtgggaacgcccacccctccaactgctggagcaggcactgcgaaagcacaacgtggccgagccctgctcaataaaggtgctcgacaaagctaccgttccaataattaagctgactgaccaagaaacagaggtaaaagttgatatctctttcaacatggaaacaggagtccgcgcggcggagttcatcaagaactatatgaagaaatattccctccttccttacctcatcttggtactcaagcagttcctgctccagagggaccttaatgaagtctttaccggcggcatttcttcttatagtcttatattgatggcgataagttttttgcaactgcatccccgcatcgacgcccgcagggccgacgaaaacctcgggatgctgttggtggagtttttcgagctgtatgggaggaattttaactacctgaaaactggaattcggataaaggaaggaggggcatacatcgctaaggaggaaattatgaaggcaatgacatcagggtacaggcccagcatgttgtgcattgaagatcctttgctgcctggaaatgacgtggggagaagctcttatggcgctatgcaggttaagcaagtgttcgattatgcatacatagtcctgtctcatgctgtgtcgcccttggcccgctcatatccaaaccgcgatgccgagagtaccctcggacgcatcatcaaggtgactcaggaggtgatcgactaccggagatggatcaaagaaaagtggggtagcaaggcccatccttccccaggaatggatagccggatcaagatcaaagagcgtatagctacgtgtaacggcgaacaaacacagaaccgcgagcctgagtctccttatggccagaggctgacactgtccctgtcttccccccagctgctgagcagtggcagctcggcctcgagcgtaagcagtctgagcgggtccgacgtggatagtgacacacctccatgtactaccccctcagtttaccaattttccttacaagcgcctgcccctctgatggctggcctgccgactgctctcccgatgccttccgggaaaccccagccgacaacgtcgcgtacactcatcatgaccactaataaccaaactaggtttacaatccctcccccaactcttggcgttgctccagtcccatgtagacaggccggagtggaagggaccgcttccctgaaagccgtgcaccacatgtcaagtcctgctatcccctccgcctcacctaatccgctcagctcaccccacttgtaccacaaacagcataacggaatgaagttatctatgaaggggtcgcacggccatacccaagggggagggtacagtagcgttggttcaggaggagtccgaccccctgtggggaaccggggtcaccatcagtataacaggacagggtggcgccggaagaaacatacccatactagggactctttgcctgtatcattgtcccggtag

SEQ ID NO: 119142 - DNA, 885 bp, Artificial Sequence
  Description of Artificial Sequence: Synthetic coding sequence
atggacctatggcagctactcctgactttagcactggccggcagttccgatgcattttccggatccgaggcgaccgcagctatcttatctagggctccatggtccctccaatccgtcaatcctggcctcaaaactaatagtagtaaagagcctaagtttacaaaatgtcggtcgccagagcgcgagactttctcttgtcactggaccgacgaggttcatcacggcacaaaaaatcttggcccaatccagctgttttacacccggcggaatacccaggagtggacccaggagtggaaagagtgtcccgactacgtgtcagcaggggagaatagctgttactttaattcatcgttcacttctatctggatcccttactgcatcaaactgactagtaatggtggtaccgttgacgaaaagtgtttttcggttgatgagatcgtgcagccagatcctcccatcgctttaaattggaccctgttaaatgtgtcccttacaggtattcacgccgatattcaggtgaggtgggaggcgcccaggaatgccgacatccagaaagggtggatggtccttgagtatgagctccagtacaaggaagtaaatgaaaccaaatggaagatgatggatcccattctgaccacttccgtgcccgtatactccctgaaggtggacaaggagtacgaggtgagagtgcgaagtaaacagcgaaacagcggcaactacggcgaattcagcgaggtcttatacgttacactccctcagatgtctcagttcacgtgcgaggaggacttttacttcccctggttgctcatcataatttttggtattttcggcctgacagtgatgctcttcgtgttcctgtttagtaaacagcagagccaaaactag

SEQ ID NO: 119143 - DNA, 1851 bp, Artificial Sequence
  Description of Artificial Sequence: Synthetic coding sequence
atggatctttggcagctcctgctcaccttagccctcgccggaagctcagacgccttttccgggtcggaagattcttcaaaagaacctaaattcactaagtgccgctcccctgagagagaaacctttagctgtcactggacagacgaggtgcaccacggaacgaaaaatcttggacctatacagcttttttacactcgtcggaatacccaggagtggacccaggagtggaaggagtgtcccgattatgtgtctgcaggcgagaatagttgctacttcaattcgtccttcacgagcatttggataccctactgtattaagctcacaagcaacggcggtactgtggatgagaagtgcttctcggtggacgaaatcgtacagcctgatccgccaatcgctctgaattggactctcttaaacgtcagccttacggggatacatgcagacattcaggtccgctgggaagctccgagaaatgccgacatccaaaagggatggatggtactagaatacgagctgcagtacaaggaggttaacgagaccaagtggaagatgatggatccgatacttaccacaagcgtccctgtgtattcactgaaggtcgataaagaatacgaggtgcgcgtgcgaagcaaacaaagaaactccggaaactacggcgagtttagcgaggtactgtatgttaccctgcctcagatgtcacaatttacttgcgaagaggacttttactttccctggctgttgataattattttcggcatatttggtcttacggtaatgctgtttgtgtttctgttcagtaaacagcagcgtattaaaatgctcattctgcccccagttccagtgccgaaaattaaaggaatcgatccagacctcctgaaagagggaaagctggaggaagtgaatactatcctggctatccatgactcatacaaacctgaatttcatagcgacgacagttgggttgagtttattgagctggacatcgatgaacccgacgagaagaccgaagagagcgatacagaccgcttactctccagtgatcacgagaagagtcactctaacctcggggtaaaagatggcgactcgggcagaacgagctgctgcgaacccgacatactagagaccgatttcaacgccaatgacattcacgaggggacctctgaggtcgcccaaccacagaggctcaagggagaagctgacctgctgtgcctcgatcagaagaatcagaacaattcaccctaccatgatgcctgtcccgcgacccagcagccatccgtgattcaggcggagaagaacaaaccgcagcctctccccaccgagggagccgagtccacccaccaggccgcacatatccagttatccaaccctagttccctatctaatattgatttctatgcccaagtcagcgacattacacctgccggatctgtagttctttcccctggacagaaaaacaaagctggtatgtcccagtgtgatatgcatcccgagatggtgtctttgtgtcaagaaaactttctcatggacaatgcatatttttgcgaagcagatgctaagaagtgcatacctgtcgctccacacattaaggtggagtcacacattcaaccgagtctgaaccaggaggatatatatatcactacagagtcattaaccacagccgccggccggcccgggacaggagagcatgtaccgggatccgaaatgcccgttcccgactacacttccattcatattgtacagagtccccagggactcattttgaacgctacggctctgcccctgcccgataaggaattcctcagcagctgcggctacgtgtctacagaccaattgaataagattatgccatag

SEQ ID NO: 119144 - DNA, 1356 bp, Artificial Sequence
  Description of Artificial Sequence: Synthetic coding sequence
atggtgttggagtatgaactccagtataaagaagtgaacgaaactaaatggaaaatgatggatcctatcttgactactagcgtgcccgtttactctctgaaagttgacaaagaatatgaggtacgcgtgcgcagcaaacagcgcaatagtggcaactacggcgaatttagcgaggtattatacgtcacactgccccagatgtctcaattcacctgcgaggaggacttctattttccttggctactcatcattattttcggaatttttgggttgaccgtcatgctgttcgtgttcctgtttagcaagcagcagcgcataaagatgctgattctgccccctgtaccagtgcccaagatcaagggaatcgatccggacctgctgaaagaggggaagctggaggaagtgaatactatcctggcgatccatgactcttataagcccgaattccactccgacgattcttgggtcgagttcatagaactggacattgatgaacctgatgagaaaactgaagaaagcgacaccgaccgcctcttgtcatccgatcatgaaaagtcacattccaacttgggagtcaaggatggggactcgggaaggacgagttgttgcgaacctgatatcctcgagacggactttaacgctaatgacatccatgagggaaccagcgaggtggcacagccacaacggctaaagggtgaggctgacctgctgtgtctagaccagaagaatcagaataactctccttaccacgatgcatgcccagccacccagcaaccatctgttattcaagctgagaaaaacaaaccccagcccctcccgactgagggcgcagagtcaacccatcaggccgcgcacattcagttgtccaatcccagtagtctgagcaatatcgacttctacgctcaagtaagcgatattacaccagctggctctgttgtactttctccaggtcagaagaataaggcaggaatgtcacaatgcgatatgcatcctgagatggtttccctgtgccaggagaatttcctgatggacaacgcctacttctgtgaggcggatgccaagaagtgtatcccagttgcaccgcatatcaaggtggagagccacattcagcctagcctcaaccaagaagacatttatatcaccacagagtctctaaccaccgccgctgggcgacctggaacaggagagcacgtgcccggaagtgagatgcctgtccctgactacacttccatccacattgtacaaagtcctcagggcttaatcttgaacgctaccgccttgccattaccagataaggagttcttgagctcctgcggatacgtgtccactgatcagctgaataaaatcatgccgtag

SEQ ID NO: 119145 - DNA, 327 bp, Artificial Sequence
  Description of Artificial Sequence: Synthetic coding sequence
atgcccttgtgggtgtttttctttgtcattctgaccctcagtaactccagtcactgtagccccccaccgcctctcacgctccggatgagacgctatgccgacgctatatttacaaactcctacagaaaggtcctgggccaactgtccgcccggaagttgttacaggatatcatgagccgccagcagggggagtccaatcaggaacgaggggccagagcacggttggggcggcaggtggattccatgtgggctgagcagaagcagatggaactggagtccattttagtcgctttgttacagaaacatagtaggaatagtcagggatag

SEQ ID NO: 119146 - DNA, 324 bp, Artificial Sequence
  Description of Artificial Sequence: Synthetic coding sequence
atgccattgtgggtgtttttctttgttatcctgaccctttccaattcatctcactgctcaccacctcctccactcacactccgtatgagaaggtatgcagacgcaatctttacaaactcatatcgaaaggtgctaggacaactgtccgcccgcaagttgctacaggatattatgtctagacagcagggcgaaagcaaccaggaacgcggcgctcgtgcgagacttggcagacaagtggatagtatgtgggccgaacaaaagcagatggagctcgagtctattctggtcgccctcctgcagaaacacagaaactcacaggggtag

SEQ ID NO: 119147 - DNA, 327 bp, Artificial Sequence
  Description of Artificial Sequence: Synthetic coding sequence
atgcctctgtgggtcttcttttttgtgatactgacactctccaatagtagccactgctccccgccccctcccctgactttgaggatgcggagatacgcggacgctatcttcactaactcatatagaaaggttttgggccagctgagcgcacggaagctgttgcaggacattatgagcaggcagcagggagaaagtaatcaggagagaggcgcaagagcccgtctcggcagacaagtagactcaatgtgggccgagcagaagcagatggaactcgagagcatactggttgccctgctgcagaaacattctaggaattctcagggctag

SEQ ID NO: 119148 - DNA, 1272 bp, Artificial Sequence
  Description of Artificial Sequence: Synthetic coding sequence
atggataggcgaatgtggggcgcacacgtcttctgcgtgctctcacctcttccaacggtactggggcacatgcaccccgagtgtgattttatcacccagttaagagaagacgaatcagcctgtctgcaagccgcagaagagatgcctaataccaccctggggtgtcctgccacctgggatggcctcctgtgctggcctaccgctggctctggagaatgggtcaccctgccttgccccgatttcttttcacatttttcttccgagtccggcgctgtaaagagagactgcaccattactgggtggtcagaacccttccctccctatcctgtagcttgccccgttccccttgaactgctcgccgaagaggaatcctattttagcacagtgaagattatttacaccgtcggtcattcaatctccatcgtggctcttttcgtagctataactattctggtggccctgcgccgtctccactgtcccaggaactacgtgcacacccagctgtttaccaccttcatccttaaggcaggcgctgtgttcttaaaggatgctgccctattccattcagatgacacagaccactgcagtttctcaaccgtcctgtgtaaagtctccgtcgccgcatctcacttcgcaaccatgaccaatttctcatggctgctggcagaagcagtatatctcaattgcctgctcgctagcacaagtcctagctcacgacgagccttctggtggctggtgctcgccgggtggggcctgcccgtattgttcacaggtacatgggttagctgcaaacttgcatttgaagacatagcatgctgggatcttgatgatacaagcccctattggtggatcatcaagggccccatcgttctgtccgtgggcgtaaactttggcctgttccttaacattatacggattcttgtgagaaaacttgagcctgctcaaggttcactgcacacacagagtcaatattggagactgtcaaaatctacactcttcctcataccccttttcggaatccattatatcatattcaattttctgccggataatgccggccttggcattaggctgcctctggagctcgggcttggttcgtttcagggcttcattgtagctatcttgtattgtttcctgaaccaggaggttcgtacagagatctctcggaagtggcatggacacgatcctgaattactgccagcatggcgaaccagagcaaagtggacgaccccttcacggtctgccgccaaagtcctaacctctatgtgctag

SEQ ID NO: 119149 - DNA, 207 bp, Artificial Sequence
  Description of Artificial Sequence: Synthetic coding sequence
atggtccccggcacgccttcccccctgttggggcgaggcaaagagctgtggctggaatccctggcttgccttcctggcgcagttaagagggattgcactatcacaggttggtctgaaccctttcctccttaccccgtcgcatgtccagtgccccttgaattgctggctgaagagggctgcccgtgctcgtcattagccaggggatag

SEQ ID NO: 119150 - DNA, 438 bp, Artificial Sequence
  Description of Artificial Sequence: Synthetic coding sequence
atggttccaggaacgccctcccccctgctaggccgcggcaaggagctttggcttgagagtctggcatgtctgcctggtgctgttaagcgggattgcacaatcacaggatggagtgagccgttccctccctatcctgtggcatgcccagtccccctggaacttctagccgaggaagaaagttatttcagcaccgtgaagatcatatatacagtgggacattcaatctccatcgtggcactctttgtggccatcaccatcttggttgccctgaggcgcctacactgtccgcgcaattacgtccatactcaattattcacaacctttatccttaaagccggagctgtgtttctcaaggacgcggctttattccattctgacgacacggaccactgttctttcagtaccggttgcccctgctcctcccttgctcgaggctag

SEQ ID NO: 119151 - DNA, 456 bp, Artificial Sequence
  Description of Artificial Sequence: Synthetic coding sequence
atgcttccattcagtaccgccaccactttaaccaccgcagcctcgcccctcgccgccagggcccttcactggcatgtgggcgaactgcagacgggcctgagggggcatcgcgtgcttggccccggccgacatctgcctttgttagtcgatcatcagcgcgctcactgccctttggggaggggggagctctgggcttttagccagtactatccccaccccggggaggagaccggggcttcgagcggccagcctccgtaccccgtgtccgtactggcatccctgcaggttgatacattccccgatcccactctgtggaattccctacaccatctgcaactgccggcacggcaatgttggcctggtcatccgcccccaccaggagcaggaacgggatttctgcctggcctgcattgctgccaccccttgcttctgccacagcccaggggtgaggattag

SEQ ID NO: 119152 - DNA, 1080 bp, Artificial Sequence
  Description of Artificial Sequence: Synthetic coding sequence
atggtccctggcacaccctcccccctgctggggcgaggaaaagaattgtggctggaatcacttgcctgcctccccggggcggtcaagcgggactgcaccatcaccggttggtctgagccattccccccgtaccccgtcgcatgcccagttccattggaacttctggcagaggaggaatcttatttctctacggttaagataatatacaccgtggggcatagcatatcaatagttgcactattcgtggcaatcacaatcttagtggcactcaggcggctccactgccctcggaattacgtacatacccaattattcaccaccttcatccttaaagccggtgccgtgtttctgaaagacgcagccctgtttcatagcgacgatacagaccactgctccttttccactgtactgtgcaaagtaagtgtcgccgcctcacacttcgctacgatgactaatttcagttggctcctagctgaagctgtgtacttaaactgtctgctggcatctacttctcctagctctaggagagccttctggtggctggtgctcgccgggtggggccttcctgttctgtttaccggaacgtgggtttcctgcaaacttgcctttgaggatattgcatgctgggacttggacgataccagcccatactggtggattatcaagggccccattgttttaagcgtcggcgttaatttcgggttattccttaacattattcgcattctcgtaagaaagctagagcccgctcaggggtcccttcacactcagtcacaatattggcggctgtctaagagcacactcttcctgatccccttgtttgggattcattatatcatcttcaatttcttgcccgacaacgctggcctcggtatccggttgcccctggaactgggcctcggaagctttcaaggctttatcgtcgctattctctactgtttccttaaccaggaagtgagaacagagattagtaggaaatggcatggtcacgatccagagttgctccctgcatggaggactcgagcaaagtggaccaccccatctaggagcgccgctaaggtactcacaagtatgtgttag

SEQ ID NO: 119153 - DNA, 1101 bp, Artificial Sequence
  Description of Artificial Sequence: Synthetic coding sequence
atgtggaacgcaacccctagcgaagagcccggcttcaacctcaccctggcagacctagattgggacgcttcgccaggtaatgatagcctgggagacgagctcttgcagctattccctgccccccttcttgccggcgtaactgctacatgcgtcgcattgtttgttgtaggcatcgccggtaatctgcttaccatgctggtagtatctcgctttagggaactgcgcactacgactaatctttacctgtctagtatggcttttagcgacttattaattttcctttgtatgcctctggatcttgtgaggctatggcaataccgtccctggaattttggtgacttactgtgtaagttgttccagtttgtgagcgagtcctgtacctatgcaaccgtgctgacaattacggcgttatccgtggagagatactttgcaatttgttttcctttgagagcaaaggtcgtggtgactaaaggcagggttaaactggttatttttgtgatctgggccgtggccttttgttcagcaggtcctatattcgtcctggtgggagttgagcacgagaacggtacggatccatgggacacgaatgagtgcagaccaacagaattcgccgtgagaagtggcctgctcacggtcatggtctgggttagtagtattttcttcttcctgcctgttttttgcctgacggtgctatacagcctgattggtaggaaactctggaggaggcgacgaggtgatgccgtcgtgggtgcttccctgagagatcaaaaccataaacagaccgtgaaaatgctggcagtggtcgtgtttgcgttcatcctgtgttggctgccattccacgtaggacggtatctgttctctaaatccttcgaacctggcagtcttgagattgctcagatcagccagtattgcaatctggtctcctttgtgctcttttacctgtccgctgccattaatccaatcctctataacatcatgtctaagaagtaccgggtcgcagtctttagattgctgggttttgaaccctttagccagcgcaaattaagtactctgaaagatgaatcctctcgcgcttggaccgaaagctctattaatacttag

SEQ ID NO: 119154 - DNA, 870 bp, Artificial Sequence
  Description of Artificial Sequence: Synthetic coding sequence
atgtggaatgccaccccctccgaggagccaggatttaacctcactttggcagacttagactgggatgccagcccgggtaacgattccttgggagatgagctcctgcaattgttccctgccccactactcgctggagtgacagccacttgcgtagcgctcttcgtggtggggatcgctggcaatctattgaccatgttggtagtgtccaggttccgggagttaagaacaaccacgaatctgtatctgtcaagcatggccttttccgatcttcttatcttcttatgcatgcccctcgatctggtaagactttggcagtatagaccctggaattttggcgatttgctgtgtaaactcttccaattcgtctccgagtcctgcacatacgccactgtgcttacaataacagcattaagtgtggaaagatacttcgctatctgcttccctttgagagcaaaggtcgtggtcacgaagggccgcgttaaactggtgatctttgtgatttgggcagtcgccttctgttctgcaggtccaatttttgtcctcgtaggagtggagcacgaaaacggaacagatccatgggatacaaatgagtgtcggcctactgagttcgccgtcagaagtggtttgctcaccgtgatggtgtgggtgagttcaatattctttttcttgcctgtgttttgcttgacggttctctactcactcatcggacgtaaattgtggcgtcgccggaggggtgacgcagtcgttggggcttcactgcgagaccagaatcacaaacagacggtcaagatgctgggcggctcccagcgggccttgagactgagcttggctggacccatcctgtccctctgcctgcttccctccctttag

SEQ ID NO: 119155 - DNA, 666 bp, Artificial Sequence
  Description of Artificial Sequence: Synthetic coding sequence
atggcattcgttaaatcggggtggctcttgcgccagagcacgattctgaagaggtggaaaaagaactggttcgacttgtggtctgatgggcatctcatatactacgacgaccagacccgacagaacattgaggacaaagtacacatgccaatggattgcatcaacattagaacaggacaggaatgccgcgatacgcagcccccggacggcaaaagcaaagactgtatgctgcaaattgtgtgtcgtgatgggaaaaccatcagtctgtgtgccgagagcacagatgattgccttgcctggaagttcaccctccaagactccaggactaatacagcttacgtggggtcggccgttatgaccgatgagactagcgtggtgtcatctccccctccctacacagcctacgcagcccctgccccggaggcatacgggtacggaccctacggcggtgcctatcccccaggcacccaggtcgtgtacgctgccaacggccaagcttatgcagtaccctaccaatacccctatgccggcctgtacgggcagcaacccgcaaaccaagtgatcatcagagagagatacagggacaacgattctgacctggctctgggtatgctggctggcgccgccaccgggatggctctaggctccctgttttgggtcttctag

SEQ ID NO: 119156 - DNA, 1230 bp, Artificial Sequence
  Description of Artificial Sequence: Synthetic coding sequence
atgggtaatagctacgccggccaactaaaaacgacgcgatttgaggaagtcctccacaacagcatcgaagcaagcttacgaagtaacaacctggtgcccaggcctattttttctcaattgtacttggaggcggagcagcaactcgcagcattagaaggcggctcccgggtcgacaacgaggaagaggaggaagagggagaaggcgggctggagactaacgggccaccgaacccctttcagctccaccccctccctgaaggatgctgtaccactgatgggttttgccaggcaggtaaagacctccgcttagtctccataagcaacgagcccatggacgtgcccgccggattcttactcgtcggtgtgaaaagcccttcccttccagaccacctgcttgtatgtgccgtagataagcgtttcttgcccgatgataatggccacaatgctctgctcggattttcaggcaattgtgtggggtgcggtaaaaaaggcttttgttacttcactgagttttcgaaccatattaacctgaagttaactacccaacccaaaaagcagaaacacctgaaatattacctcgtgcgaaacgcgcagggtacgctgactaagggaccgctgatctgttggaaaggtagtgaatttcgctcccgccagatccccgctagcacatgttctagctctctgttccctgcccttgagtcaaccgcagcattcccaagtgagccagttcctggaaccaatcccagcatcctcatgggggcccagcaggcaggtcctgcttctgatcatccttccctgaatgccgcaatgggccccgcagtgtttaatgggaaggattcccctaagtgtcagcagctagctaagaacaacctcctggctctcccacgccctagtgctcttgggattttgagcaacagtgggccacctaaaaaacgtcataagggttggtctcctgaatccccttccgcgcctgatgggggttgtcctcagggtggcggtaatcgtgctaagtacgagagtgctggcatgtcctgtgtcccacaagtgggattggtcggaccggcttcggtcacctttcccgtcgttgctagtggggagcctgtgtccgtgccggataacctgctgaagatttgtaaagcaaaacccgtcatctttaaagttttcgtgaatggagccacccagatggttgctctgggtcccgccgagccggccagccctcggagcctgtag

SEQ ID NO: 119157 - DNA, 1374 bp, Artificial Sequence
  Description of Artificial Sequence: Synthetic coding sequence
atgggaaatagttacgccggtcaacttaagactacgcgcttcgaggaagtcctacacaattcgatcgaggccagcctccgttcaaataatttagtgcctcgtccaatcttttcccagctgtacttagaggccgagcagcagcttgctgccctggagggagggtcccgcgtggataatgaagaagaagaggaagagggcgagggaggactcgaaaccaatggtcctccaaacccttttcaattgcaccccttgccagaaggttgctgcacgacagacgggttctgccaggctggaaaagatcttaggctggtgtctatttcaaatgagcccatggacgtaccagctggtttcctgctggtgggggtcaaatctcccagccttcccgaccacctgctggtgtgcgccgttgacaagcgctttctgcctgatgataacgggcataacgccctgctggggttcagcggcaactgtgtaggctgcggaaaaaagggcttctgttactttaccgagttctctaaccatataaatctgaagttaactacacagcctaagaagcagaagcatctcaagtactatctggtacggaacgcacagggaactcttaccaaaggacctctgatctgttggaagggcagcgaattcaggagccgtcagatcccggcctcgacctgttcctctagtctgttcccggccttggaatctactgctgccttcccctcggagccggtccctggcacaaacccctctattctaatgggagcacaacaggccgggcctgcctctgaccatccttctctgaatgccgcgatgggcccagcagtgttcaacggtaaggattcgcccaaatgccagcagttagcgaagaacaacctgctggctttgccacggccctcggctctgggtatacttagtaatagcggcccacctaaaaagcgacacaaggggtggagtcctgagtcgccctcagcacccgacggaggctgtccccaaggcggcgggaatcgggctaaatatgagtccgccggaatgtcgtgtgtgccccaggtggggctcgtaggccccgcatccgtgacttttcctgttgtggcttccggtgagcctgtgagtgtgcccgataatctgttgaagatctgtaaggccaaaccagttatcttcaaagggcacgggaattttccgtatctgtgcggtaacctcaatgacgtggttgtaagcccccttctctacacatgctaccagaactcccaatctgtttctagggcgtacgaacagtacggcgccagcgccattcaaccaatatctgaagaaatgcagcttctactgacagtgtactatctggtccaactcgcgcaccaaatcagaaaccctgatgtctag

SEQ ID NO: 119158 - DNA, 5850 bp, Artificial Sequence
  Description of Artificial Sequence: Synthetic coding sequence
atgggcaattcttacgctggccaactaaagactactaggttcgaggaggtgctccacaatagcatcgaggctagtctgaggagtaataacctggtgcctagacctatcttttcacagctgtacctcgaggccgaacagcaactggcagctctcgaggggggctccagggtcgacaacgaggaggaggaggaggagggcgaaggaggactggagaccaacgggcctcccaatccgttccagcttcaccccctgccagaagggtgttgcacaaccgacggattttgccaggccggaaaggatctccggctggtgtccatctccaacgagcccatggatgtgcccgctggcttcctgctggtaggagtcaagtctccaagcctccctgatcacctcctcgtatgcgcagtggacaagcgcttcctcccggacgataatggacacaacgccctactgggtttttcagggaattgcgtgggttgcggaaagaagggcttttgctactttaccgaatttagcaatcatatcaaccttaaactcacaactcagcccaaaaagcagaagcacctgaagtattacctggtgcgaaacgcgcaaggaacattaacgaagggacccttgatctgttggaagggatctgagttccgatctaggcagatccccgccagcacctgctcatctagtctgtttcccgcccttgaatccaccgccgcctttcctagcgagccagtacctggcacgaatcctagtattctcatgggcgcacagcaagcagggcctgcctcggaccacccttcactcaacgctgccatgggaccggcagtgttcaatggtaaggacagcccaaagtgccaacagcttgcgaaaaacaatttgcttgcgctgcctcggccttctgcgctgggaatactgagcaactcaggtcctcccaagaaacggcataagggctggagtcccgaatcccctagtgcccccgatggggggtgcccgcagggcggcggaaaccgggcgaagtacgagtcagccggaatgtcttgcgtgccgcaggtaggcctggtggggccggctagtgtcacgttccccgtcgtagcctccggggagcctgtctcagtcccagacaatctgctgaaaatctgtaaagctaagcccgtcatctttaagggtcacgggaactttccctatctgtgcgggaatcttaacgacgtggtagtctcaccattactgtatacatgctatcaaaacagccaatctgtgagccgcgcctacgagcagtacggcgcatctgcaattcagccaatatctgaagagatgcagctacttctaactgtctactatcttgttcagctggccgctgatcaggtgccactgatggaggaccttgagcagatatttctgcggagctggagagaaagccatctaactgaaataaggcagtatcaacaagcccctcctcagccttttccccccgccccttcagccgctgctccagtgacatccgctcagttaccttggctggccagccttgccgcatcatcttgcaacgattccgtccacgtgatagagtgtgcctacagcctcgccgagggcctctctgaaatgttccgcctgctggtcgagggaaagctggccaaaacaaactacgtggtaattatatgtgcatgtcgctccgcggcaatcgatagctgcatcgctgtcacaggtaagtaccaggctaggatcttatctgaatcactgctcacaccagcggagtaccagaaggaagtcaattacgaactggtcactggaaaagtcgactcactgggtgcattcttctctacactgtgcccagagggtgatattgacatcctgctcgacaaatttcatcaagaaaatcagggacatatcagctctagtttggcagccagttcagtaaccaaagctgcctctctcgatgtgtctggcactcccgtgtgtacgtcatataacctcgaaccgcacagtattcgacctttccagcttgccgtcgcccagaaactgctaagccacgtgtgttcaattgccgatagcagcacccagaacctggatttaggaagtttcgaaaaagtggactttttgatctgcatccccccatccgaagtcacttaccaacaaactctgcttcatgtgtggcactctggggtgctgctggaactggggctgaagaaagaacacatgaccaagcaaagagtggaacagtacgttctgaaactggacactgaagcccagactaagttcaaggcgtttctgcagaacagtttccaaaatcctcatacactcttcgtgctgattcacgaccacgcccattgggatctggtgtcatctaccgttcacaacctgtactcacagagtgaccctagtgtgggactcgtggacaggttgctgaattgccgagaggtgaaagaggcacccaatattgtcacgctccatgtgacctcatttccatatgccttgcagactcagcatactctcattagtccttataatgaaatacactggcctgcctcatgttcaaatggtgtcgatctgtaccatgagaacaaaaagtatttcggtctgagcgaatttattgaatccactttgtctggccactctctgcccttgttgcgctatgattcttcgttcgaagctatggtgacggcactgggaaagcgatttccaaggttgcactccgctgtcatcaggacctttgtactcgtgcagcactatgccgctgctctaatggcagtaagcggcctgcctcagatgaaaaattacactagcgtagaaacgctggagatcacgcagaatctcttaaatagccccaaacagtgtccatgcggccatggacttatggttttgctccgggtcccatgctctccgctcgcagtcgtggcatatgagcgccttgcccacgtgagagccagactagctctggaagaacatttcgagattatcctgggctctcccagtagtggagtaactgtgggaaaacactttgtgaaacagctgagaatgtggcagaaaatagaggacgtggagtggaggcctcaaacttacttggagctggaggggctgccttgtattctgatttttagcggcatggaccctcatggagaatccctaccgaggagtctgagatactgcgatctgcgactcattaatagcagctgccttgtcaggacggcgttggaacaggagctgggtttggcggcttactttgtctctaacgaggtgccactcgagaaaggtgcccgtaatgaagccctggaaagtgatgcagagaagctgtcttctaccgacaacgaggatgaggagcttggaaccgaagggtccacctctgaaaaacgtagcccgatgaaacgcgagcgctcccgcagccacgactcagcaagctcgtccttgagctccaaggcctccggctccgccctgggaggcgagtcttcagctcagcccaccgcccttccacagggagagcatgcacggtcccctcagccccgggggcccgccgaagagggccgcgccccaggggagaaacagaggcctagagcgtctcagggtcccccaagcgctatctcacgccattctccgggaccgaccccccagcccgattgcagcctgaggactggtcagaggtccgtccaggtctctgtgacctcatcttgcagtcaattaagttcaagcagcggctcttcgagctcctcagtagccccggcagcgggcacttgggttttgcaggcatctcaatgttctctgaccaaggcttgtcgacaacctcccatagttttcttgcctaaactggtgtacgacatggtggtgagcactgatagttcagggctcccaaaggcagcatcgttactcccaagtccctctgttatgtgggctagctccttcaggcctctgctatccaagacaatgacttctacagagcagtcgctttattacaggcaatggacagttcccaggccctctcatatggactatggaaacagagcagagggcagagtcgacgggttccacccgaggcggttgctgctaagtggtcccccccagatcggtaaaacaggggcctatctccagtttctctccgtcctgtcaaggatgctcgtccgactcacggaagtcgatgtttacgacgaggaagagattaatatcaacttacgggaagagagcgactggcattatctccagctgtcagatccttggcctgacctagaactgtttaagaagctgccttttgactatattatacacgatccaaaatacgaggacgcttctctgatttgtagccattaccagggaataaaaagtgaagacagagggatgtccaggaaaccggaggacttgtatgtcaggcgacaaactgctcgcatgaggcttagcaagtacgcagcctataatacctaccaccactgcgagcagtgccaccaatacatgggatttcatccgcgctaccagctttatgagagcaccctgcacgcgttcgcttttagctatagtatgctcggagaggagatacaactgcatttcattatcccaaagagcaaggagcaccatttcgtgttctcacagcccggcggccagttggaatccatgagactgccccttgtaaccgataaatcccacgagtacatcaaaagcccaaccttcacgcctacaactggacgtcatgagcacgggctgtttaatctctaccacgcaatggatggggcctcccatctgcacgtgcttgtcgtgaaagagtacgaaatggcaatctacaagaagtattggccgaaccatatcatgttggtcctgccgtctatcttcaattcagccggcgtgggagcggcccactttctcattaaagagctctcttaccacaacctagagctcgagaggaacaggcaggaggaactcggtatcaagcctcaagacatatggccgtttatcgtgatcagcgacgactcctgcgtgatgtggaacgtagttgacgtgaactcagccggcgagcgctcacgggaattctcctggagcgagaggaacgtcagtctgaaacatataatgcagcacattgaggcagcccctgacatcatgcactacgcactcttgggtcttcggaagtggtcttccaaaacccgggcctcagaggttcaggagcctttttcgcgctgccacgtgcataacttcatcattcttaacgtggacctcacccagaacgtccagtacaatcagaataggttcttgtgcgacgacgttgacttcaaccttagggtccattctgcgggcctgttgctgtgcaggtttaatcgattctcagtgatgaagaagcagatcgtggtcggcggacataggagcttccatattacgtcaaaggtttctgacaactcggctgccgtcgtccccgcgcagtacatttgcgctcccgacagcaaacatacattcctcgccgcacctgcgcagctcctgctggagaagttcctgcagcaccacagtcacctgtttttccccttatcattgaagaaccatgatcatcccgtgctgagtgtcgattgttaccttaacctgggatcacaaatttccgtttgctatgtttcatcccggccacatagtctcaacatctcatgtagcgatctcctgttctctgggctcctgctttatttgtgtgacagttttgtgggggctagttttttaaagaaattccattttttgaagggcgcaaccctgtgcgtaatatgccaggaccgcagttcactgcgacagacggtcgtgagactggagctggaagacgagtggcagtttcggctgcgggacgagtttcaaaccgccaacgccagagaagatcggccactattctttcttaccgggcgccatatttag

SEQ ID NO: 119159 - DNA, 1188 bp, Artificial Sequence
  Description of Artificial Sequence: Synthetic coding sequence
atgacgctgcggcgcctgcgtaagctgcagcagaaggaagaagcggcagccaccccagacccggccgctaggacacctgattcggaggtagcaccagccgcccccgtgccaactcccgggccccctgcagccgctgccactccgggtcctccagcagacgagttgtacgcagcactggaagattaccatcccgctgagctgtacagggcacttgccgtctccggcgggacccttcctcgcagaaagggctcaggctttcgttggaagaatctttcccaatccccggaacaacagagaaaggtgctcaccttggaaaaggaggacaatcagactttcggctttgaaattcagacctatggattgcaccatcgcgaggagcagcgggtcgaaatggtaacttttgtgtgtcgcgtacacgaatcaagtccggcgcaactggctgggctcaccccgggggacacaattgcctctgtcaacggcctcaatgtggagggaattcgtcaccgcgagatcgttgacatcattaaagcatctgggaacgtgctgcggctggaaactctatacggcacaagtattaggaaggctgagctcgaggctcggctccaatacttgaaacagacgctctacgaaaagtggggcgaatacaggagtttaatggtgcaggaacagaggctggtgcatggcctggtcgtaaaagaccctagcatctacgataccctggaatccgtgcggtcttgtttatacggcgctggcttgctgcccggctctctgcccttcgggcctctcctggccgtaccaggacgaccccgtgggggagcccggagggctaggggagatgccgatgatgcagtgtaccatacgtgcttctttggtgactcagagccccctgcattgccccccccgcctccccccgcacgggccttcggtcccggacccgctgaaactccagccgtagggcccggcccaggtcccagagctgccctgtctagaagtgccagtgttcgttgtgcaggtccaggaggcggtggcggaggaggcgcaccgggagctctttggactgaggcccgtgaacaggcgctgtgcggccctggcctaaggaagacaaaatatagatcgtttcgaagacggcttcttaagtttatccccggtctcaatcgctctcttgaagaggaggagagtcagctatag

SEQ ID NO: 119160 - DNA, 759 bp, Artificial Sequence
  Description of Artificial Sequence: Synthetic coding sequence
atgacactgttaccctctaagggtggcgataccatagcctccgtgaacggactaaacgtggagggcatacgccatagagaaattgtggacattatcaaagcaagcggtaatgtgctcaggctggaaaccctttacggtacttccatcagaaaagcagaactcgaagctcgcttgcaatatcttaaacagacactttacgagaaatggggagagtacagatccctgatggttcaggaacaacgtttagtgcacggactggtcgtgaaggaccctagcatctacgacactctggagagcgtgagatcttgtctgtacggtgctggattacttcccgggtctcttccttttgggcctctattagccgtgccaggacggcctaggggaggagctaggcgagcccggggggatgctgacgatgcagtctaccacacgtgtttctttggcgatagcgagccaccagcgctccctcctcccccacccccagctcgcgcattcggcccaggaccggcggagacgcctgcggttggaccagggcctggtccccgcgcagccttgtccagaagcgctagcgtgcgatgcgccgggcccggaggcggtggcggtggcggagcccccggagccttgtggacggaagctcgggagcaagcactctgtggacctgggcttaggaagacgaagtaccgctcttttaggcgcaggctcttgaagtttattccaggccttaataggagcttggaggaagaggaatcccaactatag

SEQ ID NO: 119161 - DNA, 759 bp, Artificial Sequence
  Description of Artificial Sequence: Synthetic coding sequence
atgacactcctcccatcaaagggcggagatacaatcgcgtcagtaaatggattgaatgtggagggaatccggcaccgcgaaatagtggacattataaaggcttcgggaaacgtactgaggctggagactctttacggaacgtcgataagaaaagcagaattggaggccagactacaatatctgaagcagaccctttatgagaaatggggagagtatagatcattgatggtgcaggagcagagacttgtccacggcttggtagtgaaggacccaagcatctacgacacattagaatcagtccgtagttgtctgtacggagccggccttctgcccggctctctgccgttcgggccactccttgctgtaccaggccggccaagaggcggcgccaggagggcacggggtgatgctgacgacgcagtgtaccatacttgcttctttggagactccgagccacccgctctccctccacccccaccgcctgcacgcgcttttggacctggtcctgccgagacgccagcagtcggtcccggtccaggaccccgcgccgctctttcgcgaagtgcctccgtcagatgcgccggacccgggggcgggggcggcggtggtgctcccggcgcactgtggaccgaggccagagagcaggcgctatgcgggccggggttacggaagaccaaataccgcagtttccgtagacggttgctcaagtttattccaggcttgaatcggtctttggaggaggaagagtcccagctgtag

SEQ ID NO: 119162 - DNA, 654 bp, Artificial Sequence
  Description of Artificial Sequence: Synthetic coding sequence
atggccgcccagtgcgtgcggcttgcccgcaggagtctgcccgcactcgccctgtcactgagaccaagcccccggcttctatgcacggccaccaagcagaaaaatagcgggcaaaatctggaggaggacatgggtcagtcagagcaaaaagctgaccccccggcaaccgaaaagactctcctggaagaaaaagttaaactggaggaacagctcaaagaaacagtggaaaagtacaagagagccctcgcagatacagaaaacctgcgtcagcgatcccagaaactggttgaagaggctaagctttacgggattcaggccttttgtaaggatctgctggaagtcgcggacgttttagagaaagcaacccagtgtgtgcccaaggaagaaataaaggacgataacccccacttgaagaacctctatgaaggtctggtgatgacagaggtccaaatccagaaggtttttaccaaacatggattgttgaagcttaaccctgtcggagccaagttcgatccatacgagcatgaagccctcttccatactccagttgaggggaaagaaccaggaacggttgccctggtcagcaaggtggggtataaactgcatggacggaccttgaggcccgccttagtgggcgttgtcaaagaagcctag

SEQ ID NO: 119163 - DNA, 591 bp, Artificial Sequence
  Description of Artificial Sequence: Synthetic coding sequence
atggctgcccagtgtgtccgcctggcccgaagaagcctcccagccctcgccctatcattacgtccaagtccaagactgctgtgtaccgcgaccaagcagaagaacagcggtcagaacctcgaggaagatatgggacagtccgagcagctcaaggagacggtggaaaagtacaagagggccctcgccgacacggagaacttgaggcagagaagccaaaaacttgtggaggaggcgaaattatacggtatccaagctttttgtaaggacttgctagaagtcgctgatgtgctggagaaagccacccaatgtgtccccaaagaggagattaaagatgataaccctcatctcaaaaatttgtacgaagggctcgtgatgacggaagtccagattcaaaaagtgttcactaaacatggtctactgaagctgaatcccgtcggggcaaaatttgatccttacgaacatgaggccctttttcacacccctgttgaaggaaaagagccaggcaccgtagccttggtgtccaaggtcggatacaaactccacggacggacgcttcgcccagcgctggtcggagttgttaaggaggcctag

SEQ ID NO: 119164 - DNA, 2880 bp, Artificial Sequence
  Description of Artificial Sequence: Synthetic coding sequence
atggctttattaggtaagcgctgcgacgtccctactaacggatgtggacctgatagatggaattccgcgttcacaaggaaggatgagataattacatctctggtctccgcccttgattcaatgtgttcagctctgtcaaagctgaatgcggaagtggcctgcgttgcagtgcacgacgaatctgccttcgtagtggggacagagaaaggccgaatgtttctaaatgcacgcaaggagctgcagagtgacttcctcagattctgtcggggccctccctggaaagacccggaggcagaacacccaaaaaaagttcagcgtggcgaaggggggggaagaagtctcccaaggagcagcttggaacatgggagcgatgtctacctgctgcgaaagatggttgaagaggtcttcgatgtgctctacagtgaggcactagggcgcgcatctgtcgtgcctctgccctacgagcgactgttgagggagccaggtctgttggccgtgcagggactgccagaaggtctggccttcaggcgacctgctgaatacgatccaaaggccctcatggcaatcctggaacactcccacagaatccgcttcaaactgaaacgccctctggaggatggcggccgggactctaaggccctggttgaactgaatggtgtatctttaatccccaaaggctcccgggactgcggcctccacggacaagctccgaaagtcccaccccaggacctccctccaacggccacttccagcagcatggccagctttctctacagcaccgcgctgcccaaccacgcgattagagaactgaaacaggaggcaccctcctgtcctttggctccatcagatctgggactgtctcggccaatgccagagcctaaagccactggcgctcaggacttctctgattgctgtggacagaagccaacagggcccgggggtcccctcattcagaatgtgcatgcatctaagcggattctcttctccatcgtgcacgacaaatccgagaaatgggatgcctttattaaggagaccgaagatatcaatactctccgcgaatgcgtacagattctatttaactctcgctacgcagaggccctaggtttggatcacatggtgccagtcccatatcggaaaatcgcttgtgacccagaggcagtcgagattgtgggcatacctgataagattccctttaagagaccctgtacatatggcgttcctaagctgaaacggatcctcgaggagagacattccattcacttcattatcaagcggatgttcgacgaaaggatttttacaggcaacaaatttaccaaagataccaccaagctggagcccgccagccctcccgaggacacttccgcggaggtctcccgtgctaccgttctggacctagcagggaacgctcgcagtgacaaaggatctatgtcggaagactgtggaccgggaacaagtggggaactgggaggccttcgccccataaagatcgaacccgaagatttagacataatccaggttacggtgccagacccctcaccgacttctgaagaaatgacagacagcatgccagggcatttgcctagcgaagatagcggatacggtatggagatgctgacggacaagggtctgtcagaagacgcaaggcccgaggaacgacctgtggaggatagccacggcgatgtcatcagacccctgcgcaagcaagtggagctgttgtttaacactaggtacgctaaagcaattggcatctctgaacccgtgaaggtcccgtatagtaaatttctgatgcatcccgaggagctgttcgtagtaggactgccagagggaattagcctgaggcggcctaattgttttgggattgcaaagctgagaaagatccttgaagcaagtaattctatccagttcgtgatcaaaagacccgaactcttgacagagggtgtcaaggaacctataatggattctcaaggcaccgcctcaagcttgggcttctccccacccgcgctgccgcctgaacgcgatagtggagatccactggtggatgaatctttgaagcggcaagggtttcaagagaattacgacgccaggctttcaagaatcgacatcgccaacacactgcgcgaacaggtgcaggacttattcaacaaaaagtatggcgaagccctgggtattaaataccccgtccaggtcccctataaacgcattaaaagcaatccaggatctgtgattatagaagggctcccgcccgggataccgttccgtaaaccctgtacatttggcagtcaaaacctggaacggatcttggccgtcgcagacaagattaaattcaccgtgactaggcctttccaaggactcattccgaaacctgatgaggatgatgccaaccggttgggcgagaaagtgatactcagagaacaggtgaaggaactgtttaatgagaagtacggcgaagcattaggactgaacaggcccgttctggtaccgtataagctcatccgtgattcccctgacgccgtcgaggtcacaggccttccagatgacatccccttccgtaaccctaacacatacgatatccatagacttgaaaagattctcaaggccagagagcatgtgcgcatggttatcatcaaccagctgcagcctttcgcggagatatgtaacgacgcaaaggtgccggccaaagactcttcaatacctaaacgcaaacgtaaaagagtctcggagggcaacagtgtgtctagtagtagctcctcttcgtcctcatcctccagtaatccagacagtgttgcgtccgctaaccagatctctttggttcagtggcctatgtatatggtcgattacgctggtctgaatgtccagctaccagggcccttgaattactag

SEQ ID NO: 119165 - DNA, 2835 bp, Artificial Sequence
  Description of Artificial Sequence: Synthetic coding sequence
atggccttgctggggaaaaggtgtgacgtgccaactaacgggtgtggacctgatagatggaattcagcctttaccagaaaggatgagataattacctcactggttagcgccctcgactcaatgtgcagtgctctttccaaactgaacgccgaggtggcctgtgtggccgtgcacgatgagtcagctttcgtcgttggaacagagaaagggagaatgtttctgaatgctcgcaaagagcttcagagtgacttccttcgcttttgtcggggaccaccttggaaggacccagaggccgagcatccgaagaaggtgcaacgtggcgagggggggggacggtccctacccagaagctctctagagcacggcagtgacgtttacctcctgagaaaaatggtggaggaggttttcgatgtcttatattccgaggctctgggtcgagcatcggttgtccctctgccatatgagcggttgctccgcgagcctggcttgctcgcagtgcagggtttgccggagggcctcgccttcagaaggcccgcggagtatgaccccaaagctcttatggccatccttgaacacagccacagaatcagatttaaactgaaacggcctcttgaggacggtggcagagactctaaggcccttgtcgaactgaatggggtgtccctaataccgaaggggtccagggactgtggccttcacggtcaagcaccaaaggtgcctccccaggatctgccgcctactgcaacgtcttcctcgatggcctcgtttttatacagcaccgctctccccaatcatgccatccgagagcttaagcaggaagcccctagctgccccctcgctccgagcgatttgggccttagtcggcccatgccagaacccaaggcaacaggtgctcaggacttctcagactgttgcggtcaaaagccgactggtccagggggccccttgatacagaatgttcacgccagtaagaggatacttttttcgatcgtccacgataagagtgaaaaatgggacgcatttattaaagaaacagaagacattaacacactgcgggagtgtgtccaaattctgttcaacagccgctatgcggaagccctgggcttggatcatatggtgcccgtgccttatcgaaagatagcttgcgatcccgaggccgtggagattgtgggaatccccgataagataccattcaaacgcccctgtacctatggtgttccaaagttaaagaggattctcgaagagaggcactccatccacttcatcatcaaacgcatgttcgatgagcgaatctttacaggaaataagtttaccaaggacaccaccaaattggagcccgctagcccacctgaagacacatccgctgaggtgagccgggcaactgtgctcgatttagccggcaacgccagaagcgataaaggctctatgagcgaggactgtggcccaggcacctctggcgagctcggtggccttcgaccgatcaaaattgagccggaggaccttgacatcatacaggtaactgtgcctgacccctcccctacttccgaagagatgaccgattccatgccagggcacctgccgtcagaagattcagggtatgggatggaaatgttgaccgacaaaggcctgagtgaagatgctagacccgaggaacggccagtcgaggactcacatggggatgtaatcaggccactgcggaaacaggtggagttgcttttcaacacaaggtatgctaaagccatcggcatctccgagcccgtaaaggtcccttattccaaatttctgatgcatcccgaggagttattcgtcgtgggcctccctgagggcataagcctgaggaggcctaattgcttcggcatcgccaagctgaggaagatccttgaagcctcgaacagtattcagtttgtgatcaagaggccagaattgctgaccgaaggcgtcaaggagccaattatggacagtcaggagagagattcaggggatccccttgtcgatgaatcgctcaaaaggcagggatttcaagagaactatgacgctcgcctgtcccgcatcgatattgcaaatacactgcgagagcaggtgcaggatcttttcaataagaaatacggggaggccctcggcattaaatatccagtccaggtcccatacaagcgcattaagtctaacccaggatctgtgataatcgaggggttgccccccggtattccttttcgcaaaccttgtactttcggcagtcagaacctcgagcggattctggcggttgcagacaaaatcaagttcactgtcacccggccatttcaaggattgatacccaagcccgatgaagatgacgccaacaggttgggcgagaaggtaattctgagggagcaggtaaaggagctgttcaacgagaaatacggcgaagcactcgggctgaatcgacctgtgttggttccttacaaactgatccgcgacagcccagacgctgtggaagttaccggcctgcctgacgatatccccttccgcaacccgaatacttacgatatacataggcttgaaaaaatcctaaaagctcgtgagcatgtcagaatggtgatcatcaaccagctgcagccctttgctgagatctgtaacgacgctaaagtcccggccaaagacagttccatcccaaaaagaaagcggaagcgagtgtcagaggggaacagtgtgtcgtcctcctcctctagttcaagcagtagcagctccaaccccgactctgtcgcaagtgctaatcagatctctttagtccagtggcctatgtatatggtggactacgccggcctgaacgtgcagttaccagggccccttaactattag

SEQ ID NO: 119166 - DNA, 2931 bp, Artificial Sequence
  Description of Artificial Sequence: Synthetic coding sequence
atggccctcctgggaaaacggtgcgacgtcccaaccaatggctgtggaccagataggtggaacagtgcctttacacggaaggatgagattattacttctttggtctcagcactggacagcatgtgcagcgctctgagcaagctgaatgcagaggtcgcctgcgtggcagtgcatgacgagtccgcctttgttgttggcacagagaaagggaggatgttcttaaatgctagaaaggaacttcaaagtgatttcttacggttttgcttgagcgctgcacagcaccgcgccgcaactagtcagttggaggggagggtagtcagaagggttctgacagtcgcttcccgtgcactgtgccccactggcgggcccccctggaaggaccctgaggccgagcaccccaagaaggtgcagaggggggagggagggggacgctctctgccccggtcatctctagagcatgggtccgacgtttatctcctgcgaaagatggttgaagaggttttcgacgtgttgtattccgaagccctggggagagctagcgtggtcccccttccctatgagcgccttctgagagagcctggcctcctggccgttcagggattaccagaaggcttagcattccggagacccgcggagtatgacccgaaagcgctgatggccatattagagcactcgcatcgcatcagatttaagctcaagcggccccttgaagacggtgggcgggactctaaggccctggtggagctcaacggtgtgagtctaatacctaaaggcagcagagactgtggtttgcacggccaggcacccaaagtccctccacaagatcttcccccaacagccaccagttcctctatggcttcattcctgtacagcactgctctgcccaaccacgctattagagagctaaaacaggaagccccatcttgtcctctagcacccagcgacctgggcctttctcggcctatgcccgaaccaaaagctacgggggcccaggatttttctgactgctgtgggcagaaacctactggtccgggcggacctctaatccaaaatgttcacgcgagcaaacggatcctgttctccatcgtgcatgataaaagcgaaaagtgggacgctttcattaaagaaacggaagacataaatacgctgcgggagtgtgttcagatccttttcaactccagatatgctgaagcacttggccttgatcacatggtgcctgttccgtatcggaagatcgcctgtgatccagaggctgtagaaattgtcggtattccagacaaaattcctttcaaacgcccatgcacctacggtgttcccaaactgaaacgaattctagaggagagacacagcatccactttattattaaaagaatgtttgatgagaggattttcaccggaaacaagtttacaaaggataccactaagctggagccagcttctcccccggaagatactagcgctgaggtttccagggcaacagtgctcgacctcgctggtaatgctcgtagtgataagggatccatgtccgaagattgtggcccaggaacaagcggcgaattgggtggccttaggccaataaagattgaaccagaggatttggatatcattcaggtcacagttcctgacccatcacctacgagcgaggagatgacggactcaatgcccgggcatcttcccagtgaagattccggctatggaatggaaatgctgacagataaagggctatccgaagacgcccggcctgaagagaggcctgtggaggatagtcacggcgatgtaatacgcccgctgaggaagcaagtggagcttctctttaatacgcgttacgccaaggctatcggcatctccgaaccagtcaaagtcccttatagtaaattccttatgcatcctgaagaactgtttgtagtagggctcccggagggaatttcattaagaagaccaaattgtttcggcattgccaaattacggaaaattcttgaagccagcaactccatccaattcgtaattaagcgtcccgagcttctgaccgagggggtaaaggaacccatcatggatagtcaggagcgggatagtggtgatcccctcgtggacgagagtctgaaacgacagggcttccaggagaattatgacgcccgcttgagcaggattgatattgccaacacccttcgcgagcaggttcaagacctgtttaacaaaaagtatggcgaggctttgggaatcaaatatcccgtccaggtcccgtacaagcggataaagtccaacccgggctctgtaatcattgagggcctccctcctggtatccccttcaggaagccgtgcacttttggcagccagaaccttgagcgcattctggcagtggcagataagatcaagtttaccgtgacacgcccttttcagggactgatccccaagcccgacgaggacgacgccaatcggctcggtgagaaagtgattctgcgggagcaggtgaaggagctctttaatgagaagtacggtgaagccctcgggttgaaccgaccagtcctggttccttacaaactaatcagggacagtcccgacgctgtcgaagtgacgggtctgccagatgatatccctttcaggaacccaaacacatatgatatacataggctggagaaaattttaaaagcccgggaacacgtcagaatggtcatcatcaaccaattgcagccctttgccgaaatttgcaatgacgctaaagtgccagccaaagactctagcatccccaagcgcaaacgcaaaagggtgtcagaagggaactccgtctcatcaagttcaagtagcagttcctcttcaagttccaaccccgattccgtagcttcagcgaaccaaatcagtttggtgcagtggccaatgtatatggtggattatgccgggctgaacgtgcagctgcctggtcctttaaattactag

SEQ ID NO: 119167 - DNA, 609 bp, Artificial Sequence
  Description of Artificial Sequence: Synthetic coding sequence
atgtcctgcgtgccatggaagggggataaggccaaatctgaaagtctggaactacctcaagccgcacctcctcagatttatcatgagaaacagaggagggagctgtgtgccttacacgctctcaataacgtgtttcaggattctaatgcattcactcgcgacaccctccaggagattttccagcggctgtctcccaacactatggttactccacacaaaaagtccatgctcggcaacggcaactatgacgtgaacgttatcatggctgccctgcaaacgaaaggctacgaagccgtatggtgggacaaaaggcgggacgtcggagtcatcgcactgaccaacgtcatggggtttattatgaacctgccctcaagcctgtgttggggccctctgaagttacctctgaaaaggcagcactggatttgcgtgcgcgaagtcggcggagcttactacaatcttgacagcaagctgaaaatgcctgagtggataggcggggagtccgaacttcgtaaatttctaaagcaccatctgcgagggaagaactgcgaactcctgttagtggtgcctgaagaggtggaagctcaccaatcttggagaacggacgtttag

SEQ ID NO: 119168 - DNA, 1545 bp, Artificial Sequence
  Description of Artificial Sequence: Synthetic coding sequence
atgaagtggagacttcaggagggtcgaggggaggcggtctaccagataggtgtggaggacaacggacttctggtgggcctcgccgaagaggagatgcgcgcttcgctcaaaactctgcatcggatggcagagaaagtgggtgctgacatcaccgtgctgcgagaaagagaggttgactacgatagcgacatgccccggaaaattacggaggttctggtcaggaaagtccccgacaatcaacagttcttagacttgagggtcgcagtcttagggaatgtggattcgggcaaatctacactgctgggtgtgctgactcagggagagctggacaatggccggggtagagccagactgaaccttttccgccacctacacgagatacagagcggacgtacatcatccatctcttttgaaatccttggattcaactcaaaaggggaggtggtcaactactccgattcccgcactgccgaagagatctgcgagagcagcagcaaaatgatcacatttatcgatttggctggccaccataagtatttgcacaccacaatattcgggctgaccagttactgccccgactgtgccctcctcctcgtttccgccaacactgggattgccggcacaacacgcgagcatctcggcctcgcgctggccctgaaggtccccttcttcattgtggtttcaaagattgacctgtgcgccaagacaacggttgaaagaaccgtgcgacagctggagagagttcttaaacagcccgggtgccataaggtgcccatgctggtcactagcgaagacgacgctgtcacagctgcacagcagttcgctcaatccccaaacgtgactccaatcttcacgttgtcgagcgtgtctggcgagtccctggatttgctcaaagtgttcttaaacatcctgcccccactgacaaatagcaaagagcaggaggaacttatgcagcagttgaccgaatttcaggtagacgaaatctacactgtccccgaggtgggaacagtggtgggtgggacactgagttccggcatatgcagggagggcgaccaactggtagtcggtccaacagatgatggatgcttccttgaactgcgcgtctgcagtatccagcgaaaccggagcgcatgcagggttctgcgcgcaggccaggcggccaccttagctctgggcgactttgatcgggccctactcagaaagggtatggtgatggtgtctcccgagatgaaccctactatctgttcagtgttcgaggctgagatcgtcttgctcttccacgcaaccaccttcagaagaggcttccaggtcactgtccatgtcgggaacgtgaggcagaccgcggtggtggaaaagatacatgccaaagataagctgaggacaggggaaaaggcggtggtgcggttcaggttcctcaagcacccagagtatctgaaagtgggagcgaagttattgttccgggaaggcgttaccaagggtatcggccacgtgacagacgtacaggcaattacagcaggagaggctcaagccaatatgggcttttag

SEQ ID NO: 119169 - DNA, 1809 bp, Artificial Sequence
  Description of Artificial Sequence: Synthetic coding sequence
atggactcaagagtcagtgagctattcggcggctgctgtcggcctggtggtggaccagccgtcggtggcaccctgaaggcgcgaggagccggctcatcttcaggttgtggtggtccaaaaggcaaaaaaaagaatggtagaaacagaggtggcaaggccaataacccaccttatctgccaccagaagccgaagacgggaacatcgagtataaattgaagctggtgaacccctctcaatacaggttcgaacatctggtaacccagatgaaatggcggctgcaggagggccgcggcgaggccgtgtaccaaattggcgtggaagacaatggtttactcgtgggtttggccgaagaggaaatgcgtgccagcctgaagacactacacagaatggccgagaaagtgggagcagatatcacagtactgagggagagagaagtggactacgactcagacatgcccaggaaaattactgaggtgctggtaaggaaagtgcctgacaaccagcagtttttggatttgagggtagcggtgctgggcaacgtcgattcgggaaaaagcaccctgctgggcgttcttacgcagggggagcttgataatgggagaggtagggcccgccttaatctcttcagacacctgcacgagatacagagtggtcgcacaagttccatttctttcgagatccttggtttcaattctaagggagaagtcgttaactatagcgacagcaggacagccgaggaaatttgtgagagctcctccaaaatgataaccttcatagacctggctggacaccacaaatacttgcatacaaccatttttggcctgacttcgtactgtcccgattgcgccctgcttttggtgagtgctaacactggtatcgcaggtacgaccagggagcacctcgggctcgccttggccctgaaggtgccattttttattgtcgtgtctaaaattgacttatgtgccaagaccactgttgaaagaacggttaggcaactggaacgcgtgttaaagcaacctggatgccataaggtacctatgctagttacctccgaggacgatgcggtgaccgccgctcagcaattcgcgcagagtcccaatgttacccccattttcaccctctccagcgtgtctggcgaatccctggatctgctgaaagtctttctgaacatcctgcccccgctgacgaactccaaagaacaggaagagctgatgcaacagttaacagagttccaagttgatgagatttatactgtgccagaagtcggaacagtggttggaggcaccttgtcctccggcatttgccgagaaggcgaccaactggtcgtcgggccaaccgacgacggatgctttctggaactgcgcgtttgcagcatccagcggaatagaagtgcctgtcgcgtcttacgggctggacaagcggctaccctggcccttggcgacttcgaccgggccctcttgcggaagggaatggtcatggtaagtccagagatgaacccaacaatctgtagtgtttttgaagccgagatcgtcctcttgttccacgccactaccttccgacggggattccaggttactgtgcacgtcggtaatgtgcgacagaccgccgtcgtcgagaagatccacgccaaggacaagctccggactggcgagaaagcagtggtcaggtttagatttctcaagcacccagagtatttgaaggtcggagcgaaactactgttcagagagggcgtcacaaaaggcatcggtcacgtgacagatgtgcaggctataactgcgggagaagcccaggcaaacatggggttctag

SEQ ID NO: 119170 - DNA, 735 bp, Artificial Sequence
  Description of Artificial Sequence: Synthetic coding sequence
atgaagtggcggcttcaggagggtcggggcgaggcgatctttaccttgtccagcgtgtccggcgagagcctcgatctactcaaggtctttctcaatatcctaccacctctgaccaattcgaaggagcaagaagagctgatgcagcagctgactgagttccaggtggatgagatttataccgtaccagaggttggtaccgtggtcggcgggacactttcaagcgggatttgtcgcgagggagaccagctggtggtgggcccaacagacgatggttgcttcctggaactgcgcgtgtgttccatccaaaggaataggtccgcctgtagggttctgcgtgctggccaggctgccaccctcgcgctgggggacttcgaccgggccctgctgcgcaaggggatggtcatggtcagccccgagatgaaccctacgatttgctccgtgtttgaggcggaaattgtcctgctcttccacgccaccacatttcgtcgcggctttcaggtgacggttcacgtgggcaacgtgaggcagactgcagttgtcgaaaagattcatgctaaggacaaactcagaacaggtgagaaggcagttgtacgcttccgattcctcaagcatccggaatacctaaaggttggggccaagcttctgtttcgggagggcgtgaccaaagggattggtcacgtgacagacgtgcaggccattaccgcaggagaagctcaggcaaacatggggttctag

SEQ ID NO: 119171 - DNA, 462 bp, Artificial Sequence
  Description of Artificial Sequence: Synthetic coding sequence
tagggcatatgtcgtgagggcgatcagctcgttgttggccctacagatgatgggtgcttcctggaactgagagtgtgtagcatccagcgcaatcgctctgcctgtcgtgtgcttagagccggccaggctgctactctggccctaggggacttcgatagagccttactcaggaagggaatggttatggttagcccagagatgaacccaaccatttgctcggtgtttgaagccgagatagtgctgttattccatgcaactaccttcagaaggggattccaggtcacggtccacgtcggcaacgtccggcagacagctgttgtggagaaaatccacgccaaggacaaactccgtactggtgagaaagccgtagcaagagagcgaggcgttctgagcgctacgtgttctctcccgaccttctggaggggcgcaaagctcggcgtcgcaagaaagggccaatcctag

SEQ ID NO: 119172 - DNA, 465 bp, Artificial Sequence
  Description of Artificial Sequence: Synthetic coding sequence
tagggtatctgccgcgagggggatcagcttgtggtagggccaaccgacgacggatgtttcctggagcttcgagtctgttctatccagagaaaccgtagtgcttgcagggtgctcagagccggtcaggcggccacactggccctgggcgactttgatcgggctttgctaaggaagggaatggtgatggtttcgccggaaatgaacccgacgatctgttctgttttcgaagctgagatcgtgctcttgtttcacgctacaacctttcgacgcggtttccaagttacagtgcacgtaggaaatgtgcgccagacagctgtggtggagaaaatccatgcaaaagttagaggcacctggcctagcatttccccagaggtaaggaaagaagggggactgccccagactggcagggaactgctcgatccgaccatgggaatcaagccacatttaggctgggtggccgcatag

SEQ ID NO: 119173 - DNA, 543 bp, Artificial Sequence
  Description of Artificial Sequence: Synthetic coding sequence
atgcaacagctgacagagttccaggtggacgaaatctatacagtgccagaagtaggtacagtggtaggtgggaccttaagctcgggcatttgcagggagggagaccagctcgtggtcggccctaccgatgatgggtgtttcctggagctgagggtctgttctatccagcggaaccggagcgcttgtcgggttctacgagctggccaggccgcgacattagcactgggggacttcgatcgcgccctcctgcgaaagggcatggtaatggtctccccagagatgaaccctactatttgctccgtgttcgaagctgagattgtcctgctcttccatgccaccaccttccgaaggggctttcaggttactgtgcacgttggtaacgtccgccagacagccgttgtagagaagattcatgccaaagataagctccggaccggggaaaaagcggtggctcgggagagaggcgtcctctccgcgacatgctcgctgccaacattctggcgtggggctaaattgggtgttgccagaaaaggacaaagctag

SEQ ID NO: 119174 - DNA, 951 bp, Artificial Sequence
  Description of Artificial Sequence: Synthetic coding sequence
tgacaggggggcggcgcccgcgaggaaaacacttcctttaggagtcgagacccccgggaggaaggacaacgtcttgacagccaggcggaggatgggaacatcgagtataaactaaaactggtcaatcccagccagtatagattcgagcatctggtaacccagatgaagtggcgactgcaggaaggaaggggagaggctgtgtatcagataggagtggaggacaatgggcttctcgtggggctcgctgaggaggagatgagggcgtccctgaaaacactacataggatggcggaaaaggtcggcgcggatattactgtcctgcgtgagagagaagttgattatgattctgatatgcctcggaagatcactgaagttctggtcagaaaagtgccagataatcaacagttcttggatctcagagtggccgtactgggcaatgtggactctggcaagtcaactctcctgggggttctcactcagggtgagctggacaatgggagagggcgggctagattgaacctctttcggcacctgcatgaaatccagtctgggcgaaccagctctattagctttgagatattaggcttcaatagcaagggcgaggtcgttaattattcagacagccgcacagccgaagagatatgtgagagttcctccaagatgatcacttttattgatcttgctggccatcacaagtacctgcacaccacaatcttcgggctaaccagttactgtccagattgcgcactacttctggtgtctgcaaatacaggaattgcaggcacgacccgagagcacctcggcctggccctggcccttaaggtgccctttttcatcgttgtctccaagatcgatctctgcgcgaaaacgaccgtcgagcgcacagtccgtcaactggaaagagttctcaaacaaccaggttgtcacaaagttcccatgctggtgacctag

SEQ ID NO: 119175 - DNA, 684 bp, Artificial Sequence
  Description of Artificial Sequence: Synthetic coding sequence
atggactcgagggtgtctgagctgttcggtggttgttgtcgaccgggtggaggtccggccgtggggggtaccctaaaagcgagaggtgcgggctcaagcagtggatgtggtggtcctaagggcaaaaaaaagaatggccggaacagaggaggaaaagccaacaaccccccttatttgccacctgaggctgaggacggcaatattgagtacaaatatcgctttgaacacttggtgactcagatgaaatggcgcctacaggagggccgaggagaggctgtgtatcaaatcggggtggaagataatggacttctcgtcggcctcgccgaagaggagatgagagcctccctgaaaacgctacatcgaatggccgaaaaggtgggcgcagacatcacagttctccgggagagggaggtggactatgacagcgatatgccaagaaaaatcaccgaagttctggtgagaaaagttcccgacaaccagcagttcctcgacctgagggttgcagttcttgggaatgttgactccgggaagtcaaccctcctcggagtgctcactcagggtgaactggacaatggacggggtagagcgaggctcaacctctttaggcacttacacgagatccaaagcggcaggactagttccatcagttttgagatcctcggatttaactcgaaaggcgagtag

SEQ ID NO: 119176 - DNA, 1221 bp, Artificial Sequence
  Description of Artificial Sequence: Synthetic coding sequence
atggccccggctcgttgtttttccgcaagactccgcactgtcttccaaggggtcgggcactgggccctatcaacatgggctggcttgaaacctagtcgactcttgccacagagagcctcccctcgcctgctgagcgtgggtcgcgcagacttggcgaagcaccaggagctgccaggtaagaaattgctcagcgagaaaaagttgaaacgttactttgtcgactacagaagggtgcttgtgtgtggggggaacggtggcgccggcgcaagctgctttcactccgagccgcgcaaagagtttggtggaccagacggtggggacgggggtaatggcggccatgtgatcctccgagtggaccaacaggtaaaatccttaagctccgttttgagtcggtaccagggattttccggcgaggacggagggtctaaaaattgctttggcagatccggagccgtgttatacatacgagtccctgtcggcaccttggtcaaggagggtggcagagtggtcgcggatctttcctgcgtcggagatgagtacatcgctgctcttgggggcgccggaggaaaaggtaaccgctttttcttggccaacaacaatcgagctccggtcacctgtacccccggacaacctggccagcagagagtgcttcacctggagcttaaaacagtagcccacgctggcatggtggggtttccgaacgcaggtaagagctccctgctaagggccatttctaatgctaggcctgctgtggcgtcctatcctttcacaacactcaagccgcacgtgggtatcgttcactacgaaggtcacctgcagatcgctgtagccgatatccccggaatcattcggggcgcccaccaaaacagagggctggggagcgcctttctcaggcacatagagaggtgtcggtttctgctgtttgttgttgacctttctcagccggagccctggacccaggtggatgatctaaagtatgagctggaaatgtatgagaagggattgtcagcccggccccatgcaattgtggctaataagatcgacctaccagaagcccaggcaaacctgagtcagctgagagatcatttaggacaggaggttattgtgttgtctgccctgacaggtgaaaatctggagcagctattgctgcacttgaaggtgctgtacgatgcatatgccgaagctgagctgggacaggggcggcagcctctgcggtggtag

SEQ ID NO: 119177 - DNA, 747 bp, Artificial Sequence
  Description of Artificial Sequence: Synthetic coding sequence
atggctccagccaggtgtttttctgcccggctgcgcaccgttttccagggggtggggcattgggctctctcaacgtgggctggacttaaaccttcacgtctccttcctcagagagccagtcccaggctgctgtcagtgggcagggcggatcttgccaagcatcaagaactgcctggcaagaagctactgagtgaaaagaagctcaagagatactttgtagattaccgcagggtgctcgtttgcggcggaaatggcggagccggagccagctgctttcactccgaaccccgaaaagaattcggtggcccagacggtggcgatggggggaatggcggccacgtcatcctgagggtggctgacatccccggcataattcgcggcgctcaccagaatagaggccttggatccgcattcctccgccacatagaaaggtgccgtttcctgctcttcgttgtggatctatcccagccggaaccatggacacaggtcgacgatcttaaatatgagttagaaatgtacgagaaggggctgtccgctaggcctcatgcgatcgttgccaacaagatcgacctccccgaagcccaagcgaatctgtcccaactgcgcgaccacctcgggcaagaggtcatcgtgttgtctgctctgacgggcgagaacctggaacagctgctgttgcacctgaaggtattatatgacgcctacgcagaagccgagctgggacaggggcgccagccactacgctggtag

SEQ ID NO: 119178 - DNA, 702 bp, Artificial Sequence
  Description of Artificial Sequence: Synthetic coding sequence
atggctccagctcgttgtttttcagcccgcctgcggactgtcttccagggtgtgggacactgggccttgtcaacctgggcgggtttgaagcctagcagactccttccacaacgcgctagccctaggctcctctccgttggtcgggctgacttggcaaagcaccaagagctgcccggtaagaaactgctgtctgagaaaaaactgaagcggtatttcgtggactacagaagagtgctagtttgtggcggcaatggtggagccggcgcatcctgtttccacagcgaaccacggaaggagtttggaggcccggacggtggcgacggcgggaacggcggccacgtgatccttagagtggaccaacaggtgaagagcttgtcctcggtgttgtcccgctatcagggctttagtggtgaagacggcggctccaagaattgttttggacgcagtggcgccgtcttgtacatccgggtgcctgtcggaaccctcgttaaggagggaggacgagtggtggctgatttgtcatgcgtcggggatgaatacattgcggcccttgggggtgccggggggaagggcaatcgattttttctggcaaataataaccgggctcccgtgacttgtactcctggacaaccaggccagcagagagttctgcatcttgagctgaagacggtcgcacatgccggtatggtggggttcccctag

SEQ ID NO: 119179 - DNA, 537 bp, Artificial Sequence
  Description of Artificial Sequence: Synthetic coding sequence
atggtcgggtttcccaacgcgggcaagagcagcctcttgcgcgcaatatctaacgctaggcctgctgttgccagctatcctttcaccacgctgaagccccacgtggggattgtgcattacgaggggcatcttcaaattgcggtcgcagacatccctggcatcatcagaggggcacatcaaaatagaggactcggatctgcatttctgagacacattgaaaggtgcagattcctgctttttgtggttgatctgagtcaacccgaaccatggacgcaggtggacgacctgaagtatgaactggaaatgtacgagaagggactctcagcgcgacctcatgctatcgtggcaaacaagatcgacttaccagaggctcaagcaaacttaagccagctgagagaccacctgggacaagaggtgatcgtcttatctgcattgactggagagaacctggagcagctgctcctccacctaaaagtgctttatgatgcatacgcagaggccgagctgggacaggggcggcaacccctgaggtggtag

SEQ ID NO: 119180 - DNA, 864 bp, Artificial Sequence
  Description of Artificial Sequence: Synthetic coding sequence
cgatcaaatctcaagagagacgtggcccacctatatcggggcgtgggctctcggtacataatgggttctggtgaatctttcatgcagcttcagcagcgcctgttaagggagaaagaggctaaaatacggaaagcccttgataggctaaggaagaaaaggcacctcctgcgcaggcaaaggaccagaagagagttccctgtaatcagcgtagtgggatatacaaactgcggcaaaactacgttgataaaggctctgactggcgatgctgcaatccagcctcgggatcaactatttgccacccttgacgtgaccgctcacgccggaacacttccaagccggatgacagtattatatgtagataccattgggttcctgagtcagcttccccatggcctgatcgagagcttctctgccacgctagaggacgtggctcactcagacctgatcttgcacgtccgcgacgtgtcacatccagaagccgagctccagaaatgtagcgtcttgtccactctgagggggctgcagcttcccgcacccttgcttgattctatggtggaagtgcataataaagtggaccttgtgcccgggtattcacccaccgaaccaaatgtcgtccccgtgtctgccttgagaggccacgggctgcaggaactcaaagctgaattagatgcagcagttcttaaagcgaccgggcggcaaattctaacccttcgcgtgagactggctggggctcagctgtcttggctgtacaaggaggctacggtacaagaggtcgatgtaattcccgaggacggcgctgctgacgtgcgcgtgattattagcaattcagcgtacggaaaattcaggaaactgttcccagggtag

SEQ ID NO: 119181 - DNA, 864 bp, Artificial Sequence
  Description of Artificial Sequence: Synthetic coding sequence
tagtctaatctcaagcgcgacgtggcccacctctacagaggggtcggaagcagatatatcatgggatcgggcgaatcatttatgcaacttcagcaacggctgttaagggagaaggaggcaaagatacggaaggccctagatcgcctgaggaagaagagacacttgctgcgcagacagcggacccgacgcgaatttcctgttataagcgttgttggatacactaattgcggaaagactaccctgattaaggcccttaccggggatgcagcaatccagcctcgggaccagctcttcgctacacttgatgtcaccgcgcacgcaggaacccttccatcccggatgacagtcctgtatgtagatactatcggattcctctctcagctaccccatggtctcatagaatcattctctgccacattggaggatgtggcacacagcgatctgatcttgcatgtccgcgatgttagccatcccgaggctgagctacagaagtgttcagtgctttctacactacgcggtcttcagcttcctgccccactactggacagcatggtggaggtgcataataaagtcgatctcgtgccaggttattcacccactgagcctaacgttgtgcctgtttccgcgctgcgcggacatgggcttcaggaactgaaggcggaactggatgctgctgttctgaaggccacaggacgtcagattctgactttacgcgtgcgactcgccggcgcccagttgtcgtggctatataaagaggcgacagtccaggaggtggatgtgatccctgaggacggggctgcagatgtgcgcgtgattatctctaattctgcctacggaaagtttcgcaaactttttccagggtag

SEQ ID NO: 119182 - DNA, 891 bp, Artificial Sequence
  Description of Artificial Sequence: Synthetic coding sequence
atgacattgaataacgttactatgaggcagggcacggtgggaatgcagcctcaacagcagcgctggtccatccctgcggacggacgccatctgatggtacaaaaagaacctcatcaatatagccacaggaatcgacatagcgcgacacctgaagaccactgtagacgaagttggtcttccgactccacagactccgtgatatcctctgaatctggaaatacctactaccgggtcgttcttattggggagcagggggttgggaaatctacccttgctaacattttcgccggtgtgcatgacagcatggatagtgactgtgaggtactcggggaggacacatacgagaggacccttatggtggacggcgagtcggcaactatcatcttactcgatatgtgggagaataagggggaaaatgaatggctgcatgatcactgcatgcaggtaggggatgcttacctgattgtctactctatcacagaccgagcctcatttgaaaaggcctcagaactgcgtatccaactgagaagggcccggcaaaccgaagatataccaatcattctcgtggggaacaagtcggacctggtacgttgcagagaggtgtctgtctctgagggccgggcatgtgccgtggtgttcgactgtaagttcatagagacctccgccgctgtgcagcataacgttaaagagctctttgaagggattgtcaggcaagtgcggttgcggagggactcaaaagaaaaaaatgaaagacggttagcgtaccagaaacgtaaagagagcatgcctaggaaggcgcggagattttggggcaagatagtagccaaaaacaacaaaaacatggctttcaagttaaagtccaaatcctgccatgatctgtcagtgttgtag

SEQ ID NO: 119183 - DNA, 891 bp, Artificial Sequence
  Description of Artificial Sequence: Synthetic coding sequence
atgaccctcaacaatgtcacgatgcgtcagggcacagtgggcatgcagccacagcagcagcgctggtccattccagccgatggaagacatctcatggtgcagaaagaaccgcatcaatattctcaccggaacagacactctgctactccagaggatcactgccggagaagctggtctagtgacagcacagactccgtgatttcttctgaatccgggaatacttattatagagttgtgctcatcggcgagcagggtgtgggtaagagcactttggctaacatcttcgccggagtgcatgactctatggactcagattgtgaggtgctgggtgaggacacttacgagcgcaccctcatggtggatggagagtccgccactatcattctgttagatatgtgggaaaacaagggcgagaatgagtggctccatgatcactgtatgcaagtaggcgacgcctaccttatcgtgtactccatcacagatcgcgcaagttttgagaaagccagtgagctgcgaattcagttacgccgggccagacagaccgaggatatccccatcattttggtgggtaacaaatccgacttggttagatgtcgtgaggtgtccgtgtccgaggggagggcctgcgccgtagtctttgactgcaaatttatagagacatctgcggcagtacagcacaatgttaaagagttattcgagggaatcgtgcggcaggttaggttgcgacgcgactctaaggaaaagaatgagaggagattggcatatcagaagcgcaaagaaagtatgcctcgtaaagcccgtcgtttttggggaaagatcgttgcaaaaaacaataaaaatatggcctttaaacttaagagcaagtcatgccacgatctgagtgtcctctag

SEQ ID NO: 119184 - DNA, 282 bp, Artificial Sequence
  Description of Artificial Sequence: Synthetic coding sequence
atgactctgaacaacgtcacaatgcgacagggcactgtgggcatgcaaccccagcaacagaggtggtcaattcccgcggacggacgtcatctcatggtacagaaggaaccacaccaatactcgcatcggaatagacactccgccacccctgaagatcactgcaggagatcatggagctcagattcaaccgattctgtgatttcctcagaatccgggaacacatactatcgggttgtcttgataggtgagcagggcgtgggaaagtccacactggctaactag

SEQ ID NO: 119185 - DNA, 927 bp, Artificial Sequence
  Description of Artificial Sequence: Synthetic coding sequence
atggtcatggagaagcctagccctctcctggtggggcgcgaattcgtcagacagtactataccttgttgaatcaggcacccgatatgttgcaccgcttttacggtaagaatagctcgtatgttcacgggggtctggacagcaatgggaagccagccgacgctgtgtatggccaaaaggaggttgaagagcccgaagagcgtcagcaaacacccgaagtggtccctgatgattcggggaccttttacgatcaggctgtggttagcaatgatatggaggagcatctggaagagccggtggccgaaccagagcctgaccccgaaccagaaccggagcaggagcctgtgagcgagatacaggaggagaagccaccgagaccagaatctaaacctgagagccaaattcccccccagaggccacagcgcgaccagcgtgtaagagagcagcggattaatatccctccacagaggggaccacgtccaatccgggaagctggagaacagggcgatattgaaccgcggaggatggtgcgtcacccagatagtcaccagctgttcataggcaatctgccccatgaagtggataagagcgagttaaaggatttctttcagagttacggcaacgtggttgagttacggattaactccggaggcaagctccccaatttcggattcgtggtctttgacgatagcgaacctgtgcagaaagtgttgagcaatcgcccgataatgttccgcggcgaggtccggctgaacgtcgaagaaaaaaaaaccagggcggctcgcgagggagaccggagagataaccgtctccggggaccgggcgggccccgaggaggcttagggggtggcatgaggggccctccgcgtgggggaatggttcagaagcctgggtttggagtgggccgcggcctcgctccgagacagtag

SEQ ID NO: 119186 - DNA, 1401 bp, Artificial Sequence
  Description of Artificial Sequence: Synthetic coding sequence
atggtcatggagaagccgagccccttactggttgggcgtgagtttgtgcgccaatactacacactgcttaaccaggcccccgacatgttgcacaggttctacgggaagaactcctcctatgtgcacggaggcttagattccaatggcaagcctgcagatgctgtgtacggtcagaaggagatacatcgaaaagttatgtcccagaacttcaccaattgccataccaagatccgtcatgttgacgctcacgccactctgaacgatggcgtggtggtacaggtcatgggactcctatcaaataacaatcaggcgctcagacgcttcatgcagacattcgtgctcgcgcccgagggatcagtggctaacaagttctatgtccataacgacatctttcgctatcaggatgaggtttttgggggattcgttacagaaccccaggaggagtcggaggaagaagtcgaggaaccggaggagcggcaacaaacacctgaggtggtaccagatgatagcgggactttttatgatcaggcagttgtttctaacgatatggaagaacatctggaggagcccgtggcggagcccgagcctgaccccgagcctgaaccagagcaagaaccggtgagtgagatacaggaagaaaagccagaacctgtgttagaagagaccgctcccgaggatgcacagaaaagttccagcccagcccccgctgacatcgcccagactgtgcaggaggacttgaggacattcagctgggcatccgtgacctctaaaaatctgcctcctagtggggcagttcccgtgaccggaatccccccacacgttgtgaaggtgccggcctctcagccaaggcccgaaagcaaaccagagtcccagattccaccccaacgtcctcagcgagaccagcgtgttagggaacagaggatcaacatacctccgcagcgcggacctcggcctatcagagaagctggggaacaaggcgacattgagcccagaagaatggtgcggcatccagactctcaccagttgtttatcggcaacctgcctcacgaagttgataaaagcgagctcaaggacttctttcagtcatatggtaatgtggtcgaactgagaattaactctggggggaaactgccaaatttcgggttcgtggtttttgacgattcggagccggttcaaaaagtgctgagtaacaggcctatcatgttccgaggagaggtgagactgaatgtggaagagaaaaagactagggctgctagggaaggcgacagacgggataatcgcttgcggggacctggcggtcccaggggagggcttggcggcggaatgagaggacccccccggggtggtatggtgcagaaaccagggtttggagtgggtagagggctggccccgcgccaatag

SEQ ID NO: 119187 - DNA, 1401 bp, Artificial Sequence
  Description of Artificial Sequence: Synthetic coding sequence
atggtgatggaaaagccaagcccactactcgtgggccgtgaattcgtacgacaatattatactctgttaaatcaggcaccagacatgctgcaccgcttttacggcaagaatagcagctacgtccatgggggattggatagtaatggtaaacccgcagacgccgtgtatggccagaaagagatccaccggaaagttatgtcacagaacttcaccaattgtcacaccaagattaggcacgtcgacgcccatgctaccctgaacgacggagtagtggtgcaggtgatgggcctgctgagcaacaacaaccaggcactgaggcggttcatgcagacctttgtgctggctcctgaagggtccgttgccaacaagttttacgtgcataacgacatttttaggtatcaagatgaagtgttcggaggtttcgtgacagaaccacaggaagagagcgaggaggaagtcgaagagccagaagaaaggcaacagacacccgaggtggtaccggacgattctgggactttctacgaccaggctgtggtgagtaacgatatggaggaacaccttgaggagcccgtcgccgaacccgagcctgacccagaacccgagccggaacaggaacctgtgtcagagatccaagaggaaaagccagagcctgtcctcgaagagaccgcacctgaggacgcacagaaaagtagctcgccagctcctgcggacattgcccagaccgttcaagaagatctgaggaccttcagctgggccagtgtgacaagcaagaacctcccaccctccggagcggtgccggttactggcatcccaccgcacgttgttaaggtgcccgcctcacagccccggcccgaatcgaagccggaatcgcagatcccccctcaaagaccgcagcgcgaccagagggttcgggaacaaaggatcaacatccccccacagagagggccaagaccaattcgagaggcaggggaacagggagatattgaaccaaggcgcatggttcggcacccagattcccatcagttattcatcgggaatctccctcacgaagttgacaagtctgaacttaaagacttcttccagagttacgggaatgtggttgagctgcgaatcaatagtggaggcaagctgcccaattttggctttgtggttttcgacgattctgaacccgtccagaaggtgttgtctaaccggcccattatgtttcgcggtgaagtccggctcaatgtcgaagaaaagaaaacaagagctgcaagagagggcgatcggagagacaaccgactgcgcggccccggagggcctcgtggcgggctcggcggtggtatgcgcggcccacccagagggggcatggtgcaaaaacccggctttggagtcggtagggggctggccccgcgccaatag

SEQ ID NO: 119188 - DNA, 318 bp, Artificial Sequence
  Description of Artificial Sequence: Synthetic coding sequence
atggtcatggaaaaacctagtcccctattggttggtagggagtttgtgcggcagtattatacccttctcaatcaggcccctgatatgttgcatcgattttatggtaagaactcatcatacgtgcatggaggtcttgactctaatggaaagccagcagatgcagtgtacggccagaaagagattcacagaaaagtgatgagccagaatttcactaactgtcacaccaaaattaggcacgtggatgcgcatgcgactctgaacgacggtgtagtcgtgcaggtaatgggcttattgagtaataataatcaggctttatag

SEQ ID NO: 119189 - DNA, 369 bp, Artificial Sequence
  Description of Artificial Sequence: Synthetic coding sequence
atggtaatggagaaacctagtcccctcctggtcggtagagagttcgtgagacagtactacaccctgctgaaccaggcacctgatatgcttcacagattctacggcaagaacagcagttatgtgcacggaggactagattcaaacggtaagcccgcagatgccgtctacggacagaaagagattcaccggaaggtaatgtctcagaacttcactaattgtcacacaaagattaggcatgtggacgcccacgccaccctgaacgacggggtagtggtgcaggtgatgggcttgttatccaataacaaccaggccctgcgtaggttcatgcagacatttgtcctcgctcctgagtccctcaaaaaaaagtag

SEQ ID NO: 119190 - DNA, 354 bp, Artificial Sequence
  Description of Artificial Sequence: Synthetic coding sequence
atggtgatggagaagccatcccctctgttggtcggtagggaattcgtccgtcaatattacacccttttaaatcaagccccagatatgctgcacagattttatggaaagaactcatcttacgtgcacggcggtcttgattccaacggaaaacctgcagacgccgtttacggacagaaagaaattcaccgaaaagtgatgtcacagaatttcacaaactgtcataccaagatcaggcatgtggatgcacatgcaaccctgaatgacggggtggttgttcaagtcatgggtcttctttctaacaacaaccaggcactccggagatttatgcagacgttcgtacttgcccccgagtag

SEQ ID NO: 119191 - DNA, 369 bp, Artificial Sequence
  Description of Artificial Sequence: Synthetic coding sequence
atggtgatggagaagcctagtccgttgctggtgggccgcgaattcgtgaggcagtattacacactgctgaaccaggctcccgatatgcttcaccgattctatggcaagaactccagctacgtccacggagggctggactcaaatggaaaacccgctgatgccgtgtacggccaaaaggaaatccacaggaaagttatgtctcaaaacttcacaaactgccatacgaaaattagacacgtcgatgcccacgccaccctcaatgacggggtggtggtgcaggtgatgggactcctaagtaataataaccaggcattgcgccggtttatgcagacctttgtgctggcgcccgagtctctcaagaagaaatag

SEQ ID NO: 119192 - DNA, 321 bp, Artificial Sequence
  Description of Artificial Sequence: Synthetic coding sequence
atggtgatggagaaacccagcccgctactggtaggacgggagttcgttagacagtattatacccttctcaatcaggcccctgacatgcttcacaggttttacggcaagaacagtagctacgtgcacggagggctcgacagcaatggaaagccagccgacgccgtgtacggacagaaagaaatacatcggaaagtgatgtctcaaaacttcactaactgtcatactaaaatcaggcacgtcgatgctcatgcgacactgaatgacggggtcgtggtgcaagtcatggggttgctatctaacaataaccaagccctgcggtag

SEQ ID NO: 119193 - DNA, 855 bp, Artificial Sequence
  Description of Artificial Sequence: Synthetic coding sequence
atggaagaacacctggaagagcccgtagctgagcctgagcctgatcctgaaccggaaccagaacaggagcctgtttccgaaatccaagaggaaaaacctgagcctgtactcgaagagactgctccagaagacgctcaaaaaagctcctctcctgctccagccgacattgcacagaccgtgcaggaggatttgcggaccttctcttgggcttccgtgacatccaaaaatctgcctccttcgggtgctgttccagtgactggcattccaccccatgtagttaaggttccagcctcacagccaaggccagagtcaaaacccgaatctcagatcccaccacagcggccccaaagggaccaaagggtcagagaacagaggatcaacattcctccccagagggggccccgcccaatccgcgaagctggcgaacagggcgacatagagccacgtcgcatggtgaggcaccctgactcacatcaacttttcatcggaaaccttccacacgaggtggacaaatcagagctgaaggattttttccagtcctacggcaacgttgtggaactgcggatcaacagcggcgggaaacttccaaacttcggctttgtcgtgttcgatgattctgaacctgtacaaaaggtgctgtcaaataggcccatcatgttccgaggcgaggtcaggttgaacgtggaggagaaaaagacccgagcagctcgagaaggcgacagacgagacaaccgcctcaggggacccggcggcccacgcggcggtctggggggcgggatgagggggcccccccgtggagggatggtgcagaagcccggtttcggggtgggcaggggactggcccccagacagtag

SEQ ID NO: 119194 - DNA, 4359 bp, Artificial Sequence
  Description of Artificial Sequence: Synthetic coding sequence
atggtcaaactcgatatccacaccctcgcacaccacctcaagcaggaacggttgtatgtcaacagcgagaaacagctcattcaacgcttgaatgctgatgttctcaagacggccgaaaaattgtatcggacggcatggatagctaagcaacagcggatcaatttggacaggctgataattacctccgccgaggcctcccccgctgagtgttgtcagcacgcaaagatcctggaagatacacagtttgtcgatgggtataagcagctgggttttcaggaaaccgcttatggagagtttctgtctcgcctcagggagaaccctcggttgatagcatcttccctcgttgccggcgaaaagctgaaccaagagaacacccagtccgtgatctacacagtgttcacttcactgtacggcaattgcattatgcaggaagatgaaagttatctgctccaggttctcaggtaccttatcgaatttgagttgaaggaatcggataaccctcgcaggctcctcagacgaggaacctgcgccttctcaatactatttaaattattctccgagggactcttctccgccaagttgtttctaaccgcaacgcttcacgagcctattatgcaactcctggtggaggatgaagaccatctcgaaactgaccccaataagctgattgagaggttcagtccaagtcagcaggaaaaactttttggggagaagggcagcgataggttccgccagaaggtgcaagagatggtggaatctaacgaggcaaagctcgttgccctggttaataagtttattgggtatttaaagcaaaacacctactgctttccacacagcctgcggtggattgtatcccagatgtacaaaacactctcttgcgtggaccggttggaagtgggtgaagtacgggccatgtgtaccgatctgctgctcgcgtgtttcatttgtcccgctgtagtgaatccagagcagtacggcataatatctgatgctcccattaacgaggttgctaggtttaatctgatgcaggttggccgtctgctgcagcagcttgcaatgacgggtagcgaagagggtgatccacggaccaaaagctcactgggaaagtttgacaagtcatgtgtagcggcattcctggacgtggtcattggcggtcgtgcagtggaaacaccccctttaagcagcgtgaacctgctggagggcctgtcacggaccgtggtctacattacatattctcagcttattacgcttgttaatttcatgaagagtgttatgagtggcgatcagcttcgggaggatcgaatggctctggacaatctcttagctaatctgccccccgccaagcctgggaaaagctcttccctggagatgactccttataacacaccgcagctgtctccggccaccactcccgcgaacaaaaagaacaggctgccaatcgcgacccggtcacggtctaggacaaacatgctgatggacctacacatggaccacgaagggtcttcgcaggaaaccatccaagaagtgcaaccagaagaggtactggttatttcgctcgggaccggtccccaactgactcccggcatgatgtccgagaatgaggtgttgaatatgcaactttcagatgggggccagggcgacgtaccagtggatgaaaataaactgcacgggaagcccgataagactctacggttcagcctctgttcagacaacctagagggaatcagtgaggggccttctaacagaagtaattccgtttcaagcctggacttggaaggcgagagcgtatcggagttgggagccgggccgagcgggtccaacggagtggaagccctgcagctgttagagcatgagcaggccacaacgcaagataacctggacgacaaactacggaaattcgaaatccgggatatgatggggcttaccgatgaccgagacatttcagaaacagtatcagaaacttggtctacagatgtgctgggctcagatttcgatcctaatatcgacgaggatcggttgcaggaaatcgccggagctgccgctgagaatatgctggggtctctcttgtgtctgccaggcagcggctccgttttactcgacccctgtactgggtccacaatcagcgaaaccacaagtgaggcatggagtgtagaggtcttacccagcgactccgaggcgcctgacctgaaacaggaggagaggctgcaggaactcgaatcatgctccggcctcggctctacaagtgacgatactgacgtccgagaggtgtcttctcgcccctctacccccggactgtccgtggtcagtggtatttccgccacaagtgaagatatccccaacaaaatcgaagacctccgaagtgagtgctcttctgattttggtgggaaagattccgtgaccagtccagatatggacgaaatcacccatggagcctcggctgtggtgcggcctaaggtccactacgccaggccctctcatcccccccccgatccccccatcttggagggtgcagtcggggggaatgaagcaaggctgcccaattttggcagtcatgtgctgacacccgccgagatggaggcctttaagcagcgccactcatatccagagaggctggtgaggtctcggtcttccgacatcgtctcaagcgtgagaagacctatgagcgaccccagctggaatcggcgccctggaaatgaagaacgagagctgccccccgccgcagctatcggagcgaccagcctcgtggctgccccccacagttctagcagcagcccctctaaggattctagcaggggagaaaccgaggagagaaaggatagcgacgacgaaaaatctgaccgtaaccgaccatggtggcggaaacgattcgtgtcggccatgccgaaggcgcctattccattcaggaagaaggaaaagcaagaaaaggacaaggatgaccttggcccggaccggttttccacactgaccgatgatccaagtcctcggctgagcgctcaggcgcaggtggccgaggatattctcgataagtataggaacgcaattaagagaacgagccccagcgacggggctatggctaactacgaatcaactggggataatcacgaccgcgatctgtcctcaaaattactgtaccatagcgacaaggaggttatgggagatggagagtcagcacacgacagcccgagagatgaggccctgcaaaacatttccgccgacgatcttccagatagcgcttctcaggcagctcatcctcaggactctgctttctcataccgggatgcaaagaaaaagctgaggctggcactttgcagtgccgacagcgtcgctttcccggtgctgacacactccacccgtaatgggctgccagaccataccgaccctgaagacaatgaaatcgtatgcttccttaaagtgcagatagcagaggctatcaatctccaggataaaaatttaatggctcaattgcaggagactatgagatgcgtgtgccgctttgacaaccggacatgtcgcaagctcctcgctagtattgctgaggattatcgcaaacgtgccccctacatagcttatttgactagatgtcgccagggactgcagactacacaagcccaccttgaaaggctgttgcagcgcgttctcagagataaggaggtagcgaatcgctatttcacaacggtatgcgtcagactgctgctggaaagtaaggagaagaagatcagggagtttattcaagactttcagaagctcacagcagcagacgacaaaaccgcccaggtggaagatttcctgcagttcttgtacggggcaatggctcaggacgtaatctggcagaatgcctcagaagagcaattacaggacgcacagttggctatcgagcgcagtgtgatgaacagaatatttaagctggctttctacccaaaccaggatggtgacatccttcgcgatcaagtgctacacgaacatattcaacgcctctccaaggtagttacagccaatcacagagcactgcagatcccggaggtttacctgagggaggctccatggccgagcgcccagagtgaaatccggacgatttctgcctacaagacaccacgggacaaagttcagtgcatactgcgcatgtgctcaaccatcatgaacctgctaagtctggctaatgaagactcggtcccaggcgctgatgattttgtacctgtattagtgttcgtgctcatcaaggccaatccgccgtgcctgctctccacagtccagtatattagctccttctatgcctcatgtctgtctggggaagaatcgtattggtggatgcaatttaccgcagccgttgaatttattaagaccatcgacgaccgaaagtag

SEQ ID NO: 119195 - DNA, 1494 bp, Artificial Sequence
  Description of Artificial Sequence: Synthetic coding sequence
atggtcaagttggatatccacacgctggctcatcacctcaagcaggagaggctgtatgtcaactccgagaaacagttgattcagcgcctaaatgctgatgtgcttaagacagcagaaaagttgtataggacagcctggattgcaaaacagcagcggatcaatctggatcgtttgatcattacgagtgctgaagcctctccagctgagtgctgtcagcatgcgaaaatcttggaagacacccaattcgtggacgggtataagcagctgggctttcaagagactgcgtatggggagttcctgtcaaggctgagagaaaacccacggttaatcgcctctagcctggtggccggtgaaaagcttaaccaggaaaacacacaatctgtaatttatacagtatttacctcactctacggaaattgcatcatgcaagaggacgagagttatttgttgcaggttctgcggtatctgatcgaatttgagttaaaggaaagcgataatccccggagacttctgaggcgagggacttgtgcattctctattctctttaagctgttttcagaaggcttgttttcagctaagctgttcctcaccgccaccctgcatgagcccatcatgcagcttcttgtcgaagacgaggatcacctggagaccgatcccaacaagctgatcgagaggtttagcccctcccagcaggagaagctgttcggcgaaaagggatcagataggttcagacaaaaggtgcaagaaatggtggaaagcaacgaggcaaaactagtggctctcgtgaataaattcatcggctatctgaaacagaacacttactgttttcctcattcactgagatggattgtgtcccagatgtacaagaccctgagttgtgtggaccggttggaggttggtgaggttcgagcgatgtgcacagatttgttgctggcttgtttcatctgtccagccgtagtgaatcctgagcagtatggcatcatatctgatgcccccattaatgaggtggccaggtttaatttgatgcaggttggacgactcctccagcagctggccatgactgggtccgaagaaggcgatcctcgaacaaaatccagtctgggaaagttcgataaaagttgtgtagccgcctttctcgatgtggtcatcggagggagagccgtggaaacaccacccttgagtagtgttaacttgctggaggggcttagccgtactgttgtgtacataacttatagtcaattgattactttggtaaactttatgaagtctgtgatgagcggcgatcagctgagagaggatcgcatggctctcgataacttactggctaatctgccgcccgcgaagcctggcaagtctagttctctggagatgaccccatataatacccctcagcttagcccggcgactacacccgctaataagaagaaccggctgccaattggcaaggaaaacttttcttactggtcttttctgctgaatttgatcttccattag

SEQ ID NO: 119196 - DNA, 4437 bp, Artificial Sequence
  Description of Artificial Sequence: Synthetic coding sequence
atggtgaaactggatatacatacgctcgcccatcacctgaagcaggagcgcctctacgttaactctgaaaaacaacttatacaacgtctgaatgccgacgtgttaaagactgccgagaagttatacaggaccgcctggattgcgaaacagcagagaataaaccttgaccggctgatcattacgtcagccgaggcttctcccgccgagtgttgtcaacatgctaagatactggaggatacccagttcgtcgatgggtacaaacagttgggttttcaggagacggcatacggggaattcctgtcccgcctaagggaaaacccccgcctcattgcatccagcctggtggctggcgaaaagcttaaccaggaaaatacacaatccgttatctacacagtcttcacctcactatacggaaactgcattatgcaggaggacgagtcttatctgcttcaggtcctacggtatctgattgaatttgagctgaaggaatccgacaacccaaggcggctgctgcggagggggacttgtgcattttcgatcctgtttaagctgtttagtgagggcctgttctcagcgaagctatttctgacagcaactctccacgaacccatcatgcagctgctggtggaggatgaggatcatttagagaccgatccgaataaactgatagagaggttcagtccaagccaacaagagaagttgttcggcgagaagggctctgataggtttaggcaaaaagtgcaggaaatggtggagtcaaatgaggccaagcttgtggccctggtgaataagtttatcgggtacctcaagcagaacacctattgttttccacactccctccgatggattgtgtctcaaatgtataagacgctgagctgcgtggatcgcctggaggttggtgaagttcgggccatgtgcacagacctcctgcttgcttgctttatctgcccagctgtcgttaaccctgaacagtacggtattatctctgatgcccccattaacgaagtcgcccgctttaacctgatgcaggtaggccgactgctgcagcagctggccatgaccggaagcgaagagggggatccccggacgaagtcgagcctgggcaaattcgataagtcatgcgtagctgcttttttggatgtggttatcggcggccgtgccgtggagacgcctccactttcttcggtcaacttactggagggcttgagtcgcactgtggtgtatattacttattcgcagctgattactctggtgaacttcatgaaatccgtgatgtccggcgaccagctcagagaggaccgtatggccctggacaatttgctagcaaacctcccccccgcgaaaccggggaagtcttcatctttagaaatgacgccttataacacaccccagctatcacctgcaactaccccagctaataagaagaacagactgcctatcgccacacgcagcagatcacgtaccaatatgcttatggatctgcacatggatcacgaggggagtagtcaagagaccattcaggaagtacaaccagaagaagtgttagtgatttctctgggcaccggacctcagctgacacccggaatgatgtcagagaatgaggtgttaaatatgcagctcagtgacggcgggcaaggcgatgttccggtggatgagaataagctgcacgggaagcctgataaaacgttaagattctccctctgctccgacaaccttgaaggtatctcagagggaccttccaacaggtcaaactctgttagctccctggacctcgagggggagtctgtgtctgaactgggggccggacccagcgggtctaatggagtggaggccctgcagttgctggagcacgagcaggccactactcaggacaacctggatgacaaactaagaaagttcgagatccgggatatgatggggctgacagatgatcgggacatctcggagaccgtgtccgaaacttggtctactgacgtgctgggttcagattttgacccgaatattgatgaggaccgactccaggagattgccggagcagcggctgagaatatgcttggctccttgctttgcttgccagggtcaggaagtgttctgctggatccctgtacagggtcaacaattagcgaaacaacttccgaggcatggagcgtggaggtcctcccaagtgatagcgaagcccccgatttgaaacaggaggaaagattacaggaactcgagagctgttctggcctcgggagcaccagcgatgacaccgacgtgagggaagtgtcctctaggccctctacacctggactctccgtggtttcgggaatcagcgccacatctgaagacattcctaacaagatagaggacctcaggtctgaatgttccagcgattttggaggaaaagacagcgtgacaagcccagacatggacgagattacacacggcgcacaccagctgacatcccctccaagccagtctgagtctctgctcgccatgttcgatcctctcagctcccacgaaggtgcttccgcggtggtgaggccaaaagtccactatgcccggcctagtcatcctcccccagatccacccatattggagggcgctgttggtggaaatgaggctcggctgcctaatttcgggtctcatgttctaaccccagcagaaatggaagctttcaagcagagacatagctatcctgaacggctggtgcggtcacgatcctcggatatagtgtcttctgtgaggaggcccatgagcgaccctagttggaatagacgccccggaaacgaagagcgtgagcttcccccagccgccgccatcggagccacatcgctggtggcagcgcctcactcatcttccagcagcccttcgaaagattcttctagaggggaaaccgaggagcgaaaagatagtgacgacgagaagagtgatcggaataggccctggtggcgaaagaggtttgtttctgcaatgcccaaagcccccattccgttccggaaaaaagagaagcaagaaaaggacaaggacgacctgggccccgatcggttttcgacccttacagatgatccctctccccgtctttccgcccaagcacaagtggccgaggatatccttgataagtatcgcaatgcaattaagagaacctccccatctgacggcgctatggctaactacgagagtaccggtgacaaccacgatcgagatctgtctagtaagctgctgtatcattctgataaagaggtaatgggtgacggggagagtgcccacgactcgcccagagacgaggccctgcagaacatcagcgccgacgatcttccggattcagcgagtcaggcggcccacccacaggactcagccttctcatacagagatgccaaaaagaaactgaggttggcgctctgctccgccgattccgtggcatttcctgtgctgacacatagcaccagaaacggtctgccagaccacacagatcccgaagataacgagatcgtctgttttctgaaagtgcagatagccgaagcaatcaacctacaggataagaatctgatggcccagctccaggagacgatgaggtgcgtgtgcaggtttgataacagaacgtgtcgtaaactgctcgcgtctatcgccgaggattatcgcaagcgcgctccttacatcgcatacctgaccagatgccggcagggtctccaaaccacccaagcacaccttgaacgcctactgcagagggtgctgagggacaaggaggtggcaaacaggtactttactaccgtctgtgtgcggcttctacttgaatctaaggagaagaagatcagagaatttatacaagatttccaaaaactgaccgccgccgacgataagacagctcaggttgaggacttcctacaatttctgtacggcgccatggcgcaggatgtaatctggcaaaacgcgagtgaagagcagctacaagatgcgcaactcgctatcgagcggagcgtgatgaacaggatctttaagctcgccttctatcccaatcaggatggagacattctccgggaccaagtgctccatgagcatatccagaggttaagcaaagtagtcaccgccaaccatagagccttgcagatccctgaagtatacttacgtgaagccccgtggcctagcgcacaatctgaaatacgcaccatctctgcttacaaaacacctagggacaaggtccaatgcattctgagaatgtgcagtacgattatgaacctactttctctcgccaacgaagactctgtgcccggggcagacgatttcgtcccggtactcgtattcgttcttatcaaggctaatcccccttgtctattaagcaccgttcagtacatttctagtttttatgcgtcttgtctgtccggcgaagagtcgtactggtggatgcagttcacggccgcggtggaattcataaagacaattgacgaccggaagtag

SEQ ID NO: 119197 - DNA, 4464 bp, Artificial Sequence
  Description of Artificial Sequence: Synthetic coding sequence
atggtgaagctcgatatccacactctagctcatcatcttaaacaggagcgcctctatgtgaattccgagaagcagctgatccagagattgaatgctgacgtgctgaaaactgccgagaagctctataggacagcctggattgctaaacagcaacggatcaacctcgaccggctgatcatcacctcggcagaggctagccctgccgagtgttgccagcacgccaagattcttgaggatacacagttcgtggatggatacaagcagctgggcttccaggagacggcctatggggaattcctgtcccggctgagggagaaccctcggctcatagcttcgagtctggtagccggcgaaaaacttaatcaggaaaacacacagagtgtcatctataccgtgtttacctcgctgtacgggaactgtatcatgcaggaggacgagagttatctgttacaggtgctgcggtacctgatcgaatttgagctgaaggagtctgataatcccaggcgcctcctcaggcgtgggacttgcgctttctccatactctttaaactgttctccgaagggctcttcagcgcgaagctgttcctcaccgccaccttgcacgagcctatcatgcagctgctggtggaagacgaagaccacttagaaactgatcccaataagctgatagaaaggtttagcccttcacagcaggagaagctttttggggaaaagggctccgatagatttaggcagaaggttcaggagatggtggaatcgaatgaggccaagctggtggctctggttaataaattcatagggtacctaaaacaaaacacctactgttttccccactctttgcgctggatcgtttcacagatgtacaagacactcagctgcgtggatcgactggaagtgggtgaggtcagggcgatgtgtactgatctgctgcttgcctgctttatctgtcctgccgtggttaaccctgaacagtatggaattatctcagatgccccaattaatgaggtggcaagattcaatttgatgcaggtcggtagactccttcaacagcttgctatgaccggttctgaggagggggacccacgtacgaagtcttccttaggtaaattcgacaagagttgtgtcgctgcattcctagacgtggtaattggaggccgcgccgtcgagacgccaccattgtccagtgtgaacttgttggaagggctcagtaggaccgtggtttacattacttactcgcagcttattacactggtgaactttatgaaatctgtaatgagcggagaccaactgagggaggataggatggctctggataacctgctcgccaaccttcccccggccaaacccgggaagtcatcaagtcttgaaatgactccatataatacgcctcagctgtctcctgcgacaactccagcgaacaaaaaaaaccgattacctattgcaactagatcgcgcagcaggaccaacatgcttatggacctacacatggatcatgagggctctagtcaagaaacgatacaggaagttcaacctgaagaagtcttagtgattagcctaggaaccgggcctcaactcaccccaggcatgatgtcagagaacgaggtgctaaatatgcagttgtccgatggaggacaaggggatgtacctgtcgatgagaataagctccacggaaaacccgataagacgctcagatttagtttgtgctcagataacctggaaggcatctcagagggtccaagcaaccgatccaattccgtgtcctccctcgacttagagggagagtccgtctctgaactgggcgcgggtccaagcgggtcaaacggtgtagaagccctgcagctgctcgaacacgagcaggctacgacacaggacaacctagacgacaaactgagaaaattcgaaatcagggacatgatgggcttgaccgatgacagagatatttcagagacagtctccgaaacgtggagcaccgacgtgcttggcagcgactttgatcctaacatcgacgaggatcgcttacaagaaattgcaggggcagccgcagaaaatatgctgggttctttattgtgcctccccggtagcggctctgtcttgctggatccctgcactgggtctaccatcagcgaaactaccagtgaggcctggagcgtggaggttctaccttctgactccgaggctcctgacttgaagcaggaagagaggctgcaagaactcgaatcatgcagcggattgggaagcacgagtgatgatactgacgtgagggaggttagtagtagaccctccactcctgggctgtccgtagtctccggtatcagtgcaacctctgaagacatccccaataaaatcgaggatcttcgatccgaatgcagcagcgatttcgggggtaaggacagcgttaccagtcctgacatggacgagatcacacacgacttcttatatattcttcagcccaagcaacattttcaacatatagaggccgaagcggacatgagaatccagctgtcctcatccgctcaccagctgacgtctccaccttcccagtcagagtcactcttggccatgttcgatcctctcagctctcatgagggagcttctgccgtagtccggcctaaggtgcattatgcccgaccgagccatccgccacccgacccccccatcctggagggagctgtgggcggcaacgaggcccgactgccaaactttggctcccacgtcctgacacctgcagaaatggaggcatttaaacagaggcattcttacccagagcgcctagtaaggagccggtctagcgacatcgtaagcagcgtgaggcgcccaatgtctgatccgagctggaatagacgcccgggcaatgaagaacgagagctcccccccgccgccgctattggggcaacatcactggttgccgcacctcacagctcatcttcctcaccttctaaagactcttctagaggtgagacagaggaacggaaggattccgacgatgaaaagtcagaccggaataggccctggtggcgtaaacgctttgtctccgccatgccaaaggcgccgattccattcagaaaaaaggagaagcaagaaaaagacaaagacgatcttggccccgacaggtttagtaccctcaccgacgacccaagccctagactctccgctcaggcccaggttgcggaagatatcctggacaaatatcgaaatgccatcaaaagaactagcccctcagatggcgccatggcaaattacgaaagtactgaagtgatgggcgatggcgagagcgctcatgattcaccaagggatgaggccctgcaaaacatctcagccgatgacctcccagactctgcttcccaggcagcacacccccaggacagtgcattcagttaccgcgatgcaaagaagaagctcagactggcactgtgttcagccgacagtgtcgcctttccggtcctgacccatagcaccagaaacggcctgcccgaccacacagaccctgaagacaacgagattgtgtgtttcctcaaggtccagatagcagaagctataaatttgcaggacaagaatctgatggcgcaactgcaagaaactatgcgatgtgtctgtcgctttgacaacaggacatgcagaaaactgttagcgagcattgccgaagattatcgaaagagggccccatacatcgcttacctgacgagatgtagacagggactccaaacaacccaagcccatctcgagcgactgctgcagagggtcctgcgggacaaggaggttgcgaatcggtatttcacaactgtgtgcgtgcgcttgttactagaaagcaaagaaaagaagatccgagagttcatacaggacttccaaaagctcaccgctgctgacgacaagacggctcaagttgaggactttcttcagttcttgtacggggccatggcccaggatgtgatctggcagaacgcatctgaagagcaactccaagacgcccagctcgccattgagagatcagtgatgaaccgaatctttaaacttgcattctacccaaatcaggatggcgatatccttcgcgaccaagtgcttcacgaacacatccagagactcagcaaggttgtaacagctaatcatcgggcactgcagatcccagaggtgtatctgcgggaggcaccatggcccagcgcacaatccgagataagaaccattagcgcctacaagacgcctcgagacaaagtccagtgcatcctgcggatgtgcagtaccatcatgaacctgctcagccttgccaatgaagactccgttcccggagcggatgacttcgtgcctgtgctggtctttgtcctcatcaaggctaaccctccgtgcttgctgtctacagtgcaatatataagtagcttctacgctagttgcttatccggagaggaatcctattggtggatgcagttcactgctgctgtggaattcattaaaactatcgacgaccggaaatag

SEQ ID NO: 119198 - DNA, 2514 bp, Artificial Sequence
  Description of Artificial Sequence: Synthetic coding sequence
taaaactgcattatgcaggaagatgaatcctatctgctgcaggtccttcgatatctaatcgagttcgagctcaaagaatctgataatccacggcgccttctgcgtcgtgggacatgcgccttttctatattgttcaaactgtttagtgaaggactctttagcgcaaagctgtttttgacggccacgcttcatgagcccatcatgcagttgctcgtcgaggacgaggaccatctcgagacagaccccaataaactgattgaacggttcagcccaagccaacaggaaaaactgttcggggaaaaaggatcggatcggttccgacagaaagtgcaagagatggtcgaatcgaatgaggctaagctcgtagcattggtgaataaattcatcggatacctgaagcaaaacacttactgcttcccccatagcctgcgctggatcgtttcccagatgtataagactctctcttgcgtagacaggctggaagtgggagaagtccgagccatgtgcacagatctgttgctggcctgtttcatttgccctgcagtggtgaaccctgaacagtacggtattatcagcgacgcccctataaacgaggtggcccgttttaacctgatgcaggtcggaaggctgctccagcagctggcaatgactggctccgaagagggcgaccccaggacgaaatcatctttggggaaatttgacaagtcttgcgtcgctgcatttttggacgtcgtaatcgggggacgcgccgtggagacgcctcctctgtcaagtgtcaatctgctggagggtctgtccaggacggtggtgtacattacatatagccagcttattacactggtcaactttatgaagagcgttatgtccggcgaccagctaagagaagatagaatggcgcttgataacctcctcgccaacctgcctcccgccaagcctggcaaatctagtagtcttgagatgacaccctacaatactccccagttgtctcctgcaaccactcctgctaacaagaaaaaccggctccctatcgcaacaagatccagatcaaggactaacatgttaatggacttacacatggatcatgagggcagctcccaggagaccatacaagaagtccaaccagaggaagtgttagtgatcagcctcggcaccggtccacaactcacccccgggatgatgtccgagaatgaggtgctgaacatgcaactttccgacggcggacaaggcgatgtgccggtcgatgagaataagctgcatgggaagcccgataagacactcaggttctcactttgcagtgacaacctggaaggcatttctgaagggccctcaaataggtctaatagtgtgagtagcttagatttggagggtgaaagtgtgagtgaactgggcgcaggacccagcggttccaatggcgtggaagctctccagctcctggaacatgagcaggcaactacacaagataacttagacgacaagctgagaaagttcgaaatcagagatatgatggggctcacggatgatcgggacatttctgagacagtgagcgaaacctggtccaccgacgtgctaggctctgacttcgacccaaatatcgatgaggaccgtctccaagagatcgccggggctgccgctgagaacatgttgggatcgctgctgtgtctgccaggctcaggttctgtcctgttagacccctgcacaggttctactatcagtgagaccacgtctgaggcatggtccgtagaggtcctgccttccgactcagaggcaccagatctgaagcaggaggagcggctgcaagagctcgagagctgttctggcctgggttccacgagtgacgacaccgatgtacgcgaagtgagtagcagacccagcacaccaggtctctcggtggtttcaggcatttccgccacgagcgaggatatacctaacaagattgaggacttgcggtcagagtgcagctcagactttggtggaaaagactcagtgacaagccctgacatggacgagattacgcacggagcttctgccgtggtgcgcccaaaggtgcattacgctagaccttcccatcccccccctgatcccccaatactcgagggcgccgttggtggaaacgaagcccgtctgcccaacttcggcagtcacgtcttaactccagctgaaatggaagcattcaagcaaaggcactcatatccggagcgcctggtccgtagtcgcagcagtgacatcgtgagctccgtccgtagaccaatgagcgaccctagctggaacagacgtcccggcaacgaagaacgagaactccctccagccgcagccataggggccacaagcctggtggccgccccacactcttccagttcatcgcctagtaaggactcttcacgcggagagaccgaggaaaggaaagattccgacgatgagaaatcagaccgaaatcgcccgtggtggcggaagaggtttgtctcagcaatgccaaaagcccctatcccctttcgcaagaaggaaaagcaggaatag

SEQ ID NO: 119199 - DNA, 2493 bp, Artificial Sequence
  Description of Artificial Sequence: Synthetic coding sequence
taacttagaagaggtacgtgtgcatttagcatcttatttaaattgtttagcgagggcctcttcagtgctaaactattcctgaccgcaacactgcatgaacccatcatgcagctccttgtagaggacgaagaccacttagagactgaccccaacaagctgatagaacgcttcagcccatcgcaacaggaaaaattatttggtgagaaaggctctgatagatttcggcagaaggtacaggagatggtggagtctaatgaggccaagcttgtggccttagtgaacaagttcataggctacctcaaacaaaacacgtactgcttcccacatagtctgaggtggattgtgagtcagatgtacaaaacactgagctgtgtggatcggctggaggtcggtgaggtcagagctatgtgtaccgatctccttcttgcctgcttcatttgtccggcggttgtgaaccccgagcagtacgggataatcagcgatgcaccaatcaacgaggtggcacgatttaacttgatgcaggtgggccggctactgcagcagcttgcgatgactgggtcagaggagggagatcctcgcacaaaatctagcttaggcaagttcgacaagtcttgcgttgccgcatttttggatgtcgtgatcgggggaagggccgtggagacaccacctctgtcctctgtcaatctgctggaagggctgagcagaaccgtggtgtatatcacgtactcacagcttatcacactcgtgaactttatgaagtccgtgatgtccggtgaccagctgagggaagatagaatggctctcgacaacctgctggccaatctgccccccgctaaacccggcaagtcatccagtctggagatgaccccatataacactccccagctctcccctgctacaacccctgctaataagaaaaaccgcctgcccataggccagcagctcgccgccattaccgcttgggattcatccgctaccaatattacaagtcacattaccgtggtcacaccatttgccacaaggtctcgaagccgcaccaatatgctcatggatctgcatatggatcatgaggggagctcccaggagacgatccaggaggtccaacctgaagaggtcctggttataagtttgggcacaggtccacagctcaccccgggtatgatgagcgaaaatgaggtattaaatatgcagctctccgacggcgggcagggtgatgtgccagtagatgaaaataaactccacggccctagcaaccgaagcaattcagtgagctccctggacctggagggtgaatccgttagcgaactaggcgctgggccctcgggcagtaacggggttgaggccctccaactgttagaacacgaacaagccactactcaggacaacctggatgataagctgcgtaaatttgaaatcagggatatgatggggctcacagatgacagggacatcagtgaaacggtttcagagacgtggtctactgatgttctggggtccgatttcgatcctaatatcgatgaagatcggctccaggaaatcgcgggcgccgctgccgagaatatgctgggctccttgctatgcctgcccgggtcaggctctgtgctcctggacccatgcactggcagcacgattagtgagacgactagcgaagcatggagcgttgaagtcctgccaagcgacagcgaagccccagatctgaagcaggaagagcgtctacaggagctggagtcgtgcagtggattgggcagtacctcagacgacaccgatgtgcgggaggtgtcctctcggccatctacccccgggctcagtgtcgtgtctggtatctcagccacctcggaagacatccctaataagatcgaggatttgcggtctgagtgttcatctgactttggggggaaggactctgtcacgtctccggacatggacgaaatcactcacggggctcaccagctcacatcccccccatctcagtccgagtccctcctcgctatgttcgatcccctcagcagccatgagggggcctccgccgtcgttaggcccaaggtccattatgcccgaccgagccaccccccgcccgaccctccaatccttgaaggagctgtcggaggtaatgaggcccgactccccaacttcggcagccacgtgcttacacccgcagagatggaggctttcaaacagagacatagctatcccgaacgcttagttcggagtcggtctagcgatatagtttcttcagtgcgacgaccaatgagtgatccctcatggaaccgcagacccggtaatgaagaacgcgagctgccccctgcggccgcaataggggccacgtccttggtggctgccccccactcctcctccagctccccgtctaaggatagttctcggggcgaaaccgaagaacggaaggattctgatgacgagaaaagcgatcgaaatcggccatggtggagaaaaaggtttgtgtctgcaatgccaaaggcaccaatccctttttag

SEQ ID NO: 119200 - DNA, 516 bp, Artificial Sequence
  Description of Artificial Sequence: Synthetic coding sequence
atggttcaatggccgcgcatgtcctacggaaagacgcgcgttatgaataggattttcaaactggctttttaccctaaccaagacggcgatatccttcgcgatcaggtacttcatgagcatatacaacgactgagcaaggtggtgactgctaaccaccgcgccctgcagatcccggaagtgtacctgcgcgaggcaccttggccaagcgcccagtcagagatcagaacgatctccgcctacaagaccccacgagacaaggttcagtgcatcttgcgaatgtgtagtaccatcatgaacctgctgtctctggctaatgaagattctgtccctggcgccgatgacttcgtgccagtacttgtcttcgtgctaattaaagctaaccccccttgtctgctgtccactgtgcaatacatatccagcttctatgcgagctgtctgtcaggggaggagtcctattggtggatgcaattcactgcagccgtagaatttatcaaaaccatcgacgatcggaaatag

SEQ ID NO: 119201 - DNA, 354 bp, Artificial Sequence
  Description of Artificial Sequence: Synthetic coding sequence
atggtcaaactggacattcacactctggcccaccacctaaagcaagaacgcctgtacgtcaattctgaaaagcagctaatccagcgcctaaacgccgatgtgctcaagacagcagagaaactctacaggacagcttggatcgccaagcaacagcgaatcaacttggatcggttaatcattaccagcgccgaagcctctcctgctgagtgttgccaacacgctaagatccttgaagatacccagttcgtcgatggatacaagcaactggggtttcaggagacagcttatggcgagttcctctcacggctgcgggagaatcctcggttgatcgcttcgtccctggtggccgggtag

SEQ ID NO: 119202 - DNA, 2967 bp, Artificial Sequence
  Description of Artificial Sequence: Synthetic coding sequence
atggttaagctggacattcacactcttgctcatcacttgaaacaggaacgcctgtatgtgaacagtgaaaaacaattgatccagaggctaaacgctgacgtgctcaagacagcagaaaaactatacaggacagcatggatcgctaaacagcagagaatcaaccttgacaggcttatcattacatccgccgaagcgagcccagcggagtgctgccagcatgcaaagatcctggaggacacacaattcgttgatggttacaagcagttagggtttcaagagacggcatacggcgagttccttagtcgcctgagagagaaccctcgcctaatcgcgagctctctggtggctggggaaaaactgaatcaagaaaatacacaaagcgtaatctatactgtgtttacatccctgtatgggaactgtattatgcaggaggacgaaagctacttgctgcaagtgctgcgatatctgatcgaattcgagttgaaagaatctgacaatcctcgaagactgttgcgtcgtgggacttgtgcttttagcattctgttcaaattgttttcagaggggctcttctctgctaaactcttcttgaccgcaactttgcacgagccaataatgcagttgttggtggaggatgaggaccatctggagactgatccaaacaaattgattgaacggttttctcccagccaacaggaaaagcttttcggagagaaaggctcagaccgctttaggcagaaagtgcaggaaatggtcgagtcgaatgaggccaaactagtagcccttgtcaataagtttatcggttatctaaagcagaacacatactgttttccgcattccttgcgctggatagtgagccagatgtataaaactctgtcctgtgtggaccgcctcgaagtgggcgaagtacgagctatgtgcacagacttgcttctggcatgttttatttgcccagctgttgttaatcccgaacagtacgggattatctccgacgctcctatcaacgaggtggcaaggttcaatctgatgcaggtggggcgactgctgcagcagctggctatgactggatctgaggagggggatccacggaccaaatcttctctaggcaaatttgacaaaagctgtgtagccgccttcctagatgtggttattggcggacgggccgtggaaacccctcctctgtcttccgtcaatctgctcgagggtctgtcacgaacagtggtgtatatcacctacagtcagctgataacactcgtcaatttcatgaaatccgtcatgtctggagatcaacttcgagaagatcgcatggccttagacaacctgttagccaacctgccaccggcaaagccagggaaatcatctagtctggaaatgaccccctataacacgcctcagctgtctccagccaccacccctgcaaataaaaagaatcgtctccctatcgccacacgaagtagatcaaggaccaacatgcttatggacctccacatggaccatgaaggctcctcccaggagacaatccaagaggtccagcctgaggaggtgctggtaatttcacttgggaccgggcctcaactgacccctggaatgatgagtgagaacgaggtcctgaatatgcagctgagtgacggagggcagggggacgtgcctgtcgatgagaacaaattacatgggaagcctgataaaaccctgaggttttctctgtgtagcgacaacctggaaggaatttcggagggccccagcaaccgctcaaattctgtctctagtctggacctggaaggggagtccgtaagcgagttgggcgccggcccatctggctcaaacggggttgaagccttgcagcttctggagcacgaacaagccacaactcaggacaacctcgacgataagctgcgaaagttcgagattcgggacatgatggggctgaccgatgaccgcgacatttctgaaacagtatccgagacgtggtctaccgacgtgctaggttcagactttgacccaaacatcgacgaggatagactgcaggagatcgccggcgccgcagcggaaaatatgctgggatcgctcctttgccttcccggcagcggaagcgtcttgttagatccctgtaccggtagtactatttccgagacaaccagtgaagcatggtctgtggaggtcctccctagcgacagtgaagcccctgatctgaagcaggaagagcgcctgcaggaactcgagtcctgcagtggcttaggttcgaccagcgatgacaccgacgtgagggaggtctctagcaggccatccacgccgggcttgtctgtggtgagtggaattagtgccactagtgaggatattcccaacaagattgaggatctcagatctgagtgctcaagcgactttggcggaaaggattctgtcaccagccctgatatggatgaaatcacgcacggggcgcaccagctcacgtcacctccttcccagagtgaaagcctgttagccatgttcgaccctctgtcaagccatgagggggctagcgcagtagtccgacctaaagtacattacgcgcggccaagccatcccccgccagatcccccaatcctggaaggggcagtcggtggtaacgaagcccgactgcctaatttcggttcccatgtgctcacccctgcagagatggaggccttcaaacaacgccacagctatcctgaaagactcgttcgctccagatctagcgatatcgtgtcgtcagtaagacgacccatgagcgatccaagctggaaccgtagacccggcaacgaagaacgcgaacttcccccagctgcagccattggcgcaacatccctcgttgcagctccacattcctcatcaagcagtccatcaaaggactcatctagaggcgagactgaggaacggaaggattcagatgatgagaaaagtgaccggaatcgaccatggtggcgcaagaggttcgtgtccgcaatgccaaaatag

SEQ ID NO: 119203 - DNA, 4437 bp, Artificial Sequence
  Description of Artificial Sequence: Synthetic coding sequence
atggttaaactggatatccacacactggcccaccatttgaagcaagaacgcttatacgtgaactccgaaaagcagctcatccagcggcttaatgccgacgtgttgaagactgcagaaaagctctacaggactgcgtggatcgccaaacaacagagaatcaacctcgacaggctcattattacatcagccgaggcctcaccagctgagtgttgtcaacatgcgaaaatcctggaagatactcagttcgtggacggctataagcagcttggcttccaggaaactgcttacggtgagtttttatccagacttcgggagaacccaagattgatcgcatcctccctggtagccggagagaaactgaatcaggaaaacacacagtccgtgatatacaccgtctttacatctctgtacgggaactgcatcatgcaggaggacgaaagttatctgcttcaggtgctgcggtacctcatcgaatttgaactaaaggaatccgacaatccccggcgactgctgaggcgggggacctgcgcgttctcgatcctgtttaagttgttttcggaaggattgttttccgctaaactttttcttactgcgaccctacacgaacccataatgcagttgctcgtggaggacgaggaccacttggagactgatccgaacaagctgattgaaaggttttcaccttcgcaacaggagaagctgttcggcgaaaaagggagtgaccgctttcgccagaaagtacaggaaatggtggagtctaatgaggccaagctggtggcactggtgaacaagtttatcggatatctgaagcaaaatacttactgctttccccatagcctccgctggatcgtctcacagatgtacaagaccttgtcctgtgtggacagactagaggtgggcgaggtaagggctatgtgcacagacctcctcctcgcatgttttatctgtcccgccgtggtcaatccagagcagtacggcattatatccgatgctccgattaatgaggtggccaggtttaacctgatgcaagttgggaggctgctgcagcagttggcgatgacaggctcagaggaaggggatccccggacaaagtctagcctgggcaagttcgacaagtcatgcgtggctgctttcttggatgtggtgatcgggggtcgggcagtcgagacaccaccactgtcctccgtcaatcttctggaggggctgagccggaccgtcgtgtatatcacttattcccagctgataacgttagtcaatttcatgaagtctgtgatgtccggggatcaactccgtgaagatagaatggcccttgataacttgctcgcgaacttgccacctgccaagcccggtaagtcttccagcctggaaatgactccttacaacaccccacagctgtcgcccgccactaccccagccaacaagaagaacagactccccattgccacaaggagtagatcccgcactaatatgttgatggatctccacatggaccatgagggttcttcacaggagaccattcaagaagtgcagcccgaagaagtacttgtgatctcgctaggcactggaccacaactgaccccaggaatgatgtcagagaatgaagtgctcaatatgcagttgtcggatggcggccagggtgacgttccggtggatgagaataagctgcatggtaagccagacaagactctgcgattctctttgtgttccgacaaccttgagggtatttctgagggcccaagcaataggagtaattcagttagttcccttgacttggaaggtgagtccgttagcgagctgggagctggccctagcggctcaaatggtgtggaagcgctccagctactcgaacatgagcaggcaacaacccaggataacttggacgacaaactccgtaaatttgaaattcgcgacatgatgggactcaccgacgatcgcgacatttccgagaccgttagcgaaacctggtccactgatgtcctgggctccgacttcgaccccaacatagacgaggacagactgcaggaaatcgctggagccgcggccgaaaatatgcttggtagcttactgtgtctcccgggttctggcagcgttctactagacccttgcacaggttccacaatctcggagactactagcgaggcctggagcgtagaggtcctgcccagtgacagcgaggctccagaccttaagcaagaggagcgtcttcaggagctggaaagttgttccggtttggggagcacctcagacgacaccgatgtccgcgaagtgtcctcacgtccctcgaccccagggttgagcgttgtgagcgggatcagcgcaacatcagaagacattccgaataaaatcgaggatctgagaagcgagtgttccagcgattttggaggcaaggattctgttacctcccctgacatggacgagattacacacggagcgcatcagctgacttccccaccatcccagagtgagagtttactggccatgtttgatcctttgagttcgcacgaaggagcgtccgctgtggttcgcccaaaagtccactacgctaggccttcacacccaccgcctgatccccccatactggaaggagccgtgggcggcaatgaggctaggttgcctaatttcggctctcatgttctcactccagctgaaatggaggcattcaaacagaggcactcataccccgagcgtctggtgagatcccggtctagcgacattgtaagcagcgtgagacgtcctatgagcgacccttcttggaaccgtcgacctggaaacgaggaaagagagcttccacccgctgccgccatcggagctacttcacttgtggccgcaccgcatagctcatcctcttctcctagcaaagatagttcacggggagaaacagaagagaggaaggacagcgacgatgaaaaaagtgaccgcaatcgaccgtggtggaggaagcggttcgtctcggccatgcctaaggcccccattccatttcgcaaaaaggaaaaacaggagaaggataaagacgatctgggacctgaccggttcagcaccctaaccgatgatcctagccccagattgtcagcacaagcccaggtggctgaagacatcttggataaatatcgtaatgccatcaaacgcacttcaccatccgacggagccatggccaattacgagagcacaggcgataaccacgatagggatctgtcctctaaactactgtatcacagcgataaggaagtcatgggggacggcgagtcagcccatgattctccgcgggacgaagctttgcagaatattagtgccgacgatttacccgatagtgcaagtcaggctgcccatccccaggattctgcctttagctacagagatgcaaaaaagaagctaaggctggctctctgtagcgccgattccgtggcattcccggtactgactcacagtacacgaaatggcctcccggaccataccgatccagaggacaacgagatcgtgtgtttcctcaaagtccagatagcagaagccatcaatcttcaggataagaatctgatggcccaacttcaggaaactatgcggtgtgtgtgtagattcgacaaccgcacctgtaggaaactgttagcctctatagctgaagactatcgcaagcgggcaccatatattgcgtatctcacgcggtgtaggcagggcctgcagaccactcaggcccacctcgagcgcctgctgcaacgcgtcttgcgcgacaaggaggtagcaaacaggtactttacaacagtgtgtgtgcgcctgctgctggagagcaaagagaagaaaatccgcgaattcatacaggacttccaaaagctgactgctgcagacgacaagacagcccaggtagaggattttttgcagttcctctacggagcaatggcgcaggacgtgatatggcagaacgcaagcgaggaacagcttcaagacgcacagcttgccatagaacgatcagttatgaaccggatatttaagctggccttttatccgaatcaggacggggatattctgagggaccaggtcctacacgagcacattcagaggttgtccaaggtcgtgacagcaaaccatcgggcactccagatcccagaggtatacctgagggaagccccttggcctagtgctcagtccgaaattcgcacaatctcagcctataagactccacgggacaaagtacagtgtatacttagaatgtgtagcacaattatgaacttgctttcccttgccaacgaggactccgtaccaggtgccgacgacttcgtgccggtcttagtgttcgtgcttattaaggccaacccaccttgtctgttaagcacagtgcagtatatctcatctttctacgcgagctgtctttcgggcgaggaatcctattggtggatgcagtttaccgcagccgtcgaatttatcaagactatcgacgacagaaagtag

SEQ ID NO: 119204 - DNA, 2271 bp, Artificial Sequence
  Description of Artificial Sequence: Synthetic coding sequence
atggtgaaactagatatccacacattggcccatcacctgaaacaggaacgtttatacgtcaactctgagaaacagctgatccagcgcttgaacgccgatgtattgaaaaccgccgagaaactataccggaccgcttggatcgcaaagcaacaacgcatcaacctcgaccggctgattattacgagcgcagaggcatctcccgcagagtgctgccagcacgccaagatactggaagatacccagtttgtcgatggctataagcagttggggtttcaggagacggcatacggggaattccttagccgcctccgggagaatccccgacttatcgctagctcccttgtcgccggagagaaattgaatcaggaaaacactcagtccgttatctataccgtgtttacatctctttatggaaattgtataatgcaggaggacgagtcctatttgctccaggtcctaagatatctgattgagtttgagttaaaggaaagcgataacccgcggaggttactacggcgggggacatgcgctttttcgatactcttcaagctcttttcagagggccttttttccgccaagcttttcttaaccgcaaccttgcacgagcccatcatgcagttacttgttgaggacgaggatcaccttgagacagatccaaacaaactaattgagagattttctcctagccaacaggagaagctgtttggcgaaaagggatccgaccgttttcggcaaaaggtgcaggagatggtggagtcaaacgaagccaagctagtcgctttggtcaataagtttatcggttatctcaagcagaatacttattgtttcccccactctcttaggtggattgtatcccagatgtacaaaacactctcgtgtgtggaccggctggaggtcggcgaagtacgtgctatgtgtaccgacctactgctggcctgtttcatttgcccggcagtcgtcaaccctgagcagtacgggatcatctctgacgcgcccatcaacgaggtcgccaggtttaatctgatgcaggttggccgtctcctccagcagctcgccatgacaggctcggaggagggtgatccgcggacgaagtcttcactcgggaaattcgataagtcctgcgtggctgcatttttagacgtggtgatcggcggaagggctgttgaaactcctcccctatctagcgtaaacctcctggaaggcttatctcgcaccgtggtctatattacctacagtcagttaatcaccttagttaactttatgaagtctgtgatgagtggcgaccagcttcgggaagatagaatggctctcgataatctactcgcgaatcttcccccagcaaagcctggcaagtcatcttcactcgagatgaccccctacaatacaccacagcttagccctgctactacccctgctaataagaaaaaccggctgcccatcgctactagaagccgctcaaggaccaacatgctgatggacctgcacatggaccacgagggtagttcccaggagactatccaggaggtgcagccggaagaagtgctggttatcagcctggggactgggccccagttgacgcccgggatgatgagtgagaatgaagtgttaaacatgcagctgagcgacggcggccaaggggacgttcccgtggacgagaataagctgcacgggaaacccgataaaaccttgcgatttagcctgtgtagcgataacctggaagggatctccgagggtccaagtaaccggagcaactctgtcagttcactcgatctcgagggagaaagtgtgtcagagctcggagcagggccatctgggtcaaacggcgtggaggcgctgcagctcctcgaacacgagcaggcaaccacccaggacaacctggacgacaagttgcggaagttcgagattcgagatatgatgggcctcacggatgacagggatatttcagaaaccgtgtccgaaacatggtcaacagacgttctcggaagtgacttcgatcctaacatcgatgaagaccggctccaagaaatcgccggagctgccgccgaaaatatgctgggaagcttgctttgtctgcccggttcaggtagcgtgctgctcgacccttgtacgggatctacaatctcagaaaccacttcagaggcctggtctgtggaggtgctaccttctgacagtgaggctccagatctgaagcaggaagagcgtctacaggagctcgaatcttgctcaggtcttggatctacatcagatgataccgacgtaagggaagcttag

SEQ ID NO: 119205 - DNA, 921 bp, Artificial Sequence
  Description of Artificial Sequence: Synthetic coding sequence
atgggcggccgaaagatggccacggatgaagagaacgtatatggactggaggaaaatgcccagtcaagacaggagtccactagacgactcatcctcgtgggccgcaccggagccgggaaatctgctacaggaaattctatcttgggacaaaggagattcttttcacggctgggtgctacatcagttactagagcttgtaccacgggttcccggaggtgggacaaatgccacgttgaagttgtggacacacccgacatcttctctagccaggtaagtaagacagatccaggctgcgaggaacgcggacactgttacttgctgtccgcacctggcccccacgccttacttctggtcactcaattgggcagattcaccgctcaggatcagcaggccgttagacaggttagagacatgttcggtgaagacgtgctgaaatggatggtgattgtctttacgcgcaaagaggatttggccgggggatctctgcatgattacgtgtcgaacacagaaaatcgggcactgagagagctggtggccgaatgcggtggcagagtatgtgcatttgataatcgggcaacagggagagagcaagaagcgcaagtcgaacagctactgggcatggtggaggggctcgtgttggaacacaagggagcccactacagtaacgaagtctatgagctggcgcaggtgctgcggtgggccggtccagaggaacgactgagacgtgtggcggagagagtggcagccagagttcagcgacggccgtggggcgcatggctatccgcccggctctggaaatggctaaagtctccaaggtcttggcgactgggtttggccctcctgcttggtggagccctgttgttctgggtccttcttcatagacgctggtctgaagctgtggcggaagtcgggcccgactag

SEQ ID NO: 119206 - DNA, 681 bp, Artificial Sequence
  Description of Artificial Sequence: Synthetic coding sequence
atgtcgtgggtgcaggctgccagtttgattcaggggcccggcgataagggtgacgtgtttgacgaagaagccgatgagagtctgctggcccagagagagtggcaaagcaacatgcagcgaagggtgaaagagggctatagggatggtattgacgccggtaaggccgtaacactacagcagggcttcaatcagggatacaagaaaggggcagaggttattctcaactatggtcgcctcaggggaacattatcggcacttttgtcctggtgccacctgcataacaacaattcaaccttaattaataagataaacaaccttttagatgcggtcggacaatgcgaagaatatgtcctgaaacacctcaagtctataaccccaccaagtcacgtggtggatctcttagactccatagaagatatggacctttgtcacgttgttcctgcagaaaagaaaattgatgaagcgaaggacgaacgtctatgcgagaataacgccgagtttaacaaaaattgctctaaatctcattcggggattgactgttcttacgttgagtgctgcaggactcaggagcatgcacactctgagaacccgagtcctacatggatcttggaacagacagctagcctggtcaagcagctgggcctcagcgtcgacgtgctacagcatctgaagcaactgtag

SEQ ID NO: 119207 - DNA, 990 bp, Artificial Sequence
  Description of Artificial Sequence: Synthetic coding sequence
atggccgcccaatacggctcaatgagcttcaacccaagcacccccggcgcttcctatggcccagggagacaggagccacgcaattcacagcttagaattgttctggtcgggaaaacaggggctggcaagtccgctaccggtaattccatcctgggccgcaaggtattccacagcggaacagccgctaagtccatcacaaagaagtgtgaaaagagatccagctcatggaaagaaaccgaactggtcgttgtagataccccgggcatcttcgacacggaagtaccaaacgcggagacctccaaagaaattatcagatgcattcttctaacctcgccgggcccccatgcactgttactcgtcgtaccactcggacgttatactgaagaagagcataaagcaacagagaagattcttaagatgttcggcgaacgtgccagatcattcatgattctcatctttacaagaaaagacgacctaggtgatactaatcttcacgactatttaagagaggctccagaagacatccaggaccttatggatatctttggcgatcggtactgcgctctcaataataaagccaccggggcagagcaggaagcccagcgggctcagctgcttggattgatacaaagagtggtgcgggagaacaaggagggctgttatacaaacaggatgtaccagagggcagaggaagaaatccagaaacagacacaggctatgcaggagctgcaccgagtggaactggagcgggagaaagctcgaatcagggaagaatatgaagagaaaattcgcaagctggaagacaaagttgagcaagagaagagaaaaaagcaaatggaaaaaaagctggccgagcaagaggctcattacgccgttaggcagcagcgagctcggaccgaagttgaaagtaaagatggcatcctcgaactgataatgactgcactgcagatcgcctcattcatcctgcttcgactgttcgccgaagattag

SEQ ID NO: 119208 - DNA, 786 bp, Artificial Sequence
  Description of Artificial Sequence: Synthetic coding sequence
atggccgcccagtacgggagcatgtcattcaatcccagcactcccggggccagctatgggcccggacggcaagaacctagaaactcccaactcaggatagtgctagtcgggaaaaccggcgccggaaaaagtgctaccggcaactcaatactaggacgaaaagtattccattccggcaccgccgctaaaagcatcactaaaaaaatactaaaaatgttcggtgagcgtgccagaagcttcatgattctgatttttacacggaaggatgatctgggggataccaaccttcacgattatctgagggaggcacctgaggatatccaagacctgatggacatttttggcgaccggtactgcgccctaaataacaaagcaaccggagcagagcaagaggcccagcgcgcccaattactgggactcatccagcgcgtggtacgggagaacaaagagggatgctacaccaacagaatgtatcagcgcgcggaggaggaaatccagaaacagacccaggcgatgcaagaactccaccgtgtggaactggaacgcgaaaaagcccggatccgggaagagtacgaagaaaaaatccgaaagctggaggataaagtcgagcaggaaaagaggaaaaagcagatggagaaaaagctggccgaacaggaagcacattacgccgtacggcagcaaagagcccgtaccgaggtggagtcaaaggacgggatcttggagcttatcatgaccgcactccagattgcatcattcatcctgttaaggctgtttgctgaggattag

SEQ ID NO: 119209 - DNA, 456 bp, Artificial Sequence
  Description of Artificial Sequence: Synthetic coding sequence
atggccgctcagtacgggtcgatgagcttcaatccaagcactcccggggcgtcgtacggcgagcgagctttctcagcacctcagacacgccttcaagggggacccggcaggcaggaacctcgcaacagccagctgcgtatcgtactggttgggaagacaggcgccgggaaatcggcgactgggaatagtattctaggcagaaaggtcttccacagcggtacagccgctaagagcatcactaaaaagtgcgagaaacgttcctcatcctggaaggagacggaactggtggtggttgatacgccagggatattcgacacagaggttcctaatgcggaaaccagcaaggagattattcgatgcatacttctgacctctccagggccacacgccctgcttctggtggtgcctctcggcaggtacactgaagaggagcataaagcaaccgagaaaatttag

SEQ ID NO: 119210 - DNA, 924 bp, Artificial Sequence
  Description of Artificial Sequence: Synthetic coding sequence
atgggcggcttccaaagaggaaagtacggcactatggcagaaggcagaagtgaagataacctcagtgctaccccacctgcccttagaatcatcctcgtgggtaaaactggctgtgggaaatccgcaacaggtaacagcatcctgggccagcctgtctttgagtcgaagctccgggctcagtccgtgacgcgtacatgccaagtcaagactggtacttggaatggcagaaaggtcctggttgttgacacgccaagcatctttgagtcacaagcagacacacaggagctgtataaaaatattggagattgttacctcttgagtgctccaggaccacacgtgctcctcttggtgattcagttgggacggttcacagcgcaggacactgtcgccattaggaaagtcaaggaggtgttcggtactggcgccatgaggcacgtagttattctcttcactcacaaagaagacctgggcggccaagctcttgacgattatgtggctaataccgataactgtagtctcaaagaccttgtgcgggaatgcgagcgtaggtattgtgcatttaacaactggggctcagttgaggagcagcgacaacagcaggctgagctcctggctgtgattgagcgactgggccgcgagcgcgagggcagctttcattcgaatgatctctttctggatgcccagctccttcaacgcaccggggccggcgcctgccaagaagactatcgtcagtaccaggccaaggtcgagtggcaagtagagaagcataagcaggagcttcgggagaacgaatccaactgggcctacaaggccctgctgcgtgtaaaacatctaatgcttctgcactacgagatttttgtctttctgttgttatgtagtatattgttcttcataatttttctattcatattccactatatttag

SEQ ID NO: 119211 - DNA, 1032 bp, Artificial Sequence
  Description of Artificial Sequence: Synthetic coding sequence
atggagctgagcgctcccgcccacggaagctcgctcactgcttctgcccagcctccgagcgtgacagccacactggaggaccgggcgcagcaaccctttcttgagaggatgggtgggttccagaggggtaagtacgggaccatggctgaagggcggtcagaagacaacctgtccgccacacctccagcgctacggatcattctggtgggaaaaacagggtgcgggaagtctgcgactggtaattccattctgggtcagccagttttcgaaagcaaattgagggctcagtcagtgaccagaacctgtcaggttaaaacaggaacatggaacgggcggaaagtccttgtggttgacacacccagtattttcgagtctcaggctgacacacaagaactttacaagaatatcggagactgttacctgttgtctgctcctggccctcatgtcttactgctggtgattcaactgggcaggtttacagcacaggacacagtcgcaatccgaaaggttaaagaagtcttcgggaccggggccatgaggcatgtcgtgatcctgttcacccacaaagaggaccttggcggccaagctttagatgactacgtagccaatactgataactgtagcttgaaagaccttgtgagggaatgtgaacgtcggtattgcgccttcaataactggggaagcgtggaggaacagaggcagcaacaggctgaattgttggcagtcatagaacggctggggagggagagagaaggctcatttcactcgaatgacctcttccttgatgctcagctactgcagcgaaccggcgcaggggcttgtcaggaggattataggcagtaccaggcaaaagtagaatggcaggtggaaaaacataaacaagaactaagagagaatgagtccaactgggcatacaaagctttgctgagagtgaagcatctgatgcttttacactatgaaatctttgtgtttctgctgctgtgcagcattctcttctttatcatcttcctgtttatcttccattacatttag

SEQ ID NO: 119212 - DNA, 879 bp, Artificial Sequence
  Description of Artificial Sequence: Synthetic coding sequence
atggaggaggaggagtacgaacagatcccacaggaaaaccccccagaggaactctcccaagatcccgtgctggagctgtctgggggattacgagagaaggaacagaagacccctcggcggttacgactaatcctgatggggaagacagggagcggaaaatcagcaaccggtaacagtatcctcggcagggacgtctttgagagcaaactgagcaccagacccgtcaccaaaaccagtcagcggaggtcacgcgaatgggccggtaaggaactggaagtcatagatacccccaacatcttgtctccacaggtttcacctgaggtggctgatgctatttgtcaggccatagtgctttcagcccccggaccccatgctgtgttgctggtgactcagctcgggcgctttaccgacgaagatcaacaggtggtccgtaggctccaagaggtttttggcgtgggagttctaggacacactatcttagtgttcactcgtaaagaggacctcgccggcggatctctcgaagattacgtgcgcgagacaaataaccaggcccttgcttggctggatgtaactctggcccggcgccactgcggtttcaataaccgggcccagggcgaggagcaggaggcccaattaagggagctcatggaaaaagtagaggctattatgtgggaaaatgagggagattattacagcaacaaagcctaccagtacacacagcagaacttccgcctcaaagagcttcaggaaagacaggtatcgcaggggcagggctctgaagacgtacctggtgaggaatcttggctggaaggcttatcacagatacagaaggagagtgaagaggctcacaggtgcctgctgggcaaggccgacctgtag

SEQ ID NO: 119213 - DNA, 1062 bp, Artificial Sequence
  Description of Artificial Sequence: Synthetic coding sequence
aaaccttggtactgggtatcctggtgtagcataggccaggtgagtctgttcttcttggggtctgcactcgccctgggagaaaacgtccagccccacctgcaaggttgcgggccccgcatggttgcccaacgttggttccagggaagatgctggagcttcactatctgcccatgctctctcggagtccaccccgaagctcccggcgatgacaagatggggtatatgggaccgtatcccagctccctttgttttctgtggatttttttggggctgcgcgagaaggagcagaaaacacctcggcgactgcgcttaatcctgatggggaagacgggaagcggaaaatccgctaccgggaattcgatcctgggccgggacgttttcgaaagcaagctgtccaccagaccggtaaccaagactagtcagcgccgatccagagagtgggccggtaaggaactggaggtcatcgacacaccaaacatcctaagcccacaggtttctccagaggttgctgacgccatttgtcaggcaattgtactgagcgctccaggtccccacgccgtgctgctggtgacacagctgggccgcttcactgatgaagatcagcaggtggtgcgacgcctgcaagaagtattcggtgttggcgtgttggggcatacaatcttagtatttacaagaaaggaggacttggccggcggatctttagaagattatgtccgagaaacaaataaccaggcactcgcctggctggatgtgacgctggcccggcggcactgcggtttcaataatcgcgcgcagggggaagagcaagaagcccaattaagggagcttatggagaaagtggaggctatcatgtgggagaacgaaggtgattattattccaacaaagcttaccagtacactcagcaaaatttccggctcaaagagctgcaggaaagacaagtgtcacagggacagggcagcgaggacgtcccaggcgaagagtcatggctagaagggctgtctcaaatccagaaggaaagcgaagaggcacaccgctgcctccttgggaaggcagacctttag

SEQ ID NO: 119214 - DNA, 189 bp, Artificial Sequence
  Description of Artificial Sequence: Synthetic coding sequence
atggaagaggaggagtatgaacaaattccccaagaaaatccccccgaggagctgtcgcaggatcctgtcctcgagctgtctggcggccttgccagggggggtaggaggtacctgccaagccataggctcattaggccacgcgcccctagaagggcgcccggcgacacaactggacccgtacacggatag

SEQ ID NO: 119215 - DNA, 1266 bp, Artificial Sequence
  Description of Artificial Sequence: Synthetic coding sequence
atgcgttggatcctttttataggtgcactcataggctccagtatctgcgggcaggaaaaattttttggcgaccaggtgcttcgcataaacgttcgcaatggtgatgaaatttctaagctgtcccagttagtgaactcaaataatctgaaattgaacttctggaagtccccttcatcctttaaccggcccgtagacgtacttgtcccatcagtttcgctgcaggcttttaaaagcttcctgagaagtcagggactggaatacgccgtgacgattgaagatctgcaggctttgctcgataatgaggatgatgaaatgcaacacaatgaggggcaggaaagaagctcaaataacttcaactacggggcataccattcacttgaagctatctatcacgaaatggataatatagccgccgattttcccgacctcgctcggcgcgtcaaaatcggtcattctttcgagaatcggcctatgtacgtgttgaagttttccacggggaagggggtgagaaggccagccgtgtggctgaacgcagggatacactcacgggaatggatctctcaggccacggccatctggaccgcgcgaaaaatcgtctccgattaccagcgcgacccagctatcaccagcatactggagaaaatggacattttcctgctgcctgttgcaaacccagacggttatgtctatacacagacgcagaatcgattgtggcgtaaaactcgttccaggaatccaggaagctcatgtataggagccgaccccaaccgtaattggaacgccagctttgctggcaagggggcctctgacaacccatgctcggaggtatatcacgggccccatgccaactcagaggtcgaggtgaagtcagtcgtcgacttcatccagaaacatggcaacttcaaggggttcatagatctgcacagttactctcaactgctgatgtatccctacggctatagcgtaaaaaaggcccccgatgctgaagaactcgacaaggtcgcccgcctagcagcgaaggccctggcctctgtgagcggaacagaataccaagtgggccccacgtgcacaacagtatatccagcttctggaagttccatcgactgggcctatgacaatggaattaaattcgcctttaccttcgagttacgggacactggcacctatggctttcttctccctgctaaccagatcatcccaacagccgaggagacctggcttggtctcaagacaataatggaacacgtgcgggacaatttgtactag

SEQ ID NO: 119216 - DNA, 927 bp, Artificial Sequence
  Description of Artificial Sequence: Synthetic coding sequence
atggttcattgcagctgtgtgctgttccgcaagtacggtaacttcatcgacaaactccggctctttacgaggggggggagcggtggaatggggtatcctcggcttggaggggaagggggaaaaggcggcgacgtatgggtcgtagcccagaatcgcatgaccctaaaacagcttaaggaccggtatccaaggaaacgcttcgttgctggcgtgggcgcaaacagcaaatttcctaacgcaggaaagtcctcattgttatcttgtgtgtcccatgctaaaccagccattgctgactacgcttttaccacacttaagcccgagctcggcaaaatcatgtactcagacttcaaacaaatctctgtggccgacctgcccggcctgatcgaaggggcacacatgaacaaaggcatgggccacaaatttctgaagcatatcgaaagaacccgtcagttattatttgtggtagatataagcggattccaattgtctagtcacactcagtataggaccgcatttgagaccatcatccttctcaccaaggaactggaactctataaagaagagctccagacaaaaccagccttactggctgttaacaagatggatcttccagatgctcaggacaaatttcacgagttgatgagccaactgcagaacccaaaagattttctacacctgttcgaaaagaatatgatccccgaaagaacagttgagtttcagcacatcatacccatttccgccgtgaccggggagggaattgaggagctcaagaactgcatcaggaagagtctggacgaacaagctaatcaggagaacgatgccttgcataaaaaacagcttctgaatctctggatcagcgatacaatgtcttctacagaacccccaagcaagcatgccgtgactaccagtaaaatggatattatttag

SEQ ID NO: 119217 - DNA, 711 bp, Artificial Sequence
  Description of Artificial Sequence: Synthetic coding sequence
atgtccgcaccttcagccactccaatcttcgctcccggagaaaattgctcaccagcctggggtgctgctccggctgcttacgatgcggccgacacccacctgaggatcctggggaagcccgtgatggaacgatgggagacaccatacatgcacgcacttgcagctgctgccagtagcaaaggaggacgggtgctggaagtcggattcggaatggcgattgccgctagcaaagtgcaggaagcgccgatcgacgagcattggattatagaatgcaacgatggagtcttccagcggcttcgagactgggctcctagacagacacacaaggttatcccgctcaaaggtctgtgggaggacgttgcacccaccttgcctgacggccacttcgatggtattctttacgatacctaccccctgagcgaagaaacatggcacacacatcagttcaacttcatcaagaaccatgcgttcaggttgttgaagcccggaggtgtgctcacctattgcaatttgacctcctggggagaactaatgaaaagcaagtattctgacattactataatgtttgaggagacccaggtgccagctttgctggaagctggttttcgtcgggaaaacatcagaaccgaggttatggctctcgtgcccccagctgactgcaggtactacgctttcccacagatgattacccctcttgttaccaaggggtag

SEQ ID NO: 119218 - DNA, 810 bp, Artificial Sequence
  Description of Artificial Sequence: Synthetic coding sequence
atgagcgcgccatcggccactcccatctttgctcccggtgaaaattgctcgcctgcgtggggggcggcccccgccgcatatgatgcagccgatacacacctgcggatcctcggcaagcccgtgatggagagatgggagaccccatatatgcatgcactagccgccgcagcctcatcaaaagggggtcgcgtgttggaggtgggctttgggatggcgattgcagccagcaaagttcaggaagcccctattgacgaacactggataattgaatgtaatgacggcgtgttccagcgacttcgcgactgggccccacgacagacccacaaagtgatcccactgaagggcctgtgggaagatgtcgcgcccactctgcccgatgggcattttgacggtattttgtatgacacctacccgctgtctgaggaaacgtggcacacacatcaatttaacttcattaaaaaccacgccttcagactgctaaagcccggaggggtgctcacgtattgtaacctcactagttggggagaactgatgaagtctaaatacagcgacattacaataatgttcgaagtgaggcctccagaagtgccccacgggtcgcccggctcagacttgggatgggggtgggagggcgctgcaggggctacactgttgcccggagaaggcccctttcttacaccttgggtcggttggaccgtgttagtgcacttggagatcaaggtactgtgcctggcccaatggctgccgggggcagtggctcaggtctataacccttcaacagtggagggaaggggtggccagatcgcttag

SEQ ID NO: 119219 - DNA, 1416 bp, Artificial Sequence
  Description of Artificial Sequence: Synthetic coding sequence
atgtgtgccgctcagatgccacctctggcacatattttcagaggcacatttgttcacagcacgtggacctgcccaatggaggttctgagagatcatctccttggcgtgagtgacagcgggaagatcgtcttcctcgaagaagcctcacagcaagaaaaattggcaaaggaatggtgttttaaaccctgtgaaatccgcgagctgtcccatcatgaatttttcatgcctgggctcgtcgacactcacatccatgcttcccagtatagcttcgcgggtagctcgatagatctgcctctgctggaatggttgactaagtatacttttcctgcggagcacaggtttcagaacatagacttcgcagaagaggtttacactcgtgtcgtgcggcggactctgaagaacggcaccacaacagcgtgctacttcgcaactattcataccgactcaagcctgttactggccgacatcaccgataaatttggccagagggcctttgtgggcaaggtgtgcatggacctaaacgatacattccccgaatacaaggaaacaactgaagagtctataaaggaaacagagcgctttgtgtccgaaatgcttcagaaaaactactccagagtgaagcctatcgtcaccccgaggttctccctctcttgctctgaaacgctgatgggcgaactgggcaacatagccaagaccagagatcttcacatccagtcccacattagcgagaaccgcgatgaggtggaggctgtcaaaaacttatacccgagttacaagaattacacctcagtctacgataagaacaatctgctcaccaacaagacagtgatggcacacgggtgctaccttagcgccgaggaacttaacgtgttccacgagcgcggggcatccatcgcccactgcccgaattctaacctgagcttgtcgtcggggttcctgaacgtgctggaggtacttaagcacgaggtgaagatcggattaggcacagacgtggccggcgggtacagctacagtatgttagacgccataagacgggctgtgatggtgagtaacatcctgttgataaacaaagtcaacgaaaagtctttaacactgaaggaggtgtttaggctagctaccctggggggctcgcaggcacttggtctggacggtgaaatagggaacttcgaagtcgggaaagagttcgacgccatcttgatcaaccccaaagcttccgactcaccgatcgacctgttctacggcgatttcttcggtgacatcagcgaggcggtgattcaaaagttcctctatctgggcgatgacaggaacatcgaggaagtttatgtcggcggaaagcaagtcgttcctttctcatcgtctgtgaaggagaccattcacctgcctgccagttcaccacacccaccacccttcccctag

SEQ ID NO: 119220 - DNA, 1365 bp, Artificial Sequence
  Description of Artificial Sequence: Synthetic coding sequence
atgtgtgcagcacagatgccgcctttggcccacatattccgggggactttcgtgcactccacatggacttgtccaatggaagtattgagggatcacctcctcggggtgagcgactctggaaaaattgtgttcctggaggaagcctcccaacaggagaagttagccaaggaatggtgttttaagccctgtgaaatccgagagcttagtcatcacgagtttttcatgccaggtctggttgatacccatattcacgccagccagtactccttcgccggaagttccatcgatctccccttgttagaatggctgacaaagtatacctttcctgcagaacatcgcttccagaacatagatttcgccgaagaggtctacaccagagtggtgcgccgcacactgaaaaatgggacaactactgcttgctactttgcaacaatccacacagatagttcactcctgctggcagatattacagataaatttgggcagcgggcctttgtcggaaaagtttgcatggacctgaatgacaccttcccagaatataaagaaaccacagaggagtctattaaagagaccgagaggttcgtgagcgaaatgcttcaaaaaaattattcaagggtcaaacccatcgtgaccccgcgttttagcctgtcttgctcagaaactttaatgggggagttggggaatatagccaagacccgggacctccacatccagtcacatatatccgagaatcgggacgaagtggaagcagtgaagaacctgtatccttcttacaagaattataccagtgtttacgacaagaataacctgctcacaaacaagactgtaatggcccatgggtgctatttgtctgcggaagagttaaatgttttccatgagcgcggcgcttctattgcacactgcccgaactctaacctgagcctcagttctgggtttctgaatgttttagaagtgctcaagcacgaagtcaagattggtctcggcacagatgtggctgggggttacagttacagtatgttggacgccataagacgcgccgtgatggttagtaatattctcctgattaacaaagtgaatgaaaagagcctgactctgaaagaagtattccggcttgccacgcttggtggcagccaggcactgggcctggacggggagatcgggaatttcgaggtgggcaaggaatttgacgccattcttatcaatcccaaggcttctgactctcctatagacctcttttacggcgattttttcggcgatatcagcgaggcagtgatccagaagttcttgtatttaggcgacgaccggaacattgaggaggtttatgtgggggggaagcaagtggtccctttttctagctccgtatag

SEQ ID NO: 119221 - DNA, 1182 bp, Artificial Sequence
  Description of Artificial Sequence: Synthetic coding sequence
atgtttttagaggaggcatctcagcaggagaagcttgccaaggagtggtgcttcaaaccgtgcgaaattcgcgagctctcccatcacgaattttttatgcctggtctggttgatacccatattcacgcctctcagtattcgtttgcagggtcttctattgatctgccactgttggagtggttgacaaagtacacgttccccgcagaacacaggttccagaatattgactttgccgaggaggtatacactcgagtcgtaaggaggaccctcaaaaacggcactaccacagcttgctactttgccaccattcacacagattctagtttgctgctggccgacattactgataagtttggccagagagcatttgttggtaaagtgtgcatggatctcaacgacactttcccagaatataaagaaactaccgaagaaagcatcaaagagaccgaacgcttcgtgtccgagatgctccagaaaaactcccatatttcagagaaccgggatgaagtagaggctgtgaaaaacctctatccctcctataaaaattacacatcagtgtacgacaaaaacaacctccttacaaacaagactgttatggcccacggctgctacctatctgccgaagagctgaacgtatttcatgagagaggggcctcgatcgcccattgccctaactctaatctgtccctcagttccgggtttctcaacgtacttgaggttctcaagcacgaagtcaaaataggccttggaaccgacgtagctggcggatatagttatagcatgctggacgcaattcgaagggccgtcatggtttcaaacattctattaattaacaaagttaacgaaaagtcacttaccttgaaggaagtttttcgactagccacccttggcggaagtcaagcccttgggctggatggggaaatcggcaattttgaggtgggtaaggagtttgacgcaattctcataaaccccaaggctagcgacagtcccattgaccttttttatggagattttttcggcgacatctctgaagctgtcatccagaaattcttgtacctgggagacgacagaaacattgaggaggtttacgtgggagggaaacaagtcgtgccattttcctccagcgtgaaggagacaatccacctccccgcttcttcgccacacccaccaccatttccatag

SEQ ID NO: 119222 - DNA, 1233 bp, Artificial Sequence
  Description of Artificial Sequence: Synthetic coding sequence
atggaagtacttcgggaccatctgctgggagtgagcgatagcggaaagatcgtttttctggaggaagcctcccagcaggaaaaactggcaaaagagtggtgcttcaagccctgcgaaatccgcgaactttctcatcacgaattttttatgcctgggctggtggatacacacatacacgcaagccagtactcgttcgctggatcaagtattgatctgcctttgctagaatggctcacgaaatatacgttcccagcagaacatagattccagaatatcgactttgcagaggaagtgtacacacgggtggtgagacgcacgctcaaaaacggaaccactaccgcctgctatttcgctaccatccataccgactctagcttgctgctcgccgacataacagacaaatttgggcagcgcgctttcgtagggaaggtgtgtatggacctgaatgatacgttccccgaatacaaggagaccactgaggaatcgataaaagagactgagagattcgtgagcgagatgcttcagaagaactcccacatttctgagaatcgagatgaggtagaggctgtaaaaaacctgtaccctagctataagaactacacttccgtttatgacaagaacaaccttcttacgaacaagacggttatggcccacgggtgttacctctccgccgaagaactaaacgttttccacgagagaggagcctctatcgcgcactgcccgaattcaaacctcagcctctcctccggcttcttaaatgttctggaagttttaaagcacgaagtcaagatcggtctgggtacagatgtggctggggggtattcctactccatgctggacgccatccgcagagccgttatggtgtcgaatatcctgctgatcaataaggtaaacgaaaaaagtctgaccctgaaggaagtgtttcggttagccaccctcggcggttcccaggcattaggcctcgatggggaaattggcaactttgaggtcggcaaggagtttgacgccattctgatcaaccccaaagcatctgattctccaatagatctattttatggtgatttctttggggatatatcagaggcggtcatccagaaattcctctatctgggcgatgacaggaacatagaggaagtctacgtagggggcaagcaagtggtgccattcagctcgtcggtgaaggagaccatacatctgcccgcttcctccccccatcctcccccattcccatag

SEQ ID NO: 119223 - DNA, 588 bp, Artificial Sequence
  Description of Artificial Sequence: Synthetic coding sequence
atgactttgttccaaaacacgcggcgtcccctgaggaaccggtcccggaagcttcgtgattgtcattccgtaacccaggctggggtgcagtggcgtgacctgtcaagtctaaagcctcctcctcctgtattcaaaagattttcatgcctgtccctcccaagcagttgggactatcgctttgtaagcgagatgctgcagaaaaactacagccgcgttaaaccgatcgtgactccccgcttcagtctttcctgctcagagacactgatgggcgaattagggaatatagccaagactcgagaccttcatatccagtcccatatctctgaaaatcgcgatgaagtggaggctgttaagaacctgtacccttcctataaaaattacacctctgtttatgataagaacaatcttctgactaataaaacagtcatggcccacgggtgctatctgagcgctgaggagctcaacgtttttcacgagcggggagcctccatcgcccactgtcctaattccaatttgagtcttagctctggcttcctcaatgtgcttgaggtcctgaagcatgaagtgaaaatcggtttgggtacatag

SEQ ID NO: 119224 - DNA, 540 bp, Artificial Sequence
  Description of Artificial Sequence: Synthetic coding sequence
gaaaggggcgcctccattgcacactgccctaatagcaatctttccctgtccagtggttttcttaacgttctcgaggtgctgaaacatgaagtcaagatagggttgggaacagatgtggctggtggatactcctactctatgctcgacgccataaggagagcggtgatggtgtctaatatattactgatcaacaaagtgaacgagaaaagcctgacactgaaagaagtttttcgcctggcgacactgggcggctcacaggccttgggcctcgatggagagatcggcaattttgaggtgggcaaagaatttgatgctattctcataaatcccaaggcctctgatagcccaattgacctgttctacggggacttttttggggacatatctgaggctgtaatccaaaagtttctgtacttgggggatgaccgtaacatcgaagaggtctacgtaggaggtaaacaggtggtgcctttctctagcagtgtgaaagaaaccattcacttaccggcaagctccccccatcccccgccctttccatag

SEQ ID NO: 119225 - DNA, 1365 bp, Artificial Sequence
  Description of Artificial Sequence: Synthetic coding sequence
atgtgcgcggctcaaatgcctcctctggctcacatatttcggggcactttcgttcactctacctggacctgtcctatggaggtattgagggatcatctgttaggagttagtgattccggcaagatcgtttttcttgaagaagcctcacagcaggaaaagttggccaaggagtggtgcttcaaaccctgcgagatacgggaactttcccatcacgagttttttatgcccgggttagtcgatacacatattcacgcgtcccagtactcattcgctgggagttcaattgacctgcctctccttgagtggctgactaaatatacattccctgcagaacaccgattccagaacatcgacttcgctgaggaggtatataccagggtggtgaggcgcaccctaaagaatggaaccaccacagcgtgttactttgccactatccatacagacagctcacttctcctggcagacatcaccgataaatttgggcagagagcatttgtgggtaaagtgtgtatggatttaaacgacacgttccccgaatacaaagaaacaactgaagagtcaatcaaagagaccgaaagattcgtgtctgagatgctacagaaaaattattcaagggtgaagcctattgtcaccccaaggtttagcctgtcctgcagcgaaaccctgatgggagaactcggaaatattgccaaaaccagagatctgcacatccaatcacacattagtgagaaccgtgacgaagttgaggccgtgaagaatctttatcccagctacaagaattatacaagtgtgtatgacaagaataatctgctgactaacaaaactgttatggctcacgggtgttacttgtctgccgaggagttgaatgtgtttcatgagcggggcgctagtatagcccattgcccaaattcaaatttaagcttatcatctggcttcctaaacgtgctagaggtgctcaaacacgaagtgaagatcggacttgggacggacgtggccggcggctactcctactccatgctggacgcaatcagacgggcggtaatggtgagcaatatcctgctgatcaacaaagtaaacgagaagtccttgacacttaaagaggtctttcgactcgccacacttggcggtagtcaagccctgggtcttgacggggagatcgggaacttcgaagtgggcaaagaattcgatgccatcctgattaaccccaaagcctctgactcccctatcgacctgttctacggcgacttttttggcgatattagcgaggcggttattcagaagtttctctacttaggagacgacagaaatattgaagaagtctatgtggggggcaaacaggtagtgcctttcagctccagtgtatag

SEQ ID NO: 119226 - DNA, 1143 bp, Artificial Sequence
  Description of Artificial Sequence: Synthetic coding sequence
atgcccggattagtggatactcatattcatgcaagtcagtattcttttgcgggatcttcaatcgacctccctctgctcgagtggctgacaaagtatacatttcctgcagagcaccggtttcagaacattgactttgccgaggaagtgtatactagagtggtgaggcgcaccttaaagaatggcaccaccacggcttgttacttcgctaccattcataccgattccagtctactgctcgccgatattaccgacaaatttggtcagagggcgtttgtgggaaaggtctgtatggatctgaacgacaccttccccgagtataaagagaccaccgaggagtccatcaaggaaacagagagattcgtgtctgagatgctccagaagaattatagtagagtgaaacccatagtgaccccgcgcttttctctgtcttgctccgaaaccttaatgggagaattgggcaacatagcaaagacaagagacctccacattcagagtcacatctccgagaaccgagacgaagtggaagcggtgaagaacttatatccttcatataaaaattacacgtctgtgtatgacaagaacaacttgcttacaaacaagacagtaatggcccatggctgctatttatcagcagaggaactaaacgtcttccacgagcgaggcgcgtctatcgcacattgtccaaacagcaacctgtccttaagcagcgggttcctcaatgtgctggaggtgctgaaacacgaagtaaagattggactgggaaccgacgtcgccggcggatactcttactcaatgctcgatgctattagaagggctgtcatggtgagcaacatcctgttgattaataaggttaacgaaaagtctttaaccctaaaggaagtattcagactcgctactttgggcggctcacaagccctggggctcgatggcgaaatcggtaactttgaagtgggcaaggagtttgatgcgatcctcatcaacccaaaagcctctgattctcctatcgatctcttctatggcgacttttttggtgatatcagcgaggcagttattcagaaattcctctatctgggagatgaccgaaatatagaagaagtatatgttgggggaaagcaggtggtgccattttccagctctgtttag

SEQ ID NO: 119227 - DNA, 2082 bp, Artificial Sequence
  Description of Artificial Sequence: Synthetic coding sequence
atggccctgtgcaacggagattcgaaactagaaaacgccgggggcgacctgaaagatggtcaccaccactacgaaggagcggtggtgatcctggatgccggtgcccagtatgggaaggtgatcgacaggcgcgtgcgcgagctcttcgtgcagtcagaaatctttcccctggaaacaccagcctttgccatcaaggaacaaggattccgggctatcatcatcagtggcgggcccaactccgtgtatgccgaagacgcgccctggtttgatccagccatatttacaattggcaagcccgtcctagggatctgttacgggatgcagatgatgaacaaggtctttggaggtaccgtgcacaagaagagcgtcagagaagacggggtttttaacatttctgtggacaacacctgcagtctattccgcggccttcagaaggaagaagtcgtgttgctgacccacggtgacagcgtggacaaagttgcagacggatttaaagtggttgctcgctccgggaacatagttgccggaatcgctaatgaaagcaaaaaactgtacggggctcagttccatccagaggtggggttaaccgaaaacggaaaggtcatcttgaagaatttcctatatgatatcgcgggctgtagtgggacttttacagttcagaatagggagctggaatgtatccgcgagatcaaggaacgggtcggaacatctaaggtgttggtgttgctctcagggggggtggactccaccgtctgtacggctctgctcaatcgcgcacttaaccaggaacaggtgatcgctgttcacattgataatgggttcatgcgcaagagggagagtcaatctgttgaggaagccctgaagaagctgggcattcaggtgaaggtgattaatgcagcacatagcttctataatggtactaccaccttgcccatttcagatgaggacagaaccccccgtaaacgaatttccaagacactcaacatgactaccagcccagaagagaagcggaagataattggggacacatttgtgaagatcgcgaacgaggtgatcggagagatgaatttaaagccggaagaggtgttcctagctcagggaaccctacgcccggacctcatcgaaagtgcctcactggtcgcttccggcaaagccgagctgataaagacacaccacaatgacactgagctgattcgtaagctccgagaagaaggaaaagtcatcgaacccttaaaagactttcacaaagatgaagttaggatcctagggcgggagctcggactgccagaggagttggtttcaaggcacccgtttcccgggcctggcctggccattagggtgatctgcgctgaggagccatacatatgcaaggacttcccggaaacaaacaacatcttgaaaattgtagcagatttttccgcgtccgtgaaaaagcctcacactttgctgcaacgcgttaaggcctgtacgacagaggaggaccaagagaagttaatgcagattacaagcctccactccctgaacgcttttctattgccaattaaaactgtgggagtgcaaggtgattgtagatcctactcctacgtttgcggcatttccagtaaagatgaacctgactgggaatctttaatattcttggccaggttaatcccaagaatgtgtcacaatgtgaatcgggtcgtgtatatctttggcccgcctgtgaaagaaccccccacagacgtgaccccaacatttttgacaacaggcgtactgagcactctgcgacaggccgattttgaggcccacaatatcctcagagagtccggctatgcaggtaagatttcacagatgccggtaattttaaccccactgcacttcgacagagatcccctgcagaagcagccatcctgccagcggtccgtagtgatcagaacttttattacatcagattttatgaccggaatacctgccacccccgggaacgagatcccagtggaggtagtactgaagatggtgactgagatcaaaaaaattcctggtatctccaggattatgtacgatctcactagcaagccgcccggcactactgaatgggagtag

SEQ ID NO: 119228 - DNA, 1929 bp, Artificial Sequence
  Description of Artificial Sequence: Synthetic coding sequence
atgctcgaagagacgctacgcatggccactaccacaattaaggaacaaggcttccgcgctatcattattagcggcggccctaatagcgtctatgctgaggacgccccttggttcgatcccgctattttcacaatcggtaagcctgtcctgggcatttgctatggaatgcaaatgatgaataaggtgttcgggggaacagtgcacaaaaagtctgtccgagaagacggtgtcttcaacatctcagtcgacaatacttgtagcctgttccgggggctccagaaggaagaagtggtactgctgactcacggagattctgtggacaaagtagcagatggctttaaggtcgtggctcggagcgggaacattgtagctggcatcgccaatgagagcaagaaactttatggtgctcagtttcacccagaggtggggttgacagagaacgggaaggtcattctgaagaacttcctctacgacattgctggctgctctggcaccttcaccgtccagaatcgcgagctggagtgcatcagggaaatcaaagagagggtgggaacctcaaaggtgctggtgctcctgagtggtggcgtggattctaccgtatgtacagccctgctgaacagagccctgaatcaggagcaggttatagctgtccatattgataacggcttcatgcgaaagagagagagtcagagcgttgaggaagccctgaagaaactcgggatccaggtgaaagtgataaatgctgcccatagtttctacaatggaacaacaacactgcccatcagcgatgaagaccgaaccccccggaagcgcatcagcaaaaccctgaacatgactacatctcccgaagagaagcggaagattatcggcgatacattcgtgaagattgcgaacgaggtcatcggcgagatgaatctcaagcccgaagaggtctttttggcccagggcaccttacgtcctgatctcatagagagcgcatctctcgtcgccagcgggaaagcagaactgatcaaaactcatcacaacgatactgaattgattaggaagttaagagaagagggaaaagtgatcgagcccctgaaggattttcacaaagacgaggttcgaattctcggcagagagctcggacttcccgaggaactcgtcagccgtcaccccttccctgggcccgggctagccattcgggtgatctgtgctgaagaaccgtacatctgtaaggacttccccgaaaccaataacatccttaagattgtggccgacttctcagcctcggtgaaaaagccacataccttgcttcagagagtcaaggcttgcactacggaggaagatcaggagaaactgatgcaaataactagccttcactcgctgaatgcttttctactccctattaagacagtgggtgttcaaggcgactgccgatcgtactcttacgtgtgcggtattagctcgaaggatgaaccagattgggagtcactcatctttttggcaagactgatcccccgcatgtgccataatgtgaatcgggtagtttatatatttggaccacctgtgaaggaaccacctaccgatgttacaccaacattcctgaccacaggtgtgctgtccacgttaaggcaggctgatttcgaagcccacaacatactgagggaaagcgggtacgcaggaaagatttcccagatgccagtgattttgacccccctacacttcgatcgcgaccctctccaaaaacagcctagttgtcagagatcagtcgtgataagaactttcatcacgagcgactttatgacaggtatcccggccaccccaggcaatgaaatccctgtggaggtcgtgttaaagatggtgactgaaatcaagaaaatccccggaatctcccggattatgtatgacctaacgagcaaacccccaggaaccaccgagtgggagtag

SEQ ID NO: 119229 - DNA, 2082 bp, Artificial Sequence
  Description of Artificial Sequence: Synthetic coding sequence
atggcgttgtgcaacggggactccaagcttgagaacgctggcggagaccttaaggacgggcaccatcactacgaaggcgcggtggtcatcctggatgccggcgcacagtacggcaaggtgatcgatagacgggtccgggagcttttcgtccagtctgagatcttcccgctagaaacaccagctttcgctatcaaggaacagggctttcgggccatcatcatctcaggtgggccaaacagtgtttatgcggaggacgccccatggttcgaccccgcaatttttaccataggaaagcctgttctgggcatctgctacgggatgcaaatgatgaataaggtcttcggtggcaccgtacataaaaaaagcgttcgtgaagatggagttttcaacatctctgtagacaacacctgttccctcttcaggggactgcagaaggaggaggtggtgctccttacacacggcgattcagtggacaaggttgccgacggcttcaaagttgtggccagatctggtaacatagtggcgggcatcgcaaatgaaagcaagaagctgtatggcgcacaattccatcccgaggttggtctcactgaaaacggaaaggtcattttgaaaaattttttatacgacatcgctggatgcagcggaaccttcacagtccagaatagagagcttgagtgcatcagggagatcaaggaacgggtggggacgagtaaggtgctggtgctgctttctggcggcgtcgattctaccgtctgcaccgcgctgctgaatcgggctctcaatcaggaacaggtgatagcagtccacatcgacaacgggttcatgcgcaagcgtgagagccagagcgtagaagaggccctgaaaaaactcggtatccaggtaaaggtcatcaacgccgcccacagcttttacaatggaacaacaacccttcctatttccgacgaagatcgaaccccccgaaaacggatatctaaaaccctgaacatgaccacctcgccggaagaaaagcgcaaaattattggagacacgttcgtcaaaatagccaacgaagtgattggcgaaatgaacctcaaaccagaagaggtgtttctagctcagggcacgctgcgccccgacctgatagagagtgctagcctggtcgcctctgggaaagccgagttgatcaaaacacaccataacgatacagagcttatccgcaagctgagggaggaggggaaggtaatagagccactcaaagacttccataaggacgaagtgcgtatcttgggacgggaattaggccttcccgaggagctggtgtcacgtcacccctttccaggtcccggcttggctatcagggtgatctgcgcagaggagccatacatctgcaaagatttccctgaaacaaataacatcctgaaaatagttgccgacttttccgccagtgtcaagaaaccgcacaccctgctgcagagagtgaaagcatgcacgactgaggaggatcaggagaaattgatgcagataacctccctgcactctctgaatgcctttcttttgccgattaagaccgttggtgtgcagggcgactgccgaagctatagctacgtatgtggtatttcctcaaaagacgagccagattgggagagcctcatcttcttagcaagactcatccctaggatgtgccacaatgtgaacagagtggtttatatctttgggcctcccgtaaaggaaccccctactgacgtcaccccaacttttctgaccactggtgtgctcagtaccctacggcaggctgactttgaggcgcacaacattttgcgagaaagcggctacgccggaaagatttctcagatgcccgtaatactgactccccttcacttcgaccgggaccctttgcaaaagcagccatcctgccagagaagcgtcgtcattcgcacgttcattacatctgacttcatgaccggtattcccgccactcccggaaacgaaatacctgtcgaagtggtgctgaaaatggtcaccgaaattaaaaaaatcccagggatttccagaataatgtacgatctgacttccaagcctcccggaactacagaatgggagtag

SEQ ID NO: 119230 - DNA, 1146 bp, Artificial Sequence
  Description of Artificial Sequence: Synthetic coding sequence
atgagcggagtcgtccggactctgagtcggtgcctgttgccagccgaggctggcggagccagagaaagaagagcaggtagcggtgctagggacgccgagcgagaagcgaggcgacgctctcgggatatcgacgccctgctggcgcgagaacgccgagcagtgcgacgcttagtcaagatactattactgggagccggagaaagtggtaagtcaacttttctgaagcagatgcgtatcattcacggcagggagttcgatcagaaggcattgcttgaatttcgtgacacgatctttgacaacatcctgaaggggtctcgtgtattggtggatgcccgggataaacttggtatcccatggcagtatagtgagaatgagaaacacggcatgttcctgatggcatttgagaacaaggccggtctccccgtggagcctgcaactttccagttgtacgtgcctgcactttcagcactttggagggacagcggaatccgcgaagctttctcccggaggtccgagtttcagttaggcgagtcagtgaagtactttctggacaacttggacagaatcggccagcttaactactttccaagcaaacaggatatcctcctggcccggaaggcaaccaaaggaattgtcgaacacgattttgtcattaagaaaattccattcaagatggtggacgtaggaggacagcgatcccagcgccaaaagtggttccagtgctttgacgggatcacttcaattctgttcatggtcagttcttcggagtatgaccaggttctgatggaagaccgtaggactaacagactggtggagagcatgaatattttcgaaaccatagtgaataacaaactctttttcaacgtctcaatcatcctttttctgaacaaaatggacctgcttgttgaaaaggtgaagaccgtatcaattaagaagcacttcccagactttcgaggtgatcctcaccggctggaggatgtccaaaggtatcttgtgcagtgcttcgatcgcaagcgaaggaatcgcagcaagcctctatttcatcactttaccaccgctatagatacggagaatgtgcgcttcgtctttcatgcagtcaaggacacaatcctgcaagaaaacctgaaagacatcatgcttcagtag

SEQ ID NO: 119231 - DNA, 702 bp, Artificial Sequence
  Description of Artificial Sequence: Synthetic coding sequence
atgatatatcctctgatcgtgttgcccctgtgcgcctcatggcattggggcctaatccgcaaagggatagtgctattttggggagagagtgtgaagtattttctggataatctcgatagaatcggtcaattgaactattttccatccaagcaggacatccttctggctaggaaggccaccaaagggatcgtggagcacgatttcgtaatcaagaaaatacctttcaaaatggtcgatgtgggcgggcagagatctcagcgacagaaatggtttcaatgtttcgacggtatcacatctatcctgttcatggtgtcaagctctgagtatgatcaggtcctcatggaagatcgtagaactaaccgcctggtggagtcaatgaatatattcgaaacaatcgtgaacaacaagctcttcttcaatgtgtcaattattctgtttctgaacaagatggacctgctagtagagaaagtgaagacagtatcgatcaaaaagcacttcccggactttcggggcgacccccatcggctcgaggacgtccagcgctatttggtgcaatgtttcgacaggaaaaggcgcaaccgctctaaacctctgttccaccactttaccacagcaattgacactgagaatgtgagattcgtgtttcacgccgtcaaggacacaatactgcaagagaatctaaaagacattatgctgcagtag

SEQ ID NO: 119232 - DNA, 867 bp, Artificial Sequence
  Description of Artificial Sequence: Synthetic coding sequence
atgcgtattatccacggaagggagtttgatcagaaggctctgctggaatttagagatacaatttttgacaatatcctcaagggcagccgtgtgcttgttgatgcgcgggataaattgggtataccatggcagtactctgagaatgaaaaacacggtatgtttctgatggcctttgagaataaggccgggctgcccgtcgagcccgctacttttcagctgtatgtgccggccctgtcagccctgtggcgggacagtggaattcgggaagccttttcccggcggtcagagttccaactgaattatttcccctcaaaacaggacatactgctggctagaaaggctaccaagggtatcgtggaacacgacttcgtgattaagaaaataccgttcaagatggtggacgtgggggggcaacggagccagcgacagaaatggttccagtgctttgatggcatcacaagcatcctgttcatggtgtcaagcagcgagtacgaccaggttctgatggaagacagacgcacgaacaggctggttgaaagtatgaacattttcgaaaccatagtaaataataagttattcttcaatgtcagcatcattttatttctgaacaagatggatttactagtcgagaaggtgaaaactgtatctattaagaagcatttccctgactttcgtggagaccctcatagactggaggatgtgcagcgttacctggtccaatgttttgacaggaaacgacggaaccgcagtaagcctctctttcatcactttactactgccattgacacagagaacgtgcgtttcgtgtttcacgcggtgaaggacaccatactgcaggaaaacctaaaggacattatgctgcagtag

SEQ ID NO: 119233 - DNA, 1080 bp, Artificial Sequence
  Description of Artificial Sequence: Synthetic coding sequence
atgactttggaatcgatgatggcttgttgcctgtccgacgaggtgaaagaatcaaagagaatcaatgctgagatagagaagcaactcaggagggacaagcgagacgcgcggcgcgaattgaagttgttgctactggggaccggcgaaagcggaaaatctactttcattaagcagatgcggattatccacggcgccggatattcagaagaggacaagcgtggattcacgaagctggtataccagaatatttttacagctatgcaggcaatgattcgcgccatggaaaccctgaaaatcctgtataagtacgagcaaaacaaggccaacgcattactcatccgggaggtcgatgtggagaaggtgacaactttcgagcaccagtacgtctccgcaatcaagaccctctgggaggatcctggcatacaagaatgctacgatcgccggagagagtaccagctgagcgactctgctaaatattacctgacagatgtggaccgtatcgctacattagggtatctgcccacccagcaagacgtgctgagagttagggtgcccacaactggaatcatcgagtatcccttcgatcttgagaacattatctttaggatggtggacgttgggggacaacggagcgagaggcgcaagtggatacactgtttcgaaaatgttaccagtattatgttcctggtggcactcagtgagtatgaccaggtgctcgtggaaagtgacaacgaaaataggatggaggagtcaaaagccctgtttagaacaattatcacgtacccctggtttcagaattcttccgtgatcttgtttttgaataagaaagacctattagaggataagattctatattcgcaccttgtggactattttccagaattcgatggccctcagagagacgcgcaggccgcccgggaattcatcctgaaaatgtttgtggatctgaatccagactccgacaaaattatttacagccacttcacttgtgccacagacaccgagaatatccgttttgtgtttgccgccgtcaaggataccatactgcagttaaacctcaaggagtataatctggtgtag

SEQ ID NO: 119234 - DNA, 1059 bp, Artificial Sequence
  Description of Artificial Sequence: Synthetic coding sequence
atggcagacttccttccaagccgctctgtgctgagcgtgtgttttccaggatgcctgttgacctccggcgaggcagagcagcagagaaagtctaaagaaattgacaagtgtctttccagggaaaaaacctacgtcaagagactggtgaagattctgctgctcggagctggtgagtccggaaaatcaacctattctaatgtcattaaaggcatgcgagttctcgtcgacgccagagaaaagttgcacattccctggggcgacaattcaaaccaacagcatggtgacaagatgatgtcttttgacacaagggccccaatggccgctcaggggatggtggagacacgcgtttttctgcagtacctgcctgctatccgcgccctttgggccgattcagggattcagaatgcctatgacagacggagagaattccagctaggggaatccgttaagtacttcctcgataacctggacaaactcggggagcctgattacattccctcccagcaggatatcttgctggcccggcggccaaccaaaggcatccacgagtacgatttcgaaatcaaaaatgttccttttaagatggtcgacgtggggggccagcgtagtgaaaggaagagatggttcgaatgcttcgacagcgtgacatcaattttatttctggtgagcagctccgaattcgaccaggttctgatggaggacagactaacgaatcgccttactgagagtctcaatatttttgagacgatcgtgaacaaccgcgtattttccaacgtcagtatcatcctgttcctgaacaagaccgatcttctggaagagaaggttcagatagtctccatcaaagattattttctggagttcgagggcgacccacattgtttaagagatgttcagaaatttctggtcgagtgcttccgcaacaagagaagagaccaacagcagaaaccactgtaccatcacttcactacggccattaataccgaaaatatcagactagtgttccgggacgttaaagatactatcctccatgataatctgaagcagctaatgttgcaatag

SEQ ID NO: 119235 - DNA, 1134 bp, Artificial Sequence
  Description of Artificial Sequence: Synthetic coding sequence
atggcggacttcttgccaagcagaagtgtcctttcggtgtgcttccccgggtgcctactcacatccggtgaggcggagcagcagcggaaaagtaaagagatcgataagtgcctatcgagggaaaagacctacgtgaagcggctcgtgaaaatactcctgctgggggcgggcgaaagcggaaagagtaccttcctcaagcaaatgagaataattcatggtcaggatttcgaccagcgggcccgcgaggaatttcgtcccacaatatatagcaacgtcattaagggtatgagggtgttagtagacgcaagagagaagctccacataccatggggcgataattctaatcagcagcacggggataaaatgatgagcttcgacacaagagcccccatggccgcccagggaatggtggaaacacgagtctttctgcaatacctgcctgctatccgtgcgctctgggccgattctggtattcagaacgcctatgacaggcggcgagaatttcagcttggggagtctgtaaaatacttcctggacaacctagacaagcttggagagccagattacatcccaagccagcaggacatcttactagcccgccgaccaacaaaaggcatccacgagtacgattttgaaatcaagaacgtgccgttcaagatggttgacgtgggtggccagcgctccgagaggaagagatggtttgaatgcttcgactccgtcacttctattttatttttagtttcaagctcggagttcgatcaggtgctgatggaggaccggttgaccaaccggttgacagagtctctgaatattttcgaaacaatcgtgaacaacagggtcttttccaacgtgtcaatcatcctgtttcttaacaaaacagaccttctggaagagaaagtgcagattgtctctattaaagactacttcctggagtttgagggcgacccgcactgcctgcgggatgtgcagaagttcttggtggagtgtttccgcaacaaaaggcgcgatcagcagcagaaacccttatatcatcacttcaccacagccattaacacggagaacatccggctagtatttcgggatgtcaaagatactatactgcatgacaatcttaagcagcttatgctccagtag

SEQ ID NO: 119236 - DNA, 849 bp, Artificial Sequence
  Description of Artificial Sequence: Synthetic coding sequence
atgcgggttcttgttgacgccagggagaaactgcatataccgtggggtgataatagtaaccagcagcacggggacaagatgatgagctttgacacaagagcgcccatggcagctcaggggatggtggaaacacgagtttttctgcaatatctgccggccatccgggctctgtgggccgacagtggaatccagaacgcctatgatcgaaggagggagtttcagttgggggagagcgtcaaatattttcttgataacctggacaaactcggagaaccagactatatacccagccagcaggacatccttctagccagaaggccgactaaaggaattcacgagtatgattttgaaatcaaaaatgtgccttttaaaatggtcgacgtgggtggccagcgctcagagcgcaaacgctggtttgaatgttttgattccgtgacatcaattctctttctcgtctcttcctcagagtttgaccaggttcttatggaagaccgactcaccaatcggttgacggaaagcctgaacatattcgaaaccatcgtgaataacagggtgttctcgaatgtaagtattattctgtttctaaacaagactgatctcctggaggaaaaggtgcagattgtgagcattaaagattatttcctcgagttcgagggggacccacattgtctacgggatgtccaaaaattccttgtggagtgttttcgaaataagcgcagagatcagcaacagaagcccctatatcatcactttacaaccgccataaataccgaaaatatcagactcgtttttcgggacgtaaaggataccatccttcacgataacctaaaacagctgatgttgcagtag

SEQ ID NO: 119237 - DNA, 1068 bp, Artificial Sequence
  Description of Artificial Sequence: Synthetic coding sequence
atggccgggtgttgctgcttaagcgccgaggagaaggaatcacaaagaattagtgcagaaatcgagcggcagctgcgacgagacaaaaaggatgctcggagagaattgaaactgctgctactaggcaccggagagagcggaaagtccacctttataaaacaaatgcgcatcattcacgggagtggatattctgatgaggaccgcaaaggctttacaaaacttgtatatcaaaacatctttacagccatgcaggctatgatccgggcaatggataccttgagaattcaatatgtgtgcgaacagaacaaagaaaacgcccaaatcattagagaagtcgaagtggacaaggtgtctatgctgtccagagaacaagttgaggccattaaacagctttggcaagaccccggaatccaggagtgctacgaccgacgccgtgagtaccaactttcagattccgcaaaatattatctgaccgacatcgatcgcatagccacaccgtcgttcgtgccgacccagcaggacgtcctccgggtccgggtccccacaacagggattatcgagtacccattcgacctcgagaatatcatatttagaatggtggatgtgggaggccagcgtagcgaacggcggaaatggatccattgtttcgagagcgtgacaagcatcattttccttgtggccctaagcgaatacgatcaggtcctcgctgagtgtgataatgagaaccgtatggaggaatctaaagccctcttcaagacaatcatcacttatccatggttcctaaacagcagcgtaatcctttttctaaacaagaaagatctgcttgaggagaagatcatgtacagtcatctgatcagttatttcccagagtacaccggccccaagcaggatgtcagggcggctagggatttcatcctgaaactctaccaggaccaaaaccctgacaaagagaaagtgatttactcccattttacttgcgccaccgatacggataacatccggttcgtattcgctgctgtcaaagacacgatccttcaactgaacctcagagaatttaacctcgtgtag

SEQ ID NO: 119238 - DNA, 1125 bp, Artificial Sequence
  Description of Artificial Sequence: Synthetic coding sequence
atggcccgctcattaacctggaggtgttgtccttggtgtctgactgaagatgagaaggcagccgctcgagtggaccaggagatcaatcggatactcctggaacagaagaagcaggaccgaggtgaactcaagttactgctcctgggcccaggcgaaagtggtaaatccacattcattaaacagatgcgaatcattcacggtgctgggtactcggaagaagagcgcaagggattccgtccattggtgtaccagaacatcttcgtatctatgcgcgccatgattgaagcaatggaacggcttcagatccccttcagccgccccgagagtaagcaccacgccagcctggtgatgagccaggatccatataaagttactacattcgaaaagaggtacgctgctgcaatgcagtggctctggcgggacgccggcattcgggcgtattacgagcggagacgggagtttcatctcttagattcagccgtatattatctgagtcacttggagcgaatcacggaggaaggctacgtaccgacggcgcaagacgtcctccggagcaggatgcctacgaccggtattaatgagtactgcttctctgtgcagaaaacaaatctgaggatcgtggatgtggggggtcagaaatccgaacgtaagaagtggatccactgtttcgaaaacgttattgcgctgatctatctcgcaagcctttctgagtacgaccagtgcttagaagaaaacaatcaggagaacaggatgaaggagagtcttgcactcttcggcactatcttagagcttccatggttcaagtctacatccgtgatattattcttaaacaaaacggacattcttgaagagaagattccgacctcccacttagcaacgtatttcccctcttttcaaggtccaaaacaggatgcggaggccgctaagagattcatcttagacatgtatacccggatgtatactggatgcgttgatggcccagaggggagcaagaagggagctagatcgcgacgtctcttctcccattacacttgtgcgacggatacccaaaatatccgcaaagttttcaaagacgttcgcgattccgtccttgctagatacctggatgaaataaacttgttgtag

SEQ ID NO: 119239 - DNA, 1065 bp, Artificial Sequence
  Description of Artificial Sequence: Synthetic coding sequence
atgggatgtacactcagcgccgaggagagggcggcgctggagaggagcaaagccatcgagaaaaacctgaaggaggacgggataagcgcagctaaggatgtgaagctgctcctgctgggagccggcgaaagcggcaagtccactattgttaaacagatgaaaattattcatgaagatggctttagcggggaagacgtgaaacaatataagccagtggtgtactctaacaccattcaatccctggcggccatagtacgcgccatggacacactgggtatagaatacggagacaaggagcggaaagctgatgccaagatggtttgcgatgtggtgagcaggatggaggataccgaaccattcagcgccgagctgctttctgctatgatgcgcctttggggggattcagggattcaggagtgttttaacaggtccagggagtaccagctgaatgacagcgccaagtactacctggattctcttgaccggattggtgcagccgattaccagccaaccgagcaggatatcctcagaaccagagtgaaaacgaccggcatcgtagaaactcatttcacattcaaaaacctgcactttaggctgttcgatgtggggggccagcgttccgagaggaagaagtggatccattgtttcgaggatgtaacagcgataattttttgcgtcgcactttcgggctacgaccaggtactccatgaagacgaaaccacgaaccggatgcatgagtccttgatgctgttcgattctatctgcaacaataaattctttattgacactagtatcatcctcttcttgaacaaaaaagacctgtttggcgagaagatcaaaaagtcacctctgactatttgttttcctgaatatactggccccaacacttatgaagacgccgctgcgtacatccaggcccagttcgaatccaaaaataggagcccgaataaggagatttactgtcatatgacatgcgccaccgatacgaataacattcaggtggtgtttgacgcagtgactgacattattatcgctaataacctgagaggctgcggattgtattag

SEQ ID NO: 119240 - DNA, 1065 bp, Artificial Sequence
  Description of Artificial Sequence: Synthetic coding sequence
atgggctgtacgctcagtgccgaggagagggccgctctggagaggagcaaggccatcgaaaaaaatttgaaagaggatgggatctccgcagctaaagacgtcaagcttctgctgttgggcgccggtgagagtggaaaatccaccattgtgaaacagatgaagatcattcacgaggatggttttagcggcgaggatgtcaagcagtataaacccgtagtttattctaatactattcagtccctagcggcaatcgtgcgggctatggacacactggggatcgaatatggagacaaagaaagaaaagccgatgccaagatggtctgcgacgtggtttcccggatggaggataccgaacccttcagcgctgaattgctatccgcaatgatgaggctgtggggcgactccggcatacaggagtgctttaaccgcagtcgcgaatatcagctcaacgattccgctaagtattatctcgatagtctggacaggattggagctgcagattatcagcctacagagcaagacatcctgagaaccagagtgaagacaacaggtatagttgagactcactttacgtttaagaatctccacttcagactcttcgacgtcggggggcagcggagcgagaggaaaaagtggatccactgcttcgaagatgtcaccgccataattttttgtgtggcacttagcgggtacgaccaggtgctgcatgaagacgaaaccacaaacaggatgcacgagtccctgaagctattcgattctatctgtaataacaaatggttcaccgacacctcaataatcctgtttttgaacaagaaagacatattcgaggagaaaattaaaaagagccccctaactatctgctttccagaatacaccggtcctagtgccttcactgaggctgtggcctacatccaggctcagtatgaaagtaagaacaagtctgcacacaaagagatctacacacatgtcacgtgtgctacagatacaaacaatatccaattcgtcttcgacgcagttacagatgtcataatcgcgaaaaacctgcgggggtgcggactatattag

SEQ ID NO: 119241 - DNA, 1146 bp, Artificial Sequence
  Description of Artificial Sequence: Synthetic coding sequence
atgggatgtctgggagggaattcaaagacaactgaggaccagggggtcgatgagaaggaaagaagggaagccaataagaaaatcgagaagcagctccaaaaagagaggctggcctacaaggccacccaccgcctgctgctcctcggggccggtgagtctgggaagtcaacaatcgttaaacagatgagaatactgcatgtcaacggctttaaccctgaagaaaagaaacaaaaaattctggacatcagaaagaacgtgaaagacgccatcgtaacaattgtgtcggccatgtccacgatcatcccaccagttcctcttgctaatcctgagaaccagttccgttcagactatattaaaagcatagcccccatcactgacttcgaatatagccaggaattttttgatcacgttaagaagctctgggacgatgagggggtaaaagcctgttttgagcgctctaatgagtaccagctcattgattgtgcccagtatttcctggagcggatcgattcagtgtcactggtcgactatacaccaacagatcaggacctcctgaggtgccgggtgttaacttctggtatcttcgagacccgctttcaggttgacaaggtgaattttcatatgttcgatgtggggggtcaaagggacgagagaagaaaatggattcaatgttttaacgacgtcacggctattatctatgtcgcagcttgctctagctacaacatggtaattagagaagataacaatactaacagactgagggagtctctggacctgttcgagagcatttggaataacaggtggttgaggacaataagtatcattttattcctcaacaagcaggacatgctggctgaaaaagtgctggccggcaagtctaagattgaggattactttcccgagtatgccaattatactgtccccgaagatgcaaccccagatgctggagaagatccaaaggttacacgagccaagttcttcattagagacctcttccttcgaatctccactgcgactggtgacggtaaacattactgctacccgcacttcacctgcgccgtcgacacagagaacattcgacgggtatttaacgactgtcgggatatcatccagagaatgcatctgaaacagtatgagctcctttag

SEQ ID NO: 119242 - DNA, 1377 bp, Artificial Sequence
  Description of Artificial Sequence: Synthetic coding sequence
atgggcctgtgctacagcttgcggcctctgcttttcggcggacccggggatgatccctgtgccgcctcagagccaccagttgaggatgcacagcctgctcctgcacccgcgctagcccccgtaagagccgccgcccgtgataccgcgagaaccttgttacctcgtggtggagagggatctcctgcttgcgcgcgccctaaggcggataaacccaaagagaaaaggcaaaggactgaacagctgagtgccgaagagcgcgaagcagccaaggagcgggaagccgtaaaggaggcgagaaaagtgagtcgtggaattgatcggatgctcagggaccagaaaagagatttacagcagacacaccgccttctgcttcttggggcaggagaaagcggcaaatccaccatagtcaagcagatgcgtatcctgcacgtgaatggattcaacccagaagaaaaaaagcaaaagattctagatatccggaagaacgtcaaggacgccatagtcacgattgtctctgccatgtccaccatcatccctcccgtgccacttgccaaccccgaaaaccagtttaggtcagattacatcaaaagcattgctcccattactgattttgaatattctcaggagttctttgatcatgtgaaaaagttatgggatgatgagggcgttaaggcctgctttgagcgctccaatgagtatcagctgattgattgcgcgcagtactttctggagaggatcgattctgtgtccctggtggactacacccctaccgaccaggacctcttgcggtgtcgcgtactaacaagcggaatctttgagacccgttttcaagtggataaggtgaacttccacatgttcgatgtgggcggtcagagagacgagcgtcgaaagtggatccagtgttttaatgatgtgaccgccattatctacgtggctgcttgtagctcttacaacatggtcatccgggaggacaataataccaacaggctgagagaaagtctcgatctgttcgaaagcatttggaataacagatggctccggacaatcagcatcattctcttcctgaataagcaggacatgctggcagaaaaggtcctagccggtaaaagcaagatcgaagactactttcctgagtacgccaattatacggtgcccgaagatgctacaccggacgcaggcgaagaccctaaagtcacaagggctaagttcttcatcagagatttgtttttaagaatctctacggctactggggatggtaaacattactgctacccgcatttcacctgcgccgttgacactgagaacatcagaagggttttcaatgattgtagggacatcatccagcgaatgcatctcaaacaatatgaactgctgtag

SEQ ID NO: 119243 - DNA, 1146 bp, Artificial Sequence
  Description of Artificial Sequence: Synthetic coding sequence
atgggctgccttggtggcaatagcaagaccacggaggaccagggagtcgacgaaaaggagagaagagaggcaaacaaaaagattgaaaaacaattgcagaaagaaagactggcctacaaggcaacccaccggctgctgctgctgggggccggagagtccggaaaatcgactatcgtcaagcagatgagaatcctccacgttaacggatttaatcctgaggagaaaaaacaaaagatactggatattcgcaagaacgtgaaggacgcaattgtgactattgtgagcgcgatgagcacaatcataccccccgtgccccttgcaaacccagagaatcaattcaggtcagactacattaaaagtattgctccaatcacggatttcgagtatagccaagaatttttcgatcacgtgaagaaactatgggatgatgaaggcgtgaaggcttgctttgaacggtccaacgagtatcaactgatcgactgcgcccagtatttcctggagaggatagactcagtgtctctcgtggattatacccccactgaccaggacctcttacgttgcagggtgttgacatcaggaattttcgagacgcgctttcaggtggataaagtcaacttccacatgttcgacgtgggcgggcaacgagatgaacgaaggaagtggattcagtgcttcaatgatgtcactgccatcatctatgtcgccgcatgctcctcatataacatggtcatcagggaagacaataatactaatcgactaagggaatcccttgatttattcgagtctatctggaataacagatggcttaggactatctcgataattttgttcctaaataagcaggatatgttggctgagaaggtactcgcaggcaagagtaaaatcgaagactacttccctgaatatgccaattatactgtgcccgaagacgccacacctgacgctggcgaggacccaaaagttacccgggctaaatttttcatacgcgacctattcttgcgcatctctacagcgactggggatggcaagcactattgttacccacactttacctgcgcagtggacacagagaatatcaggcgcgtctttaacgattgccgggatatcatccagcgcatgcatctgaaacagtacgaacttctttag

SEQ ID NO: 119244 - DNA, 1146 bp, Artificial Sequence
  Description of Artificial Sequence: Synthetic coding sequence
atgggctgcttgggtggcaattctaagacaaccgaggatcagggcgtggatgaaaaagagaggagagaggctaacaaaaagattgagaagcagcttcagaaagagcgcttagcatataaagccactcataggctgctgttgctcggtgctggggagtctggcaagtccaccattgtgaaacagatgaggattttgcacgtgaacggctttaaccccgaggagaaaaagcagaagatccttgacatccgcaaaaacgtcaaagacgctatcgtcaccattgtttcggcaatgagtacgattatcccccccgtcccattggctaatcctgaaaatcaatttcgttctgattatatcaagagtattgcaccaattacagatttcgaatactcccaagagttctttgaccacgtcaagaagttatgggacgacgaaggcgtgaaggcctgtttcgaacggtccaatgaatatcagctcatcgactgtgctcagtatttcctggagagaatagattccgtgtcactagtcgattatacccctacggatcaggacctgctacgatgtcgggtgctgacatccggcatttttgaaacccgattccaggtcgataaggtgaactttcatatgtttgatgtgggtggacagagggacgaacgccgtaagtggatccagtgcttcaatgatgttactgctataatctatgtggccgcctgctccagttataacatggtcattagagaagacaacaacaccaataggttgcgggaatcactcgatctgtttgaatcaatttggaacaacaggtggctgaggactattagcatcatcctgttcttgaacaagcaggacatgctagccgaaaaagtgttggctggcaagtcgaagatcgaagactactttccagagtacgcaaattatactgtccctgaagacgcaacccctgatgcgggagaggaccccaaagtgacaagggcaaagttcttcatccgtgacttattcctgaggattagcacagctaccggggatggtaaacactattgctatccacattttacatgtgcagtagatacagagaacatacgacgtgtttttaatgactgtcgagatattatacaaagaatgcacttgaagcaatacgagctcttatag

SEQ ID NO: 119245 - DNA, 525 bp, Artificial Sequence
  Description of Artificial Sequence: Synthetic coding sequence
atgttcgatgtcggcggccaacgtgacgagaggcgcaagtggatacaatgtttcaacgatgtaaccgccattatctatgtcgccgcttgctcaagttacaacatggtaattagggaagataataacaccaatcgtcttcgagagagcctggacctgtttgagtccatatggaacaaccggtggctcagaaccatcagcattatcttgttcctcaataaacaagacatgctggccgaaaaggttctggctggtaagtcgaagattgaagattacttcccggagtacgccaattatacggtgccagaggatgcgactcccgatgcgggtgaggacccgaaggtaacacgcgcgaaattcttcatccgggatctgtttctcagaattagcaccgccactggtgatgggaagcactattgctacccacattttacatgcgccgtcgacacggagaacattcggcgggtattcaacgattgtcgtgacattattcagagaatgcacctgaagcagtatgagcttctatag

SEQ ID NO: 119246 - DNA, 963 bp, Artificial Sequence
  Description of Artificial Sequence: Synthetic coding sequence
atgagaattctccatgtcaacggctttaaccccgaagaaaagaaacaaaagatcttggacatcaggaagaatgtaaaagatgccatagtcacgattgtgagcgctatgtcgacaatcatccctcctgttcccctggctaatccagaaaatcaatttcgttcagactacatcaagagtattgcaccaatcactgacttcgagtactcccaggagttctttgaccacgtcaagaagttgtgggacgacgagggggtcaaagcttgtttcgaacggagtaacgagtaccagctcattgactgtgcgcagtactttctagaacgcattgattcagtctcactggtggactatacaccaactgatcaggacctcttacggtgtcgggtgctcaccagtggcatttttgagactagatttcaggtggacaaggtgaactttcatatgttcgatgtgggcggtcaacgagatgaacgacggaaatggatccagtgtttcaatgatgttactgcaataatttacgtagctgcctgcagttcatacaacatggtgattcgcgaagataataacacaaatagattacgcgaatcgctcgacctttttgagagtatctggaacaacagatggcttcgaacaatctccattatcctgttcctcaacaagcaagatatgctcgccgagaaggttttggcaggtaagagtaagatcgaagactactttcctgaatacgccaactacactgtcccagaagacgccactcctgatgcgggcgaggacccaaaagtgactcgcgcaaaattcttcatccgggaccttttcttacgtatcagtactgcaaccggcgacggcaaacactattgctatcctcacttcacctgcgccgtggacaccgaaaacataaggagggtatttaacgactgcagagacataatccagagaatgcatctgaaacaatacgagctgctgtag

SEQ ID NO: 119247 - DNA, 1065 bp, Artificial Sequence
  Description of Artificial Sequence: Synthetic coding sequence
atgggctgcacactaagcgccgaggataaggcagcagtcgaacgttctaagatgatcgacaggaacctgagagaagacggagagaaggccgcccgcgaggtgaaactgctgcttttaggggccggggagagcggtaagagcaccatagtaaaacagatgaagatcattcacgaggctgggtattccgaagaggagtgcaagcaatataaggccgtcgtgtacagcaacacgatacagtccatcattgccattatacgcgccatgggaagacttaagatcgactttggagactccgcgcgggccgacgatgcaaggcaattgtttgtcctggccggcgctgccgaggaagggtttatgactgcagaactggccggggtaattaagaggctgtggaaggactctggcgtccaggcttgcttcaatcggtctcgggaataccagctgaatgattcagcagcttactacctgaatgacctagatcgaattgctcagcctaattacattccaacccagcaggacgtgctcagaacacgggtgaaaacgacgggaattgtcgagacacacttcacttttaaggacctccacttcaaaatgttcgatgtgggcggccagaggtccgagcggaagaagtggatccactgttttgaaggagttacagccattattttttgtgtcgcgttgagtgattacgacctcgtgttggccgaagatgaagagatgaaccggatgcacgagtctatgaaactttttgacagtatctgcaacaataagtggtttacagatacgtctattatcttattcttgaataagaaggatctgtttgaggagaaaatcaaaaagtcacctctgaccatttgttacccagaatatgctggaagcaacacctacgaagaggctgctgcatacatccagtgtcagttcgaggatctcaataaacgcaaagacaccaaggagatttatacccatttcacatgtgcgaccgatacaaaaaacgtgcagttcgtgttcgacgccgtgactgatgtgatcataaaaaataacttgaaagactgtgggctattctag

SEQ ID NO: 119248 - DNA, 72 bp, Artificial Sequence
  Description of Artificial Sequence: Synthetic coding sequence
atgggctgcaccctctctgccgaggataaagccgcagtggaacgcagtaagatgatagaccggaacctctag

SEQ ID NO: 119249 - DNA, 909 bp, Artificial Sequence
  Description of Artificial Sequence: Synthetic coding sequence
atgaagattatccacgaggccggctatagtgaagaggagtgcaagcagtacaaggccgtagtctattccaataccatccagtccataatcgctataatacgtgccatgggtcggctgaaaatcgatttcggcgactcagctcgggctgatgacgccaggcagctgttcgtgctcgccggcgccgccgaggaaggattcatgacggcagaactggcgggcgtcataaagcgcctctggaaagacagcggagtgcaggcatgctttaacagatccagagagtatcagttaaacgatagcgccgcttactatctgaacgaccttgaccggatcgctcaacctaattacataccaacacagcaggacgtgctgagaacccgggtcaagaccacaggaattgtggagactcattttactttcaaggatctacattttaaaatgttcgacgtgggtggacagcggagtgagcggaaaaaatggattcattgctttgagggtgtaacagcgattattttctgtgtcgccctgtccgactatgatctcgtgttagctgaagatgaagaaatgaatcggatgcacgagagcatgaagctattcgattctatatgtaacaacaaatggttcactgacacatcgatcatcctgtttctgaataagaaggacctttttgaggagaaaatcaagaaatctcccctaaccatttgttatcccgagtacgccggcagcaacacgtacgaagaagccgccgcctacatacagtgtcagttcgaggatctgaataaacgcaaagacactaaagaaatctacacacatttcacgtgcgccactgacactaaaaatgtgcaattcgtgttcgacgccgttaccgacgtgatcatcaagaataacctgaaggattgcggcctattttag

SEQ ID NO: 119250 - DNA, 1020 bp, Artificial Sequence
  Description of Artificial Sequence: Synthetic coding sequence
atggagtacgccggacatctaccagctagttctgctcaagggactattctggcatgcacatcgtgcaccggagctggggagagcggaaagtcgacaatcgtgaaacagatgaaaataattcacgaagatggctactcagaagaggagtgtcgccagtaccgcgctgtggtttacagtaatacaatacaatccatcatggctatagttaaggctatgggcaatctgcagattgacttcgcggatccttctagggctgacgatgcgagacaactatttgccctgtcatgcacagctgaggagcagggagtgctcccggacgatctcagcggcgtaatcagaaggttgtgggccgatcatggcgtccaggcttgcttcggtagaagccgcgagtatcagctgaacgactcagctgcctattacctgaatgatctcgagcgtatagctcaatctgattacattccaacccagcaggacgtcctgaggacacgggtgaagacaacaggcatagtcgagactcactttacatttaaagatctccattttaaaatgtttgacgtcggaggccaacgcagcgaacgcaaaaaatggatacactgcttcgaaggagttactgccattattttctgtgtagccctatcggcctatgatctagtgctggccgaggacgaagagatgaatcgcatgcacgagtccatgaaattgttcgactccatttgtaacaataagtggttcaccgatacctcaatcatcctctttctgaataagaaagacctcttcgaggagaaaataactcactctcccctgacaatctgttttcccgagtatacaggagctaataagtatgacgaggctgcttcgtacatccagtcaaaattcgaggacctgaataaacgcaaagatactaaggaaatttacactcactttacttgtgctaccgacaccaaaaatgttcagttcgtgtttgatgctgtgaccgatgtgattataaaaaacaacctgaaagactgcggcctcttctag

SEQ ID NO: 119251 - DNA, 1068 bp, Artificial Sequence
  Description of Artificial Sequence: Synthetic coding sequence
atgggatgtaccgtaagcgcagaagataaggccgccgccgaacggagtaagatgatcgacaaaaacttacgcgaggatggagaaaaggctgctcgcgaagtaaagcttctgctccttggagccggagagtctgggaaatctaccatcgttaagcagatgaaaattatccatgaggacggctattccgaagaggagtgcaggcaataccgcgcggttgtttattcaaacaccattcagagcattatggcaattgtgaaggctatgggcaacttacagatcgacttcgctgatcctagccgggcagacgatgcccggcagctttttgctttgagctgcaccgcggaggagcagggggtgcttcctgacgacctgagtggggtgatccggcggctgtgggctgatcacggagtgcaggcttgttttgggagaagtcgggaatatcagctgaacgattcagcggcctattacctcaacgacctggaacgaattgcgcagtcagattacatccccacacaacaggatgtcctgcggacccgcgtgaaaaccaccggaattgtggaaacccatttcacattcaaggacttgcacttcaagatgttcgacgtgggcggtcagcgctccgaaaggaaaaagtggatccactgttttgaaggcgtgacggcgatcatcttttgtgtggctctctctgcctatgacctcgtgctcgctgaggacgaggagatgaatcgcatgcacgaatctatgaaactctttgacagcatttgcaacaataaatggttcaccgacacaagcattattctgtttttgaataagaaggacctctttgaggaaaaaatcacgcatagcccattaacgatttgctttcctgaatataccggggccaacaagtacgacgaagccgcctcttacattcagtctaagttcgaggatcttaataagcggaaggatactaaagagatttatactcattttacttgcgcaactgacacaaagaacgtgcagttcgtcttcgacgccgtgacagacgttattatcaaaaacaatttgaaagactgcggactcttctag

SEQ ID NO: 119252 - DNA, 1020 bp, Artificial Sequence
  Description of Artificial Sequence: Synthetic coding sequence
atgacagaaggggtaaaaaccctgggctggactaagcagaaggggggttgccattggggaaggtccgagggggctggggaaagcggcaagtccaccatcgtgaagcaaatgaagattattcacgaggatggctactccgaggaggaatgcagacagtatcgagccgtggtctacagcaacaccattcagtcaattatggccatagtgaaagccatgggtaacctccagattgattttgctgacccctcccgggccgacgacgctagacaattgttcgccttgtcatgtaccgccgaagaacaaggagttctcccggacgatctctctggtgtgatccggaggctttgggccgaccacggcgtccaggcatgcttcgggcggagccgagaataccaattaaatgattccgctgcttactatctaaacgacctggagcgaatcgcacagtccgactatataccaactcagcaggacgtactgagaacacgcgttaaaacgactgggattgtcgagacacatttcactttcaaggacctccatttcaaaatgtttgacgtggggggccaacgcagcgaaagaaagaagtggatacattgctttgaaggcgtgacagctattatattttgcgttgctctgagcgcctacgatctggtgcttgcggaggacgaggaaatgaacagaatgcatgagagtatgaagttgttcgattctatctgcaacaataaatggtttaccgacacaagtatcatcctatttttgaataagaaggatctgttcgaagaaaaaataactcatagccccctgactatatgctttccggagtacacaggagcaaacaaatatgacgaggccgcttcctacatacagtcgaaattcgaagatctgaataaaaggaaggacaccaaggaaatctacacccatttcacttgtgctaccgacacgaaaaatgtccagttcgtgttcgatgcggtgactgatgttatcatcaagaacaatctcaaggattgtgggctgttttag

SEQ ID NO: 119253 - DNA, 912 bp, Artificial Sequence
  Description of Artificial Sequence: Synthetic coding sequence
atgaagattattcacgaggacggttacagtgaggaggagtgcagacaataccgtgctgtggtgtattctaatacgatacagagcatcatggccatagtgaaagccatgggaaacctccaaatagacttcgctgaccccagcagggccgatgatgcgagacaactgtttgccctttcatgcacggctgaggagcagggtgtgctgcccgatgacctgtctggagttatacgccgactgtgggccgaccatggagtgcaagcctgctttgggcgatcacgggagtatcaactcaacgactctgctgcctactatctgaacgatctggaacgcatagcgcaaagcgattacattccaacccaacaggatgtcctgaggactagggttaagaccaccggcatcgtcgaaacccacttcacattcaaggatcttcatttcaagatgttcgatgtaggcggccagcgaagcgagagaaaaaagtggatccactgtttcgaaggggtcaccgccattatattttgcgtggcgctttccgcttatgaccttgtcctagccgaggatgaggagatgaataggatgcatgagagcatgaaactattcgacagcatttgcaataacaaatggtttacagatacatccattatactgttcttgaataagaaagatttattcgaggaaaaaattacacattcacccctcaccatttgcttccctgagtacacaggcgctaataaatacgatgaggcagcatcttatattcagagcaaatttgaggatctcaataaacggaaggacacaaaggaaatttatacacattttacctgcgccaccgatacaaagaatgtacaatttgtgttcgacgcggttacggacgtaataattaaaaacaacctcaaggattgtggcctgttttag

SEQ ID NO: 119254 - DNA, 957 bp, Artificial Sequence
  Description of Artificial Sequence: Synthetic coding sequence
atgcgtggagccggagagagcggaaagtctacaatcgttaagcaaatgaaaattattcacgaggacggatatagtgaggaagaatgcaggcagtatcgcgcagtggtgtatagtaatactatccagtccatcatggctattgtcaaagccatgggcaatctccaaatcgatttcgccgatccttctagggctgacgacgcacgccagctgtttgcactgagctgtaccgccgaggaacagggggtgctgcctgatgacctttcaggggtcatccggagactctgggccgatcacggggttcaggcctgtttcggacgctcgcgagagtaccagctgaacgacagcgcggcgtattacctgaatgatttagaaaggatcgcacaaagcgactacattcctacccaacaggacgtactgcgcacccgagtgaaaacaacaggaatagtcgagacacactttacttttaaggatctacattttaagatgtttgatgtgggcggtcagagatccgaacgtaaaaagtggattcactgtttcgagggggtaaccgcaatcattttttgcgtggcactgtcagcatacgatctggtcctcgccgaagatgaggaaatgaaccgcatgcatgaaagtatgaagctttttgatagcatttgtaacaataagtggttcacggacacaagcattatcttgttcttaaacaagaaagatctgtttgaggaaaaaatcacacatagcccactgaccatttgcttcccagagtatactggagctaacaaatacgatgaggcagcctcctacatccagagcaaatttgaggatctcaataaaaggaaagatacaaaggaaatttatacacacttcacatgcgcgactgacaccaagaacgtgcagttcgttttcgacgccgtcaccgacgtgatcatcaaaaataatctgaaagactgcggcctgttttag

SEQ ID NO: 119255 - DNA, 825 bp, Artificial Sequence
  Description of Artificial Sequence: Synthetic coding sequence
atggccattgtgaaggcaatggggaacctgcagatcgactttgctgacccgagtcgcgccgacgacgctcgccagcttttcgctctttcgtgcacagccgaagaacagggagtgctccccgacgatctgagcggtgtgattagaaggttatgggctgaccacggcgtgcaggcgtgctttggacggtcacgggagtatcagctgaatgacagcgccgcttattacttgaacgatttagagaggatcgctcagagcgactatattcctactcagcaggacgtgctgagaactcgggtcaaaacaactggaatcgttgagacccatttcacattcaaagatctgcacttcaagatgtttgatgtaggcggtcaacgcagcgagcgcaagaagtggatccattgcttcgaaggcgtgaccgccattattttttgtgtagccctgtctgcatacgatttagtacttgcagaagatgaggagatgaataggatgcatgagtccatgaagctctttgattctatttgtaacaacaaatggtttactgacacctcaattatactgtttctgaacaaaaaggatctgttcgaggaaaagatcactcattctccactgaccatttgcttcccagaatatactggtgcaaacaaatatgatgaggctgctagctacatccaaagcaaattcgaagatctaaacaaacgcaaagacaccaaggaaatttacacacactttacatgcgcaaccgacactaagaacgtgcaatttgtgttcgatgcagttaccgatgttataatcaaaaacaatctgaaagactgtggccttttctag

SEQ ID NO: 119256 - DNA, 1086 bp, Artificial Sequence
  Description of Artificial Sequence: Synthetic coding sequence
atggggtgcaccgtctctgctgaagacaaggccgctgctgaacgcagcaagatgatcgacaagaacctgcgcgaagatggggagaaggccgccagagaggtgaagcttctccttctgggagctggagaaagcgggaaaagtactatcgtcaagcagatgaagatcattcacgaggacggttactccgaagaggagtgtaggcagtaccgggccgtagtgtatagtaacactatccagtcaatcatggccatcgtcaaggccatgggaaacttacagatcgactttgctgacccatcccgagctgacgatgcccgccagctcttcgccctttcatgtaccgccgaagaacagggagtgctccctgacgacctttctggggtcattaggcgtctgtgggcagaccacggggtgcaagcatgttttggaagatctcgcgagtatcagctcaatgatagtgctgcatattacctgaacgacttggagcggattgcccagtcagattatatccccactcagcaagacgttctgcgcacccgagtgaagacaactgggatcgtagagactcattttacctttaaggatctgcacttcaaaatgttcgatgtcgggggccagcgctccgagcggaagaagtggatccactgtttcgaaggggtgaccgctatcattttctgcgtggccctaagtgcttacgatctcgtattagcggaggacgaagagatgaataggatgcacgaatccatgaaactgttcgattcaatttgcaacaataagtggtttaccgacacctctattatcctgttcctcaataagaaggacctgtttgaagaaaaaattactcatagtcctctcactatctgttttcccgagtataccggcgcaaataaatacgacgaagctgcgtcatacatccagtccaaattcgaggacctgaacaaacggaaggataccaaggagatttatacacatttcacttgcgccaccgatacgaagtcgcgcaaactgttccgcgagaattacctgaagctgagcgaccctgaccagcagccacctcccgcccctcttcctagcgatagcgtgccctag

SEQ ID NO: 119257 - DNA, 1065 bp, Artificial Sequence
  Description of Artificial Sequence: Synthetic coding sequence
atgggatgcaccttgtcagccgaagacaaagccgccgttgaaagatctaagatgatcgaccggaacttgcgagaggatggtgagaaggctgcgaaggaagtcaagttgctgctattgggagccggggagtctggcaaatctacaatcgtcaagcaaatgaagattattcatgaagatgggtactcggaagacgagtgcaaacagtacaaagtggtggtctatagcaataccatccaaagcatcatcgctatcataagggccatggggcgcctaaagattgatttcggagaggctgccagggcagacgacgcaaggcagctgttcgttctggcagggagcgccgaggaaggcgtgatgactccggagctggccggagtgattaagcgattatggcgggatggaggggtgcaagcttgcttcagccgctcccgtgaatatcagctgaatgattccgcaagttattatctgaacgatttagacagaatcagccagtctaattacatccctactcagcaagatgtgctgcgcactcgagtcaagacaacaggaatcgttgaaacgcatttcacttttaaggacttgtattttaaaatgtttgatgttggcggccagcggtctgaaaggaaaaaatggatccactgctttgaaggagtcacggcaattatcttctgtgttgccctgtctgattatgacctggttctagccgaggatgaggagatgaatagaatgcacgaatcaatgaagcttttcgactccatttgtaacaacaaatggttcaccgagacatctatcattctgtttcttaacaaaaaggacctctttgaggaaaagatcaagcggtccccattaacaatttgctaccccgagtacactggaagcaacacttatgaagaagccgccgcctatatccaatgtcagtttgaggatctgaatcggcgcaaagataccaaggaaatttatacccatttcacatgcgcaacagacactaaaaatgtgcagtttgtgtttgatgccgtcacagatgtgattatcaaaaacaacttaaaagaatgcgggctgtactag

SEQ ID NO: 119258 - DNA, 2652 bp, Artificial Sequence
  Description of Artificial Sequence: Synthetic coding sequence
atggccgagaactcagtgttaacatctacaaccggccggacttcgcttgccgactcttcgatcttcgacagtaaagtgaccgaaatttctaaagaaaatctgctaattgggtcaacctcatacgtagaagaggaaatgccacagattgagacacgtgtgattctggtgcaggaagcagggaagcaggaagaactgataaaggcactaaaagatattaaagtgggctttgtgaagatggagtcagtagaagaatttgagggactggatagtcctgagtttgagaatgtcttcgtggtgacagacttccaagactcagtttttaacgatctgtataaggctgactgtagagtgatcggacctccagtggtcctcaattgttctcagaagggtgaaccgttgcctttttcttgtaggccattgtactgcacttctatgatgaatctggttctttgcttcaccgggtttagaaaaaaggaggagctggtcaggctggtcactctagtccatcatatgggtggggtgattaggaaagacttcaactccaaagttactcacctcgtcgctaattgtacccagggcgagaagttcagggttgctgtgtctctcggtacacccattatgaaaccagaatggatctataaagcctgggaacggaggaacgaacaggacttctacgccgccgtagacgactttaggaacgagtttaaagtgccaccgttccaggactgtattcttagttttctgggattctcagatgaggagaaaacgaacatggaagagatgacagaaatgcagggaggcaagtatcttcccctcggggacgagcgctgcacacatctggtggtggaagagaatattgttaaagacctcccatttgaaccatcaaagaagctttacgtcgtcaagcaggaatggttttggggctcgatccagatggatgcccgcgcaggagagaccatgtatctgtacgagaaggcgaacacccccgagctgaaaaagtccgtgtccatgctctctttaaacaccccaaatagcaataggaaacgacgccgcctgaaggaaacgctggctcaactttctagagaaaccgatgttagcccttttcctccccgcaaaaggccaagcgcagagcactctctcagcattggcagcctgttagacatcagcaacacacccgagtcttctatcaattatggagacacacctaaatcttgtaccaagtcctctaagtcctcaactccagttcctagcaaacagtctgccagatggcaggtggcaaaggagttgtaccaaacagagagcaactacgttaatatactggcgaccatcattcagctgttccaggtccccctggaggaggaggggcaacgcggggggccaatactggccccagaagaaatcaagacaatcttcggatcaatccccgatatttttgatgtccacaccaaaattaaggatgacctcgaagatctgatcgtcaactgggacgaaagtaagtcgattggggacatctttctcaagtactcaaaggacctcgttaagacttacccccctttcgttaatttttttgagatgtccaaagagacaattattaagtgcgagaaacagaagccccggttccatgcattcctgaagataaaccaagccaagcccgagtgcggccggcagagcctggtggagttgttaattaggcctgtccagaggctgcccagtgttgccttattgctgaatgacttgaaaaagcatacagcagacgaaaatccagataagagcacgctggagaaggccatagggagtcttaaagaagtcatgacacacatcaatgaggataagagaaaaacagaagcccagaagcagatcttcgacgtagtgtatgaagtggacgggtgcccggcaaatctgctgagttcacacaggagccttgttcagagggtagaaactattagtttgggggagcacccttgtgacaggggtgagcaggttaccctctttctgttcaatgattgtctggagatcgctcgcaaacgacataaggttattggcaccttcagatctcctcacggacagactcgtcctccagcgtcacttaaacacatccacttgatgcccctgagtcagataaagaaggtgcttgacatcagggagacagaggattgtcacaatgcattcgcgctgcttgtgcgtcctcccactgaacaagctaacgtgctgctgagctttcagatgacatccgacgagctccccaaagagaattggctgaaaatgctgtgtaggcatgtggccaacactatctgcaaagctgacgccgagaacctgatctatacggcagaccccgagagcttcgaggtgaacacaaaagatatggattctacgctctcacgggcttctagggccattaaaaaaaccagcaaaaaggtgacgagagcttttagtttttccaaaacgccgaagagggccctgagacgggcacttatgaccagtcatggtagcgtggagggtagatctcccagctcaaatgacaagcacgtaatgtcccgcctgtcgagcacaagcagccttgcaggcatcccttcaccgtcactcgtgtctctccctagtttcttcgaacggcggagtcacaccttatcaaggtctaccacacatttgatatag

SEQ ID NO: 119259 - DNA, 1053 bp, Artificial Sequence
  Description of Artificial Sequence: Synthetic coding sequence
atgggagcaggtgcttcagcagaggagaagcacagtagagagcttgagaagaagctcaaagaggatgccgagaaagacgcccgcaccgtaaaacttctcctgcttggtgctggggagagcggcaaatctacaattgtgaagcagatgaaaatcatccatcaagacggctactctctagaggaatgcctcgagtttattgcaatcatctatgggaacacattacagtctattttagccatcgtccgcgctatgacaacactgaatattcagtacggcgactctgctcgacaggacgacgcccgtaagctcatgcacatggcagatacaattgaagaggggaccatgccaaaagagatgtctgacattatacagcggttgtggaaggatagtggcatccaggcctgctttgagcgtgctagcgaatatcagcttaatgactccgctggatactacttgagtgacttggagaggcttgtcacgccgggctacgttcctacagaacaagatgtccttagatcccgggtgaagactacagggataatcgagactcagtttagcttcaaagacctgaatttccggatgtttgacgtgggcggccagcggagcgaacggaagaagtggatccactgctttgaaggcgtgacttgcataatatttatcgctgctcttagcgcctatgatatggtgctcgtggaagacgacgaagtcaatcgaatgcatgaatcactccatctgttcaactcgatctgtaatcataggtatttcgctactacctcaatagttttattcctgaacaaaaaggatgtgtttttcgagaaaatcaagaaggctcacctttctatttgtttccctgattatgatggccccaacacctatgaggacgccggaaattacatcaaggtgcagttcttggagctgaatatgaggagagatgtgaaggagatttacagccacatgacctgtgccacagatacacagaatgtgaaatttgtgtttgatgccgtgacagatattattatcaaagagaacctgaaggactgcgggctcttctag

SEQ ID NO: 119260 - DNA, 1065 bp, Artificial Sequence
  Description of Artificial Sequence: Synthetic coding sequence
atggggagcggcgccagtgccgaggacaaggaacttgccaagcgcagtaaggagctagagaagaagcttcaggaagacgccgataaggaagccaagacagtgaaactcctcctgcttggtgccggtgagtctgggaagtccactattgtgaagcagatgaagatcattcatcaggacgggtattccccagaagagtgcctggaattcaaagcaattatctatggaaatgtgttgcagtcaattctggccatcattagggctatgacaacactgggaatcgattatgccgagccctcgtgtgcagacgatggccggcagttaaacaatctcgctgatagcatcgaggagggaaccatgcctcctgagttagtagaggttatccgcagactctggaaagacggtggagtgcaggcctgtttcgagagggccgccgagtaccagttgaatgactccgcgagctactatctcaaccagctcgaaagaatcactgaccccgaatatctgcccagcgagcaggatgtcctgagaagtcgagttaagactaccgggatcatcgagaccaagttcagcgtgaaggacttaaacttcaggatgtttgacgtaggtggccagagatcagaaagaaaaaaatggatccattgcttcgagggcgtgacttgtatcatcttctgtgcagccctgtccgcatacgacatggtcctggtcgaagacgacgaggtgaatagaatgcacgagtctctccacttatttaacagcatatgcaaccacaagtttttcgctgcaacttccatcgtgctgtttttgaacaagaaagacttgttcgaagagaaaatcaagaaagtgcacctatcaatttgctttcctgaatatgatggtaataactcttatgatgatgctgggaattatatcaaaagccagttcctggatctcaacatgaggaaggatgtaaaggagatctactcacacatgacatgtgctacggatactcaaaacgtgaagtttgtgttcgacgccgtgaccgatataattattaaggagaacctcaaggactgtgggctgttttag

SEQ ID NO: 119261 - DNA, 1068 bp, Artificial Sequence
  Description of Artificial Sequence: Synthetic coding sequence
atgggttgcaggcagagtagcgaggagaaagaagcagctagacggtccaggagaatcgaccgacacttgaggtccgaaagccagaggcaacgccgcgagatcaagttattactgttgggaactagtaatagtggcaaatcaacgatcgtgaaacagatgaaaatcatccactccggcggtttcaatcttgaggcatgcaaggaatataagcctcttatcatttataatgccatcgactccctcacacggatcataagggcgctggctgctctcagaattgacttccacaaccccgaccgcgcatacgatgcagtacagctgttcgctctgaccggccctgcagagtctaaaggtgaaattactcctgaacttctgggcgtaatgagaaggctgtgggcagaccctggggctcaggcctgcttctctaggtcctcagaatatcatctcgaagataacgctgcatactatcttaacgatcttgaaagaattgccgctgcagattatatccccactgtcgaggacatactgcgttctcgcgatatgaccactggcatagtggagaataaattcaccttcaaagaactgacgtttaagatggtggacgttggcggccagcggagtgagaggaaaaagtggatccactgcttcgaaggagtgaccgcgatcattttctgcgtcgagctgtcaggatacgatctaaaattgtacgaggacaaccagacatcacggatggccgaatcgctgcgactgttcgatagtatttgcaacaataattggtttattaatacttcgctgattcttttcttgaacaagaaggacctgctggccgagaaaatcagaaggattccattgacaatctgctttcccgagtataagggacaaaacacctatgaggaagctgcagtctatatacagcgccagtttgaggacctgaaccgcaacaaagagactaaggaaatctatagccattttacatgtgctacagacaccagcaatattcagttcgttttcgatgccgtcactgatgtgatcattcagaacaacctaaaatacatcggtctgtgttag

SEQ ID NO: 119262 - DNA, 912 bp, Artificial Sequence
  Description of Artificial Sequence: Synthetic coding sequence
atgaagatcattcattcaggcggctttaacctggaggcttgtaaagagtataaaccactaataatctataacgctatagacagcctgaccaggatcattcgggccctcgcagccctacggatcgactttcataatcccgatcgtgcgtatgacgctgtgcagctatttgccctgacaggtccagcagagtccaagggcgagattactcctgaactgttaggtgtcatgcgcagactgtgggctgatcctggggcacaggcttgttttagccgcagtagcgaataccacctggaagataatgccgcctactatctgaacgatctggaaagaatcgccgccgctgactacataccaacagttgaggacatcctgcggtcacgtgatatgactaccggcattgttgaaaacaagttcacctttaaagaactcacatttaaaatggtggacgtagggggacaacgaagtgagcgtaaaaaatggattcactgcttcgaaggcgtgactgccatcatattttgcgtggaactgtcaggatacgatttaaaactgtatgaggataaccagacgagccggatggcagagtctctcagactcttcgacagcatatgtaacaataactggttcatcaatacatctttaattctctttttgaataaaaaagacctcttggcggagaaaatccgccgcatccccctcaccatttgcttccccgaatacaagggacagaacacctatgaagaagctgctgtctatatccagcggcaatttgaggacctcaataggaacaaggaaacgaaggagatctattcccacttcacctgcgccaccgacacaagtaacattcaattcgtgtttgacgccgtaaccgatgtcatcattcagaacaatctgaagtacatcggcctgtgttag

SEQ ID NO: 119263 - DNA, 1188 bp, Artificial Sequence
  Description of Artificial Sequence: Synthetic coding sequence
atgtgtgatcaaaccttcctggtgaatgttttcggtagttgcgataagtgcttcaagcagagagccttaagacctgtcttcaagaagtcacaacagcttagctactgttcgacatgtgctgagattatggcaacagagggcctgcatgagaacgaaaccttagccagtttgaaatcggaagcagagtccttaaaagggaagctggaggaggagagagctaagctgcatgatgtggaattgcatcaagtggcggagagagttgaggccctagggcagttcgtgatgaaaaccagacggactctgaagggccacggaaacaaggtcttgtgcatggactggtgcaaggataagcgccgcatagtatcatcttcccaggatggaaaagtgattgtctgggatagctttaccaccaacaaagaacacgcggttaccatgccctgtacctgggtcatggcttgcgcctacgccccctccggctgtgccattgcttgcggagggttggataataagtgttccgtatatcccctgacttttgataagaatgagaatatggccgccaagaaaaaatctgtggccatgcacaccaattatctgagtgcatgttcctttaccaattctgatatgcagattctgactgccagcggcgatgggacctgcgccctctgggatgttgagagcggtcaacttctccagagttttcacggacatggagcggatgtgctttgtctagatctggcccctagtgaaaccggaaatacattcgtgagtgggggttgtgataagaaggccatggtttgggacatgcgcagcgggcagtgtgtgcaggcttttgaaacccacgagtctgatatcaactcagtgcgctactatccaagtggagatgccttcgccagcggatccgacgatgccacttgcagattgtatgacctgagagccgatcgggaggttgccatctactcaaaagaatcaatcatttttggagcaagctcagtcgacttcagcctgtctggtcggttgctgttcgcaggctataatgattacacaattaatgtctgggatgtgttaaaggggtcccgggtcagcattctattcggccacgagaatcgggttagcacactgagggtgagcccagatggcaccgccttctgctcaggcagttgggatcacaccttgagggtatgggcttag

SEQ ID NO: 119264 - DNA, 1062 bp, Artificial Sequence
  Description of Artificial Sequence: Synthetic coding sequence
atggctacagagggcctccatgagaacgagaccctggctagtctgaagtccgaagctgaatcgctgaagggaaaactcgaagaagaaagggcgaaactgcatgatgtggagctgcatcaagtggccgaaagagtggaagcattaggtcagttcgtcatgaaaactagaagaaccctgaagggtcacggtaacaaggtactgtgtatggattggtgcaaggataagcgaaggatagtttcctcttcacaggacggcaaggtaattgtctgggacagctttaccactaacaaggagcatgcggtgaccatgccatgcacttgggtgatggcctgtgcctacgcaccatccggctgtgccatcgcctgcggaggattggataacaagtgtagcgtgtatccgctgacattcgacaaaaatgagaatatggcagctaagaaaaagtctgtggccatgcatacaaattacctgagtgcctgctcatttaccaacagtgacatgcagatattaaccgcttcgggcgatgggacttgtgcgctgtgggacgtcgagagtgggcagctcctgcagtcgtttcacggacacggtgccgatgtcctctgtctggacctggctccctccgaaacgggaaatacatttgtatcagggggatgtgataaaaaggctatggtttgggacatgaggtctggccagtgtgtgcaggctttcgaaacccatgaatctgacattaacagcgtgcggtattacccttctggggacgcatttgctagtggctccgatgacgcaacctgtagactgtacgacctgcgagcagatcgggaagtggctatatattcgaaggaatctatcattttcggagccagttctgtggacttcagcttaagcggcagactcttattcgccggctacaacgactacactattaatgtctgggacgtactgaagggcagccgggtgagcattttattcggccatgaaaacagggtgtctacactgcgggtgtcacccgatgggaccgctttctgctcaggcagctgggaccatactctccgggtctgggcatag

SEQ ID NO: 119265 - DNA, 852 bp, Artificial Sequence
  Description of Artificial Sequence: Synthetic coding sequence
atggcgaccgagggacttcatgagaatgaaacactggcttcattgaagtccgaggccgaaagcctgaaaggtaaactagaagaagaaagagctaagttgcatgatgtcgagttgcatcaggtggccgaacgggttgaggccttaggccagttcgtcatgaagacccgtagaacattaaaaggacacgggaataaagttctgtgtatggactggtgtaaagataaaaggaggattgtgagctcctcccaggatggaaaagtgatcgtttgggattcttttacaactaacaagatcctgactgcaagcggggacgggacttgcgcactgtgggatgtggagtccgggcaactactgcaatcattccatggccatggggccgacgttctgtgcctggatctcgccccctctgaaaccggaaatacattcgtgagcgggggctgtgataaaaaggcaatggtctgggacatgcggtcaggacagtgcgttcaggctttcgaaacccacgaatctgacattaactccgtgagatattatccatctggagacgcgttcgcctcaggctctgatgatgccacctgtcgactgtacgatctcagagcagatcgagaggttgcgatctactcaaaagaaagtataatttttggtgccagctccgttgattttagcctgagcggacgattgctgtttgccgggtacaatgattacaccattaacgtgtgggatgtcctgaaggggagcagagtttctatcctattcgggcatgaaaacagggtgagcactttacgggtctcccccgacggaaccgccttttgttcagggagctgggatcacaccctgcgagtttgggcatag

SEQ ID NO: 119266 - DNA, 582 bp, Artificial Sequence
  Description of Artificial Sequence: Synthetic coding sequence
atgtccaagttgttgatccttattcttactgcatcaggagatgggacttgcgctctgtgggatgtcgaatctggccagctgctgcagagtttccacgggcatggagccgacgtgctttgtctggatcttgcgcccagcgagactgggaacaccttcgttagcgggggctgcgataaaaaagctatggtttgggatatgaggagtgggcagtgtgtgcaggcctttgagacacacgagtctgacatcaactctgttagatattacccctctggcgacgctttcgccagtggctctgatgacgcaacatgtaggctttatgatcttagagccgacagggaagtggccatatatagcaaggagtccatcatctttggggcaagcagcgtggacttttctttaagcgggcggttactgttcgctgggtataatgactataccatcaacgtctgggacgtgctgaagggttctagggtgtcgatcttatttgggcacgaaaaccgggtttcaacgctgagggtcagtcccgacggcacagcattttgcagtgggtcctgggaccacacactacgcgtttgggcctag

SEQ ID NO: 119267 - DNA, 1023 bp, Artificial Sequence
  Description of Artificial Sequence: Synthetic coding sequence
atgagcgaactcgaccagctacgccaagaggcagagcagctcaagaatcagattcgggatgcaaggaaagcgtgtgcagacgctactctgtcccaaatcacaaataacatagatccagtgggtcggatccagatgaggaccaggcggactctgagaggccatctcgctaagatttacgccatgcattggggcacggacagtaggttactggtttctgcgtcacaggacggcaaactcataatttgggattcctacacgaccaacaaggtccacgctattcctctccgaagttcatgggttatgacttgtgcttacgcccctagtggaaactacgtggcatgtggcggactggacaacatttgcagtatctacaatttgaaaactcgtgaggggaatgtcagggtctcaagagagctcgcgggacataccgggtatctctcttgctgccggttcctggatgataaccagatcgttaccagctctggagataccacctgcgcactgtgggatatcgagacgggtcagcagacaacgacattcaccggacacactggagatgtaatgtccctctctctggctcccgatactaggttatttgttagcggggcctgtgacgcctctgccaagttgtgggacgtaagggaagggatgtgtcggcagactttcacaggccatgagagcgatataaacgccatatgtttcttccccaatgggaatgcttttgctaccggtagtgacgacgccacttgtcgccttttcgacctgagagctgaccaggagctgatgacttacagtcacgataacattatatgcgggatcactagtgtttcattctccaaaagcgggcgactgctcctggctggctatgacgactttaattgcaacgtatgggacgcactaaaggccgatagggccggtgtcctcgctggccatgacaaccgagtgagctgtctgggggtcacagacgacggaatggcagttgcgactggcagttgggatagctttctgaagatttggaattag

SEQ ID NO: 119268 - DNA, 1023 bp, Artificial Sequence
  Description of Artificial Sequence: Synthetic coding sequence
atgtctgagctagaccagttaaggcaagaagcagaacagctaaaaaaccaaattcgggatgccagaaaagcttgtgctgatgctactctatcgcaaataacaaacaatattgatcccgtaggcaggattcaaatgcgtaccaggagaaccctaagggggcaccttgctaagatttacgctatgcactggggaacagattccagattgctggtttccgcctcccaggatggcaagctaattatttgggactcttataccaccaataaggtccacgctattcccctgcgatcttcatgggttatgacctgtgcctatgcgccctcagggaattatgttgcgtgcgggggcctcgacaatatatgttctatctataacctgaaaacgagagaagggaatgtcagggtctcccgagaactcgccggccatactggctacctgtcctgttgtcgcttcctggatgacaaccagatcgtgacaagttccggtgacaccacttgcgctctttgggacatcgaaacaggtcaacagaccacaacattcactggtcataccggggatgtaatgagtcttagtctcgctcccgatacgaggcttttcgttagtggcgcctgtgacgcttccgcaaagctgtgggatgtgagagaagggatgtgccgacagacatttacgggccacgagtccgatataaatgccatctgctttttccccaatggtaacgcctttgctactggaagcgacgatgcaacttgccggttgttcgatttgagggcggatcaggaactcatgacctacagtcacgacaacatcatatgcggaataactagcgtgtctttcagtaagagtggcaggctcctgctggcaggatatgacgacttcaactgcaatgtttgggacgcactcaaggccgatcgggccggcgtactggctgggcatgataacagagtgtcatgccttggggttaccgacgacgggatggctgtggccaccggatcatgggactcattcctcaaaatttggaactag

SEQ ID NO: 119269 - DNA, 597 bp, Artificial Sequence
  Description of Artificial Sequence: Synthetic coding sequence
taaggctacttgtcatgttgtaggtttcttgatgacaatcagattgtgacgagcagcggcgataccacatgtgccctgtgggatatagagactggccagcagactaccacatttacagggcatacaggagatgtgatgagcttgagtctagctcccgacactcggctgtttgtgtccggcgcctgcgacgcatccgctaagctgtgggatgttcgggaaggcatgtgccgacagacatttacaggccacgagtcagatatcaacgctatctgtttttttccaaatggcaatgccttcgccactgggagcgatgatgctacgtgcaggctgttcgacctgagggccgaccaggaactcatgacatattcccatgacaacattatttgcgggatcacatctgtgtcattttccaagtccggccggcttctgctggccggctatgacgatttcaattgtaacgtgtgggatgctctaaaagcagaccgtgccggagtgctagccggacatgataaccgcgttagctgcctcggcgtcaccgatgatgggatggccgtggccacgggcagttgggactcctttctcaaaatatggaactag

SEQ ID NO: 119270 - DNA, 444 bp, Artificial Sequence
  Description of Artificial Sequence: Synthetic coding sequence
atgagtgaattggaccagctgaggcaggaagccgaacagctgaaaaatcagataagggacgctcgcaaggcctgcgcagatgctactctcagccaaataaccaataatatagaccccgttgggcggatccagatgcgcactaggaggacattgagaggacatctcgccaagatttacgccatgcattgggggactgacagcagactgctagtctcagcatctcaagacgggaaactgatcatatgggactcttatacaactaacaaggtgcatgcaatacctctgaggtcctcttgggtcatgacatgtgcttatgcgcccagtggaaactacgtggcctgcggcggtttggacaacatctgcagcatctacaacttaaagaccagagagggcaatgtcagggtgtcccgtgagctggccggacacactggaacctgtccttag

SEQ ID NO: 119271 - DNA, 327 bp, Artificial Sequence
  Description of Artificial Sequence: Synthetic coding sequence
atgtctgagctggatcagctgcgacaggaggccgaacagctgaagaaccaaattcgcgatgccagaaaggcctgcgcggacgctaccctgtcccaaatcaccaacaacatagaccccgttggccggattcagatgagaactcgacgtacgctgcgtggccatctggctaaaatttatgcaatgcattggggtaccgacagcagattactggtgtcggcttctcaggacggaaagctgatcatctgggacagctacactacaaataaggttcacgctatcccgttgcggagttcctgggtgatgacttgcgcctacgcccccagttag

SEQ ID NO: 119272 - DNA, 405 bp, Artificial Sequence
  Description of Artificial Sequence: Synthetic coding sequence
atgtccgagctggaccaactcaggcaggaggccgagcaattgaaaaaccagatcagaataactaacaacattgaccctgtgggaagaattcaaatgcgtacacgccggaccctgaggggacatctcgctaaaatctacgccatgcattgggggaccgatagccgattactggtcagtgcgtcccaggacggtaagctgattatctgggattcctacacaaccaacaaagtgcacgcgatcccccttcgttccagctgggtgatgacttgtgcatacgccccatctggaaactacgtggcctgcggcggattggataacatatgttcaatttataacctcaaaactagggaggggaacgtgcgggtgagcagagaactagcaggacacaccggaacctgcccttag

SEQ ID NO: 119273 - DNA, 723 bp, Artificial Sequence
  Description of Artificial Sequence: Synthetic coding sequence
atgacttgtgcatatgcccccagcggtaattatgtcgcgtgcggcgggctcgacaacatttgcagcatttataacctcaagacccgcgaaggcaacgtacgggtgtccagggaactggctggacataccgggtacctgagctgctgcagattcttggacgacaaccagattgtaaccagcagcggtgacactacctgcgcactgtgggatattgagactgggcaacagaccacaactttcacgggccatactggtgacgtgatgagtttatcacttgcccctgacacgagactgttcgtgtctggggcatgtgacgccagtgctaaactgtgggacgttcgggaaggcatgtgccggcagacatttacaggccatgaaagtgatataaacgctatttgtttcttcccaaacggtaatgccttcgccacaggatctgatgacgcaacctgtcggctcttcgatcttagggcagatcaggaattgatgacctactctcacgacaacattatatgtggcatcactagcgtaagtttttccaaaagcggtcgcctcctgttagcgggctatgacgacttcaattgtaacgtgtgggatgccctgaaggccgaccgggctggggtgcttgctggacacgataacagggtgtcttgtctgggcgtgactgacgatggcatggcagtggcaaccggcagctgggactcatttctgaaaatttggaactag

SEQ ID NO: 119274 - DNA, 984 bp, Artificial Sequence
  Description of Artificial Sequence: Synthetic coding sequence
atgacagctccctgtcctcccccaccacctgatccacagtttgtccttcgcggaacacagagtccagtgcacgcattgcacttctgtgagggtgcacaggctcaaggcaggccgctgctgttttctggcagccagtctggactcgtccacatctggtcactacagacaagaagggcagtcaccacactcgacggccacgggggtcagtgcgtgacctggctgcagacactgccccagggtcgacagttgctgtcccaagggagggacctgaaactctgtctctgggacctggctgaaggccgctccgccgtggttgactctgtttgtctcgagagtgtcgggttttgtagatctagcatcctagccggcggccagcccaggtggacccttgccgttcccggtcgaggttccgacgaggtccagattttggagatgccaagtaagacaagcgtttgcgccttgaaaccgaaagccgatgctaagctcggcatgccgatgtgtctgaggctgtggcaggccgactgctccagtagaccactgcttttggccgggtacgaggatgggtctgtcgtcctctgggacgtctcagagcagaaggtatgcagtaggatcgcctgtcatgaggagccagtgatggacttagacttcgactctcaaaaggctagaggaatctccgggtctgccggaaaagcactggctgtgtggagcttggactggcagcaggccctccaggttaggggtactcacgaactgacaaacccaggaatcgctgaagtgacaataaggccggataggaagatattggcgaccgccgggtgggaccaccgtattagagttttccactggagaaccatgcagcccttggcagtcctggcatttcactcggccgccgtccaatgtgtggccttcaccgcggatgggctgctggccgcaggatccaaggatcagcggatctcactgtggagcttgtacccgcgcgcctag

SEQ ID NO: 119275 - DNA, 984 bp, Artificial Sequence
  Description of Artificial Sequence: Synthetic coding sequence
atgaccgcaccttgcccgcctccacctcccgaccctcagtttgtgctgagaggaacgcaatccccggtccacgcgctgcatttctgcgaaggcgcgcaggcccagggtcgccctctccttttctccggatcgcaatccggcctggtgcacatttggtccttgcaaacaaggagagctgtgactaccctggacggacatggcggccagtgtgtcacttggctgcagacattgccgcaggggaggcaactcctctcccaggggcgagacctgaaactttgcctgtgggacttggccgaggggagatctgcggtggtggatagcgtttgtctcgaatctgtggggttttgtcggagttccatcttggctggaggccagccgcggtggaccttggcggtaccaggcaggggatcagatgaagtccagattctggagatgccctccaaaacaagcgtgtgcgctcttaaacctaaggctgacgccaagctcggtatgcctatgtgccttaggctctggcaagccgattgttctagccgaccactcctgttggctggttacgaggacggttcagtggtcctgtgggacgtgagcgagcagaaggtgtgcagtcggatcgcatgccacgaggagcccgtgatggatttagattttgactcacagaaggcccgcggaatcagtggttctgcaggcaaagctttagcggtctggtccctggactggcagcaggccctgcaagttagagggacccatgagctgactaatcctggaatcgcggaggttaccatacgaccagaccgcaaaatccttgctaccgcaggttgggaccacagaatccgggtttttcattggcgcacgatgcagcccctggccgttctggccttccacagtgccgcagttcagtgtgtggcatttaccgccgatggcttactggccgccggctctaaggaccaacggatctccctgtggtctttgtatccacgagcatag

SEQ ID NO: 119276 - DNA, 639 bp, Artificial Sequence
  Description of Artificial Sequence: Synthetic coding sequence
atgaccgctccttgtcctcctcctccacccgaccctcagttcgtactacgcgggacccaatctcccgtgcacgctttacacttctgcgaaggagctcaggcccagggaaggccacttttattcagcggtagccagagtggacttgtgcatatctggtcacttcagactcgacgggccgttaccacactcgatggtcatggaggccaatgcgtgacctggctgcagaccctgccacagggccgacagctgctctctcaagggcgagatctgaaattgtgtctttgggaccttgctgaggggcgctccgccgtcgtggactccgtctgcctggagtctgttggattctgtcggtctagtatactggctggagggcaaccccgctggaccttggctgtgccaggaagagggtcagacgaagtacagatcctggaaatgcctagcaagacttcggtgtgcgctttgaagcccaaagccgatgccaagctgggcatgcctatgtgcctgaggctttggcaggctgactgttcatcccggcccctgcttctggccggctacgaggatgggtcagtcgtgctttgggatgtgagcgaacagaaggtttgctcccggattgcatgtcatgaagaacccggactttag

SEQ ID NO: 119277 - DNA, 1023 bp, Artificial Sequence
  Description of Artificial Sequence: Synthetic coding sequence
atgtccgagttggagcagctccgacaagaggccgagcagctgcggaaccagattagggatgcgcgaaaagcctgtggggacagcaccctgacccaaatcactgctggactggatcccgtggggaggattcaaatgcggacccggaggaccctgagaggacacctcgcgaaaatttacgccatgcactgggggaccgattctagactgttagtcagcgcttcacaggatggcaaattaataatctgggattcctacaccacaaacaaggtgcacgccatccccctgcgaagcagctgggtgatgacctgcgcttacgctccgtcaggaaactttgttgcttgtggtggcttagataacatctgtagcatatactcattgaagacgcgcgaaggcaacgtgagagtgagccgtgagctgcctgggcacacagggtacctatcatgttgccggttccttgatgacaatcaaataatcaccagttccggggatactacctgcgctctttgggacatcgagacaggtcagcagaccgtgggcttcgcaggccactccggagacgtaatgtctctctccctcgcccctgacggaagaacctttgtgtcgggagcatgtgacgcaagcataaagctgtgggacgtgcgggactcgatgtgccgtcagacgtttattggccacgagagtgacattaatgccgtggcattctttcccaacgggtatgcttttaccactggatccgacgacgcgacctgcaggctttttgacctacgcgcagaccaagagctacttatgtactctcatgacaacattatctgcggaatcacatcagtggcttttagtaggtctggcaggctgctgcttgccgggtacgacgactttaactgtaacatctgggatgcaatgaagggggatcgcgcaggagtgcttgccggccatgacaaccgggtctcatgtttgggggtaacagatgatggcatggctgtcgctacaggaagttgggattcctttttgaagatttggaattag

SEQ ID NO: 119278 - DNA, 1023 bp, Artificial Sequence
  Description of Artificial Sequence: Synthetic coding sequence
atgagcgaattggagcagctgaggcaggaggcagaacagcttcggaaccaaatccgggatgcacgtaaggcatgcggtgactcaacactgactcagatcacggcggggctggatcccgtcggcaggatccagatgcggacacggcgcacgctgagagggcacctcgccaaaatctacgccatgcactgggggactgatagtcgcctactcgtgtctgctagccaagatgggaagctcattatctgggacagttataccactaataaagtacacgcgatcccacttcgatcctcctgggtaatgacctgcgcctacgctccctctgggaattttgtggcttgcggtggattggacaatatttgttccatttatagcttaaagacccgggagggcaatgttcgggtgtcacgggagcttcctggccacaccggatatctgagttgttgcagattcctggatgataatcagataatcacaagcagcggtgacacgacctgcgcattatgggatatcgaaactgggcagcaaaccgtgggtttcgcaggacacagcggtgacgtcatgagcctgtcccttgctcccgacggcagaacatttgtgtccggcgcctgtgatgcgagcattaaactctgggacgttagggatagtatgtgtaggcagacgttcatcggccacgaatctgatataaatgcagtggcattttttcccaatgggtacgccttcacaactgggtctgacgacgccacttgccgcctcttcgacttaagggccgaccaagaactactgatgtattcccacgataatatcatttgcgggattacgtcagtcgctttctctcggagtggacggctgctgctggctggttacgacgatttcaattgcaatatctgggacgccatgaagggcgacagggcgggggtgcttgccggacacgataatagggtgtcttgtttaggagtgaccgatgacggaatggctgtcgctacggggagttgggattcttttttgaaaatctggaattag

SEQ ID NO: 119279 - DNA, 1023 bp, Artificial Sequence
  Description of Artificial Sequence: Synthetic coding sequence
atgagtgagctcgagcagttacgccaagaggcagagcaactgcgcaatcaaattagggacgctaggaaggcttgcggcgacagcactctcacacagatcacagccggtctcgaccccgtcgggaggattcagatgcggaccagacgaacactgcggggccatctggcaaagatatacgccatgcattgggggaccgactcacggctcctggtgtcagcctcccaggacggcaaattgatcatctgggattcttataccacaaataaagtacatgctatacctttgcggtcttcctgggtaatgacatgcgcatatgctccgagcggcaacttcgtggcctgtggagggctggataacatctgtagcatttacagcttgaagacgagagaggggaatgtgcgagtgtcccgggaattacccggccacacaggttacctgtcttgttgccgcttcctggatgataatcaaattatcacgagcagcggcgacacgacctgcgcactctgggatatcgagaccggacagcaaaccgtaggcttcgctggacattcaggtgacgtcatgtccctgtccctggcaccagatggtcgcacatttgtctccggagcctgcgacgcctcgataaagctctgggacgtccgcgactctatgtgtagacagacgtttatcggtcacgagtccgacatcaatgctgtcgccttcttccccaacggctatgcctttaccaccggatcggacgacgcaacgtgtcgactgttcgacttgcgagccgatcaggagctgctgatgtattcccacgataacataatctgtgggatcacaagtgttgcattctcccgtagtggcagactgctgctggccgggtatgatgactttaactgtaatatctgggatgctatgaagggagaccgtgccggagtgctggccgggcatgataatagagtgtcctgtctgggcgtcactgatgacggcatggccgtcgccactggatcttgggattctttcctgaagatttggaactag

SEQ ID NO: 119280 - DNA, 459 bp, Artificial Sequence
  Description of Artificial Sequence: Synthetic coding sequence
atgtctgaattggagcaattgcgacaggaggccgagcaactaagaaaccagattcgtgacgcccgcaaagcgtgcggcgatagcacattaacacagatcaccgcaggcctcgatccggtgggcaggattcagatgagaactcggagaactctgcggggtcacttggccaagatctatgcgatgcattggggtacagactctcggttgttggtgagcgccagccaggacggcaagctgattatttgggacagttacaccaccaacaaagtgcatgctattccactaaggtctagttgggttatgacttgtgcgtacgctccctccgggaattttgtggcctgcggcggcttagataacatttgctccatttattctctgaagaccagagaaggcaacgtgcgtgtgagtcgggagctgcctggccacaccggatatttatcctgctgccgcttcctgtag

SEQ ID NO: 119281 - DNA, 723 bp, Artificial Sequence
  Description of Artificial Sequence: Synthetic coding sequence
atgacttgtgcctatgcccccagtggaaacttcgtggcctgcgggggcctggataacatttgtagtatttattcgttgaagaccagggagggcaacgtcagggtgagtagagaattaccaggacacactggatatcttagctgctgccgtttccttgatgataaccagattatcacaagctctggggacacaacatgcgccctatgggatatcgaaaccggccagcagaccgtggggtttgctggacattccggcgacgtcatgagtctgagcctcgcgccggacggtcgaactttcgtgagcggagcctgcgatgcaagcatcaagctgtgggatgttcgggattctatgtgtcgccagacattcattggtcacgagtctgatataaatgctgtagctttcttccccaacggctatgcatttactacaggatctgatgacgctacttgtcgcctcttcgatctgcgggctgatcaggagcttttaatgtattcccatgataatataatatgtggtattaccagcgtagcgtttagccgtagcgggaggctgctgctggcagggtatgatgatttcaactgcaacatttgggatgcaatgaagggagatcgagccggggtgttagccggtcacgataacagagtcagctgcctaggggtaaccgatgacggcatggccgtcgccaccgggagttgggattcctttttaaagatatggaactag

SEQ ID NO: 119282 - DNA, 891 bp, Artificial Sequence
  Description of Artificial Sequence: Synthetic coding sequence
atgcggactaggaggaccctgcggggccacctggcaaaaatttatgcaatgcactgggggaccgacagtcgcctgctggtgagcgcctcacaggatggcaagttgattatatgggacagctatactacgaataaggtgcatgcgataccgctaagaagctcatgggtaatgacttgcgcgtacgcgcctagcggaaattttgtcgcgtgtgggggcttggataacatttgtagcatttactctctcaaaacccgggaaggcaacgtccgcgtcagtcgagagctacccgggcataccgggtatctctcctgttgccgtttcctcgatgacaaccagattataacttcctctggggatacaacatgcgctctgtgggacatcgaaactggccagcaaaccgtaggcttcgcaggacattcaggagacgtcatgagtctgtcgcttgcgccagatggcaggacattcgtcagcggggcctgtgacgcttctattaaactgtgggatgtccgtgactccatgtgcagacagacatttatcggccatgagagcgacataaatgccgtggctttcttcccaaacggatacgcttttactacgggcagcgatgacgctacttgtaggctgttcgatctcagggctgaccaagagttgctgatgtacagccatgacaacatcatctgcggtattacctcagtggcattctcaaggtcaggtcggctgttgctggcgggctacgacgattttaattgtaatatatgggatgccatgaagggggacagagcgggcgtcttagccggacacgacaatcgggtctcatgcttgggcgttaccgacgacggaatggcagtcgctactggcagctgggacagttttcttaagatctggaactag

SEQ ID NO: 119283 - DNA, 723 bp, Artificial Sequence
  Description of Artificial Sequence: Synthetic coding sequence
atgacttgtgcttatgctccctcagggaactttgtcgcttgcgggggcctagacaacatatgtagtatttacagcttaaagaccagagaaggtaatgttcgcgtcagtcgtgagctccccggacacacggggtacctttcctgctgccgcttcttggacgataaccagatcattacctccagcggtgacaccacgtgtgctctgtgggacatcgagactggccagcagacagtggggttcgccgggcacagtggtgatgtcatgtctctaagcctcgcacccgatgggcgcaccttcgtgtctggggcttgcgacgccagtatcaaactttgggacgtccgtgattctatgtgccgacagacctttatcggacacgagtcagacataaatgctgtggccttttttcctaatggatacgcatttacaaccgggagcgatgatgccacttgtcgcctgtttgacctgagagctgaccaagagctcctgatgtacagccacgacaacattatatgtggaatcaccagcgtcgcgttcagcagaagtggacggctgttgctggccggctatgatgacttcaactgcaatatctgggatgcaatgaagggggaccgcgccggagtactggctgggcacgataatagagtttcttgcctaggggtcactgatgacgggatggcagtggcaactggtagttgggactcatttttgaaaatatggaattag

SEQ ID NO: 119284 - DNA, 699 bp, Artificial Sequence
  Description of Artificial Sequence: Synthetic coding sequence
atgagcgaactggaacagctgcgccaggaggcagaacagctccgaaatcagatccgggatgcaagaaaggcctgtggtgacagcacgctcactcagattaccgccggactcgatcctgtcggacgcatacaaatgcgtacaagaagaaccctaaggggacacctagctaagatttatgccatgcactgggggacagattcaaggcttctcgtgagcgcgtctcaggacggaaagctgatcatttgggactcgtacactacgaataaggtccatgcaatcccactgcgatcgtcttgggttatgacttgcgcctacgcacccagcggaaatttcgtagcctgtggaggtctcgataacatatgctctatttacagcctgaagacgcgagaaggcaatgtaagggtgagccgagaactccctgggcataccgggtatctgtcatgctgtagattcctcgacgacaatcagattataacaagctcaggtgacactacttgtgcgctgtgggacatcgagaccggccagcagacagtcggctttgccgggcactctggggacgtcatgtcgctgtctctggcccctgatgggagaacctttgtgagtggcgcatgcgacgcatcgatcaagctctgggacgtccgcgatagcatgtgtagacagacctttatcggtcacgaatccgacatcaacgccgtgtag

SEQ ID NO: 119285 - DNA, 891 bp, Artificial Sequence
  Description of Artificial Sequence: Synthetic coding sequence
atgagaactcgacggactctacgcgggcacctggctaagatctatgccatgcattggggtacagatagtcgccttctggtgagcgcctcccaggacggcaagctcattatatgggacagctatacgacgaacaaggtgcatgccattcccctgaggagctcgtgggtcatgacctgcgcctacgccccaagcggcaattttgtggcttgtggcgggctggataatatatgttccatctactccctgaaaactcgggagggcaacgttagggtgagcagggaattgcctggccatacaggctatctgtcttgttgcaggtttctggatgacaatcagatcataaccagcagtggcgacacgacttgtgctctctgggacatcgagactggacagcaaacagtcggatttgccggccatagcggcgacgtgatgtccctcagcttagcccccgacggacgcacctttgtgagcggcgcttgtgacgcatcaattaagctgtgggacgttcgggactctatgtgtaggcagacctttataggccacgagtccgacattaatgctgttgcatttttccctaacggatacgcattcaccacagggtctgacgacgccacctgccgtctcttcgatctgagagcagaccaggagctcttgatgtactctcatgacaatataatttgcggcatcacttccgtggcgttcagtcgctccggacgcctcctattggctggatacgacgactttaactgcaacatttgggacgccatgaaaggggatcgagcaggtgtactcgcgggtcatgataaccgtgtctcatgcttaggagtcaccgatgacggcatggccgtggcaaccgggtcttgggactcctttctgaagatctggaactag

SEQ ID NO: 119286 - DNA, 756 bp, Artificial Sequence
  Description of Artificial Sequence: Synthetic coding sequence
atgagcgaactggagcaactccgccaggaggccgagcagctccgcaatcagatccgcgacgctcgcaaagcctgtggggactcaaccctgacacagatcaccgctggcctcgaccctgtggggcgaatccagatgcgcacccgcaggacactgcgcgggcacctcgctaagatctatgcaatgcactggggaaccgatagtagactgctggttagcgcttcccaagacgggaaactgatcatctgggattcttatactacgaataaagtgcacgccataccattgcggagcagctgggttatgacctgcgcgtatgcccctagtggtaattttgttgcttgtggagggcttgacaatatatgctccatttactccctcaaaacccgcgagggaaacgttagagttagtcgagaattgcccgggcacaccggctacctctcgtgttgtcgcttcttggacgacaaccagattattaccagctccggtgatactacgtgtgctctgtgggacattgagacaggccagcagactgtcggttttgccggacattcgggcgacgtaatgagcctgtccctcgcccctgatggccggacttttgtgagtggagcctgtgacgccagcattaagctatgggacgtgcgggacagcatgtgcagacagactttcatcggccacgaatcagatatcaacgctgtggcgttttttcccaatgggtatgcatttaccactggatccgatgatgctacttgtaggtag

SEQ ID NO: 119287 - DNA, 828 bp, Artificial Sequence
  Description of Artificial Sequence: Synthetic coding sequence
atgagtgccgaagtgaaagtaaccggccagaatcaggagcagtttctgctgttagccaaatccgccaagggcgccgctttagcaacgctgatacaccaggtgctcgaagctccaggtgtatacgtttttggggaattgctggatatgccgaacgtgcgcgaactggccgagagcgactttgccagcacattccggctcttgaccgtgtttgcctacggcacttacgcagattatctggcagaggcacgcaatcttccccccctcaccgaagcacagaagaataagctgaggcaccttagcgtggtaactttggcagcaaaagtgaagtgcattccatacgctgttttgctggaggctctggcactgcgaaatgttcgtcagttggaggacttggtgattgaagcagtctatgccgacgtgctgcggggttccttggatcagcggaatcagcgactcgaagtcgactactctatcggacgcgacatccagcgacaggatctaagtgccatagccagaacattgcaggaatggtgcgtggggtgtgaggtagttctgagtggcattgaagagcaagtgtccagggcgaaccagcataaggaacaacagctcggactgaagcagcagattgaatctgaagtggccaatctgaagaaaactattaaagtgacaaccgccgcagccgccgcagctaccagtcaggacccagaacagcacctcacagaactgagagaaccagctccagggactaaccaacggcagcccagcaaaaaagctagtaagggtaaaggactgcgggggtccgccaagatctggtctaaatcaaactag

SEQ ID NO: 119288 - DNA, 387 bp, Artificial Sequence
  Description of Artificial Sequence: Synthetic coding sequence
atgacgagtctgtttgcacaggaaattcgtctttccaaacggcacgaagaaatagtgtcccagcggctcatgctcctgcagcagatggaaaacaaattgggtgatcaacacacggaaaaggcctcccagctccagaccgttgaaacagccttcaagcgcaacctatctctgctcaaagacattgaggctgccgaaaagagcctgcaaactcggattcaccccctaccccgtccagaagtagtgtcccttgaaacccggtactgggcatctgtggaggaatatatccctaagtgggagcagttcctactcggacgcgccccctatcctttcgctgtggagaatcagaatgaagctgaaaacactattcagaacgaggcacaaaggtag

SEQ ID NO: 119289 - DNA, 1023 bp, Artificial Sequence
  Description of Artificial Sequence: Synthetic coding sequence
atgagtgagctagaacagctgaggcaggaggctgagcagctgcggaaccagattcaggacgccagaaaggcctgtaatgacgccacactggtccagattacgtcaaacatggactccgtgggccgcattcagatgcggacccgtcgtacacttagaggccacctcgcaaagatctatgccatgcattggggatacgactccaggctccttgtctcagcttctcaggacggcaaactgatcatctgggattcttacaccacaaataaaatgcacgcgattccactgcgcagttcctgggtgatgacctgcgcttacgccccttcggggaactacgtggcctgtggtggtctggataacatttgttccatctataaccttaaaactagagaaggtaatgtgcgcgtttcacgggaactgcccggccacacgggatatctaagctgttgccgcttcctcgatgactctcagattgttacatcttctggtgacaccacatgcgctctgtgggatattgagaccgcgcagcagaccactacctttacgggccacagcggggacgtgatgtccctgtcactgagtccagatatgaggacattcgtatcgggagcgtgcgatgcctcgtccaaattgtgggacatccgcgacgggatgtgtcggcaaagctttacagggcacgtatctgatattaacgccgtttcattcttccctaacggatatgccttcgccactgggagtgacgatgctacatgccggctcttcgacctgcgtgccgaccaggaattgctgctgtatagccacgacaatatcatttgcgggattaccagcgtggcattcagcaaatctggacgactcctcctagctggctacgacgattttaactgtaatgtatgggacacactgaagggagatcgcgcaggtgtcctcgccggacacgacaaccgggttagttgcctcggggtaaccgacgacggaatggccgtggccacgggaagctgggattcctttcttaggatctggaattag

SEQ ID NO: 119290 - DNA, 240 bp, Artificial Sequence
  Description of Artificial Sequence: Synthetic coding sequence
atgtcggaactcgagcagttacgccaagaggctgagcagctccgaaatcagattcaggacgcgaggaaggcatgcaacgacgctactctggttcagattacctccaacatggacagtgtgggcagaattcagatgcgcacccgtaggacacttcgcggccatctggccaaaatttacgcaatgcactgggggtacgactctcgcctgctggtgtcagcttctcaggatggcaaactgtag

SEQ ID NO: 119291 - DNA, 204 bp, Artificial Sequence
  Description of Artificial Sequence: Synthetic coding sequence
atggaggagtgggacgtgccccagatgaaaaaagaggtggaatcgttgaaatatcagcttgcttttcaacgcgaaatggctagtaagacaattccagagctgctcaagtggattgaggatggcataccaaaagaccccttcctgaaccctgatctcatgaagaataacccctgggtggagaaaggaaagtgcacaatcctttag

SEQ ID NO: 119292 - DNA, 216 bp, Artificial Sequence
  Description of Artificial Sequence: Synthetic coding sequence
atggctagcaacaatacagcttcaattgcgcaggccagaaagttggtagagcagctcaagatggaggccaatattgatagaattaaagtttccaaagcagcggcggacctgatggcttactgtgaagcccacgcaaaagaggacccattattaacccccgtgcccgcttctgagaatccatttcgcgagaagaaattcttttgtgccattttatag

SEQ ID NO: 119293 - DNA, 309 bp, Artificial Sequence
  Description of Artificial Sequence: Synthetic coding sequence
atgcaggggaaattacagccgcctatggaaagagaggcccgtgacggggtgccgtccgggaaggtattcctgaaagacctgtcgtcgacgcccatggcctcaaacaacactgcatccatcgctcaagctcggaaacttgttgaacagctaaagatggaggccaatatagaccgcattaaagtttccaaagctgctgccgacctgatggcatactgtgaggctcacgctaaagaggacccgttgctgacccctgtgcccgcatctgagaacccgttcagagaaaaaaagttcttctgcgccattctgtag

SEQ ID NO: 119294 - DNA, 216 bp, Artificial Sequence
  Description of Artificial Sequence: Synthetic coding sequence
atggcctctaacaacacggcctcaattgcgcaggcaagaaaactggtcgagcagctcaagatggaggctaacatagacagaatcaaagtcagcaaggctgccgcagatctcatggcctactgcgaagcccacgcgaaggaagatccacttctaactcccgtacccgctagtgagaacccatttcgcgaaaagaagttcttttgcgcaatcctgtag

SEQ ID NO: 119295 - DNA, 216 bp, Artificial Sequence
  Description of Artificial Sequence: Synthetic coding sequence
atggcctccaataataccgctagcatcgcacaggctagaaagctggttgaacagctcaagatggaggctaacatcgaccgcattaaagtttcaaaggccgctgcagaccttatggcatactgcgaggctcatgctaaggaggatcctttgctgacccccgtgcccgccagcgagaacccgttccgggagaaaaagtttttctgcgccattctctag

SEQ ID NO: 119296 - DNA, 216 bp, Artificial Sequence
  Description of Artificial Sequence: Synthetic coding sequence
atggcaagcaacaatacagctagcattgctcaggcccggaaattggttgaacagttaaagatggaagctaacattgacagaattaaggtgtcaaaggccgcagcagatcttatggcatattgcgaggcacacgcaaaggaggaccctctgcttacacccgtcccagcatcagagaatccgttcagagaaaagaagttcttctgcgccattctatag

SEQ ID NO: 119297 - DNA, 216 bp, Artificial Sequence
  Description of Artificial Sequence: Synthetic coding sequence
atggccagcaataacacggcatctattgcccaggccagaaagctggtcgagcaacttaagatggaggccaacatcgaccgaatcaaggtgtccaaggctgccgccgatctcatggcttattgcgaggcacatgccaaagaggatccgcttctgactcctgtgccagcctcagaaaatcccttccgggagaagaaatttttttgcgcaatactgtag

SEQ ID NO: 119298 - DNA, 333 bp, Artificial Sequence
  Description of Artificial Sequence: Synthetic coding sequence
atggtatatctgcaggcaaagacgaggatccctgaacaccgcaaggtgacacagctgatcaagtgttggtcccccgacttgaacccagtgttccttaaagatttgtccagtactccaatggcttctaacaataccgcatccatcgcacaggcaagaaagctggtggagcagctgaaaatggaggcgaacattgatcgaattaaagtcagcaaagccgccgccgatttgatggcatattgtgaagctcatgctaaggaagaccccctgctgactccagtccccgcgagcgaaaacccatttcgagagaagaagtttttctgcgcaatcttgtag

SEQ ID NO: 119299 - DNA, 207 bp, Artificial Sequence
  Description of Artificial Sequence: Synthetic coding sequence
atgagcggatcctcatccgtcgctgccatgaagaaagtagtccagcagctgcgccttgaggccggattgaaccgcgtcaaggtctcacaggcagccgcagatctgaagcagttctgccttcaaaatgctcagcatgatcctctcctcaccggggtctcctccagcacgaacccctttcggccccaaaaggtgtgctcattcttgtag

SEQ ID NO: 119300 - DNA, 207 bp, Artificial Sequence
  Description of Artificial Sequence: Synthetic coding sequence
atgtctggatcctcaagcgttgcagccatgaaaaaggttgtgcagcagcttcggctcgaagcgggactaaacagggtgaaggtgtcccaggccgcggctgacttgaaacagttctgtctccagaacgcccagcacgaccctcttctcaccggcgtgtcctcatcaaccaatccattccgcccccagaaggtatgcagctttctctag

SEQ ID NO: 119301 - DNA, 225 bp, Artificial Sequence
  Description of Artificial Sequence: Synthetic coding sequence
atgcctgtaattaatatagaggacttgaccgagaaggacaaactgaagatggaagtggatcaactgaaaaaagaggtcacgctggaaagaatgctagtttccaagtgctgcgaggaagtgagggattatgtggaagagcggagcggagaggacccacttgtgaagggaatacctgaagacaagaacccctttaaggagctgaaaggaggatgtgtcattagttag

SEQ ID NO: 119302 - DNA, 225 bp, Artificial Sequence
  Description of Artificial Sequence: Synthetic coding sequence
atgccagtgattaatattgaggacctgactgaaaaggataaactcaagatggaagtagatcagcttaagaaggaagtgacacttgagagaatgctcgtgagtaagtgttgcgaagaggtgagagattatgtggaagaacgcagtggtgaagatccacttgttaaggggatcccagaagataagaacccattcaaagagctgaagggcggctgcgtcatctcctag

SEQ ID NO: 119303 - DNA, 210 bp, Artificial Sequence
  Description of Artificial Sequence: Synthetic coding sequence
atggcacaagatctcagcgaaaaggacctgctaaaaatggaagtcgagcagctcaagaaggaggtgaaaaacacgagaatccccataagtaaggctggcaaggagatcaaggagtacgttgaggcccaggcagggaacgatcccttcctgaagggcattcctgaggataaaaacccttttaaggagaagggcgggtgtctgatttcatag

SEQ ID NO: 119304 - DNA, 210 bp, Artificial Sequence
  Description of Artificial Sequence: Synthetic coding sequence
atggcccaggatctgtcggagaaagatctcctgaagatggaggtggaacagctgaagaaggaggtgaagaatacccggattcccatttctaaagccggcaaagaaatcaaagaatatgtcgaggcccaggctggaaatgatccgttccttaaggggatccctgaagataaaaacccatttaaggagaagggaggatgtctgatttcttag

SEQ ID NO: 119305 - DNA, 210 bp, Artificial Sequence
  Description of Artificial Sequence: Synthetic coding sequence
atggctcaggacctgagtgagaaagacctcctaaagatggaagttgagcagctgaaaaaagaggtcaaaaacacaagaattcctatctcaaaggccggaaaagaaattaaggaatatgtagaggctcaggccggcaacgacccctttcttaagggcattccagaagataaaaaccccttcaaagagaagggaggctgcctgatatcatag

SEQ ID NO: 119306 - DNA, 210 bp, Artificial Sequence
  Description of Artificial Sequence: Synthetic coding sequence
atggcccaggacctgtccgagaaggacctgcttaagatggaggttgagcagctcaaaaaagaggtaaaaaatacgagaattccaatctcgaaagcagggaaggagatcaaagaatacgtcgaggcccaggctggcaatgatcccttccttaaaggcatcccagaggacaaaaatcctttcaaggagaaagggggatgcctgattagctag

SEQ ID NO: 119307 - DNA, 210 bp, Artificial Sequence
  Description of Artificial Sequence: Synthetic coding sequence
atggctcaggatcttagtgagaaagatctattgaagatggaagtggagcagctgaagaaagaagtcaagaacaccaggattcccatatccaaggcaggtaaagaaatcaaagaatacgttgaagcccaggcggggaatgatcccttcttgaaggggatccccgaggataagaatccattcaaggaaaaaggaggctgtttaatcagttag

SEQ ID NO: 119308 - DNA, 1080 bp, Artificial Sequence
  Description of Artificial Sequence: Synthetic coding sequence
atgacactcgagtccattatggcgtgctgcctttccgaggaggctaaggaggccaggaggatcaacgatgaaatcgagcggcagctgcgacgcgacaagcgcgacgcccgcagagaactaaagctgctgttactgggtacaggcgagagcgggaagtccaccttcatcaagcagatgcgcataatccacgggagtggctacagtgatgaagacaagagggggttcaccaagctggtgtatcaaaatatctttaccgctatgcaggccatgattcgagccatggatactctgaagataccatataagtatgaacacaacaaggcccacgctcagttggtgagggaggtcgatgtggaaaaggtctccgcattcgagaatccatacgtcgatgcgatcaagagtctgtggaacgacccaggaatacaggagtgttacgacagacgacgagaatatcagttatccgactctacaaaatactaccttaacgatttggaccgcgtggctgacccggcctatctacctacccagcaggacgtgctgagggtacgtgtccccacgacgggtattattgaatatcccttcgacctccagtcagtcatcttcaggatggtagatgttggcgggcagagaagtgaacgcagaaagtggatccactgttttgagaatgtgacaagcattatgttcctcgtcgctctgtcagagtatgatcaagtgctcgtcgagtccgataatgagaaccggatggaggagtccaaggctcttttccgtacaataattacctacccctggttccagaattcgtccgttattttattcctgaacaagaaagatcttttggaggagaagattatgtactcacatttagtagactatttccctgagtacgatggaccacagcgcgacgcccaagcagccagagaatttattttgaaaatgttcgtcgacctcaaccccgattctgacaaaataatttactcccactttacttgcgccaccgatacggaaaatatccggtttgtattcgcagccgtgaaggacaccattctgcagttaaacctgaaagaatataatttagtctag

SEQ ID NO: 119309 - DNA, 474 bp, Artificial Sequence
  Description of Artificial Sequence: Synthetic coding sequence
atggtagatgtgggcggccaaagatcggaacgcagaaagtggatacactgcttcgagaacgtgacttccatcatgttcctggtggcgttgtcagaatacgaccaggtgctggtagaatctgacaacgagaaccggatggaagaatcaaaggctttgtttaggaccataatcacatacccctggtttcagaatagctcagtgatattgtttttgaacaaaaaggacctcctggaggagaagatcatgtattcccaccttgtagactattttcccgaatatgacggtccacaacgtgatgcacaggcagccagagagtttattctgaaaatgtttgtggaccttaacccagacagcgacaagatcatctacagtcacttcacttgcgccacagataccgagaatattagattcgtgtttgctgccgtgaaggacaccatcctacagctgaatctcaaggagtacaatctcgtctag

SEQ ID NO: 119310 - DNA, 513 bp, Artificial Sequence
  Description of Artificial Sequence: Synthetic coding sequence
atgggtgagcgctgggcggactcccagctggatagcaggtctacccatgggacaggagagtctggaaagtcaaccttcattaagcagatgcgaatcatccacggctccgggtactcagacgaagacaagcgtggattcaccaaactggtataccagaacatcttcacagcgatgcaggctatgattagagctatggacacactcaagatcccttataagtacgaacataacaaggcgcatgcccagctcgtgagggaagtggacgtcgagaaggtcagcgcatttgaaaatccttacgtagacgcaattaagagcctgtggaacgatcccggaatccaggaatgctatgatcggagacgggaataccaactgtctgactcaacaaaatattacctcaacgacctggacagagtagccgaccctgcgtacctccctacacagcaagacgtactccgggtgcgggtgccgacaactggcataatagagtatccttttgatctacagagcgtgtag

SEQ ID NO: 119311 - DNA, 1824 bp, Artificial Sequence
  Description of Artificial Sequence: Synthetic coding sequence
atgcctaggaagaaaccatttagcgtgaaacagaaaaagaaacagctgcaggataagcgcgaacgcaagaggggcttacaggacgggctccgaagcagctctaattccaggtcaggctcccgagaacgaagggaggagcaaactgatacttccgatggcgaatcagtcacccaccacattcgccgtctgaatcaacagcctagtcagggcctaggcccacggggctatgacccaaacagatatagactgcattttgaacgcgacagcagggaagaagtggaaaggcggaaaagggccgccagagaacaggtcctccagcccgtgtctgccgagcttttggagttggatatacgggaggtgtaccagcccgggtccgtgctggattttcccaggcggccaccctggtcttatgaaatgtccaaagagcagctgatgtcacaggaggagagaagcttccaggattacttgggcaagatacatggtgcttactcatctgaaaaactgtcttactttgaacataacctggagacctggagacaactgtggcgggtcctggaaatgagtgatatagtcctgctgattacagacattcggcacccagtggtgaactttccgcccgctctgtatgagtacgtcacgggggagcttggacttgcccttgtcctcgtcctgaacaaggtggatctggccccaccggccctggtcgtcgcgtggaagcactacttccaccagcattacccacaattgcatgtggtgttgtttacctcgtttccgcgggacccccgcaccccccaggatccttcttcagtactgaaaaaatcccggagacggggacgaggctggaccagagccttgggccccgagcagttattgcgggcctgtgaagccatcaccgtgggaaaggtcgatctctcttcttggagggagaagattgctcgcgatgtggccggagcaacatggggcaatggctccggagaggaggaggaggaagaagacggacctgcagtcctggtcgagcagcagactgattcagccatggagcctacaggcccgactcaggaacgctacaaagacggagtagtaaccattggctgtgtaggttttccaaacgtgggaaagtcctccttgatcaatgggctagtcggacgcaaagtggtgagtgtctcacggactcctggccataccagatattttcagacctactttctgaccccctcagtaaaattgtgtgactgccccgggctcatatttcccagcttgcttcctagacaacttcaagtgctggccggaatctaccctatagctcagatccaggagccttacaccgctgtggggtacttagcctccaggatccccgtccaggctctgctgcatctccggcacccggaggctgaggacccaagtgccgaacacccgtggtgtgcctgggacatctgcgaggcctgggccgaaaagcgcggttacaaaactgctaaagcagccaggaacgacgtataccgggctgctaacagtctattacgtttagccgtggatggacgcctttctttgtgctttcaccctccagggtacagcgaacaaaaagggacctgggaaagccatcccgagaccacagaactcgttgtcttgcaggggagagtaggaccagcaggagacgaggaagaggaggaggaagaggaactgtcctcctcatgcgaagaggagggagaggaggaccgagacgccgatgaagagggcgagggggatgaggagacccccacttctgctcccggctcaagtctggccggcaggaacccttacgctctcctgggggaggacgagtgctag

SEQ ID NO: 119312 - DNA, 1224 bp, Artificial Sequence
  Description of Artificial Sequence: Synthetic coding sequence
gtcgtcaattttccccctgccttatacgagtatgtaacaggtgagctgggtttggcccttgtcttggtgctcaataaggtcgatctggccccgcctgctttggtggttgcttggaagcactacttccaccagcattacccacagttacacgtcgtactgttcaccagctttccccgcgatcccaggactcctcaagatccgtcttctgtgctgaaaaagtccagacgacgcggtaggggttggacaagagcattagggccagaacaactgctacgagcgtgtgaggcaatcaccgtcggtaaagtagacttatcatcgtggagagagaagatcgcaagagatgtggctggagcaacctggggcaacggctccggtgaggaagaggaagaagaggacggccccgccgtgcttgttgagcaacagaccgattccgccatggagcctactggccccacacaggagcggtacaaggacggcgtggtaactatcggctgtgtggggtttcctaacgtaggcaagtcttccctgataaatggcctggtgggacgtaaagtcgtttcagtgtccagaacaccagggcatacaagatacttccaaacttactttctcacaccctccgtcaagctgtgcgactgtccaggactgatttttccctcgctgctgcctagacagctgcaagtgctggccgggatctatcctattgctcaaatacaggaaccctatactgctgtaggttaccttgcctctcgcattcctgtacaggctctactgcacctgaggcatccagaggccgaggatccgagtgccgagcacccctggtgcgcttgggacatttgcgaggcatgggccgaaaagcgcgggtataaaaccgcgaaagctgcccgaaacgatgtgtaccgagcagccaactcgcttttacgtttagccgtggacggacgactgagcttgtgctttcatccccctggatattccgagcagaagggaacgtgggagtctcatcctgagaccacagaactcgtggtactgcaaggacgggtgggaccagccggcgacgaagaagaggaggaggaagaggagctgtcctcgtcttgtgaggaggagggagaagaggaccgggatgcagacgaagaaggcgagggggacgaagagacccccacgtccgcgcctgggtcctctctggcgggtcgtaatccgtatgccctgctaggggaagacgagtgttag

SEQ ID NO: 119313 - DNA, 1824 bp, Artificial Sequence
  Description of Artificial Sequence: Synthetic coding sequence
atgccgcgtaaaaagcctttctcagtcaagcagaagaaaaaacaactgcaggataaacgtgaaaggaagagggggttacaggatggcttgcgcagctcctctaattcgcgttccggctcccgagagaggcgcgaagaacagacagacacaagcgatggagagtcagttacccaccatatcagaaggctaaatcagcaaccctcacaaggactgggcccaaggggttatgatcccaatcggtatcggttacactttgagcgcgatagcagagaagaggtcgagcggagaaaacgcgctgcacgagaacaggtgctgcaacccgtttctgcggaactcctggagcttgacatccgcgaagtctatcagccaggctcagttcttgacttccctcgcagaccaccctggtcctacgaaatgtctaaggagcagctcatgtcccaagaagaaagaagttttcaggattaccttggcaagatccatggtgcatattcctccgaaaaactttcctacttcgaacacaacctggagacgtggagacaactatggcgtgtgctggaaatgtccgacattgtactcctcattacggacatccggcacccggttgtcaacttcccgcccgccctgtacgaatacgttactggtgaacttggactggcgctagtgttggtcctcaataaagtcgatctggcaccacccgcgcttgtggtggcctggaagcattatttccatcagcattatccacagctgcatgtggttctcttcacttcttttcccagagatccaaggaccccccaggacccctccagcgtgctgaagaaatctcgacgtcggggaaggggctggacaagggctctgggcccagagcaacttctccgagcatgcgaggccattaccgtggggaaggtggacttgagctcatggcgcgaaaagattgcgcgggatgtggccggggctacctggggaaatggatcaggcgaagaggaggaggaggaagacggccccgcggtgctagtagagcagcagacagactccgctatggagccaacaggcccaacccaagaaagatataaagatggggtcgtcaccattggatgcgtcgggttccccaacgtgggcaaaagctccctgatcaacggccttgtcggaagaaaggtggtgagcgtgagtcgcacccctgggcataccaggtattttcaaacttattttttgacccccagcgtcaaactttgtgattgtccaggattaatctttccctcactactgccgcgtcagttacaggtactcgctgggatctacccgatcgcacagatccaggaaccatacacagccgtaggttatctagcctcaagaataccagttcaagccctcttacatctgaggcaccccgaggccgaggacccatcagctgagcacccctggtgcgcatgggacatctgcgaagcttgggcggagaagaggggctataagaccgctaaggccgcccggaacgacgtgtaccgggctgctaacagcctcttacggctggctgtggacgggagactatctctctgttttcacccccccggatatagtgagcaaaagggtacttgggagtctcaccctgagacaaccgagctggtggtgctgcagggccgggtggggcccgctggagatgaagaagaagaggaggaggaggagctgtcttcatcatgtgaagaggagggggaagaagaccgtgacgccgatgaggagggggagggcgatgaagaaaccccaacctccgcacccggatccagtctcgcgggccgaaacccgtatgctctcctcggagaggatgagtgttag

SEQ ID NO: 119314 - DNA, 795 bp, Artificial Sequence
  Description of Artificial Sequence: Synthetic coding sequence
atgggggaacgtgtactatggcccctgagagccgggcagcattggcggcatagacctcttccagctggactgcaggatggcttgcggagcagctcaaattctaggtcgggtagccgtgagcgcagggaagagcagactgacacatcagatggggaaagcgtcacacatcatatccgacgtttgaatcaacagccatcgcagggtctaggaccacgtggctacgatcccaataggtaccgactgcactttgagagagactctcgcgaggaggtcgaacgtcgaaaaagagccgccagggaacaggtgctacagcctgtaagtgcagaattactggaattggatatacgagaggtgtaccagcccggatcagtgctcgatttcccacgccgtccaccatggagttatgagatgtcgaaggagcaactcatgagccaggaggaacgctctttccaggactacctggggaagattcatggtgcttacagtagcgaaaagctcagctatttcgagcataacttggaaacttggagacagctttggagggtactcgaaatgtcagacattgtgctgctgattacggacatccgtcatcccgtggtgaattttcctcctgccctgtatgagtacgtaactggcgagttaggattggcactagttcttgtcctgaacaaagtggatctcgcgcctcctgccctcgtggtggcttggaagcattatttccaccagcactatccccagctgcacgttgtcttgttcacatcatttcctcgagacccccgcaccccccaagattag

SEQ ID NO: 119315 - DNA, 1824 bp, Artificial Sequence
  Description of Artificial Sequence: Synthetic coding sequence
atgccaagaaagaagccattctcagtgaaacagaagaagaaacaattgcaggacaagcgcgagcgtaaaagaggtctgcaggatggcttgcgcagctcctctaattcccggtcagggtctcgcgagcgtagagaagagcagacagacacttccgacggggaaagcgtcacacatcacattcgccggctgaatcagcagccatcccagggcctagggcctcgcgggtatgatcctaatcgttaccgtttacactttgaaagggattcccgcgaggaagtggagagaagaaagagagcggctcgagagcaggtgctgcagcctgtgtctgctgagttactggagttagacattcgcgaagtgtaccagcccggatccgtacttgatttcccacgtcgaccaccctggagctatgaaatgagcaaagagcagctaatgagtcaggaggagcggtcttttcaggactacctcggaaaaatccacggcgcatatagcagtgagaagctctcttacttcgaacacaatctggagacatggcggcaactctggagagtgctggaaatgagtgatatcgtcttacttataaccgacatccgccatccggtggtcaattttccccctgccttgtatgaatacgttacaggagagttgggcctagcgctagttctggtcctgaataaagtggacctggccccgcccgctctggttgttgcttggaaacactacttccaccagcactacccccagcttcatgtggtgctgttcacttcatttccacgcgacccccgaacgccgcaagacccttcaagtgtgctcaaaaagtcccgtcgccggggacgcggatggactcgagctctggggccagagcagctgctgcgggcttgcgaggctattactgtcggaaaagtggatctgtcttcatggcgggagaaaattgcccgtgacgtggctggagctacatggggcaatgggagcggagaggaggaagaggaagaggacggacccgcagtcctcgttgagcagcagacggattcggcaatggagccgaccggcccgacccaggaaagatataaggacggagtggttactataggctgtgtcgggtttcctaacgtggggaagtccagtttgattaatggcctggtgggcagaaaggtggttagcgtgtcccggacccctggtcatactaggtattttcaaacttattttctgaccccatcagtcaaattgtgcgactgtccaggactcatctttcccagcctgctccctaggcaactccaggtgctagctggcatttatcccatcgcgcagatacaagaaccttataccgccgtgggctacctggcctcccggatccccgtgcaagccttgctgcatctacgccatcccgaagcagaggacccgtctgcagaacacccctggtgcgcatgggacatctgtgaggcctgggcagaaaaacgcggctacaaaacagcaaaagccgcacgcaacgacgtatatagagcagctaacagtttgctccgattggcagttgacggacgcctgagcttatgttttcaccctcctggctactccgaacagaagggaacctgggaaagccaccctgagaccaccgaactcgtggtgctgcagggaagggttgggcccgccggagacgaggaggaggaagaagaggaggaactgtcgtccagctgcgaggaggaaggcgaggaggaccgagatgcggacgaggagggcgagggcgatgaggaaactccaactagtgcgcctggttcatcactggctggccggaatccctatgccctgctgggtgaagacgagtgctag

SEQ ID NO: 119316 - DNA, 1290 bp, Artificial Sequence
  Description of Artificial Sequence: Synthetic coding sequence
atggaggcagccgtggtgttggagatgagtgatattgtgctgctgatcacagatattcgtcaccctgtcgtgaacttccccccggctctctatgaatatgtgactggcgaactgggcctcgctctggtcctggtgctcaacaaggtcgatctcgcaccgccagctcttgttgtcgcttggaagcactatttccatcagcactatccccaactgcatgttgtactctttacatcattcccccgggacccgcggacaccgcaagatccaagctccgtcctgaaaaagagccgccgacgcgggcgcgggtggacccgggccttgggaccggaacagctgttgcgggcctgcgaagcaattaccgtaggaaaggtcgacctaagctcctggagagagaagatcgcgcgcgatgttgccggggccacttgggggaatggaagtggagaggaggaggaagaggaagacgggcccgccgtactcgtggaacagcagacagactctgcgatggagcctactggacccactcaagaaaggtataaagatggggtggtgacgattggctgtgtaggttttccaaatgttgggaagtcctcactgatcaatggattggttggcaggaaggtggtaagtgtgtctcgcacacctggccacactcgatacttccaaacctattttctgactcccagtgtaaaattgtgcgactgtcctggtctgatatttccatccctcctccctaggcaacttcaagtgctagctggaatctaccctatagctcagatccaagaaccctacacggctgtcggttacctggcttcacgaataccagtccaggcccttctgcacctccgccatccagaggcggaggatccatctgctgaacacccatggtgtgcctgggatatctgtgaggcttgggccgagaaaagaggatacaaaacagctaaagccgcaagaaatgatgtgtacagagctgccaacagcctgttgaggctggctgtcgatggccgactgagtctttgtttccatccgcccggctacagcgaacagaaggggacctgggaatcacaccctgaaaccactgagctcgtggtgctgcaaggacgcgtgggacctgccggcgacgaagaagaggaggaagaggaggagcttagttctagttgcgaggaagaaggtgaagaagatcgtgatgccgacgaagagggggaaggcgacgaagagacccctaccagtgctcccggatctagtctggcgggccggaacccctatgcgttgctaggggaagatgagtgttag

SEQ ID NO: 119317 - DNA, 1824 bp, Artificial Sequence
  Description of Artificial Sequence: Synthetic coding sequence
atgccacgcaaaaaaccttttagcgtaaaacagaaaaagaaacagctgcaagataagagggagaggaaacgtggcctgcaagatggcctgcgttcatcatccaactcacgtagtggctcacgagaacggcgagaagagcagacagatacctctgatggagagtcggttacccaccacattaggcgcttaaatcagcagccctcacagggcctggggccccgaggatatgatcccaatagatacaggttacatttcgaaagggatagccgtgaagaagtagagcgccgcaaaagggcggctcgggagcaagtccttcagccggtatcagccgagttgctcgaactcgacatccgcgaggtgtatcagcctggtagtgtcctggatttcccgcgcagaccaccctggtcctacgagatgtcaaaagaacaacttatgagccaggaggaacggagttttcaagattatctgggaaaaattcacggagcctattcttcggaaaagctgtcctactttgaacacaacttggaaacatggcgacagctctggcgggtgctggagatgtcagatatcgtgttactgattacagacatcagacaccctgtagtcaactttccacccgccttgtacgaatacgtgactggggaactgggattggcactcgttctggtcctgaataaagtagatctggcaccgcctgctctggtggtagcatggaaacactacttccatcaacactacccacagctgcacgtggtcctctttacatcttttcccagggatccgagaaccccgcaggacccgtcctccgtgttgaagaagtcaagaagaagaggccgcggctggacccgcgctctcggcccagagcagctgctgcgcgcatgtgaagccataactgtcggcaaagttgatttgagcagttggagggaaaaaatcgcacgagatgtcgctggcgccacatggggcaacgggtccggagaggaagaagaagaggaggatggaccagcggtgctggtagaacaacaaaccgactctgctatggaacccacaggtcccacgcaagagcggtacaaggacggtgtggtgaccataggctgcgtcggcttccccaatgtggggaagtcctcacttattaacgggctggtggggcggaaagtcgtgagtgtgagcagaacacccggccacactaggtatttccagacctacttcttaacccccagcgtgaagctttgtgattgccccggcctgattttcccaagtttgctgccaaggcaactgcaggtgctggcaggcatctatcctatcgcccagatacaggaaccttatactgccgtggggtacttggcatcccgcatcccggtccaggccctgctacatttaagacatccagaggcggaagatcctagtgccgagcatccttggtgtgcatgggacatctgtgaagcttgggcggaaaagagaggatacaaaactgcaaaagcagctaggaatgacgtttaccgcgccgctaatagcctgctccgactcgcagttgacggccggctgtccctctgtttccaccctcctggttattctgaacagaaagggacatgggagtcacaccccgaaactactgagctagtcgttctccagggacgtgtggggccagcaggcgacgaggaggaagaagaagaggaggagctctcctcgtcatgcgaggaggagggggaggaggaccgggatgccgatgaggagggagagggggacgaggagactcccacgtctgcaccgggatcatccctagccggccgcaacccgtacgccctgctgggagaggatgaatgttag

SEQ ID NO: 119318 - DNA, 1215 bp, Artificial Sequence
  Description of Artificial Sequence: Synthetic coding sequence
atgtctaaggaacaattaatgtcacaggaggagcgatcatttcaggactaccttggaaaaatccacggcgcctacagctccgagaagctttcctactttgagcataatttagagacttggaggcaactttggagagttctagaaatgtccgatattgtgctcctgattactgacatccgtcaccccgtggttaattttcctccagcattgtatgagtatgtgacaggcgaactcggcttggccctggtgttagtgctcaataaagtggacctagcgcctccggcccttgttgttgcctggaagcattactttcaccagcattatccacaacttcatgtggtgttattcacgagtttcccacgggaccccagaactcctcaagacccatcctcggtgctcaagaagagccgtcggagagggcgcggatggacccgggcattagggcctgagcagttacttagggcatgcgaagccattacagttggcaagggctttcctaatgtggggaagtcttcactgatcaatggcttggtcggcagaaaggttgtgagcgtgagtcggacccctggccataccaggtacttccagacatactttctcacaccttctgtgaaactgtgtgactgcccaggcctcattttcccctcactgctgcctcggcagctgcaggtgttggcaggaatttaccctattgctcagattcaggaaccatacaccgcagtgggttaccttgcgtcacggatcccagtgcaggccctcttgcatctgagacaccctgaggccgaagacccctctgccgaacatccctggtgtgcatgggacatttgcgaagcctgggcagaaaaaaggggttataagaccgccaaagcagctagaaacgacgtctacagagccgctaatagcctgctaagattagcagtggatggtcgcttgtcactttgttttcaccctccgggatattcagaacaaaagggaacctgggagtcccatccagagacgaccgagctggtggtgctacaggggcgggtcggccccgcgggagatgaagaggaagaagaagaagaggagttgtcaagctcttgcgaggaggagggagaagaggacagagacgccgacgaagagggagaaggcgacgaagagaccccgaccagcgcaccagggagctctctagccgggcgtaacccctatgctctgcttggggaagacgagtgctag

SEQ ID NO: 119319 - DNA, 795 bp, Artificial Sequence
  Description of Artificial Sequence: Synthetic coding sequence
atgggggaacgggtgctttggccactacgtgcgggacagcactggcgccacaggcccttacctgccgggcttcaggatggcctccgcagttcctccaacagtaggagcggttcgcgcgaacgccgggaggaacaaacggatactagcgatggcgagagcgtcacgcatcacatcaggaggctgaaccagcaaccatctcaggggttgggcccaagaggctatgatcctaacagataccggctgcatttcgagcgcgattcgcgtgaggaggtagagcgtcgcaagcgagccgctcgcgagcaggtgctccagcctgtgtcagctgagttgttggaacttgacattagggaggtttaccaacccggcagtgttctggattttccacgccgtcccccatggagctacgaaatgtcaaaggaacagctgatgtcccaagaagaaaggagttttcaggattaccttggaaaaatccacggagcttattccagtgaaaagctgtcctatttcgaacacaacctcgagacgtggaggcaactgtggagagtgctcgagatgagtgacatcgtgctgctgattaccgacatccgccatccggttgtcaacttcccaccagccctttatgagtacgtgactggggaactggggctggcactcgttttagtgctgaataaggtggacctggcgccacccgccctcgtcgtagcctggaaacactactttcaccagcactacccacaacttcatgtcgtgttgttcacttcttttccaagggacccaagaactccgcaggattag

SEQ ID NO: 119320 - DNA, 795 bp, Artificial Sequence
  Description of Artificial Sequence: Synthetic coding sequence
atgggtgagagggtgctgtggcccctccgggccggccaacattggaggcacaggcccttgcctgcgggtctgcaggacggcctccgaagcagctccaattcgcgaagtggaagccgcgagagacgggaggaacagaccgatactagcgatggcgaaagcgtaacacaccatatccgtagacttaatcagcagcctagccaaggtctcgggccgcggggctatgaccctaacagatatcgcctgcacttcgagcgagacagccgggaagaggttgagagaaggaagcgggccgcccgggagcaagttctgcagcctgtgtctgctgagctcctagagttggacattagagaggtataccagcccggctctgtacttgactttcccagaaggcctccgtggtcctatgagatgagtaaggagcagcttatgtcgcaagaggagcgcagctttcaggattacctgggcaagatccatggggcttattcatcagaaaagctgtcctactttgaacataacctggagacctggaggcagctctggcgagtactggaaatgtccgatatcgttcttctgatcacagatatcaggcacccagtggtgaacttcccccccgccctgtatgagtacgtgaccggtgaactcggcttggctctggtgctggtccttaacaaagtagatttggcaccccccgccttagtggtggcctggaagcactactttcatcagcattatccccagctgcatgttgtgctctttaccagcttccccagagacccgcgaaccccacaggattag

SEQ ID NO: 119321 - DNA, 795 bp, Artificial Sequence
  Description of Artificial Sequence: Synthetic coding sequence
atgggagagcgggtgttatggcctttacgcgccgggcagcactggcgccacaggccgctgcccgccggattgcaggacggactacgctccagtagtaactcccggagtgggagcagagagaggagggaggaacagacagatacttctgatggcgagtcagtaacccaccatatccgccgattgaaccagcagccgtcacagggactaggccctcggggctacgatcccaacaggtatcgcctccacttcgagagagacagtagggaggaggttgagcggagaaagcgggctgccagggagcaggttctgcaacctgtctcagctgagctcctcgaacttgatataagggaggtttaccagccaggtagcgtcctggatttccccaggcgccctccttggtcttatgagatgagcaaggaacaactaatgagccaagaggaaagaagttttcaggattacctggggaagatccatggcgcatactcctctgagaagttatcatactttgaacataacctagagacatggaggcaattatggcgtgtcctggagatgtccgacattgtgctgttgatcacagacattagacaccctgtggtaaacttcccaccagccctgtacgagtacgtgacaggcgagctgggcctggctctggtgctggtactgaacaaggtggacctggctccccctgcactagtggttgcttggaagcactacttccatcagcattatccgcagctgcatgtcgtgcttttcactagcttcccccgcgaccctaggacaccccaggactag

SEQ ID NO: 119322 - DNA, 1824 bp, Artificial Sequence
  Description of Artificial Sequence: Synthetic coding sequence
atgcctcgcaagaaaccgttcagcgtgaaacagaaaaaaaagcagctccaagacaagagagagcgcaaacgtgggctacaggatgggctgaggagctcttctaattccagaagcggatcaagagaacggagagaagaacaaaccgacacaagcgatggcgaatctgtcacccaccacatccgccgcctgaaccaacagccttcccaggggctgggaccacggggttatgacccaaatcggtacaggcttcactttgaaagggattcaagggaggaagtggaaagacggaagagggccgcacgcgagcaggtgcttcagcctgtatcagctgaactcctggagctggacattagagaggtgtatcagcctggatcggtactagacttcccccgtcggcctccctggagctatgaaatgagcaaggagcagctgatgtcccaggaagagcgctcgtttcaggactacctggggaagattcacggtgcttattcctctgaaaaactgtcctatttcgagcacaacctcgaaacatggaggcagttatggcgggtgctcgaaatgtctgacattgttctcctcattactgacataaggcatcccgtcgtgaatttcccaccggccctgtatgaatacgtcaccggggagcttggccttgccctagtgctcgtcttgaataaagtcgacctcgctccccccgcgctggtggtggcctggaagcactatttccaccagcactaccctcagctgcatgtggttctattcactagctttcccagagaccctcgaactcctcaggacccatcaagcgttctcaaaaaaagccggaggaggggcagggggtggacaagagcacttggaccagaacagctgcttagagcgtgtgaagccatcacagtgggcaaagtcgacctctcctcttggcgcgagaagattgccagggacgtagccggtgccacatggggaaacggaagcggtgaagaggaagaggaagaggatgggcctgcagtactagtcgagcagcaaactgattccgccatggaacctacgggacccactcaggagcgatataaggacggcgtcgtgacgattggttgcgttggcttccctaacgtgggcaaatctagccttattaatggccttgttggccgcaaggtggtgagcgtgagccgaacacctgggcatactcgttactttcaaacttattttctcactccttccgtcaagctatgtgattgtcctggcttgatttttccctccctgctccccaggcagctccaggttctcgctggcatttaccccatcgcccagattcaggagccttacaccgctgtaggatacctcgcctcacggataccagtgcaagcgttactgcacctgaggcatcccgaagccgaagatccttctgccgagcacccctggtgtgcttgggacatttgtgaagcttgggcggaaaagcggggctacaagactgccaaggccgcgagaaatgatgtttatcgggcagccaatagcctgctgcgacttgccgtcgacggtagattatccctgtgctttcatccacctggctattcagaacaaaaggggacatgggagtcacaccctgagacaacagaactggttgtccttcagggccgcgtggggcccgcgggggacgaagaagaagaggaagaggaagaactatcttcttcctgcgaggaggaaggtgaggaggaccgtgatgccgacgaggagggagagggcgatgaagagacacctacaagtgcccctgggagcagccttgctgggaggaacccgtacgccctgctcggggaggacgagtgctag

SEQ ID NO: 119323 - DNA, 1824 bp, Artificial Sequence
  Description of Artificial Sequence: Synthetic coding sequence
atgccaagaaaaaagccattttccgtgaaacagaagaaaaagcagctccaggacaaacgtgaaaggaaaagagggcttcaagacggcctgcgaagcagtagcaacagccgtagtggatcgcgcgaaagaagggaagagcagactgatactagcgacggggagagcgtaacacaccatataagacggttgaaccaacagccatcccaggggcttggaccgcgcggctacgacccgaaccgctatagactgcattttgaacgggatagtagagaggaggtagagagaaggaagcgagccgcccgtgagcaggtgctgcagcctgtgtcagctgaactgctcgaactggacatccgggaggtgtatcagcctggctcggtacttgattttccccgccgccctccatggtcctatgagatgagtaaggagcagctgatgagtcaggaagaacgaagcttccaggattatttgggcaagatccacggagcttattcaagtgagaagctgtcctattttgagcataatctggaaacttggcggcagctgtggagagttttggagatgtccgacatcgtcctgttgatcacagacatcaggcaccctgttgtgaattttccacctgcactgtatgagtacgtgacaggagaattgggattggccctggttctggtgctcaacaaagtcgatcttgcacctcctgctctcgtcgttgcctggaaacactatttccatcagcattatcctcagcttcacgtggtcctctttaccagcttccccagagatccacggactccccaggacccgagttcggtacttaaaaagagccgcagaagagggaggggttggacacgtgcgctggggccagaacagcttctgcgagcctgtgaggctatcaccgtgggcaaggtcgacctgtctagctggcgtgagaaaattgcccgcgatgtggccggcgcaacttgggggaacggtagtggggaggaagaggaagaggaggacgggcctgctgtcttggtcgaacaacagacagactctgccatggaacctacagggccaacgcaagagagatataaggacggcgtggtgaccatcggctgtgtcggtttccctaacgtgggcaagagttccctcatcaatggacttgtgggaaggaaggtggtcagtgtgtcccgcactccgggccatacaaggtacttccaaacttacttcctcactccttcagtaaagctttgtgattgtccgggcttgatttttccctcccttctcccccggcagctccaggtgctcgcaggcatttaccccatcgcccagatacaggagccatacacagccgtaggttacctggcttcccggatccccgtgcaagctctgctgcaccttcgccaccctgaggctgaagacccctctgctgagcacccatggtgtgcctgggacatatgtgaagcctgggctgaaaaaagagggtacaaaacagccaaggctgctcgaaacgacgtttatcgggcagccaacagtctcctacgcttggctgtggacggcaggctctcattgtgtttccaccctcctggatattccgaacaaaaggggacatgggagtcgcatcccgaaaccactgagcttgtggtattgcagggcagggtgggcccagcaggcgacgaggaagaagaagaagaggaagagttaagcagttcttgtgaggaggagggcgaggaagatagagatgctgatgaagaaggtgagggagacgaagagacccccacctctgcccctggctcatcactcgcagggaggaatccatacgcgttgctgggggaggacgagtgctag

SEQ ID NO: 119324 - DNA, 795 bp, Artificial Sequence
  Description of Artificial Sequence: Synthetic coding sequence
atgggcgaacgagtgctgtggcctcttagggcaggacagcactggcgacataggcccctccccgccgggcttcaagatggcctccgtagcagctcaaattctcgctcgggttcaagggaacggcgtgaagaacaaaccgatacgtcagacggcgagtcagtgacccaccacatacgacgtctgaatcaacagccttcgcagggcctgggcccgcggggctacgaccccaatagataccggcttcattttgaaagggactctcgcgaggaggttgagcggcggaaacgggccgccagagagcaggtgctgcaaccagtttccgccgaactgttggagctcgacattcgagaggtctaccagcctggctcagtccttgatttccctaggcgtcccccttggagctacgagatgtccaaagagcagctaatgtcgcaggaagagagaagcttccaggattacctaggtaagatccacggcgcttactcttccgaaaagctgagctacttcgaacacaatctcgagacatggcgtcaactttggagggtgctagagatgagcgatatcgtgctgcttattacagatatccgtcacccagtagtcaattttcctcctgctctttacgagtatgtgacaggggagctaggactcgctctggttctggtgttaaacaaggtggacttggcccctccggccctcgtggtggcttggaaacactacttccaccagcattaccctcagctacacgtggtgctctttacatcatttccgcgggacccgcggacccctcaggactag

SEQ ID NO: 119325 - DNA, 795 bp, Artificial Sequence
  Description of Artificial Sequence: Synthetic coding sequence
atgggcgagcgggtattgtggccccttagggcgggacagcactggagacacagacctcttcctgccggtttacaggatggactgcgctctagtagtaatagcaggagtggaagccgggaacgtcgagaagagcagacggatacttccgacggcgaatctgtgacccaccatattcgacgactgaaccagcagcctagtcagggtctcggcccccgggggtatgaccccaaccgttatcgccttcatttcgaacgggacagcagggaggaggtggagaggcggaagagggcagcccgagaacaggtgctccagcccgtctccgccgaactgctggagctggatatcagagaggtctaccagccaggctctgttctggattttccacgcaggccaccgtggagctatgaaatgagcaaagagcaactgatgtctcaagaggaacgaagctttcaggactacttgggaaagattcacggggcctacagttctgagaagttgtcatacttcgaacacaacttagaaacttggagacagctttggcgagtcctggagatgtccgacatcgtactgcttatcaccgacatccggcatcccgttgttaactttcccccagcgctctatgaatacgttaccggcgaacttggattggctctggtgttggtattaaataaagtcgatttagctccacctgcacttgtcgtagcctggaaacattacttccatcaacattacccccagcttcacgtggttctcttcactagtttccctagagacccacgcacaccccaggattag

SEQ ID NO: 119326 - DNA, 1824 bp, Artificial Sequence
  Description of Artificial Sequence: Synthetic coding sequence
atgcccaggaaaaaacctttctccgtgaagcagaagaagaagcagctgcaggataaaagagaacgtaagcgcgggctccaggatggtctgaggtcctcctcaaacagtaggtccggatcacgcgagcggcgggaggaacagacggatacttctgacggggagagtgtgactcaccacattaggagactcaatcagcagccatctcagggactgggaccccggggctacgatcctaatcgctaccgtttacactttgagcgcgattcccgagaagaggtggaacgaaggaagcgagcagcacgcgagcaggtactgcagccagtgtccgcagagctgttagaattggatatccgagaagtctaccagccgggcagtgtcttggactttccaaggcggcctccctggagctatgagatgtctaaggaacagcttatgagccaggaggagcgatctttccaagactatcttggaaagattcatggcgcctacagttcagagaaactgtcttatttcgagcacaacctagaaacatggcgccagttgtggagggtgctggagatgagtgacattgtgcttctgataaccgatattcgtcatcccgttgttaacttcccccctgcactttacgagtacgtgaccggtgagctgggtctcgccttggtgcttgttctgaataaggttgacttggcgcctcccgcccttgtagtggcctggaaacattacttccatcaacattatccacagctacatgtcgttctcttcaccagctttccaagagatcctcgtacccctcaggacccaagcagcgtgctaaaaaagagtagaagacgaggacgagggtggacaagggccctgggtcctgaacagctgttaagagcgtgtgaggctataacggtcggcaaagtggacctttcatcctggcgagagaagatcgctcgagatgtggcaggtgcaacatggggtaacgggtccggcgaggaggaagaggaggaggacggaccagctgtgttggtggagcagcaaactgattctgctatggagcccacggggcccacacaggaaagatataaggatggtgtagtaacaatcggttgcgtcgggttcccaaatgtggggaaaagcagtctgattaatggtctggtgggacgcaaggtggtcagtgtctcccgcaccccgggccatacaagatactttcagacatacttcctgaccccctctgttaaactctgcgactgtccaggcctgatctttccgtctctactccctcggcagctgcaggtcctagccggcatctaccccattgctcaaattcaagagccttacaccgcagtcggctatctagccagcaggattcccgtgcaggctttactccatctgagacatcccgaggctgaggaccctagcgccgagcacccatggtgtgcatgggatatctgcgaagcatgggccgagaagaggggctacaaaacagctaaagctgctcggaacgatgtgtacagggccgcaaactccctcctgcgcctggctgtggacgggcgcctaagcctctgctttcacccacccggctatagcgaacagaagggcacgtgggaatcacatcctgaaaccacagagctggtagtactgcagggacgcgttggcccggccggcgatgaggaggaggaagaggaagaagagttatctagcagctgcgaagaagagggggaagaagatcgcgatgcggatgaggaaggggagggcgacgaggagacccctacgtctgcccccggctcttccttggcgggcaggaatccgtatgcactactgggggaggacgaatgctag

SEQ ID NO: 119327 - DNA, 201 bp, Artificial Sequence
  Description of Artificial Sequence: Synthetic coding sequence
gtcgtgaattttccacccgccctctatgagtacgtgacaggggagctcggattggctctcgttctagtgttaaacaaagtcgacctggcccctccagctcttgtagtggcctggaaacattattttcatcagcattatccccaactccacgtggtgctcttcacttcttttcctcgtgaccctcgcacgccgcaagactag

SEQ ID NO: 119328 - DNA, 795 bp, Artificial Sequence
  Description of Artificial Sequence: Synthetic coding sequence
atgggggaacgagtgctttggccactgagagccggtcagcattggaggcatcgtcctttgcccgctggactgcaggacgggctccggtcttcgagcaactccaggagcggatcccgtgaacgcagggaagagcaaaccgacactagtgatggggagtccgtaacccatcacatacgacggctgaaccagcagccgtcccagggtctgggccctcgaggttatgacccaaaccggtatcggctccacttcgaacgggatagtcgggaagaagtggaacggagaaaaagggctgcccgcgagcaggtccttcaacccgtaagtgcagagttactagaacttgatatccgggaggtttaccaacccggttccgtcctagacttccctaggaggcccccctggagctatgaaatgtccaaggaacagctgatgtctcaggaagaaaggagttttcaagactatctgggcaagattcacggcgcctactcctcagagaaactaagctacttcgaacataatttagagacatggcgccagttgtggcgtgttctcgaaatgtccgacatcgttttgctaattaccgacatcagacatccagtggtaaattttccccccgccctgtacgagtacgtcacaggagaactcggtctcgctttagtactggtgctgaataaagtcgatttagcccctccagccctcgtggtcgcctggaaacactattttcaccagcactaccctcaactgcatgttgtcctcttcacatcgttcccccgcgatcctcggacaccccaagactag

SEQ ID NO: 119329 - DNA, 1215 bp, Artificial Sequence
  Description of Artificial Sequence: Synthetic coding sequence
atgagcaaagaacagctcatgagccaagaagaaagatcttttcaggattatctggggaaaatccacggagcttactccagcgagaagttatcttatttcgagcacaacctagaaacgtggaggcaactgtggcgagtgctcgaaatgtccgatatcgtcttgttgattactgacattaggcaccccgtggtcaattttccgccggctctgtacgaatatgtgaccggtgagctgggactagcgttggtacttgttctcaacaaagtcgatcttgctccacctgctctggtagtggcctggaagcactatttccatcagcactatccacagttgcatgtggttctctttactagtttcccacgggatccgcgcacgccacaggaccctagtagtgtgcttaagaagagccgtcgaaggggacggggctggacccgtgcacttggcccggaacagcttctgcgcgcctgcgaagccataaccgtagggaaaggatttccaaatgttgggaagtcaagcctgatcaatggtcttgtcggccggaaggttgtatccgtatcccggacgccaggccatacgcgctattttcagacttatttcctaacccccagtgtaaaattgtgcgactgtcctggactcatttttccgtccctgctgccaagacagctccaggtcctggctggtatttaccccattgctcagatccaggagccctacaccgcggtgggctacctggcttccaggatcccagttcaggctctgttacacctccgacacccagaggcggaggacccatcggccgaacacccttggtgtgcctgggatatctgcgaagcctgggccgagaaacgggggtacaagaccgctaaagctgcgaggaacgatgtttatagagccgcgaacagcttactgcggctggctgtggacgggcggcttagtctatgtttccacccccctggatacagtgagcagaaaggaacttgggaatctcatcccgagactaccgaattagtagtgttgcaaggcagggtgggtccagccggggatgaggaagaagaagaggaagaagagctgtctagctcttgcgaggaagagggagaagaggaccgagatgctgatgaagaaggagagggcgacgaggagactcccacatcagcaccaggttcttccttagcgggcagaaatccttatgccctcctcggggaagatgagtgctag

SEQ ID NO: 119330 - DNA, 789 bp, Artificial Sequence
  Description of Artificial Sequence: Synthetic coding sequence
atggaaccgacaggccccactcaagagcggtacaaggatggagtggtgacaatcgggtgtgttggcttcccaaacgtggggaagtcatccctgattaatgggttggtgggcagaaaagtggtatcagtctctcgtactcccggccacacccggtatttccagacgtattttctgacaccttcagtgaaactgtgtgattgtcctggtctcatctttccgtcactgctgccacggcagctgcaagttctagccgggatttaccccatcgcacagatccaagaaccatacaccgccgttgggtatttagcatctcggatccccgtgcaggcccttctccacttgcgccaccctgaagccgaggaccctagcgccgaacacccttggtgcgcgtgggacatttgcgaagcctgggccgagaagcgaggatataaaaccgctaaggccgctagaaacgacgtttatcgcgcagccaactcattattacgcctggcggtagacggccgattgtccctgtgttttcaccctcccggctattcagaacagaaaggcacctgggagtcgcacccagagactactgaactggtggtgctgcagggtcgagtggggcccgctggtgatgaagaggaagaggaggaggaggagctttcttcatcatgtgaagaagaaggggaagaagacagagacgcagatgaggagggggaaggagatgaggagacaccaacgagcgctccaggaagttccctcgcaggccgtaatccatacgccctgcttggcgaggacgagtgttag

SEQ ID NO: 119331 - DNA, 789 bp, Artificial Sequence
  Description of Artificial Sequence: Synthetic coding sequence
atggagccaaccggtcccacccaggagaggtacaaggatggcgttgtgaccattggctgcgttggtttcccaaacgtaggcaaaagcagcctgatcaacggactcgtggggaggaaagttgtttccgtgagcaggacccctggccacactcgctacttccaaacatactttctcacgcctagcgtgaagctgtgcgattgccctggcttgattttcccgagcctgcttcccaggcagctgcaggtacttgcaggcatctacccaatagcacaaattcaagagccatacacagccgtcgggtatttggcttccagaatcccagtgcaggcactgctccacctgcgacaccctgaggcagaggaccctagtgccgaacatccatggtgtgcttgggacatctgcgaggcgtgggccgagaagagaggctacaaaacagcaaaggcggccaggaatgatgtgtaccgggctgccaatagcctactacgactagcggtcgacgggaggctctccctctgctttcaccctcccgggtactctgagcagaagggtacatgggaatcacatcctgaaactacggaattagtggttctccaggggcgcgtcgggccggcaggcgacgaggaagaagaagaggaggaggagctgtcttcttcctgtgaggaggagggcgaggaggaccgggatgcagatgaggaaggagaaggcgacgaagagacacctacatcagcccctggatcttccctggccggccgcaacccttatgcactcctgggtgaggatgagtgttag

SEQ ID NO: 119332 - DNA, 1290 bp, Artificial Sequence
  Description of Artificial Sequence: Synthetic coding sequence
atggaggcggcggtggtgttggagatgtcggacatcgttctccttattacggatattcgacacccggttgtcaactttcccccagctctgtacgagtatgtgactggagaattaggcctggccctcgtcttggttctgaataaggtcgacctggctccccccgccctggtggtggcctggaaacactactttcaccagcattatcctcagctgcatgttgttctgttcacgtcctttccccgggacccgcggacgccccaagatccaagttcggtcttaaagaagtcaagacgccggggtcgagggtggacacgcgccttgggcccagagcaactcctgagggcctgtgaggctataaccgtcggtaaggtggatctgtcttcctggcgagaaaagattgcccgggacgtcgcgggagccacctggggaaatggatccggcgaggaggaagaggaggaagatgggcctgccgtgcttgtggagcagcagacagattccgccatggagcccacaggacctacccaggagcgttataaagacggcgtcgttactattgggtgcgttggattcccaaatgtggggaaaagctcactcataaatggactcgtcggccggaaagtggtttcagtttctagaacacccggacacacgaggtactttcagacctattttcttaccccgagtgttaagttgtgcgattgtcctggactgatcttcccttcccttttacctcggcaactgcaggtgctggccgggatttacccgatcgctcaaatacaggagccctatactgcagtcggctatctagcaagcaggatcccggtgcaagcgctgctgcatttaaggcatccagaggctgaagacccttccgccgagcacccctggtgtgcgtgggatatttgcgaagcctgggcagaaaagcggggctacaaaactgctaaagccgctcgaaatgatgtttatcgggctgcaaacagtctgttgaggctcgcagtcgacggaagattgtctctctgcttccacccccccggttatagcgagcagaaggggacgtgggaaagtcaccctgaaaccacggagttagtcgtcctccagggccgggtcggccctgcaggggacgaagaggaggaggaagaggaagaactcagttctagttgtgaagaggaaggcgaggaggatcgggacgctgatgaggaaggggagggtgacgaggaaactcctacatccgcccccggttcctcactcgccggtcgtaacccttacgccctactgggcgaagatgaatgctag

SEQ ID NO: 119333 - DNA, 1215 bp, Artificial Sequence
  Description of Artificial Sequence: Synthetic coding sequence
atgtccaaggagcagctaatgagtcaggaggagcggagcttccaggactacctgggcaaaatccacggcgcttatagcagtgaaaagctgtcgtattttgagcacaatttggaaacttggaggcagttgtggcgtgttctggagatgtctgacattgttctcctaataacagatattcggcacccagtggttaacttcccacccgctttgtatgaatacgtcaccggcgaactggggctggcccttgtgttagtccttaataaagttgatcttgccccacctgccttagtggtggcatggaagcattatttccaccaacactatccccagctccacgtggtgctcttcacgagcttcccaagagaccctagaacaccccaggatcctagtagcgttttaaagaaatcgcgaagaagaggccgcggttggacgagggcattaggccctgaacagctcctgcgcgcttgtgaagcgattactgtgggtaagggctttcccaacgtgggaaagtcaagcctaattaacggcctggtcgggcggaaggttgtgtccgtcagtaggaccccaggacacactaggtactttcagacctacttcttgacaccaagcgtcaagctgtgtgattgtcccggacttattttcccatcacttctgcctcggcagctccaggtgctggctggaatctatcctattgcacagatccaggaaccttacaccgccgtgggatacctcgccagcagaattcccgttcaagccctcctccacttgagacaccctgaggccgaggacccctccgctgagcacccgtggtgcgcctgggacatatgcgaagcttgggctgaaaagagaggctataaaactgcgaaggccgcacgaaacgacgtgtacagggccgcaaactcactgctgagactagccgttgacggcaggcttagtctctgttttcacccccctggatatagcgaacaaaagggcacctgggaatcccatcctgagaccacagaactcgtagtgcttcagggccgagtaggacctgccggcgacgaggaggaggaagaagaggaggagttgagcagttcctgtgaagaggaaggagaagaagacagagacgccgacgaagaaggcgagggagacgaggagacaccaacatcagccccgggcagctccctggcgggcagaaacccctacgcactgctgggtgaagacgaatgctag

SEQ ID NO: 119334 - DNA, 1215 bp, Artificial Sequence
  Description of Artificial Sequence: Synthetic coding sequence
atgtctaaggagcaactgatgagccaagaggagaggagttttcaggactacctgggtaaaatacatggcgcttactctagtgaaaagttgagctacttcgagcataaccttgaaacttggaggcaactgtggcgagtgctggagatgagtgacatcgtcctgctgataaccgatattaggcaccctgtggtgaactttccacctgcgctgtatgagtatgtgacaggcgaactgggcctggccttggttctggtcctgaacaaggtagatttagcacccccagcattggtggtggcttggaaacactatttccaccagcattatcctcagcttcatgttgtcctgttcacttcgttcccccgcgacccgaggaccccccaggatccaagctccgttctgaagaaaagcagacgccgcggacgcggttggacaagagccctgggtcccgagcagctcttgagggcgtgtgaagctattactgtcggcaagggttttcctaatgtggggaagagctcgctgatcaatgggctggtcggtcgtaaggtggtctccgtgtccagaacccctggacatacaagatatttccagacatactttctgaccccaagcgtgaaactctgcgactgccctgggctcattttccctagtcttctgcctcgccagctacaggtgctcgctggcatttatcccatcgcgcagatccaggagccatacaccgctgtcggctaccttgccagtaggataccagtacaggcactgctgcacctccgccatccagaggctgaagacccaagcgcggagcacccctggtgcgcttgggatatttgtgaagcatgggctgagaaacgcggttataaaaccgccaaggcagcgcgaaacgacgtgtacagagccgccaactcacttctccgtctggccgtggatggaagactctctctgtgctttcacccgcccggctatagcgaacagaaaggtacttgggaaagccatcccgaaacaactgagctcgttgtgctgcaaggacgggttgggcctgccggtgatgaagaggaggaagaggaagaagaacttagttcctcctgtgaggaggaaggtgaagaagacagggatgccgacgaagaaggggagggcgacgaggaaaccccaactagcgctcctggaagctccctcgcaggtcgcaacccctacgcactgttaggtgaggatgagtgttag

SEQ ID NO: 119335 - DNA, 789 bp, Artificial Sequence
  Description of Artificial Sequence: Synthetic coding sequence
atggagcccacgggacccacccaggaaagatacaaagatggtgttgtcactatagggtgtgtcggttttccaaacgtcgggaagagctcactcataaatggcctggtgggaaggaaagttgtctccgtctctaggacccccggtcacacgcgctactttcaaacgtattttctcacccctagtgtgaagctttgcgactgtcccggattgatcttcccaagtttgctgccacgccagctccaggtgctggccggcatctatcctatagcccagatccaggagccttacacggcagtgggctatttagcatctagaatccctgttcaggccttgctccacttgcgacatcccgaggcggaggatccttccgctgagcatccatggtgtgcctgggacatttgcgaagcatgggccgagaagcgcgggtacaaaacagcaaaggccgcccgcaacgatgtataccgcgcagcgaactccttgctgcgtttggctgtcgatggccgcctgtcattgtgctttcaccctccagggtactctgagcagaagggaacttgggagtcccatccagaaacgactgagctcgtcgtgctgcaggggcgcgtcggcccagcaggagacgaggaggaggaagaagaggaggaactcagttctagctgcgaggaagaaggagaggaggatagggacgcagacgaggaaggagaaggtgatgaggagacacctactagtgcccctgggtccagccttgccggccggaatccctatgccctgctgggcgaagatgagtgctag

SEQ ID NO: 119336 - DNA, 1290 bp, Artificial Sequence
  Description of Artificial Sequence: Synthetic coding sequence
atggaggctgcggtcgtactagagatgagcgacattgtgctgctgatcaccgacatccggcatcccgtagtaaatttccctcccgcactctatgaatatgtcactggcgaactgggcctggcactcgttctggtgttaaataaggtcgacctcgcgccaccagccctggtcgtcgcctggaagcactacttccatcagcactatccccagcttcacgtagttctttttacgtcgttcccccgggacccaaggacaccacaggatccttcatccgtcctgaagaagtctagaaggaggggacgcggctggacgcgagcgcttggcccggagcagttgctccgggcctgcgaagcgattacagtcggaaaggtagacctcagttcctggcgcgagaagattgctcgagatgtcgctggagctacatggggtaatgggagtggggaagaagaggaagaagaagatggccctgctgtgctcgtggagcaacagacagatagcgctatggagcctactggtcccacgcaagagagatacaaagatggagtcgtaactatcggctgcgtggggttccccaatgttggcaaaagctcattaataaatggactggtgggccgcaaggtcgtgtccgtgtcccgcacacccggacatacgcgctacttccagacatacttcctgaccccaagcgtgaaactgtgtgactgcccgggtctgatttttcctagcctgctgccgcgacagctccaggttttagccgggatatacccaattgcccagattcaggagccgtacacggccgtgggctatctcgcttctaggatccccgttcaggccctgctccacttgcggcacccagaagcagaggacccatctgcagaacacccatggtgtgcgtgggacatctgtgaagcttgggctgaaaagaggggctacaagaccgccaaggccgcacgtaatgacgtgtaccgagctgctaatagcctattgagattggccgtggacggaagactgagcctgtgttttcatcccccaggttacagtgaacaaaagggaacatgggagtcccatccggaaacaacggaactggtcgtactgcaggggcgggtcggtccagctggagatgaagaggaggaggaggaagaagaactctccagctcgtgcgaagaagaaggcgaggaggaccgtgacgcagatgaagaaggagagggcgacgaagagacacccacctccgcacccggctcatcgctcgccggccgaaacccttatgctctgctgggtgaagatgaatgttag

SEQ ID NO: 119337 - DNA, 1290 bp, Artificial Sequence
  Description of Artificial Sequence: Synthetic coding sequence
atggaggcagccgtggtacttgaaatgtctgacattgtgcttctgatcactgacattcgtcatccggtggtcaattttccgccagcactgtatgaatacgtcacgggcgaacttggtttggccctagtgctcgtgctcaataaggtggatttggcccccccagctcttgtggtggcctggaaacattattttcatcagcactatccacagttgcacgtcgtattattcacttctttccccagagatcctaggacacctcaggatccctctagcgtcctcaagaaatcacgaaggaggggaagagggtggacccgggctcttggacccgagcaactgctgcgtgcatgtgaagcgattaccgtcggaaaggtggatctgtcatcatggcgggaaaaaattgctcgcgacgtggccggagccacatgggggaatgggtcaggagaggaagaagaagaagaggatggtcccgccgtgctcgtcgaacagcaaactgattccgcaatggaacccacgggtcctactcaggaacggtacaaggatggagtcgtgaccatcgggtgcgtcggctttcccaacgtagggaaaagttccctcattaacggcctggttgggcgcaaagtggtgagtgtatctcgaacccccgggcacacacgctactttcagacctactttttgactcccagtgtgaagctgtgcgactgtcctggcctgatattcccaagcctgttacccagacagctgcaggtcttagcggggatttacccaattgcccagatccaggagccttacaccgccgtcggataccttgcgtctaggattcccgttcaggccttgttgcacctgagacaccccgaggctgaagacccaagcgccgagcacccctggtgtgcctgggatatttgcgaggcatgggctgagaagcgcggctataaaacagcaaaggcagctcgtaacgatgtctatagggctgctaactcattgctcaggctggctgtagatggcaggttgtccctgtgcttccaccctccaggatattcagagcagaaggggacctgggaatcccaccccgaaactaccgagctggtcgtgctgcagggaagggtgggacccgccggagatgaggaggaagaagaggaagaagagctgtcctcttcctgtgaagaagaaggggaagaagacagagacgctgatgaggaaggggaaggtgatgaagagactccaaccagtgctcccgggagcagcctggcgggcagaaatccctatgcactgctgggagaagacgagtgttag

SEQ ID NO: 119338 - DNA, 789 bp, Artificial Sequence
  Description of Artificial Sequence: Synthetic coding sequence
atggaacccacaggcccaacacaagagaggtacaaggatggtgtggtcaccataggctgtgtcggctttccgaacgttggcaagtctagtcttataaatggactggtgggccggaaagtggtcagtgtgtcccggactccggggcacacaagatacttccaaacttatttcctgactcccagtgtgaagctttgcgactgccctggcctaatattcccatcactcctgcctcggcagctgcaggtcttggccggaatctatccaattgcccagatccaggagccctacacggccgtgggatatctggccagccgaattccagtgcaggcgctgttacatctccgtcaccccgaggcagaagaccctagcgcagaacatccgtggtgtgcatgggacatctgcgaggcttgggccgagaaaagaggctataagacggctaaggctgcccgcaacgacgtgtatcgcgctgcgaatagtctgcttaggctggctgtagacggacgcctcagtctgtgctttcatccccctggctatagtgagcaaaagggcacatgggaatcccatccagaaaccacagagctggtggttttacaaggcagggtgggcccggcaggtgacgaagaggaggaggaagaggaggaactgtctagcagctgcgaagaggaaggcgaagaggacagggatgccgacgaagagggcgagggagacgaggagaccccaacatccgcccctggttcatctctggctggtaggaacccgtatgctcttctcggggaggatgagtgttag

SEQ ID NO: 119339 - DNA, 1215 bp, Artificial Sequence
  Description of Artificial Sequence: Synthetic coding sequence
atgtccaaggaacagctaatgagccaggaggaacgctcctttcaagattatctgggtaagatccacggtgcctacagttccgagaagctatcctatttcgaacacaatctggaaacctggagacagctgtggcgcgttctggaaatgtccgatattgtgctcctgataacggatatcagacaccccgtggtgaattttccaccggctttatacgaatatgtgaccggggaactgggactggcacttgtactggtcctcaacaaggtggatctggcccctcccgccttggtggttgcctggaaacattactttcaccagcattatcctcaactgcacgtcgtgctgttcaccagttttccaagagatccgaggactcctcaagatccttcttccgtactgaagaagtctaggcggcggggcagaggttggacccgcgcgctggggcctgagcagctactgcgagcatgcgaggctatcacagttggcaaaggatttccaaacgtcggcaaatcatcccttattaacgggcttgtggggcggaaggttgtgagcgtgtctagaaccccgggccataccaggtatttccagacctactttcttactccatcagttaagctgtgtgattgtcccggcctcattttcccttctctgctgcctcgccagttgcaagttctcgcaggaatttatccgattgcccagattcaggaaccctataccgccgttggctatctcgcctcccgcataccagtccaggcattactccatcttaggcatcctgaggccgaggatccgtctgctgagcatccgtggtgtgcatgggacatctgcgaagcctgggccgagaagcgcgggtacaagacagccaaggcggcaaggaacgatgtgtatagggccgctaacagcttgctcagactagccgtggacggacgtttgagcctgtgcttccatccccccggctactcagagcagaagggaacttgggaaagccaccccgaaaccaccgagctggtagtgctgcagggcagggtgggaccagctggggacgaagaagaggaggaggaggaagaactgagtagtagctgcgaggaagaaggagaggaggacagagacgccgacgaggaaggtgagggtgatgaggaaacccctacctccgcgcccggtagttccctggccggtcggaacccctacgcgctactgggagaggatgaatgttag

SEQ ID NO: 119340 - DNA, 1290 bp, Artificial Sequence
  Description of Artificial Sequence: Synthetic coding sequence
atggaagctgccgtcgtgctggaaatgagcgatattgttttgctgataacagacatcagacacccagtggtgaactttcctcccgctttatacgaatatgttaccggcgagcttggcctggccctcgtactggtgttaaataaagtggatcttgccccacccgccctggtggttgcatggaaacactactttcaccagcactaccctcaactgcatgtggtgttatttactagctttccccgggaccctagaacccctcaggatccatcaagcgttctgaaaaagagccggcggagaggccgaggttggacacgcgctctaggtccagaacagctgctccgcgcttgcgaggctatcaccgtcggcaaggttgacttatctagttggcgagagaaaatcgctagggatgttgctggggcaacctggggaaacggaagcggagaggaagaagaagaagaagatgggcccgccgtcctcgtggaacaacagaccgactcggctatggaacccacgggccccacacaagaacgctataaagatggagtcgttacaattgggtgcgtgggtttcccgaacgtgggcaaaagcagcctgatcaacggattggtcggccgcaaagttgtttccgtttccaggaccccaggccacactcgttattttcaaacctactttctcacaccctctgtgaaactctgcgactgtccaggcctcatttttcccagtctgcttcctcgccagctacaagtacttgccgggatctaccctatcgcccagatacaagagccgtatacagccgtcggctatcttgcatccagaatccctgtacaggctttgcttcatctgcgacatcccgaagccgaggatcccagcgccgagcacccttggtgtgcctgggacatctgtgaagcctgggccgaaaaacggggatataagacagccaaagcagcacgtaacgacgtgtaccgcgcagccaactctctcctgcgattggcagtggacggcagactgagcctctgttttcacccccctggatatagtgagcagaaaggcacctgggagtctcatccagagacaacggagctggttgtgctgcaggggagggtgggccctgcaggagacgaagaggaagaagaggaggaagaactgagtagctcatgcgaagaggaaggcgaggaagacagagacgctgacgaggagggcgaaggtgacgaggaaacacccacttccgcacctggaagcagcctggcagggcgcaacccctatgcccttctcggagaggacgagtgttag

SEQ ID NO: 119341 - DNA, 1290 bp, Artificial Sequence
  Description of Artificial Sequence: Synthetic coding sequence
atggaggcggccgtggtgctcgaaatgtctgatattgttctcctgattaccgacatacggcaccccgtcgtcaacttccccccagcactgtatgaatatgttacaggagagctaggccttgctctggtgctcgtattaaacaaagtcgatctagcccctcctgctctggttgtggcatggaaacattacttccaccagcactatccccagctgcatgtagtcctcttcaccagctttccgcgtgatccccggacccctcaagacccaagtagtgttcttaagaaaagtaggcgtcgaggacgcgggtggacacgagctctaggcccagagcagctgctccgggcctgtgaggccattaccgtggggaaggtggacctgagttcctggcgcgaaaaaatcgcgcgagatgtcgccggggctacctggggcaacggctcaggagaagaggaggaagaagaagacgggcctgccgttctggtcgagcagcagacagatagcgctatggagcctactggccctactcaggaacgctacaaggacggcgtagtgactatcggctgtgttggattccctaacgtcggaaagagctcattaattaacggactagtcggacgaaaggtggtgtctgtgagtagaacacctggccatacccgctacttccagacctattttcttacaccctcagtgaagttgtgcgactgtcccgggttgattttccctagcttactgcccagacagctgcaggtgttggcaggtatctatccaatcgcccaaatccaagagccctataccgcggtgggttacctcgcgtctcgcatccccgtacaagcactgctacatctgcgacatcccgaggccgaggacccaagtgccgagcatccttggtgcgcatgggacatctgcgaggcctgggcggaaaagcgaggttataagacggctaaggccgcccggaacgatgtgtaccgtgcagcgaacagtctgctgagactggcagtcgatggaaggctgagcctgtgtttccatcctcccgggtacagtgagcagaagggcacttgggagtcccaccctgaaaccaccgagttggtcgtgctacaaggtagagtgggaccagcaggcgatgaagaggaggaagaggaggaggagcttagcagttcctgtgaggaagagggggaagaagatcgagacgcagatgaggaaggcgagggagatgaggagaccccaacttcagcaccggggagttcattagcgggacggaatccatacgccctgctcggggaagatgaatgctag

SEQ ID NO: 119342 - DNA, 789 bp, Artificial Sequence
  Description of Artificial Sequence: Synthetic coding sequence
atggagcctacaggcccgacccaggagagatacaaagatggcgtggtcactatcgggtgcgtgggctttccaaatgtgggcaaatcttctctcattaatggccttgtgggacgcaaagttgtgagcgtcagccgtacccctggccacacgagatacttccagacatattttttgactccatcagtaaaattgtgtgactgccctgggcttatctttccatccctgctgcctaggcaactgcaagtccttgccgggatctacccgattgcccagattcaagagccttacaccgccgtaggataccttgctagccggatcccagtccaagcactcctccatttgcgacacccagaagcagaggatccttcagctgaacatccctggtgcgcctgggacatctgcgaggcatgggcagagaaacgaggttacaagacagctaaggctgctaggaatgacgtctaccgggcagctaactctcttctcaggctcgctgtggatgggcgcctttccctctgcttccatccccccggatactcagaacagaagggcacctgggaatcacacccagaaacgaccgagctggtcgtcctgcaggggcgcgttggacccgccggggatgaggaagaggaagaggaggaagagctgtcatcgagctgtgaagaagagggggaggaggaccgcgacgccgacgaagaaggggagggagacgaggagaccccaaccagtgccccggggagcagcttggcaggcaggaatccctacgcactccttggagaggatgaatgctag

SEQ ID NO: 119343 - DNA, 1290 bp, Artificial Sequence
  Description of Artificial Sequence: Synthetic coding sequence
atggaggcagccgtcgtgctggaaatgagcgatatcgttctgctaataacggacatcagacatcctgtcgtgaattttccccccgccctgtatgagtacgtgacaggcgagctgggactcgcactggtactggtcctcaataaagtggacctcgccccgccagcactggttgtggcatggaaacattactttcaccagcactacccccaactgcatgtggtgctgttcacctctttcccgagggatccgcggaccccacaggatccgtcatctgtccttaagaaaagcaggcgcagggggcgtgggtggactcgggctctgggccctgagcagctccttagagcctgtgaggccatcacagtgggcaaagtagatctatcaagctggagggagaaaatcgcgagggatgtcgcgggagcaacatggggtaatggaagcggcgaggaggaggaggaggaagacggacctgctgtgctcgtggagcaacagacagacagcgcaatggagcccactggaccaacgcaagaaaggtacaaagacggcgtggtaaccattggctgtgtagggtttcccaatgtgggcaagtcttcccttattaacggtctcgtcggtcgtaaggtcgtgagtgtctcacgcacacctggacatacccgctattttcagacctactttttaaccccatctgtgaaactatgtgactgcccgggcctcattttcccgagccttctccctagacagcttcaggtccttgccggtatctacccaattgcacaaatccaggagccttataccgcagtcggatacttggcctctcggatccccgtacaggcgctgctccacttaaggcatcccgaagccgaggacccatctgctgagcacccttggtgcgcctgggacatctgcgaagcatgggctgagaagcgcggctacaagacagccaaagcagcacggaatgatgtataccgagccgccaattcactgctaaggcttgccgtggacggacgccttagtctatgcttccatccccccggctacagcgaacagaaaggcacctgggaatcacatcccgaaaccaccgaactggtggttctacaggggagagttggacccgctggcgacgaggaggaggaggaggaagaggagctcagctccagctgcgaagaagaaggagaggaagatcgggacgccgatgaggagggagagggagacgaggaaactccaacgagcgctcctggctcctctctggcggggcggaacccgtatgccctgctgggagaggatgagtgctag

SEQ ID NO: 119344 - DNA, 1215 bp, Artificial Sequence
  Description of Artificial Sequence: Synthetic coding sequence
atgagtaaagaacagttaatgagtcaagaggagcggagcttccaggactatctcggcaagatacatggtgcctactcatccgaaaaattatcctacttcgaacacaatctggagacctggcgccagctctggagggttctggagatgtctgacatagttctgctgattaccgacatccggcaccccgtcgtcaattttcccccagctctgtatgagtatgttaccggagaactgggattggcccttgtcctcgtgttaaataaagtcgatctggcgccacctgccttagtagttgcctggaagcattattttcaccaacactatccccagctgcacgttgtcctattcactagctttccgagggatcctcgcaccccccaggacccctcttccgtgctcaaaaagagtcgccgtcgcgggaggggctggacacgggctctcggccctgagcaactgttacgtgcatgcgaagcaatcacggtagggaaggggtttccaaacgtgggaaagtctagcctcatcaatgggctggtgggcaggaaggtggtttcagttagcagaacacccgggcacactcgatattttcagacctactttcttacaccatctgttaagctgtgcgattgtccaggactcattttcccctctctgttacctagacagttgcaggttctggctggaatttacccaatcgctcagatccaagaaccctatactgctgtcggatatctggcaagtcggatacctgtgcaggcactgttacacttaagacaccccgaggctgaggatccaagcgccgaacacccatggtgtgcgtgggacatctgtgaggcctgggccgagaagaggggctataagacagccaaggccgctagaaacgacgtctatagagccgctaactctcttttacgccttgcagtcgacggacgcctgtccctatgcttccatccccccggttattcggagcagaaagggacctgggagagccaccccgagaccacagagctggtagtgctccagggtcgggtggggcccgcaggggatgaggaagaagaggaggaggaagaactttcctcatcatgtgaggaagagggtgaagaggatagagacgccgacgaagagggagagggagacgaggaaactccaacttccgctcctgggagttcgctggctggaaggaatccctacgcattgctaggagaagatgaatgctag

SEQ ID NO: 119345 - DNA, 1215 bp, Artificial Sequence
  Description of Artificial Sequence: Synthetic coding sequence
atgagcaaggaacagctcatgagtcaggaagaaagaagttttcaggattacttaggcaaaatacacggagcctacagctctgagaaactgtcctactttgagcacaatttggagacatggaggcagctgtggcgagttctcgaaatgagcgatattgtcctcttgattacggatatcagacatcccgtggtcaattttcccccagctctgtacgagtatgtgacgggagagcttgggttagcccttgtgctggtcctaaacaaggtcgacttggcacccccagccctggttgtcgcctggaagcactatttccaccagcattatccccagctccatgtggtcctgtttacctctttcccaagggatcctagaaccccacaggacccatccagcgtgctcaagaagagcaggcgacggggtcgcggctggacaagagccctcggccccgagcaacttctccgagcatgcgaagcgattactgtcggtaagggcttccctaacgtgggcaagtcctccttgattaacggcctggtgggacgtaaggttgtctccgtctctagaacacctggacacacaagatacttccagacttattttcttacaccaagcgtgaagctgtgcgattgtcctggcttaatcttcccctcactgctcccccgccagctgcaagttttggcaggaatataccctattgctcagatccaggagccgtacactgccgtcggttacctggctagcagaattcctgtgcaggccctgctgcacctccgacaccctgaggccgaggacccgagtgctgagcatccttggtgcgcttgggatatttgtgaagcctgggccgagaagcggggatacaaaactgcgaaagctgcccgcaacgatgtctacagagctgcaaattcgctcctccggctggccgtggatggcaggttgagtttgtgttttcatcccccgggatacagtgagcagaagggaacatgggagtcacaccctgagaccactgaactggtggtccttcagggtagagtgggtccggctggggatgaggaggaggaagaagaggaggaacttagctcaagttgcgaggaggagggcgaagaggatagggatgcagatgaggagggcgaaggagatgaggaaactcccacatctgcccctggatcttccctggcgggtaggaacccatatgcactgctgggcgaggacgagtgttag

SEQ ID NO: 119346 - DNA, 789 bp, Artificial Sequence
  Description of Artificial Sequence: Synthetic coding sequence
atggaacctaccggacctacacaggaacggtataaagatggagttgtgaccatagggtgtgtggggttccctaacgtgggtaagagcagccttatcaatggactggtggggaggaaggtggtctctgtctcccgcacaccaggacacacgagatatttccagacttatttcttaaccccttccgtaaagctctgtgactgccctggcctcatttttccatccctactacctcgtcagctccaagtgcttgcaggaatatatcccattgctcaaattcaggagccttatactgccgtcggatatttagcgtcacgcatcccggtgcaggccctgcttcacctacggcaccccgaagcagaggatccttctgcagagcacccctggtgcgcatgggatatctgcgaagcatgggccgagaaaagagggtacaaaactgccaaggccgcacggaacgatgtgtatcgggcggccaatagcctcctccgcctggcagtggacgggaggttgtccctttgtttccatcctcccggttacagcgaacagaaggggacttgggaatcccatcctgaaaccaccgaactcgtggtcctccagggtcgagtgggaccagccggtgatgaagaagaggaagaggaagaagagctctccagtagctgcgaagaggaaggcgaggaggacagagacgctgacgaggagggcgaaggcgacgaagaaaccccaacaagcgctcctggaagtagcctggctggcagaaatccttatgccttgctcggggaagatgagtgttag

SEQ ID NO: 119347 - DNA, 2196 bp, Artificial Sequence
  Description of Artificial Sequence: Synthetic coding sequence
atggtgaaacctaagtacaaaggcagatctacaatcaatccttccaaggctagtaccaatcctgacagggtgcagggagcagggggacagaacatgcgggatcgggccaccattaggaggcttaatatgtatcgtcaaaaggagagaaggaactctcgggggaaaatcatcaagcctctgcagtaccagtccacagtggcaagcgggactgtggctagggtggaacctaatattaaatggtttggcaacactcgggtgatcaagcagtccagcttgcagaaatttcaagaggagatggatacagtcatgaaggacccctataaggtagtgatgaaacagagcaaattgccgatgtccctcctgcatgaccgaattaggccccacaacctgaaggtgcatatactggacactgagagttttgagactacatttggaccaaagagccaaaggaaaagacctaacttattcgccagcgacatgcagtcattgattgagaatgccgaaatgtccacggaatcctacgaccaggggaaggatcgcgacttggtcaccgaagatactggggtgaggaatgaagctcaggaggagatatacaagaagggacagtccaaaaggatctggggggaactgtataaagttattgactcgtctgatgtggtggtgcaagtgctagatgcccgtgatcctatgggcacccggagtccgcacatcgagacttatctaaagaaagagaagccttggaagcatctcatttttgtcctgaataagtgtgaccttgtgcctacctgggctacaaagcgctgggtggccgttctctctcaagactacccaacactggccttccatgcttcactgacaaacccctttgggaagggggcctttattcaactactgcgtcagttcgggaagttacataccgacaagaaacaaatttcggttggcttcatcgggtatcccaacgtgggaaagagctcagtgataaacaccttgcggtcaaaaaaagtatgtaacgtggcccctatcgccggggaaaccaaagtttggcaatatatcactttgatgcggcgcatttttctcatcgattgccccggggtagtgtacccaagcgaagacagtgaaacggatattgtgctgaagggagtagtacaagtggaaaagatcaagagtcccgaagaccatataggcgctgtcctagagcgtgctaagcctgagtatatttccaagacctacaagatagattcatgggagaacgccgaagattttctggagaaactggcctttcggacaggcaaactgttaaaagggggggaaccagatctccagaccgtgggtaaaatggtcctgaatgactggcagcgcgggcgaatccctttctttgtgaagccccctaatgccgagccactggtggcccctcagctgttgccttcgtcttccctggaagtagtgcccgaggccgcccagaacaaccctggggaagaggtcacggaaacggccggcgaaggttcggaaagcattattaaggaggagaccgaggaaaattctcactgcgatgctaataccgagatgcagcagatcctgaccagggttcgccagaacttcggcaagatcaacgtggtgccgcaattctctggtgatgatctggtccccgtcgaggtgtctgatctcgaggaggagctggagagcttttccgatgaagaagaagaggagcaggaacaacagcgggacgatgctgaagaaagcagttctgaacccgaggaagaaaacgtgggcaatgatactaaagccgtgataaaggcgctggatgagaagatcgctaagtatcaaaaatttctcgataaggcaaaagccaaaaaattctccgccgtacggatcagcaagggactctccgagaagatctttgccaagccagaggaacagcgcaaaacccttgaggaggacgtcgacgatcgtgcaccatctaaaaaggggaagaagaggaaggctcagagagaggaggaacaggagcactccaacaaggcaccgcgggctctgacaagtaaggaacgccgtcgggctgttaggcagcagcggcctaagaaagttggagtgcggtattacgaaacccataacgtcaaaaatcgaaataggaataagaagaagacaaacgactctgagggccagaaacacaaacggaagaagtttagacaaaaacagtag

SEQ ID NO: 119348 - DNA, 579 bp, Artificial Sequence
  Description of Artificial Sequence: Synthetic coding sequence
atgcagagcctgattgaaaacgctgaaatgtcgactgagagctacgaccaaggaaaggatcgcgacctggtcaccgaggataccggagtgaggaacgaggcacaggaggagatctacaagaagggccagtctaaaagaatctggggagaactttacaaagtgatagatagtagcgacgtggtagtccaggtgctggacgctcgagaccctatgggcacacggagtccacacatagagacctatctgaagaaagaaaagccgtggaaacacctcatattcgtgcttaacaagtgtgacctggtgcccacctgggctacaaaacgctgggtcgccgtgctgagtcaggactatccgactctggcattccacgcaagcctgacgaaccctttcggcaaaggggcctttatccagctcctccgccaattcggtaagctgcacacagacaagaaacagatttcggtgggtttcatcggatacccaaatgttgggaagagcagcgtgattaacacactgcggtctaagaaggtgtgcaacgtggctcccatagcgggagagacgaaagtttcaatccttctctag

SEQ ID NO: 119349 - DNA, 1614 bp, Artificial Sequence
  Description of Artificial Sequence: Synthetic coding sequence
atgacttgccacaaacggtacaagattcagaagaaggtgagagaacatcatagaaagctgcggaaggaagcaaaaaagaggggacacaaaaagcccagaaaagatcccggggtgccaaactcagcaccctttaaggaggcgttgttacgtgaggccgaactccggaaacaaagacttgaagaactgaaacagcagcaaaagctggaccgtcagaaagaactggagaagaaacgaaagttagagacgaaccctgatataaagccctcgaacgtggaacccatggaaaaggagttcgggctgtgcaaaactgagaacaaggcaaagtcaggcaagcagaactctaagaagctgtattgccaagaacttaagaaagtcatcgaggcttcagacgtggtgctggaggtcctcgatgcgcgcgaccccctgggttgtcggtgcccgcaggttgaggaagccattgttcagtcagggcagaagaagttagtattgatactgaacaagtctgatctggtgccgaaagagaatttggaatcatggcttaattatctgaaaaaggaattgcccacagtcgttttcagggcctctaccaaaccgaaagacaaaggcaagataacgaaacgtgtaaaagccaagaagaatgccgcaccgttccggagcgaagtttgttttggcaaggaaggactttggaagttgctgggcgggttccaggaaacatgttctaaagcaatccgtgtgggcgttatcggattccccaatgtagggaaatcctctattattaattccttaaaacaggaacaaatgtgcaatgtaggcgtatctatgggccttaccaggtctatgcaggtggtaccgctggacaagcagatcactattattgactccccgtccttcatcgtctcgccactaaactccagcagcgcacttgcactccgcagtcctgcctcgatcgaggtggttaaacccatggaggccgcttcggctatcctatcgcaggctgacgcccggcaggtcgtgttgaagtatactgtcccaggctaccgcaatagtctggagttctttaccgtgttagcgcaacgccggggcatgcaccagaagggaggcattccgaatgttgagggtgcagctaaactcctgtggtctgagtggacaggtgcatccctcgcatactattgccaccctcctacatcttggactccaccaccatactttaatgaaagcatcgtggttgacatgaagtccggcttcaacttggaggaacttgagaagaacaacgcacagtctataagggccattaaaggcccacacctagctaattccatcctgttccagtcctctggcctgacgaatggaataatagaggagaaggatattcatgaagagctgccgaagcgtaaagagaggaagcaggaagaaagggaagatgataaagattctgatcaggagactgtggatgaggaagtcgatgagaactcctccggaatgtttgccgccgaggagactggagaagccctctcagaggagactactgccggcgaacagtctactcgatctttcatattggataaaattattgaagaggacgacgcctacgacttctccacagattacgtatag

SEQ ID NO: 119350 - DNA, 1650 bp, Artificial Sequence
  Description of Artificial Sequence: Synthetic coding sequence
atgaaacggcccaagcttaagaaagcttctaaaagaatgacatgtcacaaacgctacaaaatccagaaaaaagttcgcgaacatcaccggaagctgagaaaggaagccaagaaacgcggacacaagaagcccagaaaggatccaggagtgccaaattcagcaccttttaaggaagctttactacgtgaagcagaattgcgcaagcagcgactcgaggaactgaaacagcagcagaaattggatcgacaaaaggaactggagaagaagcgcaaactggaaactaacccagacattaaaccctctaatgtggagcccatggaaaaagagttcggtctctgtaagacggaaaacaaggcaaagagcggaaaacaaaatagtaagaagctctactgccaggagctgaagaaggtgatcgaggctagcgacgtggtgctcgaagtattagatgcccgtgacccgctgggctgtcgttgcccacaggtggaggaagccattgtccagtcaggccagaagaagctcgttttaatcctgaataagtccgatctcgttcctaaggagaatctcgagtcgtggctcaactatttaaagaaagaactgcctaccgtcgtctttagggcctctacgaaacctaaagataaggggaagatcacaaagagagtgaaagcgaaaaagaacgcagctccgtttagaagcgaggtctgcttcgggaaggagggcctgtggaaattgctcggggggttccaggagacctgtagcaaagctattcgggtgggcgtcatcggatttcccaatgtcggcaaatcttctatcattaattctctcaagcaagagcagatgtgcaacgttggggtgtctatgggactgaccagatcaatgcaagttgtgccactggacaagcaaattaccataatcgacagcccctccttcatagttagtccccttaatagtagttctgccttagcactgcggagccctgcttccatcgaggtcgtgaagccaatggaggcggctagcgcgattctgagtcaggcagatgcacgacaagttgtgctcaagtacaccgtaccaggctataggaattcgcttgagttttttaccgtgctggcccaaagaagaggaatgcatcagaagggagggatccccaacgtggagggggccgctaagcttctttggtcagagtggactggcgcttcactggcttattactgccatcccccgactagctggacaccgccaccttacttcaatgagtctatcgtggttgatatgaagtcggggttcaatctcgaagaactcgagaaaaataatgcccagagcattcgcgctatcaagggaccccatctggcaaacagtatactgttccagagctccgggctgaccaacggcatcattgaagagaaagatatacacgaggagcttcctaaacggaaggagagaaagcaggaggagagagaagacgataaagacagtgaccaagaaaccgtagatgaagaggtagatgaaaactcttccggtatgttcgccgccgaggagacaggtgaagccttgagcgaggaaacaaccgcgggagaacagtctacgagatccttcattcttgataagattatagaggaggatgatgcctacgacttttccacagactatgtgtag

SEQ ID NO: 119351 - DNA, 291 bp, Artificial Sequence
  Description of Artificial Sequence: Synthetic coding sequence
atgacttgccataaaaggtacaaaatccagaagaaagtgcgcgagcatcatcggaagctcaggaaagaggcgaaaaaaagaggccacaagaagccccgaaaggaccctggtgtccccaactccgcaccttttaaggaggctctgctgcgggaggccgagctgagaaaacagagactggaagagttgaagcaacagcaaaaactcgaccggcaaaaggaactcgagaagaagagaaagctggaaaccaacccggacatcaagccgtccaatgtcgaaccaatggagaaatag

SEQ ID NO: 119352 - DNA, 408 bp, Artificial Sequence
  Description of Artificial Sequence: Synthetic coding sequence
atgacttgtcataagcggtacaaaatccagaaaaaggtgagggaacaccatcgcaaactgagaaaggaagctaaaaagaggggccacaaaaagcctagaaaagatccaggggtgccaaactcggcccctttcaaggaagccctgctgagagaggccgaactgcggaaacagcggctggaagaactcaagcagcaacaaaaacttgatagacagaaagagctggaaaaaaaacggaaattggagaccaatccagacatcaagcctagcaacgtggagccaatggaaaaggagtttggcctttgcaaaacagagaataaggccaagagcggtaagcagaactcgaagaaactatattgccaggaactcaagaaggtaatagaagcttccgatgtcgttctggaagtttag

SEQ ID NO: 119353 - DNA, 417 bp, Artificial Sequence
  Description of Artificial Sequence: Synthetic coding sequence
atgaaaagacccaaactaaagaaagcgtctaaaaggatgacttgtcataaacgctataagatacaaaaaaaggtacgcgaacaccacagaaagctgaggaaagaggccaaaaagcgggggcacaaaaaaccgaggaaggatcccggcgttcccaatagcgccccttttaaggaggctcttctgagggaggccgaactcagaaagcaaagactggaggagctcaagcagcaacagaagctggaccggcaaaaagaattggagaaaaaacgaaaactcgaaaccaatcccgacatcaagccttcaaatgttgagcccatggaaaaggagttcggtctgtgtaaaaccgaaaataaggctaagtcgggtaaacagaacagcaagaagctatattgccaggaattaaagaaggtgagttag

SEQ ID NO: 119354 - DNA, 1038 bp, Artificial Sequence
  Description of Artificial Sequence: Synthetic coding sequence
atgccccggattgacgcggacttgaagctcgatttcaaagatgtgcttctgcggcccaagagatcttccttgaaaagccgggctgaggtggatttggaacgtacatttacattcaggaactccaagcagacttatagcggaatccccatcattgtggccaacatggataccgttgggacattcgaaatggcagctgtgatgagccagcacagcatgtttaccgccattcacaagcactatagccttgacgattggaaactcttcgctacgaatcaccccgagtgcctccaaaacgtcgccgtgtcctccggatccggtcagaatgatttggaaaaaatgacttccattctcgaagcagtgccgcaggtcaagtttatatgtctggatgtggctaacggatattcagagcactttgttgagtttgtgaaactcgtcagagcaaaattccccgagcacaccatcatggctgggaacgtcgttacgggtgaaatggtggaggaattgatcttatctggggcagacatcattaaagtaggtgttggccctggttcggtttgcactactcggactaagactggcgtcggttatccacagttaagcgccgttatcgaatgcgcggacagtgcacacgggctcaaaggccatattatatctgacggtggatgcacttgtcccggcgacgtggctaaagctttcggagccggggccgactttgtgatgctgggcgggatgttttcagggcataccgaatgtgccggtgaagtttttgaacgaaatggacgcaaactaaagctgttttatgggatgtcctccgacacagctatgaataaacacgctgggggcgtggcagaataccgggccagtgaaggtaagacagttgaagtaccctacaaaggcgacgtggaaaacacaatactggatattctcggagggcttcgatctacgtgtacatatgtgggcgccgctaagttgaaagagcttagtaggcgggccacatttatcagggtcacacagcagcacaacacagtattcagctag

SEQ ID NO: 119355 - DNA, 1230 bp, Artificial Sequence
  Description of Artificial Sequence: Synthetic coding sequence
atgccacatattgataacgatgtcaaactagacttcaaggatgtgctgctaaggcctaaacgttctacgctgaagagtaggtccgaggtcgacctgaccagatctttttctttcagaaatagcaaacagacctattcgggggtccccataattgccgctaacatggacaccgtggggacattcgaaatggcaaaagtactgtgcaaattctcattattcaccgcggtgcacaaacactactccctagtgcagtggcaggaattcgcaggccagaacccggactgccttgaacatttggccgcaagtagcggcaccggatcttctgacttcgaacagctggagcaaatcctggaggcaatcccacaggtgaaatacatatgcctcgacgtggctaatgggtactccgaacactttgtcgaattcgtaaaggatgtcaggaaacggtttccccagcacacaatcatggccgggaacgtcgtcacgggcgagatggtagaagaactgatcttgagtggcgccgatatcataaaagtcggcatcgggccaggttccgtctgcaccaccaggaagaagacgggcgtcggatacccccaacttagcgccgtcatggaatgcgccgatgccgcacatggcctgaaaggacacataatttcagacggcggatgtagctgccctggtgatgtggcaaaggcttttggtgcgggcgcagatttcgtgatgttggggggcatgctagctggtcactctgaaagcggaggggagttgatagaacgcgacggcaagaagtataaattgttctatggcatgagcagtgaaatggccatgaaaaagtacgccggcggggtggccgagtaccgttacgtgtggaggccccgatctttagtcatcgtgtggcgccaaaattcctggctacttcggggcggctggtatagcagtcagcgctcaatggtgaatagaggatctatgttaggctccgttgaaaaaagcctggggttgcgtaacccagagggcgaagacaacaaggtatttccgacattacgggcgagcgaaggaaaaactgtcgaagtgcccttcaagggcgatgtcgagcacacaatacgggacatattgggcggaattcggtccacctgtacatatgtcggcgccgctaagttaaaagagctgtcccgacgcaccacttttattcgcgttacgcagcaggtgaacccgatcttcagtgaagcctgctag

SEQ ID NO: 119356 - DNA, 1047 bp, Artificial Sequence
  Description of Artificial Sequence: Synthetic coding sequence
atgccacacatagataatgacgtaaaattggatttcaaagatgtgctgctgcggcctaagcggtcaacactcaagtctagatccgaagtcgacctcactcggtcattttctttccgcaattctaagcagacatattcgggagtacctatcattgccgccaatatggacaccgtcggaaccttcgagatggccaaagtgctctgtaaatttagtctttttaccgccgtacataaacattatagcctcgtgcagtggcaagaattcgccgggcaaaatcctgactgcttggagcacctcgctgccagcagcggcacaggcagttcggacttcgaacaactggagcagattctggaagcaatcccacaggtgaagtacatttgtttagatgtcgctaacggttatagcgagcacttcgtcgagttcgtaaaggacgtaaggaagagattcccgcagcacacgattatggcgggcaacgttgtgactggcgagatggtcgaagaactgatcctcagcggggcagacataatcaaagtaggaattggccccggatcagtctgcaccacgagaaagaagacaggcgtagggtacccacagttgtctgctgttatggagtgcgccgacgccgcccatgggctgaagggacacattatctctgacggcggatgttcgtgccccggggacgtggccaaagccttcggggccggcgccgacttcgtgatgctaggcggcatgctcgcaggacattccgagagtgggggcgagctgatagagagggatggtaagaagtataaactgttctatggtatgtcttcggagatggccatgaaaaaatatgccggaggagtggcggagtatcgggcgagtgagggcaaaacagtggaagtgccttttaagggggacgtggaacacacaatacgcgacattctgggtggtattcggtccacctgtacctacgtcggcgctgctaagcttaaggagctgtcccgacgaaccaccttcatccgggtcacacaacaagtgaatcccatcttctccgaagcttgttag

SEQ ID NO: 119357 - DNA, 1047 bp, Artificial Sequence
  Description of Artificial Sequence: Synthetic coding sequence
atgcctcacattgataacgacgtcaagctggacttcaaagatgtgctcttaaggccgaagcgatccactttaaaaagtcggtccgaagtggacctgactcggagtttctccttccgcaatagcaagcagacctattctggggtccctattatcgccgccaatatggatacagttggcaccttcgagatggcaaaggtgctatgcaagtttagtctgtttaccgctgtgcataagcactatagtctggtgcagtggcaggaattcgccggccaaaaccctgactgcctggagcatcttgccgccagctctggaaccgggagttccgacttcgagcagctggagcagatcctggaggccatccctcaggtgaaatacatctgcctggatgttgccaatggatactccgaacattttgtggagtttgtcaaagatgtgcggaagcgtttcccccagcacaccatcatggcaggtaacgtggtgaccggcgagatggtggaggaactgatacttagcggcgccgacattatcaaggtgggtataggccctggctccgtctgcaccacaaggaaaaagactggagtaggataccctcagctgtctgctgtgatggagtgtgcggacgccgctcatggactgaaaggacatattattagcgatgggggctgctcgtgtcctggagacgtggccaaagctttcggtgctggcgccgattttgttatgctggggggaatgctggctggccacagcgagtctggaggcgagctaattgagcgtgatggaaaaaaatataaactattttatggaatgtcatctgaaatggcaatgaagaagtacgcaggcggcgtcgctgaatatcgagcctccgaaggtaagacagttgaagtgccttttaagggggatgttgagcacacgattagagacatcttgggcggaattcgtagtacatgtacatacgttggtgcagcaaagcttaaagaactcagccggcgaaccaccttcatacgagtgactcagcaggttaaccctattttcagtgaggcctgctag

SEQ ID NO: 119358 - DNA, 1101 bp, Artificial Sequence
  Description of Artificial Sequence: Synthetic coding sequence
atgacttcctgcttacccgcgcttcggttcattgccactcctcggctgtctgccatgcctcatatcgacaatgatgtgaaactggattttaaagacgtgctgctccgccctaaacggagcacactgaaaagcagatccgaggtcgacttaacccggagcttttcattcagaaacagcaagcagacctactccggagtcccaatcattgcagccaacatggatactgtgggtacctttgagatggcaaaagtgctctgcaaatttagtctttttactgcggtgcacaagcactatagcttggtccagtggcaagagttcgcgggccagaatcccgactgcctggagcacctggcggcctcctctggcaccggaagttccgattttgagcagctcgagcagatcctggaggctatcccccaagtcaagtatatttgcctcgatgtagcaaacggctactctgagcattttgtggaattcgttaaagatgtcagaaagaggttccctcagcatactattatggccggtaatgttgtaaccggggagatggtagaggagctgatattaagcggtgctgacataattaaggtgggaatagggcctgggtctgtgtgtactacacggaagaagactggtgtgggctacccccaacttagcgctgtgatggaatgtgccgacgccgcgcacggtttaaaggggcacataatcagcgatggaggttgctcctgtcctggggatgtggcaaaagccttcggtgcaggggccgatttcgtaatgttgggtggcatgctggccgggcactcagagtctgggggggagttaattgaacgagatggcaaaaagtacaaactcttttacggcatgtcttccgagatggccatgaagaaatacgcgggcggagttgccgagtaccgggccagtgagggcaaaaccgtggaggtgcctttcaaaggtgacgttgagcatacaattcgcgacattcttgggggaattaggtccacatgcacctacgtcggggccgcaaagctgaaggaactgtcaaggcggactaccttcattcgtgtaacccagcaagtgaatcctatttttagtgaggcctgctag

SEQ ID NO: 119359 - DNA, 1047 bp, Artificial Sequence
  Description of Artificial Sequence: Synthetic coding sequence
atgcctcacatcgataatgacgtgaagctggacttcaaggacgtgctgctgcgcccaaaacggagcactctgaagtcccgctccgaggtagacttgacccgcagcttttcctttcgtaactctaaacaaacctacagcggggttcctattatcgccgctaatatggacacggtcgggactttcgaaatggcgaaagttctctgcaagtttagtttgttcaccgcagtgcataaacattactcccttgtacagtggcaagaattcgcaggacagaacccagactgcctcgaaagcatttggttgcctgcacaggcccaggccctccttacactatcatcatggaataggagctggaagcttttcccccggaagtatatttgtttggatgtagctaatgggtattcagaacattttgttgagttcgtcaaggacgttcggaagcgctttcctcaacataccatcatggcagggaacgtagtgacaggggagatggtggaggagctcatacttagtggagcggacatcattaaagtggggattggtccagggtctgtgtgcaccactcgcaaaaaaactggtgtgggctatccccagctatccgccgtgatggagtgcgctgatgcagcccatggactaaagggacacattatttccgatgggggatgttcttgccctggtgacgtggcaaaagcattcggagctggcgccgatttcgtgatgctgggaggaatgctcgcaggccactccgaatctggcggcgaactaatagagagagatgggaaaaaatacaagctgttctatggcatgagctccgaaatggcaatgaaaaagtatgccggcggagtggcagagtaccgagcctctgaaggtaagaccgtggaggtcccatttaagggagacgtggagcatactatccgagatatcttggggggaatccggagcacctgcacgtacgtgggagctgcaaagctcaaggagctctctaggcgaacaacattcatacgggtaacccagcaggttaaccccattttcagcgaggcttgctag

SEQ ID NO: 119360 - DNA, 1047 bp, Artificial Sequence
  Description of Artificial Sequence: Synthetic coding sequence
atgcctcacatcgataacgacgtcaagctggacttcaaggacgtgctcttaagaccaaaacggtccactttgaagtctcgatccgaagtagacttaactagatcattcagctttcggaacagcaaacaaacatactctggcgttcctatcattgctgcaaatatggatactgtggggacattcgagatggctaaggtgttatgtaagttctcgctcttcaccgcagtgcacaaacattattctctggtgcagtggcaggaattcgccggacagaatccggactgcctcgagcacctcgcagcttcctctggtaccgggagctccgatttcgaacagttggagcaaatcttggaggccatcccccaagtaaagtacatctgccttgacgtcgcaaatggctactctgagcattttgttgagtttgtgaaggacgtacggaaacgattcccccagcataccatcatggccggaaacgtggtgacgggggaaatggttgaggagcttatcctctccggtgccgacatcatcaaggtggggattggcccaggttccgtctgtaccactcggaagaaaacaggcgtaggctatccccagcttagtgcagtgatggagtgcgccgatgccgcccacgggctgaaaggacacatcatctccgatggaggctgcagctgccctggcgacgtcgctaaggcttttggagccggcgccgatttcgtaatgctgggcggaatgctggcagggcacagcgagagtggcggcgaattgattgagagagatggcaaaaagtacaagctgttctacggcatgtcctccgaaatggctatgaagaagtatgccgggggcgttgccgagtatcgtgctagcgaaggaaagacagtagaggtgcccttcaagggggacgtggaacatacgatacgagacattctgggcggtatcaggtccacttgcacctacgtgggtgcggccaaactgaaggaattgtctcgccgtactacttttatccgcgtcactcagcaggtgaacccaatcttttccgaagcctgttag

SEQ ID NO: 119361 - DNA, 1779 bp, Artificial Sequence
  Description of Artificial Sequence: Synthetic coding sequence
atggccagcgagatccacatgacaggacctatgtgtttgatcgaaaatacgaacgggcgtcttatggcgaacccagaggccctgaaaatcctgtcagctataactcaaccaatggtggtggtcgctattgtcgggttgtaccggacagggaaatcctacttgatgaacaagctcgcaggcaaaaaaaagggattctcccttggcagcacagtccagtcccacaccaaaggaatatggatgtggtgcgttccacatcccaagaagcctggccacatcctcgtgctgctggacactgaaggcctgggggatgtggagaagggggataatcaaaatgattcctggatatttgccctcgctgtactactctctagtactttcgtgtataactccatcgggactattaaccaacaagccatggaccaactgtactacgtgacggagcttacacacaggattcgcagtaaaagttcacctgatgagaatgaaaacgaggtcgaggactccgctgacttcgtcagcttttttccagacttcgtgtggacactgcgggacttttccttagacctggaggctgacggacagccactgacccctgacgagtatctgacatactctctgaaactgaaaaaaggtacatctcagaaggacgagacgttcaatctccctcggctgtgtatccgaaagtttttcccaaagaagaaatgctttgtatttgacagacctgtgcacagacgtaagttagcccaactggagaagctccaggacgaagaattggacccggaatttgtgcagcaggtagccgacttctgctcatacatcttctcaaattccaaaaccaagactctcagcggcggaatccaggtgaacggcccccgcctcgagtcgctggtgctgacttatgtgaatgctattagctccggtgacctcccatgtatggagaatgctgttctggctctagcccagatcgaaaatagcgcggcagtgcagaaagctattgcccattatgagcagcagatgggccagaaggtccaattacctactgagaccctccaagaattgttagacttgcaccgggattccgagagggaggccattgaagtgttcatccggagctcatttaaggatgtggatcacttgtttcaaaaagagttggctgctcaacttgaaaaaaagcgagatgacttctgcaaacagaatcaggaagcgtcgagcgatcgttgctctgcactgttgcaggtgatttttagtccgctcgaagaagaggtcaaggcaggaatttattctaagcctgggggctacagattgtttgtgcaaaaactgcaggatcttaagaaaaaatattacgaagagccccgaaagggtatccaggctgaagagatcctccaaacttacttgaagtccaaggagagtatgaccgatgccatcctgcagaccgatcagactttaaccgaaaaagagaaagagatcgaggtagagcgggttaaggcggagagcgcacaggcctcagctaaaatgctgcaggaaatgcagcgaaagaacgaacaaatgatggagcaaaaggagagatcttatcaggagcatctgaagcaactgaccgagaaaatggaaaacgaccgtgtacaacttctgaaagagcaagagcggaccttagctctgaaattacaggagcaagaacaactactgaaggaaggctttcagaaagaatctcgcatcatgaaaaatgaaatccaggacctgcaaaccaagatgcggagacgaaaagcttgcaccatctcttag

SEQ ID NO: 119362 - DNA, 1668 bp, Artificial Sequence
  Description of Artificial Sequence: Synthetic coding sequence
atggtagtagttgcgatagtcggcctgtacagaaccggcaagtcttatctgatgaataagctggctggaaagaaaaaggggttctcgttaggaagtacagtgcagagccacaccaagggcatttggatgtggtgtgtgccacaccccaagaagcccggacacatcttagtgttgctcgatacagagggcctcggagacgtggagaagggagacaaccagaacgatagctggattttcgctttggctgtcctgttgtcctctactttcgtctataactcgattggaacaatcaaccaacaagcaatggaccagctttactacgtgacagagttaacacataggatcagaagtaagtccagtcccgacgagaatgagaacgaggtagaggatagcgccgacttcgtgagttttttccccgacttcgtctggactttgcgagatttctcactggaccttgaggcagatggtcaaccgcttacccctgacgagtacttaacttatagccttaaacttaaaaagggaacatctcagaaagatgagacattcaatctgccgcggctctgtatccgaaagtttttccccaagaaaaagtgttttgttttcgacaggcctgttcataggcgcaagctcgcccagttggagaaactccaggatgaagaacttgaccctgagttcgtgcaacaggttgccgatttctgtagctacatcttcagcaattccaagaccaaaacattaagcggcggaatccaagttaatgggcctcggctggagtcactggtgttgacctacgtgaatgcgatcagctctggcgatttgccttgcatggaaaacgccgttcttgctctcgcacagatagagaacagcgccgcagtccagaaggctatcgctcattacgagcagcaaatgggacaaaaagtgcagctccccacagagaccctgcaggaattgttagatctgcaccgcgattcagaacgcgaggctatcgaagtgtttattagaagtagctttaaggatgtcgatcacctgttccagaaagagttggcagcccagttggaaaagaagagagacgatttctgcaaacagaatcaggaagccagctccgatcggtgcagcgctttactgcaggttatcttcagcccattagaagaggaggtgaaagctgggatatactctaaaccaggggggtaccgcctgtttgtgcagaaactacaagatcttaaaaagaagtattatgaagagcccaggaaaggaatccaagcagaagagattctgcagacctacttaaaatctaaggagagtatgaccgacgcaattctgcagacagaccagaccttgaccgagaaagagaaggagatcgaggtagagagggtgaaagccgagagcgcccaagcctcagctaagatgctgcaggagatgcaaagaaagaacgagcagatgatggagcagaaagaaagatcctaccaggaacatctgaaacagctgacggaaaaaatggaaaacgaccgggttcaacttcttaaggagcaggaaaggaccttggccctgaagctgcaggagcaggagcaactgcttaaggagggctttcagaaggaaagcaggattatgaagaacgagatccaagacttgcagaccaaaatgcggcgaaggaaggcctgcactatctcgtag

SEQ ID NO: 119363 - DNA, 1776 bp, Artificial Sequence
  Description of Artificial Sequence: Synthetic coding sequence
atggcccccgaaatcaaccttcccgggcctatgtccctcatcgataacacaaagggacaattagtcgttaatccagaggccctcaagattttgtctgctataacccagccagtggtcgttgtcgcgatcgtcgggctctatcggactggaaaatcttacctgatgaataaactggccggcaagaaaaacggttttagcttgggcagcacagtaaaaagtcatactaaaggcatctggatgtggtgtgtgccccaccccaagaagccagagcacaccctggttctgctcgacaccgagggcttaggagacattgagaaaggagataacgaaaatgattcttggatttttgctctggccatcctgctaagctccactttcgtctacaattcgatgggaacaataaatcagcaggcgatggatcagctgcactacgtgaccgagcttaccgatagaatcaaggctaatagctccccagggaacaacagcgtagacgattccgcagactttgtgagttttttccctgcttttgtgtggaccctccgcgacttcacgctcgaacttgaggtcgacggcgagccaatcacagcggacgattaccttgagttgtcgttgaaattgagaaagggcactgacaagaagtcaaagagctttaatgaccctcgtctgtgcatcaggaagtttttccccaagaggaagtgctttgttttcgattggccagctccgaaaaaatacttagcgcacctggaacagctgaaggaggaggaactgaacccggacttcattgaacaggtggcagaattttgctcatacatcctgtctcattctaacgtcaaaaccctcagtggagggatcccagtcaacgggcctagactggagagtcttgtgctcacatacgttaatgcgattagcagcggggatctgccctgcatggaaaacgctgtgctggccttggcccagatcgagaattccgcggctgtggagaaggccattgcgcactatgaacagcagatgggccagaaggtacagctccctacagagacactgcaagaacttctggacctgcaccgggattctgagagagaggcaatcgaagtgttcatgaagaactccttcaaggacgtggatcagatgttccagcggaagcttggagcccagctggaagcccgacgtgatgatttttgcaaacagaacagcaaggcctcttccgactgttgcatggcactgctgcaggacatattcggccctctggaggaggacgttaaacagggtaccttcagcaaaccgggtggttaccgcctgtttactcagaaactacaggaattgaaaaataagtattaccaggtacccagaaagggaattcaggccaaagaagtgttgaaaaaatatttggagagtaaagaagacgtggctgatgccctgctgcaaacagaccagtccttgagcgagaaggaaaaagctattgaagtagaacgaatcaaggctgaaagtgctgaagcggcgaagaagatgctggaagagatccagaagaagaacgaagagatgatggagcagaaggagaaaagttatcaagagcatgtgaagcagctgaccgagaagatggaacgggaccgtgcacagctgatggcagagcaggagaagacactagctctgaaattacaggagcaggagcggctcttaaaggagggctttgaaaacgagagtaagagacttcagaaggatatctgggacatccaaatgcggagtaagtcgttggagcctatctgtaatatcctgtag

SEQ ID NO: 119364 - DNA, 1776 bp, Artificial Sequence
  Description of Artificial Sequence: Synthetic coding sequence
atggccccagagatcaatctacccggacctatgtctctaatagataatacgaaagggcagctggttgtgaaccccgaggcccttaaaatcctgagcgcgatcacccagccagtggtggtggttgctatcgtaggtctgtacagaactggcaaatcttacctcatgaataagcttgcgggaaagaaaaatggtttctccttggggtccaccgtaaaatcccacacgaaaggcatatggatgtggtgcgtcccacacccaaagaaacccgaacacacactggttctactagacacggagggactgggggacattgagaaaggagataacgagaacgattcatggatctttgccctagcgatcttactcagctccactttcgtctacaacagcatgggcaccatcaatcaacaggcaatggaccagctgcactatgtgacggagcttacagatcgcatcaaagccaacagctcacccggtaacaacagtgtggatgatagcgcggactttgtgtccttcttccctgcctttgtttggacactccgagacttcaccctcgaactagaagtggacggagaacctatcactgccgacgactacctggagctctcgctgaaactaaggaaggggaccgacaagaagtcgaagtcctttaatgatcctcgcctgtgtataagaaagttttttcctaaacggaaatgtttcgtgtttgattggccagccccgaaaaaataccttgcccaccttgaacagcttaaagaggaagaactgaaccctgacttcattgaacaggtggccgagttctgctcatacattctaagccactctaacgtgaaaactctcagcgggggcatcccagtgaacggcccgaggctcgaatccctcgtgctgacatatgtcaacgccatcagctccggggacctgccatgtatggaaaacgcagttctggcactagcgcagattgaaaactctgcagcagtggagaaggcaatcgcacactacgaacagcagatgggtcagaaagtgcaactgcctactgagaccctgcaggagctgctcgacctccacagagattccgaacgggaggctattgaagtgttcatgaagaattcctttaaggatgtggaccagatgtttcaaaggaagttgggagcccagctggaggcaagacgagacgacttctgcaagcagaacagtaaagcctctagcgattgttgtatggctctgctgcaggatattttcggccctttagaggaggatgtaaagcaaggaactttctcgaaacccgggggataccggctgttcactcagaaactgcaggagctaaagaacaaatactaccaggtgcctaggaaaggaatccaggcaaaagaggtgttgaaaaaatatctggagtcaaaggaagacgtggccgacgccctgcttcagactgaccaatcgctgagcgaaaaagagaaagctatcgaagtggaacggattaaggctgaatctgccgaggccgcaaagaagatgctggaggagattcagaagaaaaatgaagagatgatggaacagaaggaaaagtcctaccaggagcatgttaagcagctgacagagaaaatggagcgcgaccgggcccagttgatggccgaacaggagaagacactagctctaaagctgcaggagcaggaacggttgttaaaagaaggatttgagaacgagagcaagaggttacaaaaagacatatgggacattcagatgcgatctaagagccttgaacctatctgcaacatactgtag

SEQ ID NO: 119365 - DNA, 1323 bp, Artificial Sequence
  Description of Artificial Sequence: Synthetic coding sequence
atggcgcctgaaatccatatgacaggccctatgtgcctgatcgaaaatacaaacggtgagctggtggctaacccggaagcattaaagattctgagcgccattacacaaccagtggtggtggtagccatcgtcggcctctatagaaccggaaagtcctatttgatgaacaagcttgccggcaagaataagggcttttctctgggttcaacagttaaatctcatacaaaagggatttggatgtggtgtgtaccgcaccctaagaagcccgaacatacactggtgctcctggacacggagggactgggagatgtgaagaagggtgacaaccagaacgattcatggatttttactcttgccgtgctgcttagttccacgctcgtatataacagcatgggtaccattaaccagcaagccatggatcagctctattatgtaacagaactgacccaccgaatacggtccaagagctctccagacgagaatgaaaacgaagatagtgcagactttgtgagcttctttcctgattttgtctggactctgagagatttttctctggacctggaagctgacggccagcccctgacacctgacgagtatctggaatatagcctaaagttgacacagggcacaagccaaaaggataaaaacttcaatcttcccaggctgtgcatcagaaagttttttcccaagaaaaagtgcttcgtgtttgacctgcctatccacagaaggaaactagcccaacttgagaagttgcaggatgaggaactcgaccccgaattcgtgcagcaagtagctgacttttgttcttacatcttctctaactccaagactaagacactctctggtggaatcaaggtcaatgggcctcgccttgagtcgctcgttctgacctacattaatgcgatttctcgcggagatctgccatgcatggagaacgccgtgctcgcattagcgcaaatcgagaactctgctgctgtgcagaaagctatcgcacattacgaccagcagatggggcagaaggttcagcttcctgccgagacattacaggagctgctggacctgcaccgggtcagcgaacgcgaggctacagaagtctacatgaaaaactcctttaaagacgtggaccacttgtttcaaaagaagctcgctgctcagttggataaaaagcgtgacgacttttgcaaacagaatcaagaggcctcttccgatcgatgtagtgcgcttctccaggtcatatttagtccgttagaagaagaggtgaaagcagggatctacagtaagcccggagggtattgcctgtttatacaaaagttgcaagattag

SEQ ID NO: 119366 - DNA, 1788 bp, Artificial Sequence
  Description of Artificial Sequence: Synthetic coding sequence
atggctcccgagatccacatgaccgggcctatgtgcctgattgaaaatactaacggcgaactggtggccaatccagaggctctgaagatactgagcgccatcacccaacctgtggttgtggttgcgattgtgggtctataccgcactggcaagagttatctcatgaacaaactggccggtaaaaataaagggttctccctgggatctaccgtgaagtcccacacaaaaggcatttggatgtggtgcgtgccacatcctaagaagcctgaacacaccctcgtgctgcttgatacggagggactgggtgacgtcaaaaagggagataatcaaaatgactcctggatatttaccctggcagtgcttttaagttctaccctcgtctataattctatgggcacgataaaccaacaggctatggatcagctgtattacgtgaccgagttgacccataggatccggtccaagtcttctcctgacgagaacgagaatgaagacagcgcagattttgtctcattctttccagatttcgtgtggacactgagggacttttccttagacttagaagcagacggccagccacttactccagacgaatatcttgaatactccctcaagttgacgcaggggacgagccagaaggacaaaaactttaatctcccgaggctttgtatcaggaaattctttcctaagaagaagtgtttcgtgttcgatctgccaattcacagacgaaaactggcccaactggagaaactgcaggatgaggagcttgatcccgagttcgtccagcaagtagcggatttttgcagttacatcttttctaactcaaagacaaaaactctgtccggtgggattaaggttaatggaccacgcctcgagtccctggtgctcacatacatcaacgcaatctcgcgtggcgatctcccttgtatggagaacgcagtgctggcactggctcagatcgagaattctgctgccgtacagaaagccatagcacattatgatcagcaaatggggcaaaaggtccaactgccagccgagactcttcaggaactcctggatctgcaccgggtttcagaacgcgaggccaccgaggtttatatgaagaactccttcaaagacgtagaccatttatttcagaagaaattagccgctcagttagacaaaaagcgggacgatttctgcaagcagaatcaagaggcgagctctgatcgctgtagcgccttactgcaggtgattttctcacccctcgaggaagaagtcaaagcgggcatttactctaagccagggggatactgtcttttcattcagaagctgcaagacctcgagaaaaaatattacgaagagccacgcaaggggatccaggctgaggagatactccagacttacttgaagagtaaggaaagcgtgaccgatgccatcctgcaaactgatcagatcctgaccgagaaggaaaaggagatcgaagttgagtgcgttaaagccgagagtgctcaggcatccgccaagatggttgaggagatgcagattaagtaccagcaaatgatggaagagaaagagaaatcgtaccaggaacacgtcaagcaattgacagaaaaaatggagcgggaacgtgcacaacttctggaggaacaggaaaagaccttgacatctaaactccaggagcaggccagagtcttgaaagagagatgtcagggggagtccactcagctgcagaacgaaattcagaaactgcaaaagactttgaagaagaagaccaaacggtatatgtctcacaaactgaagatttag

SEQ ID NO: 119367 - DNA, 1692 bp, Artificial Sequence
  Description of Artificial Sequence: Synthetic coding sequence
atggcgcccgagattcacatgaccggccccatgtgtctcattgagaataccaatggcgagctcgtcgcaaacccggaagcattgaagattttgtccgctattacccagcctgtggttgtagtggccatcgtgggtttgtaccgcaccggcaaaagttaccttatgaacaagctagcaggaaaaaacaagggattttctctgggatctaccgtcaaaagtcataccaaagggatctggatgtggtgcgttcctcatcccaaaaagccggagcatacactcgtgctgctcgacacagaaggcttgggcgatgtcaaaaagggcgacaatcagaacgattcctggatattcacactcgccgtgctgctctcatcgactctggtgtacaatagtatggggactatcaaccagcaggcgatggatcagctgtactatgtgactgagcttacacatagaatcagatcgaagagctccccagatgagaacgagaatgaagattctgccgatttcgtgtccttcttccccgactttgtctggactttaagggatttttctcttgatcttgaggccgatgggcagcctctgacccccgacgagtacctggaatactcactaaagctgacacagggcaaccgcaagttggcacagctcgagaagcttcaggacgaagagctggaccccgagttcgttcaacaggtcgctgatttttgcagttacatcttttcaaattcaaagactaaaaccttatcgggcggcatcaaagtgaacggcccacgtcttgagagccttgttctcacatatataaatgctatttctcgcggagacttaccttgcatggagaatgccgtattagcactcgcccagatagaaaattccgccgcagtacaaaaagctatcgctcactacgatcaacagatgggccagaaggtacagcttcccgcggagactcttcaggaacttctggaccttcatagagtgagtgaacgggaagccacagaggtgtacatgaagaactccttcaaggacgtggaccatctctttcagaaaaagctggccgcacaacttgataagaagagagatgacttctgtaaacagaatcaggaagcctctagtgacagatgtagcgctctcctccaggtgatcttcagtcccctggaagaggaggtgaaagccgggatttacagtaagcccggcggctactgccttttcatccagaaacttcaggacctggaaaagaaatattacgaggagcccagaaaaggcatccaggcggaggagatccttcagacctatctgaaatccaaggagtcagttacagacgccatcctgcagactgaccagattctgacggaaaaggagaaggagatagaggtggagtgcgtgaaggccgaaagcgcacaagcttctgctaaaatggtcgaagagatgcagattaagtaccaacagatgatggaggaaaaagagaagtcctaccaggagcatgttaagcaactgactgaaaagatggagcgggagagggctcagctactggaggaacaagagaagaccctcactagtaaattacaggagcaagcgagagtcctgaaagagagatgccaaggcgaaagcacgcagctgcagaatgagatacaaaagctccagaagaccctgaagaagaaaaccaagaggtatatgtctcacaaactcaagatctag

SEQ ID NO: 119368 - DNA, 414 bp, Artificial Sequence
  Description of Artificial Sequence: Synthetic coding sequence
caggacgaagaactggatcccgagtttgtgcaacaagtcgctgacttttgttcttacatcttttccaactctaagacaaagaccttatccggtgggatcaaggcagaggaaatcctacagacatacctgaagtctaaggagtcagtgaccgatgcaatcttacagacggatcagattttgaccgaaaaggaaaaggaaatcgaggtggagtgcgttaaagccgaaagcgcccaggcctccgccaagatggtggaggagatgcagatcaaataccaacagatgatggaggaaaaagagaagagttatcaggagcatgtaaagcagcttaccgagaaaatggaacgcgagagagcccagctgctggaggaacaagaaaaaaccctgacatccaaattgcaagtgtctaagtgctag

SEQ ID NO: 119369 - DNA, 1923 bp, Artificial Sequence
  Description of Artificial Sequence: Synthetic coding sequence
atgggcgagcgcactctccacgcagctgtgcctacaccagggtaccccgagtccgagtcgatcatgatggcccctatctgtcttgtggagaatcaagaagaacagctcactgtgaatagtaaggctttggaaatcttggataaaatttcacagccagtagtagtggtggccatagttggcctgtatagaaccggtaaatcctatttaatgaaccgtttagcagggaagagaaatggttttcctctggggtcaacagtgcaatccgaaaccaaagggatatggatgtggtgtgtgccccacctgagcaaacctaaccatacccttgtgctgctggacactgagggtctaggtgatgtggaaaagtccaacccaaagaacgattcctggatattcgccttggctgtcctgttatcttcctccttcgtgtataattccgtcagcacgattaatcatcaggccctcgaacagctccattacgtaaccgaattggccgaattgatcagagccaagtcttgtccacgccccgacgaagctgaagactctagcgaattcgcctcattcttccctgactttatctggactgtgcgagattttactctggagctcaagcttgatggcaacccaataacagaagatgaatatctcgagaatgccctgaagctaatcccaggtaagaacccaaagattcaaaacagcaatatgcccagagaatgcataagacacttcttcaggaaacggaaatgcttcgtgtttgatcgacccactaatgacaagcaatatctcaatcacatggacgaggtgcccgaggagaatctggagaggcatttccttatgcaaagtgataatttctgttcatatatcttcactcacgccaaaacaaagacactgcgagaagggattatagtaactggtaagcggctagggacgctggtcgttacttacgtggacgccattaattccggcgctgtcccctgccttgagaatgcagttaccgccctagcccagttagagaatccagcagccgtccagcgcgctgccgatcactactcccagcagatggcgcagcagctgcggctgcccacagacacactccaggagctgctggacgtccacgcagcatgcgagagagaagcaatagcagtgttcatggaacactcctttaaggatgaaaatcatgagtttcaaaagaaactggttgacactatagaaaaaaaaaagggagatttcgtgctccaaaacgaggaagcctctgcgaagtattgccaggccgaactcaaaaggttatcagaacatctgactgagagcatccttcgcggtatctttagtgtgcccggcggccacaatctgtacctggaggaaaaaaaacaggtggagtgggactataagcttgtcccccggaaaggtgtcaaggccaatgaagtcctgcaaaacttcctgcagagtcaagtcgtagtggaggagtccatccttcagtccgacaaagctttaaccgccggagagaaggctatagctgccgagcgggccatgaaggaggcggctgagaaggaacaagagctgctgagagaaaaacaaaaggagcaacagcagatgatggaggcccaggagcgtagtttccaggagtacatggctcagatggagaaaaaactggaggaggagcgggaaaacctgctccgtgagcatgaaagactgctgaagcacaaacttaaagtccaagaggaaatgcttaaggaggaattccagaagaagtctgaacagctgaacaaggaaatcaatcagctgaaggagaaaattgaatcaacaaaaaacgagcagctgcgcctgctgaaaattctggatatggccagtaacataatgatcgtgacacttcccggggctagtaaactgctgggtgtgggcaccaagtacctgggctcacgtatttag

SEQ ID NO: 119370 - DNA, 1761 bp, Artificial Sequence
  Description of Artificial Sequence: Synthetic coding sequence
atggccctggagatacatatgtctgacccaatgtgcctgatagaaaattttaacgaacagctaaaggtcaaccaggaggctctagaaattctgagcgccattacacagcccgtggtggtggtagctatcgtggggctttatcgcaccgggaagtcatatctgatgaacaagttggccgggaagaacaaaggcttttctgtggccagtacggtgcaaagccacactaaggggatttggatatggtgcgtcccccaccctaattggcctaatcacactctggtcttacttgacacagagggcctcggcgacgtggagaaggcagacaacaagaatgatattcagatttttgcacttgccttgttactaagttccacatttgtgtacaacacagtgaacaagatcgatcagggagcaatcgaccttctgcataacgtcactgagctcacagatctgttgaaggctcggaattcgccagacctcgacagggttgaggatccagccgactccgcttcattcttccccgacttagtctggacactacgcgacttttgtctgggcctcgaaatagacggtcagctcgttacgcccgacgaataccttgaaaactctttgagacccaagcagggatccgaccagagagtgcagaattttaatctgccgaggctgtgtatccaaaaattcttcccaaaaaagaagtgttttattttcgatctcccagcacaccagaagaaattggcacagctggagacactgcctgacgatgagttggagcctgagttcgtgcagcaggtgacagagttttgctcctatattttctcgcactctatgacgaaaaccctgcctgggggtatcatggttaacggcagccgcctgaaaaatctggtgctcacatacgtaaacgccatcagttcaggagatctgccatgcattgagaacgccgtgctagcactggcgcagcgagagaactccgccgccgttcagaaagcaattgcacactatgatcagcaaatgggacagaaagtgcagctcccaatggaaacattgcaagaactgctggacctgcataggaccagcgaacgcgaggctatagaggtttttatgaaaaatagtttcaaggacgtcgaccagtcctttcagaaggaactcgagacattgctagatgccaagcagaatgacatttgcaagcgaaaccttgaagccagttccgattattgttctgcactcctgaaagatattttcgggcctttggaggaggcggtgaagcagggaatttattccaaacccggcggccacaacctgtttattcagaagacagaggagctcaaggccaaatactatcgggaaccgcggaaaggcatccaggcagaagaagtccttcagaaatacctgaaaagcaaagaaagcgtaagccacgccattctgcaaaccgaccaggccctgactgagaccgaaaaaaagaagaaggaggcccaagtgaaggctgaagccgagaaggctgaggcccagaggctcgccgcgatacagcgacaaaatgaacaaatgatgcaggaaagggagcggctgcatcaagaacaggtcaggcagatggagattgccaaacagaattggctcgctgagcagcagaagatgcaagaacaacaaatgcaggagcaggccgctcaattaagcactacatttcaggcccagaataggagtctgctaagtgaactgcagcatgctcagcgcacggtgaataatgacgacccatgtgtgcttctctag

SEQ ID NO: 119371 - DNA, 1761 bp, Artificial Sequence
  Description of Artificial Sequence: Synthetic coding sequence
atggcattggagatccacatgtcagacccgatgtgcttgatcgagaacttcaacgaacagttaaaggtgaatcaggaggcattggagatcctctctgctattacacagcccgtggtggtggtggcaattgttggcctgtacaggactggaaagagctacctgatgaacaaactggccgggaagaacaaagggttcagtgtagcttctaccgtgcaatcgcacactaaggggatttggatctggtgcgttccgcatccgaattggccaaaccacacactcgtgctgctggatacggagggcctgggcgacgtcgagaaggctgacaacaagaacgacattcagatcttcgcgctcgccctcttgctgtcctctaccttcgtctataatacagtaaacaagattgaccaaggcgccatagatctgctgcataacgttaccgagctcactgatctcttgaaggctcgcaattctcctgatttggatcgagtggaggacccagcggatagcgcatcgttttttccagatctggtttggacactgagagatttctgcctggggttagaaattgatggacagctggtaacccctgacgaatatctggagaattccctccggccaaaacaaggctccgaccagcgggtacagaattttaatcttccacgcctgtgtattcagaaatttttcccaaagaaaaagtgttttattttcgacctaccggcccaccagaaaaagctggcccagcttgagactctgcccgacgacgagctcgagccagaattcgtgcagcaggtcaccgaattctgttcctatatcttttctcattcgatgaccaaaacgttgcctgggggcatcatggtgaatggtagtagactgaagaacttggtgcttacttatgtgaacgccatctcgtcaggcgacctgccttgcatcgagaatgcggtgttagctctagcccagagagagaattcggctgctgtccagaaggcaatcgcacactatgatcagcaaatgggccagaaggtgcagctccctatggagaccctgcaggaactgctcgacctgcatagaacttctgagcgagaggccattgaagtctttatgaagaactcttttaaggacgtggatcaatctttccagaaggagctggagaccctgctggacgccaagcagaatgatatctgtaagcggaacctggaggcctcctcagattactgtagtgcgctgcttaaggatatcttcgggcctctcgaggaagcagtgaagcaaggcatctacagtaagcccggcggccacaatctctttatccagaaaacagaggagctcaaagctaagtattacagagaacctcgcaaagggatccaggctgaagaagtgttacaaaagtatctcaagagcaaagaatcagtttcacacgccatcctgcagactgatcaggccttgactgagaccgaaaaaaagaagaaggaagctcaggtcaaagccgaggccgaaaaagcagaagctcagcggcttgctgccatccagcggcagaatgagcagatgatgcaggagcgggagcgtctccaccaggagcaggtgcggcagatggagattgccaagcagaattggctcgcggagcaacagaagatgcaagagcaacagatgcaggagcaagcggcccagctcagtaccaccttccaggctcaaaatcgaagtttactgtcggaattgcagcatgcccaacgcaccgttaataatgacgatccttgtgtactcctgtag

SEQ ID NO: 119372 - DNA, 1452 bp, Artificial Sequence
  Description of Artificial Sequence: Synthetic coding sequence
atggcgttagaaatacacatgagcgatccaatgtgcctaatcgagaactttaacgaacagctaaaagtaaaccaggaggccctagagatcctctccgcaattacacagcctgtcgtggtcgtggcaattgtggggctgtacaggacgggtaagtcatacctgatgaataagttagccgggaaaaacaaaggtttcagcgtcgccagcactgtgcagtcccatacaaagggaatatggatatggtgtgtacctcaccctaactggcccaaccacacccttgtattgctggacacggaaggtctaggcgatgtagaaaaagctgacaacaaaaatgatattcagatctttgctttggctttgctcctgagcagcacatttgtgtataacactgttaacaagatcgatcagggcgccattgacctcttgcacaatgtgaccgagctcaccgatctcctcaaagccagaaattcccctgacctcgaccgggtggaggacccagccgatagtgcatcgttttttcctgacttagtctggactctccgggatttctgcctcgggttggaaatagatggccagctcgttacaccagatgaatacttggaaaacagcctcagaccgaagcagggatccgatcagcgggtccagaatttcaatttgccacggctgtgcatccagaaatttttccccaaaaagaaatgtttcatcttcgatttgcctgcccaccaaaagaagctggcccaattagagactctgcccgacgacgagctggaaccagaattcgttcaacaggtaacagaattctgctcgtacatttttagccacagcatgaccaaaaccctgccagggggaattatggtgaacggttcacggctcaagaacctggtcctgacatatgtgaacgccatcagtagcggcgatctgccatgcattgaaaatgctgtgttggcgctagcgcagcgagagaactcagcagcagtgcagaaggctatcgcccactatgatcaacaaatggggcaaaaggtgcagctcccgatggagacactgcaagaattactcgacctgcaccgcacaagcgagcgggaagccatagaagtctttatgaaaaacagcttcaaggacgtagaccagtcctttcaaaaagaactggagacgctgctcgacgccaaacagaatgatatctgcaagcggaatttagaagcttctagcgattactgctcagccctgctgaaggatatctttgggcctctggaggaggccgtaaagcaaggtatttattcaaagccaggcggccacaacctcttcatccagaagacagaggaactgaaggcaaagtattacagggaaccccggaagggcatccaggcagaggaagtgcttcagaaatatctgaagagcaaggagagtgtctcccatgccatactgcagaccgatcaggccctgacagagacttag

SEQ ID NO: 119373 - DNA, 1917 bp, Artificial Sequence
  Description of Artificial Sequence: Synthetic coding sequence
atggcctctgaaattcatatgccagggcccgtgtgcctgacagagaatactaaagggcacctagtagtgaacagcgaggccttggagattcttagtgcgataacccagcctgtggtcgtcgtggctattgttggactgtatcgcacaggaaaaagttacctgatgaataaattggccggaaaaaacaagggttttcccctggggtgtacagtgaagtccgagacaaaaggtatctggatgtggtgcgtgccccacccctccaaacctaaccacacattgatccttctagacacagagggcctgggcgacatggagaagagcgaccctaaaagcgatagctggatctttgcgctcgccgtactgctcagcagttctttcgtgtacaattctatgggaacgattaatcatcaggccctggaacagctccactacgtgacagagctcactgaactaattcgcgcgaaaagttgtccccgacccgatgaagtagaagactcctctgaattcgtaagctttttccctgactttatttggaccgtgagagattttacccttgaactgaaactcgatggccaccccattaccgaggacgagtatctggaaaatgctcttaagttgatcagcggtaagaatccacagatccagaacagcaataagcctcgagaatggattcgccacttcttccctaagcagaagtgctttgtattcgacaggcctattaacgataagaagctactgcttcatgtcgaggaggtgagagaagatcagttagattccaatttccagatgcagagcgagaatttttgttcatatatcttcacacacgctaagactaagacactgagagagggcattcttgtgactggcaatagactgggcatgttggtggagacctatcttgacgcaatcaatagcggcgcaactccatgcctcgaaaacgccatggcagttctggctcagtgtgagaatagcgcggccgtgcagcgtgctgctaaccactactcacagcagatggcacagcaggtgagattccccactgatacactacaggagcttctagatgttcacgcggtctgcgagcgggaggctatagccgtgttcatggagtattctttcaaagacaagtctcaggagttccaaaagaaacttgtcgatacgatggagaaaaagaaagaagattttgttctacaaaacgaggaagccagcgctaaatactgccaagccgagttaaagcgcctctctgagctgctcacggagagcattagcagaggcaccttctttgttcccggcggacacaatatatatttggaggccaaaaagaaaatcgaacaggactacacactggttccacgaaaaggagttaaagccgatgaggtgctccaaagcttcctccagtctcaggtggttatcgaagagtccatcctgcagtccgataaggcattgactgcaggcgaaaaggcaattgctgcaaagcaggcgaaaaaagaggccgccgagaaggaacaggaactgctgaggcagaagcagaaagagcagcagcaaatgatggaggcccaggagagatcattccaggagaacattgcccaactcaagaaaaaaatggagcgggagagagagaattatatgagagagttacggaagatgttatctcataagatgaaagtgctggaggagctgctgacggaagggtttaaggaaatctttgagtcgctgaatgaagaaatcaacaggctcaaagagcaaatcgaagcggccgaaaacgaggagcccagtgttttctctcaaattctcgatgtggccgggtcgatcttcatcgcagcgctccctggcgcagcgaaacttgttgatctcggcatgaagattctgtcctccctgtgtaatcgtttaagaaacccaggcaagaagataattagctag

SEQ ID NO: 119374 - DNA, 1902 bp, Artificial Sequence
  Description of Artificial Sequence: Synthetic coding sequence
atggaatctgggccaaagatgctagccccagtttgccttgtggagaataataacgagcagctgttagtgaaccagcaggccatccagattctagagaagatctcccagccggtggtggttgtggcaattgtgggactttacaggaccggaaaatcttacctgatgaatcacttggcaggtcagaatcatggcttccctctgggtagtaccgtgcaatccgagacgaagggcatctggatgtggtgcgtccctcaccccagcaagccaaatcataccctggtactactggacactgaagggctgggggacgtagagaagggggaccccaagaacgacagctggatttttgcccttgccgtactcttatgctccacctttgtctataacagtatgagtacaattaaccaccaagccctggagcagctgcattacgtcacggaattaacagagctaatcaaagccaagtccagtccgcgacccgatggcgtagaagatagtactgaatttgtgtcattcttccctgacttcctgtggacagtgcgcgacttcacactagaactcaaactgaatgggcatcctattacagaagacgagtatcttgaaaacgccctgaagttgatccaaggaaacaaccctagggtgcaaacgagtaattttccacgcgaatgcattaggaggttttttcctaagcgaaaatgttttgttttcgaccggcccaccaacgacaaggacctgttagcaaatattgaaaaagtgagcgagaaacagctggacccgaagttccaggagcaaactaatatattctgttcctacatttttacgcacgctcggacaaagacactccgggaagggatcaccgtcaccggaaatagattgggtacgctggccgtgacatatgtggaggccatcaacagcggggctgtcccatgtctcgagaacgctgtaataaccctggcccagagagagaacagtgcagccgtccagcgcgctgccgactactactcccagcaaatggcccagcgcgttaagttgccaaccgatactcttcaagagcttctcgatatgcacgccgcgtgtgagcgggaagctatagccatcttcatggagcactcctttaaggatgagaaccaggaatttcagaagaagtttatggagacgacaatgaacaagaagggcgacttccttctgcagaacgaagagtcatctgtgcagtactgccaggccaagctcaacgaacttagtaaaggccttatggagtctatatcagctggcagtttcagtgttcctgggggtcacaaactgtacatggagaccaaggaaagaatagagcaggactactggcaagtaccgcgaaaaggagtaaaggctaaggaggtgtttcagcggttccttgagtcccagatggttatcgaggagagcatcttgcagagtgacaaggccctcacagatcgagagaaagctgtagccgtggatcgcgcaaagaaagaggcagccgaaaaagagcaggaattgctaaagcagaaactccaagaacagcagcagcaaatggaggcccaagacaagtctagaaaggagaacatagctcaactgaaagaaaaactacaaatggagagggaacacttgctgcgagagcagataatgatgcttgaacacactcagaaagttcaaaacgactggctgcacgaaggctttaagaaaaagtatgaggaaatgaacgccgagatttcgcagtttaagaggatgatcgacactaccaagaatgacgatactccttggattgcacggactctggacaatctcgccgatgaattgacagctatcctgtctgctcctgctaagctcatagggcacggcgtgaagggagtgtccagcctgttcaagaagcacaaattgcctttctag

SEQ ID NO: 119375 - DNA, 1512 bp, Artificial Sequence
  Description of Artificial Sequence: Synthetic coding sequence
atgtccaccataaatcaccaggccctcgagcagttgcactacgtgacagaactaactgagctgatcaaggccaagtcttcaccaaggcccgacggggttgaggactcaacagaattcgttagcttttttccggactttttatggaccgtgcgtgatttcactctagaactgaaacttaacgggcatcctatcacagaagacgaatatcttgaaaacgcccttaagctgatacagggcaataatccacgcgtgcagacctcaaatttcccccgcgaatgcattcgccgattttttccaaaacggaaatgctttgtattcgaccgccccacgaacgacaaagacctactggcaaatatagagaaggtgtcagagaagcagttagaccccaagtttcaagagcagacaaacatcttttgcagttatatcttcactcacgcccgtaccaagacactgagggaagggattacagtgacgggcaaccggctgggtaccctggccgtgacgtatgtcgaggccatcaactccggtgccgtaccttgtctggagaacgccgtcatcacgctggcgcagcgggaaaatagcgcggctgtgcaaagagccgcagattactacagccagcaaatggcacagagggtgaagttgcctactgataccctgcaggaactcctggatatgcatgctgcatgcgagcgggaggctatagctatttttatggaacactcatttaaggacgagaaccaggagtttcagaaaaaattcatggagaccaccatgaacaagaagggagattttctgcttcagaatgaagaatcttccgttcagtactgtcaagcaaagctgaacgagctttcaaaagggttgatggagagcatttctgcaggcagctttagtgtgcccggcggccacaaactgtacatggagactaaggaacgcattgagcaggactattggcaggttccgaggaagggagtaaaagctaaagaggtattccagaggtttctagagagccagatggttatcgaggaaagtattctgcagagcgacaaggctctgactgatagagagaaggccgttgccgtcgatagagctaagaaagaagctgctgagaaagaacaggaactccttaagcaaaaacttcaggaacagcagcagcagatggaagcccaggataagagccgaaaggagaacatcgctcaactgaaggaaaaactgcaaatggaaagggaacatctgctgcgcgagcagattatgatgttagagcacacacaaaaagtgcagaacgactggctacacgagggctttaagaaaaagtacgaagaaatgaatgccgaaatctcccaattcaagaggatgatagacacaacaaaaaatgatgataccccatggattgcccgtaccctggacaacctggcagatgagctgactgcgattctctcagcacccgctaaactaatcggccacggagtgaagggcgtgagcagcctcttcaaaaaacataaattgccattctag

SEQ ID NO: 119376 - DNA, 1815 bp, Artificial Sequence
  Description of Artificial Sequence: Synthetic coding sequence
atggagtctggccctaaaatgctagcaccagtgtgtctggttgagaacaacaatgagcagttactcgtcaaccagcaagccattcaaattctggagaagatatctcagcctgtggtggttgtggcgatcgtggggctctacaggacgggcaaaagctacctcatgaatcatttggctgggcagaaccatggctttccactggatacagagggactgggagacgtcgagaagggggacccaaaaaatgactcgtggatatttgctcttgctgtactactgtgttcaaccttcgtctataatagtatgagcacaattaaccaccaggccctggaacagttacattatgtgaccgaactgacagagcttattaaggcaaaaagtagcccccgcccggatggagtggaagattctactgagttcgtctctttcttcccagactttctctggactgtgcgcgacttcacacttgagctgaaactcaatggacacccgattaccgaggacgagtacctggagaacgctctgaagctgattcaaggtaacaatccaagagtgcagacctcaaactttcctcgggaatgtatacgtcgctttttcccaaagaggaagtgctttgtcttcgatcgaccaactaacgacaaagatcttttggccaacatcgaaaaagttagcgagaaacagttggatccaaagtttcaggagcagacgaacatcttttgctcatatattttcacacatgctaggacaaagaccctgcgggaaggcatcacagtgactgggaatcgcctgggtactcttgctgtgacatatgtggaggcaattaacagcggggctgtaccctgcttggagaatgctgtcattaccctggctcagcgggagaactctgcagccgtgcagcgggcggcagattattactcacagcaaatggcacagcgggtgaaactccccacagatacgctacaggaactgctcgacatgcacgccgcgtgtgagcgcgaggctatcgccatcttcatggaacactcttttaaagatgaaaaccaggaattccaaaaaaagttcatggaaacaactatgaataagaagggggattttctgttgcaaaacgaggagtccagcgtgcaatactgccaggctaaattaaatgaattgtctaagggactaatggaatccatatctgcaggatccttttctgtgcctggcggacataagctgtatatggaaactaaggaaagaatcgagcaggactactggcaggtcccacggaaaggcgtcaaagctaaagaggtgttccagcgtttcctggagagccagatggttatcgaggaaagcatattacagtcagacaaagcgttgactgaccgtgaaaaggcagtggcggtagatcgggcgaaaaaggaagcagcagagaaggagcaggaactactaaagcaaaagctgcaggagcagcagcagcaaatggaagcgcaggacaaaagtcgcaaggagaacattgctcagctcaaggaaaaactgcagatggagcgtgaacacctccttagagagcagattatgatgctggagcacacacaaaaagttcagaacgactggttacacgaggggtttaaaaaaaaatatgaggagatgaacgccgaaattagtcagtttaagcggatgatcgataccaccaaaaacgatgataccccatggattgcaaggacccttgataacctggctgacgagctcaccgccattctgagcgcgcccgcgaaactcataggacatggcgttaagggcgtgtccagcctgtttaagaagcataagttacctttctag

SEQ ID NO: 119377 - DNA, 1299 bp, Artificial Sequence
  Description of Artificial Sequence: Synthetic coding sequence
atgaagagcaccaagccaagcctgtccccgagcaagccccaaagctccctcgtgattccgacctcacttttctgcaagacttttccattccatttcatgtttgataaggacatgacaattttacaatttgggaacggaatcagacgattgatgaaccgacgggacttccaggggaagcctaattttgaggagtactttgagattctgacacccaagatcaatcagactttcagtggaatcatgacaatgctgaatatgcagttcgttgtacgagtgcggaggtgggataacagcgtgaagaagtcctctcgggtcatggacctgaaaggacagatgatttacattgtggagtcgagtgctatcctttttctcgggtccccctgcgtcgaccggctagaggacttcaccggccgaggcctctacctctcggatatacctatacacaacgctctgcgcgatgtggttctcatcggcgaacaggcccgagcccaggatggtctcaagaagaggcttggcaagcttaaggccacattggagcaggcccaccaggccctggaagaggagaaaaaaaagactgtcgacttactgtgttcaatattcccctgcgaagtggctcagcagttgtggcagggacaggtggtccaggccaagaaatttagcaacgttaccatgctcttctcagacattgtcgggtttacagcgatctgttcgcaatgttccccccttcaggttattacaatgctaaatgccttatacacacggttcgaccagcagtgtggggaacttgatgtgtataaagttgaaaccattggcgatgcgtactgcgtcgctgggggattgcataaagagtccgacacacacgctgtgcagatcgctctcatggctctgaaaatgatggaactgtcagacgaggtgatgtctccgcacggtgaacccatcaaaatgcgaattgggctgcactccggctcagtgttcgcgggcgtggtgggggtgaagatgccacggtactgtctgtttggcaataacgtgactttagcaaataaattcgagtcctgttctgttccaaggaagattaacgtcagccccaccacatatcgcctactgaaggactgccccgggttcgtgttcaccccgcgctccagagaagagctccctcccaatttcccttccgagatccctggtatctgccacttccttgacgcctaccagcaggggactaactcaaaaccttgctttcagaagaaagacgtcgaggacggaaatgccaactttctggggaaagctagtgggatagactag

SEQ ID NO: 119378 - DNA, 1875 bp, Artificial Sequence
  Description of Artificial Sequence: Synthetic coding sequence
atgttttgcactaaacttaaagatttgaagatcaccggcgagtgcccattttccctcctggctccaggacaggtccctaatgagagctctgaggaagctgcaggtagctccgaaagctgcaaggcaacagttcctatttgccaggatatccccgaaaagaatatccaggagagtctcccgcaaagaaaaactagcagaagcagagtgtacttgcatacactcgcggagtcaatatgcaaattaattttccccgaatttgaacgacttaacgtagccttgcagcgcacactcgcgaagcataagattaaggagagccgaaagagcctggaaagggaggattttgaaaagacaatcgccgaacaagccgtagccgccggggtgcctgttgaagttattaaggagagcctgggggaagaggtcttcaagatctgttacgaggaggatgaaaatatattgggtgtggtgggtggtacactgaaagacttcctgaattccttttctactctactcaagcagtcatctcactgccaggaagccggaaaacgcgggaggctagaagacgcgagcatcctttgcctggataaggaggacgatttcctccatgtgtattatttctttccaaaaagaacaactagtcttatccttcccgggattatcaaagctgccgcacatgtgctgtacgagaccgaagtggaggttagtttgatgccgccatgttttcataatgactgcagcgaattcgtcaaccagccttacctcctgtacagcgtacatatgaagtcaaccaagccatccctaagcccatcaaaaccccagtcatccctcgtgatccccaccagcctgttttgtaaaaccttcccatttcactttatgtttgacaaggacatgacaatcctccagttcggcaatgggattcgtaggttaatgaaccgtcgagactttcagggcaaaccaaatttcgaggaatactttgaaatcctgacccccaaaataaaccagacatttagcgggattatgacgatgttgaacatgcagtttgttgttcgagttcggcggtgggataactctgttaaaaagagctctcgcgtaatggacctgaaaggccagatgatatatattgtcgagtcaagtgccattctgttccttggaagtccttgcgtagatcgtttagaagatttcacgggaagggggctctacttgtctgatattcctattcataacgcattaagggatgtggtcctgattggtgagcaggcgcgagcccaggatggactgaagaagagattgggtaagctcaaggccaccctggaacaagcgcaccaagcactggaggaggagaaaaaaaaaacagtcgacctattgtgctcaattttcccatgtgaagtggctcagcagctttggcagggtcaggttgtgcaggcaaagaagttttccaacgttactatgctgttctcagatatcgtggggttcacggcaatctgctcgcagtgtagccctttacaggtgatcacaatgctgaacgccctgtacacacggttcgatcaacagtgtggtgagctagacgtgtataaagtcgagactatcggagatgcttattgcgttgctggagggttacacaaggagagcgacacccatgcagtgcagatcgcgcttatggcacttaaaatgatggagctgtccgacgaggtaatgagtcctcacggtgagccaatcaagatgagaatcgggctgcacagcgggagtgtgttcgccggagttgtgggggtcaagatgccccggtattgcctgttcgggaataacgtgaccctagccaataaattcgagtcctgtagcgtgcccagaaagatcaacgtgtccccaacgacatatcggtag

SEQ ID NO: 119379 - DNA, 2292 bp, Artificial Sequence
  Description of Artificial Sequence: Synthetic coding sequence
atgagtcgtagaaaaatttcgagcgaaagttttagcagcctgggatcagattatctcgagacctcccccgaggaggaaggcgagtgccccctctctcgcctgtgttggaatgggagccggtccccccctggccccctggaaccctcacccgccgctgctgccgctgccgctgcaccagcccccacacccgcagcctctgcagcagctgccgccgccaccgccggcgctcgccgcgttcagaggcggaggcgggtgaatctcgactctctgggtgaaagcataagccgtttgacagcaccctcccctcagaccattcagcagacactgaagcgcaccctgcagtattatgagcaccaagtgattggatatcgcgacgccgaaaagaactttcacaacatttcaaaccggtgtagttacgccgatcactccaacaaggaagaaatcgaggacgtctctggtatcctgcaatgcactgctaatatcttaggattaaagtttgaggaaatacaaaagaggttcggcgaagagtttttcaacatctgttttcacgagaatgagcgagtcctccgggcggtggggggaactctccaggatttcttcaatggctttgatgcccttctcgagcacataagaacatctttcggtaagcaggccactctcgagtcgccctcattcctctgcaaggagttgcctgaagggacattgatgctgcactacttccacccacaccacattgtgggcttcgctatgctgggaatgatcaaggccgcgggcaaaaaaatttaccggctggatgtcgaggtcgaacaggttgccaacgagaaactctgttccgacgtcagcaaccccggaaattgttcttgtctgaccttcctaatcaaggagtgtgagaacactaacatcatgaagaatctgccgcagggtacctctcaagttccggccgacctaaggattagcatcaacacattttgtcgggctttcccattccatctgatgttcgatccttcaatgagtgtgctacagctgggagagggcctccgtaagcagcttagatgtgacacacataaggttctaaagtttgaagattgcttcgagatcgtttctccaaaggtcaatgccaccttcgagcgagttctgctccgcctgtctaccccttttgtgattcgaaccaaaccagaagcttcgggatctgagaacaaagataaagtcatggaagtcaaagggcagatgattcacgttccggaaagcaactccattctgtttctcggctctccgtgcgtggataaactcgatgagctgatgggacgcggccttcacctcagtgatatccctattcatgacgcaacccgggatgtaatccttgtcggagagcaggccaaggcgcaagacggtcttaagaaacggatggacaaactgaaggccaccctggagcgcacccaccaggcactggaagaagagaagaagaagactgtggatttgctgtactctatcttcccaggggatgtggcccagcagctgtggcagggccagcaggtccaggccagaaagttcgacgatgtaacaatgctgttttctgacattgtaggatttactgcaatctgcgctcagtgtacaccaatgcaagtgatatccatgctgaacgagctctatactaggtttgatcaccaatgcggcttcctagacatttataaagttgagaccataggggacgcttactgcgtggccgctggactacatcgaaaaagcctctgtcatgcaaaaccgattgcattaatggcactgaagatgatggaactgtctgaggaagtccttacccccgatgggcgcccaatccagcctcagcggtccgaactgctattcagcttccccgtatccattcagctcgttcccgaccagcaccaatccgaaaccgacctgggtacagaaaagatgcgaataggcatccatagtggatccgtgctcgccggcgttgttggcgtgcgaatgcctagatattgtcttttcgggaataatgtgacgttggcctccaaatttgagtccgggagtcaccctaggcgaatcaacgtgagcccaaccacataccagctcttaaagagggaagagtctttcacattcatacccaggagtcgtgaagagcttccagacaactttcccaaggaaatcccgggaatctgctactttctagaagtgagaaccgggccgaaacctcccaagccatcattgagttcgagccggattaagaaggtttcctataacataggcacaatgtttctgagagagacttctctgtag

SEQ ID NO: 119380 - DNA, 2199 bp, Artificial Sequence
  Description of Artificial Sequence: Synthetic coding sequence
atgtctagacgtaaaatatcaagcgagagcttctcctccctgggaagcgactatctggagacaagtcctgaagaggaaggggagtgtcctctctctcgcctgtgctggaacgggagcagaagccctcccgggccgctagagccttcacctgctgctgctgctgctgctgcggccccagctcctaccccagcagccagcgcagctgcagctgcagccacggccggggcccggagagtccagagaaggcgcagagtcaatctcgattccttgggcgagagcattagccgactcaccgccccctcacctcagacaatccagcaaaccctgaaacggaccctgcagtactatgagcaccaggtaattggataccgggatgctgagaagaacttccataatatctcaaatcgctgtagctacgccgatcactccaataaagaagaaatcgaggatgtctccggcatcctgcagtgtacggcaaatatcttgggcctgaagttcgaggagattcagaaacgctttggcgaagagttttttaacatctgcttccacgagaatgagcgcgtgctccgggcggtagggggcaccctgcaggacttcttcaacgggttcgacgccctattggaacatattaggacctcatttggaaagcaggccacgctggagtctccatcttttctttgtaaggagctaccagaagggaccctgatgctccattatttccacccccatcacatcgtgggtttcgctatgctgggcatgatcaaagcagccggcaagaaaatctaccgcctggacgtggaggtcgagcaagttgcaaatgagaagctgtgctcagatgtgtcaaatcctggtaattgttcctgcctgacttttctgattaaagaatgcgagaatactaacattatgaagaaccttccacagggcacctcccaagtgcccgccgacctccggatatctatcaacaccttctgccgcgcatttccgtttcatctgatgtttgatcctagtatgagcgttctgcaactaggagaaggcctgcggaagcagttgcgttgcgatacccacaaggtgttgaagttcgaagactgtttcgaaatcgtttctccaaaggtcaacgccacctttgagagagtcctgctcaggctctctacccctttcgtgatcaggactaagccagaagctagcggctctgaaaataaagacaaagtgatggaggtgaaagggcagatgatacacgtgcccgagtctaactctattctgtttcttggaagtccgtgtgtggataagcttgacgaattaatgggcagaggtttgcatctgagcgacatccctatccacgatgctactcgggatgtgattttggtgggagaacaggcgaaggcccaggacggtctcaagaaaaggatggataaactcaaggctaccttggagagaactcaccaggcactggaggaagaaaagaagaaaaccgtagatcttctgtatagtatctttccaggcgacgtagcccagcagctctggcaaggacagcaggttcaagcacgcaaattcgacgatgtaaccatgttattcagcgatatcgtgggtttcactgccatttgcgcccagtgcaccccgatgcaagtcatctccatgttgaacgaactttataccagatttgaccaccagtgtggcttcctagacatctataaggtcgaaacaattggcgatgcctattgtgtcgccgcgggcctgcaccgcaagagcctttgtcacgcgaagccaattgcgctgatggccctcaagatgatggagctgtcggaggaggtgttgacccctgacgggcggccgatacagatgagaatcggtattcatagcggttctgtactagcgggcgttgtcggagtgcggatgcctcgctactgtctgtttggcaacaatgtcacactcgcatcaaagtttgaatcaggatctcatccgcggagaattaacgtgtcgcctacgacataccagcttctgaagcgcgaagagtctttcacttttataccccggagcagagaagagctgcctgataacttccctaaagagattcctgggatttgctactttttggaggtgaggacgggaccgaaaccaccaaagcctagtttgagttcctctcgaatcaagaaggtttcctataatattggcacaatgttcctacgcgagacgtccctttag

SEQ ID NO: 119381 - DNA, 2073 bp, Artificial Sequence
  Description of Artificial Sequence: Synthetic coding sequence
atgttttgcacgaaactcaaggacctgaaaataaccggcgagtgtcccttttctctgcttgcccccgggcaagttcctaacgagagcagtgaagaggccgccggctcctccgaatcctgcaaggcaaccgtccctatatgtcaggatatcccagagaagaacatccaggaaagtcttcctcagcgaaaaaccagcagatcaagagtatatctgcataccctggcagagagcatctgtaaactgatattccctgaatttgagcgacttaacgttgctttgcagagaaccctggcaaagcacaaaattaaggagagcagaaaatctctagaacgggaggattttgaaaagacaattgcagagcaggcggtggccgcaggggtgcccgtggaagtgattaaggaatcacttggcgaagaggttttcaaaatttgctacgaagaagatgaaaatattctgggtgtcgtgggagggacactcaaggactttctgaattccttttccaccctgctcaagcagtcatcgcattgccaggaagctgggaaaagaggtcggctagaggatgcctcaattctctgtttggataaggaagacgatttccttcatgtttattattttttccccaagcgaactacctccctgattctcccaggtatcattaaagctgcagcccatgtgctgtatgagacagaagtggaagtgtcgctcatgccgccatgttttcacaatgactgttccgaattcgtaaatcaaccctatctgctctattctgtccatatgaaaagcactaagccaagtctgtcaccgtccaaacctcagtcaagtctggtgattcctaccagcttgttctgcaagacttttccattccactttatgttcgacaaggacatgactattcttcagttcgggaacggcatcagaaggcttatgaaccgccgggactttcagggcaagcctaatttcgaagagtattttgaaattctcacacctaagatcaatcagaccttttctgggatcatgactatgctaaatatgcaatttgtggttcgtgtcagacgttgggacaatagcgttaaaaagagtagcagagtgatggatctcaagggccagatgatctatatagtggagtcatctgcaatcctgttcttgggttctccctgcgtggacaggctcgaggatttcacaggaagaggcctctacctgagcgatatccccatacataacgcactgcgagatgtggtgttgataggcgagcaggcccgggcccaggacggactcaagaaaagactggggaagctgaaggctactcttgagcaagctcatcaggctctggaggaagagaagaagaagacggtagacctgctgtgttcaatatttccctgcgaagtggcacaacagctctggcaaggccaggttgtccaggcaaagaagttcagcaatgtcacgatgttgttttccgatattgtagggttcacggccatctgctcacagtgtagccctctgcaggtcatcaccatgttaaatgctctctatacacgcttcgatcagcagtgcggtgaactcgatgtgtataaggtggaaacgatcggggacgcgtattgtgtggcaggagggttacacaaagagagcgatactcacgctgtgcaaatcgccttgatggcgctgaaaatgatggagctgtccgatgaagtgatgagcccacacggagagcctatcaagatgcggatcggattacatagtggcagcgtgttcgccggcgtggtcggcgttaaaatgccacgctattgtcttttcgggaacaacgtaaccttggccaataaattcgagagctgctccgtgcccaggaaaataaacgtctcacccacaacatatcgtttactgaaagattgccccggcttcgtgtttaccccacgctcccgagaggaactcccacctaacttccctagcgaaatacccgggatttgccattttctggacgcatatcagcaaggtacaaatagtaagccatgctttcagaagaaagacgtagaggacggaaacgccaattttttgggcaaggcatccggtatagattag

SEQ ID NO: 119382 - DNA, 2073 bp, Artificial Sequence
  Description of Artificial Sequence: Synthetic coding sequence
atgttctgtacaaagttaaaggatctgaaaattaccggggagtgcccattctctttgctcgccccaggacaagttcccaatgagtcctctgaggaggctgccggatcctcagaatcatgtaaagccacggtacctatttgtcaagacatcccggagaaaaacatccaggagtccctgccccagagaaagacctcaagatctagggtttatctccataccctcgcagagagtatatgcaaactgatctttccggaatttgaacgcctgaacgtagctctccaaagaacactagcgaaacataaaataaaggaatcgagaaagtcactggagcgagaagacttcgaaaagacgatcgcagaacaagccgtagccgccggcgtgccagttgaagtgatcaaggaatcactgggggaggaggtctttaagatctgctatgaggaagatgaaaatatcctgggggtcgtgggcggtacattaaaagactttcttaactccttctccaccctgttgaaacagtcctcacactgtcaggaggccgggaagagaggcaggttggaagatgctagtatactttgtctggataaggaggatgatttcctgcacgtgtattatttcttcccaaagagaacgactagtctgatccttccaggcatcattaaagcggccgcgcatgtcctgtatgaaaccgaggtggaggtgtcactcatgcccccgtgctttcataacgactgcagcgaatttgtcaatcagccatacttactttattccgtccacatgaagagcacaaaacccagcctaagtccctccaagcctcaatcatctctggtgatccccaccagcctgttctgcaagacattcccatttcatttcatgttcgacaaggatatgacaattctccagtttggaaatggcattcgaaggctgatgaaccgccgagatttccagggcaagcctaatttcgaggagtatttcgaaatccttactccaaaaatcaaccagaccttctctggcattatgactatgctcaatatgcagttcgttgtccgcgttcgcagatgggataattccgtcaaaaagtcatcaagagtgatggatctcaaggggcaaatgatctacatcgtggagtctagtgccatcttgtttctggggagcccctgcgtggacagactcgaggattttacaggaagaggactttacttgagcgatattcccatccacaacgcactgagggatgtcgtgctgataggtgagcaggcgagggcccaagacgggctcaagaagaggctcgggaagcttaaggccactcttgaacaggctcaccaggccttggaagaggagaagaagaagacagtggacctgctctgctctattttcccatgcgaagtcgcacagcaactttggcagggccaggttgtgcaggctaaaaagttttccaacgtgacgatgttatttagtgatatcgtgggattcaccgcgatctgcagccaatgttctcccttacaagtaatcactatgcttaatgcgctgtatactcgatttgatcagcaatgtggagaactcgacgtctacaaagtggagaccattggggacgcctattgcgttgctgggggcctgcacaaggaatcagacacacacgctgtgcagattgctctgatggccctgaaaatgatggaactatccgatgaggttatgagccctcacggagaacccattaagatgcgaatcggtcttcatagcggaagtgtttttgccggcgtcgtcggcgtgaagatgccacgctattgtctgtttggaaataacgtgaccctcgcaaataaatttgagtcatgcagtgtgccccgcaagataaatgtctcccctacaacctaccggttattaaaggactgtcccggatttgtgtttacacccagatctagggaggaactcccccctaattttccttcagaaattccaggcatctgtcatttccttgatgcataccagcagggaacaaattctaagccttgtttccagaagaaagacgttgaggacggaaacgcgaactttctcggtaaggccagtggaatagattag

SEQ ID NO: 119383 - DNA, 2073 bp, Artificial Sequence
  Description of Artificial Sequence: Synthetic coding sequence
atgttctgcacaaagcttaaggacctgaagatcacaggcgagtgtccatttagtctgcttgcaccaggccaggtccccaacgagtcttcagaagaggctgccgggagctctgagtcgtgcaaggccacagtgcccatttgccaggacatccccgagaaaaacattcaggagtctctgccccaacgaaagaccagtaggtctcgtgtatacctgcataccctggcggagtccatttgtaagctgatctttcctgagttcgaaagactgaacgtggctctccaacggacactggcaaaacacaaaatcaaggaaagcagaaagtccctggagagggaggactttgaaaagaccattgcggagcaggcagtggcagccggggtgccggtggaagtgataaaagagtctctcggagaggaagtgttcaagatttgctacgaggaggacgagaatatattgggggtcgtggggggtacacttaaggattttctgaactctttttctactttacttaagcaatcctctcactgccaggaagcaggaaagagaggacggctggaggatgcctcaattctttgtctggataaggaggacgacttcctccacgtatactatttctttcctaagcgcactacttccctaattctccccgggataatcaaagcagctgctcatgtgctgtacgagaccgaggttgaagtgagtttaatgcctccctgcttccataatgactgcagcgagttcgtaaatcagccatatcttctgtacagcgttcacatgaagagtacaaaaccctccctttctccgtcaaagccgcagagttccctggtcattccaacctcgttattttgtaaaaccttcccatttcactttatgtttgacaaggacatgactatactccaatttggtaacggaatccgcaggcttatgaatagacgggacttccagggcaagccaaacttcgaggagtacttcgaaatcctcacgcctaagattaatcagacatttagcggcattatgaccatgctgaacatgcagtttgtggtccgggtgaggcgctgggacaactccgtaaagaagtcctcacgcgtgatggatcttaagggacagatgatctatatcgtcgagagcagtgcaatcctctttttgggctcgccatgcgtggacaggttagaggatttcacaggacgagggttgtacctttcagacatcccaatacacaatgctcttcgcgatgtcgtgctgattggagagcaggctagagcacaagacggcttgaagaagcggctgggaaagttgaaagccaccctcgagcaagcgcatcaagcattagaagaggaaaaaaagaagacagtcgacctcttgtgttctatctttccatgcgaagtagcccagcagttatggcagggccaagtggtccaggccaagaaattttcgaatgtcacaatgctcttctcagacatcgtcgggtttactgcaatatgctcacagtgtagtcccctgcaggtcatcaccatgctaaacgcgctttataccagattcgatcaacagtgtggagaactggacgtgtataaagtggagacaattggcgatgcttactgcgtcgcagggggcctgcataaggaaagcgatacccatgccgtgcagattgcacttatggccttgaagatgatggagctttcagacgaggtcatgagcccccatggagaacctattaagatgaggatcggacttcacagcggctctgtgtttgctggcgtggtgggcgttaaaatgcctcggtactgtctctttgggaacaatgtgacgctggccaacaagttcgaaagctgctcagtaccgcggaagatcaatgtgagcccaacgacttatcggctgcttaaagattgccctgggtttgtgtttacgccacgaagtagggaagaacttccccccaactttccatctgaaatcccaggcatttgtcattttctggatgcataccagcagggtacaaatagcaagccatgctttcagaaaaaagacgtggaggatggaaatgcaaacttcctgggcaaggcttcggggattgactag

SEQ ID NO: 119384 - DNA, 2073 bp, Artificial Sequence
  Description of Artificial Sequence: Synthetic coding sequence
atgttctgcactaaactcaaggaccttaaaataaccggggagtgcccattcagtctgctggctcccggccaggtcccaaatgagtctagtgaggaagcagctggctctagcgaaagctgtaaggccaccgtgccaatatgccaggacatccccgaaaagaatattcaggagtcactgccacaaagaaaaacgagcaggtctcgtgtgtatctacacacccttgcagaatccatctgcaagcttatctttccagaatttgaacgtcttaatgtggccttgcagaggacactggccaaacataagatcaaggaatctcgcaagtcactagaacgagaggacttcgagaagaccatagccgagcaggctgtggctgctggagtgcccgtggaggtgatcaaagaatcgttgggcgaagaggtttttaaaatctgttacgaggaggatgaaaatatcctcggggttgtaggtggcaccctgaaagattttttgaattcattctccacactactgaaacagagctcccactgtcaggaggccggaaaaagagggagactagaagatgcttctatcctgtgtctcgacaaggaggatgattttctgcacgtgtactacttttttcccaaaaggaccacaagcctgatcttaccaggaatcattaaagccgcagcccatgtcctgtacgaaacggaagtggaagtgagccttatgcctccttgtttccacaatgattgtagcgagtttgtgaatcagccatacctcctgtactccgtgcatatgaaatccaccaaaccttccctttccccatctaagccacagagttcgctcgtgattccaactagcctcttctgtaaaactttcccttttcattttatgttcgacaaggacatgaccattctgcaattcggaaacggcattagacgcctaatgaatagaagagatttccaggggaaacctaattttgaagagtatttcgaaatactgacccccaagattaatcaaacgttctcggggataatgactatgctgaatatgcagtttgtcgtgcgggtgcgtaggtgggacaactcagtgaaaaagagtagccgggtgatggatcttaaggggcagatgatctatatcgtagaaagcagtgccattctatttttaggatccccttgcgtcgaccgcctggaagattttaccggccggggactttacttgtcagacatcccaatacataatgctctaagggatgtagtcctgattggggagcaggcacgggcgcaggatgggctgaaaaagcgcctgggcaagcttaaggctactttagagcaagctcatcaggccctggaagaagaaaaaaagaagacggtcgatctgttgtgcagcatcttcccttgtgaggtcgcacagcaactgtggcaaggccaagtggtgcaagcaaagaagttcagtaacgtcactatgctcttctcagacatagttggattcacagcaatttgtagtcagtgcagccctcttcaggttattaccatgttgaatgctctgtacacccgtttcgaccagcagtgcggagaacttgatgtatataaggttgagactattggtgatgcatactgcgtggctggcggactgcataaggaatccgatactcatgcggtgcagatcgccctaatggctctgaagatgatggaactgtctgatgaagtgatgagtccccatggggaaccaatcaaaatgcgaatcggtctgcactcggggagcgtttttgccggagtagtgggcgtgaagatgcctcggtattgcctgtttggcaataacgtgaccctagcgaataaatttgaaagctgtagtgtgccccggaaaatcaatgtatcgcctacgacatatagactgctgaaggattgtcccgggttcgtgtttactccacgatcacgcgaagaactgcctccgaatttcccaagtgagattccaggtatttgccactttctcgacgcataccagcagggtactaactccaagccttgttttcagaagaaagacgttgaggacggtaacgcaaacttccttgggaaggcttcggggatcgactag

SEQ ID NO: 119385 - DNA, 2073 bp, Artificial Sequence
  Description of Artificial Sequence: Synthetic coding sequence
atgttttgtactaaattaaaagatcttaagatcaccggggagtgcccgttctctttgctggcaccaggccaggttcccaatgagagctctgaggaagcggctgggtcatctgaatcatgcaaggcgacagttccaatatgccaagatatcccagagaagaacatacaagagtctctcccccagcgaaagacatccagatctcgggtgtacttgcacacccttgcagagtccatctgtaaactcatttttcccgagtttgagaggctcaacgtcgcgttacagcggacccttgccaagcataagatcaaagagagccgcaagtcattagagcgtgaggatttcgaaaagacaattgccgagcaggccgtggctgctggagtcccagtggaggttataaaagaatcactgggagaggaagtattcaaaatctgctacgaggaagacgaaaacatattaggcgtggttggcggaaccctgaaggattttttgaatagtttcagtacgctgctgaagcagtccagtcactgtcaggaggccggaaaacgcggcagattggaagacgcaagcattttatgcctagataaggaggatgattttctacacgtgtattattttttccctaaacgtaccacatccctgatcttaccaggcattatcaaggccgccgcccatgtgctctacgaaacagaggttgaggtgtctttaatgcccccgtgttttcacaacgattgtagtgaatttgtcaaccagccctatctactttacagcgtgcacatgaaaagcaccaagccctccctttctccgtctaaaccacagagcagcctggtcatcccaacatcactgttttgcaaaacattcccatttcactttatgttcgacaaggatatgacaatcctgcagtttggaaacggaattagaaggctcatgaatcgcagggatttccaggggaagcccaatttcgaagagtacttcgagatactgacccccaagatcaaccagaccttcagtggcatcatgacgatgcttaatatgcagttcgtggtcagagtgcgccgatgggataactcggttaaaaagtcaagtcgcgtaatggacctgaaaggacagatgatctacatagtcgaaagctccgctattttatttctcggcagcccttgtgtggaccggctggaggacttcaccggcaggggcctttatctttcagatattccaatccataatgctttaagggatgtagttttgattggagagcaggcccgagcacaagacgggctcaagaagcggctcgggaaactcaaggccacacttgagcaggcacatcaggccctcgaggaggaaaaaaagaaaactgttgacctcctgtgcagtatcttcccctgcgaggtcgctcagcagctttggcagggccaggtcgtgcaggcaaagaaatttagtaacgtgacaatgctgtttagtgatatcgttggcttcaccgccatctgtagccagtgttcgccattgcaagtgattaccatgctgaacgcactgtatactcgattcgatcagcagtgcggagaacttgacgtatataaagtggaaactattggagatgcctactgtgtggccggcggtttgcataaagaatcagacacacatgccgtgcagattgcactgatggcccttaagatgatggagctgagtgatgaggtaatgagccctcacggtgagcccataaaaatgcgcattggcttgcactctggaagcgtctttgccggcgtggtgggcgtgaaaatgcctcgctattgtctgttcgggaacaacgtaaccctggccaataagtttgaaagttgtagcgttcctcgcaaaattaatgtttccccaacaacttatcggcttctaaaggattgccctggatttgtatttacacccaggtcccgtgaggagttgccaccgaacttcccgtctgaaatacccggcatctgccacttcctcgacgcatatcaacagggaaccaattccaagccttgctttcagaaaaaagatgtggaggacggcaatgctaactttctcggaaaagcgtcgggtatcgactag

SEQ ID NO: 119386 - DNA, 1860 bp, Artificial Sequence
  Description of Artificial Sequence: Synthetic coding sequence
atgtatgggtttgtcaaccatgccctggaattgctggtgattcgaaattatgggcctgaagtttgggaggacattaagaaagaagctcaactagatgaggagggccagttcctagtgcgcataatctatgatgatagtaagacttatgatctcgttgctgcagcgtctaaggtactcaacctgaacgccggcgaaattttacagatgtttgggaaaatgttttttgtgttttgccaggaatccgggtatgacaccatccttcgcgtcctggggtcaaatgtaagggagttcttgcagaacttggacgcactccatgaccacctggccacaatttaccccggtatgagggccccatcctttagatgtactgacgcagagaaaggaaagggccttatactccactattactcggaaagggagggcttgcaggatatcgttatcggcattattaaaacggttgctcagcaaattcacggtaccgagatcgacatgaaagttattcagcagcggaatgaggaatgtgatcacacacaatttttgattgaagaaaaggaaagcaaggaggaggatttctacgaggatctggacagattcgaggagaatggcacacaagagtccaggatcagcccatacacgttttgtaaagcatttccctttcacatcattttcgacagggatctggtcgtcacacagtgcggaaatgccatatatagagtgctgccccagctgcaacctggtaattgctctctactgagtgtcttttccttggtcagacctcatatcgacatttctttccacggcatcctctcccatataaacaccgtctttgtgttacgaagtaaggagggcctcctggacgtcgaaaagttggagtgcgaggacgagctcacaggaaccgagattagctgtctaagactgaaaggccagatgatctatctgccagaagccgactcgatcctgttcttgtgcagcccttccgtgatgaatctcgacgatcttaccagaaggggcctttacctgtccgacattcccctccacgatgcgactcgggatctggtcctcctaggagagcagttcagagaggagtataaactcactcaggaactcgaaattcttaccgatcgactgcagctaactctgcgtgcgttggaggacgaaaaaaaaaaaacagatactctactctactctgtcttaccacctagcgttgccaatgagctgcggcacaagaggccagtgccagcaaagaggtacgataatgttacaattttgttcagtgggatcgtgggcttcaatgcattctgcagcaagcatgcctccggcgagggcgctatgaagatcgtgaacctcctgaatgatctgtacacacgcttcgacactctgactgactcacgaaagaatccatttgtttacaaggtcgagaccgtgggcgataagtatatgactgtcagcgggctgcccgagccatgcatacaccacgccaggagtatttgccatctcgcactggatatgatggagattgctggccaagtgcaagtggatggcgaatcagtgcaaatcaccattggtatccataccggcgaggtggtgaccggagtgattggacagaggatgccgcgctactgtctcttcggcaacacagtgaaccttacaagccgaaccgaaaccactggcgaaaaggggaaaattaatgtgagtgaatatacctatcgttgcctgatgagcccagagaattcggatccacaatttcacttagagcatagggggcctgttagcatgaaaggcaaaaaggagcctatgcaggtctggtttctcagccgcaaaaacaccgggacggaggagacaaaacaggacgacgactag

SEQ ID NO: 119387 - DNA, 1656 bp, Artificial Sequence
  Description of Artificial Sequence: Synthetic coding sequence
atgtttggcaagatgttttttgtcttttgtcaggaatccggatatgacacgattctgagagtcctcggatctaatgtgcgggaatttctgcagaacctggacgccttgcacgatcacctcgccacgatttaccctgggatgcgggcgccatctttcaggtgtactgacgctgagaaggggaagggcttaattctacattactacagcgagcgggagggcctccaagatattgtgataggtatcatcaagactgtggcacagcaaattcacggaaccgaaatcgacatgaaagtgattcagcagcggaacgaagagtgcgaccatacgcaattcctcatcgaggagaaagagtccaaggaagaagacttctatgaagatctggaccggtttgaagagaatggaactcaggagagtcggatttcgccatacacattctgtaaggctttcccatttcacatcatattcgacagagatctggtggtgacgcagtgcggcaatgccatctaccgggtgttaccccaacttcagccaggtaattgttcactgcttagtgtattttcgcttgtgaggccgcatattgatattagtttccatggtattctgtcacacataaatacagtttttgtgcttcgctcgaaggagggtcttctcgacgtagagaaattggaatgtgaggatgagctgactggaaccgaaatatcatgtctgagactgaaaggccagatgatctatctaccagaggccgactcaattttgttcctgtgcagcccgagcgtgatgaacctcgacgatcttactcgaagagggctgtacctctcagatataccactgcacgacgccacacgtgacctcgtgctcctaggcgaacagttcagggaggagtataagctcactcaggaactggagattctgactgatagactccagcttacactgcgggcattggaagacgaaaagaaaaagacggatacattgttgtactccgtgctccccccttccgttgccaatgaacttcgacacaagcggcctgttcctgccaagcgctatgacaatgttaccattctgttctcaggcatcgtgggcttcaacgccttttgcagcaagcacgctagcggcgaaggggcaatgaagattgttaatttgctgaatgacttatacactaggttcgatactctcacagattcaagaaagaatcccttcgtttacaaagtggaaacggtcggcgataagtatatgaccgtgagtggtctaccagagccgtgcatccaccacgcacggtccatctgtcacctggcgctggacatgatggagattgcggggcaggtccaagtggatggcgaaagcgtccagatcacaattgggatccataccggagaggtcgtgacaggcgtgattggacagagaatgcctcggtattgtttgttcggcaacactgtgaatctaacctctagaactgagactacaggagaaaaaggcaaaattaacgtctccgagtatacttatagatgtctcatgtccccagaaaacagtgacccccagttccatctcgagcaccgcggacctgtgtcaatgaaagggaaaaaagaaccaatgcaagtgtggttcctttccaggaagaataccggcaccgaggagactaaacaggatgacgactag

SEQ ID NO: 119388 - DNA, 1800 bp, Artificial Sequence
  Description of Artificial Sequence: Synthetic coding sequence
atgctaatgtgtttcataaaggaggcccaactagatgaggaggggcagttcctggttcggatcatttacgacgactccaaaacatacgatttggtcgcagcagccagcaaagttctgaacctgaacgctggagagattcttcagatgttcgggaagatgttttttgtcttctgccaggagagtggctatgataccattctgagggttctaggcagtaacgtgcgcgaatttctgcagaatctggatgcccttcacgatcatctcgcgaccatataccccggtatgcgcgccccttcatttagatgcactgacgctgaaaaagggaaaggactcattctgcactactattctgagcgggagggcctgcaggatatagtcattggtataatcaaaacagtcgcgcagcagattcatggaactgagattgacatgaaagtgatccaacagagaaacgaagagtgcgaccatacccagttccttatcgaggaaaaagagagcaaggaggaggatttctacgaagaccttgacagatttgaggaaaatggcactcaggagtcccgaataagtccatatacattctgcaaagccttcccctttcacataatattcgatagagacctggtagtgacacaatgtggaaatgctatttatcgggtgttgccacaactgcagcctggcaactgcagcttactttccgtcttttcattggtgcgaccccacatagatatttcctttcacggaatcctgagccatattaatactgtcttcgttcttcggtcaaaagaaggactgctggatgtggaaaaactcgagtgtgaagatgagctgacaggcactgaaataagctgcttaaggctaaagggccaaatgatctatctcccggaggctgactctattctatttctctgctcacctagcgtaatgaatctcgacgacctgacaagaagggggctctatctttctgacatccctttgcacgacgccactagggacctggttctactaggtgaacagtttagggaggaatataagttgactcaggagttggaaattctcaccgaccggcttcaactgaccctgcgagcgcttgaagacgagaaaaagaagactgacacattactgtactccgtactcccgccttctgtagccaatgagttgaggcacaagcggccggtaccagcaaaacgatacgacaacgtcactatactgttctcgggcattgtcggcttcaatgcattttgttcaaagcacgcctcaggcgagggtgccatgaagatcgtgaatctcctcaacgacctctacacacgttttgatacgctgacagattctcgaaagaatccgtttgtgtataaggtggagactgtaggcgataagtatatgactgtctccggcctaccagaaccatgtatccatcacgctcggtcaatttgtcatctcgcactggatatgatggagatagccggccaggtccaggtggatggggagtcagtgcagataaccatcggaatccatactggagaagtcgtgacaggcgttattggccagcgaatgccaaggtactgtttgttcggaaatacagtgaaccttacatcccggacagaaaccaccggcgagaaggggaagataaatgtgagtgagtatacatatcgatgccttatgagcccggaaaacagcgacccccagtttcatctggaacaccggggaccagtctcaatgaaaggcaagaaggagccaatgcaagtgtggttcctgagtcggaagaatacgggcacagaagagacaaaacaggacgatgattag

SEQ ID NO: 119389 - DNA, 1656 bp, Artificial Sequence
  Description of Artificial Sequence: Synthetic coding sequence
atgtttgggaagatgtttttcgtcttctgtcaggagtcaggatatgataccatcttgcgcgtgctgggatccaatgtgcgggaatttttgcaaaacttggatgcattacacgatcacttggcaacaatctatccggggatgcgcgcgcctagtttccgctgcacggatgcggaaaagggaaaaggtttgattctgcactattattccgagcgcgagggcctccaagacattgtcatcggtattatcaaaactgttgcccagcagattcacggcactgaaattgatatgaaggtcatacagcagagaaacgaagaatgtgaccacacccagtttttgatcgaggaaaaggagtccaaagaagaggatttttacgaggaccttgaccggttcgaggagaatgggacacaagaatctcgcattagtccttataccttttgtaaagccttccccttccacattatattcgaccgggatctagtcgttacccagtgtggtaacgctatctaccgtgtattgcctcagctgcaaccaggcaactgtagtctattgtccgtttttagtctcgtccgcccacacatagatattagtttccacgggattctgtcccacataaatactgtgttcgtgctgcggagtaaggagggactgctggacgtcgagaagcttgagtgcgaggatgagctgactggcaccgagataagctgtctacgactgaagggtcaaatgatctatttgcccgaagcagactcaatcctgttcctctgctccccatcagtcatgaacctggatgacctcactcgccgcgggctgtacctcagcgatattcccctgcacgacgctacccgggaccttgtgctgctaggtgagcagttcagggaggagtataaactaacccaggaattagagatcctgaccgacagacttcaactgactctgagagctttggaggacgaaaagaagaaaaccgacaccctgttatattcagtccttccgccatccgttgcaaatgaactgagacacaagagacctgtgccagccaagaggtacgataatgtgaccattctgtttagcggaatcgtaggcttcaacgccttctgcagcaagcatgctagtggcgaaggcgccatgaagattgtgaacctcctgaatgatttatacacccgatttgacaccctcaccgacagccgaaagaatcccttcgtgtacaaagttgaaaccgttggcgacaagtatatgaccgtgtccggcttgcccgaaccgtgtatacatcacgctaggtctatttgtcatctggcattagatatgatggagatcgcggggcaagtacaggtggacggggaatctgtgcagattacgattggaatacataccggggaagtagtgaccggcgtgataggacagcgcatgccaaggtattgtctgttcggtaatacggtgaatctcacatccaggactgagacaacgggggaaaaaggcaaaataaacgtctctgagtacacctacagatgtttaatgagccccgagaactcggatcctcagttccatctggaacaccggggacctgtgtcgatgaaggggaagaaggaaccgatgcaagtgtggttcctgagtcggaagaacactggtactgaagagacaaaacaagacgacgactag

SEQ ID NO: 119390 - DNA, 3222 bp, Artificial Sequence
  Description of Artificial Sequence: Synthetic coding sequence
atgaaaaccctgttgctggatctcgcactatggtctctgctattccaacccggatggttaagcttcagcagccaggtgtcacagaattgtcacaatggtagttacgagatttcagtgctgatgatgggaaattctgcatttgctgagcccctgaagaatcttgaagatgccgtaaacgagggcttagagattgtaagaggtaggctacaaaatgccggactcaacgtcacagtgaatgccacatttatgtatagcgatggactgatccacaactctggagactgccgctctagcacctgtgagggactcgacctgctgaggaagatatcaaacgcccagcgtatgggctgtgtgcttatcggcccatcatgtacgtattccacttttcaaatgtacctcgatacagagctgtcctatccaatgatttcagccggaagctttgggctgtcttgcgactataaggaaaccttgacaaggcttatgtctcccgcaaggaagctgatgtatttcctagttaacttctggaagacgaatgatctgccctttaaaacttacagctggtcaactagctacgtgtacaagaatgggacagagactgaggattgtttttggtacttgaatgctctcgaagcgtctgtgtcttactttagccacgaattgggcttcaaagtggtgcttcggcaggacaaggagttccaggatatcctgatggaccataatcggaagagcaatgtcatcattatgtgcggcggacccgaattcctttacaagttgaaaggcgatagagctgtggccgaagacatcgtgattattctggtcgatttgttcaacgatcagtatttcgaagacaacgttacagcccctgattacatgaaaaacgtgctcgttcttacattgtcccccggcaactccctcttgaacagctccttcagtaggaacctgagtcctaccaagagggacttcgctctcgcctatttgaatgggatcttgctcttcggtcatatgcttaagatatttctggagaatggagagaacatcaccaccccaaaattcgcacatgcatttaggaatctgaccttcgaaggatacgatggtcctgtgaccctggatgactggggagatgtagactcaaccatggtgcttctatatacaagcgtggatacaaagaagtacaaggttctcttgacttatgacacacacgtgaacaagacgtaccctgtcgacatgtcacccacgtttacctggaagaacagcaagctccccaatgatatcaccggtagggggccacaaatattaatgattgcagtgttcaccctcaccggtgccgtcgtactcttgctcctggtcgcactgttgatgttacgcaaataccgcaaagactacgaacttcggcagaaaaaatggagccacatccctcccgaaaatattttccccttggagactaatgagactaaccatgtgagtcttaagattgacgacgacaaacggagggacaccattcaaagactccgacagtgtaagtatgacaagaagcgggttattcttaaggatttgaagcataatgatggaaacttcactgaaaagcagaaaatcgaactgaacaagttgctgcagattgactactacaacctaactaagttctacggaaccgtgaagctagatactatgatttttggggtaatcgaatattgcgagcgcgggagtctgagagaggtgctgaatgataccatctcctaccccgacggcaccttcatggactgggaattcaaaatttcggtgctatacgacatcgccaaggggatgtcttatctccatagttcaaaaacggaagtgcacggtcgtctcaaatccaccaactgtgtggttgactcaaggatggtggtcaaaatcactgacttcggatgtaattccattctgcctccaaaaaaggatctgtggaccgccccggagcatctccggcaggctaacatctcccagaaaggagatgtgtatagttacggcattattgcacaagaaatcatcctgagaaaggagacgttctacacactgtcttgtcgcgacagaaacgaaaaaatcttccgggttgaaaatagtaatggcatgaaacccttccggccagatctgtttttggaaacagcagaagaaaaggaactggaggtatatttattagttaaaaactgttgggaagaggatcctgagaaaaggcctgacttcaagaagattgaaacaaccttagccaagattttcggactttttcacgaccagaagaatgagtcatatatggataccctgataaggaggctccagctctattccaggaatcttgaacatctagttgaggaacggacccaactgtacaaggccgaacgggacagagcagatcgcctgaatttcatgctcttacccaggttggtcgtcaagtctctgaaggagaaggggtttgtcgaacccgagttatacgaggaggtcacaatctatttctccgatatcgtcggcttcactacaatttgtaagtatagcacccccatggaggtcgtagatatgcttaatgatatatacaaatcctttgaccacatcgtagaccatcacgatgtgtataaagtcgagaccatcggggacgcctacatggtggccagcggattgcctaaacgcaacggaaacagacacgccatagatatcgcgaaaatggcccttgaaatcttatcctttatgggcacctttgagttagagcacttacccggactgccgatctggatcaggatcggtgtccactccggcccgtgtgcagctggagtcgtgggtatcaaaatgcctagatactgtttgtttggcgacactgtaaatactgcctcgcggatggagtctacgggcctgcctctgcgcatacatgtgtccggatcaacaatcgctattctgaagcgcaccgaatgtcaatttctttatgaggtcaggggtgaaacttaccttaagggccgaggcaatgaaacgacatactggctcacggggatgaaggaccagaagtttaaccttcccacaccccccacagtagagaatcagcaacggctgcaggctgagtttagcgatatgattgctaatagcctgcagaagagacaggccgctggaattcgctcacagaaacctagaagggtcgcaagttacaagaaaggcacactagaatacctacagcttaatacgaccgataaggagtccacctacttctag

SEQ ID NO: 119391 - DNA, 3312 bp, Artificial Sequence
  Description of Artificial Sequence: Synthetic coding sequence
atgaccgcttgtgcccgtcgcgccggaggattacccgaccccggcctctgtggtcctgcctggtgggccccatccttgccacgactccctcgcgccctgccccgcctgccgctgttactgctattgctgcttttacagccacccgcactgagtgctgtcttcaccgtgggagtgttggggccatgggcctgtgaccccattttctcccgggcacgacccgatttagcagctcgactggccgccgcccgcctcaatcgcgatccaggcctggccggggggcctaggtttgaagttgctttactgccagagccttgtcgcacaccaggcagcttaggcgcagtatcttccgcactggccagagtatcaggtttagtaggacccgtcaacccagcagcatgtaggcctgccgagctattagccgaggaggctggtatagccctcgttccttggggctgcccttggacacaagcggagggcactactgctccagcggtgacgccagcagcagacgccctctatgcattgctgcgcgccttcggttgggcacgggtggcactggttacagccccacaggatctctgggtcgaggctggccgatcattgtctaccgcactcagagcaagaggattacctgtggcatccgtgacgtcaatggagcccctagatctgagcggcgccagggaggctctgagaaaggtgcgcgacggacctagagttacggctgtcatcatggtgatgcattcagtgctactggggggcgaagagcagcgttatttactggaagcggctgaggagcttgggctcaccgatggttctcttgtcttcctccccttcgacaccattcactatgccctaagcccaggccccgaggccctggccgcgttggcgaactcttcccagctgcggcgagctcacgacgcagtgctcactctgacccggcactgtccgtccgagggctccgttctagactccctccgtcgcgctcaggagcgcagagagcttcccagtgacttaaaccttcagcaggtgagcccactgtttggaacaatatacgacgccgtgtttttactcgcccgcggagtagctgaagcaagagccgctgccggtgggcgatgggtgtctggagccgcagtggctcgccacatccgggatgcccaagtgcccgggttttgtggagacttggggggtgatgaggagccccccttcgttttgctggacacagacgcggcgggagaccgcctgtttgccacctacatgctcgatccagccagaggtagctttctgtcagctggcacccggatgcatttccctcgaggcgggagcgcccctggccccgaccctagctgttggtttgatccaaacaatatttgcggtgggggactcgagccagggctggtgtttctgggctttctgctcgttgtgggaatgggcctcgccggcgcattcctcgctcactatgtgcggcatcgcctcctccacatgcagatggtgagcgggccaaacaaaatcatcttgaccgtagacgatatcaccttcctccatccgcatggcggcacgtcccgcaaagtcgcacaggggtctcgtagctcattaggagcacggtcgatgtccgatatacggtctgggccaagccaacatctggacagccccaacataggcgtgtatgagggagaccgagtgtggctcaagaaattccctggcgaccagcacatagccatcagaccagctacaaagacagccttttccaagctgcaggagctgcgacacgagaacgttgctctttatctcgggctttttttagcccggggggccgaaggccctgctgccctctgggagggaaatcttgctgtggtctcagagcactgtacacgagggtcactgcaggaccttctggcccagagggagataaagctggactggatgttcaagagctccctgcttctggacctcataaaggggattcgatatttgcatcataggggagttgcgcacggcaggctgaaatcccggaattgcatcgtggacggccggtttgtgcttaagataactgatcatggccatgggcgtcttctggaagcgcaaaaagtgctcccagagcctccacgagcagaggaccagttgtggactgcaccagagctgctgcgcgatcctgcactcgagagacgaggaactctagcaggggatgtgttttcccttgcgataatcatgcaggaggtggtctgcagatccgccccatatgctatgttggaactgactcctgaagaagtggtacagagggttcgatcgcccccccctctgtgcaggccgttagtgtccatggatcaggctcctgtcgagtgcatactcttaatgaagcagtgttgggccgaacaacctgagctccggccctcaatggatcatacattcgacttatttaagaatatcaataaaggccgaaagactaacataatagactcgatgttacggatgctggagcagtactcctctaaccttgaggatttgataagggagcgaaccgaagaactggagctcgagaagcagaagacagatcggctgttgacacaaatgctgccaccctcggtggctgaagccctcaagaccggcaccccagtcgagcccgaatactttgaacaggtcacactgtacttcagtgacatcgttgggttcaccaccatctcagcgatgagtgagcctatcgaagtggtggacctccttaacgacctctacacactgttcgacgctattatcggttcccacgatgtctataaagtggaaactattggggacgcatatatggttgcaagcgggctgccccagcgtaatggccagcgccacgctgccgagatagccaacatgtctctggacatcctgagcgcagtgggcacctttagaatgagacatatgcccgaggttcccgtgcggatccggatcggattacatagtggcccatgcgtcgccggtgtcgtcggactcactatgccccggtactgtttatttggcgacacagtgaacactgcttctaggatggagtccacaggcttgccatatcgtattcatgtcaacctttccactgtcggcatattgagagcattagacagtgggtaccaggttgagctgcgggggcggacagaactgaaggggaagggggctgaggacaccttctggctggtggggcgccgagggtttaacaagccaatacctaagccccccgacctgcaaccaggatctagcaatcacggcattagtcttcaggaaattcctccggagaggcgcagaaagctagaaaaggcccgcccagggcaattcagttag

SEQ ID NO: 119392 - DNA, 594 bp, Artificial Sequence
  Description of Artificial Sequence: Synthetic coding sequence
atgaggaagtatcgatcgcattggtcccaaggcgatagagaaggataccaacggcgttccaactactacgagggccctcacacatcacatagcagccctgccgaccgaacccgcgaagaagtggtcacacctacgttgcccgaacatactgccactcgctcccagatggccacaagccttgatttcaagacatacgtcgaccaagcatgcagagccgctgaagaatttgtcaacatttactatgagaccatggacaagcggagacgcgcactcaccaggctttacttggataaggccacacttatctggaatggcaatgccgtttctggtttggacgcactcaacaacttttttgacacactgcccagctcagagtttcaggtgaacatgctagattgtcaacctgtgcacgagcaagctacgcagtctcagacaactgtgttagttgtgacaagcggcaccgtgaagtttgatggcaacaagcagcattttttcaaccagaattttctgcttaccgctcagagtaccccgaataataccgtgtggaagattgcctccgattgttttcgctttcaggactggtccagctcctag

SEQ ID NO: 119393 - DNA, 606 bp, Artificial Sequence
  Description of Artificial Sequence: Synthetic coding sequence
atggggaacgtcatggaagggaagtccgtggaggagctttccagcaccgaatgccatcagtggtataagaaatttatgacggaatgtcccagtggtcagctgacactgtacgagtttagacagttttttggtctgaagaatttaagtccttcggccagtcagtatgtagaacaaatgtttgaaacatttgacttcaataaagatggctatatcgatttcatggagtacgtggcagctctgtccttggtcctgaaaggtaaagtcgagcagaagctccgttggtacttcaaattgtacgatgtcgatggcaacgggtgcatagacagggacgagctgttgaccattatacaagctattcgggcgataaacccctgtagtgacactaccatgacagctgaggagtttacagatactgtgttctccaaaatcgatgtgaacggggacggggaattgagtctggaggaattcatcgagggtgtgcagaaagatcaaatgctgcttgatacattgacacgatccctggatctgacccgcattgtcaggcggctgcagaatggagagcaggacgaggagggagccgatgaagccgctgaagctgccggctag

SEQ ID NO: 119394 - DNA, 606 bp, Artificial Sequence
  Description of Artificial Sequence: Synthetic coding sequence
atggggaatgttatggagggcaagtccgtggaggagctgtcctccacagagtgtcatcagtggtataaaaagtttatgacagaatgtccctcaggacagctgactctttacgaatttcgacaattttttggtctcaagaaccttagtccgtccgctagtcagtacgtcgaacaaatgttcgagaccttcgatttcaacaaggacggctatatcgactttatggagtatgtcgcagctctgagcttggttcttaagggtaaggtcgaacagaagctgagatggtactttaagctgtacgacgtagacggaaacggctgtatagacagggatgagcttctaactatcatccaggccattcgggcaattaacccttgctcggacacaactatgaccgcagaggaatttaccgatacagtttttagcaagattgacgtcaatggagatggagagctatctcttgaagagtttatcgagggcgtccagaaagatcaaatgctcctcgacactctgacacgctcactggatcttacccggatcgtgaggcgcctgcagaatggcgagcaggatgaggaaggtgcagacgaagccgccgaggctgccggctag

SEQ ID NO: 119395 - DNA, 618 bp, Artificial Sequence
  Description of Artificial Sequence: Synthetic coding sequence
atggaaggaaagtccgtagaagaattatcctccacggaatgccaccagtggtataaaaaattcatgactgagtgtccttcggggcagctcaccctctacgaatttcgacagttctttggcctgaagaacctttccccatcagcctcccaatatgtggaacagatgttcgagactttcgactttaataaagatggctatatcgacttcatggaatacgtggccgccctgtccttagtgttgaaggggaaggtcgagcagaagttgcgctggtacttcaaattgtatgacgttgatggtaacggctgcattgatcgagatgagctgttgacaattatacagttccctcaccagtatcagaaaaccgcaattcgcgccatcaatccttgctccgacacaacgatgactgccgaggaatttaccgacacagttttctccaagattgacgtgaacggcgacggggagcttagcctcgaagaattcatagagggagtacagaaggaccagatgctccttgatactctgactaggagtctggatctcaccaggattgtgcgcagacttcagaatggtgaacaggatgaagaaggggctgatgaagccgctgaagccgccggatag

SEQ ID NO: 119396 - DNA, 606 bp, Artificial Sequence
  Description of Artificial Sequence: Synthetic coding sequence
atgggcaatgtcatggagggcaagagtgtcgaagaattgtcgagcacagagtgtcatcagtggtacaaaaagttcatgactgagtgtccttcaggtcagctgactctttacgagtttaggcagttcttcggactgaagaatttatcaccctccgcaagtcaatatgttgagcaaatgtttgagaccttcgatttcaataaggatgggtacatcgatttcatggaatacgtggccgccctgagcctggttctaaagggaaaggtggaacaaaaactccggtggtattttaaactgtatgatgtcgacgggaacgggtgcattgacagagacgaacttttgactatcatccaggccattagagcgattaatccatgttcagatacaacgatgacagctgaggaattcaccgatacagtattcagcaagatcgacgtcaacggcgatggagagctgtccctggaagaattcatcgagggagttcagaaggaccagatgctgctggatactctgacccggagcctggacctgacccggatagtgcgcagactgcagaatggtgagcaagacgaagagggagccgatgaggccgcagaggctgctggatag

SEQ ID NO: 119397 - DNA, 267 bp, Artificial Sequence
  Description of Artificial Sequence: Synthetic coding sequence
atgggcaacgtgatggaaggcaagtctgtggaagagctcagtagcactgagtgtcatcagtggtataagaaatttatgaccgagtgtccaagcggacagctgacgctgtacgagttccgccaattcttcggtcttaagaatctgtcccccagcgcttcacagtatgtcgagcagatgttcgaaaccttcgactttaataaagacggctacattgactttatggaatacgtggctgctctttcgctggtgctcaaagggaaagtatag

SEQ ID NO: 119398 - DNA, 606 bp, Artificial Sequence
  Description of Artificial Sequence: Synthetic coding sequence
atgggaaacgtgatggaggggaagtctgtggaggagcttagttccactgagtgtcaccagtggtataaaaaatttatgaccgagtgccccagtggccagctgactttgtacgagtttcggcaattcttcggacttaaaaatctgtctccttcagcgagccagtacgtggaacagatgtttgagaccttcgactttaataaggatggttacattgattttatggaatatgtggctgccctatcgctggtcctgaaaggtaaggtggaacaaaagcttagatggtattttaagttgtatgacgtggacggaaatggttgcatagaccgcgatgagctactgaccattatccaggccatcagggccattaacccctgtagcgacactactatgaccgctgaagaattcacagacaccgtgttcagcaagatcgacgtgaatggcgatggcgaattaagccttgaggagttcatcgaaggggtgcagaaggatcagatgctgctagacactctgactcgcagcctcgatcttactagaatagttcggaggctgcagaatggagagcaggatgaagaaggggcagatgaagccgctgaggctgccgggtag

SEQ ID NO: 119399 - DNA, 1020 bp, Artificial Sequence
  Description of Artificial Sequence: Synthetic coding sequence
atggaccagaacaacagtctgcccccctacgctcaaggactcgcctccccacaaggagctatgactcccggcattcctatcttcagccccatgatgccatacgggaccggcctaacaccacagccaatccaaaatactaactcacttagcatactggaggagcagcaacgtcagcagcaacaacagcagcaacaacaacagcagcaacagcaacaacagcaacagcagcagcagcaacagcaacagcaacagcagcagcagcagcagcagcaacagcagcagcaagcagtagctgctgctgctgtacagcagagtactagccagcaggccacccaaggtacttccggccaagcacctcaactgtttcatagccagactctgactactgcgcccctgcccgggaccactcccctgtacccctctcctatgacacctatgacacccatcaccccagcaacccctgcaagtgagtcatccgggattgtgccccagctccagaacatcgtgagtaccgtgaacctgggctgcaagttagatctcaagactattgcactcagggcccgcaatgctgaatacaaccccaagcggttcgctgcagttatcatgcgaattcgggaacctaggaccaccgcgcttatatttagcagcggcaagatggtttgcactggcgccaaatccgaggaacaaagtagactggctgctcggaaatacgccagggtagttcagaaattgggattccccgccaagtttctcgacttcaagatccaaaatatggtcgggtcttgcgatgtgaagttccccattagactcgagggcctcgttttgacccatcagcaattttccagctatgaacctgaactctttcccggtctcatttaccgtatgattaagccacggattgtgctcctgattttcgtgagcgggaaagtggtgctcacaggagcgaaggttagagccgagatttacgaggccttcgagaatatttatcccatcctgaaagggttccgaaagaccacttag

SEQ ID NO: 119400 - DNA, 519 bp, Artificial Sequence
  Description of Artificial Sequence: Synthetic coding sequence
atggggcaggagtttagttgggaggaagcagaagcagccggcgagatcgatgtcgcagaactccaggagtggtataaaaagtttgtgatggagtgcccttcaggcactctgttcatgcatgaattcaaacgctttttcaaggtgacagacgatgaggaggcctcgcagtacgtggaaggaatgtttcgtgcattcgataaaaatggagacaacaccattgactttctggagtacgtcgctgctctaaaccttgtcctccggggcacccttgagcacaaactgaagtggaccttcaagatatacgacaaggacggcaacggttgtatagatcggctggagttgctgaacatcgtggaatgtcggcgggagctacagacagaacaaggacagctgctcacgccggaagaagtggtggatcgcatctttttactcgtggatgagaacggggacggccagctgagcctgaatgaatttgtggaaggtgctcgcagggataacctgcttatgcccactctctag

SEQ ID NO: 119401 - DNA, 630 bp, Artificial Sequence
  Description of Artificial Sequence: Synthetic coding sequence
atgggcaatggcaaatctatcgccggggatcagaaggcagtgcccacacaggagacacacgtatggtatcgcacattcatgatggagtacccatccgggctacagacacttcacgagtttaagacactgctgggccttcagggccttaatcaaaaagccaacaagcacatcgaccaggtgtataatactttcgacaccaataaggacggcttcgtagactttctggaatttattgcagcagtgaatctaatcatgcaggaaaagatggagcaaaagttgaagtggtactttaagctctatgacgcagacggcaacgggagcattgacaagaatgaactgctggatatgttcatggctgttcaggccctgaatggccagcagacattgtctcctgaagaattcattaaccttgttttccacaaaattgacattaataatgacggcgagctcacactggaggagtttatcaatgggatggcaaaggaccaggacttattggaaatcgtgtataagtcgtttgacttttctaatgttctgcgggtgatatgtaatggaaaacagcccgacatggagactgatagttccaaatctccagacaaagctggactgggaaaggtaaaaatgaagtag

SEQ ID NO: 119402 - DNA, 591 bp, Artificial Sequence
  Description of Artificial Sequence: Synthetic coding sequence
atgggaaatggcaagtcaatcgctggagaccaaaaggccgtgccaactcaggagacacatgtgtggtatcggacttttatgatggagtatccatctggcttacaaactcttcatgaattcaagaccttactgggcttacagggcctcaaccaaaaggcaaacaagcacatcgaccaggtgtacaatactttcgataccaacaaggatggcttcgtcgacttcctggagtttatagccgctgtgaatctgattatgcaagagaagatggagcagaagctcaaatggtactttaagctctatgatgccgatggaaacggatctattgataagaacgaactgctcgacatgtttatggctgtccaagccctgaacggccagcaaaccctctcccccgaggaatttatcaacctcgtgtttcataagatcgacattaataacgacgggaacggagcaacactgtattggattacattcccaacaaaagggatcgattttcgaaggatctatcagtggcacggtaagaggtccggaagcccaggagattgtctgcaggaactccgactcctccagtgcgcagaatccaatctttag

SEQ ID NO: 119403 - DNA, 348 bp, Artificial Sequence
  Description of Artificial Sequence: Synthetic coding sequence
atgaatgcctttttgctgagcgctctgtgcctactcggggcttgggcagccctcgctggaggcgtcaccgtacaggatggaaatttttctttttccttggaatctgtcaagaagctaaaagatctgcaggagcctcaggagcctcgggtgggtaagctgcgaaacttcgcgcccatacccggtgaaccagtcgtgccgattctttgttcgaaccctaacttccctgaggaactcaagccattatgcaaggaaccaaacgcacaagagatacttcagcggcttgaggagatcgccgaagatcctggaacctgcgagatctgtgcatatgccgcatgtactggatgttag

SEQ ID NO: 119404 - DNA, 339 bp, Artificial Sequence
  Description of Artificial Sequence: Synthetic coding sequence
atgggatgtcgtgctgcttctggtctgttgccaggggtcgctgtggttctgctgctgctgcttcaatccacccagagcgtatatatacaataccagggctttagggtccagctggaatctatgaagaagctgtccgatttagaggcacagtgggctccctcccctaggcttcaagctcagagcctgctgcctgctgtgtgccatcatcctgctctccctcaggatcttcagcctgtctgcgccagccaggaggcaagtagcatttttaagaccctgaggaccatcgccaatgacgactgtgaattatgcgtcaatgtggcatgtaccggctgtctgtag

SEQ ID NO: 119405 - DNA, 594 bp, Artificial Sequence
  Description of Artificial Sequence: Synthetic coding sequence
atgagcgggccccggcccgttgtcctcagcgggccctccggcgccggcaaaagtaccctcctgaagcggctgttgcaagagcatagtggcatctttgggttttctgtgtcgcacactacgcggaatcctcgcccaggggaggagaacgggaaagattactacttcgtcacccgtgaagtgatgcaaagggatatcgctgccggagatttcatcgagcatgctgagtttagcggcaatctctacggtacctctaaggttgcagtgcaggccgtacaggccatgaatagaatctgtgtgttagatgtagatcttcaaggggtacggaacattaaagccacagatcttaggcctatctacatctccgtacaaccccctagcctgcatgtgttagagcagagactccggcagagaaacaccgaaactgaggaatccctggtcaagaggctggcagctgcgcaggccgatatggaaagcagcaaagagccggggcttttcgatgttgtcatcataaacgacagtctggaccaggcttatgctgaacttaaagaggctctgagtgaagaaattaagaaggcacagcgcacaggcgcctag

SEQ ID NO: 119406 - DNA, 594 bp, Artificial Sequence
  Description of Artificial Sequence: Synthetic coding sequence
atgtctggccccaggccggtagtcctctctggcccaagtggggcaggcaagtccacactcttaaaaagactgctgcaggaacactctgggatcttcggcttctctgtgagtcatacaacgcgcaacccgaggcccggagaggagaatgggaaggactactacttcgttacaagggaagtgatgcaacgggacattgcagcaggcgacttcatcgaacacgccgaattcagcggcaacctgtatgggacaagcaaggtggctgtgcaagccgtccaggcaatgaaccggatttgcgtactcgatgttgacctccaaggagtgagaaacattaaagcaacagacctgcgccctatctacatatccgtccagcctcccagcctgcacgttctggagcaaaggctgaggcaaaggaatacagagacagaggagagccttgtaaagagattggcagctgcccaggcggacatggaatcatcgaaagagcctggcttgtttgatgtagttattataaacgactctctcgatcaggcatatgcagagctcaaggaggcccttagcgaggaaataaagaaggcgcagcgaactggggcttag

SEQ ID NO: 119407 - DNA, 594 bp, Artificial Sequence
  Description of Artificial Sequence: Synthetic coding sequence
atgtctgggcctcggcccgtggtcctgtctgggccttccggcgccggtaaaagcactcttctaaaaaggttgctgcaggagcacagtgggatcttcggctttagcgtgtcacatactacaaggaatcctagacccggggaagaaaatggaaaggactactatttcgttactagagaagtcatgcagcgggacatcgccgccggcgactttatcgagcatgctgaattttccggaaatctatacggcacttcaaaagtggccgtgcaggcggtacaggccatgaaccgcatttgcgtgctcgacgttgacctgcagggcgtccgaaacattaaggccacggacctgagacccatatacattagtgtccagccaccaagcctacatgttctagagcagcgattgcggcaaaggaacacagagaccgaggagtccctcgtgaaacgactggctgctgctcaggccgacatggaatcctcaaaagaacccggcctgttcgatgtagtgatcatcaatgacagtctggatcaggcatacgccgagcttaaagaggcattatccgaggagatcaagaaggcacagcgcacaggcgcctag

SEQ ID NO: 119408 - DNA, 600 bp, Artificial Sequence
  Description of Artificial Sequence: Synthetic coding sequence
atgagcggacctcgcccagtggtcttatccggccctagcggcgccggaaagagtactcttttgaagagactgttgcaagagcactcagggatttttggctttagtgtctcccgcgagtccagggcactcgtcgaaggataccatgaagagcctgaagctcgccgcggagaacgtcagcgagaggtgatgcagcgggacattgccgctggggatttcatcgaacacgcagagttctccgggaatctctatgggactagcaaggtcgccgtacaggccgtccaggcaatgaataggatttgcgtcttggacgtggatcttcagggggtgagaaatattaaggccaccgacctgagaccaatctatatcagtgtgcagccacctagcctacacgtcctcgagcaacgattgcgccagagaaatacagagactgaagaatcactggtgaagagactggctgctgcccaggccgacatggaatccagtaaggagccaggtctctttgacgtcgtcattataaacgatagtcttgatcaagcttacgccgagttgaaggaagccctaagcgaggagataaagaaggcacagcgcactggtgcctag

SEQ ID NO: 119409 - DNA, 729 bp, Artificial Sequence
  Description of Artificial Sequence: Synthetic coding sequence
atgagcggtccgcggcctgttgtactctcaggtccctccggcgcaggtaagagcacccttctgaaaagattgctccaggaacacagtggtatttttggcttctctgtgtcgcacacaacccggaatccccgtccgggagaagaaaacggcaaggactattattttgtgacaagggaagttatgcaacgggacatcgcagccggtgatttcatcgaacacgccgagttcagtggtaacctttacggtacttcaaaggtggccgtccaggcagtccaagccatgaaccgcatctgcgtgctggacgtcgacctgcagggagtgcgcaacatcaaggctactgacttacgtccaatctacatttccgtgcagccaccctccctgcacgtattacggttgagacagagaaacaccgagacagaagagtctcttgtaaagcggcttgcggctgcccaagccgatatggaaagcagtaaagaacccggtttgtttgatgtggtgattatcaatgacagcttggatcaggcttacgccgagctgaaagaagccctgagcgaggtggggccaagtctttgtctgcctgggcaaggccctagaggtgggctgggggctaggcctttactcagtatgcgacccctgagaaagagccggaagcttaaggggcccgcccccgaggcatgctgtctgttttcagctccaagggcacacacaggccctggacaacagcactag

SEQ ID NO: 119410 - DNA, 657 bp, Artificial Sequence
  Description of Artificial Sequence: Synthetic coding sequence
atgttgagacgcccgctagccggtctcgccgccgcggctctgggccgcgcacctcctgacgggatgagcgggccacggcccgtcgtcctcagcggcccctcaggtgcagggaaaagcaccttgctaaagcggctgctgcaagaacactccggaatttttggattttctgtgtcacataccacaagaaaccctaggcctggagaagagaacggaaaggactattacttcgttacaagggaggtcatgcagcgtgatattgccgctggcgatttcattgagcatgctgagttttctggcaatctttatggcacatccaaagtggcagtgcaggcggtgcaggctatgaatcgaatctgtgtgcttgacgtagatttgcaaggggtacggaatattaaagcaactgacctgagaccaatctacatatccgtccagccaccatctctgcatgtactggagcagagactgcgacagagaaacaccgaaacagaagagagcctggtaaaaaggctggccgccgctcaagcagacatggaaagcagtccggccggcttggaatcttgtcccacggccgctgttcggacagctgccggccaatcccccgcatgtctgatgtggtcttcgctgaccactgcctggacacggcctacgcagagttag

SEQ ID NO: 119411 - DNA, 594 bp, Artificial Sequence
  Description of Artificial Sequence: Synthetic coding sequence
atgtcaggtcctaggccagtcgttttgagtggtccctcgggagctggaaaaagtacgttactcaagaggctacttcaagagcatagcggtattttcggcttctctgtgtcccatacaacccgcaaccctcgcccaggggaggagaacggaaaggactactatttcgtgacgagagaggtaatgcaacgtgacatcgcagccggtgattttattgagcacgccgaattcagcggcaatctgtacggtacttcgaaggttgcagtgcaggccgtccaggccatgaaccgaatttgtgtcctggacgtggatctccagggggttcggaatattaaagctaccgatctgagacctatctatatttctgtgcagccaccgtccctgcatgttcttgaacagaggcttcgacaacgcaatacagagaccgaagagagcctagttaaaaggctggccgccgcacaggccgatatggagtcttctaaggagcccggtctgtttgacgtcgttatcatcaatgactctctggaccaagcctatgctgagttaaaagaggccttatctgaagagatcaagaaggcacaaaggaccggtgcttag

SEQ ID NO: 119412 - DNA, 726 bp, Artificial Sequence
  Description of Artificial Sequence: Synthetic coding sequence
atgcttcgaagaccattagctggcttggccgccgccgccctcgggcgggctccgcctgacgggatgagtggaccccggccagtcgtacttagcggtccaagcggcgcaggcaagtctaccctactgaagaggttgctccaggaacactcagggattttcggattcagcgtctcgcacaccaccaggaacccccgcccaggcgaggagaatggtaaggactactacttcgtcacacgggaagtcatgcagagggacatcgcagccggagacttcattgaacacgcagagttctccggaaatctgtatggaacatctaaggtagccgtccaggctgtccaggccatgaaccgtatttgtgtgctggacgtggatcttcaaggcgtcagaaacatcaaagcgaccgacctgcgccccatttacatcagcgtccagccgcctagcctgcatgtcctggaacagcgtctaagacagcgtaataccgagaccgaagagtccctcgtcaaacgacttgctgcagcgcaggcagacatggagtcgagaaatcaggaatcaagtaaggaccggaggctgaggctggcagtctgttccagacaccctggtcctattcaggaccaggggtcttctattgagccccctccatggcaggctatcaggcagctctgcgctctgggccaacatgtcgagtggcggaggtgttgtccgtgtggatggaatattttgggctag

SEQ ID NO: 119413 - DNA, 594 bp, Artificial Sequence
  Description of Artificial Sequence: Synthetic coding sequence
atgtcaggacccagaccagtcgtgctctctggcccttcgggcgccggcaaatctactttgctgaagcgcttgttgcaggaacacagtggcatctttggtttttctgtgagtcataccactaggaatcccagacccggtgaggagaacggcaaagactattacttcgtaacgcgggaagtaatgcagagggacatcgctgctggcgactttatagagcacgcagaattttccggcaacttgtacggcacctctaaggttgctgttcaagcggttcaggcaatgaatagaatctgcgtgctggacgtcgatctgcaaggcgttaggaacattaaagccactgatttaaggcccatctacatttctgtccagcctccgtcgctgcacgtgctcgagcagcggctccgccagcgaaatacagagacagaggagtctctggtgaagaggctggccgcggcccaggccgacatggagagttccaaagagcccggtcttttcgacgttgttataataaacgacagcttggatcaggcctacgctgagctgaaagaagctttgagtgaggagattaaaaaggcccaacgaaccggcgcctag

SEQ ID NO: 119414 - DNA, 657 bp, Artificial Sequence
  Description of Artificial Sequence: Synthetic coding sequence
atgctgcgcagaccattggctgggcttgcggctgctgccttgggaagagctccacctgacggcatgtcggggcctagacccgtggtgctctccggccctagcggtgccggcaagtcaactctcctgaaaaggctgctgcaggaacacagcggaatcttcgggttcagtgttagtcacaccacgcggaacccccgcccgggcgaagagaacgggaaagactattactttgtgacccgtgaagtaatgcaaagagacattgccgccggtgattttatagagcatgctgaattctctggtaacctctacggaaccagcaaagtcgccgtgcaggccgtgcaggccatgaacagaatctgtgtgcttgatgtggacctccaaggtgtccggaacattaaagcgacagacttgagacctatctacatctcagtacaaccaccatccttgcacgtcctggagcaacggcttcggcagaggaatacagagactgaggaaagtctggtgaaaagactcgcggccgcccaggctgatatggagtcctccaaggagcccggcctctttgacgttgtgattataaatgattcgttggatcaggcttatgcggaactgaaagaggctttgtccgaggagatcaaaaaagcccagcggacaggggcctag

SEQ ID NO: 119415 - DNA, 762 bp, Artificial Sequence
  Description of Artificial Sequence: Synthetic coding sequence
atggccggtagtcaaaaggaggaaatcatgccaccacagcagggggtgcccttccaggagagcgggtgctggggttccatgggcgcccagtccagggaaaggtctggaagagatcatagtggtacttggatttgtgcgggaggcagtcaggaaacatttcatctgggagcccccgtcgagaccacttgcctggctggcatgtcaggtccaagacctgttgtgctttccggtcccagcggagctggcaagtcaaccctgctcaagaggctcctgcaggagcattcgggaattttcggtttctcagttagccacactacgcgcaaccctaggccaggagaggagaatggaaaggactactactttgtgacaagggaggtgatgcagcgcgacatcgccgccggagattttatcgagcacgctgagttctccgggaatctgtacggaaccagcaaagtggccgtgcaggcagtccaggccatgaaccggatatgtgtcttggacgtagacctgcagggagtcaggaacatcaaggccacggacctgcgtccaatttacatttctgtacaaccgccatcactgcatgttttggaacaaagactgcgacagcgtaatactgaaacggaagaatccttggtgaaaagactcgctgccgcgcaggccgatatggaaagtagtaaagaacccggactttttgatgtggtgatcatcaacgacagtttggaccaggcgtacgcagagctaaaggaggcgctgtccgagtag

SEQ ID NO: 119416 - DNA, 516 bp, Artificial Sequence
  Description of Artificial Sequence: Synthetic coding sequence
atgtccggcccacggcccgtggttctgagtggaccaagtggggccgggaaaagcacccttctaaagcgtctgcttcaggaacactcaggaatttttggcttctcagtctcacgcgagagcaacaccacacgaaacccaaggcccggggaggagaacggcaaagattattacttcgtgacaagggaggtgatgcagcgggatatagccgcaggagactttatagagcacgccgagttttctggaaacctatatgggacctccaaagtggctgtgcaggcggtgcaggccatgaataggatctgcgtcctggatgtggacttgcaaggagtccgtaacatcaaggctacagacttgaggccaatttacatttcagttcagccgcctagtcttcatgtcctggagcagagattaaggcagcgaaacacggagacggaggagtccttggtcaaaaggctggctgcagcccaggccgatatggaaagcgagattaagaaggcccagaggacaggggcatag

SEQ ID NO: 119417 - DNA, 819 bp, Artificial Sequence
  Description of Artificial Sequence: Synthetic coding sequence
atggccggctcccagaaggaagagattatgccccctcagcaaggcgtgccctttcaggaatcaggttgttgggggtctatgggcgctcagtctcgggaacggagcggccgggatcactccggaacttggatctgcgcgggagggtcacaggagaccttccacttaggagccccagtggaaacgacctgccttgctgcctctctcctgaccccgcgccacgtgggcccacaggcctgtggcgccgagcgcgcttttggatcctgggaggagcacccggctgaagaggctgcacctggggctcaaagacatctgtggctgcagcgagtgccctatcacgaagaacccgaggctcgccgaggcgagcggcagagagaggtcatgcaaagggacatcgcagccggcgactttattgaacatgccgagttctctggtaacctgtacgggacttctaaggttgctgtccaggcagtccaagctatgaaccgaatttgcgtcttggatgtcgatctgcagggagtgaggaatatcaaggcgaccgacctgcgtccaatctatatctcagtacaacctccttccctccacgtactggagcagagacttcggcagaggaacaccgagactgaggaaagtctcgtcaaaaggttggccgcggcgcaagcggatatggagtccagaaatcaggaaagctccaaagatcgaaggctgaggctcgcagtatgctctaggcaccccggtcctatccaggaccagggctcatcgatcgagcccccgccatggcaagccattcggcagttatgcgcgctggggcagcacgtgtag

SEQ ID NO: 119418 - DNA, 654 bp, Artificial Sequence
  Description of Artificial Sequence: Synthetic coding sequence
atgctgcgccggcctctggccggcctggcagctgctgccctcgggcgtgcccccccggacggcatgagcggcccgcgaccggttgtcttgtctggccccagcggcgctggaaagagcactctgcttaagcgattgctacaagagcactcagggatctttggcttttccgttagccatactaccagaaacccacggcccggagaggaaaatggcaaagactattatttcgttacgcgggaagttatgcagcgggacattgccgcgggcgatttcatcgaacacgcagaatttagtggaaatctgtatggaaccagtaaagtggccgtgcaggctgtgcaggcgatgaaccgcatttgcgtcctagacgttgatctgcagggtgtgagaaatatcaaagccacggatttgaggcctatatatatcagcgtgcagcctccttctctgcacgttctggagcagagattgcggcagaggaacacagagaccgaggagagtctggtaaaacgtctcgccgccgcccaggccgacatggagagtagtaaagagcccggcctctttgacgtggtgataatcaacgactccttagaccaggcgtacgctgagctaaaggaagcactttcagaggaaattaaaaaagcgcagagaaccggctag

SEQ ID NO: 119419 - DNA, 915 bp, Artificial Sequence
  Description of Artificial Sequence: Synthetic coding sequence
atgaacagagctttcagtaggaagaaggacaaaacatggatgcacacgccagaggctctcagtaagcatttcattccgtacaatgccaaattcctgggaagcaccgaagtagagcagcctaagggaaccgaggttgtcagggatgctgtgcgaaagctaaagttcgcaaggcacatcaagaagagcgagggtcagaagatcccaaaggtggagctgcagatctccatttacggtgttaaaatcttagagcctaaaaccaaggaggtccagcacaattgccagctccatagaatatcattttgtgctgatgataagacggataaacgaatcttcaccttcatctgcaaggattcggaaagcaataaacacctgtgctacgttttcgattccgagaagtgcgcagaggagataactctgactatcggacaggctttcgatctggcctacaggaagttccttgagagcggaggtaaagacgtggagacgagaaagcaaattgcgggcttgcaaaagcgaattcaggaccttgaaaccgaaaacatggaactcaagaataaagtccaggaccttgagaaccagcttaggatcacacaggtgtccgctcctcctgccgggtctatgacaccaaaatccccctctacagatatttttgacatgatccccttcagccctatttcccaccagtcctcaatgcccactaggaatgggacccagcctccccccgtgcctagcaggtccaccgaaatcaaaagggacttgtttggagccgagcccttcgacccattcaattgcggggcggctgactttccccccgatatccagtcgaagcttgatgagatgcaggagggctttaagatgggcctgacactagagggcacggtcttttgcctggaccccctggattctcgttgttag

SEQ ID NO: 119420 - DNA, 915 bp, Artificial Sequence
  Description of Artificial Sequence: Synthetic coding sequence
atgaatcgggccttcagtcgcaagaaggataaaacttggatgcacacgcccgaggctctttccaagcactttattccctataatgctaagtttttgggttcaaccgaggtggaacagccgaaggggaccgaggttgttagagacgccgtccgcaagctaaaattcgcccgtcatattaagaaatcagagggacagaaaattccaaaggtagagttgcagatctccatttacggagtaaagatactggaaccaaaaactaaggaagttcagcataattgccagctacatcgaatttctttctgcgccgatgataagacagacaagcggatttttaccttcatctgcaaagatagtgagagcaacaagcacttatgttacgttttcgactcggaaaagtgtgctgaagaaatcacactcactattggacaggcgttcgacctcgcctacaggaaattcctggagtccggaggaaaggacgtcgagactagaaaacagatcgccggcctgcagaaaagaatccaggatttggaaaccgaaaatatggagctcaaaaacaaagtgcaggacttggagaaccagctgcggatcactcaggtctcagcgccacccgcaggctcaatgactcctaagagtccgtctaccgacatcttcgatatgatcccattcagtccgatcagccatcagtcttccatgcctacgagaaacgggacacagccaccgcccgtaccgtccaggtcaacagaaattaagagagatctgttcggtgccgaacccttcgatccttttaactgcggcgctgccgatttcccgccggacattcagagtaaactcgacgaaatgcaagaagggttcaagatggggctgaccctcgagggaacggtgttttgcctcgaccccctcgacagtaggtgttag

SEQ ID NO: 119421 - DNA, 915 bp, Artificial Sequence
  Description of Artificial Sequence: Synthetic coding sequence
atgaatagagcgttttctaggaagaaagacaaaacttggatgcacactcccgaagccttgagcaagcatttcatcccatacaacgcgaagttccttggttccaccgaggtagaacagcccaaagggaccgaggtcgttagagatgccgttagaaagttaaagttcgctcggcatattaagaagagtgagggacagaaaattcctaaagtagaactgcaaattagtatctatggtgtcaaaattctggaacccaaaacaaaagaggtgcagcataactgtcagctgcatagaatctctttctgcgcggatgataagacagacaaaaggatctttaccttcatctgcaaggattctgagtcaaataaacacctctgctatgtgtttgattccgagaagtgtgccgaggagatcacactgacaattgggcaggcattcgacctggcgtaccgtaaattccttgagagcgggggaaaagacgtagagacacgcaagcagattgcaggcctgcagaaaaggattcaggatcttgaaaccgagaatatggagctcaaaaacaaggtgcaagatctcgagaaccagctcagaatcactcaggtttctgcccccccagccggatcaatgactccaaagtcacctagtactgacatcttcgacatgattcctttttcacccatctctcatcagagctcaatgccaactagaaacggaacacaaccacctcctgtcccctctcgttcaaccgagataaaacgagacctgtttggcgcggagccgttcgatccgtttaactgcggagcagcagattttcctccggacatccagtctaagctcgatgagatgcaggaaggatttaaaatgggcctgaccctcgaggggaccgtgttctgtctggatcccctggacagtcgatgttag

SEQ ID NO: 119422 - DNA, 504 bp, Artificial Sequence
  Description of Artificial Sequence: Synthetic coding sequence
atgaacagggctttttctcggaaaaaggataaaacctggatgcacacacccgaggccctctcgaagcatttcataccctacaatgccaagtttctcggttctaccgaggtggagcaaccgaaaggaacagaggttgtgagggatgctgtgaggaagcttaagtttgctcgacacattaaaaaatccgagggccaaaagattcctaaggtggaactgcagattagcatctacggtgtgaagatactcgagcccaaaactaaagaagtgcaacataactgccaactgcaccgaattagcttctgcgcagatgataagaccgacaaaagaatattcacattcatttgcaaagattccgaatccaataaacacctgtgttatgtgttcgatagcgaaaagtgcgtctctatacctgacgtggtaggttggtttgtgcttttttataaacccgggattgtgctgcttctggccttagctaaataccttaagatgaacaactttttgtag

SEQ ID NO: 119423 - DNA, 915 bp, Artificial Sequence
  Description of Artificial Sequence: Synthetic coding sequence
atgaatcgggcattctcgaggaagaaggacaaaacatggatgcatactccagaagctctatcaaagcatttcatcccgtacaatgcgaaattcctggggagtaccgaagtagaacagccaaagggtacggaagttgtgcgtgacgcggtccgcaagctgaagtttgcgcgccacatcaagaagtctgaaggccagaagattccaaaagtcgagttacaaatctccatttacggggtgaagatacttgaaccgaaaaccaaagaggttcagcataattgccagctccacagaatcagtttctgcgcagatgataagaccgataaaagaatctttacctttatctgcaaagattctgagtccaacaagcacctgtgttatgtgtttgatagcgaaaagtgtgcggaggagataaccctgaccatcggacaggcctttgacctcgcctacaggaagtttctggagtcaggcggaaaagacgtcgaaactaggaaacagattgcgggcctgcagaagcggatccaggacctggagacagaaaatatggagcttaaaaacaaggtccaggacctggagaaccagctgcgaatcactcaggtcagtgccccacccgctggatccatgacccctaaatctccatcaacggatattttcgacatgataccattttcccctatctcccaccaaagctcaatgccgacaagaaatgggacccagcctccacccgtgcccagtcggtctaccgagattaagcgcgatcttttcggcgcggaaccattcgacccctttaactgtggtgccgcggattttccccccgacattcagagcaagctcgacgaaatgcaggaaggattcaaaatggggttgacacttgaggggactgtattttgcctggaccccctggactctagatgctag

SEQ ID NO: 119424 - DNA, 207 bp, Artificial Sequence
  Description of Artificial Sequence: Synthetic coding sequence
atgaatagagccttttcccgaaaaaaggacaagacctggatgcacacacccgaagctctgagtaagcatttcatcccctacaatgctaagttcctgggatctacagaagttgagcagcccaaagggacggaggtcgttcgggatgccgtaagaaagcttaaattcgcacgccatataaagaagagcgaggggcagaaaattccctag

SEQ ID NO: 119425 - DNA, 504 bp, Artificial Sequence
  Description of Artificial Sequence: Synthetic coding sequence
atgaatcgagccttctcccggaagaaggataaaacctggatgcacactccagaagcattatctaagcacttcatcccctacaacgctaaattcctggggagcactgaagtcgagcagcccaagggtacggaagttgtgcgagatgctgttcggaaactgaaattcgcaaggcatatcaagaaaagtgaaggacagaagatcccaaaggtcgagcttcagatcagcatctacggagtcaaaattctggaaccaaaaactaaggaggtgcagcacaactgccagctccaccgtatttccttctgcgcggatgacaagactgacaagcgcatctttaccttcatttgtaaagactctgaaagtaataagcatctgtgctatgtgttcgattcagaaaaatgtgtgagcatcccggatgtggttggatggtttgtccttttctataagcctggcatagtactgctgctagctctcgcaaaatatctgaaaatgaataacttcctgtag

SEQ ID NO: 119426 - DNA, 585 bp, Artificial Sequence
  Description of Artificial Sequence: Synthetic coding sequence
atgactgagaatagtaccagcgctccggctgctaaacctaagcgggctaaggcctcaaaaaagagtacagatcatcccaagtatagcgacatgatcgtagcagctattcaggctgagaagaatcgcgccggttctagccggcagtccatacagaaatatataaaaagccactacaaggtgggcgaaaacgccgacagccagataaagcttagtattaaacgcctcgtgacaaccggcgtgttaaaacagactaaaggggtaggagccagcggttcctttagactggccaagtccgacgagcctaagaagagcgttgcatttaaaaagaccaaaaaggagataaagaaagtcgccacacccaaaaaagctagcaagccaaagaaggccgcctcgaaggctcctacaaagaaacccaaagcaacccccgtgaaaaaagccaagaagaaactggcggctacacccaaaaaagcaaagaaacctaaaacggtgaaggcaaagcccgtcaaggcctcaaagccaaaaaaggctaaacccgtgaagcctaaagccaagtctagcgcgaagcgcgcgggaaaaaagaagtag

SEQ ID NO: 119427 - DNA, 534 bp, Artificial Sequence
  Description of Artificial Sequence: Synthetic coding sequence
atgacagaaaaaagtacagatcaccccaaatactccgatatgatcgtcgctgcaatccaggccgagaaaaatagagccgggtcttcacgtcaatcgattcaaaagtatatcaagtcgcattataaggtcggggaaaatgctgactctcagatcaagctgagcattaaaagacttgtgaccacaggtgtcctcaaacagaccaaaggagtgggtgcaagcggctcctttagacttgccaagagcgacgaaccaaagaagtctgtggctttcaagaagactaaaaaggagatcaaaaaggtcgcaacgccaaaaaaggcttccaagccaaaaaaggccgcttcaaaagcccctactaagaaacccaaagctacaccagtgaagaaggcaaagaaaaaactggcggcaacaccaaagaaggccaaaaagccaaaaacagttaaggccaaacccgttaaagcgagcaagccaaagaaggccaagccagtcaaaccgaaggcgaagtcatcagccaaaagagcaggcaagaagaaatag

SEQ ID NO: 119428 - DNA, 411 bp, Artificial Sequence
  Description of Artificial Sequence: Synthetic coding sequence
atggctcgcacaaaacagactgcccgcaaaagtaccggtggtaaggccccccggaaacagttggcaactaaggccgctcgcaagagcgcccctagcacgggcggcgtgaagaaaccacacaggtaccgcccaggtactgtagcacttagggaaatccgccggtatcagaagagcacggagcttctgatccgtaagctgccgtttcagaggctggtacgggagatcgcccaagatttcaagacagacttgcggtttcaatccgcagctatcggagccctccaggaagcatcagaggcatacctcgtgggcctgtttgaggacacaaacttgtgtgcgatccacgcaaaacgtgtgaccatcatgcccaaggacattcagttggcccgaaggatcagaggagagagagcatag

SEQ ID NO: 119429 - DNA, 372 bp, Artificial Sequence
  Description of Artificial Sequence: Synthetic coding sequence
atggccagaactaaacagacagcaaggaagtctactgggggaaaagcgccaagaaaacaactcgcaacaaaggcggccagaaaatctgctccaagcactggaggggtgaagaagcctcatcgatataggcctgggaccgtggccctacgcgaaattcggagataccagaaatccactgagctcctgataagaaagctgccgtttcaacgattggtgcgcgaaattgcacaagattttaaaactgaccttcgctttcagtccgccgccatcggcgcccttcaagtgaaatggtgggtgggtcgcttacgcgtgtgtatacccgtcgtttatcaggagcaatttcaaatcgtagcatgcgcatatatcatctag

SEQ ID NO: 119430 - DNA, 411 bp, Artificial Sequence
  Description of Artificial Sequence: Synthetic coding sequence
atggctcgaactaagcagacagcaagaaaaagtaccggaggcaaagcaccaagaaagcagcttgccaccaaggctgcccgaaagagtgccccatccaccggcggggtcaagaagccacaccgctatcgcccaggaaccgtggcactgagagagattcgccggtatcaaaagtctacggaactgctaataaggaaacttcccttccagcgccttgtaagggaaattgcccaagactttaagaccgacctgcgattccagtctgctgcaataggtgcattacaggaggcctcagaggcgtatcttgtggggttgttcgaggacactaatctgtgcgctatccatgccaaacgggtgaccatcatgcccaaagatattcagctggctaggcggattagaggagagcgggcctag

SEQ ID NO: 119431 - DNA, 411 bp, Artificial Sequence
  Description of Artificial Sequence: Synthetic coding sequence
atggccaggactaagcagactgcacgaaagagcaccggtggcaaagctccccgcaaacagctggcaacaaaagctgccaggaaaagcgccccttctacaggcggggtgaagaaacctcatcgataccgtccaggcaccgttgccctgagggaaatccggagatatcagaaaagcactgaactcttgatcagaaaactgcccttccagcgcctagttcgcgagattgctcaggacttcaagactgacttaagatttcagtcagcagcaatcggtgcattgcaggaagcatctgaggcatacctcgttggcctattcgaagacaccaatctgtgtgccatacacgctaagcgcgtcactatcatgccgaaggatatccaactcgcccgccggattagaggggagagagcctag

SEQ ID NO: 119432 - DNA, 411 bp, Artificial Sequence
  Description of Artificial Sequence: Synthetic coding sequence
atggcaagaacaaagcagacagcacgaaagagcactgggggaaaggcaccacgcaaacagctcgctacaaaggcagctcgaaaatccgccccaagcaccggcggcgttaagaaacctcatcgctatcgaccaggcaccgtggctctgagggaaatcagacgctatcagaaatccacagagttgcttatccgaaagctgcccttccagcggttggtgcgcgaaatcgcccaggacttcaaaactgaccttcggttccagagtgctgccatcggggctctgcaggaggcctcagaagcctatctggtggggttattcgaggacaccaacctttgcgccatccatgctaagcgtgttactatcatgcccaaggacatccagctagcacggaggatcaggggtgagagagcctag

SEQ ID NO: 119433 - DNA, 1047 bp, Artificial Sequence
  Description of Artificial Sequence: Synthetic coding sequence
atgcccgatgaactgaccgagcccgggcgcgccacccccgctagagccagtagctttttaatcgagaatcttcttgccgctgaagcaaagggagctgggcgggccacgcagggtgacggttcaagggaagatgaagaggaggacgacgacgaccccgaggacgaggatgcagagcaggcccggaggcgccgcctgcagcgaagacgccagctcctggcaggcacaggtcctggaggagaggcccgagcacgggcgctgctggggcccggcgccctcggcttaggaccccgtcccccacctggaccggggccacccttcgcgttggggtgtggcggcgctgctaggtggtaccccagagcacacggcgggtacggaggcggcctgtcccccgatacgagcgatagagacagcccggagaccggagaagaaatgggcagagcagagggcgcttggcctcgcggccctggtccgggcgccgtccagagagaggcagctgaacttgcggctcgcgggccggccgccggtacagaggaggctagcgaattggctgaagtacccgctgccgccggtgagactagaggcggggttggcgtcggtggaggtagaaagaagaagacccgcaccgtgttcagtcgctcccaagtcttccagcttgagagcacttttgaccttaagcgatacctgtcaagcgctgagcgcgccggactcgcggcctcccttcagcttactgagacgcaagtcaagatttggttccagaacaggcgaaataagtggaaacgccagctagcagccgagttggaggctgcctccctgtcaccgcctggagcccaacgcctggtgcgggtgcccgttctgtatcacgagtcgccacctgccgctgcagccgcaggccctcccgcaactctcccattccctctggccccagccgcgccggccccccctccgcctctcctcggcttcagtggcgccttggcataccccttggccgcatttccggctgctgcttccgttccctttctgcgtgctcaaatgccaggcctcgtatag

SEQ ID NO: 119434 - DNA, 822 bp, Artificial Sequence
  Description of Artificial Sequence: Synthetic coding sequence
atgggctctaaggaagatgccggaaaaggctgcccggccgccggaggcgtgtcaagctttacaattcaatccatccttggaggggggccttcggaagctccacgcgagccagtgggctggcccgcccgaaaaagatctctgtcagtttccagcgaggaagaagaaccagatgacgggtggaaggcacctgcctgcttttgccctgatcagcacggccccaaagagcaaggtcctaagcaccaccctccgatcccctttccctgtctcggaacgccgaagggaagtggcggcagtggaccagggggtcttgagcgcacgccattcctgagcccctctcacagcgactttaaagaggagaaggagagactactgcccgccggatccccttcgcctggatcggagcgcccccgtgatggaggcgccgagcggcaggcaggagcagcaaagaaaaaaactaggacagtcttttcccgctcacaggtctatcagctggagtcaaccttcgatatgaagcgctacctctcctcttctgagagagcatgtttagccagctctttgcagctcacagaaacgcaggtgaaaacgtggtttcagaaccgccggaataaatggaaaagacagctatctgccgagctggaggctgctaacatggcacatgcgagtgctcaaactttggtcagcatgcctcttgtattccgggattcaagccttctcagagtacctgttccccgtagcctggcatttcctgccccgctgtattatccaggaagcaacctttcagccctgccgctttataatctttacaataaactcgactattag

SEQ ID NO: 119435 - DNA, 1074 bp, Artificial Sequence
  Description of Artificial Sequence: Synthetic coding sequence
atgcccgagcccggcccagatgcggctggcaccgcgtcagctcagcctcagccccccccacctccacctccagcacctaaggagagcccattctctattaagaacctgcttaacggagatcatcacagacctccccccaaacctcagccgcctcccagaactctattcgcaccagctagcgccgccgcagccgcagccgccgctgccgctgctgcggcaaagggggccctggaaggggctgcggggtttgctctgtcacaggtgggagacctggcttttccgcgatttgaaatcccggcccagaggttcgctctgcccgcccattatcttgagcggtccccggcttggtggtacccgtatacactgacacccgcgggcggacacctgcctcggcctgaagcctctgagaaagccctcctgcgggattcttcccctgcctccggtacggatagagactcaccagaacccctgctcaaggcggatccagaccataaggagctggactcgaagtcccctgacgagataattctggaagagtcagacagcgaggagagcaagaaggagggtgaagccgcccccggcgctgcaggcgccagcgtgggagccgccgctgcgactccgggagctgaagactggaaaaaaggtgcggagagtccagagaaaaagcccgcctgcaggaaaaaaaaaacacgcacggtgttctcaaggtcccaagtctttcagttggagagcacctttgacatgaagaggtacctgagtagtagtgaaagagccgggttggccgcatctttacatcttacggagacccaagtcaaaatttggtttcaaaatcgcagaaataagtggaagagacagcttgcagcggaattagaagccgccaacctctcgcacgcagccgcccagcgaatcgtaagagtgcctattctatatcacgagaacagcgctgcagagggagcagctgccgccgctgctggagcccccgtgccagtgtctcagccccttttaacattcccccatcctgtctattactcccacccagttgtaagttcagtccccctgctccgcccagtttag

SEQ ID NO: 119436 - DNA, 3405 bp, Artificial Sequence
  Description of Artificial Sequence: Synthetic coding sequence
atggagtctaccccctccttcctaaaaggcacccctacctgggagaaaaccgcgcccgagaacggaattgtacgtcaggaaccaggatctcctcctagagatggtctccaccatgggcccctgtgcttgggcgagccagcacctttttggcggggcgtgctatccactcctgattcttggttgcctcctggtttccctcaggggcctaaggacatgcttccccttgtcgagggcgaagggcctcagaatggcgagaggaaggtgaactggctggggtcaaaggaggggttaagatggaaggaggccatgcttactcacccactcgccttttgcggaccagcttgccctcccaggtgtggcccactaatgcctgagcattctggcggccatcttaaatctgatccagtcgcctttaggccatggcattgcccattcctcctggaaaccaaaattctggagcgcgcacctttttgggtccccacgtgcctgcccccttacctggtgtcaggcctgcctcctgagcatccctgtgattggcccctcacaccgcatccttgggtgtatagtggcggtcaaccgaaggtgccgtctgctttctcactagggagcaaagggttctactataaggatccctctatcccaaggctcgccaaagagcccctcgccgccgccgagcccggactgtttgggctcaattccggcggccatctacagagagctggggaggcagaacgcccatcactgcaccaacgcgatggagagatgggcgcgggccggcaacagaatccttgtcctctgtttctgggtcaacccgacaccgtgccctggacctcatggcctgcatgtccccctggcctggtgcacacacttggaaacgtatgggccggaccaggcgatggaaatctgggctatcagttgggtccgccagctacaccgcgctgcccttcaccagagccgcccgtgacccagagaggctgctgtagctcttacccacccactaaaggggggggcttgggaccgtgcggaaagtgtcaggagggcttggaaggcggcgcctccggcgcttctgaaccttcggaagaagtcaacaaggcctcaggccctagagcttgtccaccttcgcatcacactaaattaaagaagacttggttgactaggcattcagagcagttcgaatgtccccggggctgcccagaagttgaggagcggcctgtggccaggctgcgggctctgaagcgggcaggttcccctgaggtgcagggggccatgggatcacccgctcccaagcgtccaccagatcctttccctggcactgctgagcagggcgccggcggatggcaggaggtgagggacacctccatcggcaataaagacgtcgattccggtcaacacgatgagcagaagggcccgcaggacggccaggccagtctccaggatcctggacttcaggacatcccttgtctggctctgccagccaagctagctcagtgtcagtcttgcgcccaggcagccggcgaaggaggtggccatgcatgccactcccagcaggtcagacgaagtcccctggggggcgagctccagcaggaggaagatacagccaccaacagttcatctgaggagggccctgggagtggcccggattcacgtctcagcactggcctcgccaagcacctgctaagcggcctgggcgacagactgtgtagattgctccggagggagagagaagcactagcctgggctcaaagagagggtcagggccccgccgtcaccgaggactccccaggcatcccacgatgctgctccagatgtcatcacggactgttcaatactcactggaggtgccctcggtgcagtcataggttgtgcgtagcgtgtggacgcgtcgcgggcaccggaagggcccgagagaaagccgggtttcaggagcagtcggctgaggaatgcacccaggaggcgggccacgccgcgtgcagtttgatgctgactcaatttgtttcctctcaggctttggccgaactgagcacagctatgcaccaggtctgggtgaaatttgacattcgcggccactgtccatgccaggccgatgcccgcgtgtgggctccgggggatgccggccagcagaaagaatcaacccaaaaaacaccacctactccacaacccagctgcaatggtgatactcatcgtacgaagtcaattaaagaggagacacccgacagcgccgaaacgccggcagaagaccgggctggccggggacccctcccttgtcccagtctctgcgagttattggccagcacagccgtgaaattgtgcctcggccacgagagaattcatatggcgtttgcgcctgttactccagccctgccgtcagacgatcgcattactaacatccttgacagcatcattgcacaggtcgtggagagaaaaatccaagaaaaggccctcgggccgggcctgcgtgctggcccggggcttaggaaaggactagggttaccactgtcaccagtccgccccagattgccaccgcctggcgctcttctatggctgcaagaaccacagccctgcccacgaaggggctttcacctttttcaggaacattggcggcagggccagcccgtactcgtatccggtatccagcgaaccctccaaggcaatttgtggggcaccgaggcattgggggcgttgggagggcaggtgcaggcattgtctcctctggggcctccgcagccgagtagcctaggtagtaccacattttgggaaggattttcctggcccgagttgcgccctaaatccgacgaaggtagtgtcctcttactgcatagagccctgggagacgaggatacctccagagtggagaatcttgcagcaagcctgccgctgcctgagtattgtgctctgcacggcaagttgaatctagcgagctacctcccgccaggtctcgcccttagacctctggagcctcagctctgggctgcatatggtgtgtcaccacacagggggcacctgggcacaaagaatctgtgcgtggaggtcgccgatctcgtttccattcttgtccacgcagatactccgctgccagcttggcacagggcccagaaagatttcctatcgggcctcgacggcgagggcctctggagtccgggctcacaagtcagtaccgtctggcatgtctttagagctcaagacgcccagcgcattagacgattcctgcagatggtgcagggcctggtaagcaccgttagtgtcacccagcactttcttagcccagagaccagtgctcttagcgcacagctgtgccaccagggcccttctctgccacccgattgccatttattgtatgcccagatggactgggcagtttttcaggcagtgaaggtcgctgtggggactctccaggaagccaaatag

SEQ ID NO: 119437 - DNA, 3570 bp, Artificial Sequence
  Description of Artificial Sequence: Synthetic coding sequence
atggagtccacgccctcatttctcaagggcactcccacctgggaaaaaaccgcccccgaaaatggaattgtgcggcaggagcccggcagcccacccagggacggactccaccacggcccactatgcctgggagagcccgctcccttttggcgaggcgtgttgtcaactccagactcttggcttccacccgggttcccacaggggcctaaggatatgctgcctttggtcgagggagaaggccctcagaatggggagaggaaggtgaattggctggggtctaaggagggccttaggtggaaagaagcaatgctgacacatcctctggccttctgtggtcctgcttgtccgccgagatgtggcccactcatgcctgaacatagtgggggccacttaaaaagcgaccccgtggccttccgcccatggcactgcccgtttctgctggagacaaaaatcctagagagagccccattttgggtcccaacctgtctgcccccatatctggtaagcggactgccaccagagcacccctgtgactggcctttgactccacacccctgggtgtattcaggaggacaacctaaggttcctagcgctttttcacttgggagcaaggggttctactacaaggacccctccatccctaggcttgctaaagaaccattggcagctgccgaaccaggactgtttggtctgaattcgggagggcacctccagcgcgcgggggaggcagaaagacccagtctgcatcagcgagacggagagatgggagctggccgccagcaaaatccctgccctctgtttctgggccagcctgataccgttccatggacgagttggcctgcgtgccctccggggctcgtccatactctcggcaacgtttgggccgggccaggagatggaaatctgggttaccagctgggaccgcccgcgacccctagatgcccctcaccagagcctcccgtaactcagcgcggatgttgctcaagctatccgccaaccaaagggggcggactgggaccatgtggcaaatgccaggaaggactcgaggggggtgcctccggggcttcagaaccaagtgaggaagtgaacaaggcgtccggcccacgcgcctgcccaccctcgcaccacactaaactgaaaaaaacatggttgacccggcactcagaacagtttgaatgcccccgtggctgtcctgaagtggaggaaaggcccgtggcgcgtctaagggccctgaaacgcgctggtagtcctgaagtgcagggtgccatggggagtcctgcccccaaaagacctccagacccttttccagggacggccgaacaaggcgctggaggatggcaggaggttagggacacctctatcggaaataaagacgtcgattccgggcagcacgacgagcagaagggccctcaggatgggcaggcctcactacaggatccaggtttgcaggatattccctgcctggccctgcccgccaagttggcccagtgccagtcctgcgcccaggccgcaggtgaggggggaggtcacgcttgccacagccagcaagtacgccgctcacctctgggtggggaactgcaacaggaagaagataccgcgaccaacagcagttccgaggaaggacccgggagtgggcctgacagccgcctgagtactggtctggccaagcacctgctgtccggactcggcgatcgcctttgtcgtctgttgcggcgagagagggaggcgcttgcctgggcccagcgagaaggccagggccctgcagtcactgaagacagtcctggcattcctcgctgttgttcacgatgccatcacgggttatttaacacccactggcgctgcccaaggtgttcacatcggctctgtgttgcttgtggccgagtggccggaacaggccgggcccgcgagaaagctggctttcaagagcagtccgcagaagagtgtacgcaggaagccggacacgccgcttgttccctcatgctgacgcagttcgtgagcagccaggcgctcgcagagttaagcaccgccatgcaccaggtgtgggttaagttcgatatccgggggcattgtccttgccaggcagatgcccgtgtctgggctccaggcgatgcgggccagcaaaaggagtccacccagaagacaccacctactccacagccttcctgcaatggggacacccaccggaccaagtcaataaaggaggaaactcctgactcagctgaaacacccgccgaggaccgggctggaagaggaccactgccttgcccaagcctctgtgaactgctagccagcacagccgttaagttatgtctggggcacgagcggatccatatggccttcgctcctgtgacccctgccttgccttcggatgatcggattacaaacatacttgacagtatcattgcccaagtggtcgagcgaaaaatccaagaaaaagccctcggtccaggactgcgcgcagggccaggactgcggaagggactggggctgcccctatctcctgtacgtccccgcctccccccgcctggcgctcttctgtggcttcaggagccacagccctgcccaagaagaggattccacctattccaagagcactggcgccaaggccagcctgttttggtctcaggtatccaacgtacgctgcaaggcaacctttggggaacagaagccctgggggcccttggtggacaggtccaggctctgagtcccctgggtccacctcaaccctcatcccttggttctacaactttttgggaaggcttctcatggcctgagctccgcccaaagtccgacgagggttcggtgctgctgttacacagggccctgggcgacgaggataccagccgggtggagaaccttgctgcatcattaccactccctgagtattgcgctctgcacggaaagctcaatctagcttcttaccttcctcctggccttgccctgaggcccctcgaaccccagctgtgggcagcctacggcgtcagtccacacaggggccacctcggtactaagaacctttgtgtggaggtggccgatctggtgagtatcctagtccacgccgatactcctctccctgcatggcatagagcacagaaggactttctttcaggccttgatggtgaaggcctgtggtcacctgggagtcaagtgtctactgtttggcatgtgttcagagcccaggacgcccagaggattagacgcttcctgcagatggtgtgccccgctggggccggtgccctggagccaggggccccaggctcatgctacctggatgccggcttaaggcgccgccttagagaggagtggggagtgtcctgttggacattgctacaggcgcctggtgaggccgttctcgtgccagctggtgccccacatcaggtgcaaggcctggttagtacggtcagcgtcactcagcactttttaagccctgagacatcagcacttagtgcgcagctctgtcatcaaggcccttcactgccaccagattgccacctgttatatgcccagatggattgggccgtttttcaagcggtcaaagtagctgttgggacgcttcaagaggccaagtag

SEQ ID NO: 119438 - DNA, 1410 bp, Artificial Sequence
  Description of Artificial Sequence: Synthetic coding sequence
atggcatctccgcgggagctaacccagaaccccttgaagaagatctggatgccctactcgaacggtaggcctgctttgcacgcctgtcagcgaggggtctgcatgaccaattgtcccactttgatcgtcatggtagggcttcccgcccgaggcaagacatacatttccaaaaaactgaccaggtatctgaattggattggcgttccgactagagaattcaacgttggacaatacagacgggatgtagtgaaaacatataaatcatttgaattcttccttcctgacaatgaagaagggctcaagatcaggaagcagtgtgctctggccgccttaagggacgtgcgtcgattcttgtcggaagaaggcggccacgtggcggtttttgatgctactaacacgacacgggaaagaagggctactatttttaactttggcgaacagaacgggtacaagacctttttcgtcgaatccatatgcgtggatcccgaagtcatagccgcaaacatcgtacaggttaaactaggcagccccgactacgtaaatcgagatagtgacgaagctacagaagactttatgcgacgcatagagtgctacgaaaattcctacgaaagtctcgacgaggatctggatcgggatctgtcttatatcaaaataatggacgtaggccagtcttatgtggtcaatcgggttgccgatcacatacagtcccggatagtgtactacctcatgaatattcatgtgaccccccgctcgatctatctctgccgacacggggaatccgaacttaacctgaaagggcggatcggcggtgaccctgggctgagcccacgggggcgcgagtttgctaagagcctcgcccagttcattagtgaccaaaacatcaaagatctcaaagtatggacaagccagatgaaacgtaccatccagacagcagaggcgttgggggtgccatacgagcagtggaaagtcctcaacgaaattgatgccggcgtgtgtgaggaaatgacttacgaggagattcaggacaattatcctttagagtttgcgctccgggaccaggataagtacaggtacagataccccaagggagaaagctacgaggacctcgtccaaagactcgagccagtgattatggagctggagagacaagagaacgttctagttatctgccaccaagcggtgatgcgctgtctgttagcctatttcctcgacaaggctgccgagcagctgccttacctgaaatgtcccttacatacagttttgaagctgacccccgtggcttacggttgtaaggtggagagtatcttccttaatgttgcagcagtgaacacccaccgggacagacctcagaacgtcgatatcagcaggccacccgaggaggccctcgtaaccgtgccagcccaccagtag

SEQ ID NO: 119439 - DNA, 522 bp, Artificial Sequence
  Description of Artificial Sequence: Synthetic coding sequence
atgggcctgccacgcagagccggtgacgccgctgagctaagaaaatcactcaagccacttctggaaaaaagacgcagagcccggattaatcagtccctctctcagctgaagggactcatcctgccattgctggggagagaaaacagtaattgctcaaagcttgagaaggccgacgtgctggagatgactgttaggttcctgcaagagctgcctgcaagcagctggccaacagcagcccccctgccatgcgattcctatcgcgaaggctattcagcgtgcgtcgcacgcctcgccagggttctgccagcgtgcagggtattagagcctgccgtgtcagcacggctgttggagcacctttggaggagagctgcatccgctacactggatggtgggcgcgcaggagacagctccgggccaagtgctcctgctccagcccccgcctcagccccggaacctgcatctgcccccgtgccttcacctccaagcccaccatgcggcccgggtctgtggcgcccgtggtag

SEQ ID NO: 119440 - DNA, 231 bp, Artificial Sequence
  Description of Artificial Sequence: Synthetic coding sequence
atgggcctgcctagaagagctggggacgcggcagagctaagaaagtctctcaagcctctgctggaaaaaaggcggcgggcacgcatcaaccagtccttatcccaattaaagggtctcattctgcctctgctgggtagggaagacgcttccggctggcacacctggctgcccctgcacgcacagaattgcttccttctgtatatccaggctccagaacagcctcctgcctag

SEQ ID NO: 119441 - DNA, 231 bp, Artificial Sequence
  Description of Artificial Sequence: Synthetic coding sequence
atggggttgccacgtagggcgggggacgccgctgaactaaggaagtccctcaagcctctactagagaagagacgccgcgctagaattaatcaaagtctctcccagctgaagggtctcatcttgccacttttagggcgagaggacgcctcgggctggcacacgtggctcccactccatgcgcagaattgttttctgctctatatccaggcccccgagcagccccccgcctag

SEQ ID NO: 119442 - DNA, 561 bp, Artificial Sequence
  Description of Artificial Sequence: Synthetic coding sequence
atggagaagaagagacgggcccgtatcaatgtgtcactcgaacaacttaaatcactgctggagaaacattatagccatcaaattcgcaagagaaaactcgaaaaggcagacatacttgagctgtctgtaaagtatatgagatccctgcagaacagccttcaggggttatggcctgtgccacggggcgctgagcagccttccggcttcaggtcttgcctgcctggtgtctcccagctgttacggagaggcgacgaggtggggtctgggctccgttgtcctctcgtacccgaaagcgccgctggtagtaccatggattcagccggtcttgggcaagaagcccctgccctattccgcccctgcacacccgcagtttgggccccggcgcccgcggctggcggccctcgctcgcccccgcccctgttgctgctgcccgagtccctcccaggaagtagcgcttctgtgccaccgcctcagcccgccagcagtagatgcgctgagtcgccgggcttgggcctgcgagtgtggcgaccttgggggagtcctggcgatgatctgaactag

SEQ ID NO: 119443 - DNA, 666 bp, Artificial Sequence
  Description of Artificial Sequence: Synthetic coding sequence
atggccgccgacactccaggaaagcctagtgcttccccaatggctggagctccagcctcagcgtcaagaaccccagacaaaccccgtagcgccgctgaacataggaagtctagcaaaccagtgatggaaaagaggaggcgggcacggattaacgagtccctggcccaactaaagaccttaatactggacgctctgaggaaagaatcatcaagacacagtaagctggaaaaagccgacatcctggaaatgacggtgcgccacctccgatcgttaagaagagtgcaagtaactgctgccctgtctgccgatccggccgtcctgggaaagtaccgtgcaggcttccacgaatgtctggccgaagtaaaccgcttcctggcgggttgtgagggtgtccctgccgatgtgaggtcccgactgctgggtcacctcgcagcttgtctgcggcagctagggccctcaaggcggcccgcaagcctgtcacctgcggcgccagccgaggcaccagcacccgaagtgtacgccggacggccactcctgcccagccttggaggtcccttcccccttcttgctccgcccttgctacctggcctgacccgcgcgctgccagccgcccccagagctggcccccaaggcccagggggcccctggcgcccatggctccggtag

SEQ ID NO: 119444 - DNA, 744 bp, Artificial Sequence
  Description of Artificial Sequence: Synthetic coding sequence
atggccgcagacactccaggaaagccctctgcttcacccatggccggagcgcccgctagcgcctccagaactcccgataagccaagatccgccgcagagcataggaaagtaggatctcgcccaggagtgagaggcgctaccggtggccgagaagggcgaggcactcagccagtgcccgatcctcaatcttcgaaacccgtaatggaaaagcgccgacgcgcaaggattaacgagtcgctagcacagctgaagaccttgatcctggacgccctgaggaaggagtcgtcaaggcacagtaagcttgaaaaagcagatatcctcgaaatgacggtccggcatctgcgcagtctccgtcgagtgcaggtaacagctgcactgtcggcagatcctgccgtcctcggtaagtaccgtgctggattccacgagtgcctggcagaagtgaatcgctttctggccgggtgtgaaggagttccggcggatgtaaggagtcgactgcttggacacctggcggcctgtctgaggcagctcggtccatccaggaggcccgctagcctgagccctgcagctccagctgaggcccccgctcccgaggtatatgccgggcggcctctcctgccctcacttgggggccctttcccccttctggcgccccccctgcttcctgggctcacgagagccttgccagccgcaccgagggccggtccgcaaggccccgggggtccctggcggccttggttacgctag

SEQ ID NO: 119445 - DNA, 501 bp, Artificial Sequence
  Description of Artificial Sequence: Synthetic coding sequence
atggccccttccactgtggcggtagagctcctgtcacccaaagaaaaaaatcgtctgagaaagcctgtggtagagaagatgaggcgagatcggattaattcttccattgagcaactcaaacttctgctcgagcaggaatttgctagacaccagccaaactccaagctggagaaggcagacattctggagatggccgtgtcttatctgaaacattccaaagcatttgttgcagccgctgggcctaagtcactgcatcaggactacagcgagggatattcctggtgtctgcaagaagccgttcagttcctcactctgcacgccgctagcgacactcagatgaagctgctttatcacttccagagaccacccgccgcacctgctgctccagcgaaagaaccgaaggcccccggagccgccccgcctccagccctaagtgcgaaggccaccgccgccgctgcggccgctcaccaacccgcatgcggtttgtggcgcccttggtag

SEQ ID NO: 119446 - DNA, 675 bp, Artificial Sequence
  Description of Artificial Sequence: Synthetic coding sequence
atggcaccaccagcggcacctggaagagaccgcgtgggaagggaagacgaggatggctgggagactagaggggataggaaggcccgaaaaccactggttgaaaaaaaacggcgggccagaattaacgaaagtctccaggaactcaggctcctactggcgggggccgaggtccaggctaagttggagaatgcagaggttctcgaactcacggtgaggagggtccaaggcgtcttgaggggcagggccagagagagggagcagctgcaggccgaggcgtcagaacgattcgctgcaggatacatacagtgcatgcatgaggtgcatacttttgtatccacgtgccaggcaatcgatgcaaccgtggcagcagaactgttgaaccacttgttagaaagtatgccactcagagagggctcgagctttcaggatcttctgggcgatgccctggccggcccacctagagcacctgggagatccggctggcccgcagggggtgctcccggctcaccgatcccgagccccccagggcccggagacgacctgtgctcagacttagaggaggcccccgaggcagaacttagccaggcgccagccgagggcccagatctcgtgcctgcagctctcggttcattgacaacagcccagatcgccaggtccgtgtggagaccctggtag

SEQ ID NO: 119447 - DNA, 645 bp, Artificial Sequence
  Description of Artificial Sequence: Synthetic coding sequence
atggctccccctgctgctccgggtagggacagagtcgggcgcgaggatgaggatgggtgggaaactagaggggaccgcaaggctcgaaaacccctagtggaaaagaagcgccgcgcgcgaattaatgaatcattgcaggagcttcgcctgttgctggccggtgctgaagtacaggctaagctggaaaacgccgaggttcttgaacttactgtgagaagggtccaaggtgtgctgcgtgggcgcgcccgtggggagtggcggcgcggtggacgcgggaggagaccccgggctccagtgacacccgcccgccgccgtacatctctccccgcccccctgtcatgccggaggcgagggctgcctcccgaacagggggctccacctcggctgctgggcgaaccaagaccacgtggacccgggggccttggccacgccgtcgctgcccaccgagccggacgcggtagcctgccaccgacactcggcccccgggctagggctgctgcgggaggatctgaacgcgcacttaggtgtcgactccatcctgtgcatgccaggggagcccatgtaagagtccacgtgcctggccataggcgataccgccgatgcagagctcccgaacctagcgcccgtgtgcacgctgctgcctag

SEQ ID NO: 119448 - DNA, 669 bp, Artificial Sequence
  Description of Artificial Sequence: Synthetic coding sequence
atggctccaccagcggccccaggacgggacagggtgggtcgggaagatgaggatggatgggaaacacggggcgatcggaaagcccgaaagcctctagtggagaaaaaacggcgggcaagaattaacgagagtctccaggagctcaggctgctgctggctggcgcggaggccaagctggagaatgctgaagtgttggagctgacagtcaggcgggtccagggcgtccttaggggccgggccagagagcgtgagcagctgcaggccgaggcttcagagcgcttcgccgccggctatattcagtgcatgcacgaggtccacaccttcgtctcgacatgccaggcaatcgacgcgaccgtggccgctgagttgctgaatcacctattggagtccatgccactgcgcgaggggtcttcgttccaggacctccttggtgatgccctggctggtccaccgcgggcccctggaagatccggatggcctgcgggcggagcccctggcagccccataccaagccctcctggccccggagacgatctatgcagcgatctagaggaagctcccgaagcggaacttagccaagctcccgccgaaggccccgatctggtgccagccgcactgggtagcttaacaaccgcacagatagctcgctcagtgtggcggccctggtag

SEQ ID NO: 119449 - DNA, 678 bp, Artificial Sequence
  Description of Artificial Sequence: Synthetic coding sequence
atggtgacgagagatagagcggagaacagagacgggccgaagatgctgaagccattggtggagaagaggcgccgtgatcggatcaataggagtctggaggagctgcggctgctgctgctagaaaggacgcgcgaccagaacctccgaaacccgaagcttgaaaaggccgaaatactggaatttgccgtgggctatctgcgagaacgttctagggttgaacctccaggggtgcctaggagcccagtccaggatgctgaggcattggcttcttgctacttgtccggattcagggaatgcctccttagactggcggctttcgcacatgatgcgagcccagctgcacgggcgcagcttttctccgcattgcatggctatcttcgccctaaacctcctagacccaagcccgtggaccctcgaccaccagccccgaggccttcgctcgaccccgctgcaccagcactcgggcctgccctgcatcagcggcccccggtgcaccagggccatccctcccctcggtgtgcttggtccccctcgctgtgttcacctagggcgggtgattctggggcccccgccccactgactggattgttgccgcctccgccccccccccacaggcaggacggagctccaaaggcccccttgcctccgccaccagctttctggcgaccttggccttag

SEQ ID NO: 119450 - DNA, 693 bp, Artificial Sequence
  Description of Artificial Sequence: Synthetic coding sequence
atggtgactagggatagggctgaaaacagggatgggcccaagatgctgaagccactggtagaaaagaggcggagggacagaattaaccgttccctggaagagctgcggttactacttctggaacgcacacgtgatcagaacttacgtaacccaaaacttgaaaaggcagaaattttggaattcgccgtaggctacctgcgggagcgctctagagtcgagcctccagctgctgctgcccccggcgtcccacgatctccagtgcaagacgctgaggcattggctagctgttacttgagcgggttccgggagtgtctcctgagacttgcagctttcgctcatgatgcctccccggccgcaagagcccagcttttcagcgcccttcacggctatctcaggccaaaaccgccccgccccaaacccgtggaccccaggcctcccgcaccaagaccatctttggatcctgctgcccctgctctagggcctgcgttacaccaaaggcctcctgtgcaccaagggcatccgtcccccagatgtgcatggtccccgtctctatgctctcctcgtgctggggatagcggcgctcccgcccctctgaccggtctcctgccgcccccacctccaccccacaggcaggatggtgccccaaaagcacccttgccccctccccctgctttttggcggccttggccttag

SEQ ID NO: 119451 - DNA, 1014 bp, Artificial Sequence
  Description of Artificial Sequence: Synthetic coding sequence
atgaagcgcccatgcgaagaaacaaccagcgaatccgacatggatgaaaccattgacgtcgggagtgagaacaactactccggccagagtacgagtagcgtaatccgcctcaactcccccaccaccaccagccagattatggcccggaaaaagcgtagaggcataatcgagaagagacgtagggatagaattaataactccctgagcgagcttagacgcttagtacccactgcattcgaaaagcaggggagcgcaaagttggagaaagcggagattctgcagatgaccgtggatcacctgaagatgctacaagcaacagggggcaaggggtatttcgatgctcatgccctcgccatggattttatgtcaattggtttcagagagtgcctgaccgaagtcgctcgctacctttcttctgtggagggactcgacagctctgaccctttgcgagtccgattggtgagtcatctgtccacctgtgcaactcagcgcgaagctgcggctatgacttccagcatggcgcaccaccaccaccctttgcacccgcatcattgggctgccgcctttcaccatttaccagctgcgttactgcaacccaatggtctgcacgccagcgaaagcaccccttgtcggctctccacaacatccgaagttccgcctgcccacgggtctgccctgttgaccgctactttcgctcatgctgattccgccttacggatgccatctaccgggtctgtggcaccatgtgtgccaccgctgtctactagcctgctgtctctgtccgctactgtacatgctgccgctgctgctgcaactgcagccgctcacagttttcccctctcgttcgccggcgccttcccaatgcttccaccgaacgctgccgcagctgtcgctgctgctaccgccatcagcccgcctctgtctgttagtgccacttcctctcctcaacagacctccagtggcaccaacaataaaccataccggccgtggggcaccgaagttggggccttctag

SEQ ID NO: 119452 - DNA, 876 bp, Artificial Sequence
  Description of Artificial Sequence: Synthetic coding sequence
atggcacggaaaaaacggagagggattattgaaaagcgtagaagagatcgcatcaataactccctgagcgaactacgacgattggtgccaactgcattcgagaagcaaggctcagcgaagctggaaaaggccgagattctccagatgactgtggatcacctgaaaatgctgcaggcgactggtggcaagggctattttgatgcacatgctttagcaatggactttatgtccatcggctttagggagtgtctgacagaagtcgccagatatttatcgtcggtggaggggctggacagctccgaccccctgcgcgttcggttagtgtctcatctgagtacttgtgctactcaacgagaagctgcagcaatgaccagtagcatggcccatcaccaccatccgttgcacccacaccattgggccgccgcctttcatcacctgccagctgcccttctgcagccaaatgggctacatgcgagcgagagcacaccctgtcgattgtccaccacttcggaggtacctcccgcacatgggtccgcactactcacagcaacgtttgcccacgccgacagcgcactgcgtatgccctccacagggtctgtcgctccatgcgtgcctcctttgtcaacctctctgctttccctcagcgctaccgtgcacgctgcagctgctgccgctacagccgctgcacactcctttcccttgtcattcgcaggcgcatttcccatgcttccacctaatgccgccgctgccgtggcagcagcaaccgcaatttcgccacccctatccgtcagtgcaacgagcagccctcaacagacatcgtctggcacaaacaataagccctatcggccgtgggggacagaggtgggtgcattctag

SEQ ID NO: 119453 - DNA, 1221 bp, Artificial Sequence
  Description of Artificial Sequence: Synthetic coding sequence
atgagtgcattaggagccgtgatagctctcctgctatggggacagctcttcgcagtggattcaggaaatgatgtgacagacatagccgacgacggatgccctaaaccccctgagatcgctcatgggtatgtggagcatagcgttagataccagtgcaagaactactataagctgcggaccgagggcgatggcgtttacacattaaacgacaagaaacagtggataaataaggcagtgggcgacaaactacctgaatgcgaagctgatgatggttgtcccaagccacccgagattgcccatggctatgttgaacatagcgttcgttatcagtgtaagaactattacaagttgcgtaccgagggtgacggagtctacacactgaataacgaaaaacaatggatcaataaggctgtgggcgataaacttccggagtgtgaagctgtgtgcggaaagccaaaaaatccggccaatcctgttcagcgcatactcggcgggcacctggatgccaagggatcttttccatggcaggctaagatggtatcccaccataatttgaccacaggagcgactcttatcaacgaacagtggcttctgacgaccgccaagaatctgtttctgaaccattccgagaacgctaccgccaaggatatagcgcccaccctgaccctgtatgttggcaagaagcagctggttgagatcgaaaaggttgtgttgcaccccaattactcccaggtggacataggtcttattaagctcaagcaaaaggtctccgtcaacgaacgggttatgcctatctgcttgccctccaaagattatgccgaggtagggagggtggggtatgtatctggctggggcagaaatgctaactttaagtttaccgatcacttaaaatacgtgatgttgccagttgctgaccaggaccaatgcatacgccattacgagggttctactgtccccgaaaagaagacgcctaagtctcccgtgggcgttcagccaattctcaacgaacataccttctgcgctggcatgtcaaagtaccaagaagatacttgctatggtgatgccggctccgcctttgctgtccatgacctcgaagaggatacctggtatgcaactgggattttatcattcgataaatcctgcgctgtggcagagtacggagtgtacgtcaaggttacaagcattcaagattgggtccagaaaaccattgcagagaattag

SEQ ID NO: 119454 - DNA, 1149 bp, Artificial Sequence
  Description of Artificial Sequence: Synthetic coding sequence
gtctatgcatgcgtctgcgtttgcgtgtacatgcatgtgtgtgtagatgcatgcatgtgttgtgaagctggtcgacttgctttccactccagcctatcttcgctgtgctccgccttaggcgcagttattgctcttttgctctggggccagttattcgctgtcgatagtggaaacgacgtgactgacattgccgatgacggatgtcccaaacctcccgagatagctcatggctacgtggaacacagtgtgaggtaccagtgtaagaactactacaaacttaggaccgagggcgatggagtatacacactaaacgataagaaacagtggatcaacaaggcagtgggtgacaagttgcccgagtgcgaggcagtgtgtggaaagcccaagaatccggctaaccctgtccagagaattttgggaggccacctagacgcaaagggctcattcccatggcaggccaaaatggtgtctcaccacaacctaactaccggagctaccctgatcaatgagcagtggctgctgacgaccgccaaaaatttattcctcaaccattctgagaacgctaccgccaaggacattgcgccaaccctcaccctatatgtcggcaaaaagcagctggtggaaattgaaaaagttgtgctgcaccctaactactcccaggtggacattgggctgataaaactgaagcaaaaagtaagcgttaatgagagggtgatgcctatatgcctccctagcaaggattacgcagaagtgggccgagtgggatatgtgtccgggtggggtcggaacgcaaatttcaaattcactgaccacttgaagtacgtgatgcttcctgtggctgaccaggatcagtgtattagacattacgagggtagtactgtgccagaaaagaagacgccaaagtccccagtgggagtgcagcctatcttgaatgagcacacattttgcgcgggcatgtcaaaataccaggaggatacttgttacggcgacgccggaagcgctttcgcggttcacgacctcgaagaggacacctggtatgccacaggtatcctgtctttcgataaatcatgcgcagtggcagagtatggggtttacgtaaaggtgacttccatccaagactgggtgcaaaaaaccattgcggagaattag

SEQ ID NO: 119455 - DNA, 1044 bp, Artificial Sequence
  Description of Artificial Sequence: Synthetic coding sequence
atgtcggcactgggcgcggtgattgccctactgctttggggacaattgttcgctgtggactcgggcaacgacgtcaccgatatcgccgatgacggctgcccaaaaccccccgagatcgctcacggctatgtggaacactccgtcaggtaccaatgcaagaattattacaaactcagaactgagggtgacggagtgtacactctaaacaatgaaaagcagtggattaataaggccgttggcgacaagctcccagaatgcgaggccgtgtgtggcaagccgaagaacccagctaatccagttcagaggattctcgggggtcatctcgatgccaaaggatcctttccctggcaggcaaagatggtgagtcaccacaatcttacgacaggtgctacgttgatcaacgagcagtggctcctcactaccgcgaagaatttgtttctgaaccactctgaaaatgccactgccaaagatattgccccgacactgactctctatgtgggtaaaaagcagttggtcgaaatcgaaaaggtagttctccatccaaactattcgcaagttgacattggtctaattaagctgaagcagaaggtgtctgtcaatgagagagtgatgcctatctgtctgccttccaaagactatgctgaggtgggaagggtcgggtacgtgtcaggttggggacggaatgccaactttaagttcacagatcaccttaaatacgtcatgctaccggtcgcagatcaggatcaatgcattaggcactatgaagggtcaacagtgcctgagaagaaaacgcccaagagcccagttggagttcagccaatccttaacgaacatacattttgtgccggcatgagcaagtatcaggaagatacctgctatggagacgccggatcagcatttgcagtgcacgacctggaggaagacacctggtatgccaccgggatactttcattcgataaatcctgtgcggtggcagagtatggcgtatatgttaaggtgaccagcatacaagattgggtgcagaaaacgatcgccgagaactag

SEQ ID NO: 119456 - DNA, 846 bp, Artificial Sequence
  Description of Artificial Sequence: Synthetic coding sequence
atgtctaggatctcccaaatgaccgccgctcgaagcccaccccgactccatatggctatgtggtccacaaggttcgccacctccgttaggacaaatcccgtccagagaatcttaggagggcatctggacgcaaagggcagcttcccctggcaggccaagatggtcagccaccataacctgaccaccggagcgaccctgatcaacgagcagtggttactgaccaccgccaagaatctgtttttaaaccactccgaaaacgcaacagcaaaagacatagcccctaccctgaccctgtacgtcggtaaaaagcagttagttgagatcgaaaaagttgtgcttcaccccaactattcccaggtcgacattggcctgataaagctaaagcaaaaggtgtccgtgaatgagagagtgatgcctatttgtctgcccagtaaggactacgcagaagtcggccgggtcggctacgtcagcgggtggggccgaaatgccaactttaagtttacagatcacctgaaatacgtgatgctccctgtagccgaccaagaccaatgtatccgccactacgagggatcgactgtgccggagaagaaaactcccaagtcgcccgtcggagtgcagcctattctgaacgaacatacattctgtgccggtatgtctaagtaccaggaggacacatgctacggagacgctggatccgcattcgccgttcacgacctggaagaagacacctggtacgccactggaattttatcattcgacaaatcttgtgccgtcgccgagtacggcgtgtacgtcaaggtgaccagtatccaggattgggtacagaagaccatcgccgagaactag

SEQ ID NO: 119457 - DNA, 552 bp, Artificial Sequence
  Description of Artificial Sequence: Synthetic coding sequence
atgtctgccgccagagagagccacccgcacggagtcaaaagaagtgcctctcctgatgacgatctggggtcctctaactgggaggctgctgatttggggaacgaagagcggaagcaaaaatttctcagactgatgggagctggcaagaaggagcatactgggagactggttattggtgaccacaaatcgacatctcactttagaaccggcgaggaggacaagaaaataaatgaggagctggaaagccagtaccagcagtctatggattcaaaattaagcggacggtataggaggcactgtggcctggggttctccgaagtggaagaccatgacggcgaaggggacgtcgctggagacgatgatgatgacgacgatgacagtccagaccctgagtctccagatgatagcgagtccgactccgagagtgaaaaagaagaatctgcggaggagttgcaagcagctgagcatcccgatgaggtggaggatccaaaaaataagaaggacgcaaagagtaactacaagatgatgttcgtgaagagttccggttcttag

SEQ ID NO: 119458 - DNA, 1047 bp, Artificial Sequence
  Description of Artificial Sequence: Synthetic coding sequence
atgtcggatctgggggctgtcattagtctcttattgtggggacggcaactctttgctctatacagtgggaacgatgtcaccgacatttcagacgatagattcccaaagcccccggaaattgccaatggctacgtggagcacctgttcagatatcagtgtaaaaactattaccggctgcgcaccgaaggagatggcgtctacacacttaatgacaaaaagcagtggattaacaaggccgtgggtgacaagttgccagagtgcgaggccgtgtgcggaaaacccaagaatccagcaaaccccgttcaaaggatcctgggcggacacctggatgccaagggctccttcccatggcaggccaaaatggtgagtcatcacaatctaactacaggggccacgctgattaacgagcaatggctcctgacaactgcgaaaaacctgtttcttaaccattccgaaaacgccacggccaaggacatcgcgcctacactgaccctgtatgtggggaagaaacagcttgtcgaaattgagaaagtagtgctacatcccaactaccaccaggtggatatcggccttattaaactgaagcagaaggtcctcgtaaatgaaagggtcatgcccatttgcctccctagtaaaaactacgcggaagtaggtagggtaggttacgtgtctgggtggggacagtccgataattttaagctaacagaccatctgaagtacgtgatgttacccgtggccgatcagtatgactgcatcacacactacgaaggctcgacttgtcctaagtggaaagcgccaaaatcccccgtgggggttcagcccatcctgaacgagcacactttttgtgtgggaatgagcaaatatcaggaagatacctgctatggtgacgcgggctctgcattcgcagttcatgacctggaagaggacacctggtacgcggcagggattctctctttcgacaaaagctgcgcagtggccgagtatggcgtatatgtcaaggttacctcgatacagcattgggtccagaagactattgcagaaaactag

SEQ ID NO: 119459 - DNA, 1047 bp, Artificial Sequence
  Description of Artificial Sequence: Synthetic coding sequence
atgagcgatctaggggccgtcatctcgctgctcctttggggccgccagttgttcgctctgtattctggcaacgatgtcaccgatatctctgacgaccggtttcccaagcccccagagatcgctaacggttatgtggaacacctctttcgctaccaatgcaaaaattactataggctccgaaccgagggggacggggtttacactctgaatgacaaaaaacagtggatcaataaagctgtaggggacaaactcccagaatgtgaggccgtgtgtggcaaacctaaaaatccagcgaaccctgttcagaggatcctcggaggccatctagatgcaaaagggagcttcccctggcaagccaagatggttagccatcataatctgacaaccggcgcgaccctgattaatgaacaatggctgctgacaactgcaaagaacttgttccttaaccacagcgagaatgcaaccgccaaagatatagcacccactcttacactgtacgtcggtaagaagcaactggttgagatagagaaggttgttctccatcctaactaccaccaggtcgatatcgggctgatcaagctgaagcagaaggtacttgtgaatgaacgcgtgatgcccatatgtttgccatctaagaattacgcggaggtaggcagggtgggctatgtctctggctggggtcagtctgacaatttcaaactcacagaccacttaaagtacgtaatgttgccagtggctgatcaatatgattgcatcacccactacgaaggttccacctgcccaaagtggaaagctcccaaatccccagtgggagtgcagcccattttaaatgaacatacattctgtgtcggcatgtcaaagtaccaggaagatacctgttacggagatgccgggtctgcctttgccgtgcacgatctcgaggaggatacctggtatgccgccggaatcctgtcatttgacaaatcgtgcgccgtcgcagagtacggagtgtatgtgaaggtcaccagtattcaacactgggtgcagaagactatcgcagagaactag

SEQ ID NO: 119460 - DNA, 615 bp, Artificial Sequence
  Description of Artificial Sequence: Synthetic coding sequence
atggctgccgctaatccttgggacccagcgtcagctcctaacggagccggcctcgtgctgggccactttattgccagcgggatggtgaatcagaaaaatttggaaatcgagctgctcaaactggagaaagacactgccgatgtggtgcatccgttcttccttgctcagaagtgccacacactgcaaagtatgaacaaccacctggaggctgtgctgaaggagaagcgaagccttaggcagcggctgctaaaacccatgtgtcaggagaacctaccaattgaagctgtctatcatcggtacatggtccacctcctcgagctggcggtcacctttatcgaaagactcgagacccacctggaaaccatcagaaatattccacacctggccgcgaacttgaagaaaatgaaccaagctctggcaaaaatggatatcctcgtcactgaaaccgaagaactggctgaaaatattctgaagtggagaaaacaacagaatgaagtctcaagctgtatccccaagatcctggccgaggagtcttacctgtataaacatgatatcatcatgccacctctgccttttacatccaaagttcatgtgcagactattaacgctaagtag

SEQ ID NO: 119461 - DNA, 837 bp, Artificial Sequence
  Description of Artificial Sequence: Synthetic coding sequence
atggagccacaagaggagcgggagactcaggtcgctgcatggctcaagaaaattttcggggaccatcctatcccacagtatgaagtgaacccccggaccaccgaaatcctacaccacctgtccgagcggaatcgagtgcgtgaccgggatgtctatttggtcatcgaggaccttaagcaaaaggcgtccgagtatgagagtgaggctaaataccttcaagacttacttatggaatcagtgaatttttctccagcaaacctgtcctcgacaggcagcaggtacctgaatgccctggttgactcagccgtcgcactggagaccaaggacacgtctcttgcctcttttatacctgccgttaatgatttaacctccgatctgtttcgcactaagagcaaatccgaggagattaagatcgagctagagaagcttgaaaaaaacttgaccgccacactagttctggaaaagtgtctacaggaggacgtaaagaaagctgagctacacctgagtacagagagagctaaggtggataacaggcggcagaatatggacttcctgaaagcaaagagtgaggaatttcgtttcggcatcaaagctgcggaggaacagttgtccgcccgaggcatggatgcaagcctgtcccaccaatcactcgtagctctctccgagaagttggcgcggctgaagcaacagacaattcccttaaagaaaaagctggaatcatacttggacctgatgccaaatcccagtctcgcccaggtgaagattgaggaggctaagcgagagctggatagtatcgaggccgaactaacccgacgtgtcgacatgatggagctttag

SEQ ID NO: 119462 - DNA, 708 bp, Artificial Sequence
  Description of Artificial Sequence: Synthetic coding sequence
atggccgctgcgaacccttgggaccccgcctctgcgcccaatggcgcagggctcgtgctgggccacttcattgccagtggcatggttaaccaggagatgctaaacatgtcaaagaaaacggtgtcttgttttgtcaacttcacaaggctgcagcagattacaaatatccaggctgaaatatatcaaaagaatctcgagatcgagttactcaagctggagaaggatactgccgatgtagtccacccattctttcttgcacaaaagtgccatacgctccagagtatgaataaccatctcgaggctgtcttgaaggaaaaaagatccctgcggcagcggctcctgaaacccatgtgccaggagaacctgccaatcgaggcggtgtatcatcggtatatggtccatctactagagctggccgtaaccttcattgaacgcctcgagactcatcttgaaaccattcggaacatcccgcacttggctgccaacctgaagaaaatgaaccaggccctcgctaagatggacattctggttaccgaaaccgaggagctggccgagaatatactcaagtggcgaaagcagcagaatgaggtgtcatcttgtatccctaaaatactcgcagaagagtcatatctgtacaaacatgacataattatgccccctctgccatttacgagcaaggtacacgtccaaacaattaacgctaagtag

SEQ ID NO: 119463 - DNA, 615 bp, Artificial Sequence
  Description of Artificial Sequence: Synthetic coding sequence
atggccgcagctaatccttgggacccagcttccgctccgaacggggccgggctggttttgggacacttcatcgccagcggaatggtgaatcagaaaaatctggagatcgagttgttgaaactcgaaaaagacacagcagacgtggtgcacccattcttcctcgctcaaaagtgtcataccctgcagtctatgaataaccatcttgaggctgtccttaaggagaagcgaagcctaaggcaaaggctgttgaaaccaatgtgccaggaaaacttgcccattgaggccgtctaccacagatacatggtacacctgctggagctagccgtgaccttcatcgagcgccttgaaactcacctggagacaatcaggaatatcccccacctagcggctaacctgaaaaagatgaatcaggccctggcaaaaatggacatcctggtgaccgagacagaggagctggctgaaaatatcctgaagtggagaaaacagcagaatgaggtttcttcttgtattccaaagatcctggcagaggaatcctacttgtacaagcacgatattatcatgccccccctccccttcacgtccaaagtgcacgttcagacaatcaatgctaagtag

SEQ ID NO: 119464 - DNA, 1812 bp, Artificial Sequence
  Description of Artificial Sequence: Synthetic coding sequence
atgtcgtgcggtaatgagtttgtggagaccctgaaaaagatcggatatcctaaagctgataatctcaatggggaggacttcgactggctgtttgagggcgtggaagacgaaagcttcctgaagtggttttgtggcaacgtgaacgaacagaatgtgctgagcgaacgcgagcttgaagcgttctccatcctccagaaatctggaaaaccaattctggaaggcgctgcactggatgaggctttgaagacctgcaagacttcagatctgaagacaccgagattagatgataaggaactggaaaaactggaagacgaggtccagaccctgctgaagcttaagaatctgaagatacaaagaagaaacaagtgtcagctgatggcttcagtaacaagccataagtccttgcgattgaacgccaaagaagaagaagctactaaaaaattaaaacagtcccaggggattctcaatgccatgatcaccaaaatttctaatgagcttcaggccctgactgatgaagtcacgcaacttatgatgttcttccgccatagtaacctggggcagggtacaaacccccttgtttttttatctcagttcagcctggagaaatacctgagtcaggaggagcaatcgacggccgccctgacattgtataccaagaagcaattctttcaaggtatacacgaggtagttgagagttcaaacgaagataactttcagctgttagatatccagacgccatcaatctgcgataaccaagagattcttgaagagcgcagactggagatggcccgcctgcaactggcctacatctgtgcgcaacatcagctgatccatctgaaggcatctaattcttcaatgaagtcttctattaagtgggctgaggagtcgctgcactcgctgacgagcaaagccgtcgacaaagaaaatttagatgccaaaattagttcgctgacaagtgagatcatgaagctcgagaaagaggttactcagatcaaagaccgctcccttcctgccgtggttagggagaacgcccaactactgaacatgcctgtagtgaaaggggattttgatctgcaaatagccaagcaagactactacacggctcgccaggagctcgtgctcaatcaactaatcaagcagaaagcttcgttcgagttgttgcagctgagctatgagatcgaacttcggaagcatagggacatctaccgccagttggaaaacctggtgcaagagctgtcccaatcaaatatgatgctgtataagcagctggagatgctaactgacccctcagtctcacagcagattaaccctaggaacacaatcgatactaaagactatagtacccataggctgtaccaagtgttggagggagagaacaagaagaaagaattgtttctgactcacggcaacctggaggaggtggcagaaaaactaaaacagaatatttcactggtccaggaccaactggctgtgtcagcacaggaacattcattctttctatctaagcggaacaaagatgttgatatgctgtgtgataccctataccaggggggcaatcagcttctcttatcagaccaggagctgacagagcagtttcataaggtggagagccagcttaataagctcaaccatctgctgacagatatacttgctgatgtgaaaacgaagagaaaaacattggccaacaataagctacatcagatggagcgagagttctatgtctatttcctcaaggatgaggactacctcaaagacatcgtggagaacctggaaacccaaagcaagatcaaggcagtttccctcgaagattag

SEQ ID NO: 119465 - DNA, 1812 bp, Artificial Sequence
  Description of Artificial Sequence: Synthetic coding sequence
atgtcttgtggtaacgagttcgtcgagaccttaaaaaagattggctacccaaaggccgataacttgaacggtgaggattttgactggctgtttgaaggcgtggaggatgagagctttctgaagtggttttgtggcaatgtgaacgagcagaacgttctctccgaacgcgagctggaagccttctcaattctgcagaagtcaggcaagcccatcctcgaaggagcagcgctggatgaggctctgaaaacatgcaagactagtgacctgaagacacccaggctcgacgacaaagaactggaaaaactggaggatgaagtacagacactcctaaagctgaaaaatcttaagattcagcgcaggaacaagtgtcagcttatggcgagtgttaccagccataagtctctgcgcctcaatgccaaggaggaagaggccaccaagaagctgaaacaatcccaaggcatcctgaacgccatgataaccaagatctctaatgagctgcaagcactgacagatgaggttacccagcttatgatgttcttccgacatagtaatctgggccagggaacgaacccacttgtgttcctatcccaatttagcttggaaaagtacttgagtcaggaggagcaaagcaccgctgccctgaccctttataccaaaaaacagttctttcaagggatccacgaggtggtagagtcttccaatgaagataacttccagctgctggatatccagaccccctccatctgtgataatcaggaaatactcgaggaaagacgcctggaaatggcgcgtctgcagctggcgtacatatgcgcacagcaccagctgatccacctaaaagcgtctaactccagcatgaaatcatcaatcaagtgggcagaggagagtctccattcactgacctccaaagctgttgataaggagaacctggatgcgaagatcagctctctaaccagcgaaattatgaagctggaaaaggaagtgacccaaatcaaggatcgcagcttgcccgccgtagtgcgggagaacgcacagttactgaacatgcctgtggttaaaggcgacttcgacctacagatcgcaaaacaggactactacactgcccgccaggaactcgtactgaatcagctgatcaagcagaaggcgtcgtttgagttgttacagctgagctatgaaatagaactgcgcaaacaccgggacatttaccgacaactggagaacctcgtgcaggaactgagccagagcaacatgatgctatataaacaattggagatgctgacagacccatctgtatcacaacagattaaccccaggaatacgattgacacaaaggactactcaactcacaggctgtaccaagtcctggagggggaaaacaaaaaaaaggagctcttccttacgcatggcaacctcgaagaggtggccgaaaagttaaaacagaacattagcctcgtgcaagaccagctcgcagtgtcagctcaggagcacagtttttttctctcaaaaagaaacaaagatgtggacatgctgtgcgatactctctaccagggaggcaaccagctcctgctgtccgaccaggagttgactgagcagtttcataaggtcgaaagtcaacttaataaactgaatcatttgctcacggacatccttgccgatgtcaaaacaaagaggaaaactctggctaataataagctccatcagatggagagggagttttacgtatacttcctcaaggatgaggactatctcaaagacatcgtggaaaacctggaaactcagagcaagatcaaggccgtgagtcttgaagactag

SEQ ID NO: 119466 - DNA, 33 bp, Artificial Sequence
  Description of Artificial Sequence: Synthetic coding sequence
atgtcatgcggtaatgaatttgtagagacctag

SEQ ID NO: 119467 - DNA, 102 bp, Artificial Sequence
  Description of Artificial Sequence: Synthetic coding sequence
atgagttgtgggaacgagttcgttgagaccctaaagaaaatagggtacccaaaggcagataacttgaatggtgaggactttgattggcttttcgaaggttag

SEQ ID NO: 119468 - DNA, 456 bp, Artificial Sequence
  Description of Artificial Sequence: Synthetic coding sequence
atggggaaacggccgaaccttctcgctctgcagctttcagacagcactctcgctgacataatagcccggctgcaggccgggcagaagttgagcgggtcttctccgttttcttctgcgtttaatagcctctctctcgataaggagagcggtctgttgatgttcaaaggtgataagaagcctcgagtgtgggtggtaccgacccaactgcggcgagacctgatcttctcggtgcacgacatacctcttggcgcgcaccagcggccagaggagacctataagaagcttcggctgctcggttggtggcctgggatgcaagaacacgttaaggattattgtaggtcatgtctgttttgtatcccaagaaacctgatcggctccgaactgaaggttattgaaagcccacccgcctctgttttaagaggacaaggagtctgcaataggtcaggcacgcggtag

SEQ ID NO: 119469 - DNA, 957 bp, Artificial Sequence
  Description of Artificial Sequence: Synthetic coding sequence
atggccagcggggacttctgtagcccgggagaaggcatggaaatcctccagcaggtatgctccaaacagctccctccttgtaatttgagcaaagaggacttgctccagaatccatacttttccaaacttctcctgaatctgtctcaacatgttgacgaatctggactgagcctgaccctggcgaaggagcaggcacaagcttggaaggaggtgcggctccataaaaccacctggctccgctcagagattctgcatcgtgtcatccaggaactgctggtggattactatgtgaagattcaagatacaaatgtcacctccgaagacaagaaagatttcgtgtggatgagagctagattacagcaggaggtcgaagaacagctcaaaaagaaatgcttcacgctactgtgttattacgaccccaacagcgacgctgattctgagacagtaaaggccgctaaggtatggaagctggctgaggtccttgttggcgaacagcagcagtgccaggacgccaaaagccagcagaaggaacagatgctcctgctggaaaagaagtccgccgcatactctcaagtgctccttagatgccttacactcctgcagcgtttgttacaggaacatagactgaagacccagtccgagttggaccggatcaatgcccagtacttggaagtgaaatgtggagcaatgatcttgaaactgaggatggaggagctgaagattctgtctgacacttacactgtggagaaagttgaagtgcaccggctaatccgcgaccgcctcgaaggagcaattcacttgcaggaacaggatatggaaaatagcaggcaagtcctaaattcttacgaagtgctgggcgaggagttcgatcgtctggtcaaagaatacacggtgctgaagcaagcaaccgagaacaagcgctgggctctgcaggagttctccaaagtatacaggtag

SEQ ID NO: 119470 - DNA, 714 bp, Artificial Sequence
  Description of Artificial Sequence: Synthetic coding sequence
atggcaagcggggatttttgtagtcctggtgaggggatggaaatcctgcaacaggtttgctctaaacagctacctccatgtaacctgtctaaggaggatcttctccaaaatccttactttagtaaattgctgttgaatctcagccaacatgtcgatgaatccggtctcagcctgaccctggcaaaggagcaagcccaggcttggaaggaagttcggctccataagactacctggctgcgctccgagatactgcatcgggtgatccaagagctgctggtggactactatgtaaagatccaggatacaaacgtgacaagtgaagacaaaaaagttctgctgcgctgtcttacacttctgcagcggctgttgcaggaacatcggcttaaaacacagtctgaactcgatcgtattaacgcccagtaccttgaggtaaagtgtggcgcaatgattctgaagctgcgaatggaggagctcaaaatcttgtctgatacttacactgtcgaaaaagtggaagtccacagactgatcagagatcggctcgagggcgccattcacctgcaagaacaggatatggaaaactccaggcaggtgctcaatagctacgaagtgctcggggaggagtttgatcgattagtgaaggaatacacagttcttaagcaagctacggagaataaacggtgggcacttcaggagttttctaaagtgtaccgatag

SEQ ID NO: 119471 - DNA, 714 bp, Artificial Sequence
  Description of Artificial Sequence: Synthetic coding sequence
atggctagcggtgatttttgttctcctggagaaggcatggagatcctgcagcaggtttgcagtaaacagctgccaccctgcaacctttcaaaagaggacttgttgcagaacccttatttctccaaattactgctgaatcttagccagcatgtcgatgaaagcgggctttctctcaccttggctaaagaacaggcacaagcctggaaagaagttagactgcacaaaactacctggctgcggagtgagatactgcacagggtcatccaggaactgctcgtcgactactacgtcaaaattcaggacacaaatgtgacttccgaggacaagaaagtactgttgagatgtcttaccctcctgcagcgcttgctgcaggagcatcgtctgaagacccagtccgaattggataggatcaacgcccagtatctggaggtcaaatgcggcgccatgatactgaaattaagaatggaggaattaaagatactttccgacacatacaccgtagaaaaggtagaggtgcacaggctcattagggataggctggagggggctatccaccttcaggagcaggacatggaaaattctagacaagtgttgaactcctatgaggtgctgggtgaagaattcgacaggttagtgaaggaatatactgtgctgaagcaggccaccgaaaacaaacggtgggccctgcaggagttctccaaggtttataggtag

SEQ ID NO: 119472 - DNA, 720 bp, Artificial Sequence
  Description of Artificial Sequence: Synthetic coding sequence
atgaggcttcttggccccagtcaggaaagagagatacccccccttcttggactggagaaagcggatctcctggaactcatgccactgagcgaagactttgtgtggatgagagcccggttgcaacaggaggtggaagaacagctgaaaaaaaaatgctttacacttttgtgttactatgatcctaactctgacgcagactcggagaccgtgaaggcagcaaaagtctggaagttggcggaagtgttggttggtgagcagcaacagtgccaggatgccaaatcgcagcagaaagaacagatgctgctgctcgagaaaaagagtgcagcctactcccaggtcctcctccgatgcttgacattgctccagcgactgctgcaagaacaccgccttaagacccagagtgaactggaccgtattaatgcccaatatctggaggttaagtgtggggcaatgattctcaaactccgaatggaagaactaaagatcctgtccgacacatacaccgtggaaaaagtagaagttcataggcttatccgcgatagactcgaaggagccatccatctacaggagcaggacatggagaatagtagacaagtactgaatagttatgaagttcttggagaagaatttgatagactcgtgaaggagtacacagttttaaagcaggccacagaaaataagagatgggcgctccaagaattcagtaaggtctaccgctag

SEQ ID NO: 119473 - DNA, 1092 bp, Artificial Sequence
  Description of Artificial Sequence: Synthetic coding sequence
atggcgagcggagatttctgcagcccgggagagggaatggaaatcttacaacaggtgtgcagcaagcaactgcctccatgtaacctgtcgaaggaagatctgctgcaaaatccatatttttctaagctacttcttaatttgtcacagcacgtcgacgaaagcggtctgagccttaccttggctaaggaacaggcccaggcttggaaagaagtgcgtctgcataaaaccacttggctgagatccgagattttgcatcgagtgatccaggagctgctggtcgattactacgtgaagatacaggacaccaacgttactagcgaagataaaaagtttcacgagacactggagcagaggctcctggtgacagagctgatgaggctgctcgggcctagccaagaacgcgagattccacctctccttggactggagaaggccgacctgctagaattaatgcccctgtccgaggattttgtgtggatgcgagcccgcttgcagcaggaggtggaggaacaattaaagaaaaagtgttttactttattgtgctactatgatccaaatagtgacgctgatagcgaaaccgtgaaggctgccaaagtttggaagctggctgaagtcctggttggcgagcaacagcagtgtcaagacgcaaagagccagcagaaggagcaaatgttattgcttgaaaaaaagtctgccgcgtacagccaggtgctgctgagatgtctgaccctcttgcagcgcctgctccaggaacataggctgaaaacacaatcggaattagatagaattaatgcccagtacctggaagtgaagtgtggcgcgatgattttaaagctgcggatggaagagctcaagattctgtcagatacctataccgtggagaaagtggaggtgcatcgactgatccgggaccgcctggagggagctatccacctccaggaacaagacatggaaaactctcgccaggtcctgaacagctatgaagtcttgggcgaagagtttgaccgtttagtaaaggaatatacagtattaaaacaggccaccgagaacaaacgatgggcccttcaagagtttagtaaggtttatcgctag

SEQ ID NO: 119474 - DNA, 54 bp, Artificial Sequence
  Description of Artificial Sequence: Synthetic coding sequence
atgcgcctgctgggcccctcacaagagagagaaatacctcccctgttggggtag

SEQ ID NO: 119475 - DNA, 564 bp, Artificial Sequence
  Description of Artificial Sequence: Synthetic coding sequence
atggcttcaggggatttttgcagcccgggtgagggcatggagattctgcagcaggtatgctcgaagcaactcccaccgtgtaacctttcaaaagaagacctgctccagaatccttactttagtaaactcctgctaaacctgtcacaacacgtcgatgagagcggtctaagtctgactctggcaaaagagcaagcccaagcttggaaggaagttcgcttgcataaaacaacatggcttcggagcgaaattctccatagggtcatccaggagcttctagtggactactacgtgaagattcaggatactaatgtcacttccgaggacaaaaagttccacgagacactggaacagagactgctggtcaccgagctgatgcgcctgctggggccttcccaggaacgtgagattccgcctctgctggggctggaaaaagcagatctccttgagctgatgcctttatccgaggactttgtctggatgcgcgccaggctgcagcaggaggtcgaagaacagctaaagaagaagtgctttactttgttgtgctactacgaccccaattcctag

SEQ ID NO: 119476 - DNA, 840 bp, Artificial Sequence
  Description of Artificial Sequence: Synthetic coding sequence
atggcttctggcgacttctgttccccgggcgaaggcatggagatcctacagcaggtttgctcgaagcagcttcccccatgcaatctttccaaggaggatcttcttcagaatccctacttctccaagctactactgaatctgtcacaacatgtagacgaatctggcctcagcttgaccttggctaaggaacaggcccaggcctggaaggaggtgcgtctgcacaaaacaacctggttgcggagcgagatactgcaccgggtcatccaggagctcctcgtggattactacgtgaagattcaggataccaatgtgacgtccgaggacaaaaagttccacgaaaccttggaacaacgcctcctggtgactgaactgatgagattattaggcccttcccaggaaagagaaattccccctctcctggggctcgagaaggcagatctgctcgagcttatgcctctgtctgaagattttgtctggatgcgggcccggctgcaacaagaggttgaggagcagctgaaaaagaaatgctttacactgctctgctactacgacccaaattctgatgctgacagtgagacggttaaggcagccaaagtgtggaagctcgcagaagtactggtcggtgaacagcaacagtgtcaagacgctaaatcccaacagaaagaacagatgctcctgctcgagaagaagtctgccgcttactcccaggtattactacgctgtctcacactgctgcagcggctgttgcaggagcatcgcctgaagacccagtccgagctggaccgaataaatgctcaatatttggaggtcaagtgtggggctatgatcttaaaattatag

SEQ ID NO: 119477 - DNA, 957 bp, Artificial Sequence
  Description of Artificial Sequence: Synthetic coding sequence
atggcctcaggcgatttttgtagtcctggcgaaggtatggaaatcttgcagcaggtgtgtagcaagcagctgccaccttgtaatcttagtaaggaggatctgctgcagaacccttacttttctaagcttctactgaatctgagccagcacgtcgatgagtcagggcttagtctgactctcgctaaagagcaggcgcaagcttggaaggaggtccgactgcacaaaaccacttggttgcgctccgaaattttgcatcgggtgatacaggaactgctggtggattactacgtgaagattcaggacacgaatgtgacttctgaggacaagaaggacttcgtatggatgcgtgctcgtttgcagcaggaggtggaagaacagttgaaaaaaaagtgcttcacactcctgtgctactacgatcctaactctgacgcagatagcgagacagttaaagcagctaaagtgtggaagctagccgaagtactggtaggggaacagcagcaatgtcaggacgctaagagccaacagaaagaacagatgctgctcctagaaaagaaaagtgctgcctactctcaggtcctgctaagatgtcttaccctcctgcagaggctcctgcaagaacaccgccttaaaacccagtcagagctcgatagaataaacgcacagtacctggaggtgaagtgtggggctatgattctgaagctccgaatggaggaactgaagattctcagcgacacttacaccgtcgagaaggtagaggttcataggttgattagagacagactggagggcgccattcatctccaggaacaggacatggagaatagccgccaagtgctgaactcatatgaagtgctgggggaagagtttgataggcttgtcaaagagtatacggtcttgaagcaagccactgaaaataagcgctgggccctccaggaattttcaaaagtgtaccgctag

SEQ ID NO: 119478 - DNA, 957 bp, Artificial Sequence
  Description of Artificial Sequence: Synthetic coding sequence
atggcctctggggatttctgctcaccaggagagggcatggaaattctgcagcaagtgtgtagcaagcagctgccaccctgcaaccttagcaaggaggatctgcttcaaaacccttatttctctaaactgctactaaacctgagtcagcacgtggacgagagtggtctctctttgactttggccaaggagcaggctcaagcctggaaggaggtacggctgcacaagactacttggctcaggagcgagatccttcatagggtgatccaagagcttctggtggactactatgtgaagatccaggacacaaacgtaacctccgaggacaagaaggatttcgtgtggatgagggcccgtctacaacaagaagtagaagaacagctgaagaagaagtgctttaccctgctctgctattacgatccaaactctgatgccgactcagagacagtgaaagccgcaaaggtgtggaagctggctgaggtgctggtcggcgaacagcagcagtgtcaagatgcaaaaagccagcagaaggaacagatgttactgctggaaaaaaagtccgccgcctactcccaagtgttactgaggtgcctaactctcctccagaggctgctgcaagaacacaggctgaaaacacagtctgagcttgaccgcattaatgcccagtacctcgaggtgaagtgtggcgctatgattttgaagctgcgtatggaagagctgaaaatcttgtctgacacttacacggttgagaaagtagaggttcaccgcttaatcagagatcggctggagggcgctattcacttacaagagcaagacatggagaactcccgacaggtcctcaattcttacgaagtgctaggggaggagttcgaccggttggttaaagaatacactgtgctgaagcaggccacagagaataaaaggtgggccttgcaagagtttagcaaagtttatcggtag

SEQ ID NO: 119479 - DNA, 483 bp, Artificial Sequence
  Description of Artificial Sequence: Synthetic coding sequence
atggccagcggggatttctgctctccaggagaaggcatggagatactgcagcaggtctgttccaaacaactccccccatgtaaccttagcaaggaggatctgctgcagaacccttacttctccaaactgctgttaaacttgagtcagcatgttgacgaaagcggcttgagcctgaccctggccaaggagcaggctcaagcctggaaagaagtgagactccacaagacaacttggctgagatcagagattctccatagagtgattcaggagttactggtggactactacgtgaagattcaagacactaacgttacctctgaagataaaaaatttcacgagacactggaacaaaggcttctggtcactgaactgatgagactacttggcccttcgcaagagagggagattccccctctgctcggactggaaaaggcagatctgctcgaactgatgcccctgtcagaagacttcgtgtggatgtag

SEQ ID NO: 119480 - DNA, 1902 bp, Artificial Sequence
  Description of Artificial Sequence: Synthetic coding sequence
atggagttggcgcaagaagccagggagcttgggtgctgggcggttgaagaaatgggcgttcctgttgcggcaagagccccagaatcaaccctgcggcgactctgcctggggcagggagcagacatttgggcctacatactccagcatgtccatagccagcgaaccgtcaaaaaaatcaggggaaacctcctgtggtatggtcaccaggactcaccacaggtgagaagaaagctcgagctagaagcagccgtgaccagactgagagctgagattcaggaacttgaccaaagcttggagctgatggagcgtgacacagaagctcaggacaccgctatggagcaggcccggcagcacacacaagatacacagagacgagcactgttactaagagcgcaagccggcgccatgaggagacagcaacatacgctgagggaccctatgcagaggttacagaatcaactccgaagacttcaagacatggagcgcaaggcaaaagtggatgtgacattcggatcattgacttccgccgctctgggcctggagcccgtggtgcttagggacgtgcgcaccgcctgcacactccgcgctcagttcctgcagaatttgttgctaccccaggccaaacgcgggagtctcccaactccccacgacgatcactttggaacttcctaccagcagtggctcagttccgtcgagactctgctgactaaccaccccccaggacacgtgttagcggccttagagcacctggctgccgaaagagaggctgaaataaggtccttgtgtagcggagacggcttgggcgacacagagatatcaagaccccaagcgccggaccagagtgactcatcacagacattgccctctatggtacacctgatccaggagggctggcgtacagtgggcgttctagtgagccaaaggagtactctcttaaaggagcggcaagttcttacacagcgattacaaggactggtggaggaagtcgaacggcgggttctcggaagtagcgaacgccaggtcttgatactgggactccgccgatgttgcctatggaccgagttgaaggctcttcacgaccagtcccaagaattgcaggatgctgctggccatcggcagttactgctgcgggagttgcaagcaaaacagcagcggatacttcattggagacagctggtcgaagaaacccaagaacaagtgcgcctgctgatcaagggcaactcagcatcaaagactcggctgtgtcgctcacccggggaggtgctggctcttgttcagaggaaagttgttccgacattcgaggctgtcgctccccagtcccgggaactcctccgctgcctcgaggaagaagttcgacacctacctcacatcctactgggaaccctgctgagacaccgccctggagaactcaagccacttcctaccgtcctgcccagcatacatcagttacaccctgcatcgccacgtggttcatcattcattgccttatcccataaacttggtttgcctcccggaaaggcaagtgagcttttactccccgctgctgcctccctccgccaagatctcctcctactccaagatcagcgtagtttgtggtgttgggacttactgcatatgaagactagccttcctcctggtctgccaactcaggagctgctgcaaatacaggcttcacaggaaaaacaacagaaagagaaccttggacaggcacttaagcggttagagaagttgctaaaacaggctcttgagcgtattcctgagttacaaggcattgtgggagattggtgggaacaacccggccaggcagctctgtccgaggagttatgtcagggactcagcctgccccagtggagattacggtgggtccaggcccagggcgccctgcaaaagctctgtagttag

SEQ ID NO: 119481 - DNA, 873 bp, Artificial Sequence
  Description of Artificial Sequence: Synthetic coding sequence
atggaactggctcaggaggcccgtgaactgggctgttgggcagtcgaagagatgggggttcctgtggctgcccgcgccccagaatctaccctccggaggttgtgtttgggccaaggagccgatatttgggcatacattctgcaacacgtacacagccaaagaactgtaaaaaagatccgcgggaacctactctggtatgggcatcaggacagccctcaggtcaggcgcaaacttgagcttgaagctgctgtcacacgccttagagccgagattcaagaattggatcagtcccttgagttgatggagcgcgataccgaggctcaggatactgcaatggaacaggcccgacagcacacacaggatacccagcgaagggccctgctgctcagagcgcaggccggcgctatgcgcagacaacagcacaccctccgtgatccgatgcaaagacttcagaaccagctaaggcggctgcaggacatggaacgcaaggccaaagtggatgtgactttcggttccttaacatctgctgccctgggcctggagcctgttgtgttaagggacgtgcgcacagcatgtacattgagggcacaattcctccaaaatcttctgttgcctcaggctaagcgcggttcattgcccactccacatgatgatcattttgggaccagctaccagcagtggttgagctctgtggagactctcctgacaaaccatcccccgggtcacgtgttagcggctttggagcatctggccgctgagcgggaggcggaaatccggagtctgtgcagtggcgatggcctgggtgacaccgaaatcagtcggagggctggcggcctctgggtatgctggagtccctccggggctccctcatag

SEQ ID NO: 119482 - DNA, 2409 bp, Artificial Sequence
  Description of Artificial Sequence: Synthetic coding sequence
atgaaatatatcaaatccaactccaagaactcttcccaccactttgtggagacgttcaacatcaaaccccaggacctgcacaagtgtatagcccggtgtcacttcgcgcgctcccgcttcctccaaattctccagcggcaggattgcgtgactcagaaataccaggagaatgcccagctcagtgtgaagcaggtacgcaatctcagaagcgaatgcatcggtctcgaaaaccagattaaaaagatggagccgtacgacgaccactcgaacatggaggaaaagatacagaaggtcagaagcctctgggcaagtgtaaatgagactctgatgttcctggagaaggagagagaggtggtctcttctgtgttgtccctggtgaaccagtacgccctagacgggactaacgtggcgatcaatatcccgcggctgttactcgataaaatcgagaagcagatgtttcagttgcacatcggcaatgtgtacgaagcgggcaagttgaaccttcttacagtgatccagctcctcaatgaggttctgaaggtgatgaagtatgagcgttgtcaggctgatcaagccaggttaacagttgatctccattacctcgaaaaggagacaaagttccagaaggaacggttaagtgatctcaaacacatgaggtatcgaattaaagatgacctaactaccataaggcattcagtggtggaaaaacaaggagaatggcataagaagtggaaagaattcctggggctgagccctttcagccttattaagggctggacacccagcgtagatcttctgccccctatgagtcccctgtcgtttgaccctgccagcgaagaggtatacgcgaagtcaattctctgccagtatccagcatcattgcctgacgcccataagcaacacaaccaggagaacgggtgcagaggggattccgatacactgggcgctttacacgatttagctaactcccctgcatcctttcttagccagagcgtttctagcagtgaccggaattctgtgactgtgctcgagaaggacactaagatgggaacccctaaagaaaaaaacgaggctatctctaagaaaattccagagtttgaggttgagaactcccctctcagcgatgtggccaagaacaccgagagcagcgccttcggcggctctctgccagccaagaagtccgatccattccagaaggaacaggaccacctggttgaagaggtcgcgagggcggtgctgtctgattcaccccagctgtccgaaggaaaggagatcaaattggaggagttaattgactccctgggatccaatccctttctgactagaaaccagatcccccggacacctgaaaacctcataacagagatccgctcttcatggaggaaagctatcgaaatggaagaaaaccggactaaagagcctatccagatggacgccgaacaccgtgaggttttgcccgaaagcctccctgtgcttcataatcagagagaattcagtatggctgattttcttttggaaacaacagtatccgactttggccagagccatctgacagaggagaaggtaatcagcgattgtgagtgcgtgcctcagaaacacgtcctcacaagtcacattgacgaacctcccacacagaatcagtcggatctgctgaataagaaggtcatttgcaagcaagatctagagtgtctcgcattcactaaactgtctgagacaagccgcatggaaacattttctcccgcggtaggaaatcggatcgacgtcatggggggatcagaagaagagtttatgaaaatccttgaccaccttgaggtgtcttgcaacaaaccctccaccaataaaactatgctctggaactcgttccagatctcgtctggtatctctagcaaatccttcaaagacaacgacttcggcatcctgcatgaaaccttgcctgaggaggtggggcatctgtccttcaactctagctccagctctgaagcaaatttcaagctggagcccaattcgcctatgcatggtggcacactattggaagacgttgttgggggtcgtcagaccacacccgaaagcgacttcaacctgcaggcccttaggtcgcgctacgaggccctcaagaagtccctgagtaaaaagagggaggagtcgtacttgtccaactctcagactcctgagcggcacaagcccgaactgtcccccacccctcaaaacgtgcaaacagatgacacactcaatttcctagatacctgcgatcttcacacagagcacatcaagccaagtctgagaacatcaatcggggagcgcaaaagatcactgtccccactaataaagttctcccctgtagaacaacgtctcagaactaccattgcttgtagcctgggagagttgcccaacctcaaggggaaggtatag

SEQ ID NO: 119483 - DNA, 2868 bp, Artificial Sequence
  Description of Artificial Sequence: Synthetic coding sequence
atgtctagcgcctctgtcacagcgttcgagaaggagcacctgtggatgtacctgcaggctttgggcttcgaaccggggccggctactatagcttgcggcaaaattgtgagtcatacccaccttggcgtaaacatgttcgacaaactcaaccgtgacgctttccacatcatttcctattttctatttcaggtgttggatcagtcactcaccaaggaagtcttcaagttctgctggccacccttcgaccagaaaagcgacacagaatttcggaaacattgctgtgagtggatcaagcgtatctcaggcgagtgcgggtcaagcttcccccaggttgttggctcactgttcctctctccgggaggccccaagttcatccaccttatgtaccactttgctaggttcgtagcgatgaagtacattaaaagtaattccaaaaatagctcccaccactttgtggagaccttcaatattaagccccaggatcttcataagtgtatcgcacgatgccacttcgctcgcagtcggtttctgcaaatcctgcagcggcaggactgtgtgacgcagaagtatcaggagaatgcgcaactttctgtcaagcaggtgcggaatctgcggtctgaatgcatagggcttgagaatcagattaagaagatggaaccgtacgacgatcactctaacatggaggaaaagatccagaaagttagatccctgtgggccagtgtcaacgagaccctaatgtttttggaaaaggaacgcgaggtggtctcctcagtgctctcgttggtgaaccagtacgcattggacggcacgaacgttgctatcaacattccgcggctgctgttagacaagattgagaagcaaatgttccagctgcacatcggtaacgtatacgaggccggaaagttgaatctcctcaccgttatccagctgctgaatgaggttctcaaagtaatgaaatacgagaggtgccaagctgatcaggccagactgactgttgacctccattacctagaaaaagaaaccaagtttcaaaaggagagactctccgacctcaagcacatgcgttatcgtatcaaagacgaccttaccacgatccggcattccgttgtggaaaaacagggagaatggcataagaagtggaaagagttcctggggctctctcctttttccctcataaagggttggactccctctgttgatctcctgcctccaatgtctccattgagtttcgatcctgcatccgaggaggtgtatgccaagtctattctttgtcagtacccggccagcctgccggatgcccataaacaacataaccaggagaatggatgcagaggggacagtgacacacttggcgccctgcacgatctggctaattcacctgcctcatttctctcacagtcggtgtcctcttccgatcgtaattctgttacagttctggaaaaagacaccaaaatgggaaccccaaaggaaaaaaatgaggcgattagcaagaagattcccgaatttgaggtcgagaactctcctttgagcgacgtagccaaaaacacagaatccagcgcgtttggtggctcactgcctgcaaaaaaatctgacccattccaaaaagagcaggatcacctggtggaagaagtggcacgggccgtcctgagtgattcgccccaactgtctgagggaaaggagatcaagttagaggagcttattgactctctcggtagcaatccattcttaaccagaaaccagatccccagaacacccgagaaccttattacagagatcaggagctcctggcgtaaggcaatcgagatggaagagaacagaacaaaagaaccaatccagatggacgccgagcacagagaagtgctgccagagagtctgccagttctccacaatcagagagaattctcaatggcggacttcctccttgaaacaacagtgagcgattttgggcagagtcacctgaccgaagagaaggtgattagcgattgcgagtgtgttccccaaaaacacgttttgacgtcccatattgacgaaccgcccacccagaatcagtctgacctgctgaacaagaaggtcatatgcaaacaggacctggagtgtctagctttcaccaagctgtccgagacctcaagaatggaaaccttctctcctgctgtcgggaatcggatagatgttatgggggggagtgaagaggagttcatgaaaattctcgatcacctggaggtatcttgtaacaaaccctcaacaaataagaccatgctgtggaactcatttcaaatttccagcgggatctcaagcaaatcttttaaggataatgattttggcattctgcatgaaacactcccggaagaggtagggcatttgtcatttaattcaagtagttcctctgaggcgaatttcaaattggaaccgaactcacctatgcatgggggaactctgttggaggacgtggttggggggagacaaacgactcctgaatccgactttaacctgcaggctcttcgcagtaggtacgaggccttgaaaaaaagcctctcaaaaaagagggaggagagctatctgtcaaactcacaaactcccgagcgccacaaacctgagctctcaccaactcctcaaaatgtccagactgatgacacactcaatttcctagacacttgtgatttacatacagaacacataaaacctagcctgcggacctcaatcggagagagaaaacgctctctctctcccctgatcaaattttctcccgtagagcaacgactccgaacaacgatcgcgtgttccctgggagagctgcccaacctgaaggaggaggacatactgaacaagtcccttgatgccaaggagccaccttcggacctgaccagatag

SEQ ID NO: 119484 - DNA, 552 bp, Artificial Sequence
  Description of Artificial Sequence: Synthetic coding sequence
atgggaacccccaaggaaaagaatgaggcaatctccaagaagatacccgagtttgaagtggaaaattctcccctatctgacgtggctaagaacacggagtcaagtgcgttcggaggaagcctgccagccaagaaatcggacccatttcagaaggagcaggaccatcttgtggaggaagttgctagggcggtattgagtgatagcccacagttgtccgaaggaaaagagatcaaactggaagagttgattgacagtctcggcagtaacccctttctaacccggaaccaaattccacgaacccctgagaacctgattactgagatcagatcgtcttggcggaaggccattgagatggaggaaaaccgaacaaaagaaccaatccagatggacgctgagcatagggaagttctacccgagtccttgcccgttcttcataatcagagagaatttagcatggcagacttcctcctggaaactactgtgtccgactttgggcagagccatctgacagaagaaaaggttatttccgattgcgaatgtgtaccacagtag

SEQ ID NO: 119485 - DNA, 1077 bp, Artificial Sequence
  Description of Artificial Sequence: Synthetic coding sequence
atggccggacaagacgcaggatgtggcaggggcggagacgattatagtgaagacgagggggattcttccgtgagtcgcgccgcagtggaagtgtttggtaaactcaaggacctgaactgtcccttcctggaaggtttgtatatcactgaaccaaaaaccattcaggaattgctctgttctccttcagagtacagacttgaaatcctcgaatggatgtgcaccagggtctggcctagtctccaggatagattcagtagtctgaagggagtaccaactgaagtgaagattcaggaaatgacaaagctcggacacgagctgatgctgtgcgctcctgacgatcaagaactcctcaagggctgtgcctgtgcacaaaagcagcttcatttcatggatcagctcctggacacaattaggagtttgaccattggatgctccagctgcagcagtttaatggaacactttgaggacactcgcgaaaagaacgaggcacttctgggagagttgttttcctcccctcatttacagatgctgctgaatccagagtgtgatccttggcctcttgacatgcagcctctgttgaataagcaaagcgacgactggcagtgggcatctgcctctgccaaatctgaggaggaggagaagctagctgagctggctcgccagctgcaggaatctgctgccaagctgcacgctctgcggacagagtacttcgcgcagcatgagcagggcgccgcggctggagccgctgatatctcgaccctcgaccagaaactgaggctggtgacatcagatttccatcagctgattttagcctttctgcaggtgtacgacgatgaactgggcgaatgttgccagaggccgggtcccgatttgcatccgtgtggccccatcattcaggccacccatcagaacctcacttcctacagccagcttttgcaggttgtaatggccgtggcagacacatctgcaaaagccgtagagactgtgaagaaacagcagggcgagcagatctgttggggaggaagcagcagcgtgatgagcttggctacaaaaatgaacgagctgatggaaaagtag

SEQ ID NO: 119486 - DNA, 1284 bp, Artificial Sequence
  Description of Artificial Sequence: Synthetic coding sequence
atgggaggtgctcgactcggcgcccggaatatggctgggcaggatgcaggttgcggtcggggcggcgatgattacagcgaagatgagggtgatagctccgtgtcccgagccgcagtagaggtatttgggaaactcaaggacttgaactgtcctttcctggagggactgtacataacagaacccaagacaatacaggaactgctgtgttctcctagcgagtaccggctggagattctggagtggatgtgtaccagggtatggcccagcctacaagatcggttctcttccctgaagggcgtaccaactgaggtgaaaatacaggagatgacaaaactgggacatgagcttatgttgtgcgctccagacgatcaagagctcctcaaggggtgtgcctgtgcccagaaacagttgcacttcatggaccaactgctggataccatcagatccctgaccattggctgctcaagttgttcttctctgatggagcatttcgaagacacacgcgagaaaaacgaggcattattaggagagctgtttagttctccacacctgcagatgctgctgaaccccgagtgtgacccctggcccctcgacatgcagcctttgctgaataaacaatccgatgactggcagtgggcgagcgcttctgccaaaagcgaggaggaggaaaagttagcggaattggccagacaattgcaggagtccgccgcgaagctgcacgcccttcgcaccgagtactttgcccagcacgagcaaggggcggcggcaggggccgccgatatttctacattggatcagaaactgagactggtgacaagcgatttccaccagcttattctagccttcctgcaggtgtatgatgatgagctgggggaatgctgccagcggcccggtccagatttgcatccctgcggaccaatcatacaggccactcaccagaacctgacatcatacagtcagatacccagaggccagccaaaaaagcctgccctggtcacaatgactactgtcccaacatgcgcaacactgccacttgcccagggcttccgcgacgtgcacttcgggtttctttccgagcgcctgcgggcgtttcagccactcacgggctggtcatgcgagacaccaagatcgggcatgctactccaagtcgtgatggccgtggccgatacgtccgccaaggccgtcgaaactgtcaagaaacagcagggcgaacagatctgctggggtggctccagttcggtaatgtcattggctactaagatgaatgaacttatggagaaatag

SEQ ID NO: 119487 - DNA, 1107 bp, Artificial Sequence
  Description of Artificial Sequence: Synthetic coding sequence
atggggggagctagactgggggctagaaacatggcagggcaagacgccggttgcggaagaggcggcgacgattactccgaagacgagggcgacagctctgtgagccgagccgcagtggaagtcttcgggaagctgaaggacctcaattgtccattcctggaaggtctgtacatcactgaaccgaagaccatccaggagcttctttgttctccatccgagtatcgcctggagattttggaatggatgtgtactcgtgtctggccatcacttcaggatcggttctcttccttgaagggcgtgccgaccgaggtcaagatccaagagatgacaaagctgggccacgaactgatgctctgcgctcccgacgaccaagagctgttaaaaggttgcgcatgcgcacagaagcagctgcactttatggatcagctcctggacaccatcaggtcactgacaattgggtgcagcagttgttcctctttgatggagcatttcgaggatactagagaaaaaaacgaggcgctgctgggagaactcttttcatcaccacacctgcagatgctgttgaaccctgaatgtgatccctggccattggatatgcagcccctgctgaacaaacagtccgacgattggcagtgggcgagcgcttccgccaaatcagaggaagaggaaaagctggctgagcttgcccgtcaactccaagagtctgcagcaaaattacacgcgctccggaccgagtattttgcacagcatgaacagggagcagctgccggcgcagctgacatctctacgcttgaccagaagttaaggctcgtaaccagtgactttcatcaacttatactggcattccttcaggtctacgacgacgaattgggcgaatgctgccaaagacctggtcccgaccttcacccatgtggccccataatacaggcgacccatcaaaatctgacctcgtatagtcagttacttcaggttgtcatggctgtagccgacacaagtgctaaggcagttgaaaccgtgaaaaagcagcagggcgagcagatctgttggggtgggagctcatctgtcatgtccctcgccactaagatgaatgagttgatggaaaaatag

SEQ ID NO: 119488 - DNA, 411 bp, Artificial Sequence
  Description of Artificial Sequence: Synthetic coding sequence
atggaccagctgttggataccattagatcactcacaatcggctgctctagctgctcctccctgatggagcacttcgaagatacacgcgagaagaacgaagccttgctgggagaactctttagctctcctcatcttcaaatgctcctgaatccagagtgtgatccttggcctctcgacatgcaaccactgctgaataagcagtccgacgactggcagtgggcatcagcctctgctaaatccgaagaggaggagaaactggccgagctagccaggcaattgcaggagagcgcagccaagttgcacgctctccgcacggagtcgacaactactagctgggcttcagccgcttcggcccaagcactcacttccacccgggccgcaccatcttccaggcctcgcacccgtatttag

SEQ ID NO: 119489 - DNA, 516 bp, Artificial Sequence
  Description of Artificial Sequence: Synthetic coding sequence
atggttaagagaaggagatcaccagctttgggcgaagagcgctttagtccttctagcattcttcacccaagattacctctcgttttactcgggacacgggtgcccctctctgggggcgggcccggtgagccagaccaaggaaggtctgccccatcatggaagagtcttgcgtctacgcaccaccattcccggccagcagcaggagccactcccgctcggccggcgactcaaagccaactgggaccctttgcacctcccctgcccggcgtgaggccagcgcccttccccgctgtcgaggtctttgggaaactaaaagatctgaactgtcccttcctggagggcctgtatattaccgagcctaagaccatccaggagctcctctgcagtccatcggaatatagactcgaaatccttgaatggatgtgcacacgtgtttggccatctctgcaggacaggttcagctcgctgaaaggagtgcctacggaagttaagatccagggactgttagccggatag

SEQ ID NO: 119490 - DNA, 1233 bp, Artificial Sequence
  Description of Artificial Sequence: Synthetic coding sequence
atggcagatagctctggaaggggggcgggtaaacccgccacaggaccaactaacagctcatctgcaaaaaagaaggacaagcgggttcagggagggcgagttattgagtctaggtatttacagtacgagaaaaaaactacccagaaagccccggcaggagacgggtcccagacacggggaaagatgtcagaaggggggaggaagagcagcttactgcagaagtcgaaggcagactccagcggtgttggtaagggagacttacagagtactcttcttgagggacacggcacagctccccccgacctcgatttaagcgccatcaatgataagtcaattgttaagaagacaccgcaactcgccaagacaatctcgaagaagccagagagcaccagttttagcgcgccccgcaaaaaaagccctgacctgagcgaggcgatggaaatgatggagagtcaaactctgctcttaacgctgctgtccgtgaaaatggaaaacaacttggcagagttcgagcgccgggccgaaaagaacttactgatcatgtgcaaggagaaggagaagctccagaaaaaggcccacgagctcaagcggcggttactcctgtcacagagaaaaagggaacttgcagacgtgttagacgcccagattgagatgctgtcaccattcgaagccgtggctacacggttcaaagagcaatatagaacattcgcgaccgctctggacaccactcgccacgagctgcctgttaggtcaatccatttagagggtgacgggcagcagttgttagatgcattgcagcatgagctagtgactacccaacgcttgcttggcgagcttgatgtgggcgatagcgaggaaaatgtgcaggtacttgacctcctcagtgagctcaaagatgtcactgcaaaaaaagaccttgagctgaggcggtccttcgcgcaagtactggaactgagtgctgaggccagcaaagaggccgctctcgctaaccaggaggtatgggaagaaacccaagggatggccccaccgagcaggtggtacttcaatcaggatagcgcctgccgggagtccggaggcgcacctaagaacacaccgctgagcgaggacgataaccccggtgctagcagtgctcccgctcaggctaccttcattagtccctcagaagattttagctctagtagtcaagctgaagtaccccccagtctgagtcggagcggcagggacctttcttag

SEQ ID NO: 119491 - DNA, 1230 bp, Artificial Sequence
  Description of Artificial Sequence: Synthetic coding sequence
atggccgatagctctgggcggggtgcaggtaaacctgctacgggccctaccaatagttcttcagctaagaagaaagacaaacgagtccaaggcggtagggtgatcgaaagcaggtacctgcagtatgaaaaaaaaacaactcagaaagccccagccggagacggcagccagacaagaggtaagatgagcgaaggcggacggaaatccagcctgttgcaaaagagcaaggattcaagcggcgttggtaagggggatttgcagagtacactgctcgagggacacggaaccgctcctcccgatctggatttatccgccatcaacgataagtccatcgttaagaagacccctcaattagccaagaccatatctaaaaaaccggagtcaacctcctttagcgcaccacggaagaagtcccctgatctgtcagaagctatggaaatgatggagagccagaccctgctgctgaccctgttgtccgttaagatggagaataacctagctgagttcgagcggcgcgctgagaaaaatcttctcataatgtgtaaggaaaaagaaaagctacagaagaaagcccacgaactgaagcggagactgctgctgagccaacgcaagagggagctagccgacgtgctggatgctcaaattgaaatgttgtctcccttcgaggcggtggctacacgattcaaggagcagtatcggacgttcgcaacagcgctggataccaccagacatgagctgccagtgagatctatccatcttgagggcgatggtcagcagctcctggacgcccttcagcacgaacttgtgacaacccagcgactcctaggcgaactcgatgttggcgattccgaggaaaacgtgcaggttctggaccttttgtctgagctgaaagatgtgaccgctaaaaaggatcttgaactgaggcgcagcttcgcccaggtcctagagctctccgcggaagcgagcaaggaagccgctctcgccaaccaggaggtgtgggaggaaacacaggggatggcacccccatcgcgctggtatttcaaccaggactcagcctgtcgggagagtggaggagctccaaagaacacaccactcagcgaggatgataatccaggtgctagttctgcgccagctcaggcgaccttcataagccccagcgaagacttcagcagttcttcacaggcggaggtgccccccagtttgtcaaggagtggccgagatctctcatag

SEQ ID NO: 119492 - DNA, 1899 bp, Artificial Sequence
  Description of Artificial Sequence: Synthetic coding sequence
atggcccggcaccgcaacgtgaggggctacaattatgatgaagactttgaggacgacgacctctatggacagagcgtcgaggatgattattgtatttccccgtccaccgccgcccaattcatctacagccggagagataaaccctctgtcgagccagttgaagaatatgactacgaggacctgaaggaatcgagtaattcagtctccaaccaccagctgtccggctttgatcaggcacgcctttactcttgtctggaccatatgagggaggtgctgggtgacgcagtccctgatgaaatccttatcgaagccgtgctaaagaataaattcgacgtccagaaggcactttccggcgtgctcgagcaggaccgagtgcaatccttgaaggataagaacgaggcgaccgtcagtaccggtaagattgctaagggggtcctgttcagcagctcagaggttagtgcggataatgtccagtcctcatatccccagtcagcgaaccatttggattactcaagtaaaccgttcgacttcgcgtctagcgtgggaaagtacgggctgtcgcataattcaagcgtaccgacacactgtctgctgcaccgcaagaagaaactcgatacccgaaagtctgaaaagaaacttgagagctgcaagctcacaaaggagttatctcttgccaatctaatccatgacatgagtcgcgactcctgcgaaagccagccctcagttcggctcagtagtaccgattccctggagagtctgttgagtaagaatctggatgctgatctgttgcgcccgcatgcctccgaatgcatttcaaaagacgacagtgccttcaaggagattcccgatctgaaaaccattataattaaagggaccacccccaataacagtctctatattcagaataactcattgagcgacttccagaatatcccggtacaggactctttggggagctccaataaccccttatacctgaccagctcactggaaaacatgaccgtcgacaatcttaatgccagcaaggagacagaggtgggcaatgtgtctctggtcgaacagagtgcaaagaatcacaccttcaaaaacgataatctgcagttcagtcagtgtgaaagccccagcctgacagaactgttccaagaacataaagagaacaatattagccagtgttttaccctgtctgatctgtgcaatcaaagcagcgcctctttcactgacttgtctttgggctcttttccgctgtcacagttggccaaccgttgtcagagttctcctgggattagtgagctgaccgggtcactgagcagcctggccttccataaggctagtccgacaagggacctggagaatctgtccttgagtgagcttatcgccgagaccatcgacgtcgacaacagccaaataaagaaagaatcttttgaagtgagtctctcagaagtacgatccccagggatcgacagtaacatcgacctgagcgtactaatcaagaatcccgattttgtacccaaaccagtcgtggatcctagcatcgcgccttctagtcggacaaaggtgctcagctccaagctcggaaaaaattctaactttgcgaaagataacaagaagaacaacaagggctccctcacaagaaaacctccctttagtctgtcatggacaaaggccctggccgcgagaccctcagccttcgcttctaccctctgcctaagatatcccctgaagtcatgcaaaaggagaacactggatctctacaagacctttctttatagcaggcaggttcaggacgttaaagacaaggagatctcccccctcgtggccatcaccccctttgattttaagtcagcctcacccgacgacattgtgaaggcaaaccagaaaaaagctttcacccgcgaatag

SEQ ID NO: 119493 - DNA, 1563 bp, Artificial Sequence
  Description of Artificial Sequence: Synthetic coding sequence
atgacagtctccggcaaaaaacagacaatggggtttgaagtacccggcgtgagttctgaggaaaatggccactctttccacacaccccagaagggaccccccattgaggatgctatcgcaagcagcgacgtgctcgagacggcttccaaatctgcgaacccacctcatacaatacaggctagcgaagaacagtcgagcacgccagcccccgttaaaaaatctggaaagctaaggcagcaaatcgacgttaaggcggaattggaaaaaaggcaaggaggaaagcagctgctgaatctggttgtgatcggccacgtggatgcaggaaagagcactttgatgggtcatatgttgtatctcttgggaaacatcaataaacgtactatgcacaagtatgagcaggagagtaaaaaagcgggcaaagctagcttcgcctatgcttgggttcttgacgaaactggagaggaaagagaacgcggcgttactatggatgtcggcatgactaaatttgaaactaccaccaaagtcatcacccttatggatgcaccaggtcacaaggacttcatccccaacatgattaccggcgctgcgcaggcagacgtcgctgtactcgtggtcgatgcctctagaggggagtttgaagcaggattcgaaactggtggacaaacccgcgagcatgggctcctcgtgcgctcgctgggcgtgacccagctagccgtggctgtgaataaaatggatcaggtcaattggcagcaagaacgcttccaagagattaccggtaagctgggacactttctgaagcaggctggttttaaggagagcgatgtgggctttatcccaacatccggcttatccggcgagaacctgataactcgcagccagagcagtgaactcaccaagtggtataaaggcctgtgtctgctggagcagatcgattcgttcaaacccccgcaacgttccatcgacaagccatttcggctttgtgtctcggacgtgtttaaggaccagggttcagggttctgcattacagggaagattgaggccggctacattcagaccggggatcggttactggccatgccccctaacgaaacctgtacagtcaaggggatcaccctgcatgacgaacccgtggactgggcagccgcaggagatcatgtctccctcacacttgtgggcatggacataatcaagattaacgttggctgcatattctgcgggcccaaagtacccatcaaggcttgcacgaggttcagagctagaatattaatcttcaacattgagatccctattacaaaaggcttcccagtgctgctgcattatcagacagtctctgaaccagccgtaataaaaaggctgatctccgtgctgaacaaaagcaccggtgaggtgaccaagaagaaaccgaaattcctcactaagggccagaatgccttagtggagcttcaaactcaacgcccaatcgccctagagctatacaaggattttaaggaactcggccggttcatgctccggtatgggggcagcaccattgctgccggggttgtaaccgagattaaggaatag

SEQ ID NO: 119494 - DNA, 1929 bp, Artificial Sequence
  Description of Artificial Sequence: Synthetic coding sequence
atggctcgtcaccggaatgtcagaggctataactacgacgaagacttcgaggacgacgacctctatgggcagagcgtggaagacgactactgcatttctccttccaccgcccggctgtattcttgcctggaccacatgcgcgaggttctaggagatgccgtcccagatgagatcttaattgaagccgttcttaagaataaattcgacgtgcagaaagccctgtctggggtgttggagcaggaccgcgtgcagtcactcaaagacaaaaacgaagccacagtgagcaccggaaagatcgccaaagggaagcccgtcgatagccagacctcacgttcagaatcggaaatagtgccaaaggtggctaagatgacagtctcaggtaagaagcaaactatgggctttgaggtgccaggggtgtcgagcgaagaaaatggccattcctttcatactcctcagaaaggacctcccatcgaagatgccattgcctcatctgacgtgctggaaacggcctcaaaatcagcgaatcccccccataccattcaagcttctgaggagcaatcctctacacccgccccagtcaagaaatccggaaagctccgacagcagattgatgtgaaagccgagctcgagaaaagacagggcggtaaacagttacttaaccttgtcgtcattgggcatgtggatgcgggaaagtccaccctgatgggacatatgctttatttactgggcaatatcaataaacgcaccatgcataaatatgaacaagagtcgaaaaaggccggcaaggcctcatttgcatacgcctgggtgctggacgagacgggagaggaacgggagcgaggagtcacaatggacgtcggtatgacaaagtttgaaactaccacaaaagtgatcacattgatggatgcacccgggcacaaagatttcattcctaatatgattacaggcgccgctcaggctgacgtggctgttctggtggtggacgcctccaggggagagttcgaggcggggtttgaaacaggagggcagacacgtgagcatggattgctcgtgcgatccctcggcgtgacccagttagctgtggccgtcaataaaatggatcaggttaattggcagcaggagcgctttcaggagatcacggggaagctgggtcacttcttgaagcaggctggcttcaaagagtcagacgttggcttcatccccacctctgggctgagcggggagaacttgattacacggtctcagtcgtcagagctgaccaaatggtacaagggactgtgcttgttggaacaaatagattcattcaaaccccctcaacgctcaattgacaagccctttcgactctgtgtaagtgatgtgtttaaggaccaggggtctggcttttgtattacaggtaaaatcgaggccggctatatacagaccggcgaccggctcctggccatgcctcctaatgagacctgtactgttaagggtatcactctccatgatgaacccgtcgattgggctgcagctggggaccatgtttccttgaccctcgtgggaatggacataataaagattaacgtggggtgtatattctgtgggccgaaggtacccattaaggcctgcacacggtttagggcccggatcctgatcttcaacattgagattcccataacgaaaggatttcctgttctgttgcactaccaaacagtttctgagccggctgttatcaaacgtctcatttcagtgttgaataagagtaccggtgaggtgaccaaaaagaagcctaaattcctcactaaaggtcagaatgctctcgtcgaactacagacccaaaggccaattgcgctcgagctgtacaaagatttcaaagagcttggccggtttatgttgcggtatggaggcagtacaatagctgccggagtggtgaccgagataaaagaatag

SEQ ID NO: 119495 - DNA, 2055 bp, Artificial Sequence
  Description of Artificial Sequence: Synthetic coding sequence
atggcccgccacagaaacgtgcgaggctacaattatgacgaggattttgaggacgacgatctgtatggccaatccgttgaggatgattattgtatctccccaagcacggcggcgcagtttatctattcacgacgagataaaccatctgtcgaacctgtagaagaatatgactacgaagacttgaaggagtcttcaaattccgtctctaatcatcagctgtccggattcgaccaggcacgactgtattcctgcctagaccacatgcgcgaagtcctaggcgatgctgtcccagacgagattctgattgaagcggtactcaagaacaagttcgatgtccagaaggctctgtccggggttctggagcaggatcgggtgcagagcctgaaggacaagaatgaagctaccgtgtctacaggtaaaatcgctaaaggtaagcccgtggatagccaaacgtctaggtccgaatcggagattgtccccaaggtcgccaaaatgaccgtttccggcaagaaacagacaatgggctttgaggtccctggcgtgagtagtgaggagaacggccattcctttcacacaccccaaaagggaccccccatcgaggacgctattgcatctagcgacgttctggagacagcgagcaaaagtgcgaaccctcctcacaccattcaagccagtgaagagcagtcttcaaccccagccccagtaaagaagagtgggaagctccgccaacaaattgatgtcaaagccgagctggagaaacgccagggaggcaaacagctgttaaatctagtcgttatcggacacgtagatgctggtaagtctacgctgatgggacatatgctgtacctcctgggaaacatcaacaaaaggactatgcacaagtacgagcaggaatccaagaaggccgggaaggcgtcatttgcatatgcttgggtgctggacgaaactggcgaggaaagggaacgtggtgtgaccatggatgtgggaatgaccaagttcgaaaccaccactaaggtcatcacacttatggacgcaccaggccataaggattttatcccaaatatgatcacaggggcagcgcaggccgatgtggccgtgctcgtggtggacgcctctcgaggagaattcgaagccggttttgagacagggggtcaaactcgcgagcacggcctgttagtgagaagtctcggcgttacacaattagccgtggccgttaacaagatggaccaggtgaactggcagcaagagcgtttccaagaaattactggaaaactggggcactttctgaagcaggccggcttcaaggagagcgatgtcggattcataccaacctccggcctcagtggagaaaatttaattactcgcagtcagagttccgagcttaccaaatggtataaagggctgtgtctcctcgaacaaatcgattcatttaaaccacctcagcggagtattgacaagcccttccggctgtgcgtgtcagacgtgttcaaggatcagggctctggattttgtataacaggtaaaatcgaagctggctacattcagactggtgatcggttattagctatgcctcctaacgagacatgcacagttaaaggcattacgttacacgatgaacctgttgactgggccgccgctggcgatcacgtgtccttaaccctcgttggaatggacataatcaagataaacgttggatgcattttctgcggtcccaaggtgcccattaaggcctgcactaggtttagagctcgcatcctgatcttcaatatcgagatccccataaccaaggggttccctgttctgttgcattaccagacagtaagtgagccagcggtgattaaacggctgatatcggtattgaacaagtccaccggcgaggtgaccaagaagaagccgaagtttctcaccaagggccagaacgccctcgtggaactgcaaacacaacgccccatcgcgctggagttgtataaggactttaaggaactgggaagatttatgctgaggtacggaggttccacaatcgctgcaggagtggtgacagagattaaagagtag

SEQ ID NO: 119496 - DNA, 1227 bp, Artificial Sequence
  Description of Artificial Sequence: Synthetic coding sequence
atggggcacatgctctatctacttggaaacataaataagcggactatgcacaaatatgaacaagagtccaagaaagcagggaaggcatctttcgcctatgcttgggtcctggacgagaccggggaagagagggaacggggggttaccatggatgtgggcatgaccaaattcgaaaccacgaccaaggtaatcactttaatggacgctcctggacataaagacttcattccaaatatgatcaccggtgcagcccaggcagatgtagctgttctcgtagtggacgcctccagaggcgaatttgaggccggttttgaaaccggggggcagacccgcgaacacgggttgttggtgcgctccctgggagttacgcagctggctgttgctgttaataaaatggatcaggtcaattggcaacaggaacgctttcaagagattactggcaagctgggacatttcctgaaacaggcgggattcaaagaaagtgacgtaggctttattccaacatctgggctgagcggcgagaacctgatcactcggagtcaatcttctgagcttacaaaatggtataaaggcctttgccttctggagcagatagactccttcaaacctcctcagcgctccatcgataaaccctttcgattgtgcgtttcggacgtgttcaaggaccaggggtccggattctgcatcaccggaaaaatcgaagcaggctatatacagacaggcgaccgcctcctggcaatgccacccaatgagacatgtaccgttaagggcatcacattacacgacgagcctgtcgactgggccgccgcaggcgatcacgtaagtctgacgctagtcggaatggacattatcaaaattaatgtaggctgcattttttgtggtcctaaagtgccgattaaggcgtgcacaaggttccgcgctagaattctgatattcaacatagagataccgatcaccaagggctttcccgtgttgctccactaccagactgtcagcgaaccagcagttatcaaaaggttaatctctgtgctgaacaagagcactggcgaggttactaagaaaaagccgaaatttctgacaaaaggtcagaatgcactggtggaactacaaacccaacgcccgattgccctggaactgtataaggactttaaagaacttgggcggtttatgttgcggtatgggggaagtacaattgcagccggtgtagtaacagaaattaaggagtag

SEQ ID NO: 119497 - DNA, 840 bp, Artificial Sequence
  Description of Artificial Sequence: Synthetic coding sequence
atgtccctgttcgacctgtttcggggattttttggtttccccggacccagatcccaccgagacccatttttcggggggatgacccgggatgaagatgacgatgaagaggaggaggaggaaggtggctcatgggggaggggcaatccaaggtttcactctccgcagcatcctcccgaagagttcggctttgggttttctttctctcctggcgggggaatcagatttcatgataattttggtttcgatgacctcgttcgggattttaacagcattttctccgacatgggagcatggacgctgccttcgcatcctccagagcttccaggacccgagtcagagacgcccggggaacggctcagagagggacagaccttaagagactcaatgcttaagtatcccgactcacaccagccaaggatatttgggggagtgttagaatcagatgcccggtcagagtctccacagccagcgccagactggggaagccagcggccgttccacagatttgacgacgtgtggccaatggacccacacccccggacacgagaggataatgacctggattcgcaagtgtcccaagagggtttgggccccgtcctgcagccgcagccaaaaagctactttaagtccatcagtgtcaccaagattaccaaaccagatggcattgtggaggagaggcgaactgttgtcgactcggaggggagaaccgaaacaacagtcacacgccacgaggcagactcatcccccagaggagatcctgagtcccctcggccccccgccctcgatgacgccttttccatcttggacctgttcctgggccggtggttccgaagccggtag

SEQ ID NO: 119498 - DNA, 696 bp, Artificial Sequence
  Description of Artificial Sequence: Synthetic coding sequence
atgagcctttttgacctctttagaggcttttttggattccctgggcccaggagctttagtcccggcgggggaatacgctttcatgacaacttcggtttcgatgacctagtacgggacttcaatagtattttcagcgatatgggtgcctggaccttacccagtcaccccccggagctccctggccctgagtccgagactcccggcgagcggttgagagaagggcaaaccctccgagactctatgctcaagtacccagacagccatcagccaaggatatttgggggcgtgctagagtctgacgcaagaagcgagtccccgcaacccgcacctgactgggggtcccagcggcccttccatagattcgatgacgtgtggccaatggaccctcacccgcgcacgagggaagacaatgatctcgatagccaagtgagtcaggagggactcgggcctgtgctgcagcctcagccaaaaagctatttcaagtccatttcagtaaccaaaatcacaaagcctgatgggatcgtagaggagagacgaactgtggtcgattcggaagggcgcactgaaacaaccgtcacccgccacgaagcggatagttctccacgcggggatccagagtctccccggcccccagcactggatgacgctttctctattctggaccttttcctcggcaggtggtttcgatcacgctag

SEQ ID NO: 119499 - DNA, 864 bp, Artificial Sequence
  Description of Artificial Sequence: Synthetic coding sequence
atgagtctatttgatttgtttcgggggttttttggtttccctggtcctagaagccatagggatccctttttcggcggcatgaccagagatgaggacgacgacgaggaggaggaggaagagggcggctcttgggggagaggtaacccacgctttcactcacctcagcatccccccgaagagtttgggttcggcttttccttttccccaggtggtgggattcgctttcatgacaattttggattcgatgacctagtgcgggatttcaactccattttttcagacatgggagcatggaccttgccttcacatccgcccgccaatacatgccacctatccgctgagcttccgggccccgagtctgaaacacctggggagcgcttaagagaaggtcagacactgcgcgatagtatgctgaaataccccgacagccaccaacctcgaatcttcggaggtgtcttagaatcggatgcgcgtagtgagagcccccaaccagccccagactggggaagccagaggccattccacaggttcgatgatgtgtggcccatggaccctcatccacggacacgtgaagataatgatttggactcccaggtttcccaggagggactgggccccgtactgcagccacagcctaaatcttatttcaagtcaatctctgtcactaaaatcactaaacccgacggtatcgtcgaggagagacgaacggtggttgattccgaggggcgaactgagactactgttactcgccacgaagccgactcatctcctcgcggggaccccgaatcccctcgcccccccgctctggatgacgccttttcaattttggatctattcctgggcaggtggtttaggagccggtag

SEQ ID NO: 119500 - DNA, 1179 bp, Artificial Sequence
  Description of Artificial Sequence: Synthetic coding sequence
atgcaaagcccagcagtgctggtcacttcacggcgacttcaaaacgcccacactggactcgaccttactgtcccacagcaccaggaagtgagggggaaaatgatgtcggggcatgttgagtatcagattcttgtggtgactaggttggctgcctttaaaagtgccaaacaccgcccagaggacgtagtccagtttttagtgagtaagaaatactctgagatcgaggagttctatcagaagctgtcatctcggtacgcggcggccagccttccgccgttgcctcgcaaggtcttgtttgtgggtgagtcagatattcgcgagcgaagggctgtgtttaacgaaattctgaggtgcgtgagcaaagacgctgagctcgctgggagtcccgaactgctcgagttcctgggcactcgctcccctggcgcagcagggttgacatctcgcgacagctcggtgctagatggtacagatagtcaaactgggaacgacgaagaggccttcgacttcttcgaggaacaggatcaggtcgcggaggagggaccaccagtccagtcattgaaaggggaagatgccgaagagagtttggaggaagaagaagccctggacccactgggcatcatgcggagcaaaaagccgaagaaacatcctaaggtggctgtcaaagccaaaccatcccctcgcctcacaatcttcgatgaggaagtggatcctgatgagggactgttcggccccggacggaaactgagccctcaggatccctctgaggatgtctcctccgtagacccccttaagctcttcgacgacccggacttaggaggggcgatccctctgggcgacagcctcctgctcccagccgcatgtgaatccggcggcccaactccctccctgtcccaccgggacgcctctaaggagttgttccgtgtagaagaggatttggatcagattctgaatttaggcgcggaacctaagcccaaacctcagctgaagcccaaaccccccgtggcggctaaacctgtgataccgcgcaagccagccgtcccccctaaggccggacccgctgaggctgtggcgggccagcaaaaaccacaggaacagatacaggcaatggacgaaatggatattctgcagtatattcaggaccacgacactccagcacaggctgcaccttccctgttctag

SEQ ID NO: 119501 - DNA, 654 bp, Artificial Sequence
  Description of Artificial Sequence: Synthetic coding sequence
atgtccctcgtgggcggttttccacaccatcccgtggtccatcatgaagggtatccttttgccgcagccgccgccgccgctgctgcagccgcggcttccaggtgttcccacgaagaaaatccatactttcacggttggcttatcggacaccccgaaatgtcccctcccgattatagcatggccctgtcctattctccagagtatgccagtggtgccgctggtctcgaccatagtcactatgggggggtaccccccggggcaggccccccagggttgggtggaccgcgaccagtcaaacggaggggtaccgctaaccgcaaagagaggcgacggacacaatctattaacagcgcctttgccgaattgagagaatgcatccctaacgtgccggccgatacaaagctcagtaaaattaagactttgcgtttggcaacctcctatattgcctacctgatggatctgctggcgaaagacgaccagaatggtgaggccgaggcattcaaggctgagatcaagaaaaccgacgtgaaagaggaaaagcggaagaaagaattaaatgaaatcctgaaatccactgttagttcaaacgataaaaagactaagggacgtacaggatggcctcagcacgtttgggctctggagttgaaacagtag

SEQ ID NO: 119502 - DNA, 561 bp, Artificial Sequence
  Description of Artificial Sequence: Synthetic coding sequence
atgtccctcgttgggggatttccacaccaccccgtggtgcatcatgagggctacccctttgctgctgccgcagccgccgcagctgcggctgccgcatcaagatgtagccatgaagagaacccctattttcacggctggcttattgggcatcccgaaatgagcccccctgactatagtatggcactgtcttacagtccagagtacgctagcggtacggccaaccgcaaagaacgcagaaggactcaatccattaattccgcttttgcagaattaagggagtgcattcctaatgtgccagccgatacaaagctcagcaaaattaagacccttcgtttagccacatcctatattgcttacctcatggacctactggccaaagatgaccagaacggggaggcagaggcatttaaagctgagatcaagaaaactgatgtgaaagaggagaagaggaaaaaagaacttaacgaaatattgaagtctaccgtgtctagtaacgataagaagaccaagggccgaacaggatggcctcaacacgtttgggcgctggaactgaaacaatag

SEQ ID NO: 119503 - DNA, 498 bp, Artificial Sequence
  Description of Artificial Sequence: Synthetic coding sequence
atgtcacctccagactatagtatggccctctcatacagcccagagtacgcaagcggagcggcgggcctggatcacagtcattatggcggcgttccacccggagcagggccccccggactcggcggacccaggcccgtcaagaggcgaggcaccgccaaccgcaaagaacggcggagaacacagtccattaattccgctttcgccgagctgagggagtgtataccaaacgtgcccgccgacactaagttgtctaaaatcaagactctgaggttagcaactagttatatcgcttatctcatggatctgcttgcaaaagatgatcagaatggcgaggcagaggctttcaaggcagaaattaagaaaaccgacgtgaaagaagagaagcggaagaaagaacttaacgagatcttgaagtcgactgtttcatctaatgataaaaagaccaaggggcgtaccggctggccccagcatgtttgggccttagagctgaagcagtag

SEQ ID NO: 119504 - DNA, 2577 bp, Artificial Sequence
  Description of Artificial Sequence: Synthetic coding sequence
atgtcagttgtgggcctggacgtcggcagtcagtcctgttatatcgcagtcgcacgcgccggggggatagagacaattgcaaacgaattctctgacagatgcacaccgtctgtgatctctttcggaagtaaaaaccggaccattggtgtagcagccaaaaaccagcaaatcacccatgctaataatacggtgtcaaacttcaagcgtttccatggtagagctttcaacgatccctttattcagaaggagaaggaaaacctctcttacgacctggtgcccctcaagaatggaggagtcggaataaaagtgatgtacatgggggaagagcacctgttcagcgtggaacagattacggctatgcttctgactaagttaaaagaaactgcagagaactctctcaagaagcctgtcacagattgcgtgataagtgtgcccagttttttcacggatgccgaaaggcggagtgtgctggacgccgcacagatagttggcctgaactgtttgaggctgatgaacgatatgaccgcagtggctctgaactatgggatctacaagcaggatctcccctctctggatgagaaaccccgaattgtagtctttgtggatatggggcatagtgccttccaggtgtccgcttgcgccttcaacaaagggaaactaaaggtacttggtacagctttcgatcccttccttggcggtaagaatttcgacgagaagctcgtggagcacttctgcgccgagtttaaaaccaaatataagctggacgcgaagtcaaaaatacgagcccttcttcggctttatcaggaatgtgagaagcttaaaaaactgatgtctagtaactctacagacttaccgctcaacattgaatgtttcatgaacgataaggacgtgagtgggaagatgaaccgctcacagttcgaggagctgtgtgctgaactcctgcagaaaatcgaagtgccactgtactcactgttagagcaaacccacctcaaagtcgaggatgtgtccgctgtggagattgtgggcggagccactaggatccctgcagtcaaagagcgaatagcaaagttttttggcaaggatatctcgacgacgctgaacgctgacgaagcagttgcacgaggatgtgcgttgcaatgtgccatactgtcacctgcttttaaagttagggagtttagtgtcacggatgccgtaccttttcctataagtttgatctggaaccacgacagcgaagacacagaaggagtgcacgaggttttctccagaaaccacgctgcgcccttctcaaaggttctgactttcttaagacgggggccattcgagctggaagccttttactctgatcctcagggggtgccgtatccggaggcaaagatcggcagattcgtcgtccaaaacgtgagcgcccagaaggacggcgagaagtctagagtgaaggtgaaggtgcgagtgaacacccacgggatctttaccatttccaccgcttccatggtggagaaagttcctaccgaggagaacgagatgtcttcagaggctgatatggaatgtctcaaccagcgccctcctgagaatccagacacggataaaaatgtccagcaggacaattcggaagcaggcacccagccccaggtgcagaccgatgctcaacagacgagtcaaagcccccccagtccagaattgaccagcgaggaaaacaagatccccgacgcggataaagccaatgagaaaaaagtggatcagccacctgaggccaaaaaacccaagatcaaggttgttaatgttgagctacctattgaagcaaacctggtttggcagttgggcaaggatttactgaatatgtacattgagacggaggggaagatgataatgcaggacaaattggaaaaggagaggaatgatgcaaaaaatgccgtcgaggagtacgtgtatgaatttcgagacaagctctgtggaccttatgagaaatttatttgtgagcaagaccatcagaactttctgaggctgctcaccgagacggaggactggctgtacgaggaaggggaagaccaggcaaaacaagcctacgtggacaaactggaagaacttatgaaaatcggaacacccgtcaaggtacgcttccaggaggcagaagagcgccctaaaatgttcgaagagctgggacagagactgcaacactacgcgaaaatcgccgcggactttcggaataaggacgagaagtataatcacatcgatgagagcgagatgaagaaggtggaaaagtccgtgaacgaagttatggaatggatgaacaatgtgatgaacgcccaggctaaaaaatccctggaccaggaccccgtcgtgagggcacaggaaatcaagacaaaaatcaaggagctgaataacacttgtgagccggttgttactcagccaaagccaaagatcgaaagtcccaagctagagcggaccccaaacggacctaacatcgataagaaggaagaagacctcgaggacaagaacaacttcggcgcggagccgccgcaccagaatggcgagtgctacccgaacgagaaaaactctgtcaacatggatcttgattag

SEQ ID NO: 119505 - DNA, 414 bp, Artificial Sequence
  Description of Artificial Sequence: Synthetic coding sequence
atgttcgaagagttgggacagagactgcagcattacgctaaaatcgcagctgacttcagaaataaggacgagaagtacaatcatatagacgaatctgagatgaaaaaggtcgaaaaatctgtgaatgaggtcatggagtggatgaataatgtaatgaatgcccaagctaaaaagtctctagaccaggatccagtagtcagggcacaggagattaaaacgaagattaaagaactgaataatacttgtgagcctgtggtgacccagcctaagccaaaaattgagagcccaaaattggaacgaacaccaaacgggccaaatatagataaaaaagaagaagatctcgaagataaaaataatttcggcgcggagcccccacaccagaacgacagctgcggaattgtgaactcttactag

SEQ ID NO: 119506 - DNA, 2034 bp, Artificial Sequence
  Description of Artificial Sequence: Synthetic coding sequence
atgtacatgggggaggagcacctgttttcggtcgagcagataactgccatgctcctgacaaagctgaaggaaaccgccgagaactctctgaagaagccggtaaccgattgcgtgatctccgttctgggaactgcctttgacccttttctgggaggtaaaaacttcgatgagaaactagtggaacatttttgtgctgaatttaaaactaagtataagctcgacgccaagtccaagatcagagctctccttaggctctaccaggagtgtgagaagctaaagaagctaatgtcgagcaacagtactgacctgccgcttaacattgaatgtttcatgaatgacaaggacgtgtccgggaagatgaacaggtcgcaatttgaggaactgtgcgccgaactgctccagaaaattgaagttcctctgtactccctgctggaacagacccacctgaaggtggaggacgtgagcgccgtcgagatcgtgggaggcgcaactagaattcccgcagtcaaagagcgtattgccaagttctttggtaaagacatatcaaccactttgaacgccgacgaggcggtggcacgggggtgtgcattgcagtgcgccatcctcagtccagcctttaaggttcgggagtttagtgtgactgatgctgttcccttccccatctctctgatctggaaccacgattccgaggacacagagggggtgcatgaggtcttcagtagaaaccatgccgcccccttcagtaaagtgctcacttttttaaggcgggggcccttcgagctcgaggccttctattctgacccgcagggagtcccatatccagaagctaagatcggacgctttgtggttcagaacgtttcagcccagaaggatggcgaaaaatctagggtgaaggtcaaggtccgcgttaacacccacgggattttcacaatcagtacagcgagcatggtggaaaaggtccccacagaagagaatgaaatgtcctccgaagccgacatggagtgtctgaatcagaggccccccgagaatcctgacacagacaaaaatgttcaacaggataacagcgaggctggtacccagccacaggtgcagacggatgcccaacagaccagtcaatcacctccatctcccgagctgacatccgaagaaaacaagattcctgacgcagataaagcaaacgagaagaaggtcgatcaaccccccgaagccaagaaacctaaaataaaggtcgttaacgtggaacttcctatcgaggcaaaccttgtgtggcagctcgggaaagacctccttaatatgtatatcgaaactgagggaaaaatgattatgcaggacaagttagaaaaagaaagaaacgacgctaagaacgcggtggaagaatacgtgtatgaattccgggacaagctctgtggaccctatgagaaatttatctgtgaacaggaccaccagaactttttgcgtctgcttacagagaccgaagactggctgtatgaggagggtgaagatcaggcgaaacaggcctacgtggacaagctcgaggaactcatgaaaatcggcactccagtgaaagtgcggttccaggaagctgaggagaggccaaagatgtttgaagagctcggacagagactgcagcattacgccaaaatcgcggctgattttcgcaataaggatgaaaaatataaccacattgatgaatcagagatgaagaaagtggaaaagagtgttaatgaggtgatggaatggatgaataacgtgatgaacgcccaggcaaagaaatctctggaccaggacccagtggtaagagctcaagagatcaagactaagataaaggagctgaataacacttgcgaaccggtggtgacccagcctaagccaaaaatcgagtcacccaagcttgaaagaacccccaatggccctaacattgacaaaaaagaggaggacctggaagataaaaataactttggcgccgagccaccacatcagaacggtgaatgctacccgaacgaaaaaaatagcgttaacatggacttggattag

SEQ ID NO: 119507 - DNA, 1920 bp, Artificial Sequence
  Description of Artificial Sequence: Synthetic coding sequence
atggcccgagagcgcccatgtcggtgccacggtaacgggggtaggtctccaggcacaggatgtcctctgggtcgaatcttccctgagggcagtaggcgtagaaagaggaaatggcatgtggagggccctgtcgaagcgccccggaatgggcaaactccccgggcgggtgcggagaggggacagggccgcaagcggagacaggagaagcaggccggcggaatagaaacgattgccaatgagttttcggatagatgtacccccagtgtgattagtttcggaagtaagaatcgtaccatcggagtcgctgcaaagaaccagcagattacacatgcaaataacacagtgagtaatttcaaacgatttcatggccgcgcatttaacgacccctttattcagaaggaaaaagagaacctgtcatatgacttggtcccccttaagaacggcggcgtcggaattaaggtgatgtatatgggggaggagcacctctttagcgtcgaacaaatcacagccatgctcctcacaaaactgaaggagactgctgaaaactctctgaaaaagcccgttactgattgtgtgatctctgttccttcatttttcaccgacgcagaaagacgcagcgtcctggatgccgcccaaatcgtaggtctgaattgtctgcgtctgatgaacgatatgacggctgtggccctcaattacgggatttataaacaggacttaccctctctcgatgagaagcctcgcatcgtcgtattcgtcgacatgggtcactctgcgttccaggtgtcggcctgtgctttcaataaaggaaagctgaaagtgctcgggacagcttttgatcctttcctgggcggcaaaaattttgatgaaaaactcgttgaacacttctgcgccgaattcaagaccaaatataagctggacgcaaaaagtaagatccgcgccttactgaggctgtaccaggaatgcgaaaagcttaagaagctgatgagcagtaactcgacggacctgcccctcaatatcgaatgtttcatgaacgacaaagatgtctccggaaaaatgaaccggtctcagttcgaggagctatgtgcagagctccttcagaaaatcgaagtgccactttattcattgctcgaacaaacccatctcaaggtcgaggacgtcagtgccgtcgagatcgttggtggcgctacccgtattcctgccgtgaaggagcgcatcgcaaagttcttcggcaaggacattagtaccaccttgaatgctgacgaggcagtcgcccgtggctgtgccctacagtgcgctatcctgagcccagcattcaaagtccgggaattttctgtgacggacgctgtgccattcccgatctctctaatctggaaccacgatagcgaagatactgagggggtccatgaggtcttcagcagaaaccatgctgcaccattctccaaggtgctgacctttcttaggagaggcccctttgagctggaggctttctattccgatcctcagggggttccataccctgaagccaagattggtaggtttgtcgtgcagaacgtttccgctcagaaggacggcgagaaaagtcgcgtaaaggttaaagtgagagtcaacacacatgggatcttcacaatctctacggcttctatggtcgagaaggtgccgacagaggaaaatgaaatgtcttcagaggccgatatggagtgcctgaatcaacgtccccccgaaaatcccgatacagataaaaacgtgcagcaggataacagcgaggcaggcacacagccccaggttcagaccgacgcccagcagacttctcagtcccctcctagccccgaactgacgtctgaggagaacaagattcctgacgcagataaacagatgaagaaaaagctcacatccctgcaaaagctgaaaagtccaaaatag

SEQ ID NO: 119508 - DNA, 2583 bp, Artificial Sequence
  Description of Artificial Sequence: Synthetic coding sequence
atggccacggctgccgtccttcgaggccctgccgcacactgggttgagagctttcagaaggctcgggaggaaggttccggtagcggcacttggagagggcggtggcgaaggagatccgtgatttcttttggaagtaagaacagaaccatcggggttgccgcaaaaaatcagcagatcacccatgcaaacaacactgtctcaaattttaagcggtttcatgggcgcgccttcaatgatccctttattcagaaggagaaggagaatctgtcctatgatttggtgcctctcaagaatgggggggtcggtattaaagttatgtatatgggagaggagcacctgttctctgtggagcagattacggcaatgctgttaacaaagcttaaagagaccgctgagaactctctaaagaaacccgtgacggactgcgtaatcagcgtcccatccttcttcactgacgctgagcgacgatccgtcctggacgccgctcagatcgttggcctcaactgtcttaggctgatgaatgatatgacagcggttgccctgaactatggaatctacaagcaagacctgcccagccttgatgaaaaacctcgcattgtggtgttcgtggacatgggtcacagtgccttccaggtatccgcttgcgcattcaacaagggcaagctcaaagtcctcgggacagctttcgatccgtttctgggggggaagaattttgacgagaagctcgttgagcatttttgcgccgaatttaagacaaaatataaattggacgctaaatcgaagatcagggccctgctccggctataccaggagtgcgaaaaactgaaaaaactgatgtcaagcaactcgactgacttacccttgaatatcgaatgtttcatgaatgataaagatgtgagtgggaagatgaatagaagccaattcgaggagctttgtgccgagctgttgcaaaaaatcgaggtccccctgtactcactcctggagcagacccacctgaaggtcgaagacgtcagcgcagtggagatcgtgggcggggctacccgaattcccgctgtgaaagagcgcatagcaaagttctttggcaaggatatttcaactaccctaaatgccgacgaggcagtcgcccggggatgcgccctccagtgcgcgatcctgagtccagcttttaaagtgagggaattctctgtaaccgatgcagtgccctttcccatctcccttatatggaaccatgattccgaggacaccgaaggagttcatgaagtgttttcaaggaaccacgccgcccccttttctaaggtcctgaccttcctgcgccgcggacctttcgaactggaggctttttactctgatccccagggagtgccataccccgaagcaaagattggcaggttcgtcgttcagaacgtatccgcccaaaaagacggcgaaaagagcagagtaaaggttaaagtccgggtcaacacacatgggatttttacaatctcaactgcttcaatggtggagaaagtccctacagaagaaaatgagatgtcaagtgaggccgacatggagtgtctgaaccagcgccctcctgaaaatcctgatactgacaagaacgttcagcaagacaacagcgaagccggcacacagccacaagttcaaacggatgctcagcagacaagtcaatcaccgccctctcccgaactcaccagcgaggaaaacaagataccagatgccgacaaggctaacgagaagaaggtcgaccagcctcccgaggcaaaaaaacccaagattaaagtagtaaatgtagaacttccaattgaagcaaacctggtgtggcagctggggaaggatctgctgaacatgtatatagagacagaggggaaaatgatcatgcaggacaagttggagaaggagagaaacgatgctaaaaatgccgtggaggagtacgtgtacgaattccgagacaaactttgtggaccttatgaaaaatttatctgcgaacaggatcaccagaacttcctgcgtttgctaaccgagaccgaagactggctttatgaagagggggaggaccaggctaaacaggcgtacgtggataagctagaagagctcatgaagataggcaccccagtcaaggtgagatttcaggaggctgaagaacggcccaaaatgttcgaggaactgggtcagcggctgcagcactacgctaagatcgctgcagatttcaggaataaagacgagaaatataaccatattgatgaatccgagatgaagaaggtggaaaagtctgttaatgaggtgatggaatggatgaacaatgtgatgaatgctcaagccaagaagagcctggatcaggaccctgttgttagagcccaagagataaagaccaaaatcaaagagctaaacaacacctgtgagccagtggtgacacaaccaaagcccaaaatagagagtcctaagttggagcgaacacctaacggcccgaacattgacaagaaagaggaggatttggaggataaaaataattttggggccgagccccctcaccagaacggcgaatgctacccaaatgagaagaacagcgtgaacatggacctggactag

SEQ ID NO: 119509 - DNA, 582 bp, Artificial Sequence
  Description of Artificial Sequence: Synthetic coding sequence
atggattctacactagcagtgcagcaatacatccagcaaaatataagggcagattgtagtaatattgataaaattcttgaaccaccagagggccaggacgagggggtgtggaagtacgagcatctgcgccaattctgcttggagctgaacggtctcgcagtgaagctgcagagtgagtgtcatccagacacgtgtacccagatgaccgcaaccgagcaatggatttttctgtgcgcagctcacaaaacccccaaggagtgcccggccatcgattacacgcgacatactcttgacggtgcagcttgcctgttaaattcaaacaaatactttcccagccgagtgtccatcaaagagtcaagcgtggcgaaattaggctcagtgtgcaggcggatatacaggatcttttcccacgcatacttccaccatcgccagattttcgacgaatatgagaatgaaacattcctgtgtcatcgattcacaaagttcgtcatgaagtataatctcatgtccaaggacaatctgattgtccccattttggaggaggaggttcaaaacagcgtcagtggggaatctgaagcgtag

SEQ ID NO: 119510 - DNA, 306 bp, Artificial Sequence
  Description of Artificial Sequence: Synthetic coding sequence
atggctggacaagccttcagaaaatttctcccactgtttgacagagttctcgtagagcggtcggccgccgagactgtgacaaagggagggatcatgctccccgagaaatcccagggcaaggtgctgcaggccaccgtggtagcggtggggtccggctctaagggcaaaggcggcgaaatacaacctgttagtgtgaaggtgggcgacaaagtgcttctgccggagtacgggggcaccaaggtagttctcgatgacaaagtctgtaaactcaacaattctaaaaaaaaatccgatatctgtaactag

SEQ ID NO: 119511 - DNA, 144 bp, Artificial Sequence
  Description of Artificial Sequence: Synthetic coding sequence
atggggggagagatccagcccgttagtgttaaggtgggagacaaggtgctgctgcccgagtacggaggcaccaaagtggtgctggatgataaggactactttctcttccgagatggggacattctcggaaagtatgtcgattag

SEQ ID NO: 119512 - DNA, 591 bp, Artificial Sequence
  Description of Artificial Sequence: Synthetic coding sequence
atggctgacggacagatgcctttctcctgccactatccatcaagactgcgtcgggatcccttccgggacagtccactgagtagtcgactattggacgatggctttggtatggatccattcccagatgatcttaccgcatcatggccagactgggccctgccaaggctgagtagtgcatggccaggaaccctgagaagtggaatggttcctagagggcccacggccaccgcacgcttcggggtgccagccgaagggagaactcccccaccatttcccggggagccttggaaagtgtgcgtcaacgtgcatagctttaaaccagaggagcttatggtcaaaacaaaagacgggtatgtggaagttagcggcaaacatgaagagaaacagcaggagggcgggatcgtgtccaaaaatttcacaaagaaaatccaacttcctgctgaggtggaccccgtgactgtgtttgccagcttatctcccgaaggcttgctcattatcgaagcgccccaggtacccccttactccacttttggagagagcagtttcaacaatgaacttcctcaggactcccaggaggttacgtgcacatag

SEQ ID NO: 119513 - DNA, 453 bp, Artificial Sequence
  Description of Artificial Sequence: Synthetic coding sequence
atggccaagatcatcctgaggcatcttattgagatacccgtgcgataccaggaggagttcgaagcccgtgggttggaggattgccggctggatcatgccctgtacgctttgcccggacccaccattgtagaccttcggaagacgagggcagcccagtcccctcctgtggatagcgccgcagagacccctcctcgggaaggtaagagtcactttcagatcctcctggacgtggtgcagtttttgcccgaggacatcatcatacagacgtttgaagggtggttgctgattaaggcacagcacggaactcgaatggacgagcacggatttattagcaggtccttcacaaggcagtataagctccccgatggagtggagatcaaggacctgagcgcagtgctgtgtcatgatggaatactggttgtggaggttaaggaccccgtgggaaccaagtag

SEQ ID NO: 119514 - DNA, 513 bp, Artificial Sequence
  Description of Artificial Sequence: Synthetic coding sequence
atgtcacatcgcacaagtagtacttttcgcgccgagcgtagcttccactcatcatcttcgtcatcgtcatcttcgacgtcctcgtctgctagtcgagccctgccggctcaggatccaccaatggaaaaagccctgtctatgttctcggacgactttggaagcttcatgcggccccactcagaacctctggcattcccagccaggccaggaggcgccggcaacattaagacactgggggacgcttacgaatttgccgttgatgtccgcgacttctcacctgaggacatcatagtgaccacgtccaacaatcacattgaagtgcgcgcagaaaagctggccgccgacggcacagtgatgaacacctttgcgcataaatgccagctgccggaagatgttgatcctacaagcgttacgtcagccctacgcgaggacgggagtctcactattcgagctcgcagacacccacataccgaacacgtacagcagaccttcagaaccgaaattaaaatctag

SEQ ID NO: 119515 - DNA, 792 bp, Artificial Sequence
  Description of Artificial Sequence: Synthetic coding sequence
atgtccggttgtgaactttccccccttggactgcgagtcggactgagcgccggtcccgcccatgggcggcggttcccggcgccgagtggcccatggcgaggcctcaacctggcatcccggcaaggtgctggcccaaagccacgcgactctcggccttacaaggcagccgctgttggggcgtggcacgccagacccgaggcatgtgcacacacactgtcctgtcccgcgcttgcccgtttggggagggctcggcgtaggccatggatgtcccataggaccagtagtacttttcgggcagaaagaagtttccattccagctccagttcttcatcttcctcaacatcaagttcagcctctagagccctgcctgcccaagaccctcctatggaaaaggccctttccatgttcagtgacgactttggaagctttatgagaccccacagcgaaccattggcgtttcccgccgcgcatccaacagcgagacccggcggtgccggcaatatcaagaccctgggggatgcttacgaattcgcagtggacgtaagagacttctccccagaggatatcatcgtgactacatccaacaaccacatcgaggtacgggccgaaaagctcgcggccgacggcactgttatgaacacgttcgcacataaatgccagctgccggaggacgtggaccccacaagtgttacaagtgctctgcgggaagatggttcccttaccatccgagctaggcgacatccgcatactgaacatgtccagcagacattccgcacggagatcaaaatttag

SEQ ID NO: 119516 - DNA, 528 bp, Artificial Sequence
  Description of Artificial Sequence: Synthetic coding sequence
atgagtcatcgcacatctagtacattcagggccgagcgttcctttcactccagttcttccagctccagctcgagcacaagtagcagcgccagccgcgccctgccagcccaggacccccccatggagaaggcactgtctatgtttagtgacgatttcggatcttttatgcgtccccattcggagccactggcttttccagcggctcaccctacagcccgccctggaggcgcaggaaatatcaagacactgggcgacgcctatgagttcgccgtggacgttcgcgactttagcccagaagacattattgtgacgaccagtaataatcatatcgaggtcagggcagaaaagctggccgcagacggcactgtgatgaatacatttgcacataagtgtcagttacctgaagatgtggaccccacgagtgtcacaagcgccttacgcgaagacggcagcctcactatcagagctaggcggcaccctcacaccgagcacgtgcagcagacctttcgtactgagatcaagatctag

SEQ ID NO: 119517 - DNA, 207 bp, Artificial Sequence
  Description of Artificial Sequence: Synthetic coding sequence
atgtcccaccgaaccagttctacgtttagagcggaacggtcatttcactcatcatcttctagctcctcttcgtctacctcgagctccgcctcgagagccttgcccgctcaggaccctcctatggaaaaggcactgtctatgtttagtgacgatttcggtagctttatgcggccacattcagagcctctagcattcccaggcaagtag

SEQ ID NO: 119518 - DNA, 1722 bp, Artificial Sequence
  Description of Artificial Sequence: Synthetic coding sequence
atgcttcggctgcctactgtatttagacaaatgcgtcctgtgtcccgcgtgctggccccgcatctgactcgcgcatatgctaaggacgtgaaattcggtgcagacgcccgcgctctaatgctgcaaggcgtggatctgcttgctgacgcagttgccgttacgatgggaccaaaggggcgcactgttatcattgaacagtcttgggggagtccaaaggtcactaaggatggggtgacagtggccaagagtatagacctgaaggataaatataagaacattggcgctaaattagtccaggatgtggccaataacaccaacgaagaggctggcgatggcaccaccaccgctaccgttttagccaggtcgatcgctaaggaaggcttcgagaaaatctcaaaaggcgccaaccctgtggagatccgcaggggcgttatgctagccgtggacgctgtaatagccgagctcaagaagcaatccaaacccgttacaacacccgaagagattgcccaggtagccactataagcgcaaatggagacaaagagatcggcaatattatttcagacgccatgaagaaagttgggcgcaagggggtcataaccgtcaaagacggaaagaccctgaacgacgaactggagattatcgagggcatgaagtttgatcggggctacatctccccgtactttattaacactagcaaaggccagaagtgtgagttccaggacgcctacgtgcttcttagcgagaagaagatttcctccatccagtctattgttcctgcactagaaattgcaaacgcgcatcgaaaaccattggtcataatcgcggaggatgttgatggggaggccttgagcactctggtgcttaatagactaaaagtcgggctccaggtcgtggccgtgaaggccccgggctttggcgacaatcggaagaatcagctgaaagacatggccatcgcaaccgggggagccgtatttggggaggaaggactaactctgaacctagaagacgtccagccgcacgatctgggcaaggtcggcgaggtgatcgtcaccaaggacgacgccatgctgttgaaaggcaaaggagataaagctcagatcgagaaaagaattcaagagattattgagcaactggacgtgacaacaagtgaatacgagaaggaaaagttgaatgagagattagccaaactatccgatggagtagccgtgctcaaggtaggaggtacgtcagatgttgaggtcaatgagaagaaggaccgggtcaccgacgctttgaacgcaaccagagcagcagtcgaagaaggaattgttctgggcggcggatgcgcccttttacgttgtatccccgccttggattccctgacaccagcaaacgaggatcaaaaaatcgggatcgagattatcaaacggactctgaaaattcccgccatgacaattgccaagaatgctggcgtggagggaagcctgatcgtcgaaaaaattatgcaatccagctccgaggtcggctacgacgctatggccggggattttgttaacatggtggaaaaaggcatcattgatcctacaaaggttgtccgaactgctctcctggatgcagcgggggtggcatcgctgctgaccaccgcagaggtggtagtcactgaaatcccaaaggaggaaaaagacccgggcatgggtgctatgggagggatgggcggtgggatgggtggtggcatgttctag

SEQ ID NO: 119519 - DNA, 1722 bp, Artificial Sequence
  Description of Artificial Sequence: Synthetic coding sequence
atgctgcgcctccctacggtgttccggcagatgagacctgtctcacgagttttggcaccgcatctgactagagcctacgccaaagatgtgaaatttggagcagatgccagagcccttatgcttcaaggagtagatctgctcgccgacgctgtcgccgtaaccatgggacccaagggccggacagtaatcatcgagcagagctggggaagccccaaagttaccaaggatggtgtgaccgttgcaaagagcatcgaccttaaggacaagtacaaaaacataggcgctaaattagttcaggacgtcgccaataataccaacgaagaagccggggacggcacgactacagccactgtgttagctaggtccattgcaaaagaagggtttgagaagatctccaaaggagctaatcctgttgaaatccgaaggggggtgatgttggcagttgacgctgttattgccgagttaaagaagcagagcaaacctgtgacaacacctgaagaaattgctcaagtcgctactatcagcgctaatggagataaagagataggcaacatcatctcagacgctatgaaaaaagttgggagaaagggggtgattactgtgaaagacggcaaaaccctcaatgatgagctggagattatcgaagggatgaagtttgatcgggggtatatctctccatacttcatcaatacttccaagggccagaagtgcgaatttcaagacgcctacgtcctgctgtccgagaagaagataagcagcattcagtctattgtacctgccttggagattgctaatgctcataggaagcctctagttattatcgcagaagacgtcgacggagaagccctctcaactctggtgctgaataggctcaaggtcggactgcaggtggtcgcagtaaaggctcccggattcggtgataataggaagaatcaactgaaagatatggcaatcgccactggaggagccgtttttggggaagagggccttactctgaaccttgaggacgtgcagcctcacgatcttggtaaggtaggcgaagttatagttacaaaggacgacgcgatgctactgaaggggaaaggagataaggcgcagatcgaaaagaggatccaagagattatagagcagttggatgtgacaacctcggaatacgaaaaggagaaactaaatgaacgacttgcaaagctttcagatggagtcgccgtgctcaaagtgggtggaacgagcgatgtggaggtcaacgagaaaaaggatcgtgtgacagatgccttgaacgcgaccagggccgccgtggaggagggaatagtgttaggtggtggatgtgccttgctcaggtgcattcccgctttagattcactgacacctgccaatgaggatcagaagatcggaatagagatcatcaaaaggactctcaagatccctgcgatgacaatagcaaaaaacgcgggagtcgaggggtctctaatcgttgaaaagataatgcagtcttcgtccgaggtgggatacgatgctatggctggcgatttcgtgaatatggtcgagaaagggataatcgacccaacaaaagtcgtgcgtacagctctactggatgcagccggtgtggcctcactgctaactacagccgaagtggtggttactgaaatacccaaggaggaaaaggatcccgggatgggggctatgggtggcatgggcggaggcatgggcggaggaatgttctag

SEQ ID NO: 119520 - DNA, 177 bp, Artificial Sequence
  Description of Artificial Sequence: Synthetic coding sequence
atgctgcgcctgcccactgtgttccgccagatgagaccagtctctcgcgtgttggctccacatctgacgcgggcttatgcgaaggatgtcaagttcggtgcagatgctagagccctgatgctgcagggcgttgacctgttagccgatgcagtcgcggttacgatgggccctaaatag

SEQ ID NO: 119521 - DNA, 285 bp, Artificial Sequence
  Description of Artificial Sequence: Synthetic coding sequence
atgcttcggctgccaactgtgtttcgtcagatgcggcctgtgagccgggtgctggccccacatcttactagggcctatgctaaggacgtcaagtttggtgccgatgccagggcgcttatgctccaaggggtagacctgcttgccgatgcagtggccgtcacaatgggccctaaaggtagaaccgtgatcattgagcaatcctggggatcacctaaggtgacaaaggacggcgtcactgtagccaagtctattgatttgaaggataagtacaagaacatcggctag

SEQ ID NO: 119522 - DNA, 705 bp, Artificial Sequence
  Description of Artificial Sequence: Synthetic coding sequence
atgcttcggctgcctactgtcttccgccagatgcggccagtctcgcgggtcttagcccctcacctcactcgcgcctacgcaaaggacgtaaagtttggcgcagacgcccgggccctgatgctgcagggtgtcgacctgctggcggatgcggtcgcggttactatggggccaaaagggaggaccgtgatcatcgaacagagttgggggtccccgaaagtgacaaaggacggagtgaccgtggctaagagcatagaccttaaagacaaatataagaatatcggggcaaagctggtgcaggatgtagccaacaacacaaatgaagaggccggggatggcactacaactgcaactgtcctggcaagaagtattgccaaagagggattcgagaaaatcagcaaaggcgcaaaccccgtagagattaggcgaggagtaatgctggccgttgatgccgttatcgccgagctgaagaagcagtcaaagcctgtgacaacacctgaggaaatcgcgcaggtggccaccatttcggccaacggagataaggaaattggcaacattatctctgacgcaatgaagaaggtgggacgaaagggggtgattaccgatggcaagacgcttaatgatgaactggagattatcgaagggatgaaattcgatcgtggatatatttccccttacttcatcaacacatccaagggaaagaactag

SEQ ID NO: 119523 - DNA, 252 bp, Artificial Sequence
  Description of Artificial Sequence: Synthetic coding sequence
atgctgcgtctgcccacggtcttccgtcagatgcggccagtgtcgagagtcctggctccgcacctcaccagagcttacgccaaagacgtcaagtttggcgccgacgcacgagcccttatgcttcagggagttgatctgttggctgacgccgtggctgttactatgggacccaaaggaaggaccgtgataatagaacagagctggggatcacccaaagtcacaaaagacggcgtgaccgtcgctaagtcttag

SEQ ID NO: 119524 - DNA, 666 bp, Artificial Sequence
  Description of Artificial Sequence: Synthetic coding sequence
atgctgaggctgcccactgtcttcagacaaatgaggcctgtgtctcgagtcctggcaccacacctgactagagcctatgcgaaagacgtgaagttcggcgccgacgctagagcgttgatgttgcagggcgtggatctgctggctgatgcagtggccgtgaccatggggccgaaagggcgcactgtgatcattgagcagagttggggaagcccgaaggtgactaaggatggggttacagtggcaaagagtattgacctcaaggataagtacaagaacatcggagcgaagttggtacaagacgtggccaacaataccaacgaggaagccggtgacgggactaccaccgccacggtgctcgctaggagcatagccaaggagggcttcgagaaaatcagcaagggggccaaccctgtggaaatacgaaggggtgttatgctggctgtcgacgctgtgattgccgagttgaagaagcagtccaagcctgtgacgacccctgaggaaattgcccaggtggccacaattagcgccaatggagataaggagatcggcaatatcatctcagacgccatgaaaaaggttggccggaaaggcgtaattacggtcaaagatggtaagactctgaatgacgagctggagatcatcgaggggatgaaatttgataggtag

SEQ ID NO: 119525 - DNA, 738 bp, Artificial Sequence
  Description of Artificial Sequence: Synthetic coding sequence
atgctcgctgttgatgctgtgatagctgaattgaagaaacagtccaagcccgtaactacaccggaagagatcgctcaagtagccacgatctccgctaatggcgacaaagagatcggcaatataatatcagacgcaatgaagaaagttggtcggaagggcgttataacagtcaaggatggcaaaaccctgaatgatgaactggagatcattgagggcatgaaatttgatcgagggtacatttctccatactttataaacacgtcaaaaggtcagaaatgcgagtttcaagatgcctatgtgctgctgtccgaaaagaaaatcagctccatccagagcattgtgcccgctctggagattgccaacgctcaccgcaagcctcttgttatcattgccgaagatgtcgatggcgaagccctgtcaaccctcgtgttgaataggctgaaggttgggttacaagttgtcgccgttaaggcccctgggttcggcgataatcgaaagaatcaactcaaagacatggccatcgctaccggaggggcagtatttggggaagaaggcctgaccttgaatctggaggatgtgcagccccatgatctcggtaaagtgggtgaggtgatagtcaccaaggacgatgccatgcttttaaaaggcaagggggataaagcccaaatcgagaagagaatccaggaaatcattgagcagcttgacgtgaccaccagtgaatatgagaaggaaaattag

SEQ ID NO: 119526 - DNA, 477 bp, Artificial Sequence
  Description of Artificial Sequence: Synthetic coding sequence
atgctgcgactgcctaccgtgtttcggcagatgcggccagtcagccgtgtgctggcccctcatctgactcgcgcatatgccaaggatgtcaaatttggcgcagacgcaagggccttgatgcttcagggagtagatcttttggcagacgctgtggccgtaactatggggcccaaaggacgtactgtgatcatcgagcagtcctggggttcccccaaagtgacaaaggacggggtgacggtggcaaaatccattgacctgaaagacaagtacaaaaatataggtgccaagctggttcaagatgtggcaaacaacaccaatgaagaggcaggggatggaactactaccgccaccgtgcttgcccggtcaatcgcgaaggaaggctttgagaaaatatctaagggagccaacccagtagagattcggagaggtcggaacgtttgttgccatcattctgttcttaacttttctgtcttatag

SEQ ID NO: 119527 - DNA, 2061 bp, Artificial Sequence
  Description of Artificial Sequence: Synthetic coding sequence
atgctggcggtgccagagatgggtttgcagggcctgtacatcgggagcagtccggaacgatctccagtgccatctccccccggaagcccgaggacacaggagagttgcggcattgcgcccctgacgccgagccaaagccccaagccagaggtgagggccccacagcaagcgagtttttccgttgtggtggcgattgattttggcactaccagctccgggtatgcattttctttcgcgagtgatcccgaggccatacacatgatgcgaaaatgggaaggaggcgacccaggcgtggctcaccagaagacaccaacttgtctgctgctaactccagagggtgcattccatagttttggttatactgcccgcgactattatcacgacctagacccagaagaagccagggactggctgtatttcgagaagtttaagatgaagatccattccgccacggatctgacccttaagactcagctggaagctgtcaatggaaaaactatgcctgctctggaggtgttcgcacatgctctgagattcttccgggagcatgctttacaagaactgagggaacagtccccttctctccctgagaaggacacagtgcggtgggttcttaccgtgccagcaatatggaaacagcctgcaaagcagtttatgcgcgaggctgcgtacctggccggattggtctcacgcgaaaacgccgagcagctgctcatcgctttggaacctgaggccgctagtgtctattgcagaaaactgaggttacaccagctattggacctgtcggggcgtgctcccggtggagggcgtctcggagaaagacggagcatcgatagttcatttcggcaagcccgggagcagttaaggcggagtcgccacagtcgcacttttctcgtggaatctggcgtgggagaactttgggctgagatgcaggccggcgacaggtatgtggttgccgattgtggaggcggaactgtggacctgaccgtccaccagctggagcagccgcatgggacactgaaggaactatacaaagcaagcgggggtccgtacggagccgttggcgtcgaccttgccttcgaacagctgctgtgtaggatattcggtgaagatttcatagctaccttcaaaaggcagagacctgcagcgtgggttgaccttaccattgctttcgaggctagaaaaaggactgccgggccccaccgcgcaggcgcgctgaatatttccctgccctttagtttcatcgatttttacaggaaacagagaggccataatgtcgagacagccttacgaaggtcgtcagtgaatttcgtgaagtggtcatcccaggggatgttacggatgagctgcgaggctatgaatgaactgttccaacccactgtgtcgggtatcattcagcatatcgaagccctccttgccaggcccgaggtgcaaggcgttaaattactgtttttagttgggggttttgccgagagtgccgtcctgcaacacgctgtgcaggcagcattgggggccagagggcttcgggtcgtcgtgccacacgatgttggcctgaccatcttaaagggagctgtgctgttcggccaggcacccggcgttgtgagagtgcgcaggtccccgctcacatacggggttggagtgctgaaccgattcgtcccaggacgccacccacctgaaaaacttctggttagggatggcagacgatggtgtactgacgttttcgaacgattcgtggccgctgagcagagcgttgcactcggggaggaggtgcgccggagttactgcccagctagaccgggccagcgccgtgtgctaatcaacctttactgctgtgccgcagaagacgcccgttttatcaccgatcccggggtcagaaagtgcggggctctgagcttagaactggagcccgccgattgtgggcaggatactgcaggagcccctccaggaaggcgtgagatacgtgccgccatgcagtttggggacacagagattaaagtgaccgctgtggatgtgtcaacgaatcgctccgttcgggcttcaatcgatttcctttcaaactag

SEQ ID NO: 119528 - DNA, 1803 bp, Artificial Sequence
  Description of Artificial Sequence: Synthetic coding sequence
atgatgcgcaagtgggagggcggagatcctggggtcgcacatcaaaagacgcctacctgtctgctgttgactcccgaaggagccttccactcctttgggtacacagctagggactactaccatgacttggatccggaggaggcccgggactggctctatttcgaaaaattcaaaatgaagatccatagtgcgaccgatcttacattgaagacacagctggaagccgtaaatggtaaaacaatgcctgccctcgaagtatttgcccacgctctacgcttcttccgggagcatgcactgcaggagctgagggagcagagccccagcctgccagagaaggacacagttcgctgggtgctgactgtaccagctatctggaaacaacctgcaaagcaattcatgcgggaggccgcgtatctggccggacttgtatctagggagaacgctgagcagctcctgattgccctggaaccagaggcggcttcggtatactgtcgcaagctgcgcttacatcagctgcttgatctatccggaagggccccaggcggcggacgcctgggagaacgaagaagcatagattcatcattccggcaagcccgtgaacagctgcgccggtcaaggcacagcagaacttttctggtggaatccggtgtcggtgaattatgggctgagatgcaggccggagatagatatgtcgtggcagactgcggtggcggcactgtcgacctgacagttcatcagctcgagcagccgcatggaactctaaaagagttatataaggcaagcggcggcccatatggcgcagtgggcgtggacctcgctttcgagcagctgctgtgtagaatctttggcgaggatttcatcgcaacgttcaagagacaaaggcctgcagcttgggtggaccttactattgctttcgaggcacgtaaacgcacagccgggccgcatagagccggtgccctcaacatcagtcttccttttagtttcatcgacttctacagaaagcagagggggcacaacgtggagaccgcactgcggaggagctccgtaaatttcgtcaagtggtccagccaagggatgttaagaatgagttgcgaagccatgaatgagctattccaaccaaccgtctccggtatcatccagcacatcgaggctctattggctaggcctgaggtccagggggtgaagctgctgttcctggtgggggggttcgccgagtctgcagtgttacagcacgccgtccaggccgcgctcggtgcccggggtcttcgagtcgtggtgccccacgacgtggggttgacaatcctgaaaggagctgtgctattcgggcaagcacctggcgtggtacgcgtgaggcgatccccactcacttatggtgtgggtgttctgaatcgctttgtgcctggccggcatccaccagagaagctgctggtacgggacgggcgcaggtggtgtacagatgtattcgagcgctttgtggctgccgaacagtccgtggctctcggggaagaggtgagaagatcttactgccctgctagacctggacagagacgcgtgctgatcaacttgtattgttgtgctgctgaagatgctcggtttatcactgatcctggcgtgcgtaaatgcggagctctgagtctggagttagagccggctgattgtggccaggacaccgccggtgctccgccggggagacgtgaaatacgagccgcaatgcagtttggcgatactgagattaaagtcacagccgtggatgtcagcactaacagatccgttcgcgctagcattgacttcctgtccaactag

SEQ ID NO: 119529 - DNA, 1563 bp, Artificial Sequence
  Description of Artificial Sequence: Synthetic coding sequence
atgcctgcgttggaggtcttcgcccacgctctcaggtttttcagagagcacgccctgcaggagttacgggaacagagcccaagtctacccgaaaaggacacggttaggtgggtgctgacagtccctgctatttggaaacaacccgccaagcagttcatgagagaagccgcttacctagccgggcttgtgtcacgggagaacgccgagcagctgctcatcgcactggaacccgaggccgcatctgtttactgcaggaagcttagattacatcagctgctggacctttcaggtcgcgcacccggagggggaaggttgggggagagacgcagtatcgattcaagtttccgccaggctcgggaacagctgcgtaggagccgtcacagtcggacctttctagttgagtccggggtcggcgagctgtgggccgaaatgcaggcaggggacagatacgttgtcgccgattgtggggggggcacggtggatctgaccgttcaccagctggaacagccccacgggaccctgaaggaactatacaaagctagtggagggccatatggcgccgtcggcgtcgatctagccttcgagcagctcctatgcaggatttttggtgaagatttcatagcaactttcaaaagacagcgacctgcagcctgggtggatttgacaattgccttcgaggccagaaagcggaccgctggtccacaccgagcaggggccctcaatatcagtctgcctttcagcttcatcgacttttatcggaagcagcgcggacacaacgtggaaactgcactcagaagatcatccgtgaacttcgtcaagtggtcctcacagggcatgcttaggatgtcctgtgaagctatgaacgagctgtttcagcccacggtgagcggcataatacagcacattgaagcgcttctggcacgccctgaagtccaaggcgtcaagctgctctttctggtggggggcttcgccgaatctgcagtacttcagcatgcagtgcaggccgctttgggggcacgtggccttagggtggtggtgccacatgacgtcgggctgaccatcctgaagggggctgtgctgttcggacaggcacccggagtggtcagagtgcgacggtcacccctgacctacggagtgggcgtgcttaatcgcttcgtgcccggccgccacccccccgaaaaactccttgtccgggatgggagacggtggtgtaccgatgtgttcgaaagattcgttgctgccgagcagtctgtggcccttggtgaggaagtgagaagaagttactgccccgcccggcccggacagcgccgcgtgctgataaatttgtattgttgcgccgctgaagacgcccggtttatcacagacccaggcgtcagaaaatgcggagccctgtcactggaactcgagccagccgactgcgggcaagatactgcgggggctccacctggacggagagaaatccgtgcagcaatgcagttcggagacacagaaatcaaggttacagccgtcgacgtgagcactaatcgcagtgtgcgggctagtatcgatttcctctctaattag

SEQ ID NO: 119530 - DNA, 2028 bp, Artificial Sequence
  Description of Artificial Sequence: Synthetic coding sequence
atggcggacaaggaggctggcggctcagacggaccgagggaaaccgccccgacctcagcctattccagccctgcgaggtctctgggggacaccggtattacacccctgagcccttcccacatcgtgaacgacacagatagcaatgttagcgagcagcagagtttcctggtggtcgtggctgtggatttcggaactacaagcagcggctacgcatatagctttaccaaggaacccgagtgcatccatgtaatgaggagatgggaaggcggggaccccggagtttcgaatcagaagaccccgactaccattctcttgacccctgaaaggaagttccattcttttggctatgcagcaagagatttctatcacgatctggaccctaacgaagcgaaacagtggctctatctcgaaaagtttaagatgaaactgcatacgacaggcgatctcacaatggatacggatctcaccgcggctaacggaaagaaggtgaaagccttagaaatctttgcctacgcgctacagtatttcaaagaacaagctctcaaagaactgagcgatcaagccggtagtgaattcgaaaattcagatgtgagatgggtgattacagtgcccgccatctggaaacaacctgccaagcaattcatgcgtcaggccgcctatcaggcaggtctcgctagtcccgaaaattcagaacagctgatcatagcgctggagccagaggccgctagcatctattgtcgcaaactgcgcctacaccagatgatcgaactgtctagcaaggctgctgtcaacggttactccggctccgacaccgtgggagccggatttactcaggccaaggaacatattcggagaaatcgtcagtctaggacttttctggtagagaatgtgatcggcgagatctggtcagaactggaagagggcgataaatacgtcgtcgtcgatagtgggggcggtacagtcgacctaactgtgcatcagatccggctacccgagggccatcttaaagagttatacaaggcaaccgggggcccctatggctcactgggcgtggattatgaattcgaaaaactgttatataagattttcggggaggacttcatcgagcaattcaaaatcaagcgaccagctgcatgggtggatctgatgatcgccttcgagagcaggaagagagctgccgctcctgatcggacaaatcccctaaacattacacttcccttttcattcattgactactataaaaaatttcgaggtcacagcgttgaacatgcccttcggaaaagcaatgtggatttcgtgaaatggagttcccaggggatgttacggatgtccccggacgccatgaatgcactgtttaagcccacaatagatagcattatcgagcacctgcgggacctgttccaaaaacccgaggtgtctactgttaaattcctattcctggtaggaggttttgccgaggctccactgctacagcaggctgtacaggccgccttcggggaccagtgccgcatcatcatcccacaagacgtcggacttaccatactgaagggagcagtgctctttggactggatcccgcagtcatcaaagtgagaaggtctcctctgacctatggggtaggtgtgctgaacaggtatgtggaaggcaagcatccccccgagaaattactagtgaaagacggcaccaggtggtgcacagatgttttcgataaattcatctctgctgatcagtcagttgctcttggagaattggtgaagcggtcctacactcccgcaaagccatctcagctcgtgattgtcattaatatatattccagcgaacacgataatgtgagcttcattacagacccaggcgtgaagaagtgcgggacgctccggctagatctaactgggacctcaggcaccgctgtacctgctcgtcgcgaaatccagactttaatgcaattcggggatacagagatcaaagctaccgccatcgatatagcaactagcaaatcagtcaaggttgggattgacttcttgaattattag

SEQ ID NO: 119531 - DNA, 819 bp, Artificial Sequence
  Description of Artificial Sequence: Synthetic coding sequence
atgaggagcctcgacttggcgagtcagctgcttaggaatcaaatcgtcacagaccccgacaacctgatggaggacgctgcatgggctaagcactgcgaccagaatctcgtagctagtgacgccccaggcgaggaaggaaccgggatcctgaagtctaaaagaacccaagccgccgatcatcagcccattctcaaaacggtgaaggccagtgatgaggattgccaactgaggatttcggaccgaatccgtgagacaagtgatctggaggattcttgggacgagtcttctggggctggttgtagccagggcacaccatcctattcttccagccactcactgttccgaggagccgtggctccatgccagagctcgcctatggcccggctcggagtgtccggcgagccatctccttgcacctcgaccaaccgctccacccccggagtcgcaagtacgccccagacaccagtcagtagcagccgagccgggttcgtctccggaggagaccgacctcttaccagcgaaccccccccacgttgggctaggcggcggagacggtctgttgctcgtaccatagccgccgagctggccgagaatcgcagacttgccagagagctgtcgaaacgggaggaggagaagctggataggttgatcgctatcggagaggaagcctccgcgcagcaggacactgcgaatgagctccgacgggacgcagtcattgcagtgcggagattggccaccgctgtggaggaggctaccggcgctttccagttgggactcgagaagttactacagagactaatctcaaacacaaagtcttag

SEQ ID NO: 119532 - DNA, 1530 bp, Artificial Sequence
  Description of Artificial Sequence: Synthetic coding sequence
atggctgcaattggagtccacctcggttgtacttcagcctgtgttgccgtttataaagatggaagggccggtgtcgtggccaacgacgccggagatagggtcacacctgcggtggtcgcatacagcgagaacgaagagattgtcggactggcggcaaagcaatcaagaatcagaaatatatctaacactgtcatgaaagtgaaacagatcctgggaagaagttccagcgacccgcaagcccagaagtatattgccgagtcaaaatgcctcgtaatcgagaaaaatgggaagctgcgttacgagatcgataccggcgaagagacgaagttcgttaatcccgaggatgtggcacgcctcatcttctcaaagatgaaagaaacagctcattccgtactgggcagtgacgcaaacgatgttgttatcacggttcctttcgatttcggtgagaagcagaaaaatgcactgggtgaggcagcccgagctgccggctttaacgtgctccggctcattcacgagcccagcgcggccctcctcgcgtacggcattgggcaagattctccgacgggtaagtcaaacattttagtcttcaagctaggaggaacctctctgtccctgtccgtgatggaagttaactctgggatctatcgcgttctgtccaccaatacagatgataatattggcggggctcacttcactgaaaccctcgcccagtacctggcaagcgagtttcaaaggtcatttaagcacgacgtaagaggcaacgcccgtgccatgatgaaactcacaaattcagctgaagttgccaagcactccctctccactctggggagtgccaactgtttcctcgatagcttatacgaaggccaagacttcgattgtaatgtgtcacgagccagatttgagctcttatgctcacctctttttaacaaatgtatcgaagcgatccgggggctactggaccaaaatggcttcaccgctgatgatattaacaaagtagtgctctgcggagggtcatccaggatcccaaagttacagcagctcattaaggatctgtttcccgcagtcgagcttttaaactccatccctccagacgaagtgattcccataggagccgcaattgaagccggaatcctaatcggaaaagaaaatctcctggtcgaggatagcctgatgattgaatgcagcgctcgcgatattctcgtgaaaggcgttgatgagtcaggggccagcaggttcacagtcctgtttccatctgggactccgctgcccgctagacggcaacacacattacaggctccaggaagtataagctctgtatgcctggaactgtatgagtctgacgggaaaaactccgcgaaggaggagacgaagttcgcccaggtagtcctccaagacctagacaaaaaagagaacggccttagggacattctggcggtcctgacaatgaaacgcgatgggagtctccatgttacttgcaccgaccaggagacaggaaagtgcgaagccatttcaatagaaatcgcgtcatag

SEQ ID NO: 119533 - DNA, 432 bp, Artificial Sequence
  Description of Artificial Sequence: Synthetic coding sequence
atggccgccatcggagtccacttgggttgcactagcgcatgcgtggctgtatacaaagacgggcgggcaggggtagtcgccaatgacgccggcgatcgcgtgacgcctgccgtcgtggcctatagtgagaacgaggagattgtcggactggctgctaagcagtcacgcatccgaaacatctctaacaccgtcatgaaagtgaagcaaatcctggggaggcgggtgctttccagagacccacagctgcagcagctgccccagccattccagaggtgttcctgctctcttagcgaacagccacatgggcagacagggtgtgtgcggggagcccagcctctgcaccagcaccagcctcagcatagctggggctctctgcacacagcagattcatccctcttgttcgaatcctggttttgtttctggtggggctag

SEQ ID NO: 119534 - DNA, 387 bp, Artificial Sequence
  Description of Artificial Sequence: Synthetic coding sequence
taggcttgcgtagcagtttacaaggatggtagggccggcgtcgttgccaacgacgccggcgaccgagtgacacctgccgtggtggcctacagcgaaaatgaagaaatcgtcgggttagccgccaagcagtctagaatcaggaacatctcgaacaccgtgatgaaagttaaacagatactcggtcgatcaagtagcgatcctcaggctcagaagtatatcgccgagagtaaatgtctagtcattgagaaaaatgggaagttgcgatatgagatcgatacaggcgaagagactaaattcgtgaatcccgaggacgtggcccgactgatcttttctaagatgaagggcgcttactctccatggagtcagagtaacagcgaggatgggtag

SEQ ID NO: 119535 - DNA, 1926 bp, Artificial Sequence
  Description of Artificial Sequence: Synthetic coding sequence
atggcaaaagccgctgccatcggaattgatcttggtacaacctatagttgtgtcggggtcttccagcacggaaaagtggaaattatcgctaacgaccagggcaacaggacaaccccctcctacgtggcgttcaccgatactgagcggctcattggagacgcagccaagaaccaggtggcactgaatccccagaatactgtgttcgacgcaaaacgcctgattgggcgaaagtttggcgacccagtggtccagtctgacatgaagcactggccatttcaggtgatcaatgacggcgacaagccaaaggtgcaagtgtcttataaaggcgagaccaaggcattttaccctgaagaaattagctccatggtgttaactaagatgaaggaaatcgcggaggcctaccttggttacccagtcactaatgctgtgattacagttccagcctatttcaacgacagccagaggcaggcgaccaaagacgctggggtgattgccggactgaatgtactgcgaataataaatgaacctacagccgccgccatagcatatggattagataggacggggaagggagaaaggaacgttttgattttcgacttaggaggagggactttcgatgttagcatccttaccattgatgacggtatctttgaggtgaaggccaccgccggagacacccatttgggcggtgaggattttgacaatcggttggttaaccacttcgtggaggaattcaaaaggaaacacaagaaggatatctcccaaaataaaagggcggtaaggcggctgaggaccgcgtgtgagcgagccaaacggaccctctctagttccacgcaggcgtcacttgagatcgactctctttttgagggcatcgacttctatactagtataacccgggcccgatttgaagagctctgctccgacctgttccggtctaccctagagcctgtggaaaaggccttgcgcgacgctaaactagacaaggcccaaatacacgatctggtcttggtcggtgggagtacaagaattcccaaggtgcagaagcttcttcaagatttctttaacggacgtgacctgaacaagagtattaatcccgacgaagcagtcgcatacggtgccgccgttcaggcagctatactgatgggcgataagtcagaaaacgtgcaggacttgttactcctggacgtggctcccctcagtcttggacttgaaaccgccggaggcgtgatgactgcgctcattaagcgtaacagtacaatccctactaagcagactcagatattcacaacctattcggataaccagcccggtgtactgattcaggtctatgagggcgaacgggcgatgaccaaagacaacaatcttctggggcgatttgagctttccggtatacccccagccccacggggtgtgccccagattgaagtgactttcgacatcgatgccaacggtatactcaatgtgacagccactgacaagtctaccggcaaggctaacaagataacgatcactaacgataaggggcgattatctaaggaagagatcgaacgcatggtacaggaagctgagaaatacaaggcagaggatgaagtgcagagggagcgcgtcagcgctaaaaacgccttggagtcttacgcttttaacatgaaatcagccgtggaggacgagggccttaagggcaaaataagtgaagccgacaagaaaaaggtgctcgacaaatgtcaggaagtgattagctggctggacgctaacactcttgcagaaaaggatgagttcgaacacaaacgaaaagaacttgaacaggtttgcaaccccattatctctgggctctatcagggcgccggaggaccaggcccaggaggatttggtgcccagggtcctaaggggggatccggaagtggcccaactatcgaagaggtcgattag

SEQ ID NO: 119536 - DNA, 1431 bp, Artificial Sequence
  Description of Artificial Sequence: Synthetic coding sequence
atggccaaggctgcagcaatcgggatcgatctcgggacaacctattcttgcgtgggggtgtttcagcacggcaagggggagcgcaacgtgctcatttttgacctcggaggagggacattcgacgtgtccatactcacgatagacgacggcatcttcgaagtcaaggccacagccggagatacccacttgggtggtgaggactttgataataggctcgtgaatcatttcgtggaagaattcaagagaaagcacaagaaggatataagtcagaacaaaagggccgttcggcgcttacgtactgcgtgtgaacgagccaagaggacactgagcagctccacacaggcaagcctagaaattgatagcttattcgaaggcatcgatttctatacctcgattactagggcccgtttcgaggaactgtgcagcgacctctttaggtctacacttgagcctgtagagaaggctcttagggacgccaaactggacaaagctcagatacatgacctggttctggtaggtggatctactcggatccctaaggttcaaaaactgttgcaagactttttcaatgggcgcgacctaaataagtctattaatcctgacgaggcagtagcgtacggtgcggcggttcaagcggccatactgatgggggataagagcgagaatgtgcaagatctcttgttgctggacgttgcgcccttgtcgcttgggctagaaactgccgggggagttatgactgctctgattaaacggaattccactattcctacgaagcagactcagatcttcactacttacagcgataaccagccgggggtgctcatccaggtatatgagggggagcgggccatgactaaggataacaatctgctgggtagatttgagttgtccgggattccaccagctcctcggggcgtgccacagatcgaggttacgtttgatatcgacgctaacgggatcctcaatgtgacagcgacagataaatctactggtaaggccaacaaaattactatcacaaatgataagggtcgcctcagcaaagaagaaatcgagagaatggttcaggaagctgaaaaatataaggcggaggatgaagtccagcgtgaaagagtatctgccaagaacgcgctcgaatcctacgccttcaatatgaaatctgctgtcgaggacgaaggcctgaagggaaaaatttccgaggcagacaaaaagaaggtgcttgataagtgccaagaagtcatatcatggctggatgccaatacactggcggaaaaagatgagttcgagcacaagagaaaagagctggagcaggtgtgcaaccccatcatttcaggcttataccagggcgctggaggtccaggcccaggggggttcggggcgcaaggccctaagggcggatcaggctcaggccccactattgaagaggtggactag

SEQ ID NO: 119537 - DNA, 1431 bp, Artificial Sequence
  Description of Artificial Sequence: Synthetic coding sequence
atggccaaagccgcggctataggaattgacctgggtaccacttacagctgcgtgggcgtgttccagcacgggaaaggggagcggaacgttctcattttcgacttaggcggcgggacattcgatgtcagcattctcaccattgacgatgggatcttcgaggtgaaggcgaccgcgggagatacacacctgggaggagaagactttgacaataggctcgtgaaccacttcgtggaagaatttaaaagaaagcacaagaaagacataagtcagaataagcgagcagtgcgtcgcctgcggacagcatgcgagagagccaaaagaaccctgagttccagtactcaagcttccctggagattgatagcttatttgaaggaattgatttctacacctctatcacgagggctagatttgaagaactctgtagcgacctgtttcgttccactttggagcctgtggagaaggccctgagagacgccaagctggacaaggcccagatccacgacctagtgttagtcggaggcagcacccggataccaaaggtccagaagctgctccaagattttttcaatggtagggatctgaacaagagcataaaccctgatgaagccgtcgcctatggtgccgcggtccaggccgccatattgatgggcgacaaatcagagaacgttcaggatctgctacttctagatgtggccccactctccttaggactggaaacggctggtggagtcatgaccgcacttattaaacgtaactcaacgatccctactaagcaaacacagatttttaccacatattctgataatcaacctggtgttctcatacaagtctacgaaggcgaacgggcgatgacaaaagataataatcttctgggtcgcttcgagctttcaggcattcctccagcccctagaggagtgcctcagattgaagttacttttgacattgacgccaacggtattttgaatgtgacagccaccgataagtccacaggaaaagcaaataaaatcacaattaccaacgacaaagggcgcctcagcaaagaggaaattgagagaatggtgcaggaggcagagaagtataaggcagaagatgaggtccaacgggaacgcgtgagtgcgaaaaacgccctggagagttatgcattcaacatgaagtccgctgtcgaggacgagggtttaaaggggaaaatttctgaggctgacaagaagaaagtcctcgataagtgccaggaagtgatcagctggctggatgctaacactctggcagagaaagatgaatttgagcacaaacggaaggagctggagcaggtctgtaatcccatcattagtggattgtaccagggcgccggtggtcctggccctggcggatttggagcacagggacccaaaggagggtcagggagtggacccacaatagaagaggttgactag

SEQ ID NO: 119538 - DNA, 1926 bp, Artificial Sequence
  Description of Artificial Sequence: Synthetic coding sequence
atggcaaaagccgccgccattggtattgacctgggtaccacatacagctgcgtcggagtttttcagcatggtaaggtcgaaatcatcgccaacgaccaaggtaaccgtacaactccttcttatgtggcctttacagatacagaacggctgatcggagatgcagccaagaaccaggttgccctgaacccccaaaataccgtcttcgatgccaaaagactcatcggtcggaaatttggcgaccccgtagttcagagcgatatgaaacattggcctttccaggtgattaacgacggcgataaacctaaggtccaagtgtcatataagggggatacaaaagccttttatcctgaagaaatcagtagcatggtgcttacaaaaatgaaagaaatagctgaggcttacttgggctatcctgtaaccaatgccgtaattacagtcccagcctactttaatgattcacagaggcaagcgaccaaagatgcaggtgtcatcgccgggctcaacgtgttaagaataatcaatgaacccactgcagccgcaattgcctacgggctcgaccggaccgggaagggagaacgcaacgtgctgattttcgatctgggcggcggcaccttcgatgtctcaatcttgactatcgatgatggtatcttcgaagtaaaggccactgctggagatactcatctgggcggggaggacttcgataacaggttagtaaaccactttgtagaagaattcaagaggaagcacaagaaagacatatcacagaacaagagggcagtccgacgcctgcgaacagcttgcgaacgagctaaaaggacgctgtcctcttccacgcaagccagcctggaaattgatagtttattcgaggggattgatttttacacctccattacccgggcacggttcgaagagctttgttcggatctcttccgatccaccttagagccagtagagaaggcgttgcgcgatgcaaagctagataaagcccaaattcacgaccttgtgcttgttggtgggtctacccggatcccaaaagtccagaagctcctgcaggactttttcaatggacgcgatctgaataaatcaatcaaccccgatgaagcagtcgcctatggagccgcggtgcaggctgccattctcatgggagataaatcggagaacgtccaggatctcctgctgcttgatgtggctccactgtcactggggctcgaaaccgccgggggcgtgatgacagcccttataaagcggaattcaactatcccaactaaacagacccagatcttcacaacatattcagacaaccaacccggggtactcatccaggtgtatgagggcgagcgggctatgactaaggacaataatctgctggggaggtttgagctgagcggtattccccccgccccgcgcggggtccctcaaattgaggtaacctttgatatcgacgccaacggaattctaaacgttacggctaccgacaaatctacaggtaaagcgaacaagattacgatcacaaatgataaagggagactgtccaaggaggagatagagaggatggtgcaagaagctgagaagtacaaggcagaagatgaggtacagagggaacgggtatcagcaaagaatgcactggaatcatatgcctttaacatgaaaagcgcggtagaagacgagggcttgaagggcaaaatctcagaagccgacaaaaagaaggttctggacaagtgtcaggaggtgatctcctggctggatgccaacactcttgcagagaaggacgagttcgagcacaaacgaaaggaactcgagcaggtgtgcaaccctattatttcgggcctctaccaaggggccggagggcctgggccaggcgggttcggagcccagggacctaagggtggcagcggttctgggccaaccattgaagaggttgattag

SEQ ID NO: 119539 - DNA, 1431 bp, Artificial Sequence
  Description of Artificial Sequence: Synthetic coding sequence
atggccaaagcagccgccataggcatcgatctgggcaccacatacagctgcgtgggagtgttccagcacggcaagggcgaaaggaacgtgctgatatttgatcttggaggcggcacattcgatgttagcatcctcacaatagacgatggcatattcgaggtgaaggcaaccgcaggggacacacatctaggaggcgaagatttcgataataggctggtgaatcattttgttgaggagttcaaacggaagcataagaaagatatctcgcagaacaagcgggctgtccgccggctgcgaaccgcatgcgagcgggcaaaaagaacactcagtagtagcacacaagctagtctggagatcgactcactgtttgagggcatcgacttttatactagtatcacacgagcaagatttgaggagctctgcagtgatctcttcaggtctacgctggaaccggttgagaaggcgctgcgggacgccaagctggacaaggctcagattcatgatctggtgctcgtcggaggctccacacggatccctaaggttcagaagcttttgcaggatttcttcaatggacgagatctgaataagagcatcaatcccgacgaggccgttgcctacggcgctgccgtgcaggccgctatcctcatgggagacaaatctgaaaacgtacaggatctactgctgctcgatgtcgcccctctctccctaggactggaaaccgccgggggagttatgacagccctgattaagcgcaattcaacgatccccacaaagcagacccaaatatttaccacatattccgacaaccagccgggagttctgattcaggtatacgaaggagagagagcaatgactaaggataacaacctgttggggaggtttgaactgagcggaatacctccagcgcctcgaggcgtgcctcagatcgaggtcacctttgatatagacgccaatggaattcttaatgtcaccgcaactgataagtctactggaaaggcaaataagattaccattaccaacgacaaaggtcgcctcagcaaagaggaaattgaacgaatggtgcaagaggctgagaagtacaaagccgaagacgaggtgcagagagagcgcgtgagtgccaagaatgcgctcgagagctacgctttcaacatgaaaagcgccgtggaggatgaagggctcaaaggtaagatctccgaagccgataagaaaaaggttctggataaatgccaggaggttatctcttggttagatgccaacacactggcagaaaaagacgagttcgagcacaagcgcaaagagttagagcaggtatgcaatcccatcattagcggcctgtatcagggggccggtggtcctggaccaggcggatttggtgcacagggacctaaaggaggaagtggtagtggcccgactatcgaagaggttgattag

SEQ ID NO: 119540 - DNA, 1926 bp, Artificial Sequence
  Description of Artificial Sequence: Synthetic coding sequence
atggccaaggccgcggcgattgggatagacttaggcaccacatactcttgtgtcggggtgttccagcacggaaaggttgagattattgctaatgaccagggcaatcggacaaccccctcttacgttgcttttacggacacagagcgactgattggtgatgccgctaaaaaccaggtggcgctcaaccctcagaatacagtctttgatgccaagcgattaatcggccgcaagtttggggatccggtggttcaaagtgacatgaagcattggccattccaagttattaatgatggggataagcccaaggtgcaggtgtcctacaaaggggagacaaaggccttctacccagaggagatcagctcaatggtgcttactaaaatgaaggagatcgcagaggcttatctgggatatccagttacaaacgcggtcatcactgtacctgcgtattttaacgattcacaaagacaagccacaaaagatgctggtgtcatcgccggactgaatgttctgcgtataattaatgaacccactgctgcagctattgcttacggcctggataggacaggcaagggtgagagaaatgtgctgattttcgatttaggaggcgggaccttcgacgtgagtattctcaccatagacgatggtatctttgaggtcaaagccaccgccggagatactcacctgggtggtgaagacttcgataacaggctggtgaatcatttcgtagaggagttcaaacggaaacataaaaaggatatcagtcagaacaagcgcgcggtgcggcggctgcggactgcttgcgagcgtgccaaaaggacactatccagctccactcaggcaagcctagagattgactcactattcgaggggattgatttttatacatcgattaccagggccaggttcgaagagctgtgtagcgacctctttcgcagtaccttagaacctgtggagaaggcactacgggatgcaaagctcgataaggcccaaatccatgacttggtcctcgttggcgggtctacccgaattccgaaggtgcagaaactactccaggatttttttaacgggcgtgacctgaacaagtcgattaaccccgacgaggccgtggcctatggcgcagcagtgcaggcggctattctgatgggagacaagagtgaaaatgtacaggacttactgcttttagacgtggcccccttgagcttgggactcgaaacggcaggtggggtaatgacagccctgattaagcgaaatagtactattcctacgaaacagacccagatctttaccacctattcggataatcaacccggggtcctgattcaagtatacgagggagaacgagcgatgacaaaggacaataatcttctgggtcgctttgagctgagtggtatcccgcccgcgccgcgcggagtcccacagatagaggtgactttcgatatagacgccaacggaatcctgaatgtgacggccaccgacaagtcaacaggaaaagcgaataaaattactatcactaacgacaaaggaaggctgtctaaggaggaaattgagagaatggtgcaggaggctgaaaagtacaaggccgaagatgaggtgcagcgggaacgagttagtgcgaaaaatgctctggagagttacgccttcaacatgaaatcagccgtggaagacgaaggcctgaaggggaaaatctctgaggctgataaaaaaaaggtgttggataagtgccaggaggtaattagctggctagatgcaaacaccttagccgagaaagacgagttcgagcacaagcgcaaggaactggaacaggtctgcaaccccatcatctcagggctgtaccagggagccggagggccaggtcccggcggatttggggcacagggcccaaagggaggaagtgggtcaggccccacaatcgaggaggtggattag

SEQ ID NO: 119541 - DNA, 1926 bp, Artificial Sequence
  Description of Artificial Sequence: Synthetic coding sequence
atggccaaagctgccgccattggaatcgaccttggaaccacgtacagctgtgttggggtgttccagcacggcaaggtggaaatcattgcaaacgaccagggaaaccgtactaccccctcttacgtggcattcactgacacagagcgtctcattggcgatgcagccaagaatcaagtggccttgaacccgcagaatactgtgtttgacgccaaacggctgatcggacgcaagttcggtgaccccgtggttcagagcgacatgaaacattggccttttcaagtaattaacgacggcgacaagccaaaggtccaggtatcatacaagggtgaaaccaaggcattctatcccgaagaaatatcctctatggtcttgacaaaaatgaaagaaattgcagaggcgtacctaggttatccggttaccaacgcggtcataacagtgcctgcatacttcaatgactctcagcgtcaagcaacaaaagatgctggcgtcatcgctgggttaaacgtgctcaggattatcaacgaacctaccgctgcagctattgcttatggactggatcggactggaaagggagagcgaaacgtactgatctttgatttagggggtggtacttttgacgtgagcattctgacgatcgatgacggaatatttgaggtgaaagccacagctggagacacacacttgggcggtgaggacttcgataatcggctcgtgaatcacttcgtcgaggaattcaaaagaaaacacaagaaagacattagtcaaaacaaacgcgctgtgcgtcgcttgcgtactgcctgcgagagggcaaaacgcacactgtcaagtagcacacaggcatctttagagatcgacagcctgtttgagggcatagatttttatacttcaatcactcgagcgcggtttgaggagctgtgttcagaccttttccggagcacgctggagcctgttgagaaggctctccgcgatgcaaaactggacaaggcacaaatccacgatctggtcctcgtgggcggctctactaggatccctaaagtgcagaagttgctgcaggatttctttaatgggcgagatctgaacaaatccataaaccccgacgaggcagtcgcctacggagcagccgtgcaggctgcaatcttaatgggggacaaatctgagaacgtgcaggacctcctgttgttagatgtcgcaccattaagccttggcctcgaaacagcggggggtgttatgaccgcacttataaaaagaaactccacgatccctaccaagcagacccagattttcactacatactccgataaccagccaggagtcctcatccaagtctatgaaggcgagagagccatgactaaggacaataatctgctcggcaggtttgagctttctggcattccaccggcgccccgcggcgtgccacagatcgaggtgacattcgatatcgacgcaaacgggatcctcaacgttacagccactgataagtcaacagggaaagccaacaaaattaccattactaacgataaagggagactgagcaaggaggaaattgagaggatggtgcaagaggccgaaaagtataaagccgaggacgaggtgcaacgggaaagagtcagcgctaaaaatgccctcgaatcctacgcattcaatatgaaatcagccgttgaggacgagggcctgaaaggaaagatcagtgaggctgacaaaaagaaagttctcgacaaatgccaggaagtcataagctggctggacgcaaacactttggcagaaaaagacgagtttgaacacaaaagaaaggagctggaacaggtttgcaatcctattatctccggactgtaccagggagcaggaggaccgggacctggaggctttggggctcaagggccaaaaggaggttctgggagcgggcccaccatcgaagaggtcgactag

SEQ ID NO: 119542 - DNA, 699 bp, Artificial Sequence
  Description of Artificial Sequence: Synthetic coding sequence
atggctaaggctgccgcgatcggcatcgatcttggcacaacttattcatgtgtgggagtgtttcagcatgggaaagttgagatcattgcaaatgatcaaggcaatagaaccacccccagctatgttgcgttcaccgatactgagcggcttatcggagatgcaggagtgatcgccgggctgaacgtcctgcgcattattaatgaacccaccgccgccgccatcgcgtatggactagatcggacaggtaaaggcgagaggaatgtcttaatcttcgacttaggaggcgggacatttgatgtaagtattctcaccatcgatgacggaatattcgaggtcaaagcgactgccggcgacactcaccttggtggcgaagacttcgataatcggttagtgaaccattttgttgaggagtttaaacggaaacacaaaaaggacatctcccagaacaaaagagcggttagaagactaagaaccgcctgcgaacgggctaaaagaacgctgtcatcatcaacccaggcgtctctcgagatcgattccctattcgagggcatagacttctacacctccatcacccgtgcgcgcttcgaagaactgtgttctgacttgttccgaagcactctggaacctgtcgaaaaggcaccaccagcttccccgcgctgcaggtcctgttgcagaacctcctccacaggggccacttag

SEQ ID NO: 119543 - DNA, 1926 bp, Artificial Sequence
  Description of Artificial Sequence: Synthetic coding sequence
atggctaaagcagccgccatcgggattgatctcggcaccacatattcttgtgtgggcgttttccagcacgggaaggtggagatcatcgcaaatgaccaagggaaccggactacaccaagctatgtggcctttactgatacagaacggttgatcggggacgcggcgaagaaccaggttgcccttaacccacagaacactgtgttcgacgcaaagcgtttaattgggagaaagttcggagatcccgtagtgcagtctgacatgaaacactggcccttccaggtgatcaacgatggcgacaagccaaaggtacaggtcagctacaagggtgagacaaaggccttctaccccgaagaaattagtagcatggtgctgactaaaatgaaagaaatagctgaggcctatctcgggtaccctgtcactaacgcggtgattaccgtacccgcttactttaatgactcccagaggcaagcaacaaaggatgccggtgtcatcgccgggctaaatgtcctgaggattatcaacgaacctaccgccgctgctatagcgtacgggttggaccgtaccggaaagggggaacgtaacgtccttatctttgacctcggcggcggaacatttgatgtgtccattctaacaatcgacgatggcatcttcgaggttaaggcaacagcaggagatacccatctgggcggagaggatttcgataaccggctcgttaatcacttcgtggaggagttcaagcggaaacataaaaaagacatttctcaaaacaaaagagccgtaagaagacttagaaccgcatgcgaacgggctaagcggactttaagctcttcaactcaggcttccctggaaattgatagccttttcgagggtatcgatttttacacgagcattactcgagccaggttcgaggagctttgcagcgacttgtttagatccacactggagccggtcgaaaaggccctgagagacgcaaagttagataaggctcagattcacgacctggtcctggtgggcggctcaactcggatacctaaagtccagaaactcctccaagacttctttaacggtagggatctgaataaatctattaaccctgacgaggcggtcgcttatggagcagcagtgcaggccgccatcctgatgggcgacaagtctgagaacgtgcaggacctgctgctattggatgtggcccccctgtccttgggcctggagactgccgggggtgtcatgaccgctcttatcaagagaaattccacaatccccaccaagcagacccagattttcaccacgtactcagataaccaaccaggagtgctgatacaggtgtacgaaggggagagagcaatgacgaaggataataacctcttaggcagatttgaacttagcgggatcccccccgccccgagaggggtgccccagatcgaggtgacatttgatatagacgccaatgggatcctaaatgtcactgctaccgataagtcgactggcaaagcaaacaagataacaatcactaacgacaaggggcgcctgtctaaagaggagattgaaaggatggtgcaagaagccgaaaagtataaggctgaggacgaggtgcaacgagagcgggtcagcgcaaagaatgcattggaaagctatgccttcaatatgaaaagcgctgttgaggacgagggtctgaaaggaaaaatttccgaagcagataagaaaaaggtcctcgataaatgccaggaggtgattagctggctggatgccaacactctcgcagaaaaggatgaatttgagcataagagaaaggagctggagcaagtatgcaatcctatcatttcagggttgtatcaaggagccggaggccctggccccggcggttttggcgcccagggtcctaagggcggaagcggatctggccccaccatcgaagaggtcgattag

SEQ ID NO: 119544 - DNA, 1431 bp, Artificial Sequence
  Description of Artificial Sequence: Synthetic coding sequence
atggctaaggccgccgctattggaattgacctcggtacaacctatagctgcgtgggcgtttttcagcatggcaagggggaacgtaatgtgcttatcttcgatcttggtggtgggactttcgacgtgtccattctgactatcgacgatggtatcttcgaagttaaggctacagcgggcgacactcatcttggaggcgaagactttgacaacagactggttaaccacttcgtagaagaattcaaaagaaagcacaaaaaagacatctcccagaacaaacgcgcagtcaggcgactacgtacagcctgtgaaagagccaaacgaacactctcctcctcaacgcaggcaagcttggagattgattccctgttcgaggggatcgatttttacacctccataactcgtgctagattcgaggaattatgttccgacctgttccggtcaacactcgagccggtagagaaagccctccgggacgcaaaattagacaaggcccaaatccatgacttagtgctggtcggaggcagtacgcgtatccccaaagtgcaaaagctgctccaggacttttttaacggccgagatcttaataaaagcatcaatcctgacgaggcagtggcctatggcgctgctgtccaggctgctattttgatgggagacaagagtgagaacgtgcaggacctacttcttctagatgttgcaccgctcagcctcggactcgaaacggccggaggtgtgatgaccgcccttatcaaaaggaactcaaccattcccaccaagcagacccaaatcttcaccacttatagcgacaaccagcctggcgtcttaatccaggtgtatgaaggcgaacgggccatgaccaaggataacaacctcctgggccggttcgaactgtccggtatcccccccgcgcctcggggggtgccccagatagaagtcacgtttgatattgacgccaacggaatattgaatgtcacagccactgacaaaagtacaggaaaagcaaacaagattaccattacgaatgacaaaggcaggctgagcaaagaagagatcgagaggatggttcaggaagccgagaagtacaaggcagaggatgaggtgcaacgggaaagggtatctgccaaaaacgccctcgagtcctatgctttcaacatgaagtccgccgtggaggacgagggtctgaaggggaaaatcagtgaggcagacaagaaaaaagtgctcgacaaatgccaagaggtcatatcctggctcgacgccaatactctggctgagaaggatgagttcgagcacaaaaggaaagagctggaacaggtctgcaaccctattatttccggactgtaccagggcgccggtgggcccggtccaggcggttttggggcccaggggccaaagggcggatccggcagcggccccaccattgaagaagttgattag

SEQ ID NO: 119545 - DNA, 1431 bp, Artificial Sequence
  Description of Artificial Sequence: Synthetic coding sequence
atggccaaggctgcagcaattgggattgacttgggaacaacgtattcatgtgtgggggtttttcagcacgggaaaggtgagaggaacgttcttatctttgacctgggcgggggcactttcgacgtgtccatactgacgatcgacgatggcatctttgaagtgaaggccacagctggggatacccatctcggaggggaagattttgacaatcgccttgttaaccacttcgtggaggaattcaagcgcaaacataagaaagacatcagtcaaaacaagcgcgcagtcaggcgactacggactgcctgcgaaagagccaaacggacactctcaagtagtacacaagcatccctcgaaatcgattcactcttcgagggtatcgacttttatacttcaatcactcgcgcccgcttcgaggagctgtgctctgaccttttccgttcaactttggagcctgtggagaaagcactccgggatgctaagctcgacaaggcacagatacatgacctggtcctggtcggagggtccacgcgcatcccgaaggtgcagaaattgctgcaagatttcttcaacggaagggacctcaacaagtctattaaccccgacgaagcagtcgcttacggtgcagccgtccaggccgcaatccttatgggtgataagtccgagaacgtgcaagatctcttactactggacgtcgcacctctctctctgggactggaaacagccgggggcgtgatgaccgccctgataaaacggaactcaacgatccccaccaaacaaacccagatattcaccacttactctgataatcagcctggcgtgttgattcaggtttacgagggagagagagctatgactaaagacaacaatcttctggggcgattcgagctttccggcatcccaccagcccctagaggtgtgccacagatcgaggtcacattcgacatagacgctaacgggatcctaaacgtgaccgctactgacaaaagtaccggaaaggctaacaaaataacaataactaatgataaagggcgtctgtccaaggaggaaatcgagcggatggtgcaggaggccgagaagtacaaagctgaggatgaggtgcagagagagcgagtgagcgctaagaacgccctcgagagctacgctttcaacatgaaaagtgcggttgaggacgagggtctgaagggcaagatatctgaggccgataaaaagaaggtactggataaatgtcaggaggttatcagttggctagacgctaatacactggctgaaaaagatgagtttgaacataagcgcaaggaactggaacaggtgtgtaatcccatcatttcaggcttgtaccagggcgccggcgggcccgggcctggcggcttcggtgcgcaggggccaaagggaggatctggatcaggccccaccatagaggaggtggattag

SEQ ID NO: 119546 - DNA, 1653 bp, Artificial Sequence
  Description of Artificial Sequence: Synthetic coding sequence
atggctaaggcagcagccatcggcatcgatctgggtacaacctatagctgcgtgggagttttccagcacggcaaggtccagattagcagtatggtgctcactaaaatgaaagagattgccgaggcctatttagggtaccctgtgacaaacgccgtcatcaccgtcccagcctatttcaacgacagtcagaggcaggcaactaaggacgccggcgtaatcgcagggctcaatgtcctcagaattataaatgaacccacggcggcagctatcgcctatggcctggatcgcacaggcaaaggcgagaggaatgtattaattttcgatctgggagggggcacattcgatgtgtccatcttaacaatagatgatggtatatttgaagtgaaagctaccgccggcgatacccacctcggcggcgaggattttgacaatcgactggtgaaccactttgtcgaggagtttaaacggaagcacaagaaggacatcagccagaataaacgagctgtgagaaggttgaggacggcctgtgagagagccaaaaggactctctcttcatccacccaagcgtctttagaaattgattctctgtttgaagggattgacttctacacatcaatcacccgggctcgcttcgaagaactgtgttcagacctgtttcgtagcactcttgaacctgtagagaaggcactccgcgatgctaaactggataaggcacagatccatgaccttgtgctggtgggcggatcgaccaggatacccaaggttcagaagctattgcaggacttcttcaacgggagggatcttaataagagcattaaccctgatgaagctgttgcttacggcgccgccgttcaggcagctattctgatgggcgacaagagtgaaaacgtccaagacctgttgctcctcgacgtggctcccctgtctctgggcctggaaaccgcgggcggcgttatgactgccctgatcaaacgtaactcaaccatccccacaaagcagacccagatattcaccacctatagtgataaccagccaggagtgttaattcaggtatatgagggtgaacgggccatgacgaaagacaacaatctgctcgggagattcgaattgtcgggaatccccccagccccaagaggcgtacctcagatcgaggttacctttgacatcgatgccaatggcatccttaacgtgacagcgacagacaagtcaaccgggaaagcgaacaagatcacgataaccaatgacaagggacggcttagtaaggaggaaatcgaacgcatggtgcaggaggccgagaagtacaaggccgaggacgaagtccagcgggagcgagtatccgcaaaaaatgctctcgaaagttatgcatttaatatgaaaagcgccgtggaggacgagggcctgaaaggcaaaattagtgaggcagacaagaaaaaggtgctcgacaagtgccaggaagtgattagttggctcgatgccaacactctcgcggagaaggacgaattcgagcacaaacgtaaagagctggagcaggtgtgcaatccaattatctcagggctgtaccagggagctggggggcccgggcctggagggtttggcgcgcaaggccccaaaggcgggagcgggagtggccctacaatcgaggaggtggactag

SEQ ID NO: 119547 - DNA, 1872 bp, Artificial Sequence
  Description of Artificial Sequence: Synthetic coding sequence
atggcaaaagcagccgcgataggtatcgatctggggacaacctactcatgcgtgggggtatttcagcacgggaaggtggaaatcattgccaacgaccaggggaatcggacaaccccttcctatgtggcattcacggacaccgaacgcttaatcggagacgccgccaagaatcaggtggctttaaatccggtcgtacagtcagacatgaagcactggcccttccaggtaatcaacgatggcgacaagcctaaggtccaggtgagttacaaaggggaaacaaaagctttctaccccgaggaaatctcatcaatggtcctcaccaaaatgaaagagattgccgaggcctatctagggtacccagtgaccaatgctgtgatcaccgtgcccgcctacttcaacgactcacagaggcaggccactaaggatgcgggcgtgattgccggcctgaacgtgctgcggattataaatgagcctacggcggcagccatcgcatacggactggacaggaccggtaagggcgagcgaaatgtgttgatatttgacctgggtggggggacctttgatgtgtcaatcttaactatagacgatggcatatttgaggtgaaggctaccgcaggagatacacatcttggaggggaagacttcgataaccgcctcgtcaaccacttcgttgaggaattcaaacggaaacacaagaaagacatctcccagaacaaacgcgctgttagacgccttcggaccgcgtgcgagagggccaagaggaccttaagcagttcaacccaggcttccctcgagattgactctcttttcgagggcattgatttttataccagcataaccagagcaaggtttgaagagctttgctcagacctcttcaggtccacactggaaccagtagaaaaggccctgcgggacgcaaagttggacaaggcccagattcacgacttagtgctggtgggcggaagcaccaggatccccaaagtgcagaaattactacaggatttttttaacggaagagatctgaacaaatcaatcaatccagacgaggccgtggcctacggtgcagcagtgcaggctgctatcctgatgggcgacaaatccgagaatgtgcaggacttgttgctcctggatgtcgcccctctgagtctgggactggagaccgcaggcggcgtgatgactgctctgataaagaggaactccactattccaacaaagcagacacagatcttcaccacttactctgacaatcagcccggcgtgttgattcaggtctacgagggtgagagggcaatgacaaaggataacaatctgcttggccgctttgagctaagtggcatcccgccagccccccgcggagtccctcaaattgaagtcacgtttgacatagacgctaacggtatcctcaatgtgacagccactgataagtctactgggaaggccaataaaatcaccatcaccaacgataagggccgactttccaaggaggaaatcgagcggatggtccaagaggccgagaagtataaagccgaggatgaggtgcagcgagagcgggtatccgccaaaaacgcgctcgaatcctacgctttcaatatgaagtccgccgtggaggatgagggcctgaagggcaagatatcggaggcggacaagaagaaagtcctggacaaatgccaggaggttatttcttggctcgatgcgaacaccttagccgaaaaagacgagtttgagcacaaacgcaaggagttggagcaggtgtgtaatcccatcatttccgggttgtaccaaggtgccggaggcccagggcctggagggtttggggcccaggggcccaagggagggagcggcagtggcccaaccattgaggaggtcgactag

SEQ ID NO: 119548 - DNA, 1653 bp, Artificial Sequence
  Description of Artificial Sequence: Synthetic coding sequence
atggccaaagccgcggccatcggaattgatctggggacgacctattcctgcgtgggagttttccagcatgggaaggtacagatctcttctatggtactgacaaaaatgaaggaaatcgcagaggcctatctgggttaccccgttaccaatgctgtcattacggttcccgcctatttcaatgacagccagcgacaggcgacaaaggacgccggcgtcatcgcggggctgaacgtcttgcgcatcattaacgagcccacggccgcagccatcgcatacggactcgataggaccggtaagggcgagcgaaatgtcctgatatttgacctggggggaggtacttttgatgtgtcgatcctcactatcgatgatggtatctttgaagtcaaggccacggccggcgatacacacctcggtggggaggatttcgacaatagattggtcaatcactttgtcgaggagttcaagcggaagcataaaaaggatattagccaaaataaaagagcagtgcggaggctgaggacagcctgcgaacgagctaaaagaaccctgagttcaagtactcaagcctcactggaaatcgattctctcttcgaaggaattgacttctatacgagcatcacaagggcacggttcgaggagctgtgcagtgatttgtttcggagtacgctcgagcctgtggagaaggcccttagggacgctaaactcgacaaggcccagattcacgacctagtgcttgtcggaggctccacacgcatccccaaggtgcaaaagttgctccaggatttcttcaatggaagggatctcaataagagcatcaaccccgacgaggctgtggcttatggcgccgctgttcaggccgcgattttaatgggagataagtcagagaatgtgcaggacctgctcctgctagatgtggccccattgagcctaggactggagacagccggaggggtcatgaccgctctgattaagcggaactccaccatccctacaaaacagacacagatctttacgacctactctgacaaccagccaggagtcctcatccaggtctatgagggggaacgagccatgacaaaggataacaatttattaggaagattcgagctgagcgggatcccacctgctcctagaggcgtgccgcagatagaggtgactttcgatatcgatgctaacggcatcctgaatgttaccgcaaccgataaaagtactggtaaggctaacaaaattaccattaccaatgataagggacgcctgtccaaggaggaaattgagagaatggtacaagaagctgaaaagtataaggccgaggatgaggtccagcgtgagagagtgtccgctaagaatgccctggaaagttacgcatttaatatgaagagcgcagtggaggatgagggactgaaaggaaaaatcagcgaggctgacaaaaaaaaggtgctggataaatgtcaggaggtcatttcttggctagatgcaaataccctcgccgagaaagatgaatttgagcacaaaaggaaagaactggaacaggtctgcaacccaataataagtggcctatatcagggcgctggcggtccgggacccgggggctttggggcccaaggtccaaagggcggttctggtagcgggcctaccatcgaggaagttgactag

SEQ ID NO: 119549 - DNA, 1653 bp, Artificial Sequence
  Description of Artificial Sequence: Synthetic coding sequence
atggccaaagctgctgcgattggcatcgacctgggcaccacatacagttgcgtcggggtgtttcaacacgggaaagttcagatctcctctatggtcttgactaaaatgaaagagatcgcagaggcctatctcggctacccagtcactaacgctgtcatcaccgtcccagcctactttaatgattctcagcggcaggctacaaaggatgccggtgtgatcgcaggcttgaatgtgcttcgcatcatcaatgagccaacagcggctgccatcgcttatggattggatcggaccgggaaaggcgagcgtaacgtgcttatttttgatcttgggggtggtacttttgacgtgtctatcctgacaatcgatgacggtatcttcgaggtaaaggctactgccggcgatacccacctcggcggagaggacttcgataacaggctcgttaaccatttcgtcgaagagttcaaaaggaaacacaaaaaggatatttcgcaaaataagcgcgccgtgcgccgcttgagaaccgcgtgtgagagagcgaagcgtactctctccagtagcacacaggcttcactggaaattgattctctgttcgaaggcattgatttctatacatcaatcacccgtgcacggtttgaggagctgtgctctgatctgttccgcagcacgttagaacccgtggagaaagccctgcgagacgcaaaacttgacaaagctcaaattcacgatctggttctcgtgggagggtctacccggatccccaaggtccaaaaactgctgcaggacttttttaatggcagggatttgaacaagtcgatcaacccggatgaagctgtagcttatggcgcggccgtacaggctgcaattctaatgggggacaaatccgaaaacgtgcaagacttgctcctccttgatgtggccccactttcgctggggctggagaccgcaggaggagtcatgaccgccttgattaagagaaactcaaccataccaaccaagcaaacccagatctttacgacctactccgataatcaacccggcgtgctgatacaggtgtacgaaggcgagcgcgccatgacgaaagacaacaacctccttggcaggttcgaacttagcggcataccgcccgccccgcgaggagtaccacagatcgaagtgacattcgatatcgacgccaacggaatcctcaacgtgaccgccactgacaagtccacaggtaaggcaaacaaaattaccataaccaacgacaagggacgcttaagtaaggaggaaatcgaaagaatggtacaggaagctgaaaaatataaggctgaggacgaagtgcagagagagcgggtgtccgctaagaatgctttagagtcctacgcttttaacatgaagtcggctgtcgaggatgagggcttaaagggtaagatctcagaggccgataagaagaaggtgctggataagtgccaggaggtgatctcttggttggatgctaacaccctcgccgagaaagatgagttcgagcataaaaggaaggaacttgagcaagtctgcaacccaatcatttctggtctgtaccagggggcgggaggcccaggtccgggaggttttggcgcacaaggaccaaaaggaggatcaggaagcgggccaacaatcgaagaagtggactag

SEQ ID NO: 119550 - DNA, 1653 bp, Artificial Sequence
  Description of Artificial Sequence: Synthetic coding sequence
atggccaaggcagctgccattgggattgacctgggaactacctattcatgtgtgggtgtgttccagcatggcaaggtgcagatatcctcaatggtgctgacgaagatgaaggagatcgccgaggcctatctcggctatcccgtcactaacgcagttatcaccgttccagcctactttaatgattctcagcgtcaggcaaccaaggatgcaggagttatcgccgggctgaatgttctccgcatcatcaacgagcctaccgctgccgctatcgcatatggtcttgacagaacaggaaaaggagaacgcaacgtcctgattttcgatttgggaggcggaacttttgatgtatctatccttacaatcgacgatggaatcttcgaagtgaaggctactgccggcgatacacaccttggcggcgaagactttgataaccgtcttgtgaaccactttgtcgaagagttcaagaggaaacataaaaaggacatttcccagaataagagagccgttcgtagattgaggacagcatgtgagcgggcgaaacgtaccttaagttcgtcaacgcaggccagtttggaaatcgatagcctgtttgagggaatagacttttacacatctattacacgtgcccggttcgaggagctctgcagcgacctttttaggagtactctggaacctgtggagaaggctctgcgtgacgctaagttggacaaggcccagattcacgatctggtgttggtcggggggagcactaggatccccaaggttcagaaattgctccaggatttcttcaatggcagagatctcaacaagagcattaacccagacgaagccgtggcctacggcgccgccgtgcaggccgccattctcatgggtgataagtcagagaacgtacaggacctgctgttgttggacgtcgcacccctctccctcggattagaaacagctggcggggtaatgactgcactaattaagagaaatagcactatcccaaccaaacagacgcagattttcacaacttattcagataaccagccgggagtactgatccaggtctacgagggagagcgggccatgaccaaagataacaacctcctgggtcgatttgaactatctggcatccctccagcgcctcgcggcgttccccagattgaggtgacatttgatatagatgccaatggcatcctaaatgtgacggccacggataagtccactggcaaggctaataaaattaccatcacaaatgacaaaggtcggctgagtaaggaggagattgagcgcatggtacaggaagcagagaagtataaggcagaggacgaagtgcagcgggagcgagtatctgcaaagaatgcgctcgaatcgtatgcatttaatatgaaatccgccgtcgaggacgaaggcctgaaaggaaagatctcagaggccgataagaaaaaggtgcttgataaatgtcaggaggtgattagctggctagatgccaataccctcgctgagaaagacgagttcgaacataagcgcaaagagctggaacaggtctgcaaccctatcataagcggtctttatcagggcgcgggtggtcccggcccgggtggattcggagcccaggggcccaaaggcggtagtggaagcggacccaccatagaggaggttgattag

SEQ ID NO: 119551 - DNA, 699 bp, Artificial Sequence
  Description of Artificial Sequence: Synthetic coding sequence
atggcaaaggccgctgccattggaatagatctgggtacgacatactcgtgcgtgggcgtgttccagcatggaaaggtggaaattatagccaacgatcaaggcaacagaaccaccccttcttatgtagccttcaccgacaccgaacggttaattggagacgccggcgtaatagctgggctgaatgtcctgaggatcattaacgagcccacagctgccgcaattgcctacggcttagatcggactggaaagggggaacgcaacgtgcttatttttgacctgggaggcggcaccttcgatgtgtcaattcttacgatagatgacggcatcttcgaagtgaaggccaccgctggggatacgcacctaggaggggaagatttcgacaataggctggtcaaccacttcgtcgaggaatttaagcgcaagcataagaaagacatcagtcaaaacaagcgggcagtgaggcgactgcggaccgcttgcgaaagagccaagcgtacgctctccagtagcacacaggctagtctggaaatagacagcctgtttgagggaattgatttttacaccagtatcacccgggcgagattcgaggagctatgcagcgacttgttcagaagcactctggagcctgtcgagaaagcacccccggcaagccctcgctgtcgaagctgttgtcggactagctctaccggtgccacctag

SEQ ID NO: 119552 - DNA, 1653 bp, Artificial Sequence
  Description of Artificial Sequence: Synthetic coding sequence
atggctaaagccgctgccattggcatcgatctgggcacaacctacagctgtgttggcgtattccagcatggtaaagtgcagatctccagcatggtactgaccaagatgaaggaaatcgctgaagcctatctgggataccccgtgactaatgctgtgataacagtccctgcctacttcaatgactcccaaagacaggccacgaaggatgccggggtgatagcagggcttaacgtgctacgaatcataaatgagcccactgccgccgccatcgcgtacggattggaccggactggcaaaggggaacggaatgtgcttatttttgacttgggggggggaaccttcgatgtcagcattcttaccatcgacgatggtattttcgaagtgaaggctaccgcaggcgacacacacctgggcggagaggactttgataatcgacttgtcaatcattttgtcgaggagttcaagaggaagcacaagaaggacattagccaaaataaacgggcggttagacgcctccgaacagcatgtgagagggctaaacgcactctgtctagttcaactcaggccagcctggagattgactcgctttttgagggtatcgacttttacacgtccattactcgggcccgcttcgaggagctttgcagcgatttgttcaggagcaccttggaaccagtggagaaagccttgagagatgccaaactggacaaggcccagattcacgaccttgtgctggttgggggcagtacgcgcatcccaaaagtgcagaagctgctgcaggacttcttcaacggccgcgaccttaataagagcattaatccagacgaggctgtagcctatggcgcagctgtgcaagccgctatactgatgggggataagtcagaaaatgtgcaggatctcttactgcttgatgtagccccactatccctggggctcgaaactgcgggaggtgtgatgaccgctctgatcaaacgcaactctactatcccaaccaaacaaacacagatttttacaacatattcagacaatcagcctggcgttctcatccaggtctatgaaggcgagcgggctatgacaaaggataataacctgctgggccggttcgagctgtctggaattccacctgctcctcgcggagtcccgcagattgaggtgactttcgacatcgatgctaatggaatattgaatgtcacggccacagacaagtccaccggaaaggctaacaaaattacaatcaccaacgacaaaggtagactgagcaaggaggagatcgagcggatggtacaggaagctgaaaagtacaaggctgaggatgaggtgcaacgtgaacgtgttagtgctaagaatgctttggagtcttacgcatttaacatgaaatctgcggttgaagatgagggcttgaaggggaagatcagtgaggctgacaaaaagaaagtactcgacaagtgtcaggaagttattagttggctcgacgctaacacactggccgagaaagacgagtttgaacacaaacggaaggaactggaacaggtgtgcaaccccattattagtgggctgtatcagggcgctggcggacccgggcccggaggtttcggcgcacaggggcccaaaggaggtagcggctctggaccaacaatcgaagaagtggactag

SEQ ID NO: 119553 - DNA, 699 bp, Artificial Sequence
  Description of Artificial Sequence: Synthetic coding sequence
atggccaaggcagccgccatcggcatcgatctcggcacaacctactcgtgtgtgggggttttccaacatggaaaggtggagatcatcgctaatgaccagggcaaccgcacaacacctagttacgtggctttcacagacacagaacgtcttattggcgacgccggagtcattgcaggactgaatgtcctcaggatcataaacgaacctaccgcagctgctatagcgtatggtctggataggactggaaaaggagaaagaaacgtgctgatcttcgacctgggtggtggtacattcgatgtgtccatcctcacgattgacgatgggatcttcgaggtaaaagctacggccggcgacacgcacctgggtggggaagatttcgacaatcggctcgtgaaccactttgtggaggaattcaagagaaagcacaagaaggatatctcacagaataaaagagcggtgagaagattgaggactgcctgtgagcgggccaagagaactctgagtagctccacgcaggccagtctcgagattgattccctcttcgaggggatcgacttttacacctcaattacacgggccagatttgaagaactgtgttctgatctcttcaggagcaccttggagccagtcgagaaagcgccacctgcgagtccaaggtgtcgctcttgttgtcgaacatcaagcaccggagcgacgtag

SEQ ID NO: 119554 - DNA, 699 bp, Artificial Sequence
  Description of Artificial Sequence: Synthetic coding sequence
atggccaaggccgcagccatcggtatcgacctgggcacaacttactcatgtgtgggggtgttccagcacggcaaagtggagattatcgcaaatgaccagggaaatcgcaccaccccttcatatgtagcctttaccgacaccgaaaggttgattggagacgcaggcgtaatcgccgggttgaatgtgcttaggatcatcaatgaacccacagctgcggctattgcctatggactggatcgaaccggaaaaggggaacgcaacgtgctgatcttcgacttagggggtggcacttttgatgtgagcatcctgacaatcgatgacggaattttcgaagtgaaagccacggcgggcgatacgcacctgggcggagaggatttcgataatcggcttgtcaatcatttcgtcgaggaattcaaacggaagcacaagaaggacatctcccagaataaaagagcagtgcggcgattacgaacagcgtgcgagcgggcaaaaaggacgctgagtagtagcacacaggccagcctggaaatagatagtttattcgaaggaatagatttttacacgtcaataacccgtgcaagatttgaggagctctgtagcgacttgtttcgcagtaccctcgaaccagtggaaaaagccccaccagcctctccacggtgtcgttcttgctgccgcacatcttctactggggcgacctag

SEQ ID NO: 119555 - DNA, 699 bp, Artificial Sequence
  Description of Artificial Sequence: Synthetic coding sequence
atggcaaaggctgcagccattgggatcgatctaggcaccacatacagctgcgtgggagtatttcagcacggcaaagtggagatcatcgcaaacgatcaaggcaacaggactactccatcctatgtcgccttcacggacacagagaggttaattggcgatgcgggggtgattgccggcttgaatgtgcttcgcatcattaacgagcctacagccgccgcaattgcctatggactggaccgaaccggcaaaggagagcgcaacgtgctgatcttcgatctcggaggcgggacatttgacgtgagtatcctaaccatcgacgatggcatttttgaggtgaaagcgaccgccggtgacacccatctgggtggggaagatttcgataataggctggtaaaccactttgtagaagaatttaagcggaagcacaagaaggacatctctcaaaacaaaagggcggtacgccgactcagaacggcatgtgagcgggccaagcgaacactcagtagctcaacacaagcttcattggagattgatagtctgttcgagggaattgatttttacacctccattacgagggccagattcgaagaactgtgttccgacctttttcgttcaacacttgagcctgtcgagaaagcgcctcccgcatctcctcgatgtagatcttgttgcagaacaagttcgactggtgctacctag

SEQ ID NO: 119556 - DNA, 1926 bp, Artificial Sequence
  Description of Artificial Sequence: Synthetic coding sequence
atggccaaagcggctgcgatcggcatcgatctggggactacctattcctgcgtaggagtgttccagcacgggaaagtggaaatcatcgcaaatgaccagggaaaccggaccactccttcctacgtggcattcactgacacggaacggctcataggggacgccgccaagaatcaggtagcccttaatccgcagaacactgtgttcgatgcaaagaggctgattggtcgcaagtttggagatccagtagtgcagtccgacatgaaacactggcctttccaagtcattaacgatggagataagcccaaggtacaagtgagttacaagggggaaacgaaagcgttctacccggaagagattagtagcatggtgctgaccaaaatgaaggagatcgccgaagcttatctgggctaccccgttaccaacgcagtcatcaccgtgccagcatacttcaacgatagccagagacaggcaactaaggatgcaggtgtcattgcaggactgaacgtgctgcgcattatcaacgaacctactgccgctgccattgcgtacggactggatcgaacaggaaagggagaacggaacgtgctgatctttgacctgggggggggcacttttgacgtgtctatcctgacaatcgacgatgggatctttgaagtgaaagctactgccggggatactcacctgggtggggaggatttcgacaatcgtctggtcaatcactttgtggaggagtttaagcgtaaacataaaaaggacatatcgcagaacaaacgagccgtgcgcaggctgcgcactgcctgtgaacgcgccaagagaaccctgtctagtagtacacaagccagcttggagattgattcgttatttgagggcattgacttctacacatcaatcacacgtgcgcgatttgaagagctgtgctctgatctctttagatctactctggagccagtagagaaggcacttcgggacgcgaagctggacaaggctcagattcatgacctcgtgctggtgggcggatccacgcgaattccgaaggtgcagaagctattacaggatttttttaacggaagagacctaaacaaatccatcaacccagacgaggccgtggcgtatggtgccgcagttcaagccgccattctgatgggggacaagtccgagaatgtgcaagatcttctactccttgacgtggcccccctgagtctgggccttgaaacggccggcggtgtgatgacagctctgatcaagaggaatagcacgatacccacaaagcagacccaaattttcaccacgtatagtgataaccagccaggcgtgctgatacaggtgtatgaaggcgagagggccatgacgaaggacaacaacctcttagggaggtttgagctgtccggaattccacccgcgccccggggtgtaccccagatagaagtcaccttcgacatagacgccaacgggatccttaacgtgactgctacggataagagcaccggcaaagccaacaagattacgatcactaatgataaggggcggctatccaaggaagagattgagcgtatggttcaagaggccgagaaatataaagctgaggatgaagttcagcgcgagagggtgagtgccaagaatgcactggagagctacgcatttaatatgaaatcggccgtggaggatgaaggactcaaagggaaaatatcagaagctgacaagaaaaaagtgctggacaaatgccaagaagtaatttcatggttagacgcaaacaccttggcagagaaggatgaatttgagcataagcggaaggagctcgagcaagtctgcaatcccatcatcagcggcctgtaccagggggcagggggacctgggcccgggggatttggggcacagggtccaaagggaggcagcggttctggccctactattgaagaagtcgactag

SEQ ID NO: 119557 - DNA, 1926 bp, Artificial Sequence
  Description of Artificial Sequence: Synthetic coding sequence
atggcaaaagcagcagccataggcattgacttggggactacttattcctgcgtcggagttttccagcatggcaaggtggagatcatagccaatgaccaagggaacagaacgactccctcctatgtggctttcaccgacacagagagactgattggtgacgctgctaaaaatcaagtcgctctgaacccccagaataccgtgttcgatgccaaaagactgattggtcgcaaattcggggatcctgtggtccagtccgatatgaaacattggcctttccaggtgattaacgacggcgacaagcctaaggtccaggtctcatacaagggcgaaactaaggccttttaccccgaggagatatcttcaatggtgctgaccaaaatgaaagagatcgcagaagcttatttgggttatcctgtgacgaacgccgtcataactgtaccagcctacttcaacgacagtcagaggcaagccacaaaggatgccggagtgatcgccggcttgaatgtgctacggatcatcaatgaacctacggctgccgctattgcatacggcctcgaccgcactggcaaaggggagcgcaacgtgctgatattcgacttaggaggtgggacctttgacgtgtctatccttactatcgatgatggcattttcgaggtcaaggcaactgccggagatacacatctgggcggtgaagactttgataataggctggtgaatcactttgttgaggaattcaagcgtaaacataaaaaagatatttctcagaacaaacgggccgtccgccgcctgcggaccgcatgcgaaagagcgaagaggaccctgagctcttcaacccaggcttcactggaaatcgatagcctgttcgagggcatagacttctatacctcaatcacacgcgcccgctttgaggaactctgctctgatctctttcgctcgactctggaacccgtcgagaaggcccttcgcgacgcaaaattggacaaagctcagatccacgatctggtgcttgtcgggggcagcacgagaattccaaaggtgcagaagctgctgcaagatttttttaatgggcgagatctgaacaagagcattaatcctgatgaagcggttgcttatggagccgccgtgcaggctgctatcttaatgggcgacaagtcggagaacgttcaggacttactgctgctcgacgtggccccgctgagcctgggccttgagacagctggcggagtcatgaccgctctaatcaagcggaacagcactattccaacgaaacagacacaaattttcacaacctactcggacaaccaaccgggggtgctgatccaagtatatgagggagagcgagctatgaccaaggataacaatctgctgggcaggtttgaactgtcaggcatcccccccgccccgagaggcgtgccacagatcgaggtgaccttcgatatcgacgccaacgggatcctcaacgttactgccacagataagtctacagggaaggctaataaaataaccatcactaacgacaaagggagactttccaaagaagaaatcgagaggatggtacaggaagctgagaagtacaaagcagaggatgaggttcagcgcgagagagtatccgctaaaaacgcccttgaatcttacgcatttaatatgaagtctgcagtggaggatgaaggattgaaagggaagatctccgaggcagataagaagaaggtactcgataaatgccaggaggtgatttcgtggttggacgctaacaccctagccgaaaaagacgaattcgagcacaaaaggaaggagctagagcaggtgtgtaatcccataatttccggtctttaccagggggctggcggtcctggtccaggcgggtttggcgcccagggccccaaaggcggatccgggtccggaccgacaatcgaggaagtcgactag

SEQ ID NO: 119558 - DNA, 1926 bp, Artificial Sequence
  Description of Artificial Sequence: Synthetic coding sequence
atggccaaagctgcagcaattggaatcgaccttgggacaacatactcctgtgttggcgtattccaacacggcaaggtcgagattatcgccaatgaccagggaaaccgaacaactcccagctacgtggcttttactgacacagaacggctgataggggatgccgccaaaaaccaagttgccctcaatcctcagaacaccgtgtttgacgctaagcggcttatcggtcgtaagtttggcgaccctgtggtgcagtcagatatgaaacactggccctttcaagttatcaatgatggagataaacccaaggtgcaggtctcttacaaaggggagacgaaagcattctatcccgaggagatatcatctatggttcttacaaagatgaaagagattgccgaagcttacctgggataccccgttaccaatgcagtgattacggtgcctgcatactttaacgacagccagagacaggctactaaggacgcgggcgttatagccggccttaacgtcttaaggattatcaacgagcctaccgcagcagccatagcgtatggactcgatagaaccggcaagggggaacgcaacgtgttgattttcgatctgggcggtgggactttcgatgtgagtatcctcaccatcgacgacggaattttcgaggtgaaggcaacggctggcgacacacacctgggcggcgaggattttgataatagactggtaaatcattttgtggaggaatttaagaggaagcataagaaagatatcagccagaataagcgtgctgtccggagactcaggactgcatgtgaacgtgcaaaaaggactttgtctagcagtacacaggcatcgttagagatcgatagcctgttcgaagggattgacttttacacatctattacccgagcacggtttgaagaactgtgttcggacttgttccgatcaaccttggaaccagtggagaaagccctcagagatgctaaactcgataaggcacaaattcacgatctggtactggtcggcggatctaccagaatccccaaagtacagaagctgctgcaggacttctttaacgggcgagacctcaacaagtctataaaccctgacgaagcggtcgcatatggggctgctgtccaggcagcgattttgatgggggacaaatccgagaatgtccaggaccttctccttctcgatgtagcccctttgagcctgggcctggagaccgccgggggtgtgatgacagcactgatcaaaaggaactcaacaattccaaccaagcaaacacaaatctttacgacttactctgacaatcagcccggtgtgctcatacaggtgtacgaaggggagcgtgccatgactaaggataacaatctgttggggaggttcgaactgtccggcatccctcccgccccgagaggcgtgccacagatagaagtgaccttcgatattgacgcaaatggtatactgaacgtgacggcaaccgacaagtcaacggggaaggccaacaaaattacaatcacaaacgataagggccgactctctaaggaagagatcgagcgaatggtgcaagaggccgaaaagtataaagcagaagatgaggtgcagcgggaacgtgtatcagccaaaaatgcactggagtcatacgctttcaacatgaagtccgcagtggaggacgagggactgaaaggcaagatctccgaggcggacaaaaaaaaggtgctggacaagtgtcaggaagttatcagctggctcgacgctaatacattggctgaaaaggatgagtttgagcataagagaaaagaactcgaacaggtctgtaatcccatcatatccgggctctaccaaggcgcgggcggacctgggccaggagggtttggggcacaggggccaaaaggcgggtccggtagtggtcccacaatcgaagaggtggactag

SEQ ID NO: 119559 - DNA, 699 bp, Artificial Sequence
  Description of Artificial Sequence: Synthetic coding sequence
atggcgaaagccgccgcaataggcattgaccttggtaccacctacagttgcgttggcgtgttccagcacgggaaagtcgagattatcgcaaacgatcagggaaataggactacccctagctacgtggccttcacagacacggaacggctgatcggcgatgcaggtgtcatagctggcctgaatgtgctgcggatcatcaatgagcccaccgccgctgctatcgcgtatgggttggatcggacaggcaaaggggagcggaacgttttgatttttgatctggggggcggaacctttgatgtatctatactaactattgacgatgggatcttcgaagtgaaggctaccgcaggagatactcatctcggtggggaagactttgacaaccgcttggttaatcattttgtagaagagttcaaacgaaagcataagaaggatatcagtcagaacaagagagcagtccggagattgcggaccgcatgtgagagagcaaagaggaccttgagttcgagcacacaagccagcttggagatagactcattgtttgaaggcatcgatttctataccagcatcacgcgggccaggtttgaagaactgtgttctgacctttttaggtccaccctagagcctgtggagaaggccccccccgctagcccccggtgccggtcatgttgccgcactagcagcaccggtgccacctag

SEQ ID NO: 119560 - DNA, 1926 bp, Artificial Sequence
  Description of Artificial Sequence: Synthetic coding sequence
atggcgaaagccgctgctattggcatcgacctgggaacgacttactcctgcgtgggcgttttccagcatggaaaagttgagatcatcgctaacgaccaggggaaccgcacaacacctagctatgtcgccttcacagacacggagcggcttataggcgacgccgcaaagaatcaagtagcactgaaccctcagaacacagttttcgacgccaagagactaatcggcagaaaatttggtgacccagttgtgcagagtgacatgaagcactggccgtttcaagttattaacgacggtgataagccaaaggtacaggtgagctataagggcgaaacaaaagcattctaccccgaagagatcagctcaatggtcctcaccaagatgaaagaaatcgcagaggcatacctgggttaccctgtcacgaatgccgtcatcacagtgccagcatattttaatgatagccaacgacaagctacaaaagacgccggcgtgatcgcgggactaaacgttcttcgtatcattaatgaaccgacagccgcggccatcgcatacggactggaccgcacaggaaaaggcgaaagaaatgtcttaatttttgacctgggcggagggacttttgatgtcagcatacttacgatcgacgacggtattttcgaagttaaggctacagcgggcgacacccatttaggtggagaggacttcgataacagactggtaaaccacttcgtggaagagttcaaaagaaagcataagaaggatatatcacagaacaagcgcgccgtgcgacgcttgcggacagcctgtgaaagagctaaaagaacactcagctcctcgactcaggctagcctcgagattgactcgctatttgaaggaatagacttctatacatctatcacccgagccagattcgaggagctatgttctgacttgttccgatctactttggaaccagttgagaaggctttgagagacgccaaactcgacaaggcccagatacacgacttggtcctagtcgggggtagcaccagaatcccaaaggtccagaaactccttcaggacttcttcaatggaagagatcttaacaaaagcatcaatcccgatgaagctgtcgcatacggtgcagcagtgcaggcggcgattcttatgggcgataaatcagaaaatgtgcaggacctgctgctgttagacgtcgcccctttaagcctgggacttgagaccgcgggcggcgtcatgactgctctcatcaagcggaattcaaccattcctaccaagcaaactcagatatttaccacttattcagataaccagccaggcgtgcttattcaggtctacgaaggcgagcgggccatgaccaaagacaataacctcctggggcgttttgaacttagtggcatccctcccgcaccaaggggggttccgcagattgaggtgacgttcgacattgatgctaacggaatcctgaacgtgactgcaaccgacaaaagcacaggcaaagcaaacaagatcactatcacgaatgacaagggtagactaagtaaagaagaaatcgaacgcatggtccaggaggctgaaaagtataaggcggaggatgaagttcaacgcgaaagggtatctgcaaagaatgctctcgaaagttacgccttcaatatgaaaagcgcagtcgaagacgaaggattgaaggggaagatttctgaggctgacaaaaagaaggtcttggataaatgccaggaggtgatctcttggttggatgccaatacacttgctgagaaggacgaatttgaacacaagcggaaagagctggagcaggtttgtaacccgatcatttccggactctaccaaggggccggcgggccaggccccgggggttttggcgcacagggacccaagggggggagcggttctgggcccactatagaagaggtggattag

SEQ ID NO: 119561 - DNA, 1926 bp, Artificial Sequence
  Description of Artificial Sequence: Synthetic coding sequence
atggccaaggcagccgccatcggaatcgacttgggcactacctattcctgcgtaggagtgttccaacatggaaaagtcgaaatcatcgccaatgaccaggggaacaggactactccctcgtatgtggcctttacggacactgagcgcttgatcggagatgcagctaagaaccaggtggccttgaatccccagaacactgtcttcgacgcaaagcgcttgatcggcaggaagtttggagacccagtcgtgcaatcagacatgaagcactggccattccaggttatcaatgacggcgacaagcctaaggttcaggtctcttacaagggagaaacaaaagcgttctatccagaggaaatatctagcatggtcctgaccaaaatgaaggaaatcgccgaagcttacctcggttatcccgtcacaaacgctgtgattacggttcctgcttattttaacgacagccagagacaggcaactaaggacgccggagtaatagctggactgaacgttctgagaataattaatgagcctacagccgcagcaatcgcatacggactggataggaccggcaagggcgagcgcaacgtcttgatttttgatctgggtggcggtacattcgacgtgagtatcctcaccatcgatgatggtatctttgaagtcaaagcaactgccggtgacactcatctgggaggcgaggatttcgacaaccggttagtgaaccactttgttgaggaatttaagcgtaaacacaagaaggatatatcccaaaacaagagggccgtgcgccgactgcggacggcgtgcgagagggcaaaacgtacactgtcatccagcacacaggcaagcctggagatcgactctctttttgaaggtatcgatttctacacctcaatcacacgagctagatttgaggagttgtgcagcgacctgtttcgcagcaccctggaacccgtggaaaaggctctgcgtgacgcgaagcttgacaaggcgcagatccatgacctggttttggtagggggctctacaaggataccaaaggtgcaaaaacttctgcaggacttctttaacggcagagatctaaataagtcgataaatccagacgaggccgtcgcatacggcgccgctgtgcaggcagccatcttaatgggtgacaaatccgagaatgtccaagatctgttacttctggacgtggcccctctgagcttggggcttgaaactgctggaggagtgatgactgccctgatcaagcggaacagcactatcccgaccaagcagacgcaaatttttacgacctattccgataatcagccaggcgtgctcatacaagtgtacgaaggcgagagggctatgacaaaggataacaacctgctcggccggtttgagttgagtggcattccccccgccccgagaggtgtaccacagatagaggttacctttgacatcgatgccaacggcattctaaatgtcacggctactgataagtcaacaggtaaagcgaacaagattaccatcaccaacgataaaggaagactgtcgaaggaagagattgaacgcatggttcaggaagctgagaagtacaaggccgaggatgaagtacagagagagcgcgtttccgcgaaaaacgcactcgagtcatatgcttttaatatgaagagcgccgtagaggatgaaggcctgaagggcaaaatatccgaggcagacaagaagaaggtcctcgataagtgccaggaggtgattagctggttggatgcaaacaccctggcagaaaaagacgaatttgagcataaacggaaagaactggagcaggtttgcaatccaattatcagcgggttataccagggggcaggtggccccggcccgggaggattcggcgcgcaggggccgaaggggggcagcgggtccggtcccactatcgaggaggtcgattag

SEQ ID NO: 119562 - DNA, 2127 bp, Artificial Sequence
  Description of Artificial Sequence: Synthetic coding sequence
ctgagatcctgctgtgagggacccctgcgactgagcagggtgaccccagctgtgccccgactgagcagagccaatttgtgtggttgccggcaccggcgtgtggaattccccgcctttcggcgcactgagctcttgagccgcattccctccgcggtaagcagtcctcaatcccaatccggcgcacaccgccaagggacgggaatggccaaagctgccgccatcggaattgatctgggcaccacatattcttgcgtaggggtctttcagcatggtaaggtcgagatcatcgccaatgaccaaggcaacagaaccaccccctcctatgtggccttcactgatactgagaggctgattggcgatgcagcaaaaaatcaggtagcattaaatcctcagaacaccgtattcgatgccaaaaggctcatcgggagaaagttcggtgatcctgtggtgcagtctgacatgaagcactggccattccaagtaattaacgatggggacaagcctaaagtgcaggtctcatataaaggtgagacaaaggcattttatcctgaggagatttcctcaatggtcctgacgaagatgaaagagattgcagaggcatatttgggctaccctgtaaccaacgcggttataaccgtgccggcgtactttaatgatagtcagagacaggccacaaaagacgcaggagtaatcgctggcctgaatgtgctgcgaatcatcaatgagcctacagcagcagccatcgcttacgggctggaccgaacaggcaaaggagagaggaatgttttaatatttgatctgggggggggcacgtttgacgtgtccatcttgaccattgatgacgggattttcgaagttaaagctaccgcaggcgacacccatctcggtggggaggatttcgacaacagactagtgaatcatttcgtagaagagtttaaacgcaagcacaagaaggatatctcccagaacaagcgggctgttcgccgcttaaggactgcctgcgagagagccaagaggacactctccagtagcacacaggctagccttgagatcgactctctttttgaagggattgatttctacacgagtattacaagagcccgctttgaagaattatgctcagaccttttcagatcaacactcgaaccagtggagaaagctcttagagacgcaaaactggataaggctcagattcacgatctcgtcttggtgggagggagtacaaggattcccaaagtccaaaaactgcttcaagacttctttaatggtagagatctgaataagtctatcaacccagatgaagctgtggcttatggggcagcagtgcaagcagctatcctgatgggagacaaatcagagaatgtgcaggatcttctcctgctcgacgttgcccctttaagtctcggactagagacggctggcggagtcatgactgccctcatcaaaaggaatagtacaattccgacgaagcagactcagattttcaccacctacagtgacaatcagcctggagtcctgatacaagtttacgagggcgagagggctatgaccaaggataacaacctgctgggtagatttgagctctccggcatccccccggcgcctaggggcgtgccccagatcgaggttaccttcgatatcgacgccaatggaattctgaacgttacagccactgacaaaagcaccggtaaagcgaataaaataacaattacgaatgacaaagggcggctgagtaaagaggaaatagaacgtatggtgcaagaggcagagaaatacaaggcagaagatgaagttcaacgggaacgcgtgtctgccaaaaacgccctggagtcttatgcctttaacatgaagtctgctgtcgaggacgaaggactgaaagggaagatcagcgaggccgataagaagaaagttctggataaatgccaggaggtgatcagttggcttgacgccaacaccttagccgagaaggacgagttcgaacataaacggaaggaattggagcaagtgtgtaacccgataatctcggggttatatcagggcgctggaggccctggtccgggcggtttcggtgcccaagggcccaaggggggctctggtagcggccccacgattgaagaggtggactag

SEQ ID NO: 119563 - DNA, 1653 bp, Artificial Sequence
  Description of Artificial Sequence: Synthetic coding sequence
atggcgaaagccgccgccattgggatcgacctgggtaccacctactcatgcgtgggtgtctttcagcacggcaaagttcaaattagttcgatggtgttaacaaaaatgaaagagatagcagaggcttacctaggctatccggtgactaatgcagtgattactgttcctgcgtactttaatgactctcagcgacaggcaactaaagatgccggggtcattgccggcttgaacgtactgcgcatcattaatgaacccactgccgcagccatcgcttatggcctggacagaaccggaaaaggggagaggaacgtgctgattttcgacctgggcgggggtaccttcgatgtgagcattctgacaattgacgacggcatcttcgaagtcaaggcgaccgcgggggacacacatctggggggcgaggactttgacaatcggttagtgaaccactttgtggaagaatttaagcggaaacacaaaaaggatatctcacagaataaacgagcggtccgcagactgcggaccgcctgcgaacgtgccaagcgtaccctatcatcaagtacacaggcaagcctcgagatcgatagccttttcgaggggattgatttttacacgagcatcacccgagcacggtttgaagagctttgcagtgacctcttccgcagtaccctggaacctgtcgaaaaagctctgcgcgatgctaagctggacaaagctcaaattcatgacctggtcctcgtcggcgggtcaactagaatccctaaggttcagaagctgctgcaggatttttttaacggaagggatctgaataagagcatcaacccagatgaagcagtagcctacggcgccgctgtgcaggcagccatcctgatgggcgacaagtcagagaatgtgcaggacctgctcctcctcgatgtggctccccttagcttgggtctggagacggcgggtggtgtcatgaccgctctcatcaaaagaaattctactatccccacgaaacagactcagatcttcactacctactctgataatcagcccggggttcttattcaggtctatgaaggcgagagggccatgacaaaagacaacaacttgttaggtagatttgagctcagtggcattccgcctgctcctcgtggagtgccacaaattgaagttaccttcgacatcgacgctaatgggatcctcaacgtcactgccaccgataaaagcactggcaaggcaaataagatcaccattacgaatgataaaggccgcttgtctaaagaagaaatcgaaagaatggtgcaggaggccgaaaagtacaaagcagaggacgaagtacagagagagagggtatccgccaagaacgccctcgagtcttacgcctttaatatgaagtcagcagtggaggatgaaggccttaaagggaaaatcagcgaagccgataagaaaaaagtcctggacaaatgccaggaggtcatttcctggctcgatgccaataccttagccgagaaggacgagttcgagcataaacgaaaagagctggagcaggtgtgtaatcctattatttcaggcctgtatcagggagcaggcgggcccggtcctggcggattcggggctcaaggccctaagggaggttcggggtcaggcccaacgattgaggaggttgactag

SEQ ID NO: 119564 - DNA, 1875 bp, Artificial Sequence
  Description of Artificial Sequence: Synthetic coding sequence
atggccaaggccgccgctatcggtatagatctcgggacaacttactcgtgtgtgggagtattccaacatgggaaggtcgagattatcgctaatgatcaagggaaccgcaccacaccttcttacgtcgctttcacggatacagaaaggttaatcggggatgcggcaaagaaccaagtcgccctaaacccccctgtcgtgcagagtgatatgaaacattggcccttccaggtgatcaacgatggcgacaagcctaaggtgcaggtcagttataagggggagaccaaggccttctacccagaagaaatttcctccatggtgctcaccaaaatgaaagagatcgccgaggcttatctcggttaccctgtgacgaatgctgtgattacagttcccgcctacttcaacgacagtcagaggcaggccactaaggatgcaggtgttattgccgggctcaatgtcctcagaatcattaacgaaccgaccgcagccgccatcgcatatgggttggatcgaacaggaaagggtgaaagaaacgtgctcatcttcgacctcggcggtggcacttttgatgtttcaattctcaccattgacgacggaatttttgaggtcaaggccaccgcaggggacacccacttgggcggggaagactttgacaaccggttggtgaaccactttgtggaagaattcaaaaggaagcacaaaaaagacataagtcagaacaaaagggcggtgaggaggctgcgcacagcctgcgagcgggctaaacgcacattgtccagttccacccaggcctctttggaaatcgatagcctcttcgagggcattgatttttataccagtattacgagggcaagattcgaggagctctgcagtgatctcttccgctctactcttgaaccagtggagaaagctctgagagacgccaagctcgacaaggctcagatccatgatctggtcctagttggaggcagcacccgcatccccaaggtccagaagctcctccaggactttttcaatggtagagacctgaacaagtcaataaacccagacgaggccgtggcttatggggccgccgtgcaggccgctattctaatgggagataaatccgaaaacgttcaggacctgctgctactggatgtggcgcctctgtctctgggactggagacagcagggggtgtgatgaccgctctcataaagcggaattctaccataccaaccaaacagacgcagatcttcaccacctattctgacaatcagccgggcgttctgatccaggtctacgagggcgagcgcgcaatgacaaaagataataatctgcttggcagattcgagctgagcgggattcccccggccccccggggggtgcctcagatcgaagtgaccttcgacatagacgccaacggaatcttgaatgtaacagcgaccgataagtccaccggaaaagcaaataagatcacaatcacgaatgataagggacgactcagtaaggaagagatcgagcgtatggtgcaagaggcagaaaagtacaaggcagaggatgaggttcagcgcgaaagggtgtccgcaaaaaatgcactcgagagctatgccttcaatatgaagtctgcggtggaagacgaaggtctaaaaggaaaaatttctgaagcagacaagaaaaaagtgttggacaaatgtcaggaggtgataagttggctggatgctaataccctcgcagagaaggacgaatttgagcacaagagaaaagaattggaacaagtctgcaatcccataatttcagggctctatcaaggcgctggggggcctgggccaggtgggttcggagcccagggtccaaaagggggctctgggtctggccccacaatcgaagaggttgattag

SEQ ID NO: 119565 - DNA, 1857 bp, Artificial Sequence
  Description of Artificial Sequence: Synthetic coding sequence
atggcaaaagccgcagctataggcatagacctggggactacgtattcttgcgtgggagttttccagcacggcaaagtggaaatcattgccaacgaccaggggaaccgcacaacaccttcatatgttgctttcactgatacagagcgcctaatcggtgatgcagcaaaaaatcaagttgttcaatccgacatgaaacattggccttttcaggtcatcaatgacggagacaaacctaaagtacaggtttcttacaaaggtgagacgaaagccttttatccagaggagatttcctcaatggtgctgacaaaaatgaaggagatagccgaggcctacctgggctacccagtgaccaacgccgtcatcactgtccctgcgtattttaatgactcccagcgccaggcaaccaaggatgccggggttatagccgggttgaatgtcttaagaattataaatgagcctacagctgcggcgatcgcctatggtctcgacaggaccggcaaaggcgagcggaatgttctgatcttcgatctgggcggaggcacgtttgatgtgtccatcttgactatagatgacgggatctttgaagttaaggcgacagccggcgacacccacctaggcggtgaagacttcgacaatcgcttagtgaatcactttgtcgaggagttcaagaggaaacataagaaggatatttcccaaaataaacgcgcggtgcgccggctcagaaccgcatgtgagagggccaaaagaaccttgagtagttcaacacaggcctctctggagatcgattcactcttcgaaggcatcgatttttatacttctatcactagggctcggtttgaggaactgtgcagtgatctgttccggtccactctggagcccgtggagaaagcgcttcgcgacgcgaagctggataaggctcaaattcatgatcttgttctggtgggaggatctacccggataccgaaagtgcaaaagctgctccaggactttttcaacggccgagacctcaacaagagtatcaatcccgacgaggccgtggcctatggagcagcagtgcaggccgccatcctgatgggtgacaagtctgagaacgtgcaggacctacttttactggacgtggcaccactctccctggggctcgagactgctggcggcgtcatgaccgctctgatcaagcggaattctaccatccccactaagcagacccaaatcttcaccacttactccgataatcagcctggcgtcctaatacaagtgtacgaaggggagcgcgccatgactaaggacaacaatctgctggggagattcgaattgtccggcattccaccagctccccgaggggtacctcagatcgaggtgactttcgatatcgatgccaatggtatccttaacgtgactgccacagataaatcaacaggaaaggccaacaaaattaccataacaaatgacaagggccgcctgtccaaagaggagatcgaaagaatggtccaggaggcagagaagtataaggctgaggacgaggttcagcgagaacgagtttccgctaagaacgccctggaatcttatgcattcaatatgaagtcagccgtggaagatgaaggcttaaaaggaaaaattagcgaagccgataaaaaaaaggtgttggacaagtgtcaggaggtcatctcatggttagatgccaacacactcgcggagaaggacgaattcgagcataagcggaaagaactcgagcaggtttgcaatccaatcatctctggtctgtatcagggcgctggtggaccggggccaggagggtttggcgctcagggcccaaagggtggctctggaagtggcccaaccatcgaggaggtcgattag

SEQ ID NO: 119566 - DNA, 1857 bp, Artificial Sequence
  Description of Artificial Sequence: Synthetic coding sequence
atggccaaagccgccgctataggaatcgacctcgggacaacgtattcttgcgtaggggtttttcaacatggtaaggtcgagatcatcgccaatgaccagggcaacagaactactccaagctacgtggccttcactgacacggagagactcatcggggatgcggcaaagaatcaggtagtccagagcgacatgaagcactggcccttccaggtgatcaacgacggcgataaaccaaaggtccaggtctcatacaagggagagactaaggctttctaccctgaagaaattagttcaatggtcctcaccaaaatgaaagaaattgcggaggcctacttggggtacccagtcactaatgccgttattactgtgccagcatactttaatgatagccaacgacaggccaccaaagatgcaggcgtgatcgccggcttaaatgtactccgaatcatcaacgagccgaccgctgctgctatcgcatatggactcgatcgcaccggcaaaggcgagaggaatgttctgatctttgatttagggggcggaacttttgacgtgtctatcctgacaattgatgatggcatttttgaggttaaggctaccgctggagacacacatctaggcggtgaagactttgataatcgcttggttaaccacttcgtcgaggagtttaagcgcaagcataagaaagatatctcacaaaacaaaagagcggtccgtagactcaggacagcatgtgaacgtgccaaaaggacactatcttcttccacccaagccagcctggagatcgactctctgtttgaaggcatcgacttctacacttcaataacaagagcccggttcgaagagttgtgctctgacctgtttcggtctactcttgagccagtggaaaaggcattgcgcgacgcgaagcttgacaaagcacagattcacgacctggtgctggtgggcggctctacccgtatccctaaagtccagaaactcctgcaggacttcttcaatgggcgcgatttgaacaaaagcataaatccagatgaggctgttgcttacggagcagccgtccaggccgccatcctcatgggcgataagagcgagaatgttcaggatttgctgctgctcgatgtggctccactgtcactcggactggaaacagctggcggggtcatgaccgccctcatcaagagaaatagcaccattccgaccaagcaaacccaaatatttaccacttacagcgataaccagccaggcgtgttaatccaggtgtacgagggcgaacgcgccatgaccaaggacaataaccttttgggtagatttgagttgtcaggcatcccacctgcgccaagaggggttccgcaaatcgaggtgacattcgacattgacgcaaacggcatcttgaacgtgactgcaaccgacaagtccaccggcaaagccaataaaattacgattacaaacgataagggccgtctttccaaggaagagatcgaacggatggtccaggaagcagaaaagtataaggccgaggatgaagtccaaagggagagagtgtcagctaagaacgcactggaaagctatgcttttaatatgaagagcgccgtggaagacgagggtctgaaaggtaagataagcgaggccgacaagaaaaaggttctcgacaagtgtcaagaagttataagttggctggatgccaatactctggcagaaaaggacgagtttgagcacaaaaggaaggaattggagcaagtgtgtaaccccatcatttccggactctatcagggagctggcggccctggacccgggggcttcggcgcacaagggcctaagggcgggtcgggctctgggcctaccatcgaagaggtggactag

SEQ ID NO: 119567 - DNA, 1653 bp, Artificial Sequence
  Description of Artificial Sequence: Synthetic coding sequence
atggctaaagcagctgccatcggaattgatctgggcaccacctattcatgtgtgggcgtgttccagcacggcaaggtacaaataagcagtatggtgctgaccaagatgaaggagattgccgaggcatacctcggttatcccgtgactaacgcagttataacagtgccggcatacttcaacgactctcagcgccaggcgacaaaagacgctggtgttatagctggcctaaatgtcctcaggatcattaatgagcctactgccgccgcaattgcctatggattagaccggacaggcaaaggcgagcgcaacgtactgatttttgatttgggcggcgggacttttgacgtcagcatcctgactatagatgatggtatttttgaggtcaaggcgacggccggcgatactcacctcggcggtgaggacttcgataatcggctcgtgaaccatttcgttgaagaatttaagcgcaagcataagaaggacattagtcagaataagcgtgcagtgcggagactccggaccgcttgcgaacgcgccaaaagaaccttgtcttcaagtacccaagctagtctggagatcgactccttatttgagggtattgacttttacacaagtatcactagggctaggtttgaagaactttgctcggacctgttcaggtcaacccttgagcctgtggagaaagcgctgcgtgatgctaagctcgataaagcacaaatccacgacctggtccttgtgggaggatctacgagaattcccaaggtgcaaaaacttctgcaggacttcttcaacggacgggatctgaataagtcaatcaacccggatgaagccgtagcttacggagccgcagtgcaggctgcaattctgatgggtgacaagagcgaaaacgtgcaggatctcttactgctcgatgtcgccccgctcagcctcgggctggagactgctggtggagtgatgacggcgttaatcaagagaaacagcacaattcctactaaacagacccaaatattcacaacctactctgacaatcagcccggggttttgattcaggtctacgagggagagcgggccatgacaaaagacaataacctgctgggacggtttgaactctctggaattcctccagcgccccgcggcgttccacaaatagaagtgacatttgatattgatgccaacggtatactgaatgtcacagctaccgataagagcacgggaaaggccaacaagataacaataacgaacgataagggaaggctgtctaaagaagaaatcgagaggatggtccaggaggccgagaaatacaaggcagaggacgaggtacagcgagagcgcgtaagtgctaagaacgctctagaatcctatgctttcaacatgaagtccgcggtagaggatgaagggctgaagggaaaaattagtgaagcagataaaaaaaaagtgctcgataaatgtcaggaggtgattagctggctcgatgccaatactttagcagaaaaagacgagttcgaacataagcgcaaggaactggaacaggtctgcaaccctattatctcagggctttatcaaggggccggggggcccggcccaggcggctttggagctcagggccctaaagggggctcggggtctggtcctaccatcgaggaggtcgattag

SEQ ID NO: 119568 - DNA, 1857 bp, Artificial Sequence
  Description of Artificial Sequence: Synthetic coding sequence
atggcaaaagccgcagcaattgggattgatctgggtactacctattcctgcgtgggggtgttccaacatggaaaggttgaaataatcgcaaacgatcagggaaatcggaccacacctagttacgtggctttcaccgacactgagagactgatcggagacgccgctaagaaccaggttgttcagagtgacatgaaacactggcctttccaggtcattaacgatggcgacaagccgaaggttcaggtgtcttacaagggggagactaaagctttctatcccgaagaaattagcagcatggttttgactaagatgaaggaaattgcggaggcatatctgggctaccccgtgactaacgcagtcatcacggtgccggcatatttcaacgattcccagcgccaggcaacaaaagacgcgggcgtgattgctggcctgaatgtcctgcgcatcatcaatgagcctactgccgccgctatcgcttatggcctggacagaaccggaaaaggggagcgcaatgtcctcatttttgacctgggcgggggtacatttgacgtaagcattttgacaatcgatgatgggatctttgaagttaaggccactgccggcgatacacaccttggaggggaggatttcgataatcgtttagtgaaccatttcgttgaggagtttaaaaggaaacataagaaagacatttcacagaacaagcgagccgtgcgcagactgagaaccgcttgtgaaagagccaagcggaccttgagctcgagcacgcaggcttctctggaaattgatagtctgttcgaaggaattgatttttacaccagcattacacgagctagatttgaggagctgtgctctgatctgtttcgctcaaccctagagccggttgaaaaagcactacgtgatgccaaattagataaggcccagatccacgatctggtgcttgttggcggtagcacgaggatacccaaagtacagaagttgctgcaggacttttttaatggtagggacctcaataagtcaattaacccagacgaggccgtggcttacggcgcagcggtgcaggccgccatacttatgggtgataaaagtgagaatgtgcaggatctgctgctgctggacgttgctcccttgtcactgggccttgagacagcgggcggcgtgatgaccgccctgattaagcgcaactcaaccatcccgacaaaacagactcaaattttcactacatattcagacaatcagccaggcgtcttgatccaggtttatgagggcgaacgggccatgacaaaggataacaatctcctggggcgattcgagctgtccggtatacctccagcccctcggggagtgccccagatcgaagtgactttcgatattgatgccaatgggatactgaatgtgactgccacagataagagcacaggcaaggccaacaaaatcacaatcacaaatgacaaaggcaggttaagcaaggaagagattgagagaatggtccaagaagcggaaaagtataaagctgaggatgaggtccagcgagaacgcgtctctgctaaaaacgcccttgaatcctacgcatttaacatgaaatccgccgtggaggatgaaggactgaaaggaaagatttccgaagcggacaagaaaaaagtgctggataagtgccaagaggtgatttcttggctggacgctaataccctagccgagaaagacgaattcgagcacaagagaaaggagctggagcaggtctgcaatcccattatttcaggcctataccagggagcaggcggtcccgggcccggcggatttggagcgcagggacctaaggggggatccggatctggcccaacaatagaagaagtcgattag

SEQ ID NO: 119569 - DNA, 1653 bp, Artificial Sequence
  Description of Artificial Sequence: Synthetic coding sequence
atggcgaaggccgcggcaatcggcattgacttagggacaacctactcctgcgtgggagtgtttcagcatggcaaagtccagatttccagtatggtgcttaccaaaatgaaggagattgctgaggcgtacctgggctaccccgtgaccaacgccgtcattacagtgcccgcttactttaacgatagccagcggcaagccacaaaggatgctggcgtgatcgctgggctgaatgtgctgcgtattattaacgagccgacggcagccgccatcgcgtacggcctggacagaacggggaagggggaaaggaacgtgctgatcttcgatctgggtggcggaaccttcgatgtctctatcctcaccatcgacgatgggatcttcgaagttaaagcgaccgctggagacactcatcttgggggggaagactttgacaatcgcctggtcaaccactttgtggaagagtttaagcgcaagcacaagaaggacatatcacaaaacaagcgcgccgtgcgtcgtctgaggactgcctgcgaaagagctaaacgcacgctgtcatctagcacccaggcgtcactggagatagacagcctgttcgagggaatcgacttctatactagcatcacacgcgctcgattcgaagaattgtgctcagacctattcagaagtactcttgaacctgttgaaaaagcgctgagggatgctaagctagacaaggcacaaatccacgatctcgtgctggttggagggtctacacgtattcctaaagtacaaaagcttctgcaagacttttttaatgggagggatttgaacaagtcaataaaccctgatgaagccgttgcctatggtgctgccgttcaggccgctattctgatgggggacaagtctgaaaacgtgcaagaccttctgttgctggacgtggcaccgctttctttaggcctcgagacggctggcggtgtcatgaccgctcttattaaacggaattccacaatacccactaaacaaacccaaatctttaccacctacagcgataatcagccaggggttcttattcaggtctacgaaggtgagcgggccatgaccaaggacaacaacctcctcggaaggtttgagctgtctggtatacctcctgcccccaggggggtaccacagatcgaagtcacttttgatatcgacgcgaacggaattttaaatgtgacagctacagacaagtcaacgggtaaggctaacaagatcaccatcacaaatgataaaggcagattgtccaaagaagagatcgagagaatggttcaggaagccgaaaagtataaggctgaggatgaggtgcagcgggagcgcgtaagtgccaagaacgcactggagtcatatgccttcaacatgaagagtgcagttgaggacgagggcctgaaggggaaaatctccgaggccgacaaaaagaaggtgcttgacaaatgccaggaagttattagctggcttgatgcaaataccctggcggagaaggacgagttcgagcacaagcgcaaggaattagagcaggtatgcaaccccattatatccggtctgtatcagggggcgggcggcccagggcctgggggttttggggcccaggggcccaaaggcggttcaggcagtggcccaacgatagaagaggtggattag

SEQ ID NO: 119570 - DNA, 1761 bp, Artificial Sequence
  Description of Artificial Sequence: Synthetic coding sequence
atggcaacagccaagggtatcgcaatcggtatagacctgggcactacatactcctgcgtgggcgtttttcagcacggtaaggttgagatcatagccaacgaccagggcaatcgcactaccccaagttatgtggccttcacggatactgaaagactgattggagacgcggcaaagaaccaggtagctatgaatcctcaaaacaccgtgtttgatgcaaagcgtcttattggaagaaaatttaatgatccagtggtgcaggcagacatgaagctttggccctttcaagtgatcaatgactcccagcggcaggcaaccaaggacgccggcgtcattgccgggctgaatgtgctccggattatcaacgaaccaactgccgccgcaattgcttatgggttagacaagggagggcagggagagcggcacgttttgatttttgacctaggcggcggcacttttgatgttagcatccttaccatcgatgacggaatttttgaggttaaggcaactgcgggggatacacacctcgggggggaagatttcgataataggctcgtatcccactttgtcgaggagtttaagaggaaacacaaaaaggacatctcccagaataagagggcggtgcgaaggctgagaactgcctgcgagcgggcaaaacgaaccctgtcatcctccacccaagccaacctggagatcgacagcctgtacgaaggaatcgatttctacacctcgattaccagggctcggttcgaagaactttgtgccgacctatttagaggcaccctggagcctgttgagaaggctctgcgggatgctaaaatggacaaagcaaagattcacgatattgtactcgtgggaggcagcactaggatacctaaggtgcagaggttactgcaggactatttcaacgggagggatctgaacaaatccattaatccggatgaagccgtagcctatggagcagctgtgcaggccgccatactcatgggagataaaagtgagaaagtgcaggatctgcttctcttggatgtcgcacccttatcactgggcctggaaaccgctggcggagtgatgactgcccttatcaagcgtaattctaccatccctacgaagcagacccagatctttaccacgtactctgataaccaaccaggggtgctgatacaggtgtatgaaggggaacgcgctatgacaaaggacaataatctgttgggaaggttcgaccttaccggcatacctccagcccctagaggggtgcctcagatcgaagtgacttttgacatcgatgcaaatggcattcttaacgtgacagcgacagataaaagtactggcaaagttaacaaaatcactattaccaatgataagggacggttgtccaaggaggagatagagagaatggttctcgatgccgaaaaatacaaggcagaggacgaggtgcagcgcgagaagatcgcagcaaaaaacgccttagagtcctacgcgttcaatatgaaaagcgtggtgtcagacgaggggcttaaaggcaaaattagcgaatcagacaagaacaaaattttggataaatgtaatgagctcctgagctggctagaggtcaaccagctggcagaaaaagatgagttcgaccacaaaaggaaagagctggaacagatgtgcaaccctatcattactaaactgtatcagggggggtgtactggacccgcttgtggaacaggttacgtccccggacgccctgcaacgggaccgacgatcgaagaagtggactag

SEQ ID NO: 119571 - DNA, 1926 bp, Artificial Sequence
  Description of Artificial Sequence: Synthetic coding sequence
atggcaacagctaagggcattgcgattggcatagatctgggtactacctacagctgcgttggggttttccagcatggaaaagtcgaaatcatcgccaatgaccagggtaatcgcaccaccccgtcttacgtggctttcaccgatacagaacgattaataggggacgctgctaagaaccaggtagccatgaacccccagaataccgtgtttgacgccaaacggctgattggcaggaagtttaacgacccagtggtccaagccgacatgaagttgtggcccttccaggtgatcaatgagggaggcaagccaaaagttctggtatcatacaagggtgaaaataaggctttctacccagaggaaatctcttctatggtcctcacgaaactgaaggagacagcagaagcgttcttggggcaccccgtgactaatgccgtcataacagtcccggcctactttaatgattcacagcgccaggccaccaaagacgctggggtgatcgctggcctgaacgtcctgcgtatcattaacgagcctacagccgccgccatcgcttacggcttagataaaggcggccagggagagagacatgtgcttatctttgatctcggcggcggaacctttgacgttagcatccttacaatagatgacggaatctttgaagtgaaggccactgcgggtgacactcacctggggggggaagacttcgataaccgcctggtgagtcacttcgtagaagaattcaagaggaagcacaagaaagatatttcccagaataagcgggcagtgcggaggctgcgcacggcttgtgaaagggctaagcgtacactgtcatctagcacccaagccaaccttgaaattgatagcctgtatgagggcattgacttctacaccagcataacccgggctcgtttcgaggagctctgtgccgaccttttcagaggtaccctggaacctgtcgagaaggccctacgcgacgcgaaaatggacaaagctaaaatccatgatattgtgctggtgggggggtccacaaggatcccaaaagtgcagagattactgcaggattacttcaatggccgcgatctgaataagtccattaatcctgacgaggcggtcgcatacggcgccgccgttcaggcggcaatcttgatgggtgacaagagcgagaaagtgcaggaccttctgctgctcgatgtagctcctctctccctgggacttgaaacagctggcggagtgatgactgctttgatcaagagaaattccactatccccaccaagcagacacagatttttacgacctactccgacaaccagcctggagtgctgattcaggtgtacgagggggaaagagctatgaccaaggataacaacttactgggaagatttgatctgacaggaatcccacctgcccccaggggcgttcctcagatcgaagtgacatttgacatcgatgcgaacggaattctcaacgtgaccgctactgacaagtccacggggaaagtaaacaaaatcaccatcaccaacgataaagggaggctaagtaaggaggagattgaacggatggtgctggacgccgagaagtacaaagcggaggacgaggtgcagcgagagaaaattgccgctaaaaatgcactggaatcctacgccttcaatatgaagtctgtcgtcagcgatgagggactcaaggggaagatttctgagagcgataaaaataagatcttggataagtgtaacgaactgctctcttggctggaggtgaaccaacttgcggaaaaggatgagtttgaccacaaacgtaaagagctagaacaaatgtgtaatcccattatcaccaaactttatcagggaggctgcactggaccagcttgtggtaccgggtacgtgcctggtcggcctgccactggaccaacaattgaggaggtcgactag

SEQ ID NO: 119572 - DNA, 1926 bp, Artificial Sequence
  Description of Artificial Sequence: Synthetic coding sequence
atggccaccgcaaaggggattgcgatcggcatagacctcgggacgacctacagctgcgtcggtgtcttccaacacggcaaagtcgagattatcgccaatgatcagggcaatcgcaccacgcccagttacgtggcgttcacagatacagagaggctaatcggggacgctgccaagaatcaagtggccatgaatcctcaaaacacggtgttcgacgccaagaggctgatcggacgcaaatttaacgatcctgtagtgcaggcggatatgaagctgtggcctttccaggtcatcaatgaagggggaaaaccaaaggtgctggtgagttataagggcgagaataaagcattttatccggaggaaatttcatcaatggtgctgacgaagctgaaagaaaccgcagaagcttttctggggcatcctgtcacaaacgccgttattacagttccagcttattttaacgatagccaaagacaggctacaaaagacgctggggtgatcgcagggctaaacgtcctgagaatcataaatgaacctactgcggctgctattgcctatgggctggataagggaggccagggcgaacgacatgtgctgatctttgatcttggcggtgggacctttgatgttagtatcttgactattgatgacggcattttcgaggtaaaagcaactgctggagacactcatctgggcggggaagatttcgacaaccgcctcgtgtcccatttcgtggaagagttcaagcgcaagcataaaaaggacatatcccagaataagagggcagtgaggagacttcgaaccgcctgcgagagagctaaacgcacgctcagttcctctacacaggccaatttagagatagattcgctttacgaaggaatcgatttctacactagtatcactcgcgcaaggtttgaggaactgtgcgccgatctattccgggggaccttagagccggtggagaaagctctgcgcgacgcaaaaatggacaaggccaagatccacgatatagttctggtggggggctctaccaggattcctaaggtccagagattgctgcaggactacttcaacggcagggacctgaacaagtctatcaatcccgacgaagcagtggcctatggcgctgctgtgcaggcggctatactgatgggagataagagtgagaaagtgcaggatctcctgctgctggacgtggcccctctgagcttagggctcgagacagcggggggggtaatgaccgccctgattaagcgcaactccacaatccccacaaaacaaacacagatattcaccacatactccgacaatcagccaggcgtcctgatacaggtttacgagggcgaaagagcgatgactaaggataataacctcctgggacgttttgatctcactggcattccgcctgctccacggggtgtaccccagatcgaggtaacattcgacattgatgctaacggaatcctgaatgtgacagccatggataagagtacgggaaaggtgaataagattacaattaccaacgataagggccggctgtctaaggaggagatagagcggatggtcctcgacgccgagaagtataaggccgaggatgaggtccagagggagaaaatcgccgcaaagaatgcactcgaatcttacgcgtttaatatgaaaagcgtcgttagcgatgaaggattgaagggcaaaatttctgagtccgacaaaaataagatcctggacaaatgtaatgagctgctctcttggctggaagtgaatcagttagccgagaaggatgagttcgaccataaacgcaaggagctcgagcaaatgtgtaacccgattatcaccaagctttaccaaggtggttgcaccggtccggcatgtggcaccggatatgtgcctggtcgaccagctaccgggcccaccattgaagaagtggattag

SEQ ID NO: 119573 - DNA, 1926 bp, Artificial Sequence
  Description of Artificial Sequence: Synthetic coding sequence
atggctacagctaaaggaatcgctattggaatcgatctggggacaacctatagctgcgtcggcgtgttccagcatggaaaggtggagatcatcgccaacgatcaggggaacaggactacaccctcatatgtggctttcactgatacagaacggctaatcggggacgccgctaagaatcaagtggcaatgaatccacagaacacggtctttgacgctaagcgtctgatcggcagaaaattcaacgatccagtagtccaggccgacatgaagttgtggcctttccaggttatcaacgaagggggtaagcccaaagtcctggttagctacaaaggggaaaataaggcgttctatcctgaggagatttcgtctatggtactcacgaaactgaaggaaactgcagaggctttcttgggacacccagtaaccaacgcagtcatcactgttccagcctacttcaatgactcacaaaggcaggccaccaaggatgctggagtgatagctggactgaacgtgcttcggataatcaatgagccgacagcggctgccattgcatatgggttggacaaaggaggccagggggagagacacgtcctgatttttgaccttggggggggaacctttgacgtctcaattttgaccatagatgatgggatctttgaagtgaaagccactgcaggggacacccatctgggcggcgaagactttgataacaggctggtctcacacttcgtggaggaatttaagaggaaacataaaaaggatatctcccagaataagcgggccgtgcgcaggctgaggactgcctgcgagagggcgaagagaacattgagttcctctactcaagcaaacttagagattgacagtctctatgagggcattgacttttatacaagcattactcgtgccagatttgaagaactttgtgcggatctgttccgcggcacgttagagcctgtcgaaaaggcgctccgtgacgcaaagatggacaaagcaaaaatacacgatattgtgctggttggcggctccaccagaatacccaaggtgcagaggctgctgcaggactactttaacgggagggacttaaacaaatcaatcaatcccgacgaggccgtggcgtacggagctgctgttcaggcagccattttgatgggagacaaatcagaaaaggtgcaggacttgttgctcctcgacgtagctccactctccctggggcttgaaaccgcaggcggggttatgacggctctgatcaagaggaacagtacgatacctactaaacagacccaaattttcactacctacagcgataaccagccaggcgttttgattcaggtctatgagggtgagagggccatgacaaaggacaataatctgctgggcagatttgacctgacgggcatcccaccagcgcccagaggagtcccacagatcgaggttacttttgacatcgacgccaacggcatattaaacgtcaccgctacggacaaatcgacgggcaaggtgaacaagatcaccattacaaatgacaaaggccgtctttccaaggaggaaattgaaaggatggtgctggatgcggagaaatacaaggccgaggatgaggttcagagagagaagatagctgcaaagaacgccctcgagagttacgctttcaatatgaagtccgtcgtctccgacgaaggtctcaaaggcaagattagcgagtctgacaaaaataagattctggacaaatgtaatgagctgctctcctggcttgaggtgaaccaactcgccgaaaaagacgaatttgatcacaagagaaaagaactagagcagatgtgcaaccccattattaccaagctttaccagggggggtgtactggccccgcctgcggcactggctatgtgccggggcggccggccaccggccccactattgaagaagtggactag

SEQ ID NO: 119574 - DNA, 1926 bp, Artificial Sequence
  Description of Artificial Sequence: Synthetic coding sequence
atggccacagctaaagggatcgcaattggcattgacctggggacaacatacagttgcgtcggggtattccaacatgggaaagttgaaataatcgcaaatgatcaaggtaaccgcactacgccctcatatgtggcctttacggacaccgagcgactcatcggcgatgccgccaagaaccaggtagctatgaacccccagaacacagtgttcgatgcaaaaagactgatcgggcggaaattcaatgatcccgtggtccaggccgatatgaaactgtggcctttccaggttattaatgaggggggtaaacctaaggtgctcgtttcatataagggggagaacaaggccttttaccctgaggagataagcagcatggtcctgactaagttaaaggaaaccgccgaggccttcctgggccatcctgtgacaaacgctgttattacggtccctgcgtactttaatgattcgcaaagacaggctacaaaggacgctggtgtaatcgctggccttaatgtactgcggattatcaacgagccaaccgcggccgctattgcatacggattggacaagggaggtcagggcgaaagacatgtcttaatattcgacctcggcggtggcacatttgacgtttcaatccttaccatagatgacggcatctttgaggtcaaagctacagccggtgacacccacttgggcggggaggattttgacaatcggctggtctctcacttcgtggaggagttcaaaagaaaacataagaaagacatctcccagaacaaacgtgcggtgagacggctgcggaccgcatgtgaacgggccaaacggactctttccagcagcacccaagctaatctagaaatagattctttgtacgagggcatcgatttttacacgagcataactcgcgcccgcttcgaagaactctgcgcggacctttttcggggaacgctcgaacctgttgaaaaggcactgcgagacgcaaagatggataaagccaaaatccatgacattgtccttgtaggaggttccacgcggatccccaaagtccaaaggctcctgcaggattattttaatggccgggatttaaataagagcattaatcccgatgaggccgtggcctacggagcagcggttcaagccgccatcttaatgggcgacaagtcggaaaaggtgcaggacctcctgctgctggatgttgcacctttatcacttggcctggaaacagccggaggcgtgatgaccgcattaattaagcgcaattctacaattcccaccaaacagacacagatcttcacaacctactcagataaccagccgggcgtccttatacaagtgtacgagggcgaacgcgctatgacaaaagacaataacctgctcggacgctttgatttgacggggattcccccggccccaagaggagtgccgcagatcgaagttacctttgacatcgacgctaacggaattcttaacgtgacagctacagataaaagcacgggaaaagtgaataagattacaattaccaacgacaagggcaggctttccaaagaagaaatcgagcgtatggtactagatgcggagaagtataaggccgaagatgaggttcagcgcgagaaaattgctgcaaaaaatgctctggaaagctatgcctttaatatgaaaagcgtcgtgtctgacgaaggtctgaaaggcaagatatctgagagcgataagaacaagatcctggacaagtgtaatgagctgttgagttggctggaggttaaccagcttgccgagaaggatgagttcgatcacaaacggaaggaactggagcagatgtgtaatcccattattaccaagctgtaccagggcgggtgtacgggacctgcatgcggcacaggctatgtgccaggccggcctgccactggccctacgatagaagaggtcgactag

SEQ ID NO: 119575 - DNA, 699 bp, Artificial Sequence
  Description of Artificial Sequence: Synthetic coding sequence
gcaaaagggattgcgatcgggatagatcttggcactacttattcctgcgttggcgttttccagcatggtaaggttgaaatcattgcaaacgaccaaggtaatcgtactaccccttcatatgtcgcttttactgacaccgaacggcttattggcgacgccggcgtgatagcaggcctgaatgtgttgaggatcatcaacgagcccacggccgctgcaatcgcctacggcttggacaagggaggccaaggcgaacgacacgtattaatcttcgatctgggtggaggcacgtttgacgtgtcaatattgaccattgatgacggtattttcgaagttaaggccactgctggcgatacacacttaggcggcgaggatttcgacaatagactcgttagccatttcgtggaagaattcaaaaggaagcacaagaaagatatcagccaaaataagcgtgccgtgcgacgactccgtacggcctgcgaacgggcaaaacgaacgttgagttcatcaactcaggccaacctggaaattgactcactgtacgaaggcattgatttctatacctccattacgagggccagattcgaggagctgtgcgcggatctgttccgcgggaccttagagcctgtcgaaaagggcgccccccctgccagcccgagatgctccgggtgtttccgcacaacatctatggacgtgatttag

SEQ ID NO: 119576 - DNA, 1926 bp, Artificial Sequence
  Description of Artificial Sequence: Synthetic coding sequence
atggctaccgcaaaagggatagcaattggcattgaccttgggacaacttactcctgtgtcggtgtgtttcagcacggaaaagttgagatcattgctaatgaccaaggcaataggactacaccttcttatgttgcctttaccgatacagagaggctaatcggggacgcagcaaagaaccaggtcgccatgaatccccagaacactgtgtttgacgccaagagacttatagggaggaaattcaacgatcccgtcgtgcaggcagatatgaagctgtggcccttccaagtgataaacgaaggcggcaagccaaaagtgctggtgagctataaaggagagaataaagccttttaccccgaagagatctcgtccatggttctcacaaagctaaaggagaccgcagaggcatttctgggccaccccgttaccaatgccgtcattaccgttcccgcctacttcaatgatagccagcgccaggctaccaaggacgctggcgttattgctggcctgaacgtcttgagaattattaatgagcctacagccgcggccattgcctatggcctggacaagggtgggcagggtgaacgtcacgtcttaatcttcgacctcgggggggggacgttcgacgtgtccattcttaccatcgacgatggtatttttgaggtgaaagccacggcgggagatactcatcttggcggagaagacttcgataataggttagtgtcacatttcgttgaggagtttaagcggaagcacaagaaagacatatcgcaaaacaagagggctgtgagaaggctgcgtaccgcctgcgagcgagctaagcgtaccctgtctagttcaacccaggccaacttggagattgatagtctgtatgaaggcatagacttttacacttccattacacgtgcccgatttgaggagctatgtgcggatctgttccggggcacactagaacctgtggaaaaggccctgagagacgcgaaaatggataaggcaaagatccacgacatagtcctggtgggcggatccacccggatccccaaggttcaaaggctgctccaggactactttaacggcagggatctgaacaagtccattaatccagatgaagcagtcgcatacggggccgccgtccaggcggccatcctaatgggggacaaaagcgaaaaagttcaggaccttctcctgctggacgtggccccgctgagcctgggcttagagacagctggcggtgtgatgacagctctgatcaaaaggaatagcacaattcccaccaagcaaacccaaatttttaccacctactccgacaatcagcccggagtgctcatccaggtgtacgaaggagaacgcgctatgactaaggacaacaacctactggggcgtttcgacctgacggggatccctcccgcccctcgcggtgtccctcagatcgaggtgactttcgatatcgacgccaatggcattctgaatgtgaccgctatggacaaatcaacaggtaaagtaaacaagatcacaatcacaaatgataagggtcgcctctccaaggaggaaatagagcgcatggtgttagacgccgaaaaatataaagctgaggacgaagtgcagcgcgaaaagatcgccgctaagaatgcattggagagctatgctttcaatatgaaatcagttgtgagtgacgaaggtttgaagggaaagatttcagagtccgacaaaaataaaattctggataagtgtaacgaactgcttagctggttggaagtgaatcagctcgcagagaaagacgagtttgatcacaaaagaaaagagctggagcaaatgtgcaaccccattattactaaactgtaccaaggtggctgcactggtcctgcatgcggaacaggttatgttcccggcagacctgccactggtccaactatcgaagaagtggattag

SEQ ID NO: 119577 - DNA, 1599 bp, Artificial Sequence
  Description of Artificial Sequence: Synthetic coding sequence
atggctactgctaagggaattgcaataggcatcgacttgggaactacttattcttgtgttggtgtgtttcaacacggcaaggtggagataatcgccaatgaccaagggaataggactaccccttcctacgttgcctttacagataccgagaggttgattggcgatgctgcgaaaaaccaagttgctatgaatccccaaaacacagtgtttgacgcgaaacgacttatagggcggaagtttaatgacccagtcgtgcaggcagacatgaaactttggcccttccaggtgatcaatgaggggggcaaacccaaagttctggtgagctacaaaggagagaacaaggctttctaccccgaggaaatatctagcatggtactcactaaactgaaggagacggcggaagcattcctgggccaccccgttactaatgccgttatcacagtaccagcttactttaacgactctcagcggcaggcgaccaaggacgccggcgtgattgcgggccttaatgtgttacgaatcatcaacgagcccactgcagccgccatcgcttatggcttggataaaggaggtcaaggcgaacgacatgttctcatctttgacctgggagggggcacgtttgacgtgtcaatactgactatagacgacggaatattcgaagtgaaggcaactgccggggatacccacctcggcggggaggactttgataacaggcttgtttcccactttgtggaagaattcaagcgcaaacacaagaaagatatctctcagaacaagagggccgtgcgtagactgagaacggcctgcgaacgcgccaaaaggaccctcagctctagcacgcaggccaatctcgagattgattccctctacgagggtattgatttctacacaagcatcacacgcgcccggttcgaggagctatgcgcagacctgttccgcggtaccctggagcctgtggaaaaagccttgagagatgcgaaaatggacaaggcaaaaatacacgatatcgtgctggtcggaggtagcacacggatcccaaaagtgcaacggctgctgcaggactattttaatgggcgcgatctgaataagtctattaaccccgacgaagccgtcgcgtacggcgctgcagtgcaggccgcgattctgatgggagataagagcgagaaggttcaggacttactcctgctggacgtcgctccactatcgctagggctagagactgcaggtggcgtcatgacagccttaattaagcgcaactctactatccctacgaagcaaacgcaaatctttactacgtactcagataaccaaccaggcgtgcttattcaagtctacgagggagaaagagccatgacgaaggacaacaatctgctgggccgctttgatctgacagggattcccccagccccacgcggggtcccacagattgaggtaacattcgatatagacgctaatgggatactgaatgtcaccgcaatggataagagtacaggtaaggtcaacaagattaccatcactaatgataagggtcgcttaagtaaggaggagatagagcgtatggttttggacgctgagaaatacaaagccgaggacgtctag

SEQ ID NO: 119578 - DNA, 699 bp, Artificial Sequence
  Description of Artificial Sequence: Synthetic coding sequence
gccaaaggtatcgcaattggcatcgatctgggaaccacgtatagctgtgtgggtgtgtttcaacacggcaaggtcgagataatagcaaatgaccaaggtaacaggacaactcccagttatgtggcctttacagatacagagaggctgattggcgatgctggcgtgattgcaggtttgaacgttctgaggataatcaacgaacccacagcagccgcaattgcatacggacttgacaaaggaggtcaaggggaaaggcacgtgctgattttcgaccttggcgggggaacattcgacgtttccatcctcactatcgacgacggtatatttgaggtgaaggccactgccggggatactcaccttggtggagaagatttcgacaaccgcttagtcagccatttcgttgaagagttcaagcgcaaacataaaaaggacatcagccagaataagcgcgccgtccggcggttgaggacagcctgcgaacgcgccaaacgcactctgtcctcaagtacccaagccaatttggaaatagactcattgtatgagggaattgacttctacactagcattacaagagcccggttcgaagagctctgtgccgacttgtttcggggtacgctcgagccagttgagaagggggcccccccagcatctccacgttgttcaggatgctttcggacgacctccatggacgtaatttag

SEQ ID NO: 119579 - DNA, 1926 bp, Artificial Sequence
  Description of Artificial Sequence: Synthetic coding sequence
atggccactgccaaagggattgcaatcggtattgacttgggtacaacttactcctgcgtaggggtattccaacatggtaaggtagaaattattgcgaacgatcaaggtaatagaacgacaccatcctatgttgcgtttacggataccgaacgtttgataggggatgcagccaaaaaccaagtggctatgaacccgcaaaacactgtattcgacgcgaaacgactaatagggagaaaatttaacgatccagttgtgcaggccgatatgaaactatggcctttccaggtaatcaatgaaggcggcaagccaaaagtccttgtgtcatacaaaggcgagaacaaagcattctatcccgaagagatttcaagcatggtgttgaccaaactcaaggaaaccgccgaagcttttctgggccaccctgtcacgaatgccgtgataaccgtgcccgcctactttaacgatagccaaagacaggcaaccaaggatgcaggtgtgatagctgggctcaatgttctgcgcatcattaatgaacccaccgcagccgcaatcgcttacggcttagacaaaggcgggcagggcgagagacatgttctgatttttgacctggggggtggaacttttgatgtgtctatcctgactattgatgatggaatctttgaagtgaaagccaccgctggcgatactcatctggggggcgaagacttcgataatcgactcgtgtcacactttgtggaagaatttaagcgcaagcacaagaaagatattagccagaataagcgtgcagtccggaggcttcgcacggcgtgcgaacgcgcaaagcgaaccttgtccagctcaacccaggccaaccttgagattgatagtctctacgaggggattgacttctatacaagtattactcgtgcccgtttcgaggagctttgcgcagatctgtttcggggtacgcttgaaccagtcgagaaggccttgagagacgctaagatggacaaagcgaaaatccatgatattgtgctggttggcggctctacgcgcattcctaaagtgcaacgattgttacaggattatttcaacggcagggacctgaataagtccattaatccggatgaagctgtggcttacggagcagctgttcaggcagccattcttatgggcgataagtctgagaaagtgcaggatctcttgctgcttgacgtggcaccactgtctctgggcttggaaacagcaggtggagtaatgactgcacttataaagcgaaactcaaccatccccaccaaacaaactcagatattcaccacctacagcgacaaccagcctggggtcctgattcaggtgtacgagggggaaagggctatgaccaaagataataatttgctgggtcgctttgacttgaccggcatccccccagctcctcggggagtcccacagatcgaagtgacctttgatattgacgccaacggaattctcaacgtcaccgcaaccgacaaatcaaccggcaaagtcaataagatcacaataacaaacgataagggccgccttagcaaagaagaaatagagcgcatggtgctggatgccgagaagtataaggctgaagatgaggtgcaaagggaaaagatcgctgcaaagaatgcattagagtcatacgcctttaatatgaaatctgtggttagcgacgaagggctaaaagggaaaatttctgaaagcgacaaaaacaagattctggacaaatgtaatgagttgctgtcatggttggaggtgaaccaactggcagagaaggatgagtttgatcacaaacgcaaagagctggagcagatgtgtaatccaatcatcacaaaactttaccagggaggatgtacagggccagcttgtggcacaggctacgtgcccggtcgccctgctacgggtccgacaattgaagaggtcgactag

SEQ ID NO: 119580 - DNA, 1599 bp, Artificial Sequence
  Description of Artificial Sequence: Synthetic coding sequence
atggccaccgcgaaaggcattgcaataggaattgacctgggcacaacatactcatgcgtgggggtgttccaacatgggaaagtggaaataattgcaaacgaccaggggaaccgaaccaccccttcttacgtggcttttaccgatacagaacggctgattggcgacgctgccaagaatcaggtcgcaatgaatccacagaacacggtgtttgacgccaaaaggctcattggccggaagttcaatgacccagttgtacaggccgatatgaaactgtggccttttcaggttatcaacgaggggggaaagcccaaagtgttggtgtcctacaagggtgaaaataaagctttctaccccgaggagatttcatccatggtgctgaccaagctgaaggagacggccgaggcattcttgggtcatccagttacgaatgcggtcattactgtgcccgcctacttcaatgattcccaacggcaagccaccaaagacgcaggggtgatcgccggactcaacgtcctcaggataattaacgaacccaccgccgctgctattgcttatggcctggataaagggggacagggcgaacgacatgtgttaatttttgatctgggaggtggcacattcgacgtgtcgatcctaacaatcgacgatggaattttcgaagtcaaagccaccgccggcgatacccatcttggtggtgaagacttcgacaatcgactggtgtcccacttcgtggaggaattcaagaggaaacacaaaaaggacatctctcagaataagcgggccgtgagacgtttgaggacagcgtgcgaacgcgccaagcgcaccttgtcatcttcaactcaggccaacctcgaaatcgatagcctgtacgaaggaattgatttttataccagcatcacccgtgctcgttttgaggaactgtgtgccgatctctttaggggtactctggaacccgtggagaaagccctacgtgacgctaagatggataaggctaagattcacgatatagtgttggttggcggatcaacacgcatccccaaagtccagagattgctccaggactactttaatggccgcgacctgaacaagagcatcaatcccgatgaggcggtcgcctacggagccgctgtgcaggctgccattctgatgggcgataagtccgaaaaagttcaagatctgctgcttctggacgtcgcacctctcagcttgggcctggagacagccggcggcgtaatgaccgccctaatcaagagaaacagtaccattcctacgaagcagacccagatttttaccacatattctgataaccaacctggagtcttaattcaagtgtacgaaggcgaaagggccatgaccaaggataataacctactcggccgattcgatttgaccggtattccacccgctccaagaggtgtacctcagatcgaggtgaccttcgatatcgacgccaatggcattctgaacgttactgctatggataagagcaccggcaaagtgaataagatcaccataacaaacgacaaaggccggttgagcaaggaggagatcgaacgcatggtgctggacgcagaaaagtataaagccgaagatgtgtag

SEQ ID NO: 119581 - DNA, 1599 bp, Artificial Sequence
  Description of Artificial Sequence: Synthetic coding sequence
atggctacggctaaggggatagcaatcggcatcgacctcggcactacttatagctgcgtgggggtttttcaacacggtaaagtcgaaataattgctaatgaccagggtaatcgaactaccccgagttatgtcgcctttaccgacacagagcgactcatcggtgacgctgccaaaaaccaagtcgctatgaatcctcagaatacagtctttgatgctaaaagactcatcggccgtaagtttaacgatccagttgtgcaggcagatatgaaattgtggccctttcaggtcatcaacgaaggtgggaagcctaaagtgctcgtgtcctataagggcgagaataaggctttctaccccgaggagatttcgtccatggtgttgaccaagctaaaagaaaccgccgaagcattcctggggcaccctgtgaccaatgcagtaatcactgttcctgcttactttaacgattctcagagacaagcgacaaaagatgcaggcgtaattgccgggctgaatgtgctgcgaattatcaatgagcccacagccgcagcaattgcatacggactcgacaaaggcggccagggtgagcggcatgtgttgattttcgacttaggaggggggaccttcgacgtaagcatcctgacaatcgacgacggcattttcgaagttaaagcgacagcaggagatacccatctcggcggcgaggactttgacaacagactggtgtcacactttgtggaggagtttaaaaggaaacacaaaaaggatatttcgcagaacaagcgcgccgttcggcggctgcgaactgcatgtgaacgcgcgaagaggaccctcagtagtagcactcaagctaatttggaaattgactccctctatgaagggattgacttttacacctccattacgagagcccgattcgaagagctttgtgccgacctgttccgcggaaccttggagccagtagaaaaagccttaagggatgccaagatggataaagccaagattcacgatatcgtgctagtgggagggagtacccgcattccaaaggtccagaggctcctgcaggactatttcaatgggagggatctcaacaagagcattaatcctgacgaggcggtagcctacggagccgccgttcaggccgccattctcatgggtgacaaatccgagaaagtgcaagacttactgttactggatgtcgctcctttatccctcgggctcgagaccgccggtggggtgatgaccgcattgattaagaggaattccaccattcctactaagcagacacaaatattcacgacgtactctgacaatcagcccggagtgctcatccaggtatatgaaggcgagagggcaatgactaaggataataacctgttaggacggtttgatctcacgggaataccccccgctcctagaggtgtaccacagatagaggttactttcgacatagacgcaaatggtattctcaacgtaaccgccacggacaaaagtacagggaaggttaacaagattactatcaccaacgataaagggagactcagtaaagaagaaattgagcgcatggtattggatgccgaaaaatacaaagctgaagacgtctag

SEQ ID NO: 119582 - DNA, 1926 bp, Artificial Sequence
  Description of Artificial Sequence: Synthetic coding sequence
atggctaccgcgaaaggaatcgctatcgggattgatttgggaaccacctatagctgtgtgggagtcttccaacatggaaaagttgaaataattgcgaatgaccaagggaacaggacaactccgagctacgtggccttcaccgataccgaaaggctgatcggcgacgccgcgaagaatcaggttgccatgaacccccagaacactgtgttcgacgccaagcgtctcattggcagaaaatttaatgatcctgtggtacaggctgatatgaaattatggccatttcaagtaatcaatgaaggcggaaaacccaaggtgctggtgtcctacaaaggggaaaacaaggccttctaccccgaggaaatttcctccatggtcctgacgaagcttaaagaaaccgccgaggccttcctgggacaccccgtgaccaatgcagtgatcaccgtgcctgcgtacttcaacgattcacagagacaggccacgaaagatgctggtgtgatagccggcttgaacgttctacgcatcattaatgaaccaaccgccgcggctattgcatacggtctagacaaggggggtcaaggggaaaggcatgtgctaattttcgacttagggggcgggacatttgatgtgtcaatattaacaatagatgatggcatcttcgaggtcaaggctacagcaggagacactcacctgggtggggaggacttcgataatcggcttgtaagccacttcgtagaggagttcaaaagaaagcataaaaaggacatctcccagaacaagagagccgttcggcgcttgcgcacggcctgcgaaagagctaaacgcacattgagttcaagtacccaggcgaacctggagattgactctctgtacgaggggatagatttctacactagcattactcgggctcgctttgaagagttgtgcgccgatttgttcaggggaacccttgaaccagttgagaaggctttgagggacgccaaaatggacaaagctaagatccacgacatcgttctagtgggaggttctacccgtatccctaaagtgcaacgcttgttacaggactactttaatgggcgcgacctaaataagtctatcaaccctgatgaagcagtagcttatggcgcagcagtgcaggctgctattttaatgggcgacaaaagcgaaaaggtccaggacctgctcctgctcgacgtagcgcctttatcactggggcttgaaacagctgggggagtgatgaccgcgctaattaagcggaacagcacgattcccacgaaacagacccagattttcacaacctattcggataaccaacctggcgtcctgatccaagtatacgagggggaacgggcgatgacgaaggataataatctgctgggaagattcgatctcacaggtatcccccctgcccctaggggcgtgccacagatcgaagtgaccttcgacatcgacgcaaacggcatcctcaacgtaactgcaatggataagagcactggtaaagtcaacaagataactatcaccaacgacaaagggcgcctgtctaaggaggaaatcgaaagaatggtgcttgacgccgagaaatacaaagcggaagacgaggtccagagggagaaaatcgccgcaaaaaacgcactggaatcctacgcatttaatatgaagtcagtggtatccgatgagggactcaagggtaaaattagtgagagcgacaaaaacaagatccttgataagtgcaacgagttactctcatggctcgaggtgaatcagttggcagagaaggacgaattcgatcacaagagaaaagagctggagcagatgtgcaacccgattatcacgaagctttatcagggcgggtgcaccggtccagcatgtggtactggatacgtgcctggccggccggcgaccggaccaacaatcgaggaggtggattag

SEQ ID NO: 119583 - DNA, 699 bp, Artificial Sequence
  Description of Artificial Sequence: Synthetic coding sequence
gcaaaaggtattgccatcggcatcgacctcggtacaacctacagttgcgtcggagttttccagcacggaaaagttgaaatcatagctaatgaccagggcaacagaacgaccccctcatacgtggccttcaccgacacagagaggttgattggcgatgcgggggtcatcgccggattgaacgtactccgcatcatcaatgaacctacagcggctgcaattgcatatggtctggataagggaggccagggggagcggcatgtgctgatatttgacctgggtggagggacattcgatgtgtcaattttaaccattgacgatgggatcttcgaggtgaaggccactgccggcgacactcatcttggcggtgaggactttgataatagacttgttagccacttcgtagaagaattcaagcgcaagcacaagaaggacatttcacagaacaagagggctgtgaggcggttaagaacagcctgtgagagagccaagcgcacactttcttctagcacacaagccaatttggagatcgattcgctgtatgaggggatcgacttctatacaagcatcacacgggcacgcttcgaagaactgtgtgctgacctgtttagaggtactctggagcccgtggagaaaggtgcgccccctgcctctcccaggtgctccggatgttttcgcaccacctcaatggacgttatatag

SEQ ID NO: 119584 - DNA, 699 bp, Artificial Sequence
  Description of Artificial Sequence: Synthetic coding sequence
gccaaaggcattgccattggcatcgacctcggaactacttactcctgcgtcggagtattccagcacgggaaagtggaaataatcgcaaacgaccaaggtaacagaacgactccatcatatgtggcgttcactgacacagaacgactgatcggcgacgcaggcgtgatcgctgggctgaatgtcctccggattatcaatgaacctacagccgccgccatcgcatatgggctggataagggagggcagggagagcggcatgtgcttatttttgacctcggtggcgggactttcgatgttagcatcctgactatcgatgacggaatcttcgaggtgaaggctaccgctggcgatactcatctcgggggtgaagacttcgacaatagactggtgtcccattttgtcgaagagttcaagcgcaaacataagaaagatattagccagaataagcgcgctgttagaagactgagaaccgcttgtgaacgggcaaagcgtactttgtcttcctcgacacaggctaatttggagatcgactctctgtacgaaggcattgacttctataccagcattactagagcgcggtttgaagagttgtgtgccgatctgttcaggggcaccttagagcctgtcgagaaaggggcaccgccggcctcaccaagatgctctggatgctttcggaccactagtatggacgtcatttag

SEQ ID NO: 119585 - DNA, 1926 bp, Artificial Sequence
  Description of Artificial Sequence: Synthetic coding sequence
atggctactgccaaggggatcgccattggtatagatctcgggactacttatagttgtgtgggggtttttcagcacggcaaggttgagatcatcgccaacgaccagggcaacagaaccactccatcttatgtcgcgtttacggacaccgagagactgattggagacgctgccaagaatcaggtcgctatgaacccccagaacaccgtattcgacgccaaacgccttattggccgcaagtttaatgacccagtggttcaggcggacatgaaactttggccttttcaggtgatcaatgagggtggaaaacctaaggtcctggtgtcatataagggggaaaacaaggccttttatcccgaagagatttcgtcaatggtgctgacaaagctgaaggagactgccgaggctttcctgggacacccagtcacaaacgcggtcatcacagttcccgcttactttaacgattcacagagacaggcaaccaaggacgccggtgtgatcgccggcctgaacgtgctgaggatcataaacgagcctacagcggctgccattgcctacggcttggataagggaggacagggcgaacggcacgtgctgatctttgatctgggcggggggaccttcgacgttagtatcctcaccatagatgacggcatatttgaggtcaaagctacagccggagatacccacttggggggtgaagacttcgataatcgactggtgagccattttgtcgaggagttcaagagaaaacacaagaaggatatcagccaaaataaaagagctgttcggcgactgcgtaccgcttgcgagcgggcgaaaagaacgctgtcaagctccacccaggctaacctagagattgatagtctgtacgagggaatcgacttctacacctccatcacccgcgccaggttcgaagaactgtgtgcagacctttttagaggtaccctcgagcccgtggagaaagccctgagggatgctaaaatggacaaggctaagatccacgacatagtactcgtgggcgggagtacacggatccccaaagtccagcggctactacaagattattttaatggccgggatctaaataaaagcatcaacccagatgaggcggtagcctacggagctgctgtgcaggcggctatcctgatgggcgataagagcgaaaaggtccaggaccttttactgctagatgtcgcaccattgtcactagggttagagactgccggtggagttatgacggctctgattaaacgtaatagcacgatcccaacaaagcagacacagatttttacaacatacagcgataatcagcctggcgtgctgattcaggtgtacgagggggaacgcgctatgacaaaagacaataatttactaggaaggtttgaccttacaggcatccctcctgccccaaggggggtcccacagatcgaagttacctttgatatagacgctaatgggatcttgaatgtaacggccatggacaagagcacgggcaaagtcaataagatcaccataactaatgacaaaggacggctcagcaaagaagagattgagagaatggtgttagacgctgagaaatataaagcagaggacgaagtccagcgggaaaagattgccgccaagaatgctctggagagttatgctttcaacatgaaatccgtagtgagcgatgaaggactcaagggcaagatatccgagagcgacaagaataagattctggacaaatgcaacgaactcctttcctggctggaagttaatcagctcgccgaaaaggatgagttcgaccacaagcggaaggagctagagcagatgtgtaaccctatcatcacaaaactgtatcaaggaggctgtaccggcccagcctgtggaaccggatatgtgccggggcggcccgcaacaggtccgactattgaggaagttgattag

SEQ ID NO: 119586 - DNA, 1920 bp, Artificial Sequence
  Description of Artificial Sequence: Synthetic coding sequence
atgagtgcacgcggtccggccatcggcatcgacctgggaacaacatacagctgcgtcggggtattccagcatggaaaagtggagatcattgccaatgaccagggcaacagaaccacaccctcatacgtggcattcacggataccgaaaggctgatcggagacgctgccaagaaccaggtcgctatgaatccaacgaacacaattttcgacgcgaaacgcctgataggccggaaatttgaggatgctaccgtccagtctgacatgaaacattggcctttccgtgtggtgtctgaaggcggcaaaccgaaagtacaggtggaatacaaaggtgaaactaaaacattctttcccgaagagattagcagcatggttctcacaaagatgaaagaaatagccgaagcatatctgggaggaaaggtgcatagcgccgtaatcacagtgcctgcgtactttaacgactcacagcggcaggctactaaagacgccggcacaatcactgggctcaacgtgcttagaattatcaacgaacccactgcggccgctatcgcgtacggtctggataaaaaggggtgcgcgggaggtgaaaaaaatgttttgatcttcgatctgggcggtggtacgttcgacgtgtctattctcacaattgaggatggtattttcgaggtaaagtccacagctggagatacacatcttggcggggaggacttcgataacagaatggtatcccatctggctgaagagttcaaacgaaaacataaaaaggatatcggacccaataagcgggccgtgaggaggctgagaaccgcctgcgagagggcaaagcggaccctaagtagttccactcaggctagcatcgagattgactccctgtatgaaggagtggatttctataccagtatcacccgcgctcgatttgaggagctgaatgctgacctgtttcgagggacactagaacccgtcgagaaagcactgagagacgccaagctggataaaggacaaatccaggaaatcgtgctggtgggtggcagcacgcgcatcccaaagattcagaaattactgcaggatttttttaacggaaaggaactgaataagagcatcaatcctgacgaggctgtcgcatacggtgctgctgtccaggctgctatactgatcggcgataaaagcgaaaatgttcaggacctcctgctgctggatgtcacccccctcagcctgggtattgagacagcagggggggtcatgactcccctgatcaaaagaaacacgactatcccaaccaagcagacccagacttttaccacctattctgacaatcagagctctgtgctcgttcaagtctacgagggtgagagggccatgaccaaggataacaacctcttaggcaagttcgatttaacaggcatcccccctgctcctagaggtgtgcctcaaattgaggtgactttcgacatcgacgctaatggtatcctgaatgtcactgcagctgacaaaagcaccggaaaggaaaataagatcaccatcacaaacgacaaaggacgtctgtccaaagacgacatcgacagaatggtccaagaagcagaaagatacaagtccgaggacgaagcaaacagagaccgggtggctgcgaaaaacgcgctcgagtcttacacctataacattaaacagactgttgaagatgaaaaacttagaggtaagatttccgaacaggataaaaataagattttagataagtgccaggaggtgattaattggctggatcggaaccagatggctgagaaagatgagtatgagcacaaacagaaggaactggagagagtgtgtaatccaatcatctctaagctatatcaaggagggccgggcggcggctcaggggggggtggaagtggcgctagtggcgggccaacaattgaagaggtcgactag

SEQ ID NO: 119587 - DNA, 1920 bp, Artificial Sequence
  Description of Artificial Sequence: Synthetic coding sequence
atgagcgcaagggggcccgccatcgggatcgatctgggaaccacttactcctgcgtaggagtctttcagcacggaaaggtggagataattgccaatgatcaaggaaatcggaccaccccatcctacgtagcattcaccgacactgaaagactgataggggatgctgccaaaaatcaggtcgctatgaacccaaccaacacaatattcgacgccaaaaggctcatcgggaggaaatttgaggacgccacggtacagtctgacatgaagcattggccctttagggtagtctcagaagggggaaaacccaaagtgcaggtggaatacaaaggcgaaaccaaaacattctttccagaggagattagctctatggtcctcactaagatgaaagagatcgccgaggcctacctcgggggaaaagtccactcagcagttatcaccgtccccgcctattttaatgacagtcaaagacaggcaactaaggatgccgggacaatcaccgggctgaatgtgttaaggatcattaatgagcctacagcagccgccattgcttacggtctagataagaaaggttgcgccggcggcgagaagaatgtactgatttttgacctcggcgggggaactttcgatgtttccatcctgaccattgaggacggcatattcgaggtgaaaagcacagcaggagatactcacctgggaggcgaagactttgataacagaatggtctctcacttggccgaggaatttaagcgcaagcataaaaaagatatcgggcctaataaacgcgcggtgagacgcttgcgaacagcatgcgaacgggctaaacgcacattaagttcatcaacccaggcatccatcgagatcgacagcctctatgagggcgtggacttctacacatcaatcacacgggcccgcttcgaagaactcaacgccgatcttttcagaggaaccctggagcccgtcgagaaggcattacgggatgctaaactggataaggggcaaatacaggagattgtgctcgtagggggctccactagaatacctaaaatccagaaacttttgcaagacttttttaatggaaaagagttgaataaatcaatcaatccagatgaagcagtggcctacggtgccgctgtgcaagctgctattctcataggagataagagtgaaaacgtccaggacctcctgttgcttgacgtgacacctctctcactgggcatcgagactgccggcggagtcatgacacccctgatcaagcgcaacacaacaatccccactaaacagactcagacctttaccacttattcggacaatcagtcatccgtgctggtccaggtatacgagggtgagcgagcaatgacaaaggataacaaccttcttggcaagttcgaccttacgggaattccacctgccccgcgcggcgttcctcagatagaggtcaccttcgatattgacgccaatggaatcctgaacgtcacggcagccgacaagtccacagggaaggagaacaagatcacaattacaaacgacaagggcaggttgtccaaggatgatatagatcgcatggtgcaggaggccgaacgttataagtcagaggacgaggcaaacagggatcgcgttgccgcaaaaaatgcgctggagagctacacatataacatcaagcagacagttgaggacgagaagctgcggggcaaaatctctgaacaggacaaaaacaaaatcttggacaagtgtcaggaagtaattaactggttggatcgcaatcagatggctgagaaagatgagtacgagcacaaacagaaagagttggaaagagtctgtaatcccataatctctaaactctaccagggcggacccggcgggggatcaggcggtggcggcagcggggctagcgggggaccaactattgaagaagttgattag

SEQ ID NO: 119588 - DNA, 1242 bp, Artificial Sequence
  Description of Artificial Sequence: Synthetic coding sequence
atgtctgctcggggccccgcaatcggaattgacctcggcactacatacagctgtgtgggcgtcttccagcacggtaaagtcgaaataatcgctaacgatcagggcaataggactaccccaagctacgtcgctttcacagatactgaacgcctgattggagatgctgccaagaaccaggtcgccatgaatcctacgaataccattttcgacgctaagaggctaatcgggcggaaatttgaagagctcaacgccgatctgttccgcggtacccttgagccagtcgaaaaggctcttcgagacgccaagctggataagggacagatccaggaaatagtgttagtcgggggctctacgcgcatccctaaaattcagaagctgttgcaggacttctttaacgggaaggaattaaacaagtcaatcaatcccgacgaagccgttgcctatggagccgcggtacaagcagcaatactcatcggagataaatcagaaaatgtgcaggatcttctcctgctggacgtgacaccactgagcctgggtatcgagaccgccggcggagtcatgacccctctgatcaagcgaaatacgactatcccaactaagcaaacgcaaacgtttactacctattcggataaccaatccagtgtactggtgcaggtgtatgagggagagcgagctatgactaaagacaataacttgctggggaaatttgatctcaccggcatcccaccggccccacgaggcgtgccgcagattgaagttacatttgacattgacgcaaacggaatcctcaacgttaccgccgctgataaatctactggaaaggaaaacaagatcaccatcacaaacgataaaggacgcctttctaaggacgatattgacagaatggtgcaagaagctgaaaggtacaagagcgaagacgaggcgaaccgcgatcgggtcgccgctaagaatgccctggaaagctatacatacaatatcaagcaaactgtcgaggatgaaaagctccgcgggaaaatcagcgaacaggacaaaaataagatccttgacaagtgccaagaggtgattaactggctggacagaaatcagatggccgaaaaagatgagtacgagcacaagcagaaggagcttgaacgggtgtgcaatcccatcataagcaagctttatcaggggggcccaggcggggggtccggaggcggaggctcgggtgcatcaggggggccaaccatcgaagaggtggattag

SEQ ID NO: 119589 - DNA, 2523 bp, Artificial Sequence
  Description of Artificial Sequence: Synthetic coding sequence
atgagtgtggtggggattgatttagggttccagtcttgctatgtggctgtcgccagggcaggtgggatcgaaaccatcgcgaacgagtattcagatagatgcacgccggcctgtattagcttcggtccaaaaaatcggtcaatcggggcagcagctaagagccaagtgatatcgaatgctaagaacacagttcagggcttcaagcgtttccacggccgcgccttttccgacccgttcgtggaggcggaaaagtccaatctcgcttacgatattgtacagctgcctaccgggctgacaggaatcaaagttacatacatggaggaggaacggaactttacaaccgagcaggtcacagccatgcttctgtccaagctcaaagagacagctgagtccgtcctgaagaagcctgttgtggactgcgtggtgagcgtcccctgcttctacacagacgccgaaagacgaagcgtgatggacgccacacaaatcgcaggcttgaattgccttaggcttatgaacgagacaacagcggtcgctctggcttacggaatctataaacaagatttaccggcattggaggaaaagcctcgaaacgtcgtgttcgtcgatatgggtcacagcgcgtaccaggtatcagtatgtgccttcaacaggggtaaattgaaggtgcttgctacagccttcgatacaaccctgggtggccgaaagtttgatgaggtcttggtcaatcacttttgcgaggagtttgggaagaagtacaaacttgacattaaaagtaaaataagggccctactccgcttgtcccaggaatgcgagaagctcaaaaagctcatgtccgctaatgcttctgatctcccattaagtattgagtgcttcatgaacgacgtcgatgtgagtggcacgatgaaccggggcaagtttcttgagatgtgcaacgatctgctcgcgagagtagagccaccgttacgcagtgtacttgaacagactaaattaaaaaaagaagacatctatgccgtggagattgtggggggggccacccggatacctgccgtgaaagaaaaaatcagtaagttttttggtaaggagctttccactaccttgaatgctgacgaggccgtgacgagagggtgtgctctgcagtgcgccatcttgtcaccggctttcaaggtgcgagagttttccatcactgacgtcgtcccgtatcccattagcctcaggtggaacagtcccgccgaagaaggaagtagcgattgcgaagtgttcagtaagaatcatgccgccccgttttctaaagtgttgacattttaccgtaaggagccatttactctggaagcctattattcatcaccgcaggacttgccgtatccagatccagccatcgcgcaattttccgtccagaaggtcacaccacaaagtgatggaagcagtagtaaagtgaaagtgaaagtcagagtgaacgtccatggcatattcagtgttagctcagccagcttggtcgaagtgcataagtccgaggagaatgaagaacctatggaaaccgatcagaatgccaaggaagaggagaagatgcaggtcgaccaggaggaacctcacgtggaggagcagcagcagcagacccccgcagagaacaaggctgagtccgaagaaatggaaacctcccaagctggttcaaaggacaagaagatggatcagcccccccaggccaagaaggccaaggtgaagacttcgaccgtggacctgcctattgaaaatcagcttctatggcagatcgatagagaaatgctgaatctgtacatcgaaaacgagggaaagatgataatgcaagacaagctggagaaggagcggaacgatgccaagaacgcagtagaagagtacgtgtatgaaatgcgagacaaactgtctggggagtatgagaagttcgtgagcgaggatgacaggaactcgttcacactcaagctcgaagatacagaaaactggctgtatgaggatggtgaagaccagccaaagcaggtgtatgtggataagctcgcagaactgaagaatcttggtcagccgattaagatacggtttcaggaatcagaggaaagaccaaagctgtttgaggaactgggcaaacagatccagcagtatatgaagataatcagcagcttcaaaaataaggaggaccagtacgatcacctggatgcagctgacatgacaaaggttgaaaaatctaccaatgaggccatggagtggatgaataacaagctcaatctacagaacaagcaatccctgacaatggatcccgtcgtgaagtccaaagaaatcgaagcgaaaataaaggagctgacgagcacttgctccccgattatcagtaagccaaaacctaaggttgagccccctaaagaggagcagaaaaacgccgaacagaatggcccggtggatgggcaaggggataaccccggtccccaagccgccgagcagggcactgataccgctgtccccagcgatagtgacaagaaactaccagagatggacatcgactag

SEQ ID NO: 119590 - DNA, 447 bp, Artificial Sequence
  Description of Artificial Sequence: Synthetic coding sequence
atgtctgtggttgggattgatctcggctttcagagctgctatgtcgccgttgcccgcgcaggcggcatcgagaccattgcaaacgaatactccgataggtgcacgcctgcttgtataagcttcggcccaaagaatcgtagcataggggctgctgccaaatctcaggtgatctccaatgccaaaaacacagtccagggcttcaagcgctttcatggaagagccttctctgatccctttgtggaggccgaaaagagcaacctcgcgtacgacatagtgcagctgccaaccggcctgaccggtatcaaagtgacttatatggaagaggaacagaacggacctgtggatggacagggcgataacccggggccacaggctgctgaacagggcacggataccgctgtgccaagcgactcggacaagaaactgcctgagatggatatcgactag

SEQ ID NO: 119591 - DNA, 1422 bp, Artificial Sequence
  Description of Artificial Sequence: Synthetic coding sequence
atgagtgtcgttggtattgatctaggattccagagttgctacgtggcggtggcaagagcaggaggcatcgaaacaatagctaacgagtattctgatagatgcacgcctgcctgcatctcctttgggcccaaaaatcgaagcatcggggcagccgccaaaagtcaggttatatcgaacgccaaaaatactgttcagggttttaaaagattccacggccgcgctttcagcgacccgttcgtcgaagccgaaaagtctaatttagcatatgacatcgttcaactacccacgggactaaccggcatcaaggtgacttatatggaggaggagagaaatttcacgacagaacaagtcaccgctatgcttcttagcaagctgaaagaaaccgcggaatccgtgctaaagaagccagtcgttgactgcgttgtttccgtgccctgcttttacactgacgctgagcgacggtccgttatggatgcaacccaaatcgccgggctcaattgcctgcgactcatgaatgagactaccgccgtcgctttggcatacggtatctataagcaggatctccccgcactggaggagaaacctaggaacgtcgtatttgtggacatgggacactctgcttatcaagtctccgtctgtgcgtttaacagaggcaagctgaaggtactcgcgacagcctttgacacaacacttggaggaaggaagtttgacgaggtgctagtaaaccatttttgcgaagagttcggcaaaaaatataagctcgacatcaagagtaagatcagggcacttctgcgactgtctcaggagtgtgaaaagttaaagaaactcatgagcgccaacgcctcagatttgcccctgtccattgaatgctttatgaatgatgtcgacgtgtcgggcaccatgaacaggggaaagttcttagaaatgtgcaatgacctgctcgctagggtcgagcccccccttagatccgtactggaacagactaaacttaaaaaagaggatatctacgctgtcgagattgtaggcggggcaactcgcattccggcggtgaaggagaaaatatctaaatttttcgggaaggaactatccacgaccctgaatgccgacgaggccgtcacaagagggtgtgccctccagtgtgccattctgtctcctgccttcaaggtgagagaattttccatcacagatgtagttccttacccaatatccctgagatggaacagtcctgcagaggagggtagctcagattgtgaggtttttagcaagaatcacgccgcaccgttctccaaagtgctgacattctataggaaggagccctttacacttgaggcctattattccagccctggattcgcactctcaagatcttgttatagcattatcaagagcctcctgagcctgatggcccccgtgcagaaatag

SEQ ID NO: 119592 - DNA, 1965 bp, Artificial Sequence
  Description of Artificial Sequence: Synthetic coding sequence
atgaagctatctttggtggcggcgatgttgctgctgctatccgcggcacgcgctgaagaagaggacaagaaagaggacgtggggaccgtcgtcggtatcgacctggggaccacttattcctgcgtgggagtctttaaaaacggtcgggttgagatcattgcaaacgatcagggcaacaggatcactccatcatacgttgcctttacacccgaaggggagagactgattggagacgccgcaaagaatcagcttacctcaaacccggaaaataccgtattcgatgctaagcggcttatcggaaggacctggaacgatccaagtgtccagcaagacattaagtttctaccctttaaagttgtcgagaagaagaccaaaccatatattcaggtcgacatcgggggagggcagacaaaaacatttgcgccagaagagatcagtgccatggtcctgaccaaaatgaaagaaacagccgaggcttatttagggaagaaggtgactcacgctgtggtgaccgtcccagcgtatttcaatgatgcgcaacggcaggcgaccaaagacgctgggaccattgccgggctgaacgtgatgcggatcattaacgaacctacagctgctgctatcgcctacggactcgataagagagagggcgagaaaaatattttggtcttcgacctgggaggaggtacttttgatgtctctcttctcaccatagataatggggtgttcgaggtcgtggccaccaatggggacacacatctgggaggagaggacttcgaccaaagagtgatggaacacttcattaagttgtacaagaagaagacgggaaaggacgtgagaaaggacaacagagctgtccaaaaactgcggagagaagtggagaaagcaaaacgcgctttaagctctcaacaccaagcccgaattgaaatcgaaagtttttacgagggagaggatttctccgagacattgactagagcaaaatttgaggaactgaacatggacctcttcaggtctacgatgaagcctgtgcagaaagtgctggaagacagcgacctgaagaagagtgatattgacgaaatcgtactggtcggcggctccacacggatcccgaaaatacagcagctcgtcaaggaattctttaatggtaaagaacccagtagaggcattaacccggatgaagccgtagcctacggagccgcggtccaggccggggtcttgtccggtgatcaggacaccggggatctcgtgctgttggacgtctgccccttgacgctgggtatagagactgtagggggtgttatgaccaaactgatacccaggaacaccgttgtgcccaccaaaaagtcacaaatattctccactgcgtcagataaccagcccacggtaaccattaaagtgtacgagggtgaaaggccactgaccaaagacaatcacctactgggcaccttcgatctgacaggaatcccccccgcaccccggggtgtacctcaaatcgaggtgacattcgagatcgacgtcaacggaatcctgagagttacggcggaggacaaggggaccggaaataaaaacaagatcaccattactaatgatcaaaatcgactcactcccgaagaaatagagaggatggtgaatgacgctgaaaagtttgccgaagaggataaaaaattgaaagagagaatagacactagaaacgaactggaatcctacgcctattccctgaaaaaccagatcggagacaaagagaagcttggcggaaagctctctagcgaggacaaggagaccatggagaaagcagtagaggaaaagatagaatggctggaatcacaccaggacgctgacatcgaggattttaaagcgaaaaagaaagagcttgaagaaatcgtgcagccaattatcagcaagctctacggttccgcgggcccccctccaaccggcgaagaagacacagctgagaaagatgagctttag

SEQ ID NO: 119593 - DNA, 837 bp, Artificial Sequence
  Description of Artificial Sequence: Synthetic coding sequence
atgaaactaagcctggttgccgccatgctcctgctgctgagtgctgctcgagccgaagaagaggataaaaaagaggatgtggggacagtagttgggatcgatttaggcaccacctactcatgcgtgggagtcttcaaaaacgggcgagtggagattatcgccaacgaccagggtaatcgaattactccatcatacgtggcctttacgccagaaggcgagcgtctgatcggggatgcagccaaaaaccagttgacgtctaatcccgagaataccgtatttgacgcaaaacggctaatcggccgaacctggaacgatccctcagtccagcaggacattaaattcctaccctttaaagtcgtggaaaagaaaactaaaccatatatacaggtggacattgggggaggccaaacgaaaacatttgccccggaagaaatctccgctatggtgctaacaaagatgaaggaaactgctgaggcctacctcggtaagaaagtgacgcatgcggttgtgacagtccctgcctactttaacgacgctcagcggcaggctactaaggatgctggcaccatcgcagggttgaacgtcatgcgtatcatcaatgaacccacagcggccgcaatcgcctatggactggataaaagagagggggagaaaaacattctcgtgtttgaccttggcggcgggacattcgacgtgtctctgctaacaattgacaacggtgttttcgaagtcgtggcgaccaacggagatacccacttgggaggagaggacttcgatcaaagggtgatggagcacttcatcaaactgtacaagaaaaaaactttcctgcgaccctag

SEQ ID NO: 119594 - DNA, 1932 bp, Artificial Sequence
  Description of Artificial Sequence: Synthetic coding sequence
atgcaagcccccagggagctggccgtaggcattgacctgggcaccacgtatagctgcgtaggtgtctttcagcagggccgcgtggaaattctggccaacgatcagggcaacagaaccactccctcgtacgtggccttcacagacacagagcggctggtcggagatgcagctaaatcccaagccgctctcaatccccataacaccgtcttcgatgcaaaaagactgattgggcgcaagttcgcggatactaccgtgcaaagcgatatgaagcactggccattcagggtagtctccgagggcggaaagcccaaggttcgcgtctgttaccgcggtgaggataagacattctaccctgaagaaatttcaagcatggtcctcagcaagatgaaagaaacagccgaggcgtatctgggccagcccgtcaaacacgcagtcatcaccgtcccagcctattttaacgattcccagcggcaggcaaccaaggatgctggcgctatagccggactgaatgtgctgcgaatcatcaatgagcctacagccgctgcaatagcctacgggttggaccgaaggggggccggagaaaggaacgttcttatatttgatttgggtggcggaacattcgatgtgagcgtgctatcaattgatgccggcgtctttgaggtgaaagccactgcgggggacacacacctgggcggcgaggacttcgacaatcgtctcgtcaaccactttatggaggaattcaggagaaagcacggcaaagatctctctggaaacaagcgcgccctgaggcgcttgcggactgcatgtgagagggcaaagcgtacactgtcatccagtactcaagccactttagagatagatagtctcttcgagggagtggacttctacactagcataacgagagctcgtttcgaagagctatgctcggacctctttcggtccactttggaacctgtcgagaaagcattacgggacgcaaagctggacaaagctcagatccatgatgtagtgcttgttggaggtagcacaaggatcccaaaggtacagaagttattgcaggactttttcaacggcaaggagttaaacaaatcaatcaaccctgatgaggcggtggcctacggggcagccgtgcaggctgccgttctgatgggagacaagtgtgagaaggttcaggatttactgcttttggatgtcgcacccctctcccttggactggagactgctggaggggtgatgaccactttgattcaaagaaatgcaaccatcccgacaaagcagacacaaacttttactacctactccgacaatcagccaggggtgttcatccaggtgtatgaaggcgagagagctatgacaaaagacaataatcttctggggaggttcgagctgtcgggcattcctcccgcacctagaggcgtaccgcagattgaggtaacgttcgacatcgatgccaacggtattctttctgtgactgcaaccgatagatcaactggaaaagctaacaaaataacgatcaccaacgacaagggcagactgtcaaaggaagaggtggagcgcatggtccatgaagccgaacagtataaggcagaagatgaggctcaaagggaccgggttgccgcgaaaaacagtctggaagctcacgtgtttcatgttaaaggttctctgcaggaggaatcactgcgtgataagatccctgaagaagatcgccgtaaaatgcaggataagtgtcgggaggttcttgcttggctagaacacaaccagcttgcagagaaggaagagtatgagcaccagaagcgggaactggagcagatttgccggcctattttttcaaggttgtacggaggacccggcgttcctggcggatccagctgcggaacccaagccaggcagggagatccatctaccggccccattatcgaggaggtggattag

SEQ ID NO: 119595 - DNA, 1860 bp, Artificial Sequence
  Description of Artificial Sequence: Synthetic coding sequence
atgcaggccccaagagaactggcagtgggtatcgacctcggcacgacatatagttgtgtcgcctttaccgatactgagagactcgtgggcgatgccgcgaagtctcaggccgcgttgaatccacacaataccgtctttgacgcaaagcggctgatcgggaggaagttcgctgacacaaccgtccagtcagatatgaaacactggcctttcagagtggtcagcgaagggggcaagcccaaagtccgtgtgtgctacaggggcgaggacaagaccttctatcccgaagagatcagctccatggtgctgtctaaaatgaaggaaactgctgaagcctatttaggccagccggtgaaacatgctgtcatcaccgtgcccgcatatttcaatgattctcaacggcaggctactaaagatgcaggagcaatcgcaggactaaatgttctgcggatcatcaatgagccaaccgctgcagctatagcatacggattagaccgccgcggggcaggagagaggaacgttctaattttcgacctgggggggggcactttcgatgtgtctgtcttgtctatagatgccggcgtgtttgaagtcaaggccactgcaggtgacacacatctaggcggggaggatttcgataataggctggtgaatcactttatggaggagttccgtaggaaacatgggaaggatctttccggtaacaaacgcgccctcagacggctgagaacagcgtgtgagcgggctaagcgcacactgtcttcgagcacacaagctacactggaaatagatagcttgtttgagggagtagacttctacacatctataacgagagctcgcttcgaagagttgtgttccgatcttttccgcagcacactggaacccgttgagaaagcactccgagacgcaaaactggacaaggcccagattcacgacgttgtgctggtagggggctcgactcgaatcccgaaagtccagaaactcctgcaggactttttcaatggcaaggagctcaataagtcaatcaaccctgacgaggccgtggcatacggagccgcagttcaggcagccgtgctaatgggcgataagtgtgagaaagtccaggatcttctgctgttggatgtggctccattgtcattaggcttagaaactgccggcggcgttatgactacactgattcagcgcaacgccaccatacctacgaagcagactcaaacattcaccacgtatagcgataaccagcctggtgtgtttatccaggtgtacgagggtgaaagggcaatgacaaaggacaacaatctgctgggccgctttgagctgtctgggatcccccctgcccccagaggtgtacctcagatcgaggttacttttgatatcgacgccaacgggatcctgtctgtgactgctacagataggtctacgggaaaagctaacaaaataactatcactaacgataaggggcggttaagcaaagaggaagtggaacgtatggtccatgaggcagagcaatataaggccgaggacgaggcccaaagagaccgggtagcagccaaaaatagcctggaggcacacgtgtttcatgttaaaggttcattacaggaggaatcactccgagacaagataccagaggaagacaggcgcaaaatgcaggacaagtgcagggaggtgcttgcatggctcgaacataaccagctggccgaaaaagaagagtatgaacaccagaagcgggaactggagcaaatctgtagaccaattttcagtagattgtacggcggcccaggtgtcccaggggggagctcatgcggaacacaggcccgccagggagacccgtcgacaggccccatcatcgaggaagttgattag

SEQ ID NO: 119596 - DNA, 2337 bp, Artificial Sequence
  Description of Artificial Sequence: Synthetic coding sequence
atgtccaaaaggaagttgattcccaaactctctattcagtccccagtgctgcataccaacttgaacgtgcagagtacacatccaccactaaagaaggaagacctccatcgcatctccaaagacagtctggagagcgacagcgagagcctgacccaggagattatgtgtcacagcgaatttgatgacaggatccgtggtaatggtatggagcccgattcacttgacgaagaggagtctccaaggtggggctctctacacgagatggaggaggaagcttctggcaaagcagcccagatggctagagagcagaatcatcacacttgggatcaaggtgcgaacaatcgccagcagccgatcgaggacaagtactcagatttgcgctacgatcccaattggaaaagcaagaaagaggagggccagttactgtctgtcgaagctcttccggagtccaccgattcaagtctggaaaacttgccacttgctcctctttacccctctcaggagacctcgatggaattgagtgggggtaaaggcgaacagaaggagtccccccagagtgctgcatccctcctaggctcagagtttctcagcccgaactacgagcatggggcccgaaggtctaaaccgtttagcgaattaagtgatagtgacctggaagagaagagcagttctcttagcccgtatgttaagagttcttcgtctcataatgaggtcttcctgcccggatcccgtggtcccaggcggaggaagtcaaagcagcactttgtagaaaaaaacaagctgactctcggactacccacccctaaaaccgatagttacttgcagctgcacaataagaagcggggtgagtcccacccagaacagatttcctatcccgtgcgagttaccgacaaaacttccattcaaaatgcaaaggagatggaaaatgcggcaattgatcctgaggataaatggcatcagagggctcagcagctgaagaactatcaggagcattggtcacagtacgagagcaccaaatcctctaatgtacctcggggtcagcccagtgacatggtaaatgaccaccagccttctaggaggcccgcaaagctgaagatccggaagcaatgcaaacatcaaaacgggctcaaatcctcgactacagaagaagtgacagcaagtcagggaaaccaaaataacccacctcgacaacagcagaatcagaataaaccccttgataccagtacaaaaccagagagcatcgtaatcatgcacgcgtctaacaatgacgttcaggcttccagggccctgcggagccacaacctgaaggagacctcaaacactttcgcgccgcctaaacaggcattcgacaaggtgctaagtaaaaactcaactgggtgcgacagtggcttgaacgttaacaaagaaaggggacacaaggaccaggaggagaagaggttcagctaccagcagctccacaccctaagcgatatggacctgaataatctgaacgagttgtccaagcggcacgtgctactttcccagaagggttcccagttcgtgtaccacatcaatacacacggatcaacgaaaaacaagaaacaactgaagcaaccatatacagagacgaagtaccgaaacctggagatgctgtggaaattccattcatctagtgattctcaaaccgttagggccagtccagactcatggttaacccaaattatggaacagcatcagcaggcccttgtgcagctgaccgacgtgcagccctctgagggggctcttagctccgtaaccttaccacctatactttcacgagtggagagtgaaagtcaactcagctctgagcgttctcagcgaaaccaggtgaagattagcagatctaacagcgagggttatctcttccagctggagaagggcaagaaacataagaagcgttcctccagtaagaacactaagctcaaaggctatcagaaacgagacgttaagctgggtggattgggcccagatttcgaaagtattcgcgacaagacccagaaattaatccagcagaaagaatatgctaaacaggtcaaagagtacaacatgaagaccttgtctattcttagtaagccacagaccgagaagactcaaaagaagtctgctatcccacgtcagaaggctctggaatatgccaagacaatccccaagccgaaacccagcaacctgacccatcaggcctccaaagagcagaagaaccccacatatgcaggtaaggaagagtcgttacctgaaatatctctcctcgagattcttcagaaccgacatgaacgcgagaagcaagccgtggccgctttcaaggtacttcacatagtgtag

SEQ ID NO: 119597 - DNA, 1482 bp, Artificial Sequence
  Description of Artificial Sequence: Synthetic coding sequence
atgtcgaagggccctgcggtcggcatcgacttgggtacaacctacagctgtgtaggggtgtttcagcacggcaaggtggagatcattgccaacgaccaaggtaacaggacaacaccgtcctatgtagctttcaccgacacggaacgtttgattggggatgctgctaaaaatcaggtggcaatgaatccaaccaacaccgtctttgacgcaaaaaggctaatcggaagacgcttcgatgacgcagtggtgcaaagtgatatgaagcattggccttttatggtggtgaatgacgctgggaggcctaaggtacaggttgaatacaagggcgaaactaaatctttctaccccgaggaggtgagtagcatggtgctcacaaaaatgaaggagattgccgaggcttatttagggaagactgtgactaatgcagtcgtcactgtacccgcgtattttaatgatagccagaggcaagctaccaaagatgcggggactattgccggcttgaacgtccttaggatcattaacgaacccacggctgctgcaattgcatatggattagataaaaaagtcggtgcggagagaaacgttctcatattcgacctggggggtggaaccttcgacgtctcaatcctcaccatcgaggacgggatattcgaagtcaaatccacggcaggcgacacacatctggggggagaggactttgataatagaatggtaaatcacttcatcgcagagtttaaaaggaagcataagaaagacattagtgaaaacaaacgggctgttcgtagactgagaactgcctgtgaaagggctaaaaggaccctctcttccagcacccaggcatccattgaaatcgactccctatatgaaggcattgatttttatacatccatcactcgggctagatttgaagaacttaacgccgatctgttcagggggacactggaccctgtcgagaaggccttaagggatgccaagctagataaatctcagatccatgatattgttctagtgggtggttctaccaggataccgaagatccagaaactgcttcaagactttttcaacggaaaggagctgaacaagtcaattaatccagacgaggccgtcgcgtacggagccgcagtccaggccgcaattctgtccggagataaaagcgagaatgtgcaggacctcctcctcctcgatgtaactccgttgtcacttggcattgagacggcaggcggggtgatgaccgttctgattaagcggaacacaacaattccaaccaagcaaacacaaactttcaccacctacagcgacaatcagcccggagtcctcattcaagtttatgagggagaaagagcaatgactaaagataataatctgctggggaagtttgagctgacaggtatgccaggtggcatgccgggcgggtttcccggggggggcgccccaccctcaggaggagcaagcagcggcccaactatcgaagaagtcgattag

SEQ ID NO: 119598 - DNA, 1884 bp, Artificial Sequence
  Description of Artificial Sequence: Synthetic coding sequence
atgagcaagggacctgcagtcggaattgacctgggaacaacctacagttgcgtcggggtatttcagcacgggaaggtggaaattattgcaaatgatcaagggaacagaactacccccagctacgtggccttcacggataccgaacggttaatcggcgacgctgctaagaatcaggtggccatgaaccctacaaacacagtgtttgacgccaagagactgattggtcgcaggttcgacgatgcagtcgtgcagtcagatatgaaacactggcctttcatggtggtcaacgacgccggccgccccaaagtacaggtggaatataaaggtgagactaaatctttttaccctgaagaggtttcctcgatggttctgactaaaatgaaggagatcgctgaggcatatctgggcaaagccactaaagacgcaggcaccattgcaggactaaatgtcttgcgtatcataaacgaacccaccgcggccgcgatcgcttacggattggacaagaaagtgggggccgagcgcaacgtgttaatttttgatctgggcggtggaacatttgatgtgagcatcctaactatagaggacggaatcttcgaagtaaaaagcactgcgggcgacactcatctggggggtgaggattttgataacaggatggttaaccactttatagcagagttcaagcggaagcataagaaagacattagtgagaacaagcgcgcagtgcgccgcctcagaaccgcttgtgagagagctaagcggacgctgagcagctccacacaagcatctatcgaaatcgactccctgtacgagggaatcgacttttatacttcaatcacacgggcccgttttgaggaacttaacgccgatctcttcagggggactctggaccctgtggaaaaagcactccgcgatgctaagctggataaatcccaaatccatgatatagttctggtgggcggaagtacccggatccctaagatccagaagctcctgcaggacttcttcaatgggaaagaattgaataaatcaatcaatcccgatgaggctgtcgcctacggagctgctgtgcaggctgcaatcctgagcggcgataaatccgagaacgtacaggatttattgctgctagatgtaacaccactctcgctgggcatagagaccgccggaggtgtaatgacagtgttaataaagagaaacacaaccatccccaccaaacagactcagactttcacaacctactccgataaccaacctggagtcctcatccaagtatacgagggcgagcgggccatgactaaggataacaatctgctcggaaagttcgaactgaccggcatccccccggcgccaagaggcgtacctcaaatcgaagtcacattcgatatagatgctaatggtattctgaacgtctccgcagtagacaaatctacaggaaaagaaaataaaattaccattaccaatgacaagggccgcctgagcaaagaagatattgagagaatggtgcaagaagcagaaaaatataaggccgaagatgaaaaacaaagagacaaggtttcatctaagaactccctggaatcctacgctttcaacatgaaggccacagttgaggatgagaagctgcaaggcaagattaacgacgaagacaagcagaagatactggataagtgcaatgaaattattaactggctcgacaagaaccaaaccgcagaaaaggaagaatttgaacaccaacagaaagaattggagaaagtgtgcaaccccattatcacgaaattatatcagtctgccggggggatgccaggcggtatgcccggtgggttcccgggcgggggcgcgcccccatcagggggtgcatcatctggacctactatcgaagaagtggattag

SEQ ID NO: 119599 - DNA, 1941 bp, Artificial Sequence
  Description of Artificial Sequence: Synthetic coding sequence
atgtctaaaggtcccgccgttggaatcgatctgggtacaacctactcctgtgtgggagtgttccagcacggtaaagtagagattattgcgaacgatcaaggaaaccgcaccaccccttcttacgtggctttcacagacacagagaggcttatcggagatgcagccaagaatcaggtggccatgaatcctacgaacaccgtgttcgatgcaaaacgcctgattgggagacgatttgatgatgcagtggtgcaatcagacatgaagcattggccatttatggtggtcaacgacgccggcaggcccaaggtccaggttgaatataagggggagacgaagtcattttaccctgaggaggtgtcttcaatggttctgactaaaatgaaggagattgccgaagcttacctgggcaagacagttacgaatgcggttgtgacagtgccagcctatttcaatgacagccagaggcaagccacgaaggacgcagggacgattgcgggcctgaacgtactgaggattatcaacgaaccaacagccgctgccatagcatacggtctcgataagaaagttggagctgaaagaaacgtcttgatcttcgatctgggcggaggtacatttgacgtatctattttaactattgaggatggaatctttgaggtgaaatcgacagccggtgatacccaccttggcggcgaggacttcgacaacagaatggtgaaccatttcattgcagagttcaagcgcaaacataaaaaagacatctcggagaataaacgggcggtgcgccggctaaggaccgcatgtgagagggccaaaaggactctgtcttcctccacgcaggccagcattgaaatcgactcattatatgaaggtattgatttttacacttctattacgcgcgcaagattcgaggaactgaatgcggatctgtttcggggaacattagacccggtggagaaagctcttcgagacgccaagttggataagtctcaaattcacgatattgtgctagtgggcggttccactcgcattcccaagattcagaagctgcttcaggatttctttaatgggaaggagcttaataaaagcatcaacccagacgaagctgtggcgtatggagcagcagtgcaggcggccatattgagcggagataagagcgagaacgtgcaggacttattactcctggatgtgaccccactgagtctgggtatcgagacagctggcggcgtgatgaccgttctgattaagcgaaataccacaattcccacaaaacagacccagaccttcaccacttattccgacaatcaacccggagtactgatacaagtgtacgagggagaacgagcgatgacgaaagacaacaatctgttgggcaagttcgagctgaccgggatcccccctgcgccccgcggtgtgccccagatagaagtcaccttcgacatcgatgccaacggcattctgaatgtgtccgcagttgacaagtccacaggcaaggagaataagataacaatcacaaatgataaaggcaggctttctaaagaggacattgagagaatggtccaagaagccgaaaagtacaaagccgaagacgagaagcaaagggataaggtgagcagcaagaactctttagagtcttacgctttcaatatgaaggcaaccgtcgaggatgaaaaacttcagggcaagatcaacgatgaggacaaacagaagatcctggataagtgcaatgaaatcataaactggctcgataaaaatcagactgccgagaaagaggaatttgaacaccaacagaaagagctcgagaaggtttgtaacccaatcattactaagctgtatcagtcggccgggggcatgcctggaggaatgcctggcggattccctggggggggagcaccacccagcggcggagccagcagcggccccaccatcgaagaagtggactag

SEQ ID NO: 119600 - DNA, 1503 bp, Artificial Sequence
  Description of Artificial Sequence: Synthetic coding sequence
atgagcaagggccctgctgtgggcattgacctcggcacaacatattcctgcgtgggggtgtttcaacatggcaaggttgagattatcgcaaacgatcaaggaaatcgcacaactcctagttacgtggccttcacagatactgagaggttaattggcgacgcagctaagaatcaggtcgcaatgaaccccacaaacacggtttttgatgccaagaggctgatcggccgcaggtttgacgacgcagtcgtacaatctgacatgaagcattggcctttcatggtcgttaatgatgccggacgcccaaagcataagaaggacatatctgagaataagagggccgttcgtcgtcttcggactgcgtgcgagagggccaagcgaaccctctcgtcctctactcaggcgtccatcgagatagattcactttacgagggcattgatttctacacttcaattacgagggcacgctttgaagagcttaatgcagacctcttccgggggactctggaccccgtggagaaagccttaagggacgcaaagctcgataagtcccagatccacgatatcgtcctcgtaggtgggtccacacgaattccaaagattcaaaaactgctccaggactttttcaacggcaaagagctcaataaatcaatcaatccagatgaggcggtcgcctacggcgcagcagtgcaggctgcaattctgagcggggacaaatcagagaatgtgcaggaccttctgctgctggacgtgaccccactgtcactagggatcgagactgctggcggagtcatgactgtgctgatcaagcgtaacaccaccatccctaccaagcagactcaaacatttaccacctactccgataatcagcctggcgtgttgatccaggtctacgagggcgagcgtgcaatgacgaaggacaacaatttactcgggaagtttgaactaacagggatcccccctgcacccagaggtgtgccacagattgaagtaacgtttgacatcgacgcaaatgggatcctgaatgtgtccgcagttgacaaatccacgggcaaagaaaacaagataaccataaccaatgataaggggcgcctaagtaaggaggatattgagagaatggtgcaggaggctgaaaagtacaaggccgaggatgagaaacagcgagataaggtgtccagtaagaacagtttggaatcttatgctttcaatatgaaagctaccgttgaggatgagaagctgcagggaaaaattaacgacgaggataagcagaagattttggataagtgcaatgaaatcatcaactggttggacaagaaccagacagccgagaaggaggaattcgagcaccaacagaaggagctcgaaaaagtttgtaacccaatcattacaaagctttaccagagcgctggaggcatgcccggaggaatgcctggaggatttcctgggggcggtgcccctccaagtggcggagcctccagcgggcccacgatcgaggaggtggactag

SEQ ID NO: 119601 - DNA, 1233 bp, Artificial Sequence
  Description of Artificial Sequence: Synthetic coding sequence
atggtaaatcactttatcgcggagttcaaacgtaagcataaaaaagacatatctgaaaataagcgtgcggtacggcggcttcggacagcttgcgagagagccaaaaggaccctgtcctcctccacgcaagcgagcatcgagatagacagcctgtatgaagggatcgacttttatactagtatcacaagagcaaggtttgaagagctgaacgcagacttgtttaggggaacactggaccccgtggaaaaagccctaagggatgctaaactggacaaatcccagattcatgatatagtgctggtgggcggtagcaccaggattcccaagatccagaaactgttacaggatttttttaacgggaaggaactgaacaagtctattaacccagacgaggctgttgcgtacggagcggccgtccaggctgctatcctgtccggcgacaaatccgagaacgtccaggaccttctactgctggatgttacacctctatccctcgggattgaaaccgcgggaggggtcatgactgtactcattaaaaggaacacaacgatacctactaagcagacccagacattcacaacttattcagataaccagcctggcgtgcttatccaggtgtacgagggcgagagagctatgactaaggacaacaatctgctgggaaaatttgaattgacaggcattcccccagcccctaggggcgtacctcaaattgaggtgacattcgatatcgacgccaatggcattcttaatgtgtcagccgtggacaagtctactggtaaggagaataagatcactattacaaacgataagggtaggctgagtaaggaggacatcgagagaatggtccaggaggccgagaagtacaaggctgaagatgaaaagcagcgtgacaaagtgagcagcaagaactctctggagtcctacgctttcaatatgaaggccacagtagaagatgagaagttgcagggcaaaatcaatgatgaagataaacagaaaattctagacaagtgtaatgaaatcattaactggttggacaaaaatcagacagccgagaaggaggagttcgaacaccagcagaaagagttggagaaggtctgcaaccctatcatcacgaagctgtatcaatcagctggtgggatgcctggcgggatgcccggtggttttccaggcggcggcgcccctccctcaggtggagctagctcagggcctacaatcgaagaagtcgactag

SEQ ID NO: 119602 - DNA, 1941 bp, Artificial Sequence
  Description of Artificial Sequence: Synthetic coding sequence
atgtcaaagggtcctgccgtgggaatcgacctgggtactacctacagttgcgttggggtgtttcagcatgggaaggtggagattatcgccaatgatcaaggcaataggaccacgcctagctacgtagccttcaccgatactgaaagactgatcggagacgctgccaaaaatcaggtggcaatgaaccctacgaacacggtgtttgacgccaaacgcctaattggaagacgattcgatgacgccgtagtacaatccgatatgaagcattggcctttcatggtggtaaacgacgccggccgcccaaaagtgcaagtcgagtataagggtgaaacaaaaagcttctaccctgaggaagtctcttccatggtcttgactaaaatgaaggaaatcgctgaggcataccttggcaagacagtgaccaacgctgtcgtcacagtccctgcctacttcaatgactctcagaggcaggccacaaaggatgccggaaccattgccggcctgaatgtgctgcgcatcataaatgaaccaacagccgcagctatcgcttacggcctagataaaaaggtgggcgccgaaagaaatgtgctaatctttgacctcgggggaggaacttttgatgtgtctatcttgacgattgaagatggaatctttgaggttaagtccacagcaggtgatacacatttaggcggggaggactttgacaaccgaatggttaatcacttcatcgcagaatttaagcgaaagcataaaaaggacataagtgaaaataagagggctgtgaggcgcttgcgcaccgcctgtgagagggccaaaagaacgctgtcaagcagcacacaggcctccatcgaaatcgattccctctatgagggcattgatttctatacttctatcacacgcgcccggtttgaagagttaaacgccgacctatttcgcggtacgctcgatccagttgaaaaggcattacgcgatgcgaagttggacaaaagccagattcacgatatcgtgctcgtgggcgggtctactcgcattcccaaaatacagaaactgctgcaggatttcttcaacggtaaggagttgaataagagcatcaatcccgacgaggctgtggcgtatggggccgcggtgcaggcagctatcttaagtggggataagagtgaaaacgtccaggatttgctgttattggacgtgacccctttgagtctgggaattgaaaccgcaggcggagtgatgacagtgctgatcaagcgtaacactacaatccccactaagcagacgcagacattcacaacgtattcggataatcaacctggggtgctcatccaggtgtatgagggcgagcgtgcgatgaccaaagataataatctgcttgggaagtttgagttaacgggaatccctcccgcgcccagaggggtgccacagattgaagtaacattcgatatcgacgcaaacggcatcttgaatgtgagtgcagttgacaagtccaccgggaaagaaaacaaaatcaccatcacgaacgacaaaggtaggctctccaaagaggatattgaacggatggtgcaagaggctgaaaagtataaggcggaggatgaaaagcagcgtgataaggtgagctcgaaaaattccctcgagtcttacgcctttaatatgaaggccactgtggaggacgaaaaactacaaggaaagataaatgatgaagataagcagaagattctggacaaatgcaacgagattatcaattggttagataaaaatcagacggctgaaaaagaagaattcgagcatcaacagaaagagctcgaaaaggtgtgtaacccaataatcactaagttgtatcaatctgctgggggcatgcctggtggcatgccgggaggctttcctgggggaggggcgcccccctctggcggtgcttccagtggtcctaccatcgaagaagttgattag

SEQ ID NO: 119603 - DNA, 2040 bp, Artificial Sequence
  Description of Artificial Sequence: Synthetic coding sequence
atgatctctgccagccgagctgctgcagctaggttagtaggcgctgcggcttctcgcgggccgacagcagcacggcaccaagattcctggaatggcctctctcacgaggctttcaggctggtcagcagacgggattacgcatccgaggccataaagggtgccgtggtaggcatagacttggggaccaccaattcttgcgtcgccgttatggagggcaagcaggccaaggtcttggagaacgctgagggtgcccgaacaacaccttctgtggtggccttcaccgcagatggcgagagactcgtcggaatgcccgctaaaaggcaggccgtcaccaaccctaataacactttctatgcaaccaagcggctgattgggcggagatatgacgatccggaagtacaaaaggatatcaaaaacgttcctttcaaaatcgtacgagcatccaacggagatgcatgggtggaggctcacggtaaattgtacagcccatcgcaaatcggggcgtttgttctcatgaaaatgaaagaaacggcagaaaattatctggggcatacagctaagaatgccgtaatcactgtccccgcatacttcaacgattcccagcgtcaggccactaaggacgccgggcagatcagcgggttgaacgtgctccgcgtcattaatgaaccgacagcagcggccctggcatacggtctggataagtccgaggataaggtgattgctgtctatgatctgggtggaggtacctttgatattagcattctggaaatccagaaaggtgtatttgaagtgaagtccacaaacggggatacattcctcggaggggaggattttgatcaggctctgctgcgccacatcgtcaaggaattcaaacgagagacaggagtggacctgacaaaggataacatggctctgcagagagttcgcgaggctgctgaaaaggccaagtgtgagctgtcttccagtgtgcagacagatatcaatctgccataccttaccatggactcctccggtccaaaacatctgaatatgaagctcaccagggctcagttcgagggcattgtgacggacctcatccgccgcacaatcgctccctgtcagaaagctatgcaagatgccgaggtgagcaagagcgatatcggagaggtgatcttagtgggcgggatgactcgtatgcccaaagtgcagcaaactgtgcaggacctgttcgggagagccccctcaaaggccgtcaatccagatgaggctgtggcaataggggccgccatacaggggggtgtactggccggcgacgttaccgacgtgctgctattggacgtgacaccactgagtctgggcattgagactttgggcggggtgtttaccaaacttatcaatcgaaacacaacaatcccaaccaagaaatcccaagtctttagcaccgccgccgacggtcaaacacaagtggagattaaggtgtgccagggcgaaagggagatggctggggataacaaactcctcggacagtttaccttaattggcataccccctgccccacggggagtaccacaaatagaagtgacatttgatattgatgcgaacggtattgtacatgtcagcgcaaaggacaagggtacagggagggaacaacaaatagttattcagtcatctggcggcctttctaaggacgacatcgagaatatggttaagaatgctgagaagtatgcagaggaagatcggcgcaaaaaggaacgtgttgaggccgtgaacatggcagagggcattatccatgacactgagacaaaaatggaggaatttaaggaccaactccccgccgacgaatgtaataaactcaaggaagaaattagcaaaatgagggagctgctggcccgcaaggattccgagaccggtgaaaatattagacaggccgccagttccttacagcaggcatctttgaaactctttgaaatggcgtataagaagatggcctccgaacgcgagggttcaggcagctctggcacaggtgaacagaaagaagatcagaaggaagaaaagcagtag

SEQ ID NO: 119604 - DNA, 1998 bp, Artificial Sequence
  Description of Artificial Sequence: Synthetic coding sequence
atgatctctgccagccgtgctgcagcagcccgccaccaggactcatggaacggcctgtcgcacgaagcattcagactggtgagtcgcagagactacgcctcagaagctataaagggcgccgtagtaggcattgacttgggcaccacaaactcctgtgtagcagtgatggaaggcaaacaagccaaagtgctggaaaatgccgagggggctaggacaacaccaagtgtggtggcatttacggcggacggcgagcgattagtggggatgcccgccaaacggcaggccgtgacaaatcccaataatacattctacgccaccaagcggttgatcggccgcaggtacgatgatcccgaggtccagaaagatataaaaaacgttcccttcaagatcgtgagggcttccaacggcgacgcgtgggtggaggcccacggtaagctgtattcacctagtcagataggcgcctttgttctgatgaagatgaaggaaaccgcagagaattacctgggacacactgccaagaacgctgtaatcacagtgccggcttatttcaacgatagtcaacggcaggctactaaggacgcaggccagatttctggacttaacgtgctcagggttattaacgagcctacagccgccgccctggcatacgggctggataagtctgaagataaagttatcgctgtgtacgatttggggggcgggaccttcgacatcagcatcttagagatccagaagggcgtgtttgaggttaagtccacaaatggtgacaccttcttaggcggcgaggatttcgaccaggctctgctgaggcatatagtgaaggagtttaagagggagaccggagtcgatttaacaaaggacaacatggcacttcaacgcgtcagagaagccgccgaaaaggcaaagtgtgaactctcatctagcgtacagactgacataaatttgccctatcttacaatggacagctccgggcccaaacatctcaacatgaagctcacgcgggctcagtttgaaggcattgtgaccgacctcatcaggaggacaatcgctccctgccagaaggcaatgcaggatgctgaggtatctaagtccgacatcggcgaggtgattttggttggtgggatgacccgaatgcccaaggtgcagcaaactgtgcaggatctatttggacgtgcccctagcaaagccgtgaacccagacgaggccgttgctattggggcggcaatccaggggggggtcctggccggtgacgtcaccgatgtgctcctgttagacgttacccctcttagcctcggcatcgagactctcggtggggttttcaccaagctaattaataggaacaccactattcctacaaagaaatcccaagttttctccaccgccgcagatggccagacacaggttgagatcaaggtatgtcagggagaaagagagatggctggagacaataaactgctcgggcagtttactctgattggcatacctcccgctcctagaggggttccccagattgaagtgacgtttgacatcgacgcaaacggaattgtccatgtgagcgccaaggacaaaggaacgggtagagaacagcaaatcgttattcagtcctccggcgggctgagcaaggacgacatcgagaacatggtgaagaatgccgagaagtacgccgaagaggacagaagaaaaaaggaacgggtggaagctgttaacatggccgaaggcattatacatgataccgagacgaagatggaggaattcaaggaccaactgccggctgacgaatgcaacaagctaaaggaagagataagcaagatgcgggagctgctggcgcggaaggactcagaaacaggggagaatatccggcaggctgcgagctctttgcagcaggccagcctgaagcttttcgagatggcctataaaaagatggccagcgagcgggagggctccggatcatcaggtacaggagagcagaaagaggatcagaaagaggagaaacagtag

SEQ ID NO: 119605 - DNA, 1899 bp, Artificial Sequence
  Description of Artificial Sequence: Synthetic coding sequence
atggccctcgtgatgagacttttagatttatttcagggcggtatcatgcatcagaaacaatcccgggaacaattactggtcctgatctgggttttacctaccccagcctggcaactgtggaaggtaaacaagcaaagatgctggaggatgcccaaggtgcctgagccccccctgcagctctggcctctacagcagatggtcagcgatctgctagaatgtcgaccttcggatcgtctttccccgacacagaccattcacttcatgctcccttccgtatccctggcaggcgacatgatgattctgaagtaccgcaagactctgaaaatgtttccacttaagctatccgtgccccctatggtgatgcccgtgttgatgaaaatgaaagagaccgccgagaactacctggggcacaccgccaagaacgccgtgattacagttcctgcctactttaacgactcgcagcggcaggccaccaaggacgctgggcagataagcggcctgaacgtgctccgggtcatcaatgaacctacagcagcagctcttgcgtacggactggataagagcgaggacaaagtcattgctgtgtacgatctggggggtgggacttttgatatttcaatcctagagatccagaagggcgttttcgaagtgaagagtaccaacggcgacacatttttgggtggggaggattttgatcaggcactgttgcgtcatattgtcaaggaattcaagcgggagacaggggtggatctgacgaaggataacatggctcttcagagggtgcgcgaagccgctgagaaggcaaagtgtgaactgagctcgtcagtgcagacagatataaatttgccctacctgacgatggatagcagcggccctaagcatcttaatatgaaactgactcgtgctcagtttgaggggatcgtaacggacctaatcaggcggacgatcgcaccctgccaaaaagcaatgcaggatgcagaagtgtccaagtccgatattggtgaagtgatactggtgggcggcatgacacgcatgcctaaagtccaacagaccgttcaggacctgtttggccgggccccttccaaggccgtcaatccagatgaggcggtagccatcggagctgcgatccagggcggtgtgctggccggtgatgtgaccgatgttctccttctggacgtcaccccactgtcgctgggaatcgaaacactcggaggtgtgttcacaaaacttataaaccggaatacaacaatacccaccaaaaagagtcaggtgttctctaccgcagccgatgggcagacccaggtggagattaaggtttgccaaggcgaacgtgagatggccggggacaacaagctgctggggcagttcacactgatcggtatcccccctgctccacgaggggtgccccaaattgaggtcacattcgacatcgacgctaacggtatcgttcatgtgtcagccaaagataaggggaccggccgcgaacagcagatcgtgatccagagttccggaggtctgtcaaaggatgacattgagaacatggtgaaaaatgcagaaaaatacgcagaggaagataggagaaagaaggaacgggtggaggccgtgaatatggctgagggcattattcacgatactgaaaccaagatggaagaattcaaagatcagctgcccgccgatgaatgtaataagttaaaagaggaaatcagcaagatgagagagctgcttgcacgcaaggactccgagaccggcgaaaatatcagacaggccgcctcctcactccagcaagcctctttaaaacttttcgagatggcgtataagaagatggccagcgagcgggaaggatcaggaagtagcggtaccggcgagcaaaaagaggatcagaaggaagagaaacaatag

SEQ ID NO: 119606 - DNA, 2175 bp, Artificial Sequence
  Description of Artificial Sequence: Synthetic coding sequence
atgcctgaagaagtgcaccacggcgaggaggaagtggagacattcgcctttcaggccgagattgctcagcttatgagtctcattataaacacattttacagcaataaggaaatcttcttgcgggaactaatatctaatgctagcgacgccctcgataaaatacggtacgaatccctgactgacccttcgaagttggactcaggaaaagaactgaagattgatattattcctaacccccaagaacgtaccctcacattggtggacactggaatcgggatgacgaaggcagatttgattaataatcttgggacaatcgccaaatctggcacaaaggcttttatggaagcccttcaagccggcgcagacatttctatgattggccagttcggcgtcggtttttatagcgcatatctggttgctgaaaaggtggtggtcataacaaaacacaacgacgacgaacaatatgcctgggaatcttccgcgggcggaagcttcactgtgcgcgctgaccacggagaaccaataggacggggcactaaagttatcttacacctgaaagaagaccagactgagtacctggaagagcgccgagtgaaggaggttgtgaaaaaacactcgcagttcatcgggtatcccatcaccttgtacctggaaaaagagcgggaaaaagagatttctgatgatgaggccgaagaagaaaagggggagaaggaggaagaggataaagacgacgaggaaaaacccaaaattgaggatgtcggctccgatgaagaggacgattccggaaaagacaagaaaaaaaagaccaaaaagatcaaagaaaaatatattgaccaagaagagctgaacaaaaccaagcccatctggacaagaaaccccgatgacatcacccaggaagaatacggcgagttctacaaatccctgaccaacgactgggaggaccatctggcagtcaaacatttctctgtagagggacagctggaattcagggcactgctcttcataccccgacgcgccccctttgatctgtttgaaaataaaaagaaaaaaaacaatataaaactgtatgtgaggcgagtgttcataatggacagttgcgacgagctcatccctgagtacctgaatttcatccgcggcgtagttgatagcgaggaccttcccctcaatatttcacgcgaaatgctgcagcagtcaaagatactgaaggtcatcaggaagaacatcgtgaagaagtgtttagaactcttcagcgaactggcagaggacaaggaaaattacaaaaaattctacgaggctttcagtaagaatctgaagctgggtattcatgaagacagcactaatcggcgaagactgtccgaactcctgagatatcatacctcccaatccggagacgaaatgacgtcgctgtccgagtatgtgtctcgcatgaaggagacacagaaatctatttactacataactggcgagtcgaaggagcaagtggccaactctgcctttgtggaaagggtccgcaagagaggatttgaggtggtctacatgactgagcctattgatgagtactgtgtccagcaattgaaagaatttgatggtaaatctctggtgagcgtgacaaaagagggactcgaattgccagaagacgaggaagaaaaaaagaagatggaagaaagtaaagccaaatttgaaaacttgtgcaagttgatgaaagagatcctggacaagaaggtggagaaggttaccatcagtaatcgccttgtgagctctccatgctgcatcgtgacaagcacatatgggtggacagcaaatatggagagaattatgaaggcacaggcactccgcgacaactctacaatggggtatatgatggccaagaaacatttggaaattaatcccgatcaccccattgtggaaacactcaggcagaaagctgaggctgataagaatgacaaggcggtgaaggacctggtggttctgctcttcgagacggctctgctgtctagtggtttttccctggaggacccacagacacactccaacaggatttatcgcatgataaagctggggctggggatcgacgaagacgaggtggcggcggaggagccaaacgccgccgtccccgacgaaattccgccgctggagggcgacgaggacgcaagccggatggaagaggtagactag

SEQ ID NO: 119607 - DNA, 2175 bp, Artificial Sequence
  Description of Artificial Sequence: Synthetic coding sequence
atgccagaagaagtgcatcacggggaagaagaagtggaaactttcgcctttcaggctgaaatcgcacagctgatgtccctgatcataaacacattctacagtaacaaagagatattcctgcgcgagcttatcagcaacgctagcgacgcccttgataaaatccgctacgagtcattgaccgatcctagtaagctggatagtggaaaggaactgaagattgacattattcccaacccacaggaacgtacactgacgctggtggatacaggcataggcatgaccaaagccgacctcatcaacaatcttggaacaattgccaaaagcggtactaaggcatttatggaagcccttcaggctggcgccgacatctccatgatcggccagttcggggtcggattctattctgcttacctggtcgcagagaaagtggtagttattacaaagcacaacgacgacgaacagtacgcctgggagtcctctgctggcgggtcgttcacagtgcgagctgaccatggagagccaatcgggcggggaactaaggtgatccttcatctgaaagaagaccagacagagtatctggaggagagaagagttaaggaagtggttaagaaacacagccagttcatcggctatccaattactctttacctggagaaagagcgggaaaaggaaatttcagacgacgaggccgaagaggagaagggagagaaggaagaggaggacaaagacgatgaagagaaaccaaagatcgaggatgtggggagcgacgaagaggatgactccggcaaggataaaaagaaaaagaccaagaaaattaaagagaaatatatcgaccaggaagaactgaacaaaaccaagcccatctggacacggaatcccgatgacattacacaggaagagtatggcgagttctacaaatctttgactaacgattgggaggaccacctcgccgtcaaacatttttcggttgaaggacagctcgaattccgcgcgttattattcattccccgaagggcacctttcgacctcttcgaaaataagaagaaaaagaataacatcaagctgtacgtgagacgggtgtttatcatggattcatgcgatgagctgattcccgagtatctcaacttcatccgcggggtggtggattccgaagacctgccgctcaacataagcagggaaatgttgcaacagtccaagattttgaaggtgatccgcaaaaatatagtgaagaaatgcctggagctcttttctgagctcgcagaagataaggagaattacaaaaagttttacgaggcttttagtaagaatcttaaactcggtattcatgaagattctaccaacaggagacgtctgtcagaactgctgagatatcacaccagccagtccggcgatgaaatgacgtcactctctgaatatgtctcacgcatgaaggaaacacagaaaagcatctattatattactggagagagcaaggagcaggtcgccaattcagcctttgtcgagagggtgaggaagcgaggctttgaggtggtgtacatgacagagccaatcgacgagtactgcgtgcaacagctcaaagaattcgatggcaaatcccttgtgagcgtgacaaaggagggcctcgaactgcccgaggatgaggaggagaagaaaaaaatggaggagtctaaggctaagtttgagaacctgtgcaagcttatgaaggagattctcgacaagaaagtagaaaaagtcacgattagcaatcgactggtttcctcaccctgttgtatcgttacgtctacctacggatggaccgcgaatatggaaagaataatgaaggctcaggcactccgggataattcaactatgggctatatgatggccaagaagcacctggagatcaatcctgatcatccgattgtggaaactcttaggcaaaaagccgaggccgacaagaacgataaagctgtgaaggatcttgttgtcttgcttttcgagacagcactgctttcctctgggtttagccttgaagatccccagacgcatagtaaccgcatctaccgaatgattaaactgggcctgggaatcgacgaggatgaggtggccgccgaggaaccaaacgcggccgtgcccgatgaaatcccccctctggagggcgatgaagatgccagtcggatggaggaggtggactag

SEQ ID NO: 119608 - DNA, 465 bp, Artificial Sequence
  Description of Artificial Sequence: Synthetic coding sequence
atggattcatgtgacgaactgatacctgagtacctgaacttcattcgaggggtggtagattcagaggacctccccctcaacattagcagggagatgctgcaacaatctaagatcttgaaggtaattaggaaaaacattgtcaaaaagtgcttagaactcttttcagaactggcagaggataaggaaaactataagaagttttatgaggcattttcgaaaaacctcaagttaggaattcacgaggattccacaaaccgcagacggctgtctgaattattaaggtatcacaccagtcagagcggcgacgagatgacctccctgagcgaatacgtcagcagaatgaaggagacgcagaagtctatttactacatcaccggggaaagtaaagagcaggtttgcccttgccctacttggctccctctgctggtaagctccgtctttttccctctgctgtcgctgtgctag

SEQ ID NO: 119609 - DNA, 489 bp, Artificial Sequence
  Description of Artificial Sequence: Synthetic coding sequence
atggattcttgtgacgagctgatacccgaatacctcaactttattagaggtgtggtggattcggaggatcttcctcttaacatctcccgggagatgctccaacagtctaagatcctgaaggtgatccgcaagaatatcgtcaaaaagtgtctagaactcttctccgaactggctgaggacaaggagaattacaagaaattctatgaagcattctctaagaatttgaagctgggtatccacgaggactctactaatagacggaggctgtctgagttactgaggtaccacacttcgcagagcggcgacgagatgacatccctctctgagtatgtatccaggatgaaagagacacagaaatccatctactacatcaccggagaatccaaggaacaggtggcaaattcggcatttgtcgagcggtgtccttgtcccacttggctcccgctccttgtctctagtgtgtttttcccactactcagtttgtgctag

SEQ ID NO: 119610 - DNA, 552 bp, Artificial Sequence
  Description of Artificial Sequence: Synthetic coding sequence
atggatagttgcgacgagttgatacccgaatatctcaacttcattcggggcgttgtcgattccgaggatctgcccctgaacattagtagggagatgctccagcagagcaagatcctgaaagtgattcgcaagaacatcgtcaagaagtgtttggagctgttttctgaactcgcggaggacaaagagaattataagaaattttacgaggccttttccaaaaatctgaaacttggaatccatgaagattctactaatcgcaggaggctgtctgagctcttgagatatcatacgtcacagtctggagatgaaatgacctctctgtccgagtacgtctctcggatgaaggagacccagaaaagcatctattatatcaccggatctccctgctggtgcttagtgttcttctccctttcctgtccatgcgtcgaaggctccaaattaagggtcagctcgcctattcccagcctgctcctcacggcaggtcttgacgtggtatattgtggcctcttctactttctccacttcgttctcaaactgaagtacgcgaagtag

SEQ ID NO: 119611 - DNA, 2175 bp, Artificial Sequence
  Description of Artificial Sequence: Synthetic coding sequence
atgcctgaggaggtccaccatggcgaagaggaggtggaaaccttcgcgtttcaggctgaaatcgctcaacttatgtctctgattatcaacaccttctactctaacaaagaaatatttctgcgggagctgatctctaacgcatccgatgctcttgataagattcggtatgagtcgctgacggatccgtcgaaactagatagcggcaaggagctgaaaattgatatcataccaaatccccaggaacggacgcttactctcgtggacactggaattgggatgacaaaggcggacctcattaacaaccttggaaccatagcgaagagcgggaccaaggcttttatggaggccttgcaggctggcgcagatatcagcatgatcgggcaattcggcgtgggcttctacagtgcatacctggttgcggagaaagtggttgtgataacaaaacacaacgacgatgagcaatacgcctgggaaagcagtgcagggggcagtttcaccgtacgcgccgaccacggagaacccattggtcgtggaacaaaagttatactgcatctgaaggaagatcagacagaatacctcgaggaacgaagagtaaaagaggtggtcaaaaagcactcccagttcattggctacccaattaccttgtacctggagaaagaacgggagaaggagataagtgatgatgaagccgaggaagagaagggtgagaaggaagaggaggacaaggacgacgaagaaaagcccaaaatcgaggacgtgggatctgacgaggaagacgacagtgggaaagacaaaaaaaagaagacaaagaagataaaggagaaatatatagatcaagaggagctcaataagacaaaaccgatttggactcgcaatccagatgacatcacccaggaggagtacggggaattttacaaaagcctgactaatgactgggaggatcatcttgctgtgaagcatttcagcgtggagggacagctcgaatttagggcactacttttcattccccgcagggccccgttcgacttgtttgaaaacaaaaaaaaaaagaacaatataaagctatacgtgagaagagtgtttatcatggactcgtgtgacgagttaattcctgaatacctgaattttattagaggcgtggtggatagcgaagatcttcccctgaatatctctagagagatgttacagcagagcaagatccttaaagtcattaggaaaaatatcgttaagaaatgcctggaactgttctcagagttagccgaagataaagaaaattacaagaagttctacgaggcctttagcaagaacttgaaacttggtatccatgaggatagcacgaatcgccgccgcttgagcgagctgctgaggtaccatactagccagtccggagacgagatgacctcactatctgaatacgtttctagaatgaaagaaactcagaaatcaatctactacataacaggcgagagtaaggagcaggtggctaatagcgccttcgttgagagagtacgaaaaagaggctttgaggtggtgtacatgaccgaaccaatagatgagtactgcgtccaacagctgaaagaattcgacggtaagagcctggtgtccgtgaccaaggaagggttggagcttcccgaggatgaggaggagaaaaaaaaaatggaagagtccaaagccaagttcgagaacctctgcaagctgatgaaagagatactagataaaaaggtagagaaggtcactatcagtaaccgccttgtttcgagcccatgctgcattgtgaccagcacctatggctggactgcaaacatggagcgaatcatgaaagctcaggccctgagagataattctacaatgggttatatgatggctaaaaagcatctagagattaatcctgatcacccaatagttgagacactgcgtcagaaggcagaggccgataagaacgataaagccgtaaaagacctagtggtcctgctcttcgaaactgccctgctgagcagcgggttctccctcgaagacccacagacgcacagtaataggatttacagaatgattaagctcggcttgggaatcgacgaggacgaggttgcagccgaagagcctaacgccgcagttcccgacgaaatcccacccttagaaggcgacgaggatgctagccgaatggaagaagtagattag

SEQ ID NO: 119612 - DNA, 429 bp, Artificial Sequence
  Description of Artificial Sequence: Synthetic coding sequence
tagttcatcaggggtgtcgtagactccgaagatctccccctgaacatttctagagaaatgctccagcagagtaagatcctcaaagtgatccgaaagaatatcgtaaaaaaatgcctggagctgtttagtgaactcgccgaggataaagagaactacaagaaattctacgaggcattcagcaagaacctgaaactcggaattcatgaggattcaactaataggaggcgactgagtgaactcctacgctatcacacatcccagtcgggggacgaaatgacttcactgagcgaatacgtgtccaggatgaaggagacccagaaatctatctattatattacaggagagtccaaagagcaggtgtgcccctgtcccacatggctacctctgttggtgagtagcgtcttctttccattgctgtctttgtgttag

SEQ ID NO: 119613 - DNA, 453 bp, Artificial Sequence
  Description of Artificial Sequence: Synthetic coding sequence
tgatttatccgaggggtagtggatagtgaggatttgcccctgaacatcagcagggagatgctacaacagtctaagatattgaaggtcattcggaaaaatatagtaaagaaatgtctggagctcttctctgagctagccgaggataaggaaaattataagaagttttacgaagcgttctcgaaaaatctgaaacttggaatccacgaagattcaacgaatcgtcgcaggctgagtgagctactgcggtatcacacctcacagagtggcgacgaaatgacatctttgtccgaatatgtatctaggatgaaggagactcaaaagtcgatttactatattactggcgagtccaaggaacaggtcgccaacagcgctttcgtggaacggtgtccatgtcctacctggttgcccctgctggtgagttctgtcttcttccccctgcttagcttatgttag

SEQ ID NO: 119614 - DNA, 516 bp, Artificial Sequence
  Description of Artificial Sequence: Synthetic coding sequence
tgattcatccggggcgtggtggacagcgaggacttaccattgaacattagtcgggagatgttgcagcagagcaagatactaaaagtgatcaggaagaacatagtaaagaaatgtctggaactgtttagcgaattggccgaggacaaagaaaattataagaagttttatgaggcctttagcaagaacctgaagctgggaatacacgaggacagtaccaataggcgccggctctccgagctgctgagataccacacatcacaatctggggatgaaatgacctctctaagtgaatacgttagccggatgaaagagacccagaagtctatttactacataacagggtcaccatgttggtgtctggtatttttttctctgagctgcccctgtgtggagggtagcaagctgcgcgtctcatcacccatcccgtctctactactaaccgcggggctggatgtcgtctactgcgggctgttctattttctgcacttcgttctcaagctcaaatatgcaaagtag

SEQ ID NO: 119615 - DNA, 507 bp, Artificial Sequence
  Description of Artificial Sequence: Synthetic coding sequence
atgcctgaagaagtgcatcacggggaagaagaagtggagacatttgcctttcaggccgagattgcacagctcatgagtctcataatcaacacattttatagcaataaggagatctttctcagagagctgatatcaaacgcctccgacgcgctggacaagattcggtacgagtcgctcacagatccttcgaaattagactccgggaaggaattgaaaatcgatatttcgatgatcgggcagttcggagttggcttttacagcgcttacctcgtcgccgaaaaggtcgtggtgattaccaagcataacgacgacgagcagtacgcatgggaatctagcgcgggcggctccttcactgttcgggctgaccatggggagcctatcggacgaggtaccaaagtaatcctgcacttgaaggaggaccagaccgagtatctcgaagagagacgggtcaaggaagtcgttaaaaagcattcacaatttatcgggtatcccataacgctctactag

SEQ ID NO: 119616 - DNA, 483 bp, Artificial Sequence
  Description of Artificial Sequence: Synthetic coding sequence
atggaaatcccagttccagtgcagcctagttggttgcgacgagcgtctgcccccctgcctggtctctccgcacctggtcgccttttcgatcagagattcggcgagggactcctcgaggcagaactggcggccttgtgccctactactttggccccttactacctaagggcccctagtgtggcgctgccggtcgcccaggttcccacggaccccggacatttctcagtcctactggatgtgaaacatttcagcccagaagagattgccgtgaaggtggtgggcgaacacgtggaggtgcatgcaaggcatgaggaacgacctgacgagcatggttttgtggcacgcgagttccatcgcaggtacaggctaccacccggcgtcgacccagccgctgttacctccgctctaagccccgaaggcgtcctgtcgattcaggccgctcccgccagtgcccaagcaccccctcccgcagctgcaaaatag

SEQ ID NO: 119617 - DNA, 483 bp, Artificial Sequence
  Description of Artificial Sequence: Synthetic coding sequence
atggaaattccagttcctgttcaaccaagttggctgcgcagggcctctgccccactgcccggactgtcagctccaggacgtctatttgaccagcgatttggagaggggctcctcgaggctgaactcgccgctctgtgccccactacattagccccttactacttgagagccccttctgtagccttaccggtcgcccaagtgcctaccgatccaggccatttcagcgttttgctagacgtgaagcacttcagcccagaagaaatcgccgtgaaggtggtgggcgaacatgtggaggtccacgcgcgtcacgaagagagacccgatgaacacgggttcgtcgctagagagttccataggcggtataggctgccacccggggtagaccccgcagccgtgacatctgccctctcacctgaaggggtgttgtcgatccaagctgctccagcatccgcccaggcaccgccccccgcagctgccaagtag

SEQ ID NO: 119618 - DNA, 591 bp, Artificial Sequence
  Description of Artificial Sequence: Synthetic coding sequence
atggagattcccgtgcccgtgcagccttcgtggctgcgtagggcttctgctcctctgccagggctttcagcaccaggccggctgtttgaccagcgatttggagaggggctcctggaagccgaactcgcagctctttgcccaactactcttgccccttactaccttagagctccaagcgtggcactgcccgtggcgcaggtgccaacagatcccggacacttcagcgtcctcttggacgtaaaacattttagtcccgaggaaatcgccgtgaaggtggtgggcgaacacgtcgaagtgcacgccagacacgaggaacggcccgacgaacatgggttcgtcgctcgcgagtttcatcgacgctatagacttccccctggagttgatcccgccgcagtgacgtcagctctctcacccgagggggtgctgtcaattcaagccgctccggcgccacgggagcctccacaggcgccttcaatcaaggccgatctcactcctccttcccagatgtcgcgagtacgccaaggactgtcaagccaccccctgctagactctgcgctcacctctattctggacacagcgctcattacgtag

SEQ ID NO: 119619 - DNA, 1590 bp, Artificial Sequence
  Description of Artificial Sequence: Synthetic coding sequence
atggacctccctgtggggcccggagccgccgggccatcgaacgtccccgccttcctgacaaagctgtggactctcgtgagcgatcctgatacagatgcactgatctgctggtcaccctccggaaatagcttccatgttttcgatcagggacagttcgctaaagaggtcctccccaagtactttaaacataacaatatggcctcctttgttaggcaactaaatatgtatggtttccgcaaggtcgtccacatagagcagggaggtctggtgaaaccagagcgggatgatacagagtttcagcacccatgtttccttagggggcaggaacaattgctggaaaacattaagagaaaagtcacaagcgtgtctacacttaagtctgaagacattaagatccggcaggactcagtaactaaactccttaccgatgtgcagctgatgaaaggaaagcaggaatgcatggactccaagctgcttgctatgaagcatgagaacgaggccctctggcgggaggtggccagcctaaggcagaaacacgcacagcagcagaaggtcgtcaataagctgatccagtttctcatctctctggtacagagcaatagaatcctgggcgttaagagaaagatcccactgatgttaaacgacagcgggtcagcacactctatgccgaaatacagccggcagttttcgctcgagcacgtgcatggctctggcccatacagcgctccttctcctgcttatagctcttccagtctgtatgccccggacgccgtggcttcttctggccccatcatcagtgatataactgagctggctccagcctcaccaatggcaagcccaggtggcagtattgacgaacggccactgagcagcagtccactggttagagtaaaggaggagccccctagtccacctcagagtcccagggtcgaggaggcgtccccaggaagaccctcctccgtggacaccctgctttcaccaacagctctcatcgatagcatcttacgggaaagcgagccagcacctgcttccgtgacagccctgacagacgcacgtggacatacggacacagaagggaggccccctagtccaccaccaacgtccacccctgagaaatgcctgtcggtcgcttgtttagataagaatgagttgagcgaccacctcgatgccatggactccaatttagataacttacagacaatgctttcttcccatggcttttccgtcgatacctcggccttgctggatcttttctccccgagcgttacagtacccgatatgtctctgcctgacctagacagtagtttggcctcaatccaagagttgctgtccccacaggagcctccacgccctccagaggcagagaacagttccccggattcaggcaagcagctcgtgcactatacggcgcaaccactgtttcttctggatccaggtagtgtggacacggggtccaacgatctgcccgtattatttgaacttggggagggttcatacttttcggaaggtgacggctttgctgaagacccaaccatctccctgctgacaggttccgaacccccgaaagctaaggaccccactgtgtcctag

SEQ ID NO: 119620 - DNA, 1611 bp, Artificial Sequence
  Description of Artificial Sequence: Synthetic coding sequence
atgaagcagagctccaacgttcccgccttcctgtctaaactgtggacacttgtggaagagactcacactaatgagtttatcacctggagccagaacggccagtccttcctcgtcctggacgagcagcgcttcgccaaagagattcttcccaagtactttaagcataataacatggccagttttgtacggcaactcaatatgtacggattccggaaggtggtccatattgattcgggcatagtgaagcaggagcgagacggccctgtggaattccagcatccctacttcaagcaaggacaagacgacctgctagagaacatcaaaagaaaggtctcttcttctaagcctgaagagaacaagatacgccaggaagatcttacaaagattattagctccgcccagaaagttcagatcaaacaagagaccattgagtctagattgagtgaattgaagagcgagaacgagtccctctggaaagaggtttccgaacttcgcgcaaaacatgcgcaacagcagcaggttatccggaagatcgttcagttcattgtcaccctcgtgcagaacaaccagttggtctcacttaaacggaaacgcccccttctcttaaacacaaacggagcccaaaagaagaacctctttcagcatatcgttaaggaacctacagacaaccaccaccacaaggtcccccacagcagaaccgagggactgaagcctcgcgagcgtatctctgatgatattatcatatacgatgtcactgacgacaacgcagatgaggagaacattccagtgatccctgaaacaaacgaggatgttatcagtgatcccagcaattgcagccagtacccggacattgtgatcgtggaagatgacaatgaggatgaatatgccccggtcattcagtctggcgagcaaaacgaacctgctcgggagagcctctcttcgggctcagatggcagcagccccctgatgtcaagcgctgtgcagctgaacggctcttcgagcctgacatctgaggaccccgtcactatgatggattccattctgaacgacaacatcaatcttctcgggaaggtggaactgctagactatttagattctatcgactgttccctggaggattttcaagccatgttgtctgggaggcaatttagtatcgatcctgacctgctcgtggacctgttcacttcctctgtgcagatgaaccccaccgactatataaacaacaccaaatctgagaacaaagggctggaaactaccaagaataacgtcgttcagccagtcagcgaggaaggtcggaaatccaagagtaagcccgacaaacaactcatccagtacacagctttccctttgcttgccttcttagacggtaatccagcgtcttcagtcgagcaggcgtcaacaacagcttcgtccgaagtgctgagtagcgtggacaagcccatcgaggtggacgagctgctggacagctctttggatcccgaacccactcaatccaaactggtgcggttagaacctttaacggaagcggaggcctctgaggcaactctattctatctatgcgagttggcgcccgcacctctcgactccgatatgccgcttctcgattcttag

SEQ ID NO: 119621 - DNA, 1557 bp, Artificial Sequence
  Description of Artificial Sequence: Synthetic coding sequence
atgaaacagtccagcaatgtacccgcattcctctcgaaactgtggacccttgtggaagagacccacaccaacgagttcatcacttggagccagaatgggcaaagctttctggtacttgacgagcagcggttcgccaaagagatcctcccaaagtacttcaagcataataatatggcctcattcgtacggcagcttaacatgtatggctttcgcaaagttgtacacattgatagtggcattgtaaaacaggaacgggacggtccagttgaattccagcatccgtattttaaacaaggtcaggatgaccttctggagaacataaagcgaaaagtgagcagtagcaaaccggaagagaacaagatccgccaggaggacctgacaaaaatcatttcctccgctcagaaagtgcagattaaacaggaaacaatcgagagcagactaagcgaactaaaatctgagaatgagtcactttggaaagaagtgtcagagttgagggcgaagcacgctcagcaacagcaggtcataagaaagatcgtgcagtttattgtgactctggtgcaaaataaccaattagtcagtctgaaaaggaagcggccactcctgctcaacactaacggtgcccagaaaaagaacctgttccagcatatcgttaaagagcctaccgataaccatcaccataaagtcccccactcccgaactgaagggctgaagccgcgggagaggatttctgatgatatcattatctacgatgtgactgacgacaatgctgatgaggaaaacatccccgtcatccccgaaacaaacgaggatgtcatcagtgatccgtcaaattgtagccagtacccagacatcgtaatagtggaggatgacaacgaggatgaatacgccccggtcattcagtcaggggaacagaacgaacccgcacgggagtctctctcatcgggttccgatggctcgtctccactgatgtcctccgctgtacaattaaacggctcatctagcctgaccagcgaggatcccgtgactatgatggacagcatcttgaacgataacattaatctcttgggtaaagtggagttgcttgattatctggactctattgactgttccctcgaagatttccaggctatgttgtccggccgacagttcagcatcgacccggatctgcttgtcgattccgagaacaaagggcttgaaactaccaagaataatgtcgtgcagcccgtgtccgaggagggacggaagtcgaaatctaaaccggacaaacagttgatccagtataccgctttccccctcttagccttcttagatggtaaccctgcatcctcagtggaacaggcgagtacaactgcctcctccgaggtgctaagcagcgtcgacaaaccaatcgaggtcgatgagctgctggacagtagcttggatccagagcccacacaatcaaaactcgtccgactggagccactgacagaggccgaggcttccgaagccaccctcttttacctgtgcgagctggcaccggctcctttggattccgacatgcccctcttggattcttag

SEQ ID NO: 119622 - DNA, 1005 bp, Artificial Sequence
  Description of Artificial Sequence: Synthetic coding sequence
atgggtgaagccggagcggccgaggaagcttgcagacatatgggcactaaagaagaattcgtcaaggtgagaaagaaggatcttgagcgccttaccaccgaagtaatgcagatccgggactttctcccccgcattctaaacggtgaggtgttggagagcttccaaaaattgaagatagtggaaaagaatctggaacggaaggagcaggaattggaacagcttaaaatggattgcgaacacttcaaggcgaggctagaaaccgtgcaggccgataatatacgagagaagaaggaaaaactggccctaaggcaacagctaaatgaagctaaacagcagctgctgcagcaggcagaatactgcaccgagatgggcgccgcagcctgcacccttctttggggtgtgtccagcagtgaagaggtcgtgaaagctattcttggcggggataaagcgttgaagtttttctccattacaggacagactatggagtcctttgtgaagagtctagacggagacgtccaggaactcgactccgacgaatcccagtttgtgtttgccctcgccggtatagtcacgaacgtggcagctattgcatgcggcagagaattcctggtaaacagcagcagagtcttactggataccatcctgcagttgctgggggatctgaaaccggggcagtgtacaaagttgaaagtactgatgctgatgtctttgtacaacgtgtctataaatttgaaagggctcaagtacatcagcgaatctccaggatttatcccgctcttgtggtggctcttgtctgatcctgacgctgaagtgtgtctgcacgtcctcagattggtgcaatccgtcgttctggaaccagaagtctttagcaaatctgcaagcgaattccgttcctctttacccctgcagagaatccttgctatgagtaagtcacggaaccctagactgcagaccgccgctcaggagctgctagaggacctcagaacattggagcataatgtgtag

SEQ ID NO: 119623 - DNA, 780 bp, Artificial Sequence
  Description of Artificial Sequence: Synthetic coding sequence
atggattgtgaacacttcaaagctcggctggagacggtgcaggccgacaatattagagagaaaaaggaaaagctggctctcaggcagcagctgaatgaggccaaacagcagcttctgcagcaagcggaatactgtaccgaaatgggagctgctgcatgcacactgctgtggggggtctctagttccgaggaggtggtcaaggccattttaggcggcgataaggctttgaagttcttcagcattacagggcagactatggagagcttcgtgaaaagcctggatggggacgtccaggagctcgacagcgatgaatcgcaattcgtgtttgcactggcaggcatcgtcacaaacgtggcggcaattgcttgcgggcgggagtttctcgtgaattctagccgtgttctgctggacactatactgcagctgcttggcgaccttaagcccgggcagtgtaccaaactgaaggttttgatgctgatgagtctttataacgtaagtattaacctaaaggggttgaaatacatcagcgaatctcccgggtttatcccccttctgtggtggctgctgtctgaccctgatgccgaagtgtgcctgcacgttctgaggctcgtgcagtctgtggtattggaacctgaggtgttttccaagagtgcctcagagtttcgctccagcctgcctttacagagaattttggccatgagcaagtctcgtaatcctcggttacagaccgccgcgcaagagctgttggaggacctgcgcacactcgagcacaatgtttag

SEQ ID NO: 119624 - DNA, 1479 bp, Artificial Sequence
  Description of Artificial Sequence: Synthetic coding sequence
atgcaagaagcacccgccgccctcccaaccgaacctgggccctctccggtccctgctttcctgggaaaactatgggctctcgtcggagatccaggtactgatcatttgatcaggtggtctccctctgggacaagcttccttgtgtctgaccagtcacgattcgctaaggaagttttgccacagtactttaaacactctaacatggctagttttgtccggcaactcaacatgtatgggtttaggaaggtcgtgtctatagagcaaggtggactccttagacccgagcgagatcatgttgagtttcagcatcctagttttgttaggggccgggagcagttactggagagggtgagaagaaaggtgcctgcactgagaggggatgacggacggtggcggcctgaggatttgggacgactactgggcgaagtccaggccctaaggggggtacaggaatccactgaagcaagactgcgggagctcaggcagcagaacgagatcttgtggagggaagtagttactttgcgccagtctcacggacagcagcatagggtgatcggcaaacttatccagtgcctgttcggtccccttcaggccggcccatccaatgcagggggcaaaaggaagttatccctgatgctagacgagggtagtagctgtcccacgcctgccaaatttaatacctgccctcttcctggcgccctgctgcaggatccatattttattcagagccccctgcccgagacgaatcttggattgtcgccacaccgagctagggggcccattattagcgacatccccgaagatagtccaagccccgagggtacgcggctgtcgccctcaagtgacggaagacgggagaaaggactagccttgctgaaggaggaaccagctagcccaggcggggatggggaagccggcctggcccttgctcctaacgagtgcgatttttgcgtgaccgctccaccaccgctgcccgtcgccgtggtgcaggctattctcgaaggaaaaggaagcttctctcctgagggcccacgtaacgctcagcagcccgaacccggagaccctagagaaatcccagacagggggcccctgggcctggagtctggcgacagatctcccgaatctttgctacctcccatgctgctgcagcctccccaggagagtgtggaaccggcgggaccactggacgttctgggtccatctctccaggggagagaatggactctaatggatctagatatggagctcagtcttatgcagccattggtaccagagagaggagaaccggagctagccgtgaagggactgaacagtccctcacccggaaaggacccgaccctgggcgcacccctgttgcttgatgtccaggctgcccttggggggcctgctctcggcctgcctggagcgctgacaatttatagcacacctgagagcagaaccgcctcatatctggggcccgaagcatcccctagtccatag

SEQ ID NO: 119625 - DNA, 1389 bp, Artificial Sequence
  Description of Artificial Sequence: Synthetic coding sequence
atgcaagaagcccctgcagccctgccaaccgagcctggcccgtctcctgtgcccgcgttcctaggaaaactgtgggctctggtgggagatccaggcactgatcacctcatcagatggtcaccgagtggaacctcctttctggtatccgatcaatcgcgatttgccaaagaagtgctgccacagtattttaaacatagcaatatggcttcctttgtgaggcaactcaatatgtacggctttagaaaggtagtttccatcgagcagggcggccttctgcgccctgagagggatcatgtcgagttccagcatcccagctttgttaggggtcgggagcagctgctcgagagggttcgccgcaaggtgcccgcccttcgcggcgatgacggtcggtggcgccccgaggacttggggcgcctactgggcgaggtccaggctttacgaggagttcaagagtccactgaggccaggctgcgcgagctgagacagcagaatgagatcctctggagggaagtagttacattgaggcagagccatgggcaacagcaccgcgttatagggaagttgattcagtgtctgtttggtccacttcaggcaggacccagcaatgctggcggaaagcgcaaactgagcctaatgctcgatgaaggatctagctgcccaacacctgccaaattcaacacatgtcccctgcctggggccctactgcaggacccatactttatccagagcccgtcgacgtactcactgtcccagcgccaaatctgggccttggctctgactggacctggcgccccttcttcactaacctcccagaagacgttgcaccctttaaggggccctggtttcctgccacccgtgatggccggggcaccccctcccctgccagtggctgtggtccaggcaattcttgaggggaagggatctttcagcccagagggtccgcgaaacgcccagcagcccgaacccggcgatccccgggaaatccccgatagagggcctcttggcttagaaagtggcgacaggtcgcctgagagtctgctgcctcccatgcttttgcagcccccacaagagtcagttgagccagcaggcccactagacgtgttgggccctagcctccaaggccgggaatggacccttatggacctcgacatggagttatctctgatgcagcccctcgttcccgagcgtggcgagccagaactggcagtgaagggattaaacagcccaagccctggcaaggacccgactctcggcgccccactgttacttgacgtacaagctgccctgggagggccggcactgggtctccccggtgcccttacgatttattccacgccagagagtcgcacagcctcttatctcggcccggaggccagtccatctccatag

SEQ ID NO: 119626 - DNA, 1251 bp, Artificial Sequence
  Description of Artificial Sequence: Synthetic coding sequence
atgcaggaagcacctgccgctctgccgactgagcccggtccgagtcccgtgcctgcctttttgggtaaactgtgggctttagttggcgacccaggtacagaccacctcataaggtggagtccctccggaacctccttcctggtttccgaccagagccggtttgccaaggaggtattgccgcagtactttaagcacagcaatatggcctcattcgtgaggcagttgaatatgtatggtttccggaaggtcgtgagtatcgaacaaggcgggctgctccgaccagaaagggaccatgtggagtttcagcacccaagtttcgtgagaggccgagagcagctccttgagcgagtgcgccgcaaggtccctgccctgcgtggagacgatggccgctggagacccgaagacctaggccgcctgctgggggaagtgcaggcccttaggggagtgcaggaaagcaccgaggctcggcttcgggaactgcgacagcagaacgaaatcctgtggcgggaagtcgtgaccttgcgccagtcacacggacagcagcatcgagttatcggcaagcttatccagtgtctattcggccccctccaggccggtccttctaacgccgggggtaaacggaaactgagtctgatgttagatgagggttcctcctgcccaacacctgcaaagtttaatacctgtcctctccctggggccctcctgcaggacccctattttatacaaagccctttgcccgaaacgaaccttggactgtccccgcatcgggccagaggccccatcatctccgacattccggaagattcaccgagtccggaagggacaaggctcagtcctagctcagacggacggcgtggtccgcttggcctggagagtggagatcggagccccgagtctcttttgccgccaatgttgctgcagccacctcaggagagcgtggagccagcaggccctttagacgtgcttggaccaagcctgcagggaagggagtggaccttgatggatctggatatggagttgagcttgatgcaaccattagtgccagaacgtggtgagccagaactggcagtgaaggggctgaatagcccatcacctggcaaagacccgacattgggcgctcctctactgctggatgtgcaggcggcattgggcgggcctgccctggggctgccaggcgccttgaccatttacagcacacccgagagccggacagcaagttacctaggtccagaggcaagccccagcccatag

SEQ ID NO: 119627 - DNA, 1479 bp, Artificial Sequence
  Description of Artificial Sequence: Synthetic coding sequence
atgcaggaggctcccgcagcgctgcccaccgaaccgggtccaagtcccgtcccagcattcctgggaaaactgtgggccttggttggcgaccctgggactgatcatctcatccggtggtccccaagcgggacgagcttcttggtgtccgaccagtcaagatttgccaaggaggtgctgccccaatattttaaacacagtaacatggccagcttcgtgaggcagctgaatatgtacggattcaggaaagtcgttagcattgagcagggggggctgctacgccctgagcgcgaccatgtggaattccagcatcccagcttcgttcgagggcgtgagcagttgctggaaagagtcagaagaaaggtcccggctctgcggggtgacgacgggcggtggaggcctgaggatttgggaaggctcctgggggaggtgcaggcacttaggggagtgcaggagtctactgaagcaaggctgagggaactgcgccagcagaacgagatcctgtggagggaggtagtgaccctgaggcagtcacacgggcagcagcacagggttatcggaaagctcatacagtgtctgttcggtcccctccaagctgggccatctaatgccggcggaaaaaggaagctttcactcatgttggacgaggggtcttcgtgcccgacgcccgccaagtttaacacatgtccgctacctggggccctgcttcaagatccctattttatccaatctccactgccggaaaccaatctaggactgtccccccatcgggctagaggccccatcattagtgatataccagaggactcgccttctcccgaaggcacacggctgagccctagctctgacggacggcgcgagaagggactcgcgctgttgaaggaggagcctgcctcacccggaggcgatggcgaagccgggctggcgttagcacctaacgaatgtgacttttgcgttacagcacctccacctctcccagtggcagtcgtgcaggccattctagaaggtaaggggtccttttctccggaaggtccccgaaacgcgcagcaacctgaaccaggtgaccctcgcgaaatccctgacagggggccactgggccttgagagcggggaccgttcaccagagtctctgctcccgcctatgttactgcagccaccgcaggaatccgtcgagccagccggtccgctggacgtgctgggcccgagtttgcagggacgtgaatggaccctcatggatctcgacatggaactctccttgatgcaaccactggtccccgaacggggagagcctgaacttgccgtgaaaggcctgaattctcctagccctggtaaagatcctaccctgggcgcccctctactgctggatgtacaggccgcgttaggagggcctgcgctggggttgccgggggccctcacgatctattccacaccagagagccgcactgcatcatatctggggccagaggcatccccctctccgtag

SEQ ID NO: 119628 - DNA, 9 bp, Artificial Sequence
  Description of Artificial Sequence: Synthetic coding sequence
atgcagtag

SEQ ID NO: 119629 - DNA, 414 bp, Artificial Sequence
  Description of Artificial Sequence: Synthetic coding sequence
atgagttctctcatccgtcgggtaatctccaccgcaaaggcccccggggccattgggccttatagccaggccgtactggtggaccgcacgatctatatttcggggcagatcggtatggatccatccagcgggcagctcgtctccggcggggtggctgaggaagcaaaacaggccctcaaaaatatgggcgaaatcctgaaggccgcgggatgcgactttaccaatgtggtgaaaacaactgtcctgttagccgatatcaatgacttcaacacagttaacgaaatctataaacaatattttaagagcaatttcccagctagagctgcttaccaagtggccgctctgcccaaaggctcaagaatcgaaatagaagctgtggcaatccagggacctctgactacagcttcactctag

SEQ ID NO: 119630 - DNA, 14505 bp, Artificial Sequence
  Description of Artificial Sequence: Synthetic coding sequence
atgccttcggaatccttctgcctcgcagctcaggctcgtctggattctaaatggttgaaaacggacatacagttggccttcacccgtgatggattatgtggactctggaacgagatggtgaaggacggcgaaattgtatacacagggaccgagtccacacaaaacggggaacttccaccacgaaaagatgacagcgtcgagccctccggcaccaaaaaggaggacctgaacgataaggagaaaaaggatgaggaagaaacccctgccccaatttatagagccaagtctatcctggattcctgggtgtggggaaagcagcccgatgtcaatgagctaaaagagtgcctcagtgtactggtcaaggaacagcaggcattggcggtccagagcgccactacgacactctccgccctgcgcctgaagcaacgattagtgatcctggagaggtacttcatcgctctgaataggacggtgtttcaagagaacgtgaaggttaagtggaagagctctggcatttcgcttcccccagtcgacaagaagtcatcacggccagctggtaaaggggtcgaaggccttgcgcgcgtgggaagccgtgccgcactgtcattcgcttttgcgtttctgcgtagggcttggcgatctggcgaagacgctgatctgtgttccgagctgcttcaggagtcacttgatgctcttagggctctcccggaggcctcactgttcgatgaaagcaccgtttctagtgtttggctcgaggtggtggagcgggccactcgctttttaaggagtgtcgtgactggcgatgtccacggaactcccgccacaaaaggccccggaagtatacctctccaagatcagcatctggcactcgcgatactgctggagctagccgtgcagaggggaacactgagccaaatgctttcagccatcctgcttctgctccagctctgggactctggagcccaggagacggataatgaacggtctgcacaagggacgtcagcgcccctgctgccactgctgcaacggttccagtcaatcatctgccggaaggacgctcctcatagtgagggggatatgcacctcctttctggacctctctcacccaacgaaagtttcttgcgttacctcaccctgccacaggacaatgagcttgctatagacctcagacagactgcggtcgttgttatggctcacctcgatcggctggcaaccccctgtatgccccccttgtgctcaagccctacctcccataagggaagtctccaagaggttatcggctggggactgatagggtggaagtattacgccaacgtaatcggtccaattcagtgtgagggacttgccaacctcggtgtgactcaaattgcctgcgctgagaaacgctttctgatcctgtctcgcaatggaagagtttatacccaggcctacaactctgataccttggcaccgcagctcgtccaaggcttggccagccgtaatatagtaaaaatcgccgcacactcggatggtcaccattatctcgcgctggcggcgaccggagaagtctactcttggggctgcggggatggaggaaggctcggacacggcgatacggtgcccttagaggaaccaaaggttatctcggctttcagtggcaagcaggctggaaaacatgtcgtgcacatcgcttgtggaagtacatactctgcagcaatcaccgcagaaggtgagctgtacacctggggacgcgggaactacggcaggttgggccatgggtccagcgaggatgaggccatccccatgctggtggccggcctcaaaggtctcaaggtgatcgatgtcgcctgtggctcaggcgacgctcagactctagctgtgactgaaaacggccaggtgtggagctggggggacggagactacgggaaactgggcaggggtgggtcagacgggtgtaaaacacccaagctgatcgagaaattacaggatttggacgtcgtaaaagtgcgatgtggtagccagttctcaatcgctctcacgaaggacggacaagtgtattcttggggtaaaggggataaccagaggctggggcacgggaccgaagagcatgtgcggtatcctaagctgttggaaggtctgcagggaaaaaaagtgattgatgtggctgctggctctacacactgtttagcgttaactgaggatagcgaggttcactcatggggcagcaacgaccaatgccaacatttcgatactctgagagtcaccaagccagagccggcagcactgccgggactcgacactaagcacatcgttggcattgcttgcggccctgctcagtccttcgcctggtcgtcctgtagcgaatggtctataggactgagagtcccttttgtcgtggatatttgctcaatgacctttgagcagctggacttactcctacgacaggtcagcgaggggatggatgggagcgctgactggcctcccccccaggagaaggagtgtgtcgcagtggccaccttaaaccttctgagactgcaactccatgccgcaataagccatcaggtcgaccctgagttcctcggactcggcctgggctctatcctgctgaactctctcaaacagaccgtggtaacattggcttctagtgctggggttctctcgacagttcaatctgccgcgcaggccgtgctgcagtctgggtggtccgtcctgctgcctaccgcagaggagagagcccgcgctctgagtgccttgctgccttgcgcggtctcaggaaacgaagtgaatatttctcccgggcggaggtttatgatcgatttacttgtcgggtcattaatggccgacggagggttggaaagcgctctgcatgccgcgatcactgcagagattcaggacatcgaggctaagaaagaggcacagaaagagaaagaaatcgacgagcaggaggcaaatgcctctacttttcaccgctccagaacccccctcgacaaagaccttatcaatacgggtatctgcgaaagcagcggaaaacagtgcttgcctctggtccagttgattcagcaattgctgagaaatatcgcctcccagaccgtggccagactcaaggacgtagctcggagaatcagttcttgcctggactttgaacagcatagtcgagaacgcagtgcctcactcgacctgctgttgaggttccagagacttttgattagtaaactttatcccggcgagtccattggacaaacgtctgatattagttctcctgagctcatgggggtgggaagccttttaaagaaatacacagcgctcttatgtactcacataggcgacattctgccagtagctgcaagtatcgccagcacaagctggcgacacttcgctgaggtcgcctacatagtggagggtgactttaccggtgtgctgctgcctgagctcgtcgtgtccattgtgctacttctctctaaaaatgccggactcatgcaggaggccggagcggtgcctctgctgggcggactcttagaacatctggatagattcaatcacctggctccaggaaaggagcgtgacgatcatgaggaactggcctggcccggcatcatggagtccttttttaccggccagaactgccgtaataatgaagaggttactttgatcaggaaggcggacctggagaatcacaacaaggatggcggcttctggactgtgatagacgggaaggtatacgacattaaggactttcagacgcagtccttgacaggcaacagcatactggctcagtttgccggagaagatcctgtcgtcgctctggaggccgcattgcagtttgaggacactcgcgagtcaatgcacgccttctgcgttggacagtacttggagccagatcaggagatcgtaactatcccagacctgggaagtctctccagcccccttatcgacactgagagaaacctcggactgctgctgggtctgcacgcttcttaccttgcgatgtctacaccactctccccggtagagatcgagtgtgctaagtggctgcagtccagcatcttttccggcggactccagacatctcagatccactactcctacaacgaggaaaaagacgaagaccattgctcatctcccgggggcactccagcctctaagtcaagactatgcagtcacaggcgcgcacttggtgatcattctcaggccttcttgcaggcaattgcggataacaatatccaggaccacaatgtgaaggatttcctgtgccagatcgagagatactgccgccagtgtcacttgacaaccccgattatgttcccgcctgagcatccagtcgaggaggtgggcagactgctgctctgttgtttgctgaaacacgaagatctcgggcacgttgctctctccttagtgcacgccggagcactcggcatcgagcaggtcaaacatagaactctgcccaagagtgtggtcgatgtctgtagagtagtgtatcaagctaagtgctctctcatcaaaacacaccaagagcagggtagatcctataaagaagtgtgtgcaccagttatcgagcggctgagattcctcttcaacgagcttcgacccgccgtgtgcaacgatctgtctatcatgagcaaattcaaattactttcttctctgccacgctggcgcaggattgcacagaagattatccgggagagacgtaaaaagagggtccctaagaaacctgaatctacagacgacgaagaaaagatcgggaatgaggaatctgatctggaggaggcctgcatcttgcctcactctccgataaatgtggataagcggcccatcgccattaagtctccaaaggacaagtggcagcctttattgtccacggttacgggtgtacacaagtacaagtggctgaagcaaaacgtgcaggggctgtaccctcagagtcccttactgtccaccatcgctgaatttgccttgaaggaggagccggtggatgtggagaagatgagaaagtgcctgctgaagcaactggaacgcgctgaggtgcgcctggaaggcatcgacaccatcctgaaattggcgtctaaaaacttcctgcttccaagcgtgcagtacgccatgttctgcggctggcagcgactgatccctgaggggattgacattggagagcctttaacagattgcctgaaggacgtggatctaattcctcctttcaatcggatgctcctagaggtgacatttggcaagctctacgcctgggccgtgcagaacattcgcaacgttcttatggacgcgagtgccaagtttaaagaactaggcatccaacctgtgcccctgcagaccatcacgaacgaaaatccttctggcccttccctgggtactattccccaggcccgcttcctcctcgttatgctcagcatgttgactctgcaacatggtgcaaataatctcgatttgctgctgaatagcgggatgctggcattgactcagactgcgctacgcctgatcgggccatcttgtgataacgtcgaggaagacatgaatgcctcagctcagggagcctccgccaccgtactggaggaaacaaggaaggagacggcccccgtccagctccccgtgagcgggcctgagctcgccgccatgatgaagattgggactcgggtgatgagaggagtagattggaaatggggggaccaagatggtcctccccccggcctcggcagggttatcggcgaacttggagaagatgggtggattagagtgcagtgggataccgggagtaccaacagctaccgtatgggcaaggaaggaaaatacgatctgaaattggcggagctccccgcggctgcacagccatcagccgaagattcagataccgaggacgacagcgaagctgagcaaactgagagaaacatccatcccactgccatgatgtttacaagtacaatcaatctgctgcagactttatgcctgagtgcaggggtacatgccgaaatcatgcagtctgaagccacaaaaacactttgcggattactgcgcatgttagtggagagtggaactacggacaagacttcttcaccaaataggctggtctatcgagaacagcatagatcctggtgcactctgggatttgttagatcgattgctctgacaccacaagtctgcggcgccttgtcctcaccacagtggatcaccctgctgatgaaggtcgtcgaggggcatgctcccttcaccgccacatctctccaacggcagatcctcgcagtacaccttctccaagctgtgctacctagttgggataagaccgaacgtgccagagacatgaagtgcctggtggagaaattatttgacttcctggggtcattgctgaccacatgttcaagcgacgtcccacttttgcgcgaaagcactttgaggaggagaagagtccgccctcaagccagcttgacagctacacacagcagcactctggctgaagaggtcgtggcccttctccggacactacattcactgacccaatggaacggcctgatcaataaatacatcaattcccaattaaggtccattacccactctttcgtgggcaggcctagcgaaggagcccagttggaggactactttcctgactccgagaatccagaagtcggaggtctgatggctgtcctcgcggtgattggtggcattgatggtcgattaagattgggcggtcaggtgatgcacgacgagtttggcgaaggtacagtgaccagaattacgccaaaagggaagattactgtgcagttctccgacatgcggacttgtagggtctgtcctcttaatcagctcaaacctttgcccgcagtggcgtttaatgtcaacaacctaccattcacagaacctatgttgtctgtgtgggcgcagttggtcaatctcgcaggatctaagctggagaaacacaaaataaagaagagtactaagcaggcgtttgccggacaggtagatctggatctgctgcgctgccaacagctgaaattgtacatcctgaaggccggcagggcactgctatcacaccaggataagctccggcaaatcctctctcagccagctgtgcaagaaacaggcaccgttcacacagatgatggggctgtagtaagtcctgaccttggggatatgtctcccgagggtccccaaccaccgatgattctcctgcagcagctcctagccagcgccacccagccctcccccgttaaggcaatctttgacaagcaggaactcgaagccgccgccctggcagtgtgccagtgcttagccgtggagtccacacatccgagctctccgggcttcgaggactgttctagctccgaagctacgacccccgtggcggtacagcacatcaggccagcccgggtgaaacgccggaagcagtctcctgttccagctctgcctattgtcgttcagctgatggagatggggttttctaggagaaatattgagtttgctttgaaatcccttacaggggcctccggaaacgcctcttcattgccgggcgtcgaagccctagtgggatggctcttagaccactccgacatccaggtgaccgaactgtcagacgccgatacagtgagcgacgagtactccgatgaggaggtggtagaggatgtggatgacgccgcgtacagtatgtctacaggcgccgttgtcaccgagtcgcaaacatataagaagcgagcagacttcctgtctaacgacgattacgccgtttacgtacgtgaaaacattcaggttggcatgatggtgcgatgctgccgggcatacgaagaggtttgcgagggcgatgtggggaaggtgattaagttggaccgagatggcctccatgaccttaatgtgcagtgcgactggcaacagaagggggggacttattgggtcagatatatccacgtagagcttatcggctacccccccccatcaagctcttctcatatcaaaattggggataaagttcgagttaaagcttctgtgaccaccccaaaatacaagtgggggtccgtgacccaccagagcgtgggagtagtcaaagccttctcagccaacgggaaggatattatcgttgattttccgcagcaaagtcattggacgggcttgttatccgagatggaactcgtgccaagtatccatccgggcgttacatgcgacgggtgccagatgttcccaatcaatggatcacgttttaaatgccgcaattgcgatgacttcgatttttgtgaaacatgttttaaaaccaagaagcataatacaagacatacgttcggacggatcaatgaaccagggcagtccgctgtgttctgtgggaggtccggtaagcagctgaagcgatgtcacagttctcaacccggaatgctgctggattcttggagtagaatggtgaaatctctcaatgtgagcagttctgtaaaccaggcgtcccggttaatcgacggaagcgagccctgttggcagtcatctggttctcagggtaagcactggatacggctcgaaattttccccgatgtgttagtacatagactaaagatgatcgtcgatcccgccgattcatcatatatgccttcactggttgttgtgtcaggagggaactctcttaataaccttatcgagttgaagaccattaacatcaacccctcagatacaaccgtgcctctgctgaatgattgtaccgaataccatcgctatatcgagattgctatcaaacaatgccggtcctccgggatagattgtaagatccatggtctgattctattggggcgaatccgcgcagaggaggaggatctggccgctgttcctttcctggcctccgataacgaagaagaggaagatgagaaaggcaattctggatcactaattaggaagaaagctgccggcctagagtctgccgcaaccatacgcacaaaagtctttgtttggggcttgaacgacaaggatcagctgggaggactgaaaggaagtaagatcaaagtcccctccttctcagagacactctcggctcttaacgttgtgcaggtcgcgggaggatccaagtcactgtttgcggttacagttgaagggaaggtctacgcctgcggagaggcaaccaatgggagactggggctgggcatcagttcaggtaccgtcccaattccaagacagatcacggcgttaagttcttatgttgtcaaaaaagttgcggtacacagtggcggccgtcatgctacagcattaacagtcgatggaaaagtgttttcttggggcgagggcgacgatggtaagctggggcacttttccagaatgaactgcgacaagcctcggctcattgaggcactcaagacaaaacgcatcagggatattgcttgtggcagctctcattccgccgcactgacctcatctggggagctgtatacatgggggctgggcgagtacgggcggcttggacacggggacaacactactcagctgaaaccaaagatggtcaaggttctgctcggccacagagtcattcaggttgcgtgcggatccagagacgctcagaccctcgcactcaccgacgaaggcttggtgttttcttggggtgatggggacttcggcaaactcggacgagggggatctgaaggctgcaatatcccccagaacatcgagcgcttgaatggccagggggtgtgccagatcgagtgcggcgcccagttcagtctggctctgaccaaatctggtgttgtatggacctggggcaaaggcgattacttccgactcggccatggctccgatgtgcacgttcgcaagccacaggtcgtggagggtctcaggggaaagaagatagtgcacgtggccgtcggagcactccactgcttagcagttacggattcggggcaggtctatgcctggggagacaacgatcatggccagcagggcaatggaacaacgaccgttaacagaaagccaaccctcgtgcagggacttgaggggcagaaaataacgcgagtggcctgtggttcctctcactccgtggcctggactaccgtcgacgtagcaactccttccgtgcatgaaccggtgctgttccagaccgccagagatcctctgggcgcgtcctatttaggagtgccgagcgatgctgacagcagcgccgccagcaacaaaattagtggagcaagcaacagcaagcccaacaggcctagcctggccaagattttgttgtcgctagacggtaacttagccaagcagcaggcacttagtcatatactgacagctcttcaaatcatgtatgccagggacgcggtagtcggagccctgatgccagccgcgatgatcgcccctgtcgagtgcccgagtttcagttcagccgctccctccgatgctagcgccatggccagtcccatgaacggcgaggagtgcatgctggccgtagacattgaggacaggttgtctccaaacccctggcaagagaagcgggaaatcgtgtcaagcgaggatgctgtgaccccctcggcggtcaccccctctgctccctcagcaagtgcccggccctttattccagtgacggacgatttgggagctgcgagcatcattgccgagacaatgacaaaaaccaaggaggatgtcgaatcgcagaataaagccgcaggtccagagccccaggcacttgacgagtttacgtccttactgattgccgacgatacgagggtggtcgtcgaccttctgaagttatcggtgtgcagcagagccggggaccgagggagagatgtactgtcagccgtgctgtccgggatgggcactgcatacccacaagtggccgacatgctgcttgaattgtgcgtgaccgagctggaggatgtggccactgacagccaaagcggacggctgtccagccagcccgtcgtggtagagagtagccacccatacacggatgacacttccacttccggcaccgtgaagatcccaggagctgagggactgcgagttgaatttgacaggcagtgctctacagaaagacgccacgatcccctaacagttatggatggagtgaacaggattgtcagcgtccggagcggcagagagtggagtgactggtcctctgaattaagaatacctggagacgaacttaaatggaagttcatctctgacggtagcgtcaacgggtggggttggcgctttaccgtgtaccccattatgcccgccgccggtccgaaagagctgttgagcgatcggtgtgtcctgtcttgtccatctatggacttggtaacctgtttgctggacttccggctaaaccttgcgagtaaccgctccattgtccctcgtctcgccgcctccctggccgcttgcgcccagctttctgctcttgcggcaagtcatcggatgtgggctctccaaagactcagaaaactgctcaccaccgaatttggccagagcattaatatcaatcggctcctcggggagaatgacggggaaactagggcgctgagcttcacaggctccgcgttagctgcactggttaaggggttacccgaggccttgcagaggcagtttgagtacgaggatcccatcgtgcgaggcggaaagcaactgctgcactcgccattctttaaggtgctagtcgcgctggcttgcgacctcgaactggacactctgccatgttgtgccgagacacacaaatgggcttggtttagacggtattgtatggcaagccgggtggccgtggccttggacaagcggacgccccttccacgcttgtttctggatgaagtcgccaaaaagattagagagctcatggccgactcggaaaacatggacgtcctccacgagtcacatgacatcttcaagcgggaacaggacgaacaacttgtccagtggatgaatagacgcccagacgattggactctatcagcagggggatccggtactatttatggctgggggcacaaccacagggggcagctcggaggcatcgagggggccaaagttaaggttcccaccccctgtgaagcactggctaccttgaggccagttcagctgattggcggagaacaaactttgtttgctgtaacggcagacggcaaactgtacgctaccgggtatggagccggaggtcgtctgggcattgggggcacggagtccgtcagtactcccactctgttagagtccattcaacacgtattcattaaaaaggtggccgtcaacagtgggggaaagcactgtctggcccttagttccgaaggggaggtttacagttggggggaggccgaagatgggaaactggggcacggcaatagatccccttgcgataggccccgtgtgatcgaatccctccgcggcattgaggtagtagacgtggccgcaggaggtgcccacagcgcttgcgtcacggccgctggagacctgtacacttgggggaagggtcgctatggacgactgggtcactccgatagtgaagatcagctcaaacccaaactggtcgaggctcttcagggtcatagagtggtggatatcgcatgtggcagcggagatgcgcagaccctttgcctaaccgatgacgatacagtgtggtcatggggggacggtgactacggaaagcttgggcggggtggcagcgatggatgtaaggtgccgatgaagatcgacagcctcaccggcctaggtgtagtcaaagtggaatgtgggtctcagttttccgtcgccttaaccaaatctggagcggtgtacacatggggaaagggggattaccataggctcggccatggatctgacgaccatgtccgcagacccaggcaggtgcagggtctgcaggggaagaaggttatcgcaatagccaccgggtcactccattgtgtgtgctgcacggaggacggcgaggtctacacgtggggggacaatgatgaagggcagttaggcgacggcacaaccaacgctattcagagaccaaggctggtggctgctctacagggcaagaaagtaaatagagtcgcctgtggatccgcccataccttggcctggagcacatcaaaacccgcctccgctggtaagctgcccgctcaagtaccaatggagtataaccatcttcaggagatccctatcatcgcactgcgaaaccggttgctcctgctgcatcatctgagtgaactgttttgcccgtgtatcccaatgttcgatctggaggggtctctcgatgagacgggacttggcccctccgtcggctttgacacattgcggggcattttaataagccagggaaaagaagccgcctttcggaaggtggttcaggcaacaatggtccgggacaggcagcatgggcctgtcgtcgagctgaacagaatacaggttaagcgctcaagatcaaaggggggtttggccggaccggatggcacaaaatctgtctttggacaaatgtgtgcaaaaatgtcatcgtttggcccggattcccttctcctccctcaccgggtttggaaggttaaatttgtcggtgagagcgtggacgactgtggcggagggtattccgagtccatcgccgagatatgtgaggagctacaaaacggactgacaccactgttgattgtaactcccaatggaagggatgaaagtggcgctaaccgcgactgctatctcctgtcccccgccgcaagggcacctgtccattccagcatgttccggtttttgggagtgttactgggaattgcgatcaggaccggatcccctctcagtctgaatcttgctgaaccagtatggaaacaactggccggaatgtccctgaccattgccgacttgtcagaggtcgacaaagacttcatcccgggtcttatgtacattagagataatgaggctacatctgaagagtttgaggccatgtctctccctttcaccgtgccatctgcttctggacaagacatccagctctcatcaaaacatacccatattacccttgacaaccgagcggagtatgtgcgcctggcgatcaactaccgactgcatgaattcgatgaacaggtcgctgctgtgcgggaaggcatggccagagtggtgcctgtacctctgctgtcactgttcacggggtacgagctggagactatggtgtgtggatccccagacattcccctgcatctgctgaagtccgtggctacgtacaaagggatcgagccaagtgcatctctcatacagtggttctgggaagtcatggagagttttagcaacacggagagaagcctctttcttcgtttcgtttggggccggaccaggctcccccgcacaattgctgattttcgaggacgtgacttcgtgatccaggtgctggataaatacaatccgcctgatcactttctgcccgaatcatacacgtgctttttccttctgaagctgcccaggtacagctgcaagcaggtattggaggaaaagctaaagtacgctatccatttctgtaaatcaattgataccgatgactacgcccgaattgccctgaccggagaaccggccgccgacgactcctcagacgactccgacaatgaagatgttgactcattcgcctctgattcgacacaggactatctgaccgggcattag

SEQ ID NO: 119631 - DNA, 3075 bp, Artificial Sequence
  Description of Artificial Sequence: Synthetic coding sequence
atggaaagacgatcccgccgaaagagccggagaaacggcaggtccacggccggcaaagctgcggccacccagcccgccaagtctcctggggctcaactgtggctctttccttccgccgctgggttacatcgggctttactaagacgcgtggaggtgacacgccagttgtgttgttctcctggccgcttggctgtgctcgagagaggcggcgctggcgtccaggtccaccaactgttagccgggtccggcggcgcacggactcctaaatgtattaaactggggaagaatatgaaaatccacagcgttgatcagggcgcagaacacatgctgatcctctcaagcgacggcaagcccttcgagtacgacaattatagcatgaaacatttgcgcttcgaatccatcttacaagagaagaagattattcaaataacctgcggcgactatcacagcttagccctcagcaagggcggggaactttttgcctggggccagaatctgcacggtcaattgggcgttggccgcaaatttccatctaccaccactcctcagatcgtcgagcatctggcaggcgtgcctttggctcagatttccgccggagaggcccattcaatggccttgagcatgagcggaaacatttattcttggggcaaaaatgagtgcggccagttaggactcgggcatactgaaagtaaagatgatcctagcctcatcgaggggcttgataaccaaaaggtggaattcgtggcttgtggaggctcgcacagcgctttgctgactcaggacggactgctgtttaccttcggggctgggaaacacggccagcttggtcataattcaacccaaaacgaattacgtccatgtctggtggctgagctggtcggttaccgtgtgactcagattgcctgtggacggtggcatacgctggcatacgtgtccgatttaggaaaagtcttctcttttgggagcggaaaagacggacagttggggaacgggggcactagggatcaactaatgcccctgccggtcaaagtgtcatcatcagaggaattaaaactggaaagccacacctccgaaaaagaattaatcatgatcgcagggggcaatcagtccattttgctatggattaagaaagagaattcatacgtgaacctgaagcgcacgatccctaccttgaacgaaggtaccgtgaaacgctggatcgccgacgtcgagacaaagcggtggcagagtaccaaacgagagattcaggagatcttctccagcccagcatgcctgacaggctcttttttaaggaaacgtcgaacaaccgagatgatgcctgtgtacctcgatctcaataaggcccgcaatatctttaaggaactcacacagaaggattggatcacaaacatgatcacaacctgtctaaaggacaatctgcttaaacggctcccctttcactctccaccacaggaggcattagagattttcttcctcctgcctgaatgccctatgatgcacataagtaacaattgggagagtctagtcgtaccattcgcaaaggtggtgtgcaagatgtcagatcagagttcgttggtccttgaggaatactgggccacactgcaggagagtaccttcagtaaacttgtgcagatgttcaaaacagctgtgatctgtcagttagactattgggacgagagcgctgaggaaaacggcaacgtccaggcactgctcgaaatgctgaaaaaactccaccgggtgaatcaggtcaagtgtcaactaccagagagtatcttccaagtggatgagcttttgcaccggctcaatttctttgtagaagtctgtaggcggtatttgtggaagatgaccgtcgacgcgtcagagaatgtgcagtgctgtgtcatcttcagccactttccctttatcttcaataatctctctaagattaagctgcttcacacagacaccctgctgaagatcgagtcaaagaagcacaaggcatatcttaggagtgctgccattgaagaggaacgggagtctgaatttgccctgcggcctacatttgatctcacggtacggagaaaccatttgattgaggacgtcctgaaccagttgtctcagtttgaaaacgaagacctgcgcaaagagctttgggttagcttttcaggagagattggttacgaccttggaggagtgaaaaaggagttcttctattgtctattcgctgagatgatccagccagagtatggtatgttcatgtatccagaaggggcttcctgtatgtggttccctgtgaagcccaagttcgagaagaagcgctactttttctttggggtgctgtgtgggttgtctctctttaattgtaatgtcgcaaatttgccttttcccctggcactgtttaaaaagctcctagatcaaatgccctcactggaggacctcaaggagctgtccccagatctcggaaaaaacctgcagacactcctcgatgatgagggggataatttcgaggaagtgttttacattcatttcaacgtacactgggaccgcaatgatactaatttgattcccaatggatcaagcatcactgtaaatcaaaccaataaacgcgactatgtgtccaagtatattaactacattttcaacgacagcgtgaaagctgtctatgaggagtttaggagaggattctacaaaatgtgtgacgaggacattatcaagttgtttcaccccgaggaactcaaagatgtgattgttggtaatacagattatgactggaaaacttttgaaaaaaatgctcgctatgagcccgggtacaactcctctcacccaacaatcgttatgttttggaaagcatttcacaaacttacactggaagagaaaaagaagttcttagtctttcttactggcacagacaggctccagatgaaagacctgaataatatgaagatcacattttgttgccctgagagctggaatgagcgcgatccaattcgtgcccttacctgtttctccgtcctgttcttgcccaagtatagcaccatggaaaccgttgaagaggctcttcaggaagccatcaacaacaataggggattcggctag

SEQ ID NO: 119632 - DNA, 1854 bp, Artificial Sequence
  Description of Artificial Sequence: Synthetic coding sequence
atgggtcccaccctggctgtacccacaccttacggttgtatcggatgcaaactcccgcagcctgagtatccacctgccctgattatcttcatgttttgtgccatggtcatcacaatcgttgtcgatttgattggaaattcaatggtgattctggcggttaccaaaaataagaaattgcgtaactcaggcaatatcttcgttgtgagcctgtcggtggcagatatgctggtggccatttatccctatcccctaatgttgcatgctatgtcaatcggcggatgggacctctctcagctgcagtgtcaaatggtgggtttcatcacaggcctatccgtggtggggagtatctttaacatcgtggccattgcaattaatcgttactgttatatttgccacagcttgcagtatgagcgcattttttccgtgcgcaatacatgtatctaccttgtgattacttggatcatgaccgtccttgctgtgctgcccaatatgtatatagggactatcgagtacgatccccgtacctacacgtgtatcttcaattatttgaacaaccccgttttcacggtgaccatagtgtgcatacacttcgtgctcccgctactgattgtgggattttgctacgtgcgaatctggactaaggttctggcagcccgtgacccagcgggtcagaaccccgacaatcaactcgctgaggtgcggaactttttgactatgttcgtaatttttttgttattcgctgtgtgttggtgcccaataaatgtcctgactgtgctggtggccgtcagtcccaaggagatggctggaaagatccccaattggctgtacctcgctgcgtatttcatcgcatacttcaatagctgcctgaatgctgtgatctacggactgctgaatgagaacttcaggcgggagtactggacaattttccatgccatgcgacacccaatcatattcttctccgggctgatctcagatatacgtgagatgcaagaagcaaggacgttagcaagggcacgcgcacacgctcgagatcaggctcgcgagcaagatcgagcccacgcctgtcctgccgtggaggaaactcccatgaatgtgaggaacgtgcccctgcctggtgatgcagcagctggccatcctgatcgtgcttccggccatccgaagcctcactcaaggtcatcgtcagcctatcgcaagtccgccagcacacaccataaaagtgtgttctcgcacagcaaggctgctagcgggcacctgaaacctgtatccggccattccaagcccgcgtctggccaccctaaaagtgccaccgtttaccctaaaccggcttcagtccacttcaaggccgacagcgtccactttaaaggtgattcggtacattttaaacctgatagcgtgcactttaagccggcctcctccaaccctaaacccattacaggacatcatgtatctgccggcagtcacagtaaaagcgctttctctgccgccaccagccatccaaaaccgacgaccgggcacatcaagcccgctaccagccacgccgaacctacgacggcagattacccaaagcccgcaactacctcccaccctaagccaacggcagccgacaacccagaactgtctgcctcccattgcccggagatccctgccatcgctcaccccgtcagcgacgatagtgacttgccagaatctgccagctccccagcagctggcccaacgaaaccagccgcatcccagctggagtccgacacaatagcagatctaccggaccccaccgtggtgactacctctacgaacgattaccacgacgtggtcgtgatcgatgtggaagacgacccagacgaaatggcggtgtag

SEQ ID NO: 119633 - DNA, 13125 bp, Artificial Sequence
  Description of Artificial Sequence: Synthetic coding sequence
atgaaggttgaccgaaccaaactcaaaaaaacccccactgaagcccctgccgattgtcgcgcactcatcgacaagctgaaagtgtgcaacgacgagcaacttctgctggaattacagcaaatcaagacctggaacatcggcaaatgtgagctgtaccactgggtcgatctactggacaggttcgatggcatcctagctgacgctggacagaccgttgaaaacatgagttggatgctggtgtgtgaccggccagagcgcgagcagctcaaaatgttgttgttggccgtgctgaactttaccgccctgctgatagagtattccttcagcaggcatctctatagcagcatcgaacaccttaccacgctactcgcaagtagcgacatgcaggttgtgttggctgttctgaatctcctgtatgtgttttccaagcgcagcaattacataactcgtcttggtagcgacaagaggacgccccttctgactaggcttcagcaccttgcggagtcatgggggggcaaagagaacgggttcggtctcgccgagtgctgtcgggacctccatatgatgaaatacccaccttccgcgacgactttacacttcgagttttatgcagaccccggtgccgaggtaaagatagagaaaaggactacatcaaacactctccactacatccatatcgagcaactcgacaagatcagtgaaagtcctagtgagatcatggagtccctgacaaagatgtatagcatccccaaggataagcagatgctcctgttcacccatatcaggctggcacacggattcagtaaccacagaaaacggttgcaagcagtccaggccaggcttcacgccataagcatactcgtgtatagtaacgccctgcaagagtccgcgaatagtattctgtacaacgggctcatcgaggagttggtagacgtcctccagatcactgacaagcagctgatggaaatcaaggctgcctcactccgaacattgacgagtatcgtgcacctggagaggacaccaaaactgagttccattatcgactgcacagggactgcaagctaccacggcttcctgccagtgctcgtgcggaactgtattcaggctatgattgatccttcaatggacccctatcctcaccaattcgcgacagccctgttttctttcctgtatcatctggcatcctatgatgccggtggagaggctctcgtttcttgcggaatgatggaagccctcctcaaggtgatcaaattcctcggcgacgagcaagaccagattacctttgtaacaagagctgtgcgcgtcgtggatctgattaccaacctcgatatggccgcttttcagtcacacagcggactgtcgatattcatttatcggctggagcacgaggtggatctgtgtcgcaaggagtgtccctttgtcatcaaaccaaaaattcagagaccaaacaccacccaggagggggaggagatggagactgatatggacggcgtacagtgcattcctcagcgagccgccctgcttaagagtatgctgaactttctaaagaaggcgatccaggatcccgccttcagtgacgggataaggcacgtgatggacggtagcctgcccacctctctcaagcacatcatctccaatgccgagtactacggcccctctttatttttgttggctaccgaagtggtcactgtattcgtattccaggagccaagcctactctctagcctgcaggacaatggtctaactgacgtgatgcttcacgcccttctcatcaaagacgtacctgctacgcgcgaggtgctggggagcttgccgaacgtgtttagcgccctgtgcttgaatgcgcggggcttgcagagctttgtgcaatgccagccgtttgaacgtctgttcaaggtcctactgagccccgattatctccccgccatgcgacgccgcagatcttcagatcccctgggcgacactgcttcgaatttgggttcagcagtggatgagcttatgagacatcaacctaccctcaaaactgatgccacaacggctattatcaagttgctcgaagagatttgtaatctgggcagagaccctaagtacatctgtcaaaaaccttccattcagaaagcagatgggacggccacagcaccccccccccgatccaatcatgcagctgaagaggccagctcagaggacgaggaggaagaagaggtgcaggcgatgcaaagcttcaactccacgcagcagaatgagacagagccaaaccagcaggtggtaggaactgaagagcgcatccctatccctctgatggactatattctgaacgttatgaagtttgtcgagtctatcctgtcgaataacaccaccgacgaccactgccaggagttcgtgaatcagaagggactcctaccactcgtgaccattctgggcctcccaaacctgccgatcgactttcccaccagtgcagcctgtcaggcagtcgctggcgtgtgcaaatctatcctgactttgtcgcatgaaccaaaagtcctacaggaggggctgttacaattggattcaatcctcagtagccttgaacccctccacagacctatcgagtccccgggagggagtgtgttactcagggaactcgcatgtgcgggaaacgtcgccgacgccaccctctctgcccaggcaacccctttgctgcacgcattgaccgctgcccacgcctacatcatgatgtttgtgcatacttgcagggttggccagtccgaaattagatccatctcagttaatcagtgggggtctcagctaggattgtccgtactgagtaagctgagtcagttgtattgttcgctagtttgggagagtaccgtgcttctgagtctttgcactcccaactcgctgccctcaggatgtgagttcggtcaagccgacatgcagaagctggttccaaaggacgaaaaagctggcacaactcagggtggtaagcgttccgacggcgagcaggacggtgcagccggctctatggatgcctccacacagggactgttagaaggcatcggacttgacggagatacattagctccgatggagacggatgagcccactgcgtccgacagcaagggaaagagcaaaatcactcccgctatggcagcaaggattaagcagattaaaccactgctcagcgcatccagccgactgggaagagcccttgccgagctgtttggactgctcgtcaaactctgcgtcgggtccccagtgcggcagcgtaggtcccatcacgctgcgtctaccaccacagccccaacgccggccgcccgtagcacagcatccgcccttacaaagctccttactaagggtttaagttggcagcctccaccttacactcccacaccaaggttccggcttaccttcttcatctgctcagttggtttcacttcccctatgctcttcgacgagcggaagtacccatatcacctaatgctccagaagttcctttgtagcgggggtcacaatgccttgtttgaaaccttcaactgggcactttctatgggtgggaaggttcccgtgtccgaaggcctggagcatagcgatcttcccgacggcactggagagttcctggatgcctggttgatgctggtggagaagatggttaaccctacaacggtccttgagagccctcactccctcccggcaaagttacccggaggagtgcaaaattttccgcagttttctgcgctgcgatttctggtagtcactcaaaaggccgcttttacgtgtattaagaatctctggaatagaaagccgctcaaagtgtacggtggcagaatggctgagagcatgctggcaatactgtgtcacatcttgcgaggcgaacccgttattcgagagcggctctctaaagagaaggaagggtctcgcggcgaggaggacactgggcaggaagagggtgggtctaggcgcgagccccaggttaatcagcaacaactgcagcagctcatggacatgggtttcaccagggaacatgcaatggaggccctcctgaacaccagtaccatggagcaggccacagaatatctgcttactcatccacctcctatcatgggaggggtggttcgagatctctccatgtccgaagaggaccaaatgatgcgagcaattgcaatgagccttggccaggatatacccatggaccaaagagccgaaagtccggaggaagtcgcttgccgcaaggaagaagaggagcggaaagccagagagaagcaagaagaagaagaagccaagtgcttggagaagtttcaggatgctgatccccttgagcaggatgaactccacacctttaccgataccatgctgccaggctgcttccatctactggacgaactccctgatacagtataccgagtgtgtgacttgatcatgacggctatcaaaagaaacggtgctgattatagagacatgatcctcaagcaggttgtgaatcaagtctgggaggccgctgacgtcctgattaaagcggcccttcctcttactacaagcgacaccaaaactgtcagtgaatggatttcacaaatggccacactgccgcaggcttctaatctcgctactagaattctgctactgactctgctctttgaggaactgaaattgccttgtgcttgggtcgtagagtcatctgggatcttaaatgtgctcatcaagctgctcgaagtcgttcagccttgtttgcaggccgccaaggagcagaaggaggtgcagacacctaaatggatcacgccagtgctcctgctgatcgatttctatgaaaaaactgctatatctagcaaacggagagctcagatgaccaagtatctccagagcaatagcaataattggcggtggttcgacgacagaagtggccgatggtgttcctacagtgcctccaacaactctaccatcgatagtgcatggaagagcggggagacatcggttcgctttacggccgggagacggagatacacagtccaattcacaacaatggttcaggttaatgaagaaaccgggaatcgccggccagtgatgcttacattgcttcgcgtgccgagactgaacaaaaactccaaaaatagcaatggtcaggagctggaaaagaccctggaagagagtaaggaaatggacattaagaggaaggagaacaagggcaatgatacccctctcgcattagaaagcactaacactgagaaagagacgtctctcgaggaaaccaaaatcggcgaaatcctgattcagggtctgacggaagatatggtgactgtgctgatccgtgcctgtgtttcaatgctgggagtgcccgtggaccccgacactttacacgcaacactcagactgtgtcttcgccttacgcgcgaccacaaatatgcaatgatgtttgctgaattgaagagcacaagaatgattctgaacctcactcagagtagcggatttaacgggttcacccctctcgtgaccctgttattgaggcatatcatagaggacccctgcactctaaggcataccatggagaaagttgtccgctctgctgcaaccagcggcgccggaagtaccacctctggcgtcgtcagcggatctctggggagtagggagatcaactacattcttagagtgcttgggcctgcagcatgcaggaatcctgacattttcaccgaggttgcgaattgctgtataagaatcgccctcccagctccccgcggtagcggtactgcatccgacgatgaattcgagaacctccgtattaaagggccaaacgctgtacagctggtgaagacaactccactcaagcccagtccacttcccgtgattcccgatacaattaaggaggttatttatgacatgctgaacgccctggctgcctatcacgctccagaagaggcagataagagtgatcctaaacccggtgtgatgacccaagaagtgggacagcttctccaggacatgggcgacgatgtctatcaacagtaccgatccctgacacggcagtcttccgactttgatacccagtccgggttttccataaacagtcaggtgttcgccgccgatggcgccagtactgagacgtctgcctccgggaccagtcagggcgaagcaagcactccagaagagagccgagatggcaaaaaggataaggaaggagaccgcgcctctgaggagggaaagcagaaagggaagggatccaagccacttatgcccactagcaccattctgcgcctgctggccgaactggtgcggagctacgtgggcattgctacactgatcgcgaactattcctatactgtggggcagtccgagttgatcaaagaggattgttccgtgctggctttcgtgctcgaccacctgctcccacacacacagaacgccgaagacaaagacacacccgccttggcgcgactgttccttgccagcctggccgccgctggatccgggactgacgcccaggtggctcttgtcaatgaggtcaaggcggctctgggaagggcactggctatggccgagagcacagagaagcacgctcgtctgcaagctgttatgtgcatcatctccactatcatggagtcatgcccgagtacctctagcttctatagctccgctacggctaagacccagcacaacggcatgaacaatatcataaggctcttcttgaaaaaaggactcgttaatgacctggcaagggtcccacacagcctcgatctgagtagtcccaacatggccaataccgtgaatgccgctctgaagcccttagaaacactgagcagaatagtcaatcaacccagctctctgttcggtagtaagagtgcctcatctaaaaataagagcgaacaggatgctcaaggggcatcacaggacagtagttccaatcaacaggaccccggggagccgggcgaggctgaagttcaggaagaagatcatgacgtaacccagaccgaggttgccgatggagatatcatggatggcgaagccgagacagacagcgttgtgatcgccggtcagcccgaggtcctctctagtcaggagatgcaggtggagaatgaactcgaagatcttatcgatgaactgctggaacgagatgggggatccggtaattctactattatcgtctcccggagcggcgaggacgagtctcaggaggatgtgctaatggacgaagctcccagtaatctgtcacaggcgagtacgttgcaggccaaccgcgaagactccatgaacatattagaccctgaggatgaagaggagcacacccaggaggaggacagtagcggtagcaatgaggatgaagatgacagtcaggatgaggaggaggaagaggaagaggacgaggaggatgaccaggaagatgacgagggcgaggagggcgacgaggacgatgacgatgacggcagcgaaatggagcttgacgaagattaccctgacatgaatgcctctcctctcgttcgtttcgaaagatttgatcgagaggatgaccttatcatagagtttgataatatgttttcctccgctacagacattccaccttcccccgggaacattccaaccacccatccactaatggttcgccacgcagaccacagctccctcaccctcggtagcgggtcgtctactacaaggctaacccagggaatcggccgcagccagaggacccttcgccaactcaccgcaaacaccggccatacgatccatgtccactatcctggaaatcggcagccaaatccacccctcatcctgcaaaggctcctaggcccttccgccgccgccgacatattgcaactgtcttccagcctgcctctgcagtctcggggcagagccaggctcttggtgggaaacgacgatgttcatattatagcccgttctgatgatgagttgctggacgattttttccatgaccagtctacggccacctcacaagccggcactttgtccagcatcccaaccgctctgactcgatggactgaagagtgcaaggttctcgacgctgagtccatgcatgattgcgtcagcgtggttaaagtaagtatcgtgaaccacctggaattcctgagggatgaggaacttgaagaacgtcgagaaaagcggcgaaaacaattggcggaagaagaaacaaagataacggacaaggggaaggaggataaagagaaccgcgatcaatcagctcagtgtacggcctctaagagcaacgatagcaccgaacagaatctctccgacgggactcctatgccggactcgtaccccaccactcctagttccacagacgcagccaccagcgagtctaaggagactcttgggactctgcagagttctcagcaacaacccacactgccaaccccccctgctcttggtgaagtgcctcaggagctccagagccccgcaggcgagggaggcagtagtacccagctgctgatgcccgtcgaacccgaggagcttggcccaacaaggccgagtggtgaggctgaaacaacgcagatggagttaagtccagcacccaccataacttccctgtcacccgagagggccgaggactctgatgccctcaccgcagtgagtagtcaacttgaaggaagcccaatggacacttcctctcttgcgtcttgcactctggaggaggccgtgggagacacttcggcagcgggcagtagcgagcagcccagggccggttctagcactcctggggacgcccctccagccgtagctgaggttcagggcaggagtgatggatcgggcgaatccgcacagccaccggaagacagcagccctccagcctcaagtgagtcctcctccactagagacagcgctgtggctatttccggagccgatagtcgggggattttagaagagcctttgccgagcacctcttccgaggaggaggacccgctcgcaggcatctcgcttccggagggagtcgacccgtccttccttgccgcactgcccgacgacatccgccgtgaggtgttgcaaaaccagctggggatccgtccgcccaccaggaccgcaccctccacaaactcatccgcccctgccgttgtggggaaccccggagtgacagaagtgagccctgagtttctagccgccctgccccctgctatccaagaagaggtgttggcccagcaaagagcggaacaacaaagacgcgagctggcccagaacgcttccagtgatactcctatggatcctgtaacgttcattcagaccctcccttcagatctccgaagaagtgtgctggaggatatggaggattccgttctggccgttatgcctcccgacatcgcagccgaggcgcaggctctgcggagagagcaggaagccaggcagcgtcagctcatgcacgaaaggctcttcgggcattctagtacatctgccctgagcgccatactccgctctccggcattcacgagcaggctgtcaggcaataggggtgtgcaatacactcggttagccgtgcaaaggggcgggaccttccaaatgggcggcagctcttcccataacaggccaagcggatcaaacgtggacactttgctgagactccgtggcagattgctgctagatcatgaagccttatcatgtctgctcgtgcttttgttcgtggatgagccgaaactaaacacaagtaggctgcacagagtgctgcgcaacctgtgttaccatgctcaaacgcggcactgggtgattcgttcgctattgtccattctccagcgttcttctgagtctgagttgtgtattgagactcctaaacttactactagcgaggagaaggggaagaagtctagtaagtcttgcggcagctcaagccacgagaacagaccattggatttattgcacaagatggagagcaaatccagtaatcagttgtcctggttgagcgtctctatggacgccgccctgggctgtcggacaaacattttccaaatacaaagaagtgggggtaggaagcacacagagaagcacgcaagtggaggaagcaccgttcatatacacccacaggcagcccctgtcgtttgtcgccacgtgctggataccctgattcagctggcgaaggtctttccatcacactttacccagcaacgaaccaaagagaccaactgtgaaagtgatcgggaacggggaaacaaagcctgctccccatgctcatcccagagcagctcttccggaatttgcaccgacttttgggacctcttggtcaagctggacaacatgaacgtctccaggaaaggaaagaattccgtcaaatccgtgcccgtttctgcgggtggtgaaggcgagacctccccttattccctggaagctagccctctggggcaattgatgaacatgctctcacacccggtgatcaggcggtcaagtctactaaccgagaagttgctgcggctgctgagcttgattagcatagccctgccagagaacaaggttagcgaggcacaagccaactcaggttccggggcctcatctacaaccaccgccaccagtaccacttccaccacaactacaacagcagcatcaactacaccgacccccccaaccgcacccacaccagtaacaagcgcccccgctttagtcgctgctaccgctattagtactattgtggtggccgcatctactacagtcactacaccaacaacggctacgaccacagtgagcatcagccccacgaccaagggcagcaagtcacctgccaaggtttcagatggtggcagctccagcaccgacttcaaaatggtaagcagcggattgaccgagaatcagctacagttaagcgtagaagtactgacctcccattcctgtagcgaggaaggcttggaagatgcggctaacgtgctgctccagctctcgagaggtgattctggtacccgcgatactgtccttaaacttctcctgaacggagcgagacaccttgggtataccctgtgtaaacagataggcacactcctggcggagcttagagagtataatttggagcagcagaggagagctcaatgcgagaccttgtcgcccgatggcctgccagaggaacagccacaaacaactaagcttaaggggaaaatgcagtcgcggtttgacatggccgagaacgtggtcatcgtggcctcccagaagagacccttagggggccgtgagctacagctgccttccatgtcgatgctgacatcaaaaacctccactcaaaaattcttcctgcgagtgctgcaggtgatcattcaactgagggacgacacaagacgggccaataagaaggccaagcagaccggcagactcggctcaagtgggctcgggagtgccagctctatccaggcagctgttcgtcagctggaggctgaagccgacgcgatcatccagatggtgagagaaggccagcgtgcccgacgacaacagcaggccgccaccagcgaatccagccagtccgaggcttccgttagaagagaagaaagccccatggatgttgaccagcccagccctagtgcacaggatacgcaatccattgcttcagacggtacaccccaaggtgagaaggagaaggaggagcggccacctgagctgccactcctaagtgagcagctttcactagacgagctatgggacatgctgggggaatgtttgaaagaactggaagaaagccacgatcagcatgctgtcctggtcctgcagcccgccgtggaggcgttcttcttggtacacgccacagagcgcgaatcaaagcctcccgtgcgtgatacaagagagagccagctagcgcacattaaggacgaacccccacccctcagtcccgctccgctgactcccgccaccccatcatcgcttgatcctttctttagcagagaaccctctagcatgcacataagctcttctctgcctcccgacacccagaagtttctgaggttcgctgagacacataggacagtgcttaatcagatcctgaggcagtctaccacccacctggcagacggaccttttgctgtgttagtggactatatccgggtcctggattttgacgtcaagaggaagtactttaggcaggagctggagaggctggacgaaggcctgaggaaagaagacatggcggtgcacgtaagacgggaccatgtgtttgaggattcttaccgcgagttacacagaaagagcccagaggagatgaagaaccggctgtacatcgtgtttgagggcgaggaaggccaggacgccggtggcctcttaagagaatggtatatgatcatctcacgcgagatgttcaaccctatgtatgccctgtttagaacgtccccaggagatcgtgtgacttacactatcaaccccagctcccattgcaatcccaatcacctaagttacttcaaatttgtggggcgaatcgtagctaaggctgtgtacgacaaccgtctgcttgaatgttactttaccagatccttctacaaacacattctgggcaagtccgtgagatacacggatatggagagcgaggactaccacttctaccagggactagtgtacctattagaaaatgacgtgtccacgctcgggtacgatctgaccttctctaccgaagtgcaggaattcggcgtctgtgaagtccgagatctcaagcccaatggagccaacatactggttacagaggaaaacaaaaaagaatatgtgcatctcgtgtgccaaatgagaatgactggggctatcaggaagcagttggccgcttttctggaaggtttttacgagattatcccgaaaaggctcatcagcatcttcaccgagcaggaactcgagttgctgatctccggcctccctacgattgacattgacgaccttaaatctaatactgagtatcataaataccaaagcaattccatccaaatacagtggttctggagggcactacggagcttcgatcaagcagatcgggccaaatttctccagttcgtaaccgggacctctaaggtgcctctccagggcttcgcagctctagaaggaatgaacggaatccagaagttccagatccatcgggatgaccgcagtacagatagattgcccagcgctcacacgtgttttaaccagctggacctacccgcctatgagagctttgaaaagctcaggcacatgttgctgctggccatccaggaatgctctgagggattcgggctcgcttag

SEQ ID NO: 119634 - DNA, 13125 bp, Artificial Sequence
  Description of Artificial Sequence: Synthetic coding sequence
atgaaggtggatcggactaagttaaagaagactcctacagaagcccccgccgattgtcgtgcgctgatcgataagctgaaggtctgcaatgacgaacagctgttactggaactgcagcaaataaagacctggaacattggaaaatgcgaactgtatcactgggtggatctgctcgacaggttcgatgggatcttggccgacgcaggccagactgtggaaaacatgtcatggatgcttgtatgcgataggccagaaagggaacaacttaagatgctgttgctggctgtcctcaactttacagctcttctgatcgaatacagcttctcccggcacctctactcatcgatcgaacatctcactactctgttggcctcctcagacatgcaggtggtgctggcagtactcaaccttctgtatgtgttctctaagaggtccaactatatcactcgcctcggcagcgacaagagaacccccctcctaacaaggctgcagcacctggccgaatcctgggggggcaaagagaacggcttcggattagccgagtgttgccgggacctgcacatgatgaaataccctccctccgccaccacactccacttcgaattttatgcagaccctggcgccgaagtgaagatcgaaaagagaacgacttccaataccctgcactatattcacattgagcaacttgataagatatctgagtcccctagcgagattatggagtcactgaccaagatgtattccattcctaaggacaagcagatgctgctgttcactcatattcggctggcccacggcttctctaaccatcgcaagcgcttgcaggcagtccaggctaggttgcacgcaattagcatcctcgtatattccaatgccctgcaggaatccgccaactctatcctctacaacggcctaatcgaagaactcgtggacgtcctgcagataaccgataagcagctgatggaaatcaaggcagcttccctgcggaccttaacctccatcgtgcacctggaacggacacccaaactgtcctcgattatcgattgtacaggtacagcttcttatcacgggttccttccagtgcttgtccgcaactgcatacaggctatgatcgaccccagtatggatccttacccacaccaattcgctactgcccttttttctttcctctatcatctcgcatcgtatgatgctggaggcgaggccctagtgtcttgcggaatgatggaggccctacttaaggtgatcaagttcttgggcgacgaacaagatcagattaccttcgtgacaagagccgttagagttgtagatctgattactaacttagacatggcagccttccagagccattctggccttagcatctttatttaccggttggaacacgaggtggacctgtgtcggaaagaatgcccctttgtgatcaagcctaaaatccagcggcccaacaccacccaagagggagaagagatggaaaccgatatggacggcgtgcaatgtatccctcaacgggctgctctgcttaagtccatgttgaattttctgaagaaggccatccaagatccagctttcagcgatggtataagacacgtaatggatggaagtctccccacttctcttaagcacattatctctaacgctgagtactacgggcccagcctctttctgcttgccaccgaggtggtaaccgtgtttgtcttccaggagccctcactgttgagttcccttcaggacaatggactgacagacgttatgttacacgcactcctgatcaaggatgtgccagctacccgcgaagtgctcgggtccctgcctaacgtgtttagcgctctgtgtctaaacgcccgcggcttgcagagtttcgtccagtgtcagccctttgagcggctatttaaggttttactcagtcctgattacctgcccgctatgcgtaggagacgaagctccgatcccctgggcgataccgcttctaatcttggctccgccgtagatgagctgatgcgacaccagcccactctgaagacagacgcaactacagccataatcaagctgctggaagagatctgcaacttggggcgggaccctaagtatatctgccagaagccttcaattcagaaggcagatggcacggctaccgcgcctccccctaggagcaaccacgcggccgaggaggcctcttctgaggacgaagaggaggaagaagtgcaggcaatgcaaagcttcaattccacccaacaaaacgagaccgaaccaaaccagcaggtggtcgggacagaggagcggataccaattcctctaatggactacatccttaatgttatgaaatttgttgaatctatcctgagtaataatacaacagacgaccactgccaggaattcgtgaaccaaaagggcctcctgccactggtcaccattctcgggctgcctaatctcccaatagactttcccaccagcgctgcatgccaggctgtggccggcgtgtgcaaatcaattcttaccctttctcatgagcccaaggtcctgcaagaaggcctgcttcaattggactcgatcctcagtagcctggagcccctccaccgccctattgagtccccgggaggctccgtgttgctgagggaattagcatgcgccggcaacgtggcagacgctaccctatctgcacaggcaaccccactcctccacgcgttgactgctgctcacgcctacatcatgatgtttgtccatacctgtagggtgggccagagcgagataaggagcatttctgtgaaccaatggggttctcagttgggcctgtctgtcctctccaaactgtctcagctgtactgctccttggtgtgggagtcaacagtcctgcttagtctctgtacccccaacagtttaccttccggatgcgagttcgggcaggctgacatgcagaagcttgtgccgaaggacgagaaagctggtaccacccaaggcggaaaacgatccgacggtgaacaagatggtgcagccggcagtatggacgcatcgacacagggcctgcttgagggcataggtctggatggtgacacactcgctcccatggagactgacgagcccacggcgtcagactcaaagggaaagtctaaaattaccccggccatggccgcccgaatcaaacaaatcaagccgttattgagtgccagcagtcgtcttggacgagcgctcgccgaactgtttggcctactcgtgaaactgtgtgtgggaagtcccgtgcggcagcgacgatctcaccacgctgcatccactaccactgccccaacgccagctgcgcgctcgaccgcttctgcccttaccaagttgctgactaagggcttatcctggcagccacccccctataccccgacccctcgctttaggctcacctttttcatatgtagcgtgggattcacatctcctatgctcttcgatgaaaggaaatacccctatcatttgatgctccagaagttcctgtgttcgggcggtcataatgccctcttcgaaaccttcaactgggccctatctatggggggtaaagtgcccgtatccgagggactggaacactctgaccttcctgacgggacaggggaattcctcgatgcatggcttatgctggttgagaagatggtcaatcccactactgtgctcgagtctcctcatagcctgcccgcaaagttgcctggcggcgtgcagaatttcccacaattcagcgcgctccggtttctggtcgtcacccaaaaggcagcattcacttgtatcaaaaacctgtggaatcggaaacctctcaaagtctatggaggtcggatggccgagagcatgctcgccatattgtgtcacattttgcgtggcgagccagtgatccgggagcgactgtctaaagagaaagagggctcccgtggcgaagaagataccggtcaggaggagggcggaagtcgtcgggaaccgcaagtaaaccagcaacagctgcagcagctaatggacatgggcttcaccagggagcatgccatggaggcactgttgaacacaagtaccatggagcaagccaccgagtatctgctgactcatcctccgcccatcatgggaggggtagtacgtgatctgtcaatgtccgaagaggatcagatgatgagagccatagccatgtcgctgggtcaggacattcccatggatcaaagggcagaatcccctgaagaggtggcatgccgcaaagaagaggaggagcgaaaggcacgtgaaaagcaagaagaggaggaggccaagtgcctcgagaagtttcaggacgctgaccccctagagcaggacgaattgcacacgtttaccgacaccatgctgcccggctgtttccacctgttggatgaactccctgacaccgtataccgggtttgcgatctgatcatgacagcaattaaaagaaatggcgccgattacagagatatgatcctgaagcaagtggtaaaccaggtgtgggaggctgcagacgtgctcataaaagctgctctgcccctgactactagtgacaccaagacagtgagtgagtggatcagtcagatggccacactgccgcaagcttccaacttggccaccagaatcctgttgctaacactgctctttgaggaattgaagctgccgtgcgcgtgggtggtggaaagtagtggtatcctaaatgttctgatcaagttgctcgaagtggttcagccctgcctgcaggccgcgaaagagcagaaagaggttcagacccctaagtggatcacacccgtattactcttgattgacttttatgagaagaccgccatcagtagcaagcggcgggcacagatgacgaagtacctccaatccaactcaaacaattggcgttggttcgacgaccgcagcggccgctggtgttcatacagcgcctctaacaatagcaccatcgacagtgcctggaagagtggtgaaacaagcgtcaggttcaccgccgggcgaagacggtataccgttcagttcacaaccatggtacaagtgaatgaggagacgggtaaccgccggcctgtaatgctgacactactgcgcgtccctcggttgaataagaactctaagaactccaatggccaagagttggaaaagactctggaagagtccaaggagatggatatcaagcggaaggagaataagggaaacgatacccctctggcccttgagtcaacaaatacggagaaagagacgtctctggaggagacaaagataggcgaaatcctgatacagggcctaacagaggacatggtcaccgtcttgattagagcttgcgtatcgatgttaggcgtacctgtagatccggacactctgcacgctaccttgaggctctgcctgcgcctaactagggatcacaagtacgctatgatgtttgctgagcttaagagcacccgcatgattctgaatctgactcagtcaagtggttttaacggctttacacctctggtcaccttactgctgcgccacattatcgaagacccatgtaccttaagacatactatggaaaaggtggttaggagcgcggccactagcggggctggctccaccacctcaggggtggtcagcggtagcctgggctctagggagattaattacattctgcgtgtgctcgggccggctgcttgtagaaacccagatatttttaccgaggtggccaattgctgcataaggatcgctctgccagccccacgcgggtctggcacagctagcgacgatgagtttgaaaatttgcgaattaagggccctaatgcggtgcagcttgtgaaaaccactccccttaagcccagccctcttcctgtgatcccagatactattaaagaggtaatctatgacatgctgaatgctctggccgcataccacgcgccggaggaggccgataaaagtgaccccaagcctggtgttatgacccaggaagtggggcaactgctgcaggatatgggagacgacgtgtaccagcagtaccgaagcctcacccgacagagtagcgactttgacactcagtcaggcttttccattaactcccaagtgttcgcagccgatggtgcaagcaccgaaaccagcgcctccggaacatctcagggcgaggcctctaccccagaagaatcccgcgatgggaaaaaggacaaagaaggtgaccgggcttctgaagagggcaaacagaaggggaagggcagcaagccgctaatgccaacttctaccattctgcggctactggccgaactcgtgcggagttacgtgggtattgccactcttattgctaattatagttacactgtgggccagtcagaactgatcaaagaggactgctccgtgctggcttttgttcttgaccatctcttacctcacacacagaatgccgaggacaaggatactcctgcacttgcacggctcttcctggcttcccttgccgctgccgggagcggcacagacgctcaagtcgcactggtcaacgaggtgaaggctgctctggggcgggctctcgccatggctgaaagcacagagaagcacgccaggcttcaggctgtcatgtgcattattagtaccatcatggagagttgtccatcaacaagtagtttttattcaagtgctaccgctaagacgcagcacaacgggatgaacaatatcatccgccttttcctgaagaaaggactggttaacgaccttgctcgggtaccgcattcacttgatctctcgtcccctaacatggctaatactgtcaacgcagccctaaaacctcttgagacactttctcgaatcgtgaaccagccatcctcattgtttggatccaagtctgctagcagcaaaaacaaaagtgagcaggatgcccagggagccagccaagatagctcctccaaccaacaagatcctggcgaacccggagaggcggaggtccaggaggaggaccacgacgtcacacagactgaggttgccgacggggacattatggatggtgaggccgaaaccgattcagttgttatagctggacagcccgaggtcctgtctagtcaggagatgcaggtggagaacgagctcgaggacttgatcgacgaactcctggaacgcgatggcggaagtggaaattcaaccattatagtttcgcgttcaggcgaagacgaatcccaagaggatgtccttatggacgaggcaccctcaaacctttcccaggcttccacgctacaggctaacagggaggactccatgaacatactggatcccgaagatgaagaggagcacactcaggaggaagatagcagtggctctaatgaggacgaagacgacagtcaggacgaagaggaggaagaggaggaggatgaggaggacgaccaagaagacgatgaaggtgaggagggtgatgaagacgacgacgacgacggctctgaaatggaactggacgaggattacccagacatgaacgcctctccgttggtacggttcgagcgattcgacagagaagacgatctgatcattgaattcgataacatgttctcgtctgcgacagatattcccccgtctcctggcaatataccaacaacacaccccttgatggttcgccacgcagatcattcaagcctaaccctgggctccggatcttccaccacgaggcttacacaagggataggccgctcccaaagaacactgaggcagttaacggccaatacaggccacacaatacacgtccattacccagggaatcggcaacccaatccccccttgatcctgcagcggctgttaggaccgtctgccgccgccgacatccttcagctttcttctagcctaccgctccagagccggggccgtgcgcggctgctcgtgggtaacgacgacgtacacataatcgcgcgtagcgatgatgagctattagatgatttcttccatgaccaatctactgccaccagtcaagctggcacactcagcagcatcccaacggcacttactaggtggactgaggaatgcaaggtcctggatgcggagtcaatgcacgattgtgtgtcagtggtgaaggtgagcatagtgaaccacctggagtttcttagagatgaagagctggaggaaaggagggagaaacgcaggaagcagctagcggaggaggagactaaaattaccgataaaggaaaggaagacaaagaaaatcgtgatcagtctgctcagtgtacggcctccaagtcgaatgattccaccgagcagaacttgtcagacggcacaccgatgcctgattcttacccaacaacacccagcagcaccgacgctgctactagcgagagtaaagagactctgggtacactgcagagcagccagcagcaaccaacattgcctactcctcccgccttgggggaggtcccccaggagctacaatccccagccggtgagggtggctcctcgactcaactcttaatgcctgtggaaccggaggaactggggccaacccgcccgagtggcgaagccgagactacacaaatggaactgagtcccgccccaaccataactagcctttccccagagcgcgctgaggatagcgatgccttaacagccgtgtcctcgcagctggaggggagtcccatggatacatccagcctggcctcgtgtaccctagaggaggccgtgggtgatacatctgcagccggctcgagcgagcagccacgggctgggtcatcaaccccgggagacgccccgcctgcagtggccgaagttcaagggaggtcagatggttccggcgagtcagcccagcctcctgaggattcttcaccccctgcaagttccgagtcatcatccacaagggacagtgccgtcgccatcagcggcgctgactcccggggaatcttggaggagcctttgccaagcacttcttctgaagaggaggatcctttagctggcattagcctgcctgagggcgtggacccctcctttctcgccgccctccctgatgacataagaagggaagtgctccagaatcagctcgggatccgcccaccaaccagaactgccccaagtaccaacagcagtgctccagctgtggtggggaaccccggggtgactgaagtgagtccggaattcctggccgccttaccacccgctattcaggaggaggtgctcgcccaacagcgtgcagagcagcaacgtagggagttggcacagaatgctagttcagacacccccatggatccagtgacttttatccagacattgcccagcgatctgcggagaagcgttttggaggacatggaggactctgtcctcgccgtgatgcctccggacatcgccgcagaggcacaggcattgaggcgggagcaggaagccaggcagcgtcagctgatgcacgagcggttgtttggccattcctcaacgagcgcacttagcgctatactgaggtctccagcatttaccagccggctttcaggcaacagaggtgtgcagtatactagactggctgtgcaaagagggggtacattccagatgggcggttcatcctctcataatcgcccgagtggaagtaatgtggacacgctactgcggctgaggggacgccttcttctggaccatgaggccctgtcctgcctgctagttctactgtttgttgacgagcccaagctcaacacctctcgcctacacagggtgctcaggaacctgtgctaccacgctcagacgagacactgggtgatccgaagtctgctttctatcctgcaacgatcctcagaaagcgagctatgtatagaaacccctaaacttacgacgtccgaagagaaggggaaaaaaagcagtaagagttgcggctcgagctctcacgagaataggcctcttgaccttcttcacaagatggagtcaaagtcatctaaccagttgagctggctttccgtgtccatggacgccgccctcgggtgccggaccaatatttttcaaattcagcgtagcgggggaaggaaacacaccgaaaagcacgcatcaggtggtagcacagtacatatccatcctcaggccgcacccgttgtgtgccgccatgtgctggacactctgatccagttagccaaggtgtttccgtctcactttactcagcagcggactaaggaaaccaactgtgaatccgatcgggagagaggtaacaaggcctgtagcccatgtagcagtcagtcttcaagttcaggcatttgtaccgatttttgggatcttctcgtgaagcttgacaacatgaacgtttctcgaaagggcaaaaatagcgtgaagtctgtgccggtgagtgccggtggcgaaggagaaacttccccctactcgctggaagcatcccctctggggcagctgatgaacatgttgtcgcacccggttatccgccgctcatctctgctgactgagaaattgctgcgactgttgtcactcataagtattgctctccccgaaaacaaggtgtcagaggctcaggccaacagtggcagcggggctagtagtacaactacggccacatcgactacgtccactaccaccactacagccgcctctacaactcccacccctcctactgctcctacccctgttacatccgcaccagctctggtggcagctaccgctattagtaccatcgtcgtggcagctagcaccactgttaccactcctactactgcaactacaactgttagtataagccccacgaccaagggctccaagtctcccgccaaggtgagcgacggcggatccagctctaccgacttcaagatggtgagtagtggtctgactgagaatcagctacaactctcagtggaagtgctaacttcccactcatgctcagaagagggtttggaagatgcggcaaatgtcctcctccagctcagcagaggagattccgggactagagacacggtgctgaagctcttactaaacggcgcgaggcatctggggtatactctatgtaaacaaatcggcactcttttagctgagctccgagaatataacctggagcagcagaggagggcccagtgtgaaacactttctccggatggcctacctgaggaacagcctcaaaccacaaagctgaagggcaagatgcaaagtcgttttgacatggctgaaaacgtcgttatcgttgctagccaaaagcgacctctgggagggcgggaactgcagttgccttcaatgagcatgctgacttcgaagacctctacccagaaattcttcctacgcgtccttcaggtgataatccagctgagagatgacacacgaagggcaaataagaaggctaagcagacaggccgactaggctcttccggcctcggcagcgctagctccatccaggccgctgttcgccaactcgaggccgaagccgatgccatcatccaaatggttagggaaggccagcgagcgcgacggcagcaacaggctgctaccagcgagagcagtcagtccgaggcaagtgtgcgccgagaagagtcgcctatggacgtagaccaaccaagcccctccgcccaggacacccaatctattgctagcgacgggacaccccagggagaaaaagagaaggaggaaaggccccctgagctgccacttctctctgagcagctttctctagacgagctctgggatatgctgggtgagtgtttaaaggaactggaggaatctcacgatcaacatgcagttctggtcctccagccggcagtagaagccttctttctggtgcacgcaacagaacgggaatctaaaccccccgtgagggacactagggagtcccaactggcgcatatcaaagatgaacctccacctttaagtccagcacctctgacccctgcaacgcctagtagcctagacccatttttttctcgggagccgtctagcatgcatatctccagtagcctgcctcccgacacccaaaaattcttaaggttcgcggagacacatcgtacagtcttaaaccagatcttaagacagagtaccactcatctggctgacggtcccttcgcagtcctggtggattatatcagggttctggatttcgacgtgaaaagaaagtacttccgccaggagttagagcgcctggacgaagggttgcggaaggaggatatggcggtccacgtcagacgggatcatgtctttgaggatagttatcgggagctgcaccgtaagtcccccgaagaaatgaagaatcgtttgtacatcgtgttcgaaggagaagaaggacaggacgcaggcgggcttttgagagaatggtacatgattatctctcgcgagatgtttaaccccatgtacgctctttttagaacatccccaggcgatagggtgacttacacaatcaatcctagcagtcactgcaacccaaatcacctcagctactttaagtttgtgggcagaattgtcgctaaggcggtatatgacaacagattgttggagtgttattttacaagaagcttctataagcacattctgggtaagtctgtcagatatactgacatggagtccgaggattatcacttttatcaggggttagtttaccttctggagaatgatgtctctacgttaggatacgacctcactttcagcaccgaggttcaggagtttggcgtttgtgaagtgcgtgatctgaaacctaacggggcaaacatcctggttactgaggagaataaaaaagagtatgttcacctcgtatgccagatgcgcatgacaggggcgatccggaaacagctggctgcttttttggagggcttctacgagattatcccaaagcgtctgatcagcattttcacagaacaggagctcgagctgcttatctctggcctgccgacaattgacatagacgatctcaaatctaacaccgagtaccataagtatcaaagcaacagcattcagattcagtggttttggagagctctacggtcttttgaccaggccgatagggcaaaattcctccagtttgtcaccggcacttctaaggtccctctccagggctttgctgcgctggaaggcatgaatggcatccagaagtttcagatccatcgggatgaccggagcactgacagactccctagcgctcacacatgcttcaatcagctggatctgccagcttatgagagcttcgagaagctgagacacatgctgctgctcgctatacaggagtgctccgaaggattcggcctcgcctag

SEQ ID NO: 119635 - DNA, 771 bp, Artificial Sequence
  Description of Artificial Sequence: Synthetic coding sequence
atggatccttacccacaccagtttgccacagccctcttttctttcctgtatcacctggccagttatgatgcaggaggagaagccctcgtgtcgtgcggcatgatggaggccttgctgaaagttatcaaatttctgggagatgagcaggaccaaattacatttgtaacccgcgcagtgagagtggtggacctgatcaccaatctggacatggccgctttccagtcccatagtggtctgtccatctttatataccgcctggaacatgaagtggatttgtgtagaaaggagtgccccttcgtgattaagccgaagatccagagaccaaacacaacccaggagggtgaggagatggaaacagatatggatgtggcagatgttgcaatggagtccagtccaggaagtagtatctcaatggagcaccgtctggacgtggaacttcgcgcctcggggagttctagttccactaatatcagtagtgggccatcccccggtccaagccctggcactgggccaggcccggggcccggacctggaccaggaccgggccccggccctggcccaggccctgggcccggcccgggaccgggaccggggccaggtcccagaccgggtgtgcagtgcatcccccaaagagctgcgctcctgaagtctatgctaaatttcctcaagaaggcgatccaggacccagctttctctgacggaatccgccacgtaatggacggcagcctccccaccagcctaaaacacattatctctaatgctgaatattag

SEQ ID NO: 119636 - DNA, 687 bp, Artificial Sequence
  Description of Artificial Sequence: Synthetic coding sequence
tgagtgagctgtggcatgatggaggccctgctgaaggtgatcaaattcctcggtgatgaacaggaccagattacattcgtgacgcgggccgttcgggtggttgacctgattaccaacctcgatatggccgcttttcagtctcattcagggttgtctatattcatctatagactcgagcatgaagtggacttatgtcggaaagaatgccccttcgtgattaaacccaagatccagagaccgaacacaacgcaggagggagaggagatggaaacagacatggatgttgcggacgtcgccatggagagtagtccagggtcttccatttccatggaacatagactggacgtggagctgagagcttctggatcctccagttcaacaaacattagttcaggtcccagcccaggcccatccccagggaccgggccaggcccaggccccggacctggcccgggccccgggcccgggcctggccccggccctggacccgggccgggtccaggcccaggaccgggcccccgacctggcgttcagtgcataccacaacgggctgcgctcttgaaaagcatgctcaacttcttgaagaaggctatccaagaccctgctttcagtgacggtatccgacacgtcatggacggctcccttccaaccagcctgaagcatattatctctaatgctgagtactag

SEQ ID NO: 119637 - DNA, 3594 bp, Artificial Sequence
  Description of Artificial Sequence: Synthetic coding sequence
taaccatccgggagtaatgtggacactctgctacgcctgagaggtaggttgctactggaccacgaggccctctcatgtttgctggtattactatttgtggacgaaccaaagctgaacacgtcacggctccatagggtgcttcggaacctgtgttaccacgctcagacccggcactgggtgattcggtccctactgtcaattctgcagcgcagtagtgaatccgaactttgcattgaaacaccgaagctgaccacctctgaagaaaaggggaagaaaagcagcaagtcctgtggatcctccagtcacgaaaatagaccacttgacctgttacacaagatggagagcaaaagtagcaaccagctcagctggttatccgtatccatggatgctgcccttggatgccggactaacatctttcaaatacaacgctctgggggccgtaagcatacagagaaacacgcatcaggggggagcacagttcacatccacccgcaggctgctcccgtcgtttgccgccatgtcctggacaccctgattcagctggccaaggtctttccaagccacttcactcaacaacgcaccaaagaaactaactgcgaatccgaccgtgaacgagggaacaaagcttgctccccctgttcctctcagagctcctcttccggaatctgcactgacttctgggatctgctggtcaagcttgacaatatgaacgtcagtcgaaagggcaagaacagcgtgaaaagcgtccctgtgtctgcggggggggagggggagacgagcccatattctctcgaggcctctcccctgggccagttaatgaacatgctgtctcatcccgtcattcgtcggagttctcttctcactgagaagctgctccgactgttatctctgatctccattgccctgcctgaaaacaaagtctctgaagcgcaagctaatagcggctctggggcaagcagcacaacaacggcgacttccaccaccagcacaaccacaactaccgccgcttccacaacccccactccacctacagctccaacccccgtgacttccgctcctgcgctcgtcgcagctacggcaatctctacaattgtggtcgctgcttcaactacggtcaccacgccaacaaccgcaaccacaactgtgagcatcagcccaactactaagggctcgaagtctccggcaaaggtgtccgatggcgggtcctcctcaactgatttcaaaatggtgtcctcagggttgactgagaatcaacttcagctgtctgtcgaggtgcttaccagccacagctgctctgaagaagggctggaggacgccgccaacgtgctgttgcagctcagccgaggggactccgggactcgggatacggtgttgaagctgctcctgaacggagctagacacctgggctatactctctgcaagcagattggaaccctgctagccgaattgcgagaatataacctggaacagcagcggagggcacagtgtgagactctgagccctgatggcctgccagaggagcagcctcagactacaaagctgaaaggaaaaatgcagagcagatttgacatggctgagaatgtggtaattgttgcttcccaaaagcggcccctggggggcagagagctgcagctcccaagcatgtcaatgcttacgtctaagacatccactcagaagttcttcctgagggtactgcaggtgatcatccagctcagagatgacacaaggcgagccaacaaaaaggcaaagcaaacagggagactgggttcttctggcctgggttctgctagctcaattcaggcagctgtcaggcagctggaggccgaagcagatgccatcatacaaatgtccgagtcgagccaatccgaagctagtgtaaggcgcgaggagagccctatggatgtggaccaaccctcgccctccgcccaggacacgcagtccatagcaagtgacggaacacctcaaggcgagaaggaaaaagaggaaagaccacccgagctcccgctgctgtcagagcagctttctcttgatgagctgtgggatatgctgggagagtgcctgaaagaattggaggagtcccatgaccagcatgctgtcctcgtcctccagcctgccgttgaggcttttttcctcgtccacgctacagaacgcgagagcaagccgcctgtgcgagataccagggaatcacagctagcccatataaaagacgagccaccccccctgtctccagctcccctgacccctgctaccccgtccagtctggaccccttcttctcccgggagccgtcgagtatgcacatatctagctctctgcctcccgacacacagaagtttctacgatttgccgagactcacaggacagtgctgaaccagatcctgagacagtccactacacacctggccgacggacctttcgccgttctcgttgactatatccgcgttctggacttcgatgtgaagaggaagtattttcgccaagagctagagcggctggacgaagggctccgcaaagaggacatggccgtccatgtgcggcgtgaccacgtcttcgaggatagctaccgagagctccatagaaaatcacccgaggaaatgaagaatcggctctacatcgtgttcgaaggggaggaggggcaggatgccgggggccttttgcgagagtggtatatgataatatcacgagagatgtttaacccaatgtatgccttgttccggacatctccaggcgaccgcgtgacctacaccatcaacccgagttctcactgtaatccaaatcatctgtcttatttcaagtttgtagggaggatcgtggcaaaagctgtatacgataacaggctgctggaatgttactttacacggagtttttacaagcacatactgggcaaatccgtccggtatactgacatggagagcgaagattaccatttttaccaaggcctggtctatttgttggagaatgacgtctccacactcggctatgatttgacattcagtactgaggtgcaggagttcggcgtgtgtgaagtgagagatcttaaacctaatggcgcaaacatccttgtgaccgaagaaaataaaaaagagtatgtgcacctggtgtgccagatgcggatgaccggggcaatccggaagcaactggcggcatttctggaggggttctatgaaatcatcccaaagcgtctaataagtatctttacagaacaggaactagaactcctgatctccggtctgccaacgattgacatcgacgaccttaagtccaacacagagtaccacaagtatcagagtaactcaattcaaatccagtggttttggagggccctgaggagcttcgaccaggcagatcgggcaaagtttctccagtttgtgaccggcacttctaaggtcccactgcagggcttcgcagcattggagggcatgaacggaatccagaagtttcagatccatcgcgatgaccgctctacggacaggctgccaagtgcacacacctgcttcaatcagttggatctccctgcctatgagtcttttgaaaaattgcgacatatgctgcttctggcaattcaggagtgctccgagggcttcggtctggcctag

SEQ ID NO: 119638 - DNA, 10227 bp, Artificial Sequence
  Description of Artificial Sequence: Synthetic coding sequence
tgaagcctcccaagcggctgtgagttcggacaggcagacatgcagaaactcgtaccaaaggatgaaaaagccgatggagagcaggacggtgccgccggcagtatggacgcttctacccagggactgcttgagggtataggcttagatggagacactctagcgccaatggaaactgatgaacccacagcctctgatagcaaggggaagtctaaaataactcccgctatggctgccaggattaagcagatcaaacctctgctgtctgcgtcctccaggctcgggagagcattggccgagctgttcgggctgctggtcaagctgtgtgtgggatcacccgtgcgccagcggaggtctcatcacgcggcaagtacaacaaccgctcctacccctgctgcccgctccaccgcaagtgcgctgaccaagctgcttaccaaaggattaagttggcagcctcctccgtatacacctactccccgcttccggctgacattttttatctgttcagtgggctttaccagccccatgttatttgacgagcgtaagtacccttaccatctcatgctgcaaaagtttctttgctctggtgggcataacgccctgtttgaaactttcaattgggccctgagtatggggggcaaagttccagtatccgagggcttagaacattcagaccttccggacggcactggcgagtttctcgacgcatggctgatgttagttgagaaaatggtgaacccaacgacggtgctcgagagccctcacagcctgcccgccaagctgccgggcggtgtgcagaatttcccccagttttcagctctccgattcttggtggtgactcagaaggcagcgtttacatgcataaaaaatctgtggaacagaaagccacttaaggtgtatggcggaagaatggccgagtcaatgctcgccatattatgtcacatcctcaggggggaaccggtgataagagaaagactatctaaggagaaggaaggatcgcgaggagaggaggacactggacaagaagaaggtggatcacgccgggagccgcaagtgaaccagcaacagctccaacagctcatggacatggggtttactcgagagcacgccatggaagctcttcttaacacctccaccatggagcaagccacagagtatctgctgacacatccaccacctatcatgggaggcgtcgtgagagatttgtctatgtctgaagaagaccagatgatgcgggcaatcgcaatgagcctcggtcaagatataccaatggatcagagggcagagtcccccgaagaagtcgcatgtagaaaggaagaagaagagcgtaaggccagggagaagcaggaggaggaagaagcgaagtgcctggagaaattccaagacgccgacccgctggagcaggacgaattgcatacctttacagatacgatgctgcctgggtgctttcatctgttagatgaattaccggataccgtgtatcgagtgtgtgatctcatcatgactgctattaagcggaatggggcagattatcgagatatgattcttaaacaggtggtgaaccaggtgtgggaagctgccgatgtcctcattaaggctgctctccccttgaccacttcagacaccaaaacagtttctgaatggatctctcagatggcaaccctgccccaggcctctaatttagcaacccgaattcttctgctgaccctgttgttcgaagaactcaaacttccctgcgcttgggtggtcgaatcttctggcattctgaacgtactaatcaaactgctcgaggtagtgcagccatgtctccaagctgccaaggagcagaaggaggtgcaaactcctaaatggattactccagtgttactgctgatcgatttttacgaaaagaccgctatcagctccaaacgacgagcccagatgactaagtacctgcagtctaattcaaataactggaggtggttcgatgacagatctggacgctggtgcagctattctgcatctaataactcaacaattgattctgcctggaagtccggagagacctccgtgcgtttcacagccggccgtcgccgctacactgttcagtttacaacaatggtccaggtcaacgaagaaactggaaaccggcgaccagtgatgctgactttgctgcgtgtccctcgcctgaataagaattcaaaaaacagtaatgggcaggagctggagaaaaccctagaggagtcaaaagagatggatattaagagaaaagagaataaagggaacgatactccccttgcgctggaatcaacaaatactgagaaggagacttccctcgaggagaccaaaatcggggagatactgattcagggacttacagaggacatggtgactgtgctcatccgcgcatgcgtttccatgctaggggtcccggttgatcctgacacactccacgctactctgcgcctgtgtctccgactgactcgtgaccacaagtacgccatgatgtttgctgagctgaaaagtacacgcatgattctgaatttaacccagagcagcggctttaatggctttacacccttggtgacattactcttaagacacatcatcgaggatccatgcactctgcgccacacaatggagaaagtggtgcgatccgcggcgacatcgggggcgggaagtacaacttcgggcgtggtttccggaagcctcggcagtagagaaataaattatatcttgagggtgctgggacctgctgcttgtcggaaccccgacatattcactgaggtggcaaattgctgtattcggattgccctgcccgctccaagaggcagcggtacagcctctgatgacgagttcgagaatttaagaattaagggtcccaacgctgtgcagctagttaaaacaacacctctgaagccatcaccgttgcccgtcatcccagacaccatcaaagaggtcatatacgacatgcttaatgcattggcagcctaccacgcccctgaagaggctgataagtctgatcccaaacccggggtgatgacccaagaggtgggccagctcctgcaggatatgggcgatgacgtttatcagcagtaccgaagcctgacacgacagtcgtctgatttcgatacacaaagtggttttagcattaattcccaggtgtttgctgccgatggagcatctacagagacaagtgcttctggtacatcacaaggagaagctagcaccccagaggaaagccgagatgggaaaaaagacaaagaaggggacagggcttccgaggagggcaagcaaaaaggcaagggaagcaagcctctgatgccaacctccactattctgcggttactggcagaactggtgagatcttacgtcgggattgctactttgattgccaactacagttacacagtgggtcaaagcgagctgatcaaggaggactgttccgtgctagcgttcgtccttgaccatctgcttccacatacacagaacgccgaggataaggatactccagcccttgccaggctcttccttgcatctttagccgcagcaggatctggaacagacgcacaggtagccctggtgaacgaggtgaaggccgctctgggcagagcactggccatggctgaaagcactgagaaacatgcaaggttgcaagccgtgatgtgtataatcagcactataatggaaagttgcccctctaccagcagtttttacagcagcgctaccgccaagacacaacacaacgggatgaacaacatcatcagactgtttctgaagaaaggcctagtaaacgatctggctcgagtcccccattcccttgacctctcctctcccaatatggccaatactgttaacgccgccctcaagcctctggaaactctgtcccgcattgtcaatcaacctagcagtcttttcgggagtaaaagcgcctctagcaaaaacaagtccgagcaggacgctcagggagcaagccaggacagctccagcaaccagcaggacccgggtgagccgggcgaggccgaggtgcaggaggaggaccatgacgtgacccagacagaggtggcagacggcgacattatggacggggaagccgaaacagattcagtcgtcattgctggccagcccgaagtgctgagcagccaggagatgcaagttgagaatgagctggaggatttgatcgacgagctgttggaaagagatggtgggagcgggaatagtacaatcattgtttcccggagcggggaggacgaatcacaggaggatgtgctgatggatgaagctccttccaacctttcccaggcatccactctgcaggcaaatcgcgaagacagtatgaatatcttagaccctgaagacgaagaagagcacactcaggaagaggactcctctggaagcaacgaggatgaggatgacagccaggacgaagaagaggaagaggaggaagacgaagaggatgatcaggaagacgacgaaggcgaggagggcgacgaagatgacgacgatgacggatccgagatggagctggatgaagattatcccgacatgaacgcctctccgctcgttagattcgaacgatttgatcgggaggacgacttaattattgaatttgacaacatgttctcctccgccaccgacatcccaccctcccccggcaacatcccaacaactcatcctctcatggtgcggcatgctgaccattcttcgttgaccttgggaagcggcagctccaccaccaggctgactcagggaattggccgaagccagcgaacactgcggcagctgacggctaacactggacatacaattcatgtccattatcctggtaaccgccaaccaaacccccctctgattctgcaacgactcctcgggccgagtgctgctgcagacatcctccaactgtccagtagtctgcccttgcagtccaggggccgggctcggctgctcgttggcaacgatgatgttcacattattgcaagatccgatgacgagctcttggatgacttttttcatgaccaatcgacggcaacatcgcaggcgggaaccctgagtagtatacccaccgcattgacaagatggacagaggagtgcaaggtcctcgacgcggagagtatgcatgattgcgtttctgtggtcaaagtcagtattgtcaaccacctcgaattcctgagggatgaggagctcgaagagcgtagggagaaacgccgtaaacagttggccgaggaggaaacaaaaatcactgataaaggcaaggaggacaaagaaaacagagaccagagcgctcaatgcaccgcgtcgaaatctaacgactctaccgagcagaatctatcagatggaacacccatgcctgacagctaccccactaccccttcatctacagatgccgccacttcagagtcgaaagagacccttggaacactgcagtctagccagcaacagcctaccctccctacaccccccgctcttggtgaagttccacaagaacttcagagccctgcaggcgaaggcggtagcagcacccagctcctgatgccagttgaacctgaagaactggggccaacacggccaagtggtgaggcggaaacaacccagatggaactctcacctgctcctaccattaccagtctcagccccgagcgagcagaagattccgatgcattaactgccgtctcttctcagcttgagggctcccccatggatacatcatctctcgcttcctgtacactggaagaagccgttggtgacacgagcgccgccggatcgagcgaacagcccagggcaggatcttcaacccccggtgatgcgccccctgctgtcgcagaagtccagggtaggagtgacggttccggggagtcagcccagccacccgaagatagcagcccgccagcctcctccgagtcatccagcacacgcgattctgccgttgccatttcaggggcagatagcagaggcatactcgaggaaccactgccctcaacatcttcggaggaagaggatcctttggctggtatttcccttcctgaaggagtggatcccagttttctcgcagctttgcccgacgatattcgccgtgaggtgctccagaaccagctagggattcgaccacctaccaggactgcaccatctacaaatagctctgcccctgctgtcgtggggaatccaggagtgactgaggtcagccccgagttcttggcagcactgccccccgctatccaggaggaggtattggcccagcaacgggccgagcaacagaggagggagctcgctcagaacgcaagcagcgatacgccaatggatcccgtaacttttatccagactctgcccagtgacctgaggagatctgtcctggaggacatggaggatagcgtccttgccgtgatgccgccagatatcgctgctgaggcacaagccctacgaagagagcaggaagcacgccagcgacagctgatgcacgagcggttatttgggcactcatccacaagtgcactgtccgcaatattgcgttcacctgccttcacgagcaggctgtccgggaatcgcggcgtccagtacactcggctcgcagtgcagaggggaggtacctttcaaatgggcgggtcttcatctcacaatcgcccgagtggatcaaatgttgatactcttttacggctgagaggacggctgctcctcgaccatgaggccctgagttgccttctggtcctgctgttcgttgacgagcctaagctgaatacaagtaggcttcatagagttttgaggaacttgtgttatcacgcccagacaagacattgggtgatacgatcacttctgagtattctgcagcgcagttccgagtccgagctttgtattgaaacccccaagctgacaacttcagaagagaagggcaagaagtccagcaagagctgtggatccagctctcacgagaatagaccccttgacctgttgcataaaatggagagtaagtctagtaaccagctgtcgtggttatctgtgagtatggacgctgccctcggctgtaggaccaacatctttcagatacagcgctccggaggtagaaagcatacagagaagcatgcatcaggcggttccacggtgcacattcaccctcaggcagcgcccgtggtgtgccggcatgtgctcgatacgttaatacagctggctaaggtgttcccctctcacttcactcagcagagaactaaggaaacgaattgcgagagcgacagagagagaggcaacaaagcctgctcgccttgcagcagtcagtctagttcaagcgggatttgtactgacttttgggatctattggtgaagctggataatatgaatgttagtcggaaggggaagaacagcgttaaaagtgtcccggtgagtgctggtggcgaaggcgaaacttctccatacagccttgaagcctccccgttaggacagttaatgaacatgctgtctcatccggtcatcagacggtcctctcttttgaccgagaaactcctgcggctgctgtcactgatcagcattgcccttcctgaaaataaggtatctgaggctcaggccaattctggcagcggcgcctccagtaccactactgccacctctacaacaagcactacgacaacaacagcagccagcacgacccctaccccccctacggccccaaccccagtaactagcgccccagcactggtcgcagcgacagctatatctaccattgtggtggcagcttctacaaccgtcacaacaccaacgactgctactacaactgtgagcatttccccaaccaccaagggcagcaaatccccggccaaggtctctgacggcggctcctcatccactgatttcaagatggtgagcagtggtctcaccgagaatcagttgcagctgtcggttgaagtattgacgagccacagttgtagcgaggaaggcctggaggacgccgcaaacgtcctcctccagctgagccgcggggatagtgggacccgggatacagtgctgaaactcctgttaaacggagcccgccacctgggctacacactctgcaaacaaatcggtacgctgctagccgagctgcgcgagtacaatctcgagcagcagcgaagagctcagtgcgaaactctcagcccggacggcttacctgaggaacagccccaaaccacaaagctgaagggaaagatgcagtcccgtttcgacatggcagagaacgtggtaatcgtggcctcccaaaaacgccctctgggtggccgggagctccagttgccatccatgagcatgctgacatcaaagacctctacacagaagttttttttgcgggtgttacaggtaattatccagctacgcgacgacactagaagagccaataaaaaggctaagcagactggacggctaggcagttctggacttggcagcgcctcaagtatccaggccgctgtgagacagttagaggctgaggcagatgcaattattcaaatggtgagggagggacagagagcgcgacgacagcagcaggccgcaacttctgagagttctcagagcgaagccagtgtgcgccgggaagaatccccgatggacgtcgaccaaccatccccatcagctcaggatacgcaaagcatcgcgtcagatggaacaccccagggagaaaaagagaaagaagagagaccgcctgagctgcccttgctcagtgagcagctttcgcttgacgaactttgggacatgctcggtgaatgtttgaaggagctggaagagagccacgaccagcatgctgttctcgtcttacagcccgctgtggaggcatttttcctggttcatgcaacagagagagaaagcaaaccacctgtgcgcgataccagagagtcacagctcgcccacattaaagatgaaccaccgcctctgtcccccgccccactgacacccgccaccccctccagtcttgatccttttttctcacgagagcccagttccatgcacataagtagcagtctgcctcctgatactcagaagttcctgcgcttcgccgaaacccacagaactgtattaaaccagatcttgaggcagagcactacacacttggctgacggcccatttgccgtcttggtggactacataagggttttggacttcgacgttaagaggaagtactttaggcaggagctcgagcggttagatgaagggttacgcaaagaagatatggctgtgcacgttagacgggatcatgtctttgaagactcctaccgggaactgcataggaagtctccagaagaaatgaagaacagactgtacatagtgttcgaaggcgaggagggccaggatgccggcgggttgttgagggaatggtatatgattatttctcgcgagatgttcaaccccatgtatgcactttttcgcacaagtccaggcgatagagtcacttacaccattaacccctccagccattgtaatccaaaccacctatcttattttaagttcgtgggaagaatcgtggccaaagcagtgtacgacaaccgccttctagagtgctatttcaccaggtcattctacaagcatatcctcggtaaatccgtacgttacaccgacatggagagtgaagattaccacttctaccaggggcttgtttatctactggagaacgatgtatccaccctggggtatgatctaaccttctccactgaagtccaggagttcggcgtgtgcgaggtcagggatctcaaaccaaatggcgccaacatcctagtgactgaggaaaataagaaggagtatgttcacctggtgtgtcagatgaggatgactggcgccatccgcaagcaattggccgctttcttggaaggcttctacgaaatcataccaaagaggctcatatctatcttcactgagcaggagttagaactgctgatctccggcctgcctacaatagacatcgacgacctcaagtctaatactgagtaccacaagtatcagagcaacagcatccaaatacagtggttctggagagcgttgcggtctttcgaccaggccgatcgcgcaaagtttttgcagttcgtgaccgggacctccaaagtgcccctccagggctttgccgcccttgagggaatgaatggcatccaaaaattccagattcatcgggacgataggtccacagaccgactgccgagcgcccatacatgcttcaatcagctggatctaccagcttatgagtctttcgaaaaacttcggcacatgctcctattggccattcaggagtgttccgaggggttcggcctggcttag

SEQ ID NO: 119639 - DNA, 651 bp, Artificial Sequence
  Description of Artificial Sequence: Synthetic coding sequence
atgaaggtggacagaacaaaactgaagaagacgcccaccgaggctccggctgactgccgtgccctgattgacaagctgaaagtctgcaacgacgagcagctgctcttggaactgcagcaaatcaagacgtggaatattggcaaatgtgagctatatcattgggtggatctgctggataggtttgatgggatcttggcggatgccggccaaaccgtggagaacatgagctggatgctggtttgcgaccgtcccgaaagagagcagttgaagatgctgctgcttgccgtgttgaatttcactgcactcttgatcgagtactctttttctcgccacctgtattcatccatcgagcacctcaccacattactggcctcaagtgacatgcaggtcgtcctggctgtgttgaatttgttgtatgtttttagcaaaaggagtaactatatcacacgccttggctccgacaagagaacaccacttctgacccggctacaacatttggcggagagctggggcggaaaggagaacggctttggcctcgcagagtgttgccgcgacctgcacatgatgaaatatcctccatcagccactactctgcacttcgaattttacgcggacccaggtgctgaagtgaaaattgaaaaacggaaatag

SEQ ID NO: 119640 - DNA, 282 bp, Artificial Sequence
  Description of Artificial Sequence: Synthetic coding sequence
atgaaggtggaccgtaccaaactgaaaaaaactcctaccgaggctcccgcggactgcagagctctgatagacaagctcaaggtgtgcaatgacgaacagctccttcttgaattacagcagattaagacttggaacatagggaaatgtgaactgtaccattgggtggatctcctggaccgattcgatgggatactggccgatgctggccagaccgtggagaatatgtcgtggatgctggtctgcgatagacccgaacgcgaacagctgaaaatgctgctgtag

SEQ ID NO: 119641 - DNA, 1482 bp, Artificial Sequence
  Description of Artificial Sequence: Synthetic coding sequence
atgttgccaagatgggagcttgccctctatctgctcgcctctctgggattccacttctactctttctatgaggtctacaaggtcagcagagaacacgaagaggagttagaccaggagttcgagctggaaacagataccctgtttgggggactgaaaaaagacgctactgacttcgaatggtccttttggatggagtggggcaagcagtggctggtttggctgcttctcggccacatggtggttagtcagatggccaccctactggcaagaaagcatagaccttggatcctgatgctctacgggatgtgggcctgctggtgtgtgctgggcactcccggagtcgccatggtcctgctgcacacaaccattagtttttgtgttgcgcagttccgaagccagctcctgacctggttgtgtagcctcttattactgagcacgttgcgcctgcagggggtggaggaagtgaaacggaggtggtacaaaaccgaaaacgaatattatctgcttcagtttactctaactgttaggtgcttgtactataccagcttttccctggagctgtgctggcagcagctgcctgctgcctctaccagctacagcttcccgtggatgttggcctacgtattttactatcccgtgttgcataatggacctattttgtctttttccgagtttatcaaacagatgcagcaacaggagcacgactccctgaaggcctcactgtgtgtgctcgcactcggattgggccgccttttgtgctggtggtggctggcagagttaatggcacacctaatgtacatgcatgccatatactccagcatcccgctcttggaaactgtgtcctgttggactctaggaggccttgcccttgctcaggttctctttttctacgtgaagtacctcgtattattcggggtgcctgccctcctcatgaggctcgatggcctaaccccaccagcattgccaagatgtgtatctacaatgttctcgttcactggaatgtggcgttatttcgatgtggggctccacaatttcctgatcaggtacgtgtatattcccgttggcgggtcccagcacggactcctggggaccctgttttctacggccatgacctttgcttttgttagctattggcacggtgggtacgactacctttggtgctgggctgccctgaattggctgggtgtgactgtggagaatggagttcgccggctggtcgagaccccttgtattcaggatagtctcgcacggtacttcagcccgcaggcgcgaagacggttccacgctgcgctggctagctgctctacctccatgctgattttgagtaacctggtattcttggggggaaacgaggttggcaagacttactggaatcgcatatttatccaaggatggccctgggtgaccctgagcgtgcttggtttcctttattgttacagtcatgtcggcattgcctgggcccagacctatgcaaccgattag

SEQ ID NO: 119642 - DNA, 1347 bp, Artificial Sequence
  Description of Artificial Sequence: Synthetic coding sequence
atgaagttcacaaagagccctgaggatgcaactgattttgaatggtctttttggatggaatggggcaaacagtggttggtttggttgctgttgggccacatggtcgtgtctcagatggccacacttcttgcccggaagcacagaccatggatcttgatgctgtacggaatgtgggcctgctggtgtgtgctgggaacacctggtgtggccatggtgctcctgcacacgactattagcttttgcgtggcccagttccgtagtcagctgctgacatggctctgtagcttattactgctgtccacccttcggttgcagggagtggaggaggtaaaacgtcgctggtacaaaacggagaatgagtattacctcctccagtttacattaactgtgcgatgtctctactataccagcttctcccttgagctgtgttggcagcaactccccgccgcatccacctcgtatagctttccttggatgctcgcatatgtgttttattatccggttctgcataacgggccaattctctccttctctgaattcatcaaacagatgcagcagcaggaacatgactcactgaaagcatccctatgtgtgctagccctgggcctggggcggcttctgtgctggtggtggctggccgagctcatggcccacttgatgtacatgcacgctatatactcatctattcccctgctggaaaccgtctcatgttggaccctcggtggactcgcactagctcaagtcctgttcttttacgtcaaatatcttgtgctgttcggggttcctgcgcttttaatgcggctcgacggcctgacccctcctgccctgcctcggtgcgtgtcgaccatgttcagtttcactgggatgtggcgatacttcgacgtgggtctgcataatttcttgatcaggtacgtttacatcccagtaggagggtcacaacacggcctgttgggaactctgttcagtactgccatgacattcgctttcgtaagctactggcacggaggctacgattacctctggtgttgggccgctctgaattggctgggtgtaaccgtggaaaatggggttaggagattggtcgagactccttgcattcaggactctctagcacggtatttcagcccacaagcacggcggcgttttcatgcggcacttgcatcatgctcgaccagtatgctgattctcagtaatctggtctttctgggcggcaacgaggtcggaaaaacatactggaacagaatattcattcaagggtggccatgggttaccctgtcagtcttgggcttcctgtattgctactcccacgttggcattgcctgggcccagacctatgctaccgattag

SEQ ID NO: 119643 - DNA, 552 bp, Artificial Sequence
  Description of Artificial Sequence: Synthetic coding sequence
atgcgactggacggactgacaccaccggctctacctcgctgcgtgtcaactatgttttcatttacgggaatgtggcgttacttcgatgtcggcctgcataattttttaatccgctacgtctatatccctgtcggaggatctcagcacggccttttggggactctgtttagcaccgctatgacattcgcttttgtgtcatactggcatggcgggtacgattatctttggtgctgggcggccctgaactggttaggggttacagtggagaacggagtcagaaggctagtcgaaactccctgcatccaggatagcctggcccgttacttcagtcctcaagccagaagacggttccacgctgctctcgcctcctgttctaccagtatgctcattttatccaacctggtcttcttgggaggaaatgaggtggggaaaacatactggaacagaatctttatccagggctggccctgggtgactttgtccgtcctgggtttcctttattgctatagtcacgtcggtatcgcctgggctcagacatatgcaacggactag

SEQ ID NO: 119644 - DNA, 1482 bp, Artificial Sequence
  Description of Artificial Sequence: Synthetic coding sequence
atgctgcctcggtgggagttagccctctacctcctagcatccctgggttttcacttttattccttctatgaggtgtacaaggtgtctcgggaacacgaggaggaactggatcaggagtttgaactggagacagatactctgttcggcgggttgaagaaggatgctacagacttcgagtggagcttctggatggagtggggtaaacagtggctggtgtggcttcttttggggcacatggtggttagccagatggctacacttctggcaagaaagcacaggccatggatcctgatgctgtatggcatgtgggcatgctggtgcgtcttagggacgcctggggtcgcaatggtattactgcacacaaccatctcattctgcgtggcgcagttcaggtcacaattgctgacttggctctgttctctgctgttgttatcaacgctacggctccagggcgtcgaagaagtgaagaggcgctggtacaagacagaaaacgagtattatttgttacaattcaccctcacggtgcgctgcctgtactacacaagtttctctctggagttgtgctggcagcagcttcccgcggcctcaacttcctactccttcccgtggatgttggcgtatgtgttctattatccagtcctgcacaacggacccatattgtctttttcagagttcattaagcaaatgcagcagcaggagcacgattctctgaaagccagcctctgtgttcttgccctgggcctggggaggctgctgtgttggtggtggcttgccgagcttatggctcacttgatgtatatgcacgcgatatactcctccatcccactgctagaaactgtgtcctgttggacactgggtggccttgcgttggcacaggtactgtttttctatgtcaagtatttggtgctgtttggtgttcctgccctgctcatgcgactggacgggctgacacccccagccttaccccgttgcgtatctaccatgttcagtttcacaggcatgtggcgatacttcgacgtgggtctccacaacttcctgatccgatacgtatacatcccagttgggggaagtcagcacgggctgctgggtaccctgtttagcactgcaatgacatttgcgtttgtgagctactggcacggaggctacgattacttgtggtgctgggccgcacttaactggctgggagttaccgtggaaaacggagttcgtcggctggtggaaacaccctgtattcaggacagtctagcccgatacttcagtccacaggcgcggcgaagatttcacgctgccttagcctcctgcagcacctctatgctgatcctttcgaatttggtatttctcggtgggaatgaggttggcaaaacttattggaaccgcatttttatccagggatggccttgggtcaccttgtccgtgcttggatttctctactgttattctcacgtgggcatagcatgggcccagacctatgccaccgattag

SEQ ID NO: 119645 - DNA, 1557 bp, Artificial Sequence
  Description of Artificial Sequence: Synthetic coding sequence
atgttgccaagatgggagctggctctgtacctcctggcatccctcgggttccatttttactctttttacgaggtctacaaggtgtcccgtgagcacgaagaggagctggatcaggaattcgagctggagaccgatacactctttggagggctcaaaaaggacgcaacagacttcgagtggtctttctggatggaatggggcaagcagtggctggtatggctgctcttgggtcacatggtagtgtcacagatggccactctcctggcccgaaaacatcgcccctggattctgatgctgtacggcatgtgggcgtgttggtgtgttttgggaactcctggggtggcaatggtcctcctccataccactatcagcttttgcgtggcacagttcagaagccagctgcttacctggctatgtagcttgctgcttctatcaacgctgagactgcagggagttgaagaggttaagagacggtggtacaaaaccgagaacgagtattaccttttacagttcacactgactgtaagatgcttatactatacctcattttctctagaactgtgttggcaacagctgcccgccgccagcactagctacagctttccctggatgctggcatatgtgttttactaccccgtcctgcataatggtcccattctatccttcagtgaatttatcaagcagatgcaacagcaggaacacgacagcctgaaagctagcctatgcgtgctcgctctggggctaggccgccttctgtgctggtggtggttagcagagttgatggcccacctcatgtacatgcacgccatctattcctcaatccctctgctggagacagtcagctgctggaccctgggcggcctggctctcgctcaggtcctcttcttttatgttaaatacctcgtacttttcggcgtgccagccctcctaatgcgtctggacggtctgacaccccctgctttgcctcggtgtgtgagtacaatgttttcgttcactggcatgtggagatatttcgatgtggggctccacaatttcctcatcagatacgtttacatccccgtgggcggttcacagcacggtctcctcggcaccctgtttagtactgccatgacattcgccttcgttagttactggcacgggggctacgactacctttggtgttgggccgcgctgaattggctcggggtcacggtagagaatggagtgcgccgattggtagagactccctgtatacaagactccctcgccaggtatttcagccctcaggctaggcggcggtttcatgccgccttggccagttgctccacatcgatgctgatcctgtccaatctggtattcctcggtggaaacgaggtgggtaagacttactggaaccgaatcttcattcaaggaggcctgttcctattttttttgctaaatccatgctgggaaactgctttccagggattcccggtctttctgcacttccttcaaacagaagtcctcgcaaccttcgtgcccaattacttctcttggaatatctgcattgaaaacaccagcgagctcagcagctactag

SEQ ID NO: 119646 - DNA, 1482 bp, Artificial Sequence
  Description of Artificial Sequence: Synthetic coding sequence
atgctacccaggtgggagctggccctgtacctgctcgccagcctaggatttcatttctactccttctatgaggtctacaaggtctcccgtgagcatgaggaggagctcgaccaggagtttgagcttgagactgacacgttattcggtggcctcaagaaggacgcaaccgattttgaatggagtttttggatggagtgggggaagcagtggctggtgtggttactgcttggacatatggtcgtctcccagatggccactctgctcgcgaggaaacaccgcccttggatacttatgctctacgggatgtgggcatgttggtgcgtcctgggtacacccggcgttgccatggtgctcttgcataccacgatatcattttgtgtggcccagtttcgatctcaactcctcacttggctctgtagcctactcttattatctacgctgcggctccaaggcgttgaggaggtgaagaggcgatggtacaaaacagagaacgaatattatttgctccaattcacattgactgtgaggtgtctttactacacatctttctcgctggagctctgctggcagcagcttcccgcagccagtacttcttactcattcccttggatgcttgcctacgttttttactatcctgtcctgcataatggccccatcttaagcttctccgagtttattaaacagatgcaacagcaggaacacgatagcctcaaggcgtcgctgtgtgtcctggctcttggacttggcaggcttttatgctggtggtggttggctgagctcatggcacacctgatgtacatgcatgctatctacagcagcatccctctgctggagaccgtgagttgttggaccctcgggggcctcgctctggcacaggtactgtttttttatgtgaagtatctcgtgctgtttggcgttccagcactactgatgaggctggacggtctgactccccccgccctccccagatgtgtgtcaacaatgttttcttttactggaatgtggagatatttcgacgttgggctccacaactttctgatccgttatgtgtacatccctgtgggtggctcacagcacggccttttgggcactctgttttcaactgccatgacatttgcattcgtgtcctactggcacggaggatatgactatctctggtgctgggcagccctcaattggctcggtgtgacagtggagaatggggtgcggaggcttgttgagacaccctgtatacaggactctttagcgcggtacttctctcctcaggcccgaaggcggttccatgcggcactggccagctgctccacctcgatgctcattctcagtaaccttgtctttctcggagggaatgaggtcggcaagacatactggaaccgcatctttattcaaggctggccttgggtgacactctccgtgcttggctttctgtattgctactctcatgtaggaatcgcatgggcacaaacatacgcgactgactag

SEQ ID NO: 119647 - DNA, 624 bp, Artificial Sequence
  Description of Artificial Sequence: Synthetic coding sequence
atggagtggggcaaacaatggttggtgtggctgttgctaggtcacatggtggtcagtcagatggccaccctgttggcaaggaaacggcgttggtataaaaccgagaatgaatactaccttctgcagtttacccttaccgttagatgtctatactacacttcttttagccttgagctctgctggcagcagctgcctgccgcatctactagttatagcttcccatggatgcttgcatatgtgttctattaccccgtgctccacaacggccctattctcagtttcagcgagttcattaagcagatgcagcaacaggagcacgatagcctgaaagcctccttatgtgtgcttgcgctaggcctcggaaggctgttatgctggtggtggctggcagagctgatggcccatctaatgtacatgcatgccatctattcatcgatccctctgttggaaacggtttcatgctggacgctcggggggctcgcactggctcaggtgctcttcttttacgtgaaatacctggtgctgtttggagtcccagctctcctgatgaggctggacgggttgactccacccgccctgccgagatgcgtctctaccatgttttccttcaccggaatgtggtag

SEQ ID NO: 119648 - DNA, 1287 bp, Artificial Sequence
  Description of Artificial Sequence: Synthetic coding sequence
atgctgcctcgctgggagctggccctgtatcttctcgcctctctggggttccatttttacagcttctatgaggtgtacaaagtttcccgcgagcatgaggaagaattagatcaggagttcgaattggagacagacacactctttggcggactgaaaaaagatgccacagacttcgagtggagcttttggatggagtggggtaaacagtggcttgtgtggcttctcctcggccacatggtcgtgagccaaatggctacactgctggcgcgaaagaggcgatggtacaaaaccgaaaacgaatactacctgttgcagttcactctgaccgtgcgctgcctctactacaccagcttcagtctggagctctgttggcagcagctgcctgcagccagcactagttatagttttccgtggatgcttgcttatgtgttctactacccagtgctgcataatggccccatcttgagcttctcagaatttataaaacagatgcagcagcaagagcacgatagcctgaaggcctccctctgcgtactggccttgggcctaggcagattgctgtgttggtggtggttagccgagctgatggcccatcttatgtacatgcacgctatctactcttccatccctcttctcgagactgtgtcttgttggactctaggtggcctggcgctcgcacaggtgctgttcttttatgttaaatatctcgtgctctttggcgtccccgccctgctgatgaggctcgatgggcttaccccaccagcacttcctcgatgcgtctcaaccatgttctcattcacagggatgtggagatattttgacgtggggctgcacaatttcctgattagatacgtgtacatccctgtaggagggtcgcagcatggcctcctcggaacgcttttctccaccgcaatgacatttgccttcgtaagttattggcacgggggctacgactatctctggtgttgggcagccctgaattggttgggggtcactgtggagaacggtgtacgccggcttgtggaaaccccgtgtatccaggactccctggccagatacttttctccccaagcccggcgccgtttccatgccgctttagcttcatgttcaacttcaatgttgatcttatcaaatctggtgttcttaggaggcaatgaggtcggcaagacgtattggaaccgaattttcatccaaggatggccctgggtgactctctctgttctaggatttttgtactgttattcccatgtgggcattgcttgggctcaaacatatgcgaccgactag

SEQ ID NO: 119649 - DNA, 1071 bp, Artificial Sequence
  Description of Artificial Sequence: Synthetic coding sequence
atgttgccaaggtgggaactcgctctctatctactggcttcactcggcttccatttctactctttctacgaggtgtataaagtttcaagggagcacgaagaagaactggatcaggagtttgagcttgagactgacacactcttcgggggcctcaaaaaagacgccacagacttcgaatggtctttttggatggaatggggaaagcaatggctcgtatggttgttactgggccatatggttgtttcccaaatggcgactctgttggccaggaagatgcagcagcaggagcacgacagcttaaaggcctctctgtgtgtcctggcactggggctgggcaggttactgtgctggtggtggctcgcagaactgatggcccatctcatgtatatgcacgcaatttactccagcatccccctcttggagactgtgagttgctggacactcggcggcttggctctggctcaggttctcttcttctacgtcaagtaccttgttctcttcggcgtccccgcgctgttgatgaggctggatggtctgacgccacccgctctcccccggtgtgtgtcaacgatgttcagtttcaccgggatgtggaggtactttgatgtcggattgcataatttcctgatccggtacgtatacatcccggtcggtggctctcagcatggcctcctgggaactctgttttccacggcgatgactttcgcattcgtaagttactggcacggtggatatgattacctgtggtgctgggcagccctgaattggctgggtgttaccgtggagaacggcgtgaggcgcttggtggaaacgccgtgtatacaggattccttggcccgctattttagcccacaggcccggaggagattccacgcagccctcgcctcttgctctacatctatgctgatcctcagtaacctggtgtttctcggaggcaacgaagttggtaagacttactggaaccggatcttcatccaaggttggccctgggtgaccctctccgtcttaggatttctctactgctatagccacgtggggatcgcctgggcccaaacctacgctacggattag

SEQ ID NO: 119650 - DNA, 1485 bp, Artificial Sequence
  Description of Artificial Sequence: Synthetic coding sequence
atgagcctcgggctgggctcggcagagcgcggagtactgggaacaaggggggctcgggaacgttgcaggcgtagaaggccaggacagcccggagaacacgaggaggagctggatcaagaattcgaactcgaaaccgacaccttgtttggcggcctgaagaaggacgctacagattttgaatggtcgttttggatggagtggggaaagcagtggcttgtttggctgctcttaggacacatggtggtgtcccagatggccaccttactcgccagaaaacacaggccttggatcttgatgctttatggaatgtgggcctgctggtgcgttctgggcactcctggcgtagccatggttctgctacacacgacaatcagcttctgcgttgcccagtttcggagccagctgttgacatggctatgcagcctgcttttactcagtacactgagactgcaaggcgtagaagaggttaagagacgctggtataaaacagagaacgaatactacctgctgcagtttacactgacagtgcggtgcctgtactataccagcttctccctcgagctgtgctggcagcagctgcctgctgcaagcacttcttatagttttccatggatgctcgcctatgtattttactaccccgtgcttcataacggtcctatcttatcttttagcgaatttatcaagcagatgcaacagcaggaacacgactccctaaaggcatctctctgcgtcctggcgcttggcctaggaagactgctatgctggtggtggctggccgagttgatggcccacctcatgtatatgcacgccatatattcctccatccctctcctcgagacggtgagctgctggaccctggggggcttggctctggcccaggtgctctttttctacgtgaagtacctggtgctcttcggagtgcctgccctgctaatgaggctcgatggtctgacgcctcctgcgcttcccagatgcgtgtccactatgttctcctttactgggatgtggcggtattttgatgttggcttgcacaactttctgattcgctatgtgtacatcccagtgggcggttcccagcacggtctgttaggaactctctttagcactgctatgacctttgcgtttgtttcctattggcacgggggatatgactatctgtggtgttgggctgcactgaattggttgggggtcacagtggagaacggcgttcggagactggtggaaaccccatgtatccaggattctctggctcgctatttcagtccgcaggctcgaaggcggttccatgcggctcttgcctcatgttccacaagcatgcttatactttctaacctggtcttcctaggcgggaatgaagtgggtaagacctactggaatcgaatcttcattcagggttggccttgggtgactctttcagtcctgggcttcctctactgttactcacatgtgggcattgcctgggcacagacatatgctacagattag

SEQ ID NO: 119651 - DNA, 1293 bp, Artificial Sequence
  Description of Artificial Sequence: Synthetic coding sequence
atggagtggggtaaacagtggctagtatggttgctcctgggccatatggttgtatcacagatggccactttactggcccgcaaacataggccctggatcctcatgctatacggcatgtgggcctgttggtgcgtgctgggcacccccggagttgcaatggtgctactccacactactattagcttttgtgtagcccagttccgcagccagctgctgacctggctatgtagcctgttgctgctgtctacgctgcggttacagggagtcgaagaggtcaaacggaggtggtataagacggaaaatgaatactatctacttcagtttacactcacggtaaggtgtctctattacacaagtttcagtttggaactctgttggcagcaactccctgcagcgtccaccagctattctttcccatggatgttagcgtacgttttctactatcctgtccttcacaacggacccattctctcttttagcgaatttataaagcaaatgcagcagcaagagcacgattcgctgaaagcatcactctgcgtgctggcacttggactgggccggctgttgtgttggtggtggcttgccgagctgatggctcacctgatgtacatgcacgccatttattcctccattccgctcctggagaccgtgtcttgttggacccttggggggctggccctcgcgcaggtgctgtttttttatgtcaagtacctggtcctcttcggtgtccccgctcttctcatgaggctcgacgggctgactccccctgcattacctcgctgcgtttcaacaatgttctcctttacgggaatgtggcggtatttcgatgtaggtctgcataactttctgatccgctacgtttacatccccgtaggtgggtcccagcatggcctgctcgggactttgttctctacagccatgacgtttgctttcgtgtcgtactggcacggcggttacgattacctatggtgctgggcagcgttgaactggcttggagtgactgtggagaacggagtgcgtcggttagttgaaaccccatgtatccaggacagtctggccagatactttagcccccaagcacgcagacgattccatgcagctttagcctcatgtagcacgagtatgctgattctgagtaatttagtgtttctgggtggaaatgaagtgggaaagacttattggaatcggattttcatccagggttggccttgggtgaccctttccgtactggggttcctgtactgctatagccacgtgggcatcgcttgggcccagacttacgcgacagattag

SEQ ID NO: 119652 - DNA, 2103 bp, Artificial Sequence
  Description of Artificial Sequence: Synthetic coding sequence
atgctgaagatgctgagctttaagcttctgctgctggccgtcgcgctcgggtttttcgagggggacgctaaattcggggagaggaacgagggcagcggtgccaggcgacgtcgatgcctgaacggaaaccctcctaagagactcaagaggcgagacagaagaatgatgtcacagctggagctgctttccggcggcgaaatgctgtgcggcgggttctacccccgattaagctgctgcttgcggagcgacagtccaggactaggccggctggaaaacaagatcttttcggtcacaaacaacacggagtgcggtaaacttctcgaggagatcaagtgtgccctgtgcagcccccactcccagagcttattccactcgcctgaacgggaagtgctggaaagagatcttgtgttaccactgttatgcaaggactattgtaaggaatttttctatacctgcagagggcatattcctggcttcctccaaacgaccgccgacgagttttgcttttattacgcccggaaagacggtggtttatgctttcccgacttccctcgcaagcaggtacggggcccagcttctaactatctagatcagatggaggagtatgacaaggttgaggaaatttcacgcaagcacaagcacaactgtttctgtatccaggaagttgttagcgggcttcgacaacccgttggggctctgcattctggcgacggctctcagaggctgttcattttggaaaaggaaggatacgtcaagatcctgacacccgagggcgaaatatttaaggagccctatctggacatacacaagttggtccagagcggaattaaaggcggtgacgaacggggcttactgtcactcgcttttcacccaaattacaaaaagaacgggaaactttatgtctcttacaccaccaaccaggaacgatgggcaatcggccctcatgaccacattctgagggtggtggagtacaccgtttctaggaaaaatccgcatcaggtggatctacggaccgcgcgggttttcctggaggtcgccgaactgcaccgaaaacatctcgggggccagttgttgttcggcccagacggatttctgtacatcatcctcggggatgggatgataacactcgacgatatggaggagatggatggcctctctgacttcacaggttctgtgctacgcctggacgtagacaccgacatgtgcaatgtcccttacagcatcccgcgctcgaaccctcacttcaactctactaaccagccacctgaggtgttcgcacacggtctgcacgatcctggtcggtgcgcggtcgaccgacaccctactgatattaacattaatctcaccatcctatgtagcgatagcaacggtaagaaccggtcctccgctcgcatactgcagatcatcaaggggaaggactatgaatccgagccctcgctgttggagtttaagcctttcagcaacggcccactcgttggcggcttcgtatataggggatgccagtcggagaggctgtatggcagttatgtatttggggatagaaatggaaactttctgacactccaacaatctccagttacaaagcagtggcaggagaagccactctgtctaggaacgagtggaagctgccggggatatttctcaggccacatcctcgggttcggtgaggacgaattgggtgaagtgtatattttgtcttcctcaaagtctatgacgcagacccataatggaaagctctataagatcgtggaccctaaacgcccgctgatgcctgaagagtgcagggccaccgtccagccagcccagactctcactagcgagtgcagtcgtctgtgcagaaacggttattgcaccccgaccgggaaatgctgctgttcccccggttgggagggtgatttttgtcgtactgcaaagtgtgaacccgcatgccggcacgggggcgtttgcgtcaggcccaacaaatgcctttgtaagaagggctatctgggcccacaatgtgagcaggtagaccgaaacattcgacgtgtgacccgggcagggatcctggaccagatcattgatatgacctcttacctcctggacctcacgtcatacatcgtgtag

SEQ ID NO: 119653 - DNA, 963 bp, Artificial Sequence
  Description of Artificial Sequence: Synthetic coding sequence
atgttgaaaatgctatcattcaagttactgttactggcggttgcactgggtttcttcgagggagatgcgaagtttggtgaacggaatgagggttctggcgctcggcgaaggaggtgcctaaatggcaacccacctaaacggttgaaacggagagaccgccgcatgatgtcccagttggagctgctcagcgggggagagatgctttgcgggggcttttacccccggctgtcttgttgtttgcgaagtgactcaccagggctcggccggttagagaacaagatcttctccgtgaccaacaatactgaatgcgggaaactgttagaagagataaagtgcgctctttgttcaccacacagccagtctctcttccattctccggagcgggaggtgctggaaagagacctagttctgcccctgctatgcaaggattattgcaaggagtttttctatacttgccgggggcatatccccggctttctgcagacaaccgccgatgagttttgcttctattatgcccgcaaggatggtgggctttgtttcccagacttccctcgaaaacaggtgagaggacccgcctccaactacctggatcaaatggaggaatacgataaggttgaggaaattagccggaagcacaagcataattgtttctgtatccaggaagtcgtttcagggctgaggcagccagtaggggcactgcatagtggggatggctcacagcgccttttcatcctggaaaaggagggctatgtcaagatactgacaccagagggagagatcttcaaggaaccgtacttggatatacataaattagttcagtctgggattaaagtaggcttcttaaactttatttacttttgcgccgggtacgtgaacttcatactggtgctaccatctagccttaaagtgttcttgtgtaacaaacgcaaaaacctcgccggggaaaataagggggccacctag

SEQ ID NO: 119654 - DNA, 4146 bp, Artificial Sequence
  Description of Artificial Sequence: Synthetic coding sequence
atggcctcccctcgggccagccggtggccgcctcctttgttgctgcttttactccctctgttgttactgcctccagcagctccgggaacacgtgatccgccgccttcgcctgcacgccgggccctgagcctggcgccacttgcaggagctggactggagctgcaactcgaaaggcgcccagagcgggagcctccccccactcccccgcgcgaacgcaggggtccggcgactcccggtccatcttacagagctccagagcccggggctgctacacagcggggacccagtgggcgggctccccgtgggggatctgcagacgctgcatggaaacactggcccgaatctaacactgaggcacacgtggaaaacatcacattctaccagaaccaggaagacttctcaaccgtgtcctccaaggaaggggtaatggtccaaacctcaggaaaaagccacgcggcttcagatgcccctgagaacctgacccttctcgctgagacagctgatgcgcgaggcagaagcgggtcctcgtcccgcacaaactttaccatcctgcctgtgggctactcgctggagatcgcaacggctttaacgtcacagtcaggcaacctcgcatcggaatcccttcatctgccttcaagctcaagtgagttcgatgagaggattgccgcgtttcagacaaagtcaggcaccgcgtctgagatggggaccgaacgcgccatgggcctcagcgaagagtggactgtccactcccaggaggctaccacaagcgcctggtccccaagttttctacccgccctggagatgggagagttgacaactccttccagaaaacggaacagttctggccccgacctctcctggctgcacttctacagaaccgcggcctcaagtcccctgctcgacctgtcgtctagcagcgagagcactgagaaattgaacaacagcacaggcctgcaatcatcctcggtgagccagaccaagactatgcacgttgctacagtgtttaccgatggtgggccaagaacgctgaggtctctgacggtgtctcttggcccggtctcaaagactgaaggattcccgaaagactccaggatcgcaacaacctcctcatccgtactgctctctccttccgccgtggagtccaggaggaactctcgcgtgactggtaacccgggagatgaagagttcatagagccatctaccgaaaacgagtttgggctgacttcattacggtggcaaaacgattctcccaccttcggggagcatcagctcgcctcctccagcgaggtacaaaacggcagcccaatgtctcagactgagacggtgtccaggagcgtggcccctatgcgcgggggggaaatcaccgcccattggctcctgactaatagcaccaccagtgccgatgtcacaggctctagcgcgagctatccagaaggcgtaaatgccagcgtgctgacccagttctctgattcgaccgtccagagtggaggatcccacacagctcttggagatcggagctattccgagtcaagctcgacatcaagtagcgaatcgctcaactcatcagccccgcgcggagagcggagcattgcaggaataagttacggccaggtccggggcacagcaattgagcagcggacctcaagcgatcatacagatcatacctacctgtcttcaactttcaccaagggcgagcgggctctactcagcatcacggataactcttccagcagcgatattgttgaaagctccacctcatacataaagatcagtaattcatctcactctgagtactcatcattcttccatgctcagacagagcgttcaaatatcagcagctatgacggtgaatatgcgcagccctctacggagtcacccgtgctccatacctccaatctgccgagctacactccaaccataaacatgcccaacacctccgtggtcctcgacacagatgctgaatttgtctctgacagttccagttcctcttctagctcaagctctagttcgtccagcggaccccccctgcccctgccatccgtgagtcaatcgcatcatttgtttagttcgatcctcccctcaactcgcgcttcagtgcacctgctgaaatctactagcgatgcaagcaccccttggtcctccagcccttcgccccttccggtgagcctcactacctcaacatccgcgccactgtccgtgtctcagactaccttgccccagagctcctctacaccagtccttccacgtgcccgcgaaaccccagttacgagctttcaaacttccaccatgacaagcttcatgacaatgctacactcatcccaaaccgctgacctgaagtcccagtctactcctcaccaagaaaaggtcattacagagagtaaatcccctagccttgttagtctgcctactgaatccaccaaagccgttacaacgaactctccgctacctccaagtctgacggagtcgtccaccgagcagactctccccgccacctcaactaacttggcccaaatgagccccaccttcacaactactattctgaaaacctcgcaaccactcatgactacaccaggcaccctttctagtacagcttctctggtgaccgggcccatcgccgtgcagaccacagcgggaaagcagctgagtctgacgcatcccgaaatcctcgtcccacagatcagcacagaaggggggatctcgacagaaaggaatcgggttattgtggacgctaccactggcctgatccctctgacgagcgtgcctacatccgccaaagaaatgactaccaaactgggagtgacagcagaatactcacctgcaagccggtcactgggaacctctccgagccctcagaccacggtggtaagcacagccgaggacttagcgcctaaatccgccaccttcgcagtgcagagtagtacgcagtctcctaccacagtgtcatcatctgcttccgtgaactcatgcgccgtgaacccctgtttgcataacggagaatgtgttgcggacaacaccagtagaggataccactgccggtgcccccctagctggcagggagacgactgcagtgttgacgtgaatgaatgcctctccaacccctgtccttccaccgcaatgtgtaacaatacccagggtagcttcatttgcaagtgtccagtgggttaccagctcgaaaaaggtatctgcaatctagtgcggacatttgtgaccgaattcaaactcaaacgcaccttcctgaatacaactgtcgagaagcactctgatttgcaggaggtcgaaaatgagatcaccaagacactgaatatgtgcttttcggcgttgccttcatacattagatctactgtccatgcctcacgggagagcaacgcggttgttatcagcctgcaaacaacgttttcactcgcgagtaacgtgacactattcgatttggccgaccgcatgcagaagtgcgtcaacagctgtaagtcttctgctgaagtctgtcagttgctgggctcccagagacgcatatttagagccgggtccctgtgtaagcgtaaaagcccagaatgcgataaggacacttctatctgcacagacctggacggggtcgccttgtgccaatgcaagtctggctatttccagttcaataagatggaccatagttgtcgggcatgcgaagatggatatcgtctggagaacgagacatgcatgagttgccccttcggcctggggggcctcaactgcggcaacccctaccagttaattaccgtcgtcattgccgccgctggtggggggctgctgctgattctagggattgccctcatagtcacatgttgtagaaagaataagaacgatattagcaagctgatcttcaaaagcggcgattttcagatgtccccctatgcggaatatccaaaaaatcctcggtctcaagagtggggacgagaggccattgaaatgcacgagaacggtagcacaaagaacttacttcagatgactgacgtctactacagtcctacctccgtgcgtaatccagagttagaacggaatgggctttatcccgcctatactggactgcctggctcccgccacagttgcatctttccaggccagtacaacccctcctttatttctgatgagagtaggaggcgtgactacttctag

SEQ ID NO: 119655 - DNA, 5829 bp, Artificial Sequence
  Description of Artificial Sequence: Synthetic coding sequence
atggaagatcggcgagctgaaaagtcctgcgagcaggcatgcgagtccctgaaacggcaggattatgagatggcattgaaacattgcaccgaggccctactgagcctgggacagtacagcatggccgacttcactggaccatgcccactcgagatcgaaagaatcaagatagagtccttattgtacagaatagcgtccttcctgcagctgaagaattatgtccaggccgacgaggattgccgccatgttttgggagaagggttggccaaaggcgaagacgcctttagggcagttctctgttgcatgcaactgaaaggcaagctacagccagtgagcacgattctcgccaaatcgctaacaggagagtccttgaatggaatggtgaccaaagaccttaccagactgaaaacgctgcttagcgagactgagaccgcgacgtccaatgccttgagcggctatcatgtggaagatcttgacgaagggtcctgcaatggctggcactttcgcccccccccaagggggatcacatccagcgaggagtacaccctgtgcaaaagatttttggagcagggaatctgcaggtatggcgctcagtgtacgagtgctcacagtcaggaggaactggccgagtggcagaaacggtacgcttctcggctcattaagctgaagcagcagaacgagaataaacagctgtctggctcctacatggaaacattgatagaaaagtggatgaacagcctatctcccgagaaggtgctgagtgagtgcattgagggtgtgaaggtggagcacaaccccgatctgtctgtgactgtgagcactaaaaagtcacaccagacctggactttcgcactcacttgcaaaccggcccggatgctgtacagagtggctctgttatacgatgcacaccgccctcatttctccattattgctatcagcgccggagactcaacaacccaggtgtcccaggaagtgcctgagaactgccaagaatggattggaggaaagatggctcaaaatgggctcgaccactacgtgtacaaagtgggaattgctttcaatacagaaatttttggaacttttcggcagaccattgtgttcgacttcgggctcgagcctgtgttaatgcagagagttatgatcgatgccgcctctacagaggacctcgagtatctcatgcacgcaaagcagcagctggtcacaacagccaaaagatgggatagttcctctaaaaccatcatcgactttgagccaaacgagacaaccgacctcgaaaaaagtctcctgatcagataccagattcctctgtcagcagaccagcttttcacccagtctgtgcttgacaaatctttgacaaagtctaattaccaaagccgcttacacgacttactgtatattgaagagatagctcagtacaaagagatatccaaatttaatctaaaggtgcaactgcaaattctggcaagcttcatgctcacaggcgtctctggcggtgcgaaatacgcccagaatggccaactcttcggcagatttaaactcactgagacgttgtctgaggataccctggcaggccggctggtcatgacaaaagtcaatgccgtttatctgctgccggtgcccaagcaaaaattggtgcagactcagggcaccaaggaaaaggtgtacgaagctaccatcgaagagaaaaccaaagagtatatatttcttcgactcagtagagaatgttgtgaggagctgaaccttagaccagactgcgatacccaggtggagctgcagttccagctgaacagactgccactgtgtgagatgcattacgcactcgataggatcaaggacaacggggttctgtttcctgacattagcatgactccaacaattccctggtctcccaatcgccagtgggacgaacagctggacccaaggttgaacgctaagcaaaaagaggcagtgctggccataaccacccctttggcaatccagctaccacctgtgctgattatcggaccatatggaacgggaaagacatttacactggcccaagccgtcaaacatatacttcagcagcaggaaacacgcattttaatttgcacccactccaattccgccgccgacctgtatatcaaggactatctgcatccatacgtagaagccggcaacccacaagctcgaccactgagggtgtattttcggaatagatgggtcaaaaccgtgcatcctgtcgttcaccagtactgcttgatctcaagcgcacatagtacctttcaaatgccccagaaggaggatattcttaagcatcgggtggtggtagttacactcaacacaagccagtacctctgtcagttagatctagaaccgggcttctttacccatatcctactggacgaggcagcccaggccatggagtgtgagacaatcatgccactggcactcgccactcagaatacaagaatcgtcctggccggtgaccatatgcagctgtctccgttcgtttatagcgaattcgcacgggagagaaatctccatgtctcccttctggaccgcctctacgagcactatccagccgagtttccttgcaggattctattatgcgagaattacaggtcccacgaggcaatcattaattatacatccgaactgttttacgaaggcaagttaatggctagcggaaaacagcccgcccacaaggatttctatcctctgacattttttacagctcggggagaggacgtgcaggagaaaaattcgaccgctttttacaataacgctgaggtatttgaagtggtggaaagagttgaggaactgcggcggaagtggcccgtggcgtggggtaagcttgacgacggcagtatcggagtcgtgacaccttatgcagaccaggtattcagaatccgtgccgaactgagaaagaaacgcttgtcagatgtgaacgtcgagagggtcctgaatgtccaggggaagcaattccgagtgctgttcctgagcactgtcagaactaggcatacctgcaaacacaaacagactccaatcaagaagaaggaacagctcttagaggactctaccgaggacctcgactatggatttctgtccaactacaaactgttgaacaccgccatcacaagagctcagagcctcgttgccgtagtcggtgaccctatcgctctgtgctcaatcggtcgctgccggaagttctgggaaaggtttattgcactgtgccatgagaattcatctctccatggcatcaccttcgagcaaataaaggcccagcttgaagctttggaattgaaaaaaacatacgtgctcaaccccctagcaccggaatttattccacgcgcattgagactacagcattctgggtcaacaaacaaacagcagcaaagccctccaaagggaaagagcctccatcatactcaaaatgatcattttcagaacgatggcattgtccagccaaaccccagcgtgttgattgggaatcccatccgcgcctacactccaccccccccgctgggcccgcacccaaatttaggaaaaagcccatctcccgttcagcgaatcgacccacatacgggaaccagtatcctttacgtcccggccgtctacggggggaatgtggttatgagcgtgcctctcccagtcccctggactggctaccaagggcgctttgctgtcgatcccaggattattactcaccaggccgctatggcctacaacatgaacctgctccagacccatggtcgaggctctcccatcccgtatggcctgggacaccaccctcccgttacaatcggtcagccacaaaaccaacaccaggaaaaggatcagcatgagcagaaccgcaatggaaaaagtgacactaacaacagcggtcccgaaattaataagatcagaacgcccgagaagaagccaactgagcccaagcaggtggatctggaaagcaacccacaaaaccgatcacctgagagtcggccctccgtcgtttacccatcaaccaaatttccgcgtaaggacaacctgaacccccgccacatcaacctacccctccccgccccccacgcccagtacgccatccctaacagacactttcaccccctgccccaactgcctcgaccgcctttcccaatccctcagcagcacacgctattgaaccaacagcagaacaacctgccggaacagcctaatcagatccccccccagccaaaccaggtggtgcagcagcagagccagctgaatcagcagccgcagcagccgcccccccagctgtctcccgcttaccaggccggacccaacaatgcgtttttcaacagcgctgtggcacataggccacagagcccacctgcagaagccgtgattcccgagcaacaaccacctccaatgctgcaggaggggcatagccctctgagagcaattgctcagccaggtcccatcctgccttcccatctgaattcattcattgatgaaaaccccagtggactgccgattggcgaagccctcgaccggatacatggatcggtggcgcttgagaccttacgacaacagcaggccaggttccagcagtggtcggagcaccatgcctttctttcgcaaggctctgccccctaccctcaccatcaccacccccaccttcagcacctcccacagcctccgctgggccttcatcagccacctgtgcgcgccgattggaagcttacatctagtgccgaagacgaggtagagacaacttacagcagatttcaggacctgatccgagagctgtcacacagggatcagtcagaaacccgtgaactggctgaaatgccaccaccccaatcccggctcctccaatacaggcaggtgcagtcacgcagcccgcccgcggtgccttcacccccatccagcactgaccactcctcacattttagcaactttaacgacaactcccgcgacatcgaggtggcctctaatccagcattcccccaacggctgccgcctcagattttcaattccccattcagcctgccttccgagcacttggcccctccaccgctcaagtacctcgcacctgatggtgcttggacttttgccaatttacagcaaaaccacctgatgggccccggttttccttacggtctgcccccactgccccacagacccccccagaacccattcgttcagatccagaatcaccagcatgcaatcgggcaggagccatttcatccgctctccagtcgcacggtgagcagctcatcccttccttccctagaggaatacgagcctagaggccccggcaggccactgtaccaaaggagaatatctagtagcagcgtgcaaccctgctctgaagaggtcagcaccccccaagactcgttagctcagtgcaaagaactgcaggaccactctaaccagtcctctttcaattttagctctccagaaagttgggtaaatactacttcatcaaccccctaccagaatataccttgtaacggatcatctcgcaccgctcagcccagagagcttatcgctcctccaaaaacagtgaagccacccgaagaccagctgaagtccgaaaatctggaagttagtagttccttcaattattccgtgttacagcatttaggtcaatttccgcctcttatgcccaacaaacaaattgcagaaagtgctaattcttctagtcctcagagctctgctggggggaagccggccatgagctatgcgagcgcgctgcgagcccccccaaaaccacgaccaccacctgagcaagcaaaaaagtcctccgatcccctgtcactgttccaggagctcagtctggggagcagctcaggaagtaatggattctacagctatttcaagtag

SEQ ID NO: 119656 - DNA, 1365 bp, Artificial Sequence
  Description of Artificial Sequence: Synthetic coding sequence
atggaggaccggcgggcggaaaagtcatgcgagcaggcgtgcgagtctctgaagcgtcaggattatgagatggcgctgaagcactgtaccgaagctttgctttctctcgggcagtattccatggctgattttactggcccatgccctctggaaatcgagcgcataaaaattgaaagtctcctctaccgtatcgcaagcttcttgcagcttaaaaactacgtgcaggcagatgaggattgtcggcacgtcctgggcgaggggctggctaagggagaggatgcttttcgcgcagttctctgttgcatgcagctgaaggggaaactccagcccgtcagcaccatccttgccaagtctctgacaggagaaagccttaacggcatggttacgaaagacctaacacggcttaagacactactgtctgaaacagaaaccgccacctccaatgcactaagtgggtaccatgttgaggatttagacgaaggttcatgtaatgggtggcacttccggcctcccccaaggggcatcacgtcaagcgaggagtataccctgtgtaagcgctttcttgagcaaggcatctgtcgctacggggcccagtgcaccagtgcacattcacaagaagaattagctgaatggcaaaagcgatacgcatctagattgattaagctgaaacagcagaacgagaacaagcaactgtccgggtcctacatggaaactctaatcgaaaagtggatgaatagcctttctcccgagaaggtgttgagcgagtgcatcgaaggggtgaaagtagagcataacccagacctatctgttaccgtgtctacaaagaagtcccaccagacatggaccttcgccctgacctgtaagcccgcgagaatgctttatagggtcgccctgctatatgacgcccaccggccacacttctccattatcgccatcagtgccggggacagtacaactcaggtatcccaggaggtgccagagaactgccaggagtggatcgggggcaaaatggcacagaatggacttgaccactatgtctacaaagtgggcatagcattcaacacagaaatttttggtacttttcgacagactattgtctttgacttcgggcttgagcccgtgttgatgcagcgcgtgatgatcgacgcggcctctacagaagatttagagtacctgatgcatgctaaacaacaactggtcaccacagcaaaaaggtgggactcttcatctaagaccataatcgattttgagcctaacgagaccacagatctggaaaaatcacttctcattcgctaccagatacctttatccgagaaaaaaaaaaagaaaaaaaagaagaagaagaagaagaaaaaaaaaaaatag

SEQ ID NO: 119657 - DNA, 294 bp, Artificial Sequence
  Description of Artificial Sequence: Synthetic coding sequence
atgcctgccgagaggcccgctgggagcggcggatccgaagcccctgccatggtggaacaactggacaccgccgttatcactcctgccatgctcgaagaggaggaacagttggaggccgcgggactcgaaagggagcgtaagatgttagagaaggccaggatgagctgggacagagaaagcacggaaattcgctataggagattgcaacacctgctggagaaatctaatatttattccaaatttcttttgaccaagatggagcagcagcagctagaaacagtcatgaagatctag

SEQ ID NO: 119658 - DNA, 2517 bp, Artificial Sequence
  Description of Artificial Sequence: Synthetic coding sequence
atgcccgcggaaaggcctgctggttccggggggtccgaggcccccgccatggtggagcagctggatacagctgtgatcacccccgcaatgctagaggaagaggagcaactggaggcggcaggcttagaacgagagcggaagatgctggagaaagccaggatgtcctgggatagagagtctaccgaaataagatatcggagactccagcatctacttgaaaagagcaacatttattctaagtttctcttgaccaaaatggagcagcaacagctggaagagcagaagaagaaagagaagcttgaacgaaagaaagaatcattaaaagtgaagaagggcaagaattcgatcgacgccagtgaagaaaagccagtgatgagaaaaaagcgcggaagagaggacgagagttataacatttccgaggtcatgtctaaagaagagatcttgtccgtggccaagaagaataaaaaagagaacgaagatgaaaacagttcatctaccaatctctgtgtggaagatctgcagaaaaacaaggacagcaacagtatcatcaaggataggctaagcgaaaccgtgagacagaataccaaattcttttttgacccagttcggaagtgcaacggccaacctgtcccatttcagcaacccaagcactttacagggggggtgatgaggtggtaccaggtggaaggcatggagtggctcaggatgctgtgggagaatggtataaacggcatccttgctgacgagatgggtctaggcaagaccgtgcagtgtatcgcaacgatcgccttaatgatccagagaggggttccaggtccctttcttgtgtgcggtcccctcagcacactaccaaattggatggccgagtttaaacggttcacccccgacattccaactatgctgtatcatggaactcaggaagaacgacagaagctggtgcgtaatatctacaagcgcaagggtaccctgcagattcatccagtcgtcataacttccttcgaaattgcaatgcgcgaccggaatgcccttcagcactgctattggaagtacctcattgtggacgagggacacaggatcaagaatatgaaatgcagacttattagagagcttaagcgttttaatgctgataacaaactgctcctgaccggcacccccctgcagaataatctgtcggagctttggtcattactcaattttctgctacctgacgtatttgacgacctcaaaagcttcgagagctggtttgacattacctctttgtctgaaaccgctgaggacataattgcgaaagagcgagagcagaatgtgcttcatatgttgcatcagatcctcaccccctttctgctccgccggctgaagagtgatgttgccctggaagtgcccccaaagcgggaagttgtagtctatgctcccctgtccaagaagcaggaaatattttacaccgcgatcgtaaatcggacgatagcgaatatgttcggctcttctgaaaaggaaaccatcgaactgagccctaccggtagaccaaaacggaggacacgcaagagtatcaattattccaagatagacgacttccccaacgagctggaaaagttaatctcccagatacaacctgaggtagaccgggagcgggcagttgtcgaagtgaacatacccgtggaaagtgaagtgaatctgaagctccagaacatcatgatgctgctacgcaaatgttgcaaccatccttacttgatagaataccccattgatcccgtgactcaagagtttaagattgacgaagaactggttaccaactccggcaagtttctgattctcgataggatgttaccagagcttaaaaaacgcggacacaaggtccttctcttctcacagatgaccagcatgctcgatattctcatggactactgccatctcagggacttcaacttctctcgattggacgggagtatgtcctactccgagcgggaaaagaacatgcacagtttcaataccgatcccgaggtgtttatctttctggtgtccactagggctggcgggctggggatcaacctaactgctgccgacaccgtcataatctatgactctgactggaacccccagtctgacctccaggcccaagacagatgccacagaattggccagacaaagcccgtggtggtttaccgacttgtcactgcaaatacaatcgatcagaaaatagtggaaagagctgcggctaagaggaagcttgaaaagcttattatccacaaaaaccattttaagggaggtcagagcggcttgaatttgagcaagaatttcttggatcctaaggagctgatggagctcttgaagtccagggactatgaacgtgagattaaaggcagtcgcgagaaagttattagcgacaaggacctcgaacttttactggaccgttccgacctcatcgatcagatgaacgctagcggtcctatcaaggaaaaaatggggatctttaaaatattggagaattccgaagacagtagcccagaatgcctcttttag

SEQ ID NO: 119659 - DNA, 2655 bp, Artificial Sequence
  Description of Artificial Sequence: Synthetic coding sequence
atgcccgcagagcgcccagctggatcaggagggagcgaagcccctgcaatggtcgaacagttggacacagcagtcatcacgcccgctatgctcgaggaggaggagcagctcgaagctgctggtttagaacgggaacgcaagatgttggagaaagcgcggatgagctgggatagagagtcaacggagatcaggtatcgccggcttcagcatctactggaaaaaagtaatatttactccaagtttcttctgacgaagatggaacagcagcagttggaggagcagaagaaaaaggagaaattggagaggaagaaagaaagcctcaaagtgaagaaagggaaaaattccatagacgcctccgaagagaaaccagtgatgagaaaaaagaggggccgagaggacgaatcttacaatattagcgaagttatgtcaaaagaagaaatcctaagcgtggctaaaaaaaacaagaaggagaacgaagacgaaaacagcagtagtacaaatctgtgtgtggaagacctgcagaagaacaaggattccaactccataataaaagaccggctcagcgagaccgttcgccagaacaccaaattcttctttgatcctgtgcggaagtgtaacgggcagccagtgccttttcagcagccaaagcacttcactggaggagtgatgaggtggtatcaggttgagggtatggagtggctaaggatgctatgggagaacggcatcaatggaatactcgctgacgaaatgggccttgggaaaactgtccagtgtattgccaccattgccctgatgattcaacggggcgtgcctgggccgttcttagtgtgcggccccctgtcaacacttcctaactggatggccgaattcaagcgatttactccggacatcccaaccatgctttatcacggaacgcaggaagaaaggcagaagctagtccgaaatatctacaagcgaaaaggaactctgcagatccacccagtggtgatcacttccttcgagatcgcaatgagagataggaacgccctgcagcattgttattggaagtacctgatcgtcgatgaggggcatcggatcaagaatatgaaatgccgtcttatacgcgaattgaagcgctttaatgccgacaacaaacttctattgactggtacacctctccaaaacaatctctccgaactctggtctctgctgaatttcttgcttccggatgtcttcgatgacctgaagtccttcgaatcctggttcgatataacctctcttagtgagaccgccgaagacataattgccaaggaaagggagcagaatgtgttgcacatgcttcaccaagagcggatccctaggatgtatgtgagtgagtttacagatgagggattcttcgaagggaaacttccgtcacggaaagatctttacgacattagaccatacgaaaacacgtaccttctcaagttgcataccaacttcgaaatccttacacctttcctgttaagaaggctgaagtctgacgtcgcactggaggtcccacccaagcgggaggtagttgtgtatgcccctctgagcaaaaagcaagaaatcttttacaccgctattgtgaacagaaccattgccaacatgtttgggagttccgaaaaagaaacaattgaacttagcccaaccggaagacccaagcggaggactcgaaaatctatcaattactcaaagatagatgacttcccgaacgagctcgagaaacttatcagccaaatccagcctgaggtggaccgggagagagctgtggtcgaggtgaacatcccagtcgaaagcgaggtcaatctcaagctgcagaacatcatgatgctcctaagaaagtgctgcaaccacccttacctcatcgagtaccccatagatcccgttacccaggagtttaaaattgatgaagaacttgttaccaactcggggaaatttttaatactggatcgcatgctgcctgagctgaaaaagcgcgggcataaagtgctccttttctctcaaatgacaagtatgctggacatcttgatggactactgccacttacgggatttcaatttcagcagactcgatggaagtatgagctattcagagcgagagaaaaatatgcacagtttcaatacagatcctgaggtgtttatcttcctggtgtcgacacgggccggcggactaggcatcaacctcactgcagccgacacggtgattatctacgactccgactggaaccctcagagtgacctccaggcccaggaccgctgccacagaatcggacagaccaaacctgtcgtggtgtacagactggttactgctaacaccattgaccagaagatagttgagcgggcagccgccaagcggaaactggagaagcttattattcataagaatcatttcaaaggagggcaatctggtctaaatctctctaaaaacttcctcgaccctaaggagcttatggagttgctgaagtccagagattacgagcgggagatcaaaggctctagggagaaagttatatccgataaggacttggagttactactagacaggtctgatctgatcgatcagatgaacgctagtggaccaatcaaggagaagatggggatttttaagatcctggaaaattcagaagattcctcccccgagtgtctgttttag

SEQ ID NO: 119660 - DNA, 390 bp, Artificial Sequence
  Description of Artificial Sequence: Synthetic coding sequence
atgcctgccgaacggccagccggaagtggcggcagcgaagcacccgcgatggttgagcagttagatacggcagtgatcactcccgctatgctggaagaggaggagcagcttgaagccgccggactggagagagagagaaaaatgctggaaaaagcccggatgagctgggaccgtgaaagcactgaaatcagatataggaggcttcaacacctgctcgagaagagtaacatctactcaaagtttcttctcactaagatggagcagcagcagcttgaagagcagaagaagaaagaaaagctggaacggaagaaggaaagtctgaaggttaaaaaagggaagaactcgatcgatgcttctgaagagaagccaggcaactttgtgtgtggctag

SEQ ID NO: 119661 - DNA, 948 bp, Artificial Sequence
  Description of Artificial Sequence: Synthetic coding sequence
atgcctgccgagagacctgccgggtctggtgggtccgaggcacccgccatggtcgaacagttggataccgcggtgattacccccgctatgctggaggaagaagagcaactggaggccgccggtttggagagggagcgcaagatgttggagaaggcacggatgtcctgggaccgagagagcactgagattagatataggagactgcagcacctcctggagaagtccaacatttactctaagttcctgcttaccaagatggagcaacaacagctggaagagcagaagaaaaaggagaaactcgaaagaaagaaagaatcccttaaagtcaaaaaggggaagaatagtatcgatgccagtgaagagaaaccggtaatgcgaaaaaaacggggacgggaggacgaatcttacaacataagcgaggttatgagcaaggaggaaatcttgtctgtcgcgaaaaagaataagaaggaaaatgaggatgaaaatagctcttcaaccaacctatgcgtggaagatttacagaaaaacaaagatagcaactcaatcattaaggaccgtttgagcgaaactgtgcggcaaaacacaaaattctttttcgatcctgtgagaaaatgtaatgggcagccagtgcctttccagcagccgaaacacttcacaggcggcgtgatgcgatggtatcaggtggaaggcatggaatggctgcgcatgctgtgggagaatggcattaacgggatcttggctgacgagatggggctcggtaagaccgtgcagtgcattgcgaccatagccctgatgattcagagaggggtgcctgggccatttcttgtgtgtggcccgctgagcacactgcccaactggatggcagagtttaaaaggttcaccccagacatccccactatgctttaccatggaacccaggaggaaagacagaagctcatatacctgtag

SEQ ID NO: 119662 - DNA, 2223 bp, Artificial Sequence
  Description of Artificial Sequence: Synthetic coding sequence
atgcccgccgagcgtccagctgggtccggcggttcagaagctcccgcgatggtggaacagttggataccgccgtgatcactccggccatgctagaagaggaggaacaacttgaggctgctggcctggagcgcgagagaaagatgttggagaaagcgagaatgtcatgggaccgggagtctacggagatccgctacaggcggttgcagcatctgctggagaagtccaacatttacagcaagttcctcctaacgaagatggaacaacagcagctagaggagcagaaaaagaaggagaaactagagcggaagaaggaatccctaaaggtgaaaaaaggcaaaaactcgatcgacgcatctgaggagaaacctgtgatgcgcaaaaagagaggcagagaagacgaaagctacaacatcagcgaggtgatgagcaaggaggaaattctctccgtggccaaaaaaaataagaaagagaacgaggacgaaaatagctcttctacgaacctgtgtgtggaggatctgcagaaaaacaaggactctaattcaattatcaaggacaggttgagcgagaccgtacggcagaatacgaagtttttttttgatcctgttcgcaagtgcaacggccagcccgtgccttttcagcagcctaagcatttcactggtggcgtgatgaggtggtatcaagtggaaggtatggaatggctcaggatgctctgggagaacgggatcaatggcatcctggccgacgaaatgggtctcgggaagacggtgcagtgtatcgccaccattgctctgatgattcaacgtggggtgccgggcccttttctggtttgtggcccactgagcaccctccccaactggatggccgagttcaagcggttcacaccagatattcccacaatgctgtaccacggcacccaggaggaacggcagaaattagtaaggaatatctacaaaaggaagggcaccctacagatccatccagtagtgatcacttcgtttgagatagctatgcgagacaggaatgctctccagattttgacgccttttctcctgaggagactgaagtccgacgtggccttggaagttccacccaaaagggaagttgtggtgtacgcccccttgtcaaaaaagcaagagattttttacacagcaatcgtgaatcgaaccatcgctaacatgtttgggagcagtgagaaggagactatagagctctcccctacaggtaggcccaagcgcagaacccggaagagcattaattactcaaaaatcgacgactttcctaacgagctcgagaagctgattagccagattcagccggaagtcgatagagagcgagctgtcgtggaggtcaacatccccgttgagtcagaggtcaacttaaagctccagaatataatgatgttgctgcgtaagtgttgcaatcatccctacctgatcgagtacccgatcgaccctgtaacacaagagtttaaaatcgacgaagaactggtgaccaactctggcaagtttctgattctggatcgaatgctcccggaattgaaaaagcgaggccacaaagtgttgctgttcagccaaatgactagcatgttggacatattaatggattactgccatctgcgcgattttaatttcagtcgcctagacgggagcatgtcttattcagaaagggagaaaaacatgcattctttcaataccgatcccgaagttttcatctttctggtgagtaccagagctggggggctggggatcaatcttactgcagccgacacggtcatcatatacgattcagactggaatcctcagtcggacctgcaagcccaggacagatgccacaggatcggtcagaccaaaccggtggtcgtgtaccgtctcgtcacagctaacacaatagatcagaaaatagtagagagagctgccgccaagaggaaactggagaagttgatcatacataagaaccatttcaagggaggccagtccggtctgaacctgtccaagaactttctggacccgaaggaacttatggaattactcaagtctcgcgattatgagagggaaataaagggcagtcgggaaaaggtgatcagtgacaaagatttggagctcctgctggatagatctgacctcattgatcagatgaacgcctccggcccaattaaggagaagatggggatattcaagattctggaaaacagtgaagactcttcaccagagtgcctcttctag

SEQ ID NO: 119663 - DNA, 579 bp, Artificial Sequence
  Description of Artificial Sequence: Synthetic coding sequence
atggtagaacagctggacactgccgtcatcacacccgccatgctggaggaggaggaacagctcgaagccgctggtctcgagcgcgagaggaagatgcttgaaaaggctagaatgtcatgggatagagagtccacagagataagatatcgcagactgcaacatttgctcgagaaatcgaacatttactcaaagttccttctgacaaagatggagcaacagcaactggaagaacagaagaagaaggagaaactggaacgcaagaaggagtcactcaaagtgaagaaaggaaagaattctatcgacgcgtctgaagaaaaaccagttatgaggaagaaacgcggtagagaggacgagtcgtacaatatttctgaggtgatgtctaaggaggagatcctgagtgttgctaaaaaaaataagaaggaaaacgaagatgagaattcctccagtactaatttgtgcgtggaagatttacagaaaaataaggactctaattctatcattaaagaccggttgtctgaaacggtacggcagaatactaagttcttttttgatccagtgcgtaagtgtaatgggcaatag

SEQ ID NO: 119664 - DNA, 1461 bp, Artificial Sequence
  Description of Artificial Sequence: Synthetic coding sequence
atgtggaagagtgtcgtggggcatgacgtgtccgtgtctgtggagacccagggtgacgattgggataccgatccggattttgtaaatgatattagcgaaaaggagcagcgctggggagcaaaaacaatagaaggaagcggtcggaccgaacatatcaatattcatcagctgcgcaacaaagtgagtgaggaacatgacgtcctccgcaaaaaagagatggaatctggcccaaaggcatcccacggctatggtgggcggtttggcgtggaacgcgacaggatggacaagtccgccgtgggtcacgagtatgtcgcggaagtcgagaagcatagctcacagactgatgcagcgaaaggatttggcggcaaatacggggtggagcgcgacagggctgacaagtcagctgtgggattcgattacaagggcgaagtggagaagcacactagtcagaaagattacagccgcggctttggtggaagatacggagtggaaaaagacaagtgggataaagccgccctcggatacgactataagggagagactgagaaacacgaaagccagcgagattatgctaagggctttggtggccagtacggcatccaaaaagacagagtcgataaaagtgccgtggggttcaatgaaatggaggctcctaccaccgcgtacaaaaaaaccacgcccattgaagcggcttcttccggcacaagaggcctgaaggcgaagtttgaatccatggctgaggagaaacggaagagggaggaggaagagaaagctcagcaagtcgccaggaggcagcaggagcggaaagcggtgaccaagcggagtcccgaggcaccccagccagtgatagcgatggaagaacccgccgtgccagccccccttcccaaaaagatcagttcggaagcctggccgccggtcggaaccccaccttctagcgagagcgagccggtccgcacgtccagagagcacccagtgccactgctacccatcaggcagactcttccagaagacaatgaggaaccccctgccttacccccgcgcacactcgagggtctacaggtggaggaggagcctgtctacgaagctgagccggaacccgagccagagcccgagccagagccagagaatgattacgaggacgtagaggagatggaccgacacgaacaggaggacgaaccagagggcgactacgaggaggtgctggagccagaagactcctcttttagctcagctctcgccgggtctagtggctgtccggcaggcgccggcgccggggccgtggctctcggcatctccgcggttgctgtctacgactatcagggcgagggctccgatgagctgtcattcgaccctgatgatgtcatcacggacattgagatggtggacgaagggtggtggcggggaagatgtcacggacactttggattattccccgcaaactacgtcaaactcctagagtag

SEQ ID NO: 119665 - DNA, 600 bp, Artificial Sequence
  Description of Artificial Sequence: Synthetic coding sequence
atgcccaattacaagttgacgtactttaacatgcgaggacgtgccgaaataatccgatacatctttgcctatcttgacatccaatacgaggaccaccgaatcgaacaggccgattggcccgaaatcaaaagcacactgcctttcgggaaaattcccattctggaagtagacggactgactttgcaccaaagccttgccatagcacgttatctcacgaaaaatacagacctcgccggtaataccgagatggaacaatgccacgtggacgctattgtcgatactctagatgatttcatgtcttgttttccgtgggccgaaaaaaagcaggacgttaaagagcaaatgtttaatgagttgctgacgtataatgctccccatctgatgcaggatctcgacacatatttagggggcagagagtggctgattgggaactctgtcacgtgggctgatttctattgggaaatttgtagcaccacactcctggtctttaaaccggacctccttgataaccatccacgactagtgacgctgcgaaagaaggtgcaggccattccagcagttgctaactggatcaagcgaagacctcaaactaaactctag

SEQ ID NO: 119666 - DNA, 813 bp, Artificial Sequence
  Description of Artificial Sequence: Synthetic coding sequence
atgcagtacccgcacccaggacccgctgcaggtgctgtgggtgtgcccctctacgccccaactcctctgcttcagcctgcccatcctacgcctttctatattgaagacatcctgggaaggggaccagcagcccctaccccggcacccaccctgccttcaccgaacagttcattcaccagcctcgtttccccataccgcactccagtctatgaacctactccaatacaccccgctttctcgcatcattccgcagccgctctagctgccgcttatggccctgggggctttggcgggcccttgtacccttttccacggactgtgaatgactatacacatgctctactgagacatgatccccttgggaagccactgttgtggtccccatttcttcagagacctctgcacaaacgcaaaggaggccaggtccggttcagcaatgaccaaaccatcgaactggagaagaagttcgagacacagaaatatctttctccccccgagcgtaaaagattggccaaaatgctccagctctctgagcggcaggttaagacatggttccaaaatagaagggccaagtggaggcgattaaagcaagaaaatccccaatctaataagaaagaggagctcgagagccttgattcttcctgtgaccaaagacaagacttgcctagcgaacagaataaaggggcaagcctagactcatctcagtgtagccccagccctgccagtcaggaagacctcgaatccgaaatttccgaagactccgaccaggaagtggatattgagggcgataagagctactttaatgcgggatag

SEQ ID NO: 119667 - DNA, 570 bp, Artificial Sequence
  Description of Artificial Sequence: Synthetic coding sequence
atgctaggtatgataaagaactctctttttggaagcgttgagacatggccttggcaggtcctctcaaaaggagataaagaggaagtggcctacgaagagcgagcatgcgagggcggcaagtttgctacagttgaagtgacagacaagccagtggatgaggcacttagagaagccatgcccaaagttgcgaaatacgcaggggggactaatgacaaagggataggcatggggatgaccgtgcccataagtttcgctgtgtttccaaacgaagatggctctttacagaaaaaactgaaggtctggttccgcatacctaaccagttccagtcagatcctccagcaccttcggataagagtgtcaaaatcgaggagcgtgaaggcataactgtgtattcaatgcaattcggcgggtacgctaaggaggctgactatgttgctcaggccactaggctgagagccgcactagagggtactgctacctatcggggagatatctatttttgtaccgggtacgatccgcccatgaaaccatacggtcggcgaaatgaaatttggctactgaagacctag

SEQ ID NO: 119668 - DNA, 4059 bp, Artificial Sequence
  Description of Artificial Sequence: Synthetic coding sequence
atgtcaaaagttaccgcgccgggctctggtccccccgctgccgcctccggcaaggaaaaaagatcttttagtaagcggctctttcggtccgggagggcaggcgggggcggtgctggtgggcccggcgctagtggcccggccgccccatcctcaccttcctccccatcctcggctaggagcgtggggagctttatgagccgggtgcttaagactctgtcaaccctcagccatctcagtagtgaaggggctgcacctgacagaggagggttacgatcgtgcttcccaccaggtcccgcagctgctcctacccctcccccgtgcccaccccctcctgctagcccggcaccccccgcctgtgccgctgagcccgtgccgggtgtggcgggtctgcggaatcatggtaatacgtgcttcatgaatgctacactgcaatgcttgtctaatacggaactattcgctgagtatctggcactcgggcagtatcgcgcaggccgccccgagccttctcccgacccagagcagcccgctggcagaggagcacaagggcagggcgaggtaaccgaacagcttgctcacctggtgcgcgccttgtggacgctggaatacactcctcaacattcccgagatttcaaaacaattgttagtaagaacgcactccagtacagaggcaacagccagcatgacgcgcaagaattcctcctttggctgctcgacagggttcacgaagacctgaaccacagtgtaaagcagagcggacagccacccctcaagccgccctcggaaaccgatatgatgccagagggcccttctttccctgtgtgtagtacctttgtgcaggagctgtttcaggcccagtaccggagcagcctgacctgcccacactgtcagaaacaatccaatacatttgatccgtttctttgcatatcgctgcccattccgctgccccacacaagacctctttacgtgaccgtggtatatcagggaaagtgcagccattgtatgaggatcggcgtagccgtgccactttccggcacagtggctcggctgagggaagccgtgtcaatggagacgaagatcccaaccgatcagatagttctcaccgagatgtattatgacggttttcatcgttccttctgcgacactgatgatctagaaactgtgcacgagagcgactgtattttcgcctttgagactcccgagatctttcggccagaagggatactgagccagagaggcattcatttaaacaacaacttgaaccatctcaagttcgggttagactatcatcgcctgagcagccctactcagaccgcagccaaacaggggaaaatggactctcctacctctcgagccggctcagacaagattgtgctcctggtgtgtaacagagcctgcaccggtcagcagggcaagagatttgggctacccttcgtgctgcatctggaaaagactatcgcgtgggacttgctgcagaaagagatcctcgaaaagatgaaatattttctccgccctactgtatgcattcaagtctgcccctttagtctccgggtagtgtctgttgtcgggattacatatcttttacctcaggaggaacaacctctttgccaccctatcgtcgaacgcgctcttaaatcatgtgggcctgggggcactgcacacgtaaaacttgttgtggagtgggataaggagaccagagactttttgttcgtcaacactgaggatgagtacataccggatgccgagagcgtccgtttacaacgggagcgtcaccatcaaccacagacttgcacgctcagccagtgtttccagctgtatactaaggaggaacgcctagcgcccgatgacgcctggcgatgtccacactgtaaacaactccagcaagggtccataacactctctctctggacgttgccagacgtcctgatcattcatctcaagaggttccggcaggaaggggacaggcggatgaaactacagaatatggtaaagtttcctctgacgggcttggacatgacaccccacgtcgtcaagcgctcccagtcctcttggagtctgcctagtcattggtctccctggagaaggccttatgggttagggcgagaccccgaagattatatctacgacctgtatgcagtgtgtaaccaccacggaaccatgcaaggaggtcattatactgcttattgtaagaatagcgttgacggcctgtggtattgttttgacgactccgatgttcaacagctcagcgaagatgaagtctgtacacagaccgcatatatcctgttttaccagcggaggacggccatcccgagctggtcagccaattcttcagtagccggaagcaccagtagctctctgtgcgagcactgggtgtctagattaccgggtagcaaaccagcttcagtcacgtcagcggcctcctccaggcgcacttccctggcctctctcagcgaatcagtagaaatgactggggagcgatctgaagatgacggaggcttttcaacgagacccttcgttaggtctgtgcagagacaatctctcagcagccggagtagcgtcacatctcctttggccgtaaatgaaaactgcatgcgaccctcatggagcttgagcgcaaagcttcagatgcggtccaattcaccctcgcggttttcgggcgattctcccatccattcgtcagcttcgaccctggagaaaatcggggaggcagccgacgataaggtcagcattagctgcttcggaagtctgaggaatctgtcttcgtcctatcaggaacctagcgactctcactccaggcgggagcacaaggcggttgggcgggcccctctggccgtgatggagggtgtgtttaaggatgagtccgacacaaggaggctgaacagctcagtcgttgacactcagagtaaacactcggcccagggagatcgccttccacctttgagtggcccgtttgacaacaataatcagattgcctacgtggatcagtccgacagtgtggactcttcacccgtgaaggaagtgaaagctccttcccatcctggctctctggcaaaaaagccagaaagcacaactaaaagatcacccagcagcaagggcacctctgagcctgaaaagtcgctgcgcaaggggagacccgctctggcttctcaggagtcctctctcagttcgacctccccatcctctccacttccggtaaaagtgagtctaaagccatctcggagccgcagcaaggccgacagcagctcccgcgggtccgggcgtcatagctcacccgcccctgcgcagccaaaaaaggaaagttctccaaagtcacaagattccgtttctagcccgtcccctcaaaaacagaagagtgcctccgctctgacatataccgcaagtagcacctctgccaagaaggcctccgggccagctacacggagcccattccccccagggaaatcaaggacctccgatcattctctgtcgcgggagggatccaggcagtctctgggaagcgaccgagcttcagctacctcgaccagcaagccgaactctccacgggtgtcacaggcccgcgccggagaaggtcgcggggccggaaaacacgttaggtctagctccatggccagcctccgaagtccatcaacgagcatcaagagtggcttaaagcgagatagcaagtctgaggacaagggtctgtccttttttaaaagtgctcttcgacagaaggagacccgcaggagcactgatctgggaaaaaccgctcttctgagcaaaaaagcggggggctcgtcagtgaaatctgtttgcaaaaacactggagatgatgaagcagaacgtggtcaccagccgcctgcttcgcagcaacctaacgccaatacaaccggtaaagaacaattggtaacaaaggacccggcgtccgcaaagcactcgctgctgtcagctcggaaatcgaaatccagccagctcgattccggggtacctagctcgcccgggggcaggcagtcagctgaaaaaagcagcaaaaaactgtcctcttcgatgcagactagcgctaggcctagccagaagccccagtag

SEQ ID NO: 119669 - DNA, 951 bp, Artificial Sequence
  Description of Artificial Sequence: Synthetic coding sequence
atgtcagccgaggtggagacctccgagggcgtggacgaatcggagaagaaaaactcaggggctttagagaaggagaaccagatgcggatggccgatcttagcgagctgctgaaagaagggaccaaagaggctcacgatagggcggagaacacccagtttgtgaaagactttttgaaaggtaatataaagaaggaactttttaagctggctacaactgcgttgtattttacctattctgccctggaagaggaaatggaaagaaacaaagatcaccccgctttcgcccccctctattttccaatggaacttcatcgtaaggaggccctgacaaaagatatggaatatttttttggagaaaattgggaggaacaggtgcaatgccctaaggcggcccagaagtacgtggagcgaattcactacatcggccagaatgaacccgaactgctggtcgcacacgcctatactcgctacatgggtgatctgagcggaggccaggtcctgaagaaggtggcacagcgagctttaaaactgccatccacaggtgaagggacgcagttttacctgttcgaaaacgtcgacaacgcccagcagtttaaacaactttaccgggctagaatgaatgccctcgacctgaatatgaagactaaggagagaattgttgaagaagccaacaaagcattcgagtataacatgcagattttcaatgaactggaccaggccggaagcacactggcccgggagaccttggaggatggctttcccgtgcacgatggtaagggggatatgaggaagtgcccattttatgctgccgagcaggacaaaggcgccctcgagggttcttcttgcccctttagaaccgctatggcagtgctgagaaaacctagcttgcagttcattctcgccgctggcgtcgcgcttgctgccggcctgctcgcatggtactatatgtag

SEQ ID NO: 119670 - DNA, 951 bp, Artificial Sequence
  Description of Artificial Sequence: Synthetic coding sequence
atgtcagccgaagtggaaaccagtgaaggtgttgacgagtccgaaaagaaaaacagcggggcactagaaaaggagaatcagatgagaatggctgatctctctgagctactgaaggagggtacaaaggaggcacacgaccgcgccgagaatacacagtttgtaaaggactttctaaagggcaacattaaaaaggagctgtttaaactggccaccaccgctctatattttacttattcggcgttagaggaggagatggaaaggaataaagatcaccccgcgttcgcacccctctattttcccatggagctgcatagaaaagaggcactgaccaaggatatggagtacttcttcggggaaaattgggaagaacaggtacagtgcccaaaagcagctcagaaatacgtcgaacgtattcactacattgggcaaaacgaacctgagcttttggttgcccatgcctacacccggtacatgggagacttaagtggcggccaggtattgaagaaggtcgcacagagagccctgaagctgccaagcacaggtgaggggacccagttctacctctttgagaacgttgataacgcccagcagttcaagcagctgtacagagcgcgcatgaacgccctcgaccttaacatgaagactaaggaaaggatcgttgaggaggccaacaaagccttcgagtataacatgcagatattcaacgaactcgaccaggcaggctctaccctggcgagggagacgttggaggatgggtttcccgtacatgacggaaagggtgatatgcgcaaatgccccttttatgcagctgagcaggataaaggagccctggaggggagctcctgcccttttcggactgccatggcagtcctcagaaagccctccttgcagtttatccttgcggcaggtgtggccctcgccgccgggctgcttgcttggtactatatgtag

SEQ ID NO: 119671 - DNA, 951 bp, Artificial Sequence
  Description of Artificial Sequence: Synthetic coding sequence
atgtctgcagaggtagaaacctctgagggagtggacgagtccgaaaaaaagaactcaggcgctcttgaaaaagaaaaccagatgcgtatggctgacctgagcgagttgctgaaggaggggaccaaagaagcccacgacagggcagagaatactcagtttgttaaagactttctgaaaggcaatattaagaaagagctattcaaactggcgactactgctctgtactttacctacagtgcactggaggaagagatggaacggaataaggatcacccagctttcgctcccctgtactttccgatggaactgcaccgcaaggaggccctgactaaagacatggaatacttctttggcgagaattgggaagagcaagtgcagtgccctaaagcggctcagaagtatgtggagcggattcactatatcgggcagaacgaaccagaacttctggtagctcacgcatatacacgctacatgggtgacctttccggaggccaagtcttgaaaaaagtggcccaaagggccctgaaactccccagtaccggagaaggcacccaattctacttgtttgaaaatgtggacaacgctcaacagttcaaacagttatacagggctaggatgaatgctctggatctgaatatgaagaccaaggagcggatcgttgaggaagctaacaaagctttcgagtataacatgcagatcttcaatgagctggatcaagcgggttccacgctggcacgtgaaactctggaggacggctttccagtgcacgatggcaagggtgacatgcggaagtgcccattctacgcggccgagcaggataagggcgctctggagggttctagttgccccttcaggaccgctatggcggtactacgcaaacccagcttacagtttattctcgccgccggtgtggctttggccgcaggactgctggcctggtattatatgtag

SEQ ID NO: 119672 - DNA, 951 bp, Artificial Sequence
  Description of Artificial Sequence: Synthetic coding sequence
atgtccgccgaggtggagacctctgagggggtggatgaatcagagaaaaagaattcaggagcactggagaaggagaaccaaatgcggatggccgacctgtcggagttgctgaaggaagggactaaagaagcgcatgaccgcgctgagaatacacagttcgtcaaggattttctgaaaggcaatataaaaaaagaactctttaagctggccaccactgccctctacttcacttatagcgcactagaagaggaaatggaaaggaataaagatcaccctgcatttgccccgctttattttcctatggagctacatagaaaagaggccctgacaaaagatatggagtattttttcggtgaaaactgggaggagcaggtgcagtgccctaaggctgcccagaaatacgttgagaggattcattatatcgggcagaacgaacctgaattactggttgctcatgcctatacccgttatatgggggacttgagcgggggtcaggtgcttaagaaggtggctcaacgagcactaaagcttccaagtaccggcgaaggaacgcagttctatctctttgagaatgtggacaacgcccagcagtttaaacaactctatcgggcacggatgaatgccctcgacctgaacatgaagacgaaggagcgcattgttgaggaagcaaataaggcctttgagtacaacatgcagattttcaacgagctagaccaggctgggtccacactggcacgggaaacactcgaggatggattcccagtgcatgacgggaaaggtgatatgcgtaagtgcccattctatgctgctgagcaggataagggcgctctcgagggtagcagctgtccattcagaaccgcaatggctgttctgcggaaaccttccctgcagttcatcctggcggctggcgtggctctagcggcaggattgttggcctggtattacatgtag

SEQ ID NO: 119673 - DNA, 951 bp, Artificial Sequence
  Description of Artificial Sequence: Synthetic coding sequence
atgtctgcagaagtggagacgagtgagggggtcgacgaaagtgagaagaagaactctggggccttggagaaggagaatcagatgcggatggcagacctttctgaactcctgaaggagggcactaaagaagcccatgatcgcgccgaaaatacacaatttgtgaaagatttcttgaaggggaacattaaaaaggagctcttcaagctggcgactactgcactgtatttcacctactccgctttggaagaagagatggagcgtaacaaagatcaccctgccttcgcccccctgtacttcccgatggagttacaccggaaagaagcactaaccaaagacatggaatacttttttggagaaaactgggaggagcaggtccagtgccccaaagctgcccagaagtacgtcgaaaggattcattacataggccagaacgaacccgagcttctcgtggcccacgcctacacccggtacatgggcgacctttcgggagggcaggtgctgaagaaggtggcacagcgcgcgctaaaactccctagtactggtgaaggcacccagttttacctgttcgagaacgtcgacaacgcccagcagtttaagcagctgtatagggctaggatgaatgccctggacttgaacatgaagaccaaggagagaatcgtggaggaggcgaacaaagcctttgagtacaacatgcaaatcttcaacgaattagaccaggccggtagcaccctcgctcgggagactttggaagatggctttcctgtgcatgatgggaagggggatatgcgtaagtgtccattctacgccgcggagcaggacaagggcgccctggaggggagctcttgcccctttcggactgctatggccgtgctccggaaaccatcccttcagttcattctggccgctggtgtcgctctcgcggctgggctcttggcatggtattatatgtag

SEQ ID NO: 119674 - DNA, 16908 bp, Artificial Sequence
  Description of Artificial Sequence: Synthetic coding sequence
atgatctcttgggaggtggtgcataccgtgtttctgttcgctctcctgtattccagtctagcccaggatgcctctccacagagtgaaatacgcgccgaagagattcctgaaggcgcttccacactggccttcgtcttcgacgtgactggttccatgtacgacgacctagtgcaagtgatcgaaggagctagcaaaattctcgaaacttccttgaagagaccaaagagaccattattcaatttcgctctggtgccatttcatgatcctgaaattggccctgtgacaattaccaccgatcctaagaagttccagtatgagcttagagagctctatgtacaagggggcggagactgcccagagatgtctattggagctatcaagatcgcactggaaatatctctgccagggtcattcatttatgtctttacagatgcgcggagcaaggactacagacttacccacgaggtgctgcagcttattcaacaaaagcaaagtcaagttgtctttgtgctgactggcgactgtgatgatcggacccacataggatataaggtctatgaagaaatcgctagcaccagttcaggacaggtgtttcacttagataagaaacaggtcaatgaagtccttaaatgggtggaagaggccgtccaggcttcgaaggtacacctgttgtctactgatcacctggagcaggctgtaaacacatggcgcatccccttcgacccatccctgaaggaggtcacagtttctctcagcggccctagtcctatgatcgaaatccggaaccctcttggcaaactgattaaaaagggcttcggcttacacgagctcctgaacattcacaacagcgctaaggtcgtgaatgtcaaagagcccgaggccggcatgtggacagtgaaaacctcgtcatcaggacggcacagcgtgcggattacaggcctgtccactatcgacttccgtgccggtttcagtagaaagcccactctggacttcaagaagacggtgtcaagaccggttcaagggatcccaacctacgtattattaaatacttcggggatctcgacccctgcacggattgatctgctcgagctgctatcaatttccggctccagtctgaagaccattcccgtcaaatattaccctcacagaaaaccttatggcatttggaacatcagcgatttcgtcccgcccaatgaagctttttttcttaaagtcaccggatatgacaaggacgattacctctttcagagagtgtcttccgtgtctttctcatctattgtcccagacgccccgaaggtaactatgcctgaaaagaccccgggatactacctccagcctgggcaaattccttgtagtgtggatagtctccttcctttcactctgtcctttgtccgcaatggcgtaacactgggcgttgaccagtatctgaaagaatccgcctctgtcaatttagatattgccaaggtgactttgagtgatgagggcttctatgagtgcattgcagtctccagcgccggcaccggtagagcacaaactttcttcgacgtatccgaaccaccccctgtcatacaggtgcctaacaatgttacagtgaccccgggcgaaagggctgtgcttacctgcctcattattagcgctgtggattacaacctaacatggcagagaaacgatagggacgtgcggcttgctgagccagcccgcattcggaccctggctaatttatccctggagttgaagtcggtaaagtttaatgatgccggggagtaccactgcatggttagttctgaaggtggatctagcgctgcctctgtcttccttactgttcaggaaccacctaaggtgaccgtgatgccgaaaaaccagtccttcacgggtggtagcgaggtgtcaattatgtgttccgctacaggatatccaaagcccaaaattgcgtggaccgtgaatgatatgttcatcgtcggttcacatagataccgaatgacttccgacggcactctattcatcaagaatgctgcccctaaagatgcggggatctacgggtgcctcgcttccaattctgcaggaacagacaaacagaacagcacacttcgctatattgaggcacctaagctcatggtggttcagtccgagctgctcgtcgctctaggagacataaccgtaatggaatgtaaaacctctggtataccccctcctcaggtgaagtggtttaagggcgacttagaacttaggccaagcaccttcctgattatcgacccgctccttggacttctaaagatccaggagacccaggatctggatgctggtgactatacatgcgtggccataaatgaagccggacgggctacgggtaaaatcactttagacgtgggatccccccccgtgtttatccaagagcctgctgacgtcagcatggagatcgggagtaatgtgaccctcccatgttacgtccagggatatcctgagcctactattaagtggcggcgactggataacatgcctatcttcagcagacctttttctgttagctctatttcacagctccgcacaggcgctctgtttattctaaacctctgggcatccgataagggtacttatatctgcgaggccgaaaaccagtttggtaagatccaaagcgaaactacagtgacggtaacagggctggtggcccccctgatcggaatatcaccttcagttgcgaacgtcatagaaggccagcagttgaccctgccttgtaccctactggctgggaaccccatccctgagcgccggtggattaagaacagcgctatgctgctccagaatccatatataaccgttcgcagcgacggaagtctacatattgaaagagtgcagctgcaggatggcggcgaatatacttgtgtcgcctctaacgtcgccgggaccaacaataagaccacgtccgtggtcgtgcatgtgttgcccaccatccaacatggacagcagatcctgtctaccatcgagggaatcccagtgactctgccctgtaaggctagcggaaaccctaagccatctgtaatatggtcaaagaaaggtgagctcatatcaacctcctcagccaagttctccgccggagcagatgggtccttatatgtggtgtcaccgggaggagaagaaagcggggaatatgtgtgtaccgctactaacactgccggttatgccaagagaaaagtgcagctgactgtctatgtgagaccccgcgtctttggcgatcaaagggggctgtcgcaggataagccagtagagatttcagtacttgctggggaggaggttacactgccttgtgaggtgaagtccctgcctcctcccatcattacttgggccaaagagacccagttgatttctcctttttcaccacgacatacctttctgccaagcggttccatgaagatcactgaaacaagaactagcgactccggtatgtatctgtgtgtcgcaactaacattgccgggaacgtgacacaggccgtcaagttaaatgtgcatgttccccctaagatccagagggggccgaagcacctgaaggtccaggtcggccagcgtgttgatattccctgtaacgcccagggaactccccttccagtaattacctggtccaaaggaggttctactatgctggtcgatggagaacatcatgtgtccaaccctgacggtactctcagcatagaccaggcaacccctagcgatgctggcatctatacatgtgttgccaccaacattgccggcacggacgaaacagagataaccttgcacgtgcaagaaccgcctacagtcgaagaccttgaaccaccctacaatacaacctttcaagaaagggtggccaaccagaggatcgaattcccttgccctgcgaaagggacaccaaagcccaccattaaatggctgcacaatggtagagaactgaccggtagggaaccgggcattagtatccttgaggatgggacactcctcgtgattgccagcgtgactccatacgacaatggcgaatatatttgcgtggccgtcaacgaggctgggaccaccgaacggaagtataatttgaaggttcatgtgcccccagttatcaaggataaagaacaagtgacgaatgttagcgtgctcctgaatcaactgacaaaccttttctgtgaagttgaggggactccaagtcccatcatcatgtggtataaggacaacgtgcaggtgaccgaatccagcaccatccagaccgtaaataacggaaagatactgaagctgtttagggccacccccgaggatgcaggaagatactcttgcaaggcaattaatatcgcaggaacctctcaaaagtatttcaacattgacgtcctcgtgcctcccactatcatcgggactaacttcccaaatgaagtgtcagtagtcctcaatagggatgtcgctctggaatgccaggtcaagggtactccgttcccagatatccattggtttaaggatggtaaacctctattccttggcgaccctaacgtagagctgctagacaggggacaggttttgcacctcaagaacgcaagacgaaacgataagggccggtatcagtgtacagtcagtaatgcagctggtaagcaggccaaggatatcaagctcaccatctacattccgccttctatcaaaggtggtaacgtaaccactgacatcagcgtccttattaactctctgatcaaactggagtgtgagacacgcggactccccatgccagctatcacctggtacaaggacgggcagcccatcatgagttcctctcaggccttgtacattgataaagggcagtatctgcatatcccccgcgcacaggtgtctgattcggccacatacacttgtcatgtggcaaatgtagccggcacggctgagaagtcattccatgtggacgtgtatgttcctcccatgatcgagggaaatcttgccacgcccttgaataaacaagtagttatagctcattccttgacgcttgagtgcaaggcggctgggaacccttctcctattctcacatggttgaaggatggagttcccgttaaggcgaacgacaatataagaattgaagctggaggaaagaagctggagatcatgtctgcccaagagatagatcgggggcaatacatctgtgttgccacctctgtagccggcgaaaaggaaattaaatatgaagtcgatgttctcgtcccccccgctatcgaggggggggacgaaactagctactttatcgtaatggtcaacaacctgctcgaactggattgtcatgtaactggctccccacccccgaccatcatgtggctgaaagacggtcagctgatcgacgaacgggacgggttcaagatcttgttgaatggacggaagctcgttattgcgcaagctcaagtgagcaatacaggcctgtaccgatgtatggctgctaacactgccggagatcataaaaaggaattcgaggttacagtgcacgtgcctcctactattaagtcttccggtttgtccgagagggtggttgtaaagtacaaacctgtggcactgcagtgcatcgctaatggaatccctaacccttctatcacttggctgaaagacgatcaacccgtgaacaccgcacagggaaacctgaagatccagtctagcgggcgtgtcctgcaaatcgcgaaaacattgttagaggacgccgggcggtacacttgcgtagccacaaatgctgctggggagacacaacagcacattcaactgcacgtccatgagccaccctctttggaagacgccggcaagatgctgaacgaaacagtcctcgtctccaaccctgtgcagctagaatgcaaggctgctggcaaccctgtgccggtcatcacttggtacaaggacaataggctcttgagcggatccacttctatgacctttctgaatagagggcagattatcgatattgaatccgcacaaatttctgatgccggcatttataagtgtgtcgctataaacagcgctggcgctactgaactgttctactctcttcaggtacacgtcgcacctagcatttccggctctaataacatggtagctgtggttgtcaacaacccggtgaggcttgagtgcgaagccagaggcatccctgccccgtctcttacttggttgaaggacggttcccccgtgtctagtttctctaacggtctccaagtgctttccggcggcagaatcttggcactgacatccgcacagatcagcgacaccgggagatacacatgtgtggcagtgaatgccgccggtgagaaacagcgggatatcgacttgagagtgtacgtcccaccaaatattatgggcgaagaacagaatgtatccgtgctgatcagtcaggcggttgagctcctgtgtcagagtgacgctatcccaccccccaccctgacttggctgaaggacggtcacccactactcaagaagccgggactcagcatatccgagaacagatctgtgctgaaaatagaggatgctcaggtgcaagatactggcaggtatacctgtgaggctacgaatgttgcgggaaagaccgagaagaattacaacgtcaatatctgggttccgcccaacattggaggctccgacgagctgacgcaactgacagtaattgagggcaacttaatttccctgctgtgtgaatcctccgggatcccgccccccaacctgatctggaagaagaaagggtctcctgtgctcaccgactctatgggtagggttagaatcctatccgggggcagacaactgcaaatctccatcgcggagaagagcgacgccgccctgtactcctgcgttgccagcaacgtagcaggcaccgccaagaaagagtataacttacaagtctatattcgaccgaccatcacaaatagcggaagccacccaacagaaattattgtgacgagaggcaaatccatttcactggagtgtgaagtgcagggtatcccaccaccaactgtgacgtggatgaaggatggccatccattgatcaaagctaagggggtcgagattttggacgagggccacattctgcagctgaaaaacattcacgtctccgacactggccgatatgtttgcgtggcagtgaacgtggcggggatgactgacaagaagtatgatctcagcgtccatgccccacctagcataatcggcaatcacaggtctccagaaaacatctccgtcgtagagaaaaattctgtttctttaacttgtgaggccagcggcattccgttacctagtattacgtggtttaaggatgggtggcctgtctcactttcgaattccgtacgtatcctcagtgggggaagaatgttgcgtctgatgcagaccactatggaggatgccggacaatatacatgcgtggtcagaaatgccgccggggaggagcgcaagatttttggactgtccgtcctagtccctcctcatatcgtgggcgaaaacactcttgaagatgtgaaagtgaaagaaaagcagagcgtgacgcttacgtgtgaggttactggcaatccagtccctgaaatcacatggcataaagacgggcaacctctccaggaggatgaagcccatcacattattagcggtggacggtttctgcaaataaccaacgtacaagtcccccatactggacggtatacctgcctggcctcatcccccgcggggcacaagtcaagaagcttctcgctgaacgtcttcgtgtctcccactattgcaggggtgggctcagacggcaatccagaagacgtgaccgtgatcctgaactctccaacatcgctggtctgcgaggcctattcttacccacctgccactattacctggttcaaagacggtacccccctcgaatctaaccgcaacatccgtatactcccagggggaagaacactgcagatcttgaacgcgcaggaggataatgcgggtcgatactcttgcgttgccactaatgaagccggcgaaatgattaagcactatgaggtgaaggtttatatacctcccattattaacaagggagacctatggggtcctgggttaagtccaaaagaagtcaaaataaaggtcaacaataccctcactctggaatgcgaagcttatgccattccatccgccagcctgagctggtacaaggacggccagccacttaagagcgacgaccacgtgaatattgctgccaatggtcataccctccagatcaaggaggcacagatatctgacactggcagatacacttgcgtcgcaagtaatatcgctggggaggacgagcttgatttcgatgtcaatatacaggtcccaccatcctttcagaaactgtgggagattggaaacatgttggatacgggcagaaatggggaggcaaaagacgttattatcaacaatccaatatctttatattgcgaaactaacgccgcaccgccacctaccctgacctggtataaggacgggcacccactaacatccagtgacaaagttctgatattacctggaggcagggtcctccagattcctcgtgccaaggtggaggacgccgggagatatacctgcgtggctgtgaacgaagccggagaagattctctccagtatgacgtacgtgtcttagtccccccaattataaaaggcgctaattctgatctgccagaagaggtgactgtactggtgaacaagtctgctctcatagagtgcttgagcagcggctccccggctcccaggaacagctggcaaaaggacgggcagcccctcctggaggatgaccaccacaaatttctgagtaatggacgaatcctgcaaatcctgaatacccaaattacagacatcggccgctatgtctgcgtagccgagaacactgctgggtctgctaaaaaatactttaatctaaacgtgcatgtgcctccctctgtaattgggccaaagtccgagaacctcaccgtggtggtgaacaattttatttcactgacttgcgaggtctctggtttcccacctcccgatctgtcgtggcttaagaatgagcaacctataaaacttaatacaaacacactgatagtcccagggggccggactctccagattatcagagcaaaggtgtcagacgggggcgaatacacctgcattgctatcaatcaggccggcgagtctaaaaagaaattctcattaacagtttatgtgcccccttcgatcaaagatcacgacagcgaatccctgagcgtggtaaacgtgcgagaaggcaccagtgtgtccctggagtgtgaatccaacgctgtgcctcctccagttatcacatggtacaaaaacggaaggatgatcaccgaaagcactcatgttgaaatcttggcggatggtcaaatgttgcacatcaagaaggccgaggtatcagacactggccagtacgtttgccgagccattaacgttgcaggccgagacgataaaaattttcatcttaacgtgtacgtgcccccatctatcgaaggccccgagcgcgaggtgattgtggaaaccatctctaatccagttactctgacctgcgatgctaccggaatcccacccccaacaatcgcttggctaaaaaaccataagaggattgaaaatagtgattcactggaggtcagaattctttctggaggttcaaagctccagatcgcaaggtctcagcactcggattccgggaactacacctgcatcgcatctaacatggagggaaaagcccaaaagtactactttctctcaatccaggtgcctcccagcgtggcaggggcagaaatcccctctgatgtaagcgtgctgctaggcgaaaacgtggagttagtgtgcaacgcaaacggcatccctaccccgttaatccagtggctgaaggatggaaaaccgatcgcctcaggcgagaccgaacggattagggtgagcgctaacgggtcaacccttaacatttacggtgcccttacatctgacacagggaagtacacttgtgtcgctacaaatcctgccggagaagaggatcggatctttaaccttaatgtgtacgtcacccctaccatcaggggcaacaaggacgaagcagagaaattgatgaccctggttgatacgtccattaatattgagtgcagggccactggaactccacccccgcagatcaattggctgaagaatgggcttccactgcccttgtcttcccatatcagactcctggctgctggccaggttatccgaattgtacgggcccaggtttccgatgtcgctgtgtatacctgcgtggctagtaatcgcgccggcgtggacaacaagcattacaatttacaggtgttcgccccacccaatatggacaactctatgggtactgaggagatcaccgttttgaaaggctccagcacaagtatggcttgtatcaccgatggaactccagcaccatccatggcatggttgagagatggccagccgctaggcttagacgcccatctcacggtgagcacccacggtatggtcttacaactgctgaaggccgaaacagaggactcgggtaaatacacatgcatcgcaagcaacgaggccggtgaagtgagtaagcatttcatcctaaaagtgcttgaaccaccccacattaatggcagcgaagaacatgaggaaatatctgtgatagtgaataacccactggagctcacctgcattgcctctggtataccagctccaaagatgacctggatgaaagacgggaggcctctgccccaaaccgatcaggttcagactctgggaggaggcgaagtactgagaatatctaccgctcaggttgaagacaccgggagatacacttgccttgccagcagcccggctggagacgatgataaagagtacctcgtgagggtgcatgtgccgcccaatatcgccggcaccgatgaacccagggacatcaccgtattacggaacaggcaggtgacgctcgagtgcaaatctgacgccgtaccaccccccgtaattacttggctccgtaacggcgagcggcttcaggccactcctagagttcgcattctaagcggagggagatatctccagataaacaacgcggacctcggtgacactgctaattacacttgtgtcgcttcaaacattgcgggtaagaccacacgcgaattcatcctgaccgtgaatgtccccccaaacatcaagggtgggcctcaaagcctggtgattctcctaaataagtctacagtcctggaatgtatagcagagggcgtcccaacaccccggattacatggcggaaagatggcgctgtgctggcaggcaatcacgcacggtattctattcttgagaacggatttctccatattcagagcgcccacgttacagacactggtcgctatctctgtatggccaccaacgcagctggcactgatcggcggcggatcgatctacaggtgcatgtgccaccgagtatagccccagggccaaccaatatgactgtaattgtgaacgtccagactaccctggcctgcgaggccaccgggattcccaagcctagcattaactggcgaaagaatgggcacctgctcaacgtcgaccagaaccaaaactcgtaccgactgctttcctctggttctttagtcattatttctccatctgtcgacgatactgcaacttatgaatgtactgtcacaaacggcgccggggacgataaacggactgtggatctgacagtgcaggtccctccgtccattgccgacgaaccaaccgactttctagtaacaaagcacgcaccagccgtgatcacatgtacagcttcaggggtaccctttccgtccatccattggaccaaaaacggaatcagactcctgccacgtggagacggttaccgtatcctctcctcaggtgccatcgaaatcctggccacccagctgaaccacgcaggtagatatacctgtgtcgctcggaatgctgctggtagtgcacaccggcacgtgactttacatgtgcatgagccacccgtgatccagcctcagccctcggaactgcacgttatcctgaacaacccaattctgctgccctgtgaggctacagggaccccatcaccatttattacatggcagaaggagggaatcaatgtaaacacttctggacgaaaccacgcggtgctgccgtcaggcgggctccagatatcccgagccgttcgcgaagacgccggcacgtatatgtgcgtggctcagaatccagccggtacagccctgggtaaaattaaattgaatgttcaggtcccccccgtcatttccccacacttgaaagagtatgtgatagcggtggataagccgatcactctctcttgtgaggcagatggactgcctcccccagacataacttggcacaaagacggcagagccattgtcgaatcaattcgccagcgcgtgctctccagcgggtcattgcaaatcgccttcgttcaacccggtgatgcgggtcactatacctgtatggctgccaacgtggcaggctcctcatctacctccaccaagctcactgtgcacgtgccgccccggataaggtctaccgaggggcattataccgtgaacgaaaacagccaggccattctgccatgcgtggccgacgggatccctactccagccattaactggaagaaagataacgtgctactggctaatttgctaggtaaatacacagccgagccatatggggagctgatcctcgagaatgtggttctggaagactcaggcttttatacctgtgtagccaacaatgccgcaggagaggacacgcatacagtttcactgactgtgcatgtgctgcccacattcacagagctgcctggcgatgtgtccttgaataagggagagcagctaaggttaagctgtaaggccacaggtatcccattgcccaagctgacttggacattcaacaataatattatccctgcccactttgatagcgttaacgggcacagtgaactggttattgaacgtgtgtcaaaggaggactccggtacctacgtgtgcaccgccgagaacagtgtcgggtttgtcaaagccatagggtttgtgtatgtcaaggagccgcccgtgtttaagggagactatccttccaactggatcgaacctctggggggcaatgctatactgaactgcgaagttaaaggcgaccccacccccacaatccagtggaaccggaaaggagtcgatatcgaaatcagccatcgcattaggcagttgggtaatggatctcttgctatatatggtacagtgaatgaagatgctggtgattatacctgcgtggcgactaacgaggcaggcgtggtcgaaaggagcatgtccctaactctacaaagtccccccattatcactcttgagccagtggaaacggtcatcaatgccggcggaaagatcatattgaactgccaggcaaccggcgagccccaacctaccattacctggtctcgtcagggacacagcatcagttgggatgatagagtaaacgtgctgtcaaacaactcactgtatattgccgacgctcagaaggaagataccagtgaattcgagtgcgtcgctagaaatttaatggggagtgttctcgtccgtgtcccagtaatagtgcaggtgcatggcggcttttcccagtggtcagcttggcgcgcttgtagtgtaacatgcgggaagggtattcagaagaggagcaggctgtgcaatcagccactgccggcaaacggggggaagccctgccaaggatccgacctggagatgcgcaactgccagaacaagccgtgccctgtggatggatcatggtccgagtggagtctgtgggaggagtgcactagaagctgtggtaggggaaatcagacgagaacaagaacctgcaacaacccctctgtccagcacggcggccgcccttgtgaagggaatgcagtggagattatcatgtgtaacattaggccatgccctgtccatggcgcttggtctgcatggcagccttggggaacttgcagtgagtcttgtggcaagggcacacagaccagggctaggctatgtaacaacccgcctcctgccttcggaggttcttattgtgatggcgccgagacacagatgcaggtgtgtaatgagcggaactgtccaattcatgggaagtgggccacatgggctagctggagtgcctgcagtgtgtcatgcggcggcggcgcccgtcagagaacccgaggctgcagcgacccggttccgcaatatggaggccgcaaatgtgagggtagtgatgtccagtccgacttctgcaatagtgatccctgtcctacgcacgggaattggtctccctggtccggatgggggacctgttcacggacctgcaacggaggtcagatgcggaggtacagaacgtgcgacaacccccctccctccaacggcggcagggcctgcgggggcccagactcccagatccagcgatgcaatacagatatgtgtcccgtcgatgggtcatgggggtcttggcattcttggtctcagtgctcggctagctgcggaggaggagagaagactcggaagagattgtgtgaccatcctgtgcctgtaaaaggtggccgaccctgccccggcgacacaacccaggtgacccgatgcaacgtacaggcatgtccaggaggacctcagcgcgcccggggaagcgtcattggcaacattaacgatgttgagttcgggatcgcctttcttaacgcgacgattaccgattcccctaattctgacacccgcatcattcgggcaaagattacaaatgttccgcgttctctggggtcagcgatgaggaagatcgtgagcatcctgaacccaatctactggacaacagccaaggagattggcgaagccgttaatggctttacactaacgaatgccgtattcaagagagaaacgcaagtggagttcgctacaggcgaaattttgcaaatgtctcacatcgccagggggctggattctgacggatctctgctgctggacattgtcgtatcagggtatgtccttcaactacagtcgcccgcggaagtgacagtgaaggactatacggaagattacattcagaccgggccaggtcagctatacgcatactcaactaggttgtttactatcgatggaatctcgatcccctacacttggaatcacactgtcttttacgaccaggcacagggtcggatgccctttctggtggagaccctgcatgcaagttccgttgagtccgactataatcagattgaagaaactttaggttttaagattcacgcatcgattagtaaaggagaccggagcaaccagtgcccatcaggatttacgcttgactccgtgggccccttctgcgccgatgaagatgagtgcgccgcaggcaacccttgctctcactcctgtcacaatgcaatgggaacttattactgctcctgtcccaaaggactgactattgccgccgatggtcggacatgtcaggacatcgatgagtgcgctctgggccgccacacgtgtcatgctggacaggattgcgacaacaccattggcagctaccgatgtgtggtgcgctgtgggtctggctttcggaggacctccgatgggctgagctgtcaggacatcaatgaatgccaggaatcaagtccctgtcaccagaggtgcttcaacgccattggctccttccactgcgggtgcgaaccaggttatcaattgaaaggtcgcaaatgtatggacgtcaacgaatgcagacagaacgtgtgtcgccccgatcaacactgcaaaaacacccgtggaggctacaaatgtatcgatctgtgtccaaatgggatgaccaaagcggagaacggtacatgcatcgacatagatgaatgcaaagacggtactcaccagtgtcggtacaaccagatatgcgagaatacaagagggtcataccgatgtgtctgccctcgtggctacaggtcccagggggttggtcgcccttgcatggacataaatgagtgtgagcaagttcctaaaccctgcgcccaccagtgctcgaatactccgggatcgtttaagtgcatctgtcccccaggacagcacctcctgggcgatggtaagtcctgcgcaggcctggagaggttgccaaattatggaacacagtacagcagttataacctcgcccgcttctccccagtccggaataactatcaaccccagcaacactaccgacagtactctcacctgtattcctcctacagtgagtatcgaaacagtagaaccagcctatcccgcactcgcaggaccatacgcaagacttgccccgagggctccgaagcttcacatgacacctgtgttgacatagacgaatgcgagaacaccgacgcctgccagcacgagtgtaaaaatactttcggtagctatcagtgtatttgcccccccggctaccaactaacccacaatggcaaaacttgccaggacatagatgagtgtctggaacagaatgtccactgcggcccgaatagaatgtgctttaacatgcgcggcagctaccagtgtatagataccccatgcccacctaactatcagcgggacccagtgagtgggttttgcctcaaaaactgtcctcccaacgacctggaatgcgctctaagtccatatgcactagagtacaagctggtgtctctgcctttcgggattgccacgaatcaggacctgatccgactagtggcatacacccaagatggcgtcatgcatccacgtactacctttctgatggtggacgaagaacagaccgtgccttttgcattacgggacgaaaatctcaagggtgtggtgtacactacacgcccgctgcgcgaggcagagacctacaggatgcgggtacgcgcttcgtcctactcagccaacggtactattgaataccagaccactttcatcgtgtatatcgccgtgtctgcttacccctattag

SEQ ID NO: 119675 - DNA, 16557 bp, Artificial Sequence
  Description of Artificial Sequence: Synthetic coding sequence
atgatctcctgggaggtcgtgcacacagttttcttgttcgcattactgtattcaagtctcgcacaggatgcgtcaccacaaagtgaaatacgggccgaggaaataccagagggcgcttccaccctggccttcgtcttcgatgtgacaggttccatgtatgatgatctcgtgcaggtaatcgagggcgcatctaagattctggaaacgagcttgaagaggccaaagaggcccttgtttaacttcgctctggtgccattccatgatcccgaaattggccctgtgacaattaccacggatcctaagaaatttcaatacgaactgagggagctgtatgtgcaagggggaggggactgccccgaaatgtccattggggccatcaagatagcactcgagatttccctgcctggttccttcatttacgtgtttaccgacgcccgaagtaaggactataggctaactcacgaggtgctgcaactcatccagcagaagcagtcacaggtcgtgtttgttcttactggagactgtgatgatcggacacacatcggttacaaagtgtatgaagaaatcgccagcaccagctccgggcaggttttccacctggataagaaacaggtgaacgaggtcttaaaatgggtggaggaagcagtgcaagcttctaaagtgcatctcctctccacagatcatctggagcaggccgttaacacatggagaatccctttcgatccttccctgaaggaggtcacagtctccctgtccggcccgagtcctatgattgaaatccgtaatcccctaggaaaattaatcaaaaaggggtttgggcttcatgaattgctgaatattcacaattcagctaaggtggtcaacgttaaagagccagaagcaggtatgtggacagtgaagacctcgagctcaggccgtcatagcgttcgcatcacaggtctgagcactatcgatttcagggcagggttcagccggaaacccaccttagactttaagaaaacagtcagccgtcctgtgcaaggaatcccaacatacgtcctgctgaacacatctggcatttccactcctgctcgcatcgacttgttggaacttctgagcatctcggggtccagtctaaagaccattcccgtcaagtactaccctcatcgcaagccctacggcatctggaatatcagcgatttcgtgccaccaaatgaggccttcttcctgaaggtcaccgggtacgacaaggatgattaccttttccagagagtgtcctcagttagcttttccagcatagtgcccgacgcccccaaggtcacaatgcctgaaaaaacacctgggtattatttgcagccaggccagatcccttgttcggtggactccctgctgccttttactttatcctttgtgaggaacggggtgaccctgggggtggatcagtatctaaaagaaagcgcctcggtgaaccttgacatagctaaggtgacactcagtgacgagggcttctacgaatgcattgccgtgtcatccgcaggaaccggccgagcccaaacgtttttcgacgtttctgaaccgcctcccgtgatccaggtgcccaataatgtgaccgtgacacctggagagcgagcagtcctgacttgcttgatcatatcggccgtcgactacaatctcacctggcagaggaacgaccgcgatgtcaggctggcggaaccagcccgcatacggacactcgcaaatctgagcctggagctgaagagtgtgaagttcaacgacgccggcgagtaccactgcatggtgagttccgaaggagggtcctcagccgctagtgtgttccttacagttcaggaaccacccaaagtcactgtgatgcctaagaaccagtccttcactggtggctctgaggtgagtataatgtgctctgctacagggtatcctaagcccaagatcgcgtggacagtgaatgacatgttcatcgtgggatctcaccgatatcgtatgacatctgacggcactctatttatcaagaatgctgcgccaaaggacgccggaatctatggctgtctcgcctccaactccgccggcacagacaaacagaacagcaccctgcggtatattgaagcccccaagctgatggtggtgcagagcgagctgctcgtagccttgggagacatcacggttatggagtgcaaaactagcgggatcccacctcctcaagttaagtggttcaaaggcgatctggagctgcgcccctctacattcctgatcatcgatcccctactgggactgcttaaaattcaggagacacaggacctcgatgcaggagactacacttgcgtggctattaatgaagcgggcagagcgacaggaaagattactttggacgtcggcagtccgcccgtgtttatccaagaacctgccgacgtgtctatggagatcggaagtaacgtgactctgccctgctacgtgcagggttatcctgagccaactatcaaatggcggcgactagataacatgccgattttttcacggcctttttccgtgtcaagtatatcccagttaaggactggcgctctttttattctcaatctctgggccagtgacaaagggacttatatctgtgaggccgagaaccaatttggcaagattcagagcgaaacaacagtgaccgtcaccgggttagtggcacccttgatcggtatatcaccatccgtggcgaatgttattgaaggtcagcagctgacacttccctgtaccctgctcgccggtaatccaattccagagcgcaggtggatcaagaattcagctatgctcctgcaaaacccctatattacagttaggtccgacggctctctccacatagaacgggtgcagttgcaggacggaggcgaatacacatgcgtggcgtccaacgtggccggcacaaataataaaaccacttctgtagttgtccatgtgctcccaactatccagcatgggcagcaaatattgagtacgatcgaaggcatccctgtgacccttccgtgtaaagcctctggcaaccccaagccttctgtgatctggtccaagaagggcgaactaatcagcacctcgtccgccaagttcagtgccggggcagatggttcgctctacgtcgtgtcaccaggcggggaggaatctggtgagtacgtctgcactgcaaccaacacagccgggtatgctaaacgcaaagtgcagctgacggtctacgtccggcctcgagtgtttggggaccagagaggcctcagccaagataagcccgtggaaatttccgtcctagcaggggaagaagtgactttgccgtgcgaagtgaagtctctcccgccacccattattacttgggctaaagagacgcagctcatcagcccctttagtccacggcatacctttctgcctagcggtagcatgaaaatcaccgaaactcggactagtgactcaggaatgtacttatgcgtcgctaccaacatcgctggcaacgtgacacaggccgtgaagctgaatgtgcacgtgcccccaaagattcagcggggccctaagcatttgaaagtgcaagtgggccaaagggttgacataccttgcaatgctcagggcactcctcttccagtgattacatggtcaaaagggggatccacgatgctggtcgacggtgagcatcatgtgtcaaatcccgacgggacacttagcattgaccaagcaaccccaagcgacgcgggtatctacacctgtgtggctaccaatattgcaggaactgatgagaccgaaattactttgcacgttcaagagccccccactgtagaggacctggaacctccatacaatactacatttcaagagcgcgttgccaaccagaggattgaatttccttgtcctgcaaaaggcactccaaaaccgaccatcaagtggctgcacaacggcagagaactgaccggccgcgagcctggcatctccattctcgaagacggcaccctcctggtaatagcaagcgttaccccctacgataacggtgaatacatttgtgtggccgtgaacgaggctggtaccactgagagaaaatacaacttgaaggtccatgtgccccctgtcatcaaggacaaggaacaggtcactaatgtgtcagtgctgctcaaccagcttactaatctcttttgtgaggtagagggaacaccatcacccattataatgtggtacaaggacaacgtgcaggtgacggagagctcaaccatccaaaccgtgaacaacgggaaaatcctgaaactatttcgggccaccccagaagatgccggcaggtactcatgtaaagccatcaacatagcggggactagccagaaatactttaatattgacgtactcgtcccaccgaccatcataggcaccaatttcccaaatgaagtgtcagtcgtcttgaacagggatgtggccctggaatgccaagtgaagggcacaccattccccgacatccactggtttaaggatggaaagcctttattcctgggcgacccgaatgtcgaattgctggatcgcgggcaggtacttcaccttaagaacgcccgccgcaacgacaaaggtcgctatcaatgtaccgtgtcgaacgccgctggtaagcaggccaaggatatcaagctcacaatttatattcccccctccatcaaaggcggtaacgtgaccactgacataagtgtgttaattaactcgctcataaaactggagtgcgagaccagaggtcttccaatgcctgcaatcacctggtataaagacggacagcctattatgagttcttcccaggcactctacatagacaagggccagtacctccacatccccagagcccaggtttccgacagtgccacctatacctgtcatgttgccaatgtggctggcacggccgagaagagctttcatgtggatgtttatgtccctccgatgattgagggcaacctggccacccccttaaacaagcaggtggtgattgcacactctttgaccttggagtgtaaagctgctggcaacccctctccaattctcacatggcttaaggacggcgtccctgtcaaagccaacgacaatattaggattgaggccggcggcaaaaaattggagatcatgagtgcacaggagatagatcgcggacaatatatatgcgttgccacttcggtcgcaggtgagaaagagatcaaatatgaggtcgatgtccttgttccacctgctattgaaggcggcgatgagaccagttacttcattgtcatggtgaacaatctgctggagctcgattgtcacgtgaccggctccccccctcccaccattatgtggctgaaggatggacagcttattgatgaacgcgatgggttcaagatcctgcttaacggcagaaaactcgtcatcgcccaggcccaggtgagtaatacaggcctgtacaggtgtatggccgccaatactgcaggagatcacaagaaagagttcgaagtgaccgtccacgttcccccaactattaagagctccgggctgtccgaaagagtggtggtcaaatacaaaccagtcgccctccagtgtattgccaacggtatccctaaccccagcattacatggctgaaagacgaccagcccgtgaacactgcacaaggaaatctgaaaatccaaagctcagggcgcgttctgcagatcgctaaaaccttgttagaggatgccggacgatatacatgtgtagcaacaaacgcagcaggcgagacacaacagcacatacagctccacgtacacgagccccccagccttgaggatgccggcaaaatgctgaatgagaccgtgctagtgtcgaaccctgtgcagctggaatgcaaagctgccggtaatccggtgcctgtgatcacctggtataaggataatcgactgttatccggctccacttccatgacttttctaaatcggggccaaattatcgacattgagtccgcacagatcagtgatgcaggcatttataagtgtgtcgccataaactctgcaggcgctacagagctcttttactccctgcaagttcatgtggccccaagtatctctggctcaaataatatggtcgctgttgtggtgaacaacccagttcggctagaatgtgaagctcggggcattcctgctccaagtttaacctggttgaaggacggcagccccgtttcttccttttctaacggcctccaggtgcttagcggcggtagaatactcgccctcacatctgctcagatcagcgacacgggccggtatacctgcgtggcagtgaacgcagccggcgagaaacagagggatatcgatctacgagtctacgttccccctaatatcatgggagaagagcaaaatgtgtctgtcttgatttctcaggcggttgaactgctctgccagagtgacgcaataccccctccgaccctgacctggcttaaagacggccatcccctgctcaagaagccaggcctgtcaattagtgagaatcgcagtgtgctcaagattgaggacgcccaagttcaagacacaggccgatatacatgcgaagcaaccaatgtggcaggcaagaccgaaaaaaattataacgttaacatctgggtacctcccaacatcggcgggtctgacgagttgacacagttaacagtgattgaaggcaatctgatttcactgctatgtgagtcatctgggataccccctccaaatctcatatggaagaagaaaggctccccggtgctgaccgatagtatggggcgagtgcggattctctccgggggccggcagttgcagatctcgatcgccgaaaagtcagacgcggctctttacagctgtgttgcttccaacgtggcgggaacagctaaaaaggagtataacctccaggtgtacatccgacctaccataacaaacagcggcagccaccctactgaaatcatcgtgactagggggaagtccattagcctggagtgtgaggtgcagggcatccctccccccacagtgacttggatgaaagacggacatccccttattaaggcaaagggtgtcgagattctggatgagggacacatcttgcagctgaaaaatattcacgtgagcgacacaggtcgctatgtgtgcgtcgccgtgaatgtggcaggaatgacagataagaagtatgatctgagcgtacacgcgccaccttcgatcattggcaaccacaggtcccccgagaacattagtgttgtggagaagaattctgtctcattgacctgcgaggccagcggcatcccactcccttccattacctggtttaaggatggctggccagtcagcctttcaaacagcgtcaggattctgtctggcggccgcatgttgagactgatgcaaaccacgatggaggatgccggacagtatacctgtgtagtccgcaatgctgctggtgaggagcggaagatctttggcctctcagttttagtgcctccgcacattgtgggcgaaaatacgctggaagacgtgaaggtcaaggagaaacagagcgtgacactgacttgcgaggtgaccgggaatcctgtgcctgagatcacctggcataaggatggacagccactccaagaggatgaggcccaccacatcatctcagggggccgattccttcaaataacgaatgttcaggttcctcatactgggagatatacatgcctggcttccagcccggccggtcataagtcaagatctttttctttgaacgtgttcgtgagccctacaattgcaggagtgggcagtgatggcaatcccgaagacgtcactgtaattcttaactcccctacctcattagtatgcgaagcttactcataccccccagctaccattacgtggtttaaggacggcacacccctggaaagcaacagaaacataaggatactgcccggcggccgcaccctccagatcctgaatgcccaagaagataacgcaggcaggtactcctgcgttgccaccaatgaggccggcgagatgatcaagcactacgaagtcaaagtctatatcccgccaattatcaacaaaggcgacctctgggggcctgggctctcccccaaagaagtcaaaatcaaggtaaacaatacactcactctggagtgcgaggcatacgccataccaagcgcatctctgagctggtacaaggatggccaaccgctgaagagtgacgatcatgtgaacattgcagcaaatgggcacacactgcagatcaaagaagcccagataagtgacaccgggcgttatacctgtgtggcaagtaacatcgccggcgaagatgaactggactttgacgtgaacatccaggtccctcccagcttccagaagctctgggagatcggaaacatgctggatactggcaggaatggggaagccaaagacgtgattattaacaaccccatctccctttattgcgagaccaacgccgcacctcctcccaccctcacttggtacaaggacggacacccgctgacaagctctgataaagtcctaattttaccgggcggtcgggtccttcaaatcccccgggcaaaggtagaagatgctggacgatatacatgcgtcgcagtaaacgaggccggggaggatagcctccagtacgatgttagggtgttagttccgcccatcattaagggggctaactctgatttgccagaagaagtcactgtactcgtgaataaatcagctctcattgaatgcctgtcgagcggttctccagcaccgcggaatagctggcagaaagatggccagcctctgttagaggatgaccaccataagtttctctctaacgggcgtatactgcagatcctcaatacccaaatcaccgacattggccgatacgtatgcgtagctgaaaatacagccggcagcgccaagaaatacttcaatctgaacgtgcacgttcccccctctgtaattggcccaaaaagcgagaacttaaccgtggtcgttaacaattttatttcactgacctgcgaagtttccggctttccaccccccgacctgagctggctgaagaacgagcaacctatcaagctgaacacaaatactcttattgtgcccggcggccgaactttgcagattatccgtgcaaaggtgtccgatggcggagagtacacatgtatagcgattaaccaagcaggtgaaagtaaaaaaaagttctccctgactgtttacgttccgccaagtatcaaggatcatgacagcgaatcactgtctgttgtcaatgtgcgagagggcactagcgtctctttagagtgcgaatcgaatgccgtgccacctcccgtgataacatggtataaaaatggccgcatgatcaccgaaagcacacacgtggagatcctagccgatggccagatgctccacattaagaaggctgaggtgagcgacaccggtcagtacgtgtgccgcgcaatcaacgtggcaggacgggatgataaaaatttccatttgaatgtatacgtgcccccttcaatagaaggacctgaaagggaggtgatcgtcgaaacaatcagtaacccagttacactgacttgcgatgctactggcattcccccccccactattgcttggctaaaaaatcataaaagaatagagaatagcgactcactggaggtgagaatactcagtggggggtctaagctgcagattgcccgaagtcagcacagtgacagcgggaattacacctgcattgcgtctaacatggaagggaaggcccaaaagtattacttcctctctattcaggtaccaccgagcgtcgcaggagccgaaatcccatctgacgtatctgtgctgctcggagagaacgtggagcttgtatgcaacgctaacgggataccaactccactcattcagtggctgaaagatggcaagcctattgcaagtggagagacggaaaggattagagtcagcgccaacggctctaccttaaacatctatggagccctaacatccgacaccggaaaatatacatgtgtcgctaccaatccggctggagaggaagaccggatttttaatcttaacgtctacgtgactcccacaatccgcgggaacaaagatgaggctgaaaaacttatgactctggtagatacctcaataaacatagagtgcagggccaccggaaccccccccccccagataaattggctcaagaacggtctgcctctgcccctctcgtcacacattcgcctactcgcggccggccaagtgatccgcatcgtgcgggcccaggtatccgacgtggcagtgtacacctgtgtcgctagcaaccgggccggcgtggataataaacattacaacctgcaggtcttcgctccccccaacatggataattcgatggggactgaggagattaccgtactgaagggttcatcaactagtatggcttgcatcacagacgggacgcccgccccatctatggcttggctgagagacgggcagccgctcggcttggatgctcacctcaccgtctctacacatgggatggtccttcagctcctgaaagctgagaccgaggacagtggaaagtatacgtgtattgccagcaacgaagccggcgaagtgtctaagcattttattctcaaggtcctggaacccccacatattaacggttccgaggaacacgaggaaatctccgtgatagttaataaccctctggagctcacctgtatcgctagcgggattcctgcccccaagatgacctggatgaaggatggcaggcctcttcctcagactgatcaggtgcaaacattaggaggcggggaagtgctcaggatatcaaccgcacaggtggaagacaccggccggtacacttgcctggcgtcttctccggctggcgacgatgacaaggagtatctcgttcgcgtgcatgtaccacccaatatcgccgggaccgacgaacccagagatattacagttctgagaaataggcaagtgactctggaatgcaagagtgacgccgtgccaccccccgtaatcacatggcttagaaacggcgagcgcctgcaagccaccccacgagtgcggattctctctggagggcgttatttgcagatcaataacgcggatttgggtgatacagccaattacacctgcgtcgcatccaatatcgctggcaaaaccacacgggaattcatcctgaccgtgaatgtgcctcctaacatcaaagggggccctcagtctttggtgattctactgaacaaaagcacggttctggagtgtattgccgagggagtgccaacaccgcggatcacatggcgtaaggatggcgccgtgctggccggtaaccatgcacgctactcaatactagagaatggcttcttgcatatccagagcgcgcatgtcactgatacagggcgatacctgtgcatggctacgaacgccgctgggacagaccgacggcgcattgatcttcaggtccacgtgcccccctccatcgcaccggggcccacgaacatgaccgtgatcgtgaacgtgcagactacactggcttgcgaagctacgggcatcccaaaaccatccataaactggagaaaaaacgggcatcttctcaacgtggaccagaatcaaaattcttataggctgctcagctcaggaagccttgtgatcatttctccatctgtagacgacactgcaacgtacgagtgcactgtcacaaacggagccggtgatgacaaacgcactgtagatctgaccgtacaggtgcccccaagtattgcggatgaacctacagattttctggtgactaagcacgcgcccgccgtgataacatgcaccgccagcggtgtaccattccctagtattcattggacaaaaaacggtatccgcttgctgccgaggggagatggctacagaatcctgtcaagtggcgctatcgagatcttggctactcagctgaaccacgcaggacggtatacgtgtgtggcacgcaatgcagctggatctgcacaccgccacgttaccctgcatgtgcacgaacctcccgtcattcagcctcaaccctccgagctgcatgttatcctcaataatcccatcctgcttccatgcgaagcaactggtaccccgagtccatttattacatggcaaaaagagggaatcaacgtcaacacatccggtcgcaatcatgcggtgttaccctctggcggacttcagatctcccgcgctgtgcgcgaggacgctggaacatacatgtgtgtcgcccagaatcctgcgggtaccgccttgggtaaaattaaattgaatgtccaggtgccgcctgttatcagcccacatttaaaagaatacgttatagcggtggataaacctattacgttgtcctgtgaagcggatgggcttcccccccccgacatcacatggcacaaggatggccgcgcgatcgtagaatccatccggcaaagagtgctgtcatccggctctctgcagatcgccttcgtgcaaccaggtgatgctgggcattatacttgcatggcagcaaatgtcgcgggtagcagctccaccagcactaagttgacagttcatgtgccccctcgtataagatcaacggaaggccattataccgtaaacgaaaacagccaggccattctaccttgcgttgctgacgggatacctactcccgcaatcaactggaagaaggataatgtcctgttggctaatttgttaggtaaatatactgcagagccttatggagagttgatattagagaatgttgttctggaagactcaggtttctatacctgcgtagccaataacgctgcaggtgaggacacacacacagttagcctcaccgttcatgtgctgcccacttttactgagctccctggagatgtttctcttaacaagggggaacaattacgactaagttgcaaggcaaccggcattccacttccgaaactgacatggactttcaataacaacattatccccgcccattttgatagtgtgaatgggcattctgaactcgttattgaaagagtctctaaagaagacagtggcacatacgtgtgcactgcggagaacagcgtcggttttgtgaaagctatcggctttgtgtacgttaaagagcctcccgtcttcaagggggattatcccagtaactggatcgaacctttagggggcaatgcgatcctcaactgcgaagtgaaaggcgacccaaccccgaccatccagtggaaccgtaaaggagtcgatatcgagatttctcaccgcatcagacagctcggcaacggctccctcgccatctatggcaccgtgaacgaggacgcaggagactacacctgcgtggccactaacgaagcgggggtcgtggagagatcaatgtccctgaccctccagtccccgccaattatcacgttagagccagtcgagaccgtgataaacgccgggggcaaaattattctgaactgtcaggccaccggggagccccagcctactatcacttggtctcgccagggacactcgatcagctgggacgacagggtcaatgtgctaagcaacaacagcctgtatatcgctgacgcacagaaagaagacacttctgaatttgagtgcgtcgctcggaaccttatggggtcggtactcgttcgcgttcccgttatcgtgcaggtccacggcgggttctcccaatggagcgcgtggagggcctgttctgtgacctgcgggaagggtattcaaaagagatctaggctctgcaaccagccactgcccgcaaacggaggaaaaccctgtcagggctcagatttagagatgcggaattgtcagaataagccctgcccggtggatgggtcatggtcagaatggagcctgtgggaagagtgcactagaagttgtggaagaggaaatcaaacacgtactcggacttgcaacaacccgtctgtgcaacatggtggaaggccctgtgagggcaacgccgttgaaattatcatgtgcaatattaggccttgccccgtccatggtgcttggtccgcttggcagccatggggtacctgctcagaaagttgcgggaaaggaactcagactcgggcacgcctgtgtaataatcccccgcctgccttcggtggctcctattgcgacggtgctgagactcagatgcaagtgtgcaatgaaaggaattgccctatccacgggaagtgggccacttgggccagttggtcggcctgctcagtctcgtgtggaggtggtgcacgccagaggaccagaggatgctcggatcccgtgccacagtatggggggcgtaaatgtgagggaagcgacgtgcagagcgatttctgcaattcggacccttgcccaacgcatgggaactggtccccctggtcagggtggggcacctgctcacggacctgcaacggagggcagatgcgtagataccgcacttgtgataaccctcctccatctaacgggggaagagcgtgtggcggccccgacagccagatccagcggtgcaacaccgacatgtgccccgtggatggctcatggggctcctggcactcctggtctcagtgttcggcatcatgtgggggcggcgaaaaaacgcggaaaagactgtgcgaccatcctgtccctgtaaaggggggcaggccttgtcctggggatactacacaggtgacccgatgtaatgtgcaggcttgccctggaggtccccagagagcccgcggctccgtcatcgggaatattaatgatgttgaattcggtatcgccttcctaaacgctaccattacagattctcccaattcagacacacggataatccgcgccaaaattactaacgtccctcgcagtctgggatctgccatgaggaagatagtctccatcctgaatccaatctactggaccactgcaaaagaaatcggagaggctgtgaacggctttaccctgactaatgctgtattcaaacgagaaacccaggtggaattcgccactggggagattctccaaatgtcacacattgcaagggggctggattccgacggaagcctgctcctggacattgtggtgtccggatatgtcctgcagctgcagtcccccgctgaagttactgtgaaagattatacggaagattatatacaaactggacccggtcagttgtacgcctatagcactcgactgttcactatcgacgggatctccattccatacacctggaaccatacagtgttttacgatcaggctcaaggcaggatgccattcttggtcgaaaccctccatgcctcaagcgtggagagcgactataatcaaatcgaggagaccctggggtttaagattcacgcctctatttctaagggcgataggtctaaccaatgtccgtcgggtttcaccctggatagcgtgggaccattttgcgccgatgaagatgaatgcgcggccggaaatccctgtagtcattcttgccataatgctatggggacttattactgcagctgtcctaagggcctgaccatcgctgcagatggccgaacttgtcaggatattgacgagtgcgcattgggccgccatacctgtcacgccgggcaggactgcgataatactataggctcataccgctgtgtggtgcgctgcggttcaggttttcgccgaacgagcgacggcctgagctgccaggacattaacgaatgtcaggagagtagcccgtgccatcaaaggtgctttaacgcaatcggtagcttccactgtggctgtgaacctgggtatcagctgaaaggcaggaagtgtatggatgttaacgagtgtcgccaaaatgtgtgccgacctgatcaacattgcaagaatacccggggcggatacaagtgtatcgatctgtgcccaaacgggatgactaaagctgaaaatggaacttgcatcgacattgatgagtgcaaggacgggacccaccaatgcaggtataaccaaatttgtgaaaataccaggggctcatacaggtgcgtgtgtccccgcgggtaccggtcacagggcgtgggacgcccctgtatggatatcgacgaatgtgaaaacacagatgcctgccaacacgagtgtaaaaacacatttggtagctaccagtgcatctgccctccgggttaccaactgacacacaatggtaagacctgccaggatattgacgaatgcctggagcaaaacgtgcattgtggcccaaacagaatgtgcttcaacatgaggggctcatatcaatgtatcgacacaccatgtcctcctaactatcagcgggatcctgtgtccggattttgcctgaaaaattgccctcccaatgatctggagtgtgcactgtccccgtacgccctggagtacaagctcgtgagtcttccctttggaatcgccaccaaccaggacctcatcagactggttgcgtatacgcaggatggcgtgatgcatccacgcacaaccttcctgatggtcgatgaagagcagaccgtgccttttgccctgcgggatgagaacctgaagggcgtggtgtacaccacccgtccacttcgagaagcagaaacttataggatgagggttagggctagttcctattctgccaatggaaccatagagtatcagaccacattcatagtgtatattgcggtcagcgcctatccttactag

SEQ ID NO: 119676 - DNA, 723 bp, Artificial Sequence
  Description of Artificial Sequence: Synthetic coding sequence
gccattgggagtttccactgcggctgtgaacctggttatcagctgaagggaaggaagtgcatggatgtgaacgagtgtagacagaacgtctgcaggccagaccaacattgcaagaatacgagagggggctataagtgtatcgacctctgcccaaacggcatgactaaggccgaaaacggcacgtgtatcgacatcgacgagtgtaaggatggcacccaccaatgccggtacaatcagatctgtgagaatacgcgcggttcctaccgctgcgtctgcccgagaggctaccggtcccagggagttggcagaccctgcatggatatcgatgaatgcgagaatacagatgcatgccagcacgagtgtaagaacacctttgggtcataccagtgtatttgtcctccgggatatcagcttacacataatggcaagacatgtcaggacatcgacgaatgtctggaacagaacgtccattgtgggccaaaccgtatgtgcttcaacatgagaggaagctaccagtgcattgacaccccctgtccccccaactaccagagagaccccgtgagcggattctgtctcaagaactgcccacccaacgacctggagtgcgctctttccccttatgcactcgaatacaagttagtgagtcttccttttggaattgctaccaaccaggacctaatccggctggtggcgtacacccaagatggtgtgatgcacccatag

SEQ ID NO: 119677 - DNA, 1455 bp, Artificial Sequence
  Description of Artificial Sequence: Synthetic coding sequence
atggacttgggcaaggaccagtcccacctgaagcatcatcaaacacccgacccgcaccaagaggagaatcacagtccagaggtcatcggcacctggtctctgcgcaatcgcgagctgctgaggaaaagaaaggccgaagtccacgagaaggagactagccaatggctctttggcgagcagaaaaagcggaagcagcagcgcacggggaagggtaacagacggggcaggaaaaggcagcagaacaccgagctgaaagttgagccccagcctcagattgagaaggagatagttgagaaagcactagcccctatcgagaaaaaaaccgaaccccctgggtctattactaaggtgttcccaagcgtggcgagccctcagaaggttgtgccggaagaacacttcagtgaaatatgccaagagtcaaacatttaccaggagaatttttctgagtaccaagagatcgctgtccagaaccactcctcagaaacctgtcaacacgtctccgaaccagaagatctgtctccaaagatgtatcaggagattagtgtcctccaggataattcatctaagatttgccaggacatgaaagaacctgaggataactcccctaatacttgccaagtgatttctgttattcaggatcatcccttcaagatgtaccaggatatggccaagcgggaggacctcgccccaaaaatgtgtcaggaagccgcagtgccaaaaattctgccatgtccgaccagcgaggatacagccgatctggctggttgctctttacaagcatacccaaagcctgatgtacctaaggggtacatattggacactgaccagaaccccgccgaacccgaagaatacaatgaaacagatcagggcatcgcggagacggaaggcttattcccgaaaatccaagaaatagccgagccaaaggacttgtcaacaaagacccatcaggaaagtgccgagcccaagtatcttccgcataagacctgcaacgaaattatcgtacccaaggccccctctcataaaaccattcaagagacaccacactcagaagactacagtatcgaaatcaaccaggagacacctgggagtgagaagtactcacctgaaacttaccaggaaatacccggactggaagagtattctccagagatttatcaagaaaccagtcagctggaggaatactctcccgagatttaccaggaaactccaggccccgaagacttatccacagaaacttacaagaacaaagatgttccaaaggagtgctttcctgaacctcatcaggagacagggggtccccaaggacaggaccctaaagcacaccaagaggatgctaaagatgcgtatacgttcccccaggagatgaaagaaaagcctaaggaagagccgggtattcccgctatcttgaacgaaagccacccggagaacgatgtgtactcttacgtgctgttttag

SEQ ID NO: 119678 - DNA, 1455 bp, Artificial Sequence
  Description of Artificial Sequence: Synthetic coding sequence
atggatctcggcaaggatcagtcccacctgaagcatcatcagactcccgatccccatcaggaagaaaaccattcgccggaagtgatcggcacgtggtctctccggaatagagagctgttgcgtaaaaggaaggcagaagtgcatgaaaaagaaaccagccagtggctgttcggggagcagaaaaaaaggaagcagcaacgcacagggaaaggaaatcggcggggccggaagagacagcagaacacggagcttaaggttgaacctcaacctcagatagagaaggagattgtggagaaagctctcgctcctattgaaaaaaagactgaacccccaggtagtatcacaaaggttttcccgtctgtcgctagtcctcaaaaggttgtccccgaagagcattttagcgagatctgccaggagagcaacatatatcaagaaaacttctcggagtaccaggagatagcagttcagaaccactcttcagaaacttgccaacatgtgagtgagcccgaggacctgagcccaaaaatgtatcaggagatcagtgtcctgcaagacaattcgagcaagatttgtcaggacatgaaagaaccagaagacaactctccgaatacttgccaagtgataagtgtcatccaggaccacccgttcaagatgtaccaggacatggcaaaacgcgaagatcttgccccaaagatgtgccaagaggccgctgtgcccaagattttgccctgtcccacgagcgaggatactgccgatctcgcaggctgctcactccaggcctacccgaagcctgatgttcctaaagggtacatccttgacaccgaccagaatcctgcggaaccagaggaatacaatgaaactgatcagggcatcgccgagactgaaggcctgttccccaaaatccaggagatagccgaacccaaagaccttagtaccaagacacatcaggaaagcgctgagcccaagtacctcccacacaagacgtgtaatgagatcatcgtccccaaggcgccctctcataaaaccattcaggaaactcctcacagcgaggattactccattgagattaaccaggagactccggggtccgagaagtatagcccagagacctatcaggagatccctggtttggaagaatactcacctgaaatataccaagaaacaagccagctggaggaatatagtcccgaaatctatcaggaaacccccggtcccgaggatctctcaaccgagacatacaagaacaaggatgttcccaaagagtgcttccctgagcctcatcaggagactggaggcccacaaggccaagacccaaaagctcatcaggaggatgctaaagacgcatacactttcccacaagaaatgaaagaaaagccgaaggaggagcctgggatcccagcaattcttaacgagagtcacccggaaaatgatgtttattcgtacgtgttattctag

SEQ ID NO: 119679 - DNA, 429 bp, Artificial Sequence
  Description of Artificial Sequence: Synthetic coding sequence
atggtcctgtccccggccgacaagaccaatgtgaaggccgcgtggggaaaagtaggggcgcatgccggagaatacggagctgaagcgcttgagcgcatgttcttaagcttccctacaacgaaaacatacttccctcactttgatctttctcatggctccgcacaggtgaaaggacacggaaagaaagtagccgatgcgttgacaaatgcagtcgcacatgtggacgatatgccaaacgctctaagtgccctgtccgatctgcacgcacacaagcttcgggttgacccagtgaactttaagctactgagtcattgcctgctggtgaccctcgctgcccatctcccagcagagttcactccagctgtccacgcctctctagacaagttcctggccagcgtctctaccgttctgacatctaagtacagatag

SEQ ID NO: 119680 - DNA, 429 bp, Artificial Sequence
  Description of Artificial Sequence: Synthetic coding sequence
atggttctcagccctgcagataagaccaacgtgaaagccgcttggggcaaggtaggagctcatgccggcgaatatggcgccgaggctcttgagaggatgtttctttcatttcctactactaagacctacttcccacactttgacctgtctcatggctctgctcaggtgaaaggtcacggaaaaaaggttgccgacgcactgacaaacgctgtggctcacgtcgatgatatgcctaatgccctctccgcgctctcagaccttcacgcgcataagctcagggtggatcccgtgaacttcaagctgctgtcccactgcctgttggtcactttggccgcccatttgccggcagagtttacccctgccgtgcacgccagtctggataaattccttgccagtgtgagtaccgtgctgacttccaagtatcgctag

SEQ ID NO: 119681 - DNA, 333 bp, Artificial Sequence
  Description of Artificial Sequence: Synthetic coding sequence
atgtttctgtcattcccaactacaaaaacatactttcctcacttcgacctgtcccacgggtcggctcaagtgaaggggcatgggaaaaaggtcgccgacgctctcactaacgctgttgcccatgtagatgacatgcctaatgctctcagcgctctgagcgatttgcacgcacacaagctgagagtggatccagtgaatttcaagctgcttagtcactgcctgctggtgacgctggcagcgcatctgcccgccgagttcacgccagcggtccacgccagccttgacaagttcttggctagcgtgtctaccgtcctcaccagtaaatatagatag

SEQ ID NO: 119682 - DNA, 444 bp, Artificial Sequence
  Description of Artificial Sequence: Synthetic coding sequence
atggtgcatctcacccccgaagagaaaagcgcagtcaccgccctctggggaaaggtgaatgtggacgaagtgggaggagaagccctgggtaggttgttggtcgtttacccctggacccagcgcttctttgagtctttcggagatctctctaccccagatgccgtcatgggtaatcccaaggtcaaggctcacgggaagaaggttctgggagcctttagtgacgggttggctcacctggataacctcaagggaacgttcgcgactctgtccgaactgcattgcgacaagctgcacgtggatcctgaaaattttcgattattaggaaatgtgctcgtctgtgttttagcacatcatttcggcaaagaattcaccccgccagtgcaggctgcgtatcaaaaggtggtggcaggagtcgccaatgccttggcccacaagtatcactag

SEQ ID NO: 119683 - DNA, 273 bp, Artificial Sequence
  Description of Artificial Sequence: Synthetic coding sequence
atggtgcaccttaccccagaagagaaaagtgcggtgacagctttgtggggaaaggtgaacgttgatgaagtgggcggagaggccctggggcggctgctcgtagtttatccctggactcagagattttttgagtctttcggtgacctctcaaccccagacgctgtcatgggcaatcctaaggtcaaagcacacggcaagaaggtcctaggagccttttctgacgggcttgcccacctggataacctgaaaggcacttttgccacactatcatag

SEQ ID NO: 119684 - DNA, 426 bp, Artificial Sequence
  Description of Artificial Sequence: Synthetic coding sequence
atggtgcacctcactccagaggaaaagaccgctgtgaacgctctgtggggtaaggtcaatgtcgatgccgtcggtggggaagccttggggagattattggtcgtttatccctggacccagcggttttttgaatcttttggcgatctgagcagtccagatgctgtgatgggcaaccctaaggtgaaggcacatggcaaaaaggtgctgggcgcctttagcgatggtctcgcccacctcgataaccttaagggcacattcagccagctgagcgaactgcattgtgacaaactgcacgtcgatcccgagaattttcgcgtgtgtaagaaggtgcccgaggccctccagatcgggtccacctgcctgttctataaagagtatatgggcaaagagaagtcgaagggcacggtccagggaattaacggctag

SEQ ID NO: 119685 - DNA, 444 bp, Artificial Sequence
  Description of Artificial Sequence: Synthetic coding sequence
atggtacacctgacgcccgaagagaaaaccgctgtgaacgcattgtgggggaaggtgaatgtggacgctgtgggcggcgaggctttaggccgccttctggttgtgtatccatggacacaacgtttcttcgaaagctttggagacctttcttcccccgatgcagtaatgggaaaccctaaagtcaaggcccatggcaagaaggttctcggggctttcagtgacggattggcgcacttagacaatctcaaaggcacatttagtcaattaagcgagctccactgcgacaaactccacgtggaccctgagaatttccgactgttagggaatgtgctggtttgtgtcctggcgcggaactttgggaaggaatttactcctcagatgcaagccgcctatcagaaagtcgttgccggcgtggcaaatgccctggctcacaaataccattag

SEQ ID NO: 119686 - DNA, 315 bp, Artificial Sequence
  Description of Artificial Sequence: Synthetic coding sequence
atggtgcacctgacccctgaagaaaagactgctgtcaacgctctgtgggggaaggtgaacgtggatgcagtggggggggaggcgctcgggagattgctagtggtgtacccttggactcaaaggttctttgaatccttcggagacctctcatcacccgacgccgttatggggaatcctaaggtgaaggctcatgggaaaaaggttcttggcgcattctctgacggacttgcccatctagataatctaaagggtacattctcccagctgagtgaactacattgcgataagctccatgtcgatccggaaaacttctag

SEQ ID NO: 119687 - DNA, 444 bp, Artificial Sequence
  Description of Artificial Sequence: Synthetic coding sequence
atggtacactttaccgccgaggagaaagccgccgtgacctccttgtggagtaagatgaacgtagaagaggctggcggggaggccttagggagactgctggttgtttacccttggacccagcggttcttcgactcgttcggtaacctttcaagtccatccgccatcttaggtaacccaaaggtgaaagctcacggaaaaaaggtgctgacaagttttggggatgccattaagaacatggataatctgaaacctgcattcgcaaagctaagcgagttgcattgcgacaaactgcatgtcgacccagagaattttaagctgctgggaaatgtaatggtcattatcctcgcaacccactttggtaaggagtttacccccgaggtgcaggctgcttggcagaaactcgtgagcgcggtggccatcgccctcgcccacaagtaccactag

SEQ ID NO: 119688 - DNA, 444 bp, Artificial Sequence
  Description of Artificial Sequence: Synthetic coding sequence
atggttcacttcaccgccgaggaaaaggcggctgtgacttccctgtggagcaaaatgaatgtagaggaggcaggaggagaagcgctaggcagacttcttgtagtttatccgtggacccagcgatttttcgatagtttcggaaacctttcctctccttccgcgatacttgggaacccaaaagtgaaggcgcatggcaagaaagtgttaacatctttcggagacgctattaagaatatggacaatctaaagccagcgtttgctaagctgagcgagctgcattgtgataaacttcacgtcgatcctgaaaatttcaaactcctgggcaacgtgatggtgataatcctggctacacatttcggaaaagagtttaccccagaggtccaggcagcatggcagaaactagtttctgcggtggcgattgcactggcccacaaatatcactag

SEQ ID NO: 119689 - DNA, 264 bp, Artificial Sequence
  Description of Artificial Sequence: Synthetic coding sequence
atggtccattttaccgcggaggaaaaagctgcggtcacctccctgtggtcaaaaatgaatgtagaagaagccggtggtgaggcacttggccgcctgttggttgtgtatccatggacacagcgattcttcgactccttcggcaacctgtcaagtcccagtgccattctgggaaatcctaaagtgaaggcgcacgggaaaaaggtcctgaccagctttggagatgccatcaaaaatatggacaatctcaaacctgcattcgcatag

SEQ ID NO: 119690 - DNA, 444 bp, Artificial Sequence
  Description of Artificial Sequence: Synthetic coding sequence
atgggccattttacagaggaagacaaggccaccatcacgtcactttggggtaaagttaacgttgaagatgctgggggtgaaacgctgggaaggcttctggtagtctacccatggacccagcgtttttttgattcttttggaaacttgagttctgcttcagctataatggggaatccaaaagtcaaggcccatggcaaaaaagtgcttacctcattaggcgatgcaactaaacatctggacgatctcaagggcaccttcgcccagctgtctgagctgcactgcgacaagttgcatgttgatccggagaatttcaaactgctaggaaatgtactcgttacagtgctggctattcactttggcaaggaattcacacccgaagtgcaggcctcttggcagaagatggtgacagcggtggcttccgctttgtcatcacgctaccactag

SEQ ID NO: 119691 - DNA, 444 bp, Artificial Sequence
  Description of Artificial Sequence: Synthetic coding sequence
atgggacacttcactgaggaagataaagccacaatcacctctctgtggggcaaggtgaatgtcgaagatgctgggggagaaacattaggcagactcctggtcgtctatccgtggactcaaaggttcttcgactcctttggcaacctgtcgagcgcaagcgcgatcatgggcaaccctaaggttaaggctcacggcaaaaaggtgctcaccagcctgggggacgccattaagcacctggacgacctgaagggaacatttgcacagctgagcgagctgcattgcgacaagttgcacgtggatccagaaaatttcaaactgcttggaaatgtccttgttaccgttctggccattcattttggcaaagaatttacccccgaggtccaagcctcctggcagaagatggtgaccggagtcgcctcggccctatctagccggtatcactag

SEQ ID NO: 119692 - DNA, 477 bp, Artificial Sequence
  Description of Artificial Sequence: Synthetic coding sequence
atgggccattttaccgaggaggataaggcgaccattaccagtctgtggggcaaggtaaatgtggaggacgcagggggcgagactctcggacgactgctcgtagtttacccatggactcaacgcttcttcgattccttcggaaacttgagctctgcgagcgctataatggggaaccccaaagtaaaagcccacggaaagaaggtgctcacctcactgggggacgccatcaagcacctcgatgatctaaaagggacattcgcacagctgtctgagttgcactgtgataagctgcatgtcgatcccgaaaatttcaaactgctgggcaacgtacttgtgactgtgctcgcaatccatttcggaaaggagtttactccagaggttcaagcgtcatggcagaagatggattggtcaggccagtgccccgtcttgcaaattcccttgtcatccttaccgatgatgcagtcttttcagggctag

SEQ ID NO: 119693 - DNA, 414 bp, Artificial Sequence
  Description of Artificial Sequence: Synthetic coding sequence
atggtcgtgttaggagagatgaagcgaaaggttttgcctctccacttcctcccctttatgcgcttactggtggtgtacccctggactcagagattttttgatagtttcggaaacttatcctctgctagtgccatcatgggaaaccccaaagtgaaagcccatggtaagaaagtcttgacatcactcggcgatgcaatcaaacacctggacgacttgaaaggtacatttgcacagttgtcagaactccactgtgacaagctccatgtggatcctgaaaacttcaaactcctgggaaatgtgcttgtgactgtgctggccatccatttcggtaaagagtttacacctgaagttcaagcctcctggcagaaaatggtaaccggcgtggcgtcggcactctccagcagataccactag

SEQ ID NO: 119694 - DNA, 444 bp, Artificial Sequence
  Description of Artificial Sequence: Synthetic coding sequence
atgggccatttcaccgaggaggacaaggccacaataacatccctctgggggaaagtgaacgtcgaggatgctggcggagagacactcggcaggctcctagtcgtctacccctggacccaaagattcttcgatagcttcggtaatctgagtagcgcctcagccatcatgggaaacccaaaagtcaaagcccacggtaagaaggtgctaacaagcctgggcgacgctattaagcacctggatgacctgaagggaacttttgcacagctaagcgagctgcattgtgataagctgcacgtggaccctgaaaactttaaactgctggggaatgttctcgtgaccgtcctggccattcactttgggaaagaatttactccagaagtccaggcatcatggcaaaaaatggtaacaggcgtagccagcgccttaagttctcggtatcactag

SEQ ID NO: 119695 - DNA, 426 bp, Artificial Sequence
  Description of Artificial Sequence: Synthetic coding sequence
atgctatccgctcaagaaagagctcagattgcgcaggtatgggatttaattgctggccatgaagcccagtttggcgccgagctgctcttacgactgtttactgtgtatcccagcaccaaggtttatttcccccacctttcagcatgtcaggacgccacccaactgttgagtcacggacagagaatgctggccgcggtgggcgcagctgtccagcatgttgataatctcagggctgcactctcccctcttgcagatctgcatgcactggtgctgagagtcgatcctgcaaactttccccttctgatacagtgtttccacgtggtgttggcctcccatctacaggatgaattcaccgtgcagatgcaagctgcatgggataaattcctgacaggcgttgccgtcgtgctcacagagaaataccggtag

SEQ ID NO: 119696 - DNA, 429 bp, Artificial Sequence
  Description of Artificial Sequence: Synthetic coding sequence
atggcactgagcgccgaggacagggcattagtccgcgctctgtggaagaaactgggatccaacgttggtgtatacactacagaagcgctcgagcggaccttccttgcgtttcctgcaactaaaacttacttctcacacctggacctgtcccccggttcgagccaggtgagggcccacggtcagaaggtagctgatgccctgagtctggccgtcgagcgactggacgatctcccccacgctctaagtgccctttcacatctgcacgcttgccagctgcgcgtggacccagctagcttccagctccttggacattgtcttctggtcaccctggcgcgccattacccgggtgacttcagcccggccttgcaagcttctctcgacaaattcctgtctcacgtgatatccgccctcgtgtccgaataccgttag

SEQ ID NO: 119697 - DNA, 429 bp, Artificial Sequence
  Description of Artificial Sequence: Synthetic coding sequence
atgagcctcaccaagacggaacgaaccatcatcgtgagcatgtgggcaaaaatttcaacacaggccgacacgatagggacagagacacttgagcggttgtttttatcccacccccagaccaaaacctattttccccactttgacttgcaccccggcagcgcccagttacgagcccacggcagtaaggtagtcgcagcggtcggcgatgccgtcaagagcatcgatgatatcgggggagccctgtccaagctgtcagaactgcacgcctacatccttcgcgtggacccagtcaactttaagctgctctcccactgcctcttggtgactctggccgcaaggttccctgccgacttcacggcagaagcgcatgccgcctgggataagtttctcagcgtcgtgtcctctgtcctgacggagaaatatagatag

SEQ ID NO: 119698 - DNA, 1389 bp, Artificial Sequence
  Description of Artificial Sequence: Synthetic coding sequence
atggccagggttctgggggcccccgtcgcactggggttgtggtccctgtgctggtcgttagcaatagctacccctttgccgcctacgtctgctcacggcaatgtagctgagggagagaccaaacccgatcctgatgtcactgagaggtgttcggacggctggagctttgatgctacgaccctcgatgataatggtaccatgctcttcttcaagggagaatttgtatggaagtcccacaagtgggatcgggagctcatctctgaaaggtggaaaaatttcccctcccccgtagatgccgccttccgtcagggacataactcggtctttctcattaagggcgataaagtatgggtgtatccacctgagaagaaagaaaaaggatacccaaagctgttgcaggacgagttcccagggatcccgtcccccctggacgccgctgtcgagtgccatcgtggggagtgccaggctgaaggggtgctgttcttccagggggaccgggagtggttctgggacttggccacaggcacgatgaaggagcggtcctggccagctgtcgggaattgctcatctgcattgagatggctcgggcgttattactgttttcagggaaaccagtttttgcgctttgaccctgttcgaggggaggtgcctcctagatatccccgtgacgtccgtgactattttatgccctgcccagggaggggtcatggacacagaaatggcactggtcatggcaacagcacccaccacgggccggagtacatgaggtgttcccctcatctggttctgtcagctctcacttcagacaaccatggcgctacatatgcttttagcggcacgcactattggagactcgacacttctagggatggctggcattcatggcctatagctcatcagtggcctcaaggcccatccgctgttgatgcagcgttcagctgggaagagaagctctatctggtccagggcacacaggtttacgtctttctcaccaagggcgggtacaccctcgtgagcggatacccgaagcgtctcgaaaaggaggtgggaactcctcacgggatcattctcgacagtgtcgatgccgcgttcatctgccccggaagttcgagactgcacatcatggcggggagacgattgtggtggctggacctgaaaagtggagcgcaagcaacctggacagagctgccttggcctcatgaaaaggtcgacggcgccctctgtatggaaaaatccctcggcccaaacagctgtagtgcaaatggtccgggactctatcttattcatgggcctaatctatactgctacagtgacgttgaaaagctgaacgcggccaaagcactgccacagccgcagaatgtgacctcactgcttggctgcactcactag

SEQ ID NO: 119699 - DNA, 765 bp, Artificial Sequence
  Description of Artificial Sequence: Synthetic coding sequence
atggcacgcgtgctgggcgctcccgtggcactgggtctgtggagtctctgctggtctctggcaatagcaacccctctgccccccacttccgcacatggcaatgttgccgagggcgaaacaaagcctgaccctgatgtgactgagagatgctcggatggctggtcttttgacgctacgacactggatgacaatgggacaatgctctttttcaaaggtgagttcgtctggaaatcccacaagtgggaccgagagttgatatctgaaagatggaaaaacttcccttccccagtggatgctgcttttcgacagggccataatagcgtttttctgatcaagggcgacaaggtatgggtgtaccctcctgaaaaaaaagagaaaggctatcctaagttgttacaggatgaatttccaggcatcccatcacctctcgacgccgcagtagaatgtcatcgcggggaatgccaggcagaaggagtgctttttttccaaggcgaccgggagtggttttgggacttggccaccggcacgatgaaggaacgctcatggcctgctgtgggcaattgctctagcgcactgcgctggctgggtcgatactactgctttcagggaaaccagtttttacgctttgaccccgtgagaggtgaggtgccgccaagatatccacgcgatgttcgagattacttcatgccttgccccggccgcgggcatggtcaccgcaacgggacaggccatgggaacagcatttgcgccgtcgcacacatatag

SEQ ID NO: 119700 - DNA, 1353 bp, Artificial Sequence
  Description of Artificial Sequence: Synthetic coding sequence
atgtggttaaaagtgttcaccacttttctcagttttgccaccggtgcatgtagcggactcaaagtaactgtaccatcacatactgtgcatggagtgcggggacaagctctctacctgccagtacactacgggttccatactcccgcctccgatatccagattatttggctgttcgagcggccgcatactatgcctaaatatctgctaggctccgtaaataagtctgttgtgcccgatctcgaatatcagcataaatttacgatgatgccccccaacgcaagccttttgatcaatcccctgcagtttcccgatgaaggcaattatatcgtcaaggtgaatattcagggcaatggcaccctgagcgctagccagaaaatccaagttacagtggatgatccagtgactaagccagttgtgcagatccacccgccgtccggagcggtggagtacgtcggaaatatgacactgacatgccacgtggaaggcggcactcggttagcataccagtggttaaagaacggaagacccgtgcatacgagtagtacctactcattctcacctcagaataacaccttgcatattgccccggtcaccaaagaggacatcggcaattactcatgcctcgtgaggaacccagtgagcgagatggagtccgatattatcatgccaattatatactatggtccctacgggctccaggttaactcagacaaggggcttaaggtcggtgaagtgtttactgtggatctaggagaagctatattgttcgattgctccgcagactcccatcctcccaatacatactcctggatcaggagaaccgacaataccacgtatattattaaacatggcccgaggctggaggtggcatccgagaaggtggctcagaagacaatggactacgtgtgttgcgcatacaataatataaccggtcgacaagacgaaacccacttcactgtgataattacgtccgtaggcctggagaaactagcgcaaaagggtaagtcgctttctccgctggcatcaattactggaatctcactatttcttatcatttccatgtgtctcctgtttttgtggaaaaagtaccagccctacaaagttatcaaacagaagcttgaaggacggcccgagacagaataccgaaaagctcagaccttcagcggacacgaggatgcattagacgatttcgggatttacgagttcgtggcctttccagatgtgtcaggagtcagccgtatacctagcaggtcagtgcccgcctctgactgcgtgagtgggcaagatcttcactccactgtgtatgaagtgattcaacatatcccagcccagcaacaggaccatcctgagtag

SEQ ID NO: 119701 - DNA, 1389 bp, Artificial Sequence
  Description of Artificial Sequence: Synthetic coding sequence
atgggtcaggatgccttcatggagcctttcggagacaccctcggagtatttcagtgtaagatataccttttgctgttcggcgcttgttcaggactcaaggtgaccgttccgagccacaccgtgcatggcgtgcggggccaagctttgtacctgccagtgcactacggatttcatacacctgctagtgacatccaaattatctggcttttcgaaagaccccacaccatgccgaaataccttctggggagcgttaataagagcgtggtgccagaccttgagtatcagcacaaattcacaatgatgccccctaatgcctcactccttattaatcccctccagttccccgacgaaggtaactatatagtgaaagtgaacatccaaggtaacgggactctcagcgctagccagaaaatccaggttactgttgacgaccccgtaacgaaacccgtggtccaaattcaccccccttccggggccgttgaatacgtgggtaatatgactcttacctgccacgtggagggcgggaccaggttagcctatcaatggttgaagaatggcaggccggtccacacctcctccacttacagtttctcccctcagaataacaccctgcacatcgcacccgtgaccaaagaggacatcggcaactattcttgcctggttcgtaatccggtcagcgagatggagtctgatataattatgcctatcatctattacggcccatatggactacaggtgaactcggacaagggactcaaggtaggagaggttttcactgtcgatcttggcgaggctattctgttcgattgtagcgccgacagtcatccccctaacacttacagctggattcggagaaccgacaacaccacttacatcatcaaacatgggccaagactagaggtcgctagtgagaaagtggcccaaaaaacgatggactacgtttgctgcgcgtataataatatcaccgggaggcaagacgaaactcactttaccgtgattataacaagtgtgggactcgagaaattagcacagaaagggaagagcttgtccccgctcgctagtattacaggtattagtctgttcttgataatcagtatgtgtcttctctttttgtggaaaaagtatcagccatataaggtcatcaaacaaaagctcgagggccgcccggagactgaatatcggaaagcccagacctttagcgggcacgaagacgctctggacgacttcggcatttacgagtttgtggcgtttccagacgtgagcggggtctctagaatcccgtcccgcagcgtccccgcctcagactgcgtctctggccaggacctgcatagcactgtgtatgaagtgatccagcacatcccagcccagcagcaggaccacccggagtag

SEQ ID NO: 119702 - DNA, 1104 bp, Artificial Sequence
  Description of Artificial Sequence: Synthetic coding sequence
atggcatatagagttttaggtcgggccgggccgccacagccacgccgcgcaagaaggctgctcttcgccttcaccctgtctttgagctgtacctacctatgctattcttttctgtgctgttgcgatgacctcggccgaagtcggctgcttggggccccccggtgccttaggggacccagcgccgggggacagaagcttttgcagaagagccggccctgtgacccttcaggcccgactcccagcgagcccagtgcgccaagcgcacctgctgctgccgttccagctccccggctgagcggctctaaccacagcgggagcccaaagctgggcacaaaacgtctgccccaggctttgatcgtcggcgtcaaaaaagggggaactcgcgctgtgctggagtttattagggtgcaccctgacgttagagcgcttggaaccgaaccccatttttttgaccggaattacggccgagggctagactggtaccgaagtctcatgcctaggactctggaaagccagattacccttgaaaaaacaccaagctactttgtgacgcaggaggcacccagacgcatctttaacatgtctagagataccaaattgatcgtcgtggtgaggaaccctgttaccagagctatatccgactacactcaaaccctgagcaaaaaacccgatatcccaaccttcgaaggactgtcattccggaaccgcactctcggacttgtagatgtgagctggaacgccatccggatcgggatgtacgtcttacacctcgaatcgtggctacagtactttccacttgcccaaatacatttcgtgagcggagagaggctgattactgaccctgccggtgaaatggggcgcgtgcaggatttcttagggatcaagagatttatcaccgacaaacacttttattttaataagaccaaggggttcccctgtttgaagaagacagagtcctcactgctacccaggtgtttgggaaagagtaaaggcagaactcacgtgcaaattgatcctgaggtgatagaccagttaagggaattttatcgcccctacaatataaagttttacgaaactgtcgggcaagatttccgttgggagtag

SEQ ID NO: 119703 - DNA, 1035 bp, Artificial Sequence
  Description of Artificial Sequence: Synthetic coding sequence
cctccggccagagcccacggcgctatggcctatcgcgtcctcggacgggcaggtcctccgcagcctcggagggcccgccgcctgctctttgccttcactttgagtctgagctgcacttacttgtgctattctttcctctgctgctgtgacgatctcggaagaagcagactgttgggagccccacggtgcttgcggggcccttccgctggaggccaaaaactacttcagaaatcccgtccctgcgatccctctggtccaaccccgagtgagcccagtgcgccctcagctcccgccgccgctgtgccagcaccacggttgagtggctctaaccactctgggtccccaaagctcggtaccaagcgactgccccaggcgctgattgttggagtaaagaaaggaggaactagggccgtcctagaattcattagggtgcaccctgatgtcagagcactgggcacggaaccccacttcttcgaccgcaattacggacggggactggattggtatcggtctctgatgccgcggaccctcgagtcccagatcaccttagagaagaccccaagttactttgtgacccaggaagcccctaggcgaatttttaatatgagcagggatacaaaactgatcgttgtggtccggaaccctgtgacccgtgcgatctcagactacacccagaccttgtctaagaagcccgatatcccaacgttcgaagggctgtctttccgcaatcgtacactcggtctggtcgatgtgtcatggaatgccatcaggatcggtatgtacgtgctgcatcttgaaagctggctgcagtattttcctctcgcccagatccatttcgtgtccggtgagcgcctcattaccgaccctgccggcgagatgggtcgagtgcaagacttcctgggcataaaaagattcatcacggacaagcacttctactttaacaaaacaaaaggcttcccttgtttaaaaaaccggatcgagcctcctgcctccatgctggggcagatcaagcgggaaaatagctgcacagattag

SEQ ID NO: 119704 - DNA, 1221 bp, Artificial Sequence
  Description of Artificial Sequence: Synthetic coding sequence
atggcgcctcccggaccagcatccgccctgtccaccagcgcggagcccctctcgcgaagcatctttaggaaatttttgctcatgctgtgctctttgcttacgagtctatacgtattttactgtctggccgagcgatgtcagaccttgagcgggcccgtggtcgggttgtccgggggcggcgaggaagcgggtgcccctggtggcggggtcctcgctggggggccgcgggagttagcagtgtggccagctgctgcccagcgaaagaggttgttgcagcttccgcagtggcgaagaagaagaccgcctgcccccagagacgatggggaggaggccgcatgggaagaggaatccccaggactaagtggtggcccaggcggcagcggagccggcagcaccgtggctgaggcaccccctgggaccttggcactgctactcgatgaaggctcaaagcaactaccgcaggctatcattataggcgtcaagaaaggcgggaccagggcactgctggaatttctgcgggtccatccagatgtacgagctgttggtgcagagccacacttttttgatcgctcctacgataagggactcgcatggtatcgcgacttgatgccacgcactctggatggacagattacaatggagaagacccccagctactttgtgacccgtgaagctcctgcaaggatctcagcaatgtccaaggacacgaaactaatcgtggtcgttagagaccccgtgaccagggccatctccgattatacacagacactgtcaaagagaccagacattccaactttcgaaagcttgacctttaagaatagaacggctggactcatcgacacatcttggagcgccatccagatcggcatctacgcgaaacatctggaacactggctcaggcactttcccatacgccaaatgctctttgtatcaggagagagactgatctcagatcccgctggggaactggggagggtgcaagactttctgggtctgaagcgcatcattacagacaagcatttttacttcaacaagaccaaaggctttccctgtctgaaaaaagccgaagggagtagccgcccgcattgcctgggtaagacaaaaggccggacgcaccctgagatcgaccgcgaagtggtccgcaggcttcgagagttctatagaccattcaatcttaagttctaccagatgactggccatgactttggatgggacgggtag

SEQ ID NO: 119705 - DNA, 1173 bp, Artificial Sequence
  Description of Artificial Sequence: Synthetic coding sequence
atgggacaaaggttatccggagggcggtcatgcctcgatgtccctggcagactgttgccccaaccccctccgccacctccacctgtgcggcgcaagctagccctgctttttgctatgctctgcgtgtggctctatatgtttctgtactcatgcgcgggctcctgcgccgccgcgcccggcctgctgcttctgggcagtgggagccgggctgcacacgatccacccgcactggccacagctccagacggcaccccaccgcggctgcctttccgagcacctccagctacccctctggcaagcggcaaggagatggccgagggggctgccagccccgaagagcaaagcccagaagtgccagattctccctctccaatctccagctttttctccggatccgggagtaaacaactccctcaggctattattatcggggtcaagaagggtgggaccagggcccttctcgagtttctgagggtgcatccggacgtgcgcgcagtcggggccgagccgcattttttcgatcgatcctatgacaagggcttagcttggtacagagatctcatgccacggaccctcgacggccagatcacaatggaaaagacaccgtcttactttgttaccagggaagctcccgcgaggatttcagctatgtctaaagatacaaaattgatagtggttgtgcgggatcccgtgacccgcgcaattagcgactatacgcaaactttgagtaagcgaccagatatccccacctttgaaagcttgacctttaaaaacagaaccgctgggctgatagatacatcctggtccgccatccagattgggatatatgcgaagcatttagagcattggctgcggcactttccaattcgacagatgctattcgttagcggcgaacgtctcatatcagatcctgcaggtgaattaggaagagtccaggactttcttggactaaagcggatcataaccgacaagcatttctattttaataagaccaagggcttcccgtgcctgaagaaagctgagggttctagtaggccccactgcctgggtaagacgaagggccgtacccaccccgaaattgatcgggaagttgtaagacgcttgcgcgaattctataggcccttcaacctcaagttctaccagatgaccggtcatgatttcggatgggattag

SEQ ID NO: 119706 - DNA, 1173 bp, Artificial Sequence
  Description of Artificial Sequence: Synthetic coding sequence
atgggccaaagactctccggtggaagatcttgcctggatgtaccagggcggctcttgccccagcctccgcctcctccaccccccgttcgcaggaagctggcactcctttttgccatgctgtgtgtctggctgtatatgttcctgtatagttgcgccggatcttgtgcggctgcccctggcctgctcctgctcggctctggatctagagccgctcatgacccacctgccctggccactgcccctgacggaactccccctcgcctgccatttagggctccaccagcgactccccttgcttctggtaaagagatggcggagggggctgctagcccagaggagcagagtcctgaggtcccggactcaccatcgcccatatccagctttttctccggcagcggatctaagcaactcccacaggccattattattggagttaagaagggcggcacaagggctctgttggagtttttaagggtgcatcccgacgtgagagctgttggcgctgagccgcacttctttgatcgctcttacgataaagggctcgcatggtatcgcgatctgatgccaagaacccttgacggtcaaattaccatggagaagacacccagctatttcgtgactcgggaggcacccgctcggatttcagccatgtccaaggataccaagttgattgtcgtggtccgggaccctgttactcgggcgatctctgattatacccaaaccctgtccaagcgacccgatattcctacttttgaaagcctgacttttaaaaataggacagccggtctaattgatacttcctggtccgctatccagatagggatatatgctaagcatctggagcactggttaagacacttccccatccgtcaaatgctcttcgtgtctggtgaaaggctcataagtgatcccgcgggggaattgggaagagtacaggactttctcggactgaagaggataatcactgataaacacttctacttcaacaaaacaaagggctttccctgcttgaagaaagccgaagggagcagccggccacactgcctcggaaaaacaaagggccgaacacacccagaaatagacagagaagtcgtacggcggcttagggagttctatcgcccgttcaacctcaagttttaccaaatgacgggacacgacttcgggtgggactag

SEQ ID NO: 119707 - DNA, 1371 bp, Artificial Sequence
  Description of Artificial Sequence: Synthetic coding sequence
atggccagatggccagcgccgcctccccccccacctccaccccctccccttgccgctcctcctccacccggagcctccgcaaaaggcccacctgcccgaaaactgctcttcatgtgtacactgagtctgtccgtaacatatctgtgctattccctcctgggtgggagtggttccctccagttccccctagcccttcaggagagccccggggctgctgccgaacctcccccctctccgccgcccccatcacttttgcctaccccagtgaggctgggggccccaagtcagccacccgcgccgccccccctcgataatgccagtcacggggaacccccagaacccccagagcagcctgctgctccagggacagacggatggggtttaccttcagggggggggggagctcaggacgcttggctgcggaccccactcgctcctagcgagatgatcactgcccagagtgccctgccggaacgtgaagcccaggaatccagtactaccgacgaggatcttgccgggaggcgggcggcgaacggatcaagtgaacgcggaggtgccgtgtccacacctgactacggggagaagaaacttccccaggcacttattattggagtgaagaagggaggaacgagagcattgctcgaagcaattcgggtacaccccgacgtcagagccgtcggcgtggagcctcactttttcgaccgcaactacgaaaaagggttggagtggtaccgcaatgtgatgcccaagaccctagacgggcagattacgatggaaaaaaccccatcttactttgtcaccaatgaagcgcccaaacggatccactccatggcaaaagatattaaacttattgtcgtcgtgcgtaatcctgtgacacgggctataagcgactacactcaaacgttaagtaagaagcccgagatacccacgttcgaagtgctggcgttcaaaaaccgaaccctgggtctgatcgatgctagctggtccgcaatacgaattgggatttacgcactgcacctagaaaattggctccagtacttccccctgagtcagattctttttgtctctggagaacgtcttatagtcgatcccgccggcgagatggccaaggtacaggatttcctcgggctaaagcgcgtagtaaccgaaaagcatttctactttaataaaaccaaagggttcccctgtctgaagaaacccgaggacagtagtgctccaagatgtctcgggaagtctaagggccgcacacatccacggatcgaccccgatgtgatccatcgacttcggaagttttacaagccctttaaccttatgttttaccagatgacaggccaggatttccagtgggagcaggaggagggcgacaagtag

SEQ ID NO: 119708 - DNA, 1041 bp, Artificial Sequence
  Description of Artificial Sequence: Synthetic coding sequence
atgctgttcaaacagcaggcctggttgcggcagaaactgctcgtgttggggtctctggcagtgggatctctcctgtatttggtggccagggtcgggagtttggatagactgcaacccatttgtcccatcgaagggaggttaggaggcgcccgaacgcaggctgaattccccctaagagctttgcagtttaagaggggactgctgcacgagttccgtaagggcaatgcttcaaaggagcaggttaggctgcacgatctggttcagcaactgcctaaagctattattatcggggttaggaagggcgggacaagggccttgctcgagatgctaaatttgcaccctgctgtcgtcaaggcctcacaagagatccacttctttgataacgacgagaattatggcaaggggatcgagtggtacaggaaaaagatgcccttctcctatccccaacagatcacaattgaaaagtctcccgcttacttcatcacagaggaagtacctgagagaatatacaagatgaacagcagtattaaattactcatcattgtgcgggagcctacaacacgcgccatcagtgactatacacaggtgctggagggaaaggaaaggaaaaataagacttattacaagtttgagaagctagcgatcgacccaaacacttgcgaagtgaacaccaaatataaggcagtgagaacttcaatctacactaaacatcttgagcgttggctcaaatattttccaattgagcagttccatgtggtggatggagaccgcctgatcacagaacccctgcccgagctacagctcgtagaaaaatttctgaacctgcccccaaggatatcccagtacaatctttactttaacgctacaagggggttttattgcctgcgatttaacataattttcaataaatgcctcgctggctccaaaggacgtatccacccggaggtggaccccagcgtgatcactaaactgagaaaattttttcatccattcaaccaaaagttttaccagattacagggagaactttaaactggccctag

SEQ ID NO: 119709 - DNA, 1041 bp, Artificial Sequence
  Description of Artificial Sequence: Synthetic coding sequence
atgctgtttaaacagcaggcctggttgcgccagaaactcctggtgctaggttcactggcggtcggtagcttgctttaccttgtcgcacgggttgggagcctagaccgactgcagcctatatgccccattgagggccgattagggggggccaggacccaggcagagtttccactgcgtgcgctgcagttcaaacgtggactgctgcatgagtttaggaaaggaaatgcttcaaaagaacaagtccggctgcatgacttagtgcagcagctgccaaaagccataatcatcggagtcagaaagggcgggacgcgagctctgctcgagatgctgaacctgcaccctgctgttgtaaaggcctcccaggagatccactttttcgataatgatgagaactacggcaagggaatcgagtggtaccgcaagaaaatgccttttagctacccacagcaaatcacaatagagaagtcgcccgcatacttcattacggaagaggtccctgaacgcatttacaagatgaattcttccattaagttattaattatcgtacgcgagccgactacgcgtgcaatttcagattacacacaggtactcgagggcaaggagagaaaaaacaagacctattataagtttgagaaactggctatcgaccctaatacctgcgaggtgaacacaaagtacaaagccgtgcggacctcaatctacacaaagcatttggagcgctggctgaagtattttcctatcgagcagttccatgtcgtcgatggggatcgcttaattaccgagcctctgcctgagctgcagttggtcgagaaatttctgaatcttccccctcgaattagtcagtacaatctttattttaatgccacacgcggcttctattgtttgcggttcaatataatattcaataaatgcctggccggttcaaaagggcgcattcacccagaagtggatccctccgtcatcactaagttgcggaagttcttccatccttttaatcaaaaattctaccagatcacgggtcgcactctgaattggccctag

SEQ ID NO: 119710 - DNA, 969 bp, Artificial Sequence
  Description of Artificial Sequence: Synthetic coding sequence
atgctctttataaagtttattcacctggaggtgtttagcatgcccgagcgggccatcgcccgtcacgaggtgagagagatagagcaacggcacaccatggacgggcctagacaggatgccacgctggacgaagaggaagacatggttattatctacaacagagtgcctaagacggcctctacatctttcacaaatattgcctatgacttatgcgctaagaataagtatcacgtcctgcatatcaatactaccaaaaataatcccgttatgagcctgcaggaccaggtcaggtttgtgaaaaacattacctcctggaaggagatgaaacccggcttctatcacggacacgtgtcatatctggattttgctaagttcggagtgaagaagaagccgatctatattaacgttattcgggatcccattgaacgactagtgtcttactactactttctgcgatttggagacgactaccgccccggtttgcgccgaaggaagcagggagataaaaaaaccttcgatgagtgcgtagctgaggggggctcagactgcgctcctgagaaactctggctacaaattccattcttctgtggacacagttcagagtgttggaatgtgggctcacgctgggctatggaccaggccaagtataatctgattaacgagtactttcttgttggggtgactgaggagcttgaagacttcatcatgctgctggaggctgcccttcccaggttcttccgaggcgccacagagctctatcggaccgccccggacaccgccaccccttcccatagacatggcccaatatgcggctccaagtcgattagctctttactggtcaaggtgtctcctgtctgtaaggactcccactgccactgcagacgtggaactggaactcccaagggcgagacccttgcaaccctggcgccatgcagccagtcttggagctcggtgacacaccgctggtag

SEQ ID NO: 119711 - DNA, 912 bp, Artificial Sequence
  Description of Artificial Sequence: Synthetic coding sequence
atgcttttcatcaaattcatccacctggaagtgttctcaatgcctgagagggccatcgctaggcacgaggtgagggagatagagcagcgccataccatggacgggccacgccaggatgctactctggatgaggaagaggatatggtgatcatctataatcgcgttccgaagaccgcgagtaccagcttcaccaatatcgcgtacgacctctgcgctaagaataagtatcatgttctgcatatcaataccacgaaaaataatccagttatgagtctgcaggaccaggtcaggttcgtcaaaaacataacgagttggaaggaaatgaaacctgggttctatcacggtcacgtcagttatctggacttcgccaaattcggcgtgaagaagaaacccatttacataaacgtgattagggaccctatcgagagactggtctcatattactacttcctgcggttcggcgacgactacagaccgggtcttcggcgtcggaagcaaggcgacaaaaaaactttcgatgaatgcgtggccgagggtggctccgattgcgcccctgaaaagctatggctgcagatcccatttttttgcgggcattcctcagaatgttggaatgtcggttctcggtgggcaatggaccaggcaaaatacaatttaatcaacgagtatttcctggtgggcgtgaccgaagaacttgaggacttcatcatgctgctagaagccgccctgcccagattcttccgtggcgccaccgagttgtaccgcacagcacctgacaccgccactcctagtcatcggcatggtccaatctgtggaagcaagagcatctcttccctgctggtgaaggtgtccccagtatgtaaagattcacactgtctgggtaaatgctcaaggaatggcttgtccgctgtctag

SEQ ID NO: 119712 - DNA, 1071 bp, Artificial Sequence
  Description of Artificial Sequence: Synthetic coding sequence
atgggtctgctgaggatcatgatgcctcctaaactgcagcttctcgctgtggttgctttcgcggtcgccatgttatttcttgaaaatcagattcagaagctcgaagagagtcgctctaaactcgagcgggcaattgcgcgccacgaggtgcgcgaaatcgaacagcgccacaccatggacgggccaaggcaggatgccaccctggatgaggaagaagatatggtcattatctataaccgggttcccaaaacagcgtcgaccagtttcaccaatatcgcctatgacctctgcgctaagaataaataccatgtgctgcatattaacacaaccaaaaataatcctgtgatgagtctccaagatcaggtcagattcgtgaaaaatataacctcctggaaagaaatgaagcctggattttaccacggccacgtgagctacttggatttcgccaagtttggtgtgaaaaaaaagcccatctacattaatgttatacgggatccaatagagcgcctggtgtcctactattacttcctcagatttggggatgattacagaccagggcttcggcgtagaaagcagggggataagaagactttcgacgagtgtgtcgccgaaggcggctcagattgtgcccccgagaaactctggttacaaattccattcttctgcggccattcatctgaatgctggaacgtgggtagtcgttgggccatggaccaggccaaatataatctgattaatgagtacttcttagtgggggtgacggaagaactcgaagactttatcatgcttctagaagcagccctcccgcgctttttcagaggggctactgaactgtacagaactggcaagaaaagccaccttcgcaaaacaacagagaaaaaactgcctactaagcaaactattgccaagctgcagcaatccgatatttggaagatggaaaatgagttttacgaatttgccctggagcagtttcagtttatcagagctcatgccgtccgcgagaaagatggcgacctttatatcctcgcccaaaatttcttctatgaaaagatctaccccaagtcgaattag

SEQ ID NO: 119713 - DNA, 690 bp, Artificial Sequence
  Description of Artificial Sequence: Synthetic coding sequence
atgggactgcttaggattatgatgccaccgaaactccagctgctggctgtggtggccttcgccgtagccatgttatttctggaaaaccaaatccagaagctggaggagtcgcgcagcaagctggagagggccattgcgcgacacgaagtaagagagattgagcagaggcatactatggacggccctagacaggatgcgaccctggatgaggaggaagacatggttatcatttacaatcgagtcccgaaaacagcgtctacctcatttactaacatcgcctatgacctgtgcgcgaaaaataaatatcatgtgcttcacataaacacgacaaagaacaacccagtcatgtctctccaggaccaggtccgttttgttaagaacatcactagttggaaggagatgaaacccggcttttatcatggccatgtgtcatatctggacttcgccaagttcggcgtcaagaagaaacctatatacatcaatgtgatccgcgatcctatcgagcgtctggtatcgtactattacttcctaagattcggcgacgattacaggcctggcctaagacgcagaaagcagggcgataaaaagactttcgatgagtgtgtggctgaaggtgggtcagactgcgcccctgagaaactgtggttacagattccattcttttgtggccattccagcgagtgctggtag

SEQ ID NO: 119714 - DNA, 1236 bp, Artificial Sequence
  Description of Artificial Sequence: Synthetic coding sequence
atgcggcgtcgaagagctggcgggagaacgatggtcgaacgagcctcaaaatttgttctcgttgtggctgggtctgtgtgcttcatgctgatcctgtaccaatatgcaggccctggactgagcctaggcgcgcctgggggacgagccccaccggacgatctggacctatttcctactcctgacccacactacgagaagaagtactactttcctgtccgtgagctggagagatcacttcgcttcgacatgaaaggggacgacgtaatcgtattcctgcacatccagaaaacaggcgggaccacattcggaagacacctagtgcagaatgtcaggttagaggtgccatgcgattgtaggccaggccaaaaaaaatgcacctgctacaggccaaatcgacgggagacgtggctgttctcaaggttcagcacgggatggagttgcggattacatgcagattggacagaattgactaactgcgtgcctggggtgctggaccgccgggacagcgccgctctacgcaccccccgtaagttttactatataaccctgttgcgcgaccccgtgtcaagatacctgagcgaatggcggcatgttcagcgcggggctacttggaaaacaagcctgcatatgtgtgacgggaggacgcccacaccggaagagcttcctccatgttacgaagggaccgactggagcggctgcactttgcaggaatttatggattgcccttacaatttggccaacaatcggcaggtgagaatgctcgcagatctgtcactggttggttgctacaatctgagctttatccccgaggggaaaagagcccagttgctgctcgagtccgcaaaaaagaacctgagaggaatggccttcttcggcctgactgaatttcagcggaagacccagtatctgtttgaacggacattcaacctcaaatttattaggccatttatgcagtacaactccacaagagctggcggggtggaggtggacgaggatacaatccgaaggatcgaagagttgaacgatctggacatgcagctgtacgactacgccaaagacctcttccagcagaggtaccagtataagcgccaactggagcgaagagagcagcggctgagaagccgggaagaacgtttattacaccgcgcgaaggaagctctgcctcgcgaggacgccgacgagccaggcagagtccccaccgaggattatatgagtcacatcatcgaaaaatggtag

SEQ ID NO: 119715 - DNA, 831 bp, Artificial Sequence
  Description of Artificial Sequence: Synthetic coding sequence
atgctcttcctgtttgccgtgatcgtactacagtacgtgtgtcctggaactgagtgccaactactccggttgcaagccttctcgtccccagttcccgatccataccgaagcgaagacgagtcatcagcgcggtttgtgccaaggtacaatttcaccaggggcgacctgctccgaaaagtcgattttgacattaaaggcgatgatcttatagtgttcctgcatattcaaaagaccggagggacaaccttcggtagacacctggtgcgcaacattcagctcgagcagccatgcgaatgccgcgttggtcagaagaagtgcacctgtcaccgacctgggaagcgggagacctggctcttctctaggttctcgaccgggtggtcctgtggccttcacgcagactggactgagctgactagttgtgtgccatctgttgttgacggtaaaagggacgccaggcttcgcccgtcccgctggcgaatattccagattctggacgccgcgtctaaggataagaggggttcaccgaacactaacgctggagcgaattccccatcaagtaccaagactcgcaataccagtaaatcagggaaaaattttcattatataactattctgagagatcctgtatccagatatctgtctgaatggcggcatgtccagaggggcgctacctggaaggccagtctgcatgtgtgcgacggcagaccccctacatccgaagaactcccgtcctgctatacaggggatgactggagtggatgccctcttaaggagttcatggattgcccctataacctggctaacaaccggtgtgcctgcagccccacttag

SEQ ID NO: 119716 - DNA, 1389 bp, Artificial Sequence
  Description of Artificial Sequence: Synthetic coding sequence
atggacgagaagtcaaataagctactgctggctctggtcatgttgttcttgtttgcggtgattgtactacaatatgtgtgtccggggactgagtgccagcttctgcggctgcaagcatttagctctccggtgcctgatccgtacaggtcagaagacgagagctccgcaagattcgtgcccaggtataattttaccaggggggacctgttaaggaaagtagactttgacataaagggagatgacctgatcgtgttcctgcacatccagaagaccggcgggaccaccttcggtcgacacctcgtgcgtaatattcagttagaacagccttgcgagtgccgcgtgggacagaagaagtgcacttgtcacagaccaggcaagcgggaaacgtggctctttagccgattttcaacaggatggtcctgcggcttacatgcagattggaccgagctcaccagctgcgtcccttctgtggtggacggaaagagggacgcacgtcttcgcccttctcgctggaggattttccagatactagatgcggcatctaaggacaagcgtgggtctcctaataccaacgccggcgcgaactcgccctcctccaccaaaacaagaaacacaagcaagtcgggcaaaaacttccactacatcacaattctgagagaccccgtctctcgctacctcagcgagtggcgtcacgtgcagaggggggccacatggaaagcctcgctgcacgtctgtgacgggcggcctccgacatctgaagagcttccgtcgtgttatactggcgacgattggagcggatgcccgctgaaggagtttatggactgtccctataacctggcaaataacagacaagtgcgaatgttgtccgatttgactctcgtcggctgctataatctgtctgtgatgcccgaaaaacagcgaaataaggtgctacttgaatccgcaaaaagcaacctaaagcatatggctttcttcggtctcacggaattccagcggaagacccaatacctgtttgagaagacatttaatatgaattttatatccccgtttacccaatacaacacaacccgggcgtcgagtgtagagattaatgaagagattcagaaacgtattgaggggctcaacttccttgatatggaactttacagctacgctaaggatcttttccttcagcgctatcagtttatgcggcaaaaggaacatcaggaagcgagacgcaaaagacaagaacagcgtaaattcttaaagggacggctgctccaaacgcattttcagagtcagggacaagggcagtcccagaatcctaaccagaaccaaagcaaggagcagaatgacaacacgagcaacggtaccaatgactacatagggagtgtggaaaagtggcgctag

SEQ ID NO: 119717 - DNA, 1818 bp, Artificial Sequence
  Description of Artificial Sequence: Synthetic coding sequence
atggctctgccagcctgtgccgtaagggagtttgagccaccccgccagcctgaacgcggggctcctgtgagaactacctgtcctagacggcattcacgggttgaggccgagttagctgctagccgtcccggatccgtggctgctagtgtccgcgctggaccgccacggggagtcagccacgggttccataccagacccttactcgataaacccaggaaagccagcagctctcttgccggcgcggcatgtgcgccgctgtttgcactgttatccagaggcaggcgccgccgaatgcatgtgctgcgacggcgttgggatctgggttccctctgccgtgcactgctgacgcgcggcctggccgcactgggtcacagtctgaagcacgtccttggcgccatattctccaagattttcggcccaatggcctctgttggcaacatggacgaaaagtctaacaaactgctattagccctggtcatgttgtttttgttcgctgtcatcgtcttgcagtatgtctgccccggaactgagtgccagctcttgcgactacaggctttcagtagtcctgtgccagacccataccggagcgaggatgagagttcagctagatttgtgcccagatacaactttacacgcggtgatctgctgaggaaagtagacttcgacattaagggtgacgacctcattgtctttctgcacatacaaaagacgggaggtacaacatttggcaggcaccttgttaggaatattcagctggagcagccatgtgaatgtagagtgggacagaaaaaatgcacgtgccatcggcctggaaagagagagacctggctgttttctcgattctcaactgggtggagttgcgggttgcacgccgactggacagagcttacatcctgcgttccatccgtagtagatggcaagcgcgacgcacgactgaggcccagccggaactttcattatattactatcttaagggacccggtgtcaaggtatctctccgagtggcgacatgtgcagagaggcgcgacctggaaagccagcttacatgtctgtgacggacgacctccaacttcggaggagcttcccagctgttatacaggtgatgactggagcggatgcccgttaaaggagttcatggactgtccttataatctggccaataataggcaggtgcgtatgctttcagacctgacactcgtgggatgctataatctctctgtgatgcccgagaagcaacgaaacaaagtactgctggagtcggccaagagcaatcttaaacacatggccttcttcggactgaccgagtttcaaagaaagactcagtacctctttgaaaagaccttcaacatgaatttcatctctcccttcactcaatacaacactacacgcgctagttccgtagagatcaacgaggaaatccaaaaacggattgaggggttgaatttcctcgacatggaactgtactcttacgcaaaagatctgtttcttcagcgctaccagtttatgcggcagaaagaacaccaggaagcaagaagaaagaggcaggagcagaggaaatttttgaaggggcggctgcttcaaactcactttcagagccaaggccagggccaatcgcagaaccccaaccaaaaccagagccaaaatccaaatcctaacgcaaaccaaaatctcacacagaaccttatgcagaaccttacccaaagtctctcccagaaggagaacagggagagcccaaaacaaaacagcggcaaggagcagaacgacaacacctcaaacggcaccaacgactatatcggttccgtagagaaatggaggtag

SEQ ID NO: 119718 - DNA, 1380 bp, Artificial Sequence
  Description of Artificial Sequence: Synthetic coding sequence
atggacgagaagagtaacaagcttttgctggccttggtcatgctctttctctttgctgtgattgtgctgcagtacgtgtgcccgggcactgagtgccagttgctccggttgcaagcctttagctcaccagttcctgacccctatcgtagcgaagacgaaagttcagcaaggtttgtccctaggtacaactttaccaggggcgacttgctccgcaaagtagactttgacataaaaggcgatgatcttattgtattccttcacattcaaaagacgggaggaacaacgttcggcaggcatctggtcagaaatattcagctggagcagccatgcgaatgtagggttgggcaaaaaaaatgcacctgtcaccgacccggtaagcgggaaacttggctttttagccgatttagtacgggttggtcctgcggattacatgctgactggacggaacttacatcatgcgtcccatctgttgtcgatggaaaacgggacgctagactccggccctcccgaaactttcattatattaccattttgagagaccccgttagccgttatttgagcgaatggcggcacgtgcaacgaggtgcaacgtggaaagcaagtctgcacgtttgcgatggtagacctcctacgtctgaagagctgcccagttgttacacaggcgatgattggtccggatgtcctctgaaggagtttatggattgcccctataacctggcgaataatcgtcaggtccggatgctgtctgatcttacactggtaggctgctacaacctttctgtaatgcctgaaaaacagcgcaacaaggttcttctggagtccgccaagtccaatctcaagcacatggctttttttggcctgactgagtttcagcgcaagactcagtatctttttgaaaaaaccttcaacatgaattttatttcccccttcacccagtacaacacaaccagggcaagtagcgttgaaattaacgaggaaatccaaaaaaggattgagggcctaaatttccttgacatggagctgtactcctacgctaaggacctcttcttgcagagataccagtttatgaggcagaaagagcatcaagaggctcgtcgcaagaggcaggagcagaggaagttccttaaagggaggctgctccagacccactttcaatctcaaggccagggccagagtcaaaaccccaaccagaaccagtcacagaacccaaaccctaacgcaaatcagaatctgacccaaaaccttatgcaaaatttgacacaatccttaagccagaaggaaaacagagaaagtcccaagcaaaatagcggcaaggagcagaatgataacacatcaaatggcacgaacgattatataggcagcgtggaaaaatggcgttag

SEQ ID NO: 119719 - DNA, 996 bp, Artificial Sequence
  Description of Artificial Sequence: Synthetic coding sequence
atgctgttgaagcacaacggaaaactgctgctcttctatctcctgtcttaccaagcactcgcctctgattggttttattgcagttttaatcgatggcggattttccagatattagacgctgcccgcaactttcactacatcacgatactgcgcgaccctgtttcaaggtatttgagcgagtggcgtcacgtccaaaggggtgctacctggaaggcgtctctacacgtatgtgatggccgacctcccaccagtgaagaacttccgtcttgctacacgggcgatgattggtccggttgtccattgaaggagtttatggattgcccttataatttggccaataacaggcaggttcgaatgctgagcgatctcactttagtcggctgctataatttgtcagtgatgcccgagaaacaacgcaataaggttcttttggagtctgctaagtctaacctgaaacatatggcctttttcgggttgaccgagtttcaaaggaagactcagtatctcttcgaaaaaacatttaacatgaacttcatttcacccttcacccagtacaacaccacccgggcttcaagcgttgagatcaacgaggagattcagaagcggatcgaaggtttgaattttctggacatggaactgtactcttatgccaaggatctattcctccagagataccaatttatgcggcagaaggagcatcaggaagccaggaggaagaggcaggaacagcgcaaatttctgaaagggaggctcttgcagacccactttcagagccagggccaggggcagtctcagaatcctaatcagaaccagtcccaaaaccccaacccaaacgcgaatcaaaatctgactcaaaatctgatgcagaatctcacgcagtctctgtcacagaaagagaatagggaatcaccaaaacagaacagcggcaaggagcagaatgacaacacaagcaatggaaccaacgactacatcggtagtgttgaaaagtggagatag

SEQ ID NO: 119720 - DNA, 1938 bp, Artificial Sequence
  Description of Artificial Sequence: Synthetic coding sequence
atggctctgcctgcatgtgctgttcgggaattcgagccccctcgacagcccgagaggggggcgccagtcaggacgacgtgcccacgacgtcactctagggtagaggcagagctggcagcctcccgacccggctctgtcgccgcctcagttcgcgccggcccccctcggggggtatcccatgggttccacacccggcccttgttggacaaacctcgtaaggcttcgtcatcgctggctggcgccgcgtgtgcacctttgttcgctctgctatctcgcggcaggcggcgtcgtatgcacgtgcttcggagacgatgggatctgggaagcctatgccgcgctctcctgaccagaggactggcagccctcggacacagccttaagcacgtcctcggggccatttttagtaagatcttcggcccaatggccagcgtggggaatatggatgaaaagagcaataagcttctgttagctctggttatgctgtttttattcgccgtgattgtattgcagtatgtgtgcccagggactgagtgtcagctgctgaggctccaggcattctctagcccagtgcctgacccttatcgctccgaggacgagtccagcgcaaggttcgtgccgaggtacaactttactcgaggcgatttactcaggaaggtggacttcgatattaagggagatgatctgatcgtttttctgcacattcagaagactggcggcactacctttggcagacatctggtgcggaacatacagctggaacagccatgtgagtgccgagtgggccagaagaagtgcacttgccataggcctggaaagcgggagacatggctctttagtagattcagtacaggctggagttgtggcctgcatgcagactggaccgagctaaccagctgcgttccctccgtggtcgatggtaagagagacgccaggctgcgcccgtccagatggaggatcttccaaatccttgatgcagcctctaaagataaacggggtagcccgaacacgaatgccggcgcaaattcaccttccagcacaaagacaagaaacacctccaagagtggcaagaattttcactatattaccattttgagagaccctgtgagtcgctatctgagtgagtggagacacgttcagcggggtgctacgtggaaagccagcctccacgtttgtgacggcaggccaccgacttctgaagaacttccctcatgctacacaggcgatgattggagtggctgtcctctgaaagagttcatggactgcccctataatcttgccaacaaccggcaggtgagaatgctcagtgacctgactttagtcggatgctataatttatccgtcatgccagaaaagcaaaggaacaaagtcctgctggaatcagcgaagagcaacctgaagcacatggcctttttcgggctgaccgagtttcaaaggaaaactcagtatctattcgagaaaacgtttaatatgaactttatcagcccttttacccagtacaatactactcgtgccagttccgtcgagatcaacgaggaaatccagaagaggattgaggggctcaatttcctggatatggagttgtattcctatgccaaagacctctttctgcagcgctatcagttcatgagacagaaagaacaccaggaagcgcgtaggaagcgacaggagcaaaggaaattcttgaaaggaagactcctccagacgcacttccagagtcagggtcaaggtcagtctcaaaatcctaaccagaatcaatcccagaaccctaatccgaacgccaaccagaatcttacgcaaaatctaatgcagaatcttactcagagcctcagccagaaagaaaacagagagtctcccaaacaaaattctggcaaagaacagaatgataacacctccaatggtaccaatgactatatcggctcagtagaaaaatggcgctag

SEQ ID NO: 119721 - DNA, 1416 bp, Artificial Sequence
  Description of Artificial Sequence: Synthetic coding sequence
atggacgagaggtttaataaatggctcctcacgccggtactgaccttgctgtttgtggtgatcatgtatcagtacgtgtccccttcctgtacctcaagctgcactaacttcggagaacagcctagagctggcgaagctgggccacccgcggtgccaggccccgctcgacgggcacaagccccacccgaagaatgggaaaggaggccgcagctgccgccgccaccccgaggacctccagagggccccagaggggctgcggctccagaggaagaggacgaggagcccggcgaccctcgggagggagaagaagaggaggaagaggacgagccagatccggaagcccccgagaatggttccctcccaagatttgtccctcgtttcaatttctcacttaaagatcttacaaggttcgttgacttcaatatcaaaggccgggacgttatcgtgttcttgcacatccagaaaactggaggaacaaccttcgggcgccacctcgtgaagaatatacggctggaacagccgtgttcctgcaaggcgggtcagaagaagtgtacctgccaccggccaggcaaaaaggaaacatggctgttcagccgattttcaactggttggtcatgcggattgcacgccgattggacggagctcacaaattgcgtgcctgctataatggaaaagaaggactgccctcgcaaccatagtcatactcgaaatttctactatattaccatgcttagagatcctgtctctagatatttaagtgaatggaagcacgttcaacgtggcgccacgtggaaaactagcctgcacatgtgtgatggacggtcccccactccggatgaactaccaacatgttaccctggggatgactggagtggggttagcctccgggagttcatggattgcacttacaatttagccaacaacagacaagtgcgcatgctcgccgacttgagcctggtcggctgctataatctcacgttcatgaacgaaagcgaacgcaataccatcttactgcagtctgccaagaacaatctcaaaaacatggccttctttgggcttaccgagtttcagcgaaaaacccaatttctgtttgaaagaacattcaacttgaagttcataagcccttttactcagttcaacattactcgggcgtcgaatgtggaaattaatgagggcgcccgtcaaagaattgaggacctcaacttcttggacatgcagctgtatgagtatgctaaggacctgttccagcaaagataccatcataccaagcagcttgagcaccagagggatcggcagaaaagacgggaggaacgtcgacttcagcgagaacaccgagaccaccagtggcctaaggaggacggcgctgctgaggggaccgtgaccgaagattataactcacaggtggtgcgctggtag

SEQ ID NO: 119722 - DNA, 543 bp, Artificial Sequence
  Description of Artificial Sequence: Synthetic coding sequence
taagcacagactccaccgccccccccggcagccgtggcagtggccgtcacccccgtaccccaatttccccgagcatgcacagaagctgagtttgcctgtcatagttacaatgaatgcgttgcactagagtatcgctgtgaccgccgacctgactgtcgagacatgagtgacgagttgaattgcgaagagccggtgctaggaatcagtcccacattcagtctgctggtggagaccacatcactcccgccccgaccagagactaccatcatgagacagccccctgtaacccacgctccccagccactcctccccggtagcgtgagacccctaccatgtgggccccaggaagcggcttgcagaaacgggcactgcatccctagggactacctctgcgacggtcaggaggactgcgaagatggctctgatgagctagactgcggccctccgcctccttgtgagccaaacgagttcccatgcggaaatgggcactgtgctttgaagctttggagatgtgatggtgatttcgattgtgaggatcgatag

SEQ ID NO: 119723 - DNA, 285 bp, Artificial Sequence
  Description of Artificial Sequence: Synthetic coding sequence
tgaggacacccacatagcccctcatccggtgcggcgtgggcagccgccttcctcggagggcggcctcccggaacatcatgctgtaccctgtccgtgcaacccctccgcacccaggccgccacagctgcaggatcacccacaaggtgggcacagcctcggcctctgccttcgtgttccagcaagaatcctgaactaggaccggaactacctcgtgatgtgtatatgccaggaccctggactctgggtgaaggccccggccagtgtcccgcggggtacccccgctag

SEQ ID NO: 119724 - DNA, 13176 bp, Artificial Sequence
  Description of Artificial Sequence: Synthetic coding sequence
atggggtggcgagctgctggggcattactcctagccctgctcctgcacgggaggcttctagccgttacacacgggcttcgggcctatgacggcctcagtctgcccgaagatattgagacagtcactgcctctcaaatgcgctggacccactcctatctcagtgacgacgaggacatgctggcggattccatcagtggagatgacctggggagcggggatctcgggtccggagattttcagatggtgtattttcgagcattagtgaactttacgagaagcatagaatattccccccagctcgaagacgctggctcaagagagtttagagaggttagcgaggcagtggtggacactttggaatccgagtacttgaaaattcccggtgaccaggtagtgtctgtggtgtttataaaggagcttgatggatgggtgttcgtggaattggatgttggaagcgaggggaatgccgatggcgcccaaatccaggaaatgctgctgcgcgttatcagttccggaagcgtggcgtcgtacgtcaccagcccgcagggttttcagtttaggagactcggcaccgttccgcagtttccacgcgcctgtaccgaggccgaattcgcgtgtcacagttataacgagtgtgtggcactggagtacagatgtgatcggcgtcccgactgtagggatatgtccgatgagcttaattgtgaggagcccgtgttggggatttcccccactttttccttactggtggagacgacctctttgccgccccggccggaaacaaccattatgagacaaccccccgttactcacgctccacagcccctgttgcctggcagcgttaggcccctcccatgtggcccccaggaggccgcctgcaggaatggtcattgcatccccagggactatctgtgcgacggccaggaggactgcgaggatggatcagacgagttagactgcgggccccctccaccgtgcgagccaaacgaattcccttgcggcaatgggcattgtgcgctgaaactgtggcgttgtgacggtgacttcgattgtgaagatagaactgatgaggcaaactgccccaccaagaggccagaagaagtctgcggtcctacacagttccgctgtgtttctactaacatgtgtatcccagcatcgttccattgtgatgaagagagcgattgtcccgatcggtctgacgagttcggctgcatgcctccccaagtagttaccccaccacgcgaaagcatacaggccagccgcggccagaccgtgacttttacgtgcgtggcgatcggagtacccacacctataattaactggcgactgaattggggtcatattcctagccatcctagggtgacagtcacttcagaggggggacggggtaccctgataatacgggacgttaaagagtctgatcaaggcgcgtatacttgcgaggcgatgaatgcacgagggatggtgttcggaattcctgacggagtgctggaacttgtcccgcagcgtggtccctgtcctgatggtcatttttatttggaacactcagctgcgtgtctgccatgtttttgcttcggcatcacatctgtctgtcagtccacacggaggttcagagatcagatcaggcttcgttttgaccaaccggacgacttcaaaggcgtcaacgtaacaatgcccgcccagccaggcacaccaccacttagttctacccagctccagatagatccgagtctgcatgagtttcaactggttgacctcagccggcgttttctggtgcacgattcgttttgggctctacctgagcagtttttgggaaacaaggttgattcatatggtgggtccctgcgctataacgtgaggtatgagttggccaggggcatgttggagcctgtgcagaggcccgacgtggtgctgatgggggcaggttaccgtctgctatctaggggtcacacgccgacacagccgggcgctctcaaccagcgccaggtacaattttccgaagagcactgggtgcacgagagtgggagacctgtccagcgtgccgagctgttacaggtccttcagtccttggaggccgttctcatccagactgtatacaataccaaaatggcctcagtaggactctccgatatcgcaatggatactacagtcacacacgcaacttctcacggccgggcccattctgttgaagaatgtagatgcccaatcgggtactccggcctttcttgcgaatcatgcgacgcgcactttacacgcgtgccagggggcccatacctcggcacatgtagcgggtgcaactgcaacggacacgccagctcatgtgatcctgtgtatggccactgtctgaattgtcagcataacaccgaggggccacagtgtaacaaatgtaaggccggctttttcggcgatgcaatgaaggctacagccacaagctgcaggccctgtccatgcccttatatcgacgcctcacgaagattctctgacacttgttttcttgacacagacggccaggcgacctgcgatgcctgcgccccgggctacacaggccgtcgctgcgaaagctgcgcaccaggatacgaaggtaatcccatacagccaggcggcaaatgccgtccagtgaatcaggagatcgtgagatgtgacgaaagaggatccatgggcaccagtggagaagcttgccgttgcaaaaataacgtggtgggccgcctgtgtaacgagtgtgcggacggatcctttcatctctcaactcgtaaccccgatggatgtcttaagtgtttttgcatgggagtgtctagacattgcacttcctcctcttggtcccgcgctcagctgcacggggcttctgaggagcctggccatttctccctgaccaacgctgccagcacccacaccacgaacgagggcatcttctctcccaccccgggagagctgggattttcttcctttcaccgcctactgtccggtccctacttttggtcgctgccatcacggttcctcggggataaagtgactagctacggtggtgaacttcggttcaccgttacccagagatctcaacccggcagcacccccctgcatggccagcctctcgtcgttctccagggcaataacattatcttggaacatcatgtagcacaagagccatcacccggccagccttccacattcatcgtcccattccgggagcaggcctggcaacgacccgacgggcaacccgcaacaagagagcacttgctcatggcattggccggtattgacacacttctgataagagcatcttacgctcaacagccagcagagtcacgagtgagcggtattagcatggacgtggcagttccagaggaaactgggcaggatcccgcactggaggtcgaacagtgctcgtgtccccccggctaccgcggaccttcctgccaggactgcgacacaggttacacccgtactccaagtggattgtacttgggcacgtgcgagagatgcagctgccatgggcactccgaggcatgcgaacccgagaccggtgcttgtcagggttgccagcatcatactgaaggccctagatgcgagcaatgtcagccgggctactacggagatgcccagaggggtactccacaggattgtcagctctgcccatgttacggcgatcccgctgctggacaggctgctcacacctgttttctggatacggacggtcatcccacctgcgacgcctgctcccccgggcactcaggacgtcattgcgagaggtgcgctccagggtactacgggaacccttctcagggacaaccctgccaaagagacagccaggtgccagggccaattggctgtaactgtgatccgcagggtagcgtctcttctcagtgtgatgcagctggccagtgccagtgcaaagcacaggttgagggcctcacctgcagccattgtaggccccatcattttcacctgtctgcaagcaatcccgacggctgccttccttgtttttgcatgggtatcacgcagcagtgcgcgagtagcgcctatacccgccacctgattagtacgcactttgccccaggtgattttcaaggattcgccctagttaacccccagcgcaactcccgtctgaccggcgagttcacggtggaaccagtgcctgagggggcgcagctgtcgtttgggaactttgcgcaacttggccatgaatctttctactggcagcttcccgagacctatcagggggataaggtcgcggcatacggcggcaaacttcgttacactctgagctatacagcagggccacaaggttcgcctctcagcgatcccgacgtccagatcaccggaaacaacattatgctggtagcgagtcagccagcgctgcaggggccagagaggcgaagttatgagattatgtttcgggaagagttctggaggcgtcccgatggacagcccgcaacaagggagcacctcctcatggccctggctgacctggacgaacttttgataagggccacattcagtagtgtgcctctcgccgcatccatttcggccgtgtctcttgaggttgcccagcctggcccatccaatcgccccagagccctggaggtggaagaatgcaggtgccctccaggctacattgggttatcctgccaggactgcgctcccggttacactcggaccggtagcggactatatcttggacactgtgagctatgtgagtgcaacggacacagcgacctgtgccaccctgagaccggcgcctgtagccagtgccaacataacgccgcgggagagttctgtgagctctgcgctccagggtactacggtgacgccactgccgggacccccgaggattgtcaaccttgtgcttgcccactgaccaatcctgagaatatgttcagtcgtacatgtgaatccttgggcgccgggggctaccgatgtacggcctgcgaaccaggatacacagggcagtactgtgaacagtgtggaccaggctatgtgggtaatccctctgttcagggcggtcagtgcctgcccgagactaaccaggcaccgttagtggttgaagtccacccagccagaagcattgtgccccagggcgggtcccatagcctccgctgccaggtttctggctcacccccacactatttctactggtcccgggaggacggccggcctgtacctagcgggacacagcaacgacaccaaggctccgaactgcatttcccgtcagtacagccaagtgatgctggagtgtacatatgcacttgcagaaatctccaccagtctaacacgagtcgggccgaacttctggtgactgaggccccaagtaaaccaataacagtgacagtggaagagcagcgttcccagtcagttcgccccggcgcagatgttacctttatttgtacagcaaaatctaaaagtcctgcttacacactggtctggacaaggttgcacaacgggaaactccccactcgggccatggatttcaacggcattctgacaatccggaatgtacaactcagcgacgcggggacctacgtgtgcaccggcagtaacatgtttgccatggaccagggtacagccacactgcacgtgcaagccagcggcacacttagcgcccccgtggtgtctattcaccctccacagctgaccgtccaaccaggacagctcgcagaatttcgatgctctgccactggttccccaacccctactctcgagtggacagggggtccagggggacagctaccggccaaggcccagatccatggcggcatcctccgcctaccggccgtggaaccgacagaccaggctcagtacctgtgccgtgcgcattcttcagccggccagcaggttgccagggcagtgctccatgttcacggcggcggcggacccagagttcaggtctcgcccgaacgcactcaagtgcacgccggtcgaacggtgcgtctctactgccgggctgccggggtccccagtgccactattacgtggagaaaggaaggtggcagcctgccacctcaggcgcggagcgaacggaccgatatagctactctgctgattccggccatcaccacagctgacgccgggttctatctctgtgtggcaaccagcccagccggtactgcgcaagctcgcatccaggtcgttgtgctgtcggcttccgacgcctcccctccacccgttaagatagaatcttcctccccttccgtcaccgaggggcagacactggatctgaattgcgtcgttgccggctccgcccacgctcaggtgacttggtatcgtcggggaggtagtctgcccccgcacacccaggtgcatggatccaggctcagactcccacaagtgtccccggctgatagtggggaatatgtatgtcgagttgaaaacggcagcgggcctaaagaggcatcaatcactgtgagcgtgctgcacggtacacacagtggacccagttacacccccgtacccggctctactaggcccatacgcattgagccatctagcagccacgtagcagaaggccaaacgctagacctcaactgtgtggtacccggccaagcgcatgcgcaggtgacttggcacaagaggggaggatcactaccggcgagacatcagacccacgggagcttgttacgtcttcatcaggtcactcccgccgacagcggcgagtacgtctgtcacgttgttggaacatcaggtccactcgaagcttccgtgcttgtcaccatcgaggcatccgtgatccccgggcctatcccacccgtacgtatcgaatcttcttcctctacggttgctgaaggacaaacattagacctgtcatgtgtcgttgccgggcaggctcatgcacaggtgacatggtataagaggggtggaagccttcctgcacggcaccaggtcagaggttcccggctttatatattccaagcttccccagcagatgctggacagtacgtctgccgcgcctcgaatgggatggaagcgtcaattaccgtgactgtgactggcacccagggcgcgaatctagcctaccccgctggctctacgcagcctataaggatagaaccatctagctctcaagtcgctgagggacaaactttagatcttaactgcgtggttccagggcagtcccacgcacaggttacctggcacaaaagaggcgggtctctgccagtgagacaccaaactcatggatccctcctgagattgtaccaagcatccccagccgacagcggcgagtacgtctgtcgagtgctcggcagtagtgtgcccctggaggcctcggtgctggtaactatcgaaccagcggggtcagtccccgcgctgggagtgacacccaccgtacggatagagagctcatctagccaggtggcggagggtcagacattggatctaaactgtttagttgcggggcaggcccatgcacaggtgacatggcacaagaggggtggctctctcccggcacgacatcaagttcacgggtcccgcctgagactcctgcaagtgaccccagcagactctggcgagtacgtttgcagagttgtgggctcatcaggcacccaggaagcatctgtgctggtgacaatccagcagcgcctttccggttcccattcccagggagtagcctatccagttagaattgagtccagctcagctagccttgctaacggtcatactttggatctaaactgcctggtggcatcccaagccccacacactattacatggtacaagcgcggaggcagcttgccctcgcggcatcagatcgtaggttcacggctgagaattccacaggttactcccgctgattccggggaatatgtttgtcatgttagtaacggggccggaagtagagaaacaagtcttattgtaacaattcagggcagcgggtcgtctcacgtcccatcggtcagtccaccgattcgaattgaatcctcatcccccactgtggtagaggggcagacactggatctgaattgtgtggtggctagacagccgcaggcaatcattacgtggtacaagagaggcgggagcctgccttcacgacatcagactcacgggtctcatttaagacttcaccagatgtccgttgctgacagcggagagtacgtgtgccgggctaataataacatcgacgctctcgaggcttctatcgtgatctcagtgagcccctccgccggaagcccttctgccccaggaagttcaatgcccatacggatagagtcctcttcaagccacgtggcagaaggggagaccttggatctgaactgtgtagttccgggtcaggctcacgcccaggtgacgtggcataagagaggcggaagcctcccatcccatcatcagactcggggatcaagactgcgactccaccacgtctcgcccgcggattctggcgagtatgtgtgtagagtgatggggtcatccggtcctctggaagcgtccgttctggtgaccatagaggcctcaggctcatcggcggtgcatgtgcccgcacccggaggggccccacccattaggattgagcctagcagctcccgcgttgcagagggacagacacttgatttgaaatgtgtcgtgccaggacaagcccatgctcaggttacctggcataaacggggcggaaatctccctgccaggcaccaggttcacggacctctcctgcgcctgaatcaggtgtcccccgctgattctggtgaatactcatgtcaggtcacaggatctagcggaaccctcgaggctagcgtgctggtaacgatcgaacccagctcccctgggcctattccggcacccggactggcacagccgatctacattgaggcctcctctagccacgttactgagggccagacgttagatcttaactgtgttgtgcccggtcaggctcatgcgcaggtgacatggtataagagagggggctccctgcctgccaggcaccaaacacatggcagtcaactccggctgcacttagtgagcccggccgacagcggggagtacgtgtgccgggcagcgtcgggcccaggccctgagcaggaggcttccttcactgtaaccgtccccccatctgagggtagctcttaccgactgcgctctcccgtgatttcaattgaccctccttcttctacagtgcagcagggccaggacgcctccttcaaatgccttatacacgatggtgccgctccaatttctctggagtggaagacaagaaaccaagaactggaagacaatgtgcatatctcaccaaatggttccatcataacaattgtgggaacccgccctagcaaccatggaacatataggtgcgtcgcctccaatgcgtacggggtcgcccagtctgtcgtgaacctctccgtgcatggtcccccgaccgtgagtgtgcttcctgaaggcccagtgtgggttaaggtgggcaaggccgtgacattagagtgtgtgtccgctggcgagcccagaagttcagctagatggaccagaatatcatccacaccggcaaagttggaacaaaggacttatggacttatggacagccacgccgtgcttcagatctcttctgcaaagcctagtgacgcaggcacttatgtgtgtctggcccagaatgccctaggcacggcccaaaagcaggtcgaagtaatcgtggataccggagcaatggcccccggggctccgcaggttcaagcagaagaggccgagcttaccgttgaagccggtcacaccgccaccttacgctgctctgccacgggaagccccgctccgaccatccactggtctaagctgcgctctcctttgccgtggcaacacaggctggagggggacacccttattataccaagggtggcacagcaggatagcggccagtatatctgtaacgctactagtcctgctgggcacgccgaggctactataattctccacgttgaaagtcccccctatgctacaacagtcccggagcatgccagtgtgcaagccggggagacagtgcagctgcagtgtcttgcccacggtacacctcccctcacttttcagtggagtagggttggctcttctctgcctggccgagctaccgcaaggaacgagctgttacattttgaacgcgccgctccagaagattctggaaggtaccgatgtcgtgtcaccaacaaagtcggatcagcagaggcctttgcccaattgctcgttcagggacctcccggctctctcccagctacaagcattccagctggaagcacgcccaccgtgcaggttactccccaactggagacaaagtctatcggggcctctgtcgagtttcactgcgctgtcccctcggatagaggcacacaacttcgatggtttaaggagggcggacagttgccaccagggcattcagttcaggatggcgtattgaggattcagaacttggaccagagttgtcaaggtacgtacatctgccaagcacatggcccttggggcaaagcgcaagcatctgcacaactggtcatccaggctctcccatccgtcttgataaatattcgcacgagtgttcagaccgtggtggttggtcacgccgttgagtttgagtgcttggccctcggtgatcccaaaccccaggtgacttggagtaaggttggaggacatcttcgcccaggaattgtgcaatccggtggagtagtgcgcattgcccacgttgaactggcagacgcaggacagtatcgatgcacagccactaacgctgccgggaccacccaaagtcacgtgctgctgctcgtgcaagcactgccacagatcagcatgccccaggaggtgagagttcctgctgggtcagctgcagtcttcccatgtattgcttctggctaccccacacccgatatcagttggagtaaactggatgggagcctgccaccggatagccgcctcgaaaataacatgctgatgcttccctctgtaagacctcaggacgctgggacttacgtgtgtactgctacaaataggcagggaaaggtcaaagcattcgctcacctccaggtcccggagagggtggtgccttatttcacccagactccttactcttttctccccctgcctactatcaaagatgcttatagaaaatttgagattaagatcacattcagacctgattcggccgacggaatgctcttatataacggacagaaacgagtcccaggctccccgacgaatctggccaatcgccagccagatttcatctctttcggcctggtgggagggcggcccgagttccggtttgacgccgggtcgggtatggcaaccattcgtcatcccacccctctggctctggggcatttccacaccgtcacgctgttgaggtccttgacgcaggggtcacttattgtgggagatctggctcccgtgaacggcacatctcaagggaagttccagggcctcgacctgaatgaggaactgtatctagggggataccccgactatggagccattccaaaagctggcctgtcttctgggtttatcggctgcgtgcgcgagttgcgcattcagggcgaggagatcgtgttccacgacctcaatttgactgcccacggaatcagccattgcccaacctgcagagacaggccttgccagaatggcggacagtgtcatgactctgaaagttctagttacgtgtgcgtctgccctgcgggcttcacggggtctagatgcgagcattcccaggccctccactgccatccagaggcgtgtggacctgatgcaacttgtgtgaacagacctgatggcagaggatatacctgtcgctgccatctcgggcgaagcgggctcagatgtgaagaaggggttactgtgaccacccccagtttgtccggtgccggcagctatctggcattaccagcattaactaatacccaccacgagctgcgcttagacgtcgaatttaaacccttagcccccgatggcgtcctcttattttcaggcggcaagagcggtccagtggaagactttgtgtctcttgctatggtgggcgggcatcttgagttccgctatgagctcgggtcagggcttgccgtgctgcgcagtgccgaaccactggccctgggccggtggcacagggtgagtgcagagcgactgaataaggatgggtcactccgcgtcaacggggggcggccagtgctgagaagttcccccggcaagtcccaggggcttaaccttcatacactcctctacctagggggcgtagagcctagcgtccctctctctcccgccacaaacatgagtgcccacttccggggatgcgtgggagaggtgtccgtgaatggaaaacggctggacctcacatattccttcttaggaagtcagggtatcggccagtgctacgatagctcaccatgtgaaagacagccctgtcaacacggggcgacttgtatgccggccggggagtatgaatttcaatgcttgtgtagagatgggtttaagggtgatctctgtgagcacgaagagaacccttgtcagctgagagagccttgcttgcatgggggcacttgccagggaacccgctgcttatgtctccctgggttcagcggccctcgatgccagcaaggtagcgggcatggaattgcagaatccgattggcacctcgagggctccgggggtaatgacgcgccagggcaatacggcgcatacttccacgatgatggattcttagcattcccggggcacgtcttcagccggtccctaccagaggtcccggaaactattgaactagaagtgcggacatccacagcctcagggctcctgctgtggcagggcgtggaagtgggcgaggcgggccaggggaaggactttattagccttgggctgcaggacgggcaccttgtctttcgttaccagctgggctccggtgaggcaagattggtttcagaggatcctattaacgacggagagtggcatagggtgacagctctgcgtgagggacgaagagggagtatacaggtagatggcgaggagttggtgtccggtcgtagtccaggacctaacgttgccgttaacgccaagggcagtgtttacataggaggagctccagatgtggcaacccttacgggcggacggttttccagcggtatcaccggctgcgtgaagaacttggttctgcactcagcccgccctggcgctcctccgcctcaacctctggacttgcaacacagagcccaggcaggtgctaatacgcgcccttgcccaagttag

SEQ ID NO: 119725 - DNA, 720 bp, Artificial Sequence
  Description of Artificial Sequence: Synthetic coding sequence
gtcacccacggcttacgcgcctacgacggcctatctctgccagaagacattgaaactgttaccgcttctcagatgcggtggacacacagctatctgagcgatgatgaagatatgttggccgatagcatcagcggagatgatcttggctctggcgacctcggttccggtgactttcagatggggtcatggatggctggctttctgtggtcctggatgtgggcaaggaaaggcatgcggatgggtctcaggttcaggaggtgttgcagtggcagttcacccgcggccctgtggccaccaacctctcctctgccccgagacagttcatccgatgcatgggcgcaatgcccgtcctcacaggaaccagctcgtagaccatctctgccagctactgccaccatgagtgtttggccgtggtccatagctgtgacgggcgggccaacagctggcacttgcctcatgtcgtccattgtaagaagtcagtcgtgggtctcagccccgcattcactctccctgtggagaaggcacttataccgcccaggccagaggcaaccatcatgtgacagtcatcaatctccgacactccttagcccctgttttcccgtccctagcggaccttgcccagtgggacctcgacgaccacacgctgcaatgggcaccgcctcccctgagactacatccgccacagacagacgcactgcccgcacagcggccatgtcctag

SEQ ID NO: 119726 - DNA, 567 bp, Artificial Sequence
  Description of Artificial Sequence: Synthetic coding sequence
atgaacgccggtgcatctgtgctgacgttcccctgggccgtttatgggcttcctagggcacgcccagcagtcaccgatctgacaggaccgcttccaccctcttctccagcattgccttccgtccttatcaacattcggacctccgtacagacagtggtggttggccacgccgtcgaattcgaatgccttgcactgggtgatccaaagcctcaggttacctggtcgaaagttggcggacacttgcgacctggcattgtccagtcgggtggagtcgtgcggattgctcatgttgagcttgcagatgcaggtcagtataggtgtaccgcaacaaacgcggcaggaacaacccagtctcatgtgttactgctggtgcaggctctgccccagatctccatgcctcaggaggttagagtgcccgcgggcagcgccgctgttttcccttgtatcgcctctggctacccaactccagacataagttggtccaagctcgacggtagtctgccccccgattcccggttggaaaataacatgctaatgctgccttccgtacgccctcaggacgcctag

SEQ ID NO: 119727 - DNA, 594 bp, Artificial Sequence
  Description of Artificial Sequence: Synthetic coding sequence
tgaaccccaagcggcctctacctggggacctgtgagcgctgttcttgccacgggcatagtgaggcctgtgagcccgagaccggcgcctgtcaagggtgccaacaccacaccgaaggacctcggtgcgagcagtgccagcctggttattacggagacgcacagaggggaacacctcaagactgccaactttgcccgtgctatggagaccctgctgccggacaagcagcccacacttgctttttggatactgacggacaccctacctgtgacgcttgctctcctggacactcaggtaggcactgcgaaagatgcgctcccggttactacggcaacccctcacaaggacaaccctgtcaacgcgactcacaggtcccgggacccatcggttgcaattgcgacccacaaggctccgtgagctctcagtgtgacgctgcagggcagtgtcaatgtaaggtgtctccaaatccatgtccatgcggggcatgttcagcacccctgccccgcccatgcggagaaattcgacagcacctggttgaagcggagacctgggcatggggagccgggcacggaggccagggtagagggtgtccgtag

SEQ ID NO: 119728 - DNA, 492 bp, Artificial Sequence
  Description of Artificial Sequence: Synthetic coding sequence
ccacctgtgaagattgagagctcatcccctagcgtgactgagggacagactctggacctgaattgtgtggtggccggcagtgcgcacgctcaggttacttggtacaggagaggtgggtcactgcccccacatactcaggtgcatgggtcgagacttaggcttcctcaagtgagccccgcagactcaggggagtatgtgtgccgagtagaaaatggctccggtcccaaggaagcgtcaatcaccgtcagctactgcccaccagcatggagttggtgcgtgcccggctccacacgacccatccggattgagccctcttcatctcatgtagccgagggccagactttggatttgaattgtgttgtcccaggacaggcgcacgcccaggtaacatggcacaagagggggggcagcttgcctgccaggcatcagacccatggatctctgctcaggctacatcaggtgacccctgcagactctggcgagtatgtctag

SEQ ID NO: 119729 - DNA, 573 bp, Artificial Sequence
  Description of Artificial Sequence: Synthetic coding sequence
ccagaggacattgagacagtgaccgctagccagatgaggtggactcatagctacctgtctgacgatgaagacatgttggccgactcaatctccggagacgacttgggatccggggatcttggatctggggatttccaaatggtatatttccgtgcactggtcaacttcactagatccattgaatactctcctcagttggaagatgctggatccagggaattccgggaggtaagtgaagccgtcgtggatacgctggagtctgaatatttgaaaatacccggcgaccaggtggtatcagtggtgtttatcaaggaattggatgggtgggtattcgtggagctcgatgtgggatcagagggcaacgctgacggggctcagatccaagagatgctccttcgggtgatcagctccggttcagttgcgagctacgtaacttcccctcaggggtttcaattcagacgcctgggaactggcgagccaattttggtttcagggattgcgagctcgcggctcgtcgggtcgcctttctccgtgtcggcaattggctctcaactagggctggctcaccactag

SEQ ID NO: 119730 - DNA, 624 bp, Artificial Sequence
  Description of Artificial Sequence: Synthetic coding sequence
ggggagtccagagagggaagaggctacagacaagtggcccagagggtggctgagcgttctcccgtccccagtttactatcacacagcggatgcgtggtacacacaagattatctcctgtccctagcgttagccccccgataaggatcgaatcatcatcccctactgtggtagaggggcagacactggatttgaactgcgtggtagctcggcagcctcaagccattattacttggtataaaaggggtggaagcctaccctctcgtcaccagacccatggtagtcacctgcggctccatcagatgtccgtcgcagactccggggaatacgtctgccgagcgaataataacatcgacgccctcgaagcgagcattgtgatatccgtgtccccctcggcaggtagtccttcagctcccggatcttcgatgcccatcaggattgagtcttcctctagtcacgtagccgaaggtgagacgctggacctgaattgcgtagtgcccggacaagctcacgcccaggttacttggcacaagaggggaggaagtctgccatcccatcaccaaacccgcggatccaggctcagattgcaccatgtctccccagctgattcgggcgagtatgtttag

SEQ ID NO: 119731 - DNA, 1104 bp, Artificial Sequence
  Description of Artificial Sequence: Synthetic coding sequence
atgggctggcgacgcggcaggggcgctccccgtttcccagatggcatggcagcgggccaaaggcggtcttccctctcccgtcttgggtcacaggcagagggcctcctgactagccagacaatgggcgggcaggccgagacactactgacttcacaaaccgggtggcttcttggaagggggtgcaatctgggcagcccgggaggccaggtctcttgggacaaggtccgaattccaggcgtcttacagcgcctcggagtcacctacttcgtggtggccgtactggaacttctttttgccaaaccagtgccagagcattgtgctagcgaacggtcttgtctgtcactcagggacattaccagcagttggccccagtggctattgatcctcgtcttggagggcttgtggctcgggctaacctttcttctgcccgtgccaggctgtcctacgggatatctgggacccggtggcataggggatttcggtaaataccccaattgcacaggcggtgccgcggggtatattgatagattgctattgggggatgatcacctgtaccaacacccctcatccgctgtgctctatcacacagaagtggcttacgatcctgagggtatccttggaacaataaattccattgtgatggcatttttgggagtgcaggcgggcaagatcctgttatactacaaggccagaactaaggacattctgatccgtttcaccgcatggtgctgtatccttggcctgattagcgttgccttaacaaaggtaagcgagaatgagggcttcatacctgtgaataagaacctgtggtcactgtcgtacgttactacgctaagcagctttgctttcttcatcctgctagtgttatatccagtcgtagatgttaaaggactctggaccggcactcctttcttttatcccgggatgaacagcatcttggtctacgtgggacatgaagtcttcgagaactactttccattccagtggaagcttaaagacaaccagtcccataaggaacacctgacgcagaatatcgttgccaccgcactttgggttctcatcgcctacattctatatcgcaaaaagatcttttggaagatttag

SEQ ID NO: 119732 - DNA, 669 bp, Artificial Sequence
  Description of Artificial Sequence: Synthetic coding sequence
atgtctggcgccggccgagccctcgccgcccttcttttggccgcctcagtgctctccgccgccctacttgcgccaggcgggtcttccggaagggatgctcaagctgccccccctagagatttggacaagaagaggcacgcagagctcaaaatggaccaggctctattactcattcacaacgagcttctatggactaatctgactgtctactggaaatctgaatgctgttaccattgcctgttccaagttctggttaacgttcctcaaagccctaaggccggcaagcctagcgccgcagccgcgtccgtgagcacccagcacggcagtatcctgcaactaaacgacacgctggaggaaaaagaggtgtgtcggcttgaataccgttttggcgaatttggtaattactctctgctggttaagaacattcacaacggcgtttccgagatagcttgtgaccttgccgttaacgaggacccagtggacagcaacctgcccgtctccattgcgttcttaatcggactcgccgtgatcatagtgatatccttcctgcgtctcctcctaagggtcttgctgtgccatccaggctggtctgctgttgcaccctcgaggttgactccctcttccgcttccagagtgcacaccattcttctgccgcagcccccagagtag

SEQ ID NO: 119733 - DNA, 1908 bp, Artificial Sequence
  Description of Artificial Sequence: Synthetic coding sequence
atgtccggagcaggacgggcacttgctgccctactgcttgcagccagcgtcctgtcagctgccctactcgcaccgggcggatccagcggtcgggatgcgcaggcagcaccaccaagagatctggataagaagcggcacgctgagctaaagatggatcaggcactgttgcttatccataacgagctgctttggactaatctgactgtgtattggaagtccgagtgctgttatcactgtctgtttcaagttctagtgaacgttccccagagcccaaaggccggaaagcctagtgctgcagctgccagcgtatctactcagcatgggtccattctccaacttaatgacaccctcgaggagaaagaggtgtgtaggctcgaataccgctttggggaatttggcaactactctctgctcgtgaagaatatccataacggcgtgagcgagatcgcctgcgatcttgccgtcaacgaagatcctgtagatagcaatctgccagtgtctatagcgtttctcattggcctggccgttattatcgtgatctcgttcttacgattgttattgagccttgacgactttaacaattggatcagtaaggcgattagctcccgagagacagatagactaatcaattctgagctcggcagcccgtcccggactgacccactagacggagatgtccaacccgccacttggaggctgtccgccctgcccccaagactgcgcagtgttgataccttcaggggcatagccctcatactgatggttttcgtgaattatggaggcggcaaatactggtacttcaaacatgcgtcgtggaatggcttgactgttgcagaccttgtgtttccctggttcgtgttcatcatgggtagttcgatatttctctcaatgacatctatcttgcagagaggctgctcaaagttccggctcctgggcaaaatcgcatggcggtcttttctgctcatttgtatcgggatcattatcgtaaatcctaactactgtctcgggcctctgagctgggataaggtacggatcccgggtgttctgcagcggttgggggtgacttacttcgtggtcgcagtccttgagcttcttttcgcgaaacctgtgccagagcattgcgccagcgaaagatcctgcctctctttgagagatattacatccagctggccccagtggctgctaatactggtgctggagggcctgtggctaggcctgacctttcttctgccagtgcctgggtgtcctaccgggtacttgggcccaggaggaattggcgatttcggcaagtacccaaattgcacgggcggagccgctgggtatattgatagactgttgttgggcgacgaccacctgtatcagcacccttcctctgcggtgctgtaccatactgaggtggcttatgacccagagggcatattgggaaccattaatagcatagtcatggctttccttggagttcaggcgggcaaaatcctgctctactacaaggccaggactaaggatattctgatacgctttaccgcttggtgctgcattctgggcttgattagtgtggccctgactaaagtgagtgagaacgagggattcatccccgttaacaagaacctgtggagcctctcctatgttactacactatcttcctttgcattcttcatactattggtgttgtaccctgttgttgacgtgaaaggcctgtggactggcactccgtttttttatcctggaatgaattctatcctggtttatgtgggtcacgaggtgtttgagaactattttccctttcagtggaagttgaaggataatcagtctcataaagagcacctgacacagaacatcgtggcgaccgcactgtgggtgctcattgcctacatcttatatcggaaaaagattttctggaagatctag

SEQ ID NO: 119734 - DNA, 1992 bp, Artificial Sequence
  Description of Artificial Sequence: Synthetic coding sequence
atgaccggtgctcgagcaagcgccgctgagcagagacgagccggccgatcagggcaggcacgggccgccgagcgcgcagcgggcatgtctggggctgggcgggcgctggctgcgttactgttggccgcatccgttttgtcagcagctttgctagcacctggtgggagcagcggtcgggatgcgcaagcggcccctccccgcgatctggacaaaaagagacatgcagagctgaagatggaccaagctttactactgatccataatgagctgctctggacaaacctaacagtttactggaaaagcgagtgctgctatcactgcctttttcaggttctcgtgaatgttcctcagagccctaaggccggcaagccctccgcggctgccgcctcagtgagcacgcagcatggctctattctgcaattaaatgacactttggaagaaaaggaagtgtgtcggcttgagtatcgattcggagaatttggcaactatagcttgctggtgaagaacattcacaatggggtgtccgaaatcgcttgtgacctcgccgtgaacgaagaccccgtggactctaacttgcccgtctccattgctttcctgataggcctggccgttatcatcgtgatcagcttcctccgtctgctcttatctctagacgatttcaataactggatcagcaaagcaatatcttcaagagaaaccgataggttgataaacagtgagctcgggtctccaagtagaaccgacccactggatggcgatgtccagcccgctacttggaggctgtccgctctacccccgcgactgaggtctgttgacacctttcgtggtattgccttaattctgatggtcttcgtgaattacggcgggggtaaatactggtacttcaagcatgcatcctggaatggcctcaccgtggcagacttggtgtttccatggtttgtgtttataatgggatcgagtatctttctctcaatgacctcaatacttcagcgcggctgtagtaaattcaggctccttgggaaaatcgcatggcgatcattccttctcatctgcattgggatcattattgtgaaccccaactactgtcttgggccacttagctgggataaagttcggattcccggcgtgctgcaacgcttgggcgtcacctactttgttgtcgcagtgctcgaactattgtttgctaagcccgtgccagagcattgcgcatctgaaagaagctgcctgtccttgcgagacattacttccagttggccacagtggcttctcattctagtgcttgaggggctctggctcggtttaacattcctgctgcccgtgccggggtgtcctaccgggtacctcggacctggagggattggagattttggaaaatacccaaattgcacgggaggcgcagcagggtacattgataggttgcttctgggggacgatcacctgtatcagcatccgtccagtgcagttctgtaccatacagaagtggcctacgaccctgaaggaatccttggcaccattaacagcatcgtgatggcttttctaggggtacaagctggcaagattctcttatattacaaagctagaaccaaagatatactgattcgcttcacggcttggtgctgcatcttgggcctgattagtgtagcactcaccaaggtgagcgaaaatgaaggctttatcccagttaataaaaatctgtggtcactgagctacgttaccacccttagcagcttcgccttcttcatactgctggtgctctatcccgtggtcgatgtgaaggggttgtggaccggtacaccattcttctacccaggaatgaacagtattctggtatacgtgggccacgaggtgttcgagaactattttcctttccagtggaagctgaaggataaccagagccataaagagcacttgacgcagaatatcgtagctaccgcactatgggttctgatcgcgtacattctgtatcgtaagaaaattttttggaagatttag

SEQ ID NO: 119735 - DNA, 1647 bp, Artificial Sequence
  Description of Artificial Sequence: Synthetic coding sequence
atgcgagtgctgtgcgcctttcctgaagccatgccctcttccaattctcgccccccagcgtgcctcgcgcccggggcgctttatcttgcgctgctgctccacctctctctcagctctcaggccggtgacagaagaccactgccggtggaccgtgccgctggcctgaaagagaaaaccctgatcctgctcgatgtttctaccaaaaatccagtccgaacagtgaacgaaaattttctaagccttcagctggatccaagtatcatccacgacggatggttagactttctgagttctaagagactcgtaaccctggccaggggactgagtcccgcattcctgcgctttggtggaaagcgtactgattttctgcaatttcaaaacttgcgaaatccggccaaatctagaggcggaccagggcctgattactatcttaagaactacgaggacgatattgtgcgttctgatgtcgctctcgataagcagaaaggatgcaagattgcacagcaccccgatgtgatgttggagctccagcgggaaaaagccgcacagatgcatttagtgctgcttaaggagcagttttcaaacacatatagtaaccttattttgaccgcgcggtccttggataagctctacaattttgcagattgtagtggactgcacctaattttcgctctcaacgccctgaggagaaatcccaataattcctggaacagctcatcagccctctcactgctgaaatattcggcatctaagaagtacaacattagctgggaactggggaacgagcctaacaattatcgcaccatgcatggcagggcagttaacgggagccaactgggaaaagactatatacagctcaagtcattactgcaaccaattaggatctacagcagggccagcttatacgggcccaacatcggacgcccaaggaagaacgtgatcgccctgctggacggtttcatgaaggttgccggttctacggtcgacgctgttacgtggcaacattgctatatcgacgggagggtagtcaaggtgatggactttttaaagactcggctgctcgataccctatccgaccaaatcagaaaaatccagaaagtggtgaacacgtacaccccaggtaaaaagatctggctggagggcgttgtcacaactagcgccgggggcacaaataacctgtccgacagttatgctgccgggtttctgtggctcaatacactcggcatgctggcaaaccaaggcatcgatgttgtgatccgtcacagcttttttgatcacggatataatcacctcgtcgatcagaattttaatccattgccagactattggttgtctctcttgtacaaacggctgatagggcccaaggttctggcagttcacgtagcgggcttgcaacgcaagcccaggccaggccgggttatccgagataaacttaggatttacgcccactgtaccaatcaccataaccataactatgtccgaggctcaatcacactcttcataataaatctccacagaagccggaagaagataaagctcgccgggactctgcgcgataagttggtgcaccagtacctcctgcaaccttatggtcaggaaggcctcaaatccaagacccaacgctgccaatattgtggtatcatctag

SEQ ID NO: 119736 - DNA, 1605 bp, Artificial Sequence
  Description of Artificial Sequence: Synthetic coding sequence
atgagggtgctgtgtgccttccccgaggcgatgccttcatcaaattcccggcctccagcgtgcttggcaccaggggcgttgtacctggcacttcttttacatctatcattaagctcccaggctggcgatcgaaggcccctcccagtggatcgggctgccggcctgaaagagaagacacttattttgcttgatgtgtcgacgaaaaaccccgtgaggacggtcaacgagaactttctttcgctccaactagatcccagtattatacacgatggctggcttgattttctgagcagcaaacgtctcgtgacactagctcggggcctgtctccagcattcttaagattcggaggcaagaggaccgattttctgcagtttcaaaaccttcgaaatccagccaagagccgcgggggccccgggccggattactacctgaaaaattacgaagatgatatcgtcaggtctgacgtcgcattggataagcaaaagggatgcaagatcgcacaacaccccgatgtgatgctcgagcttcaacgagagaaagcggcacaaatgcacctggtgcttctcaaggaacagtttagtaacacctatagcaaccttatccttacggaaccaaataattaccgcaccatgcacggcagagcagtgaatggcagccagctgggtaaggactacattcaactgaaatctttgctgcagcctattcgcatctacagtcgggccagcctgtatggccccaatataggccggccccgcaaaaatgttatcgccttactggatggcttcatgaaggtggccggcagcacagtggacgccgtcacttggcagcactgctacatcgacggtagggttgtcaaggtgatggattttctcaagacccggctgcttgatactttgagtgatcagatcagaaagattcagaaagttgtgaatacatacacacctggaaaaaaaatttggctcgagggagtggtaactaccagtgcgggcggcaccaacaaccttagcgactcttacgctgcgggctttctgtggttgaacactctggggatgctggccaaccagggcattgatgtagtcattcggcactccttcttcgatcatggctataaccacctggtggatcaaaatttcaaccctctcccagattactggctgagcttactttataagagactgattggaccaaaggttctcgcggtgcatgttgccgggctgcagcgcaaacctaggccagggcgcgtcatcagggacaagctccgcatctatgcccactgcactaaccaccacaatcacaattatgttcggggttctatcaccctattcatcattaacctccatcgctctcgcaagaagattaaactggcaggcactctgcgcgacaagttagtccaccagtatctgctgcagccatacggacaggaggggctaaagtcaaaatctgtgcagctgaatggccagcccctcgtgatggtggatgatgggacgctacccgaactgaagcctcgtcctctgcgcgcaggacggaccttagttattccaccggtcacaatgggcttctatgtagttaagaacgtcaatgcgctggcatgtagataccggtag

SEQ ID NO: 119737 - DNA, 1779 bp, Artificial Sequence
  Description of Artificial Sequence: Synthetic coding sequence
atgcgggtgctgtgtgcgtttcctgaggcaatgcccagttccaacagccgacccccagcctgcctagcacctggtgccctgtacctggccctgctgctgcacttgtcccttagcagtcaagcgggcgatcgtcgacccttgcccgtggatcgcgccgctggacttaaagagaagactctaatcctgttggacgtatctaccaaaaaccccgttcgcaccgtgaatgaaaactttctctcgttacaactcgaccccagtattatacacgacggatggctagatttcttgagctcaaagcgtctggtaaccctggcccgcggcctgagccccgcctttcttcgcttcggggggaaacgaacggactttcttcaattccagaacctgcgaaaccctgcgaaatctcgagggggccccggtcctgattactacctgaagaactatgaggacgacatcgtgaggtctgacgtggccctcgacaaacagaagggatgtaaaatagcccaacaccccgatgtgatgctggaactgcagcgcgagaaggccgctcagatgcacctcgtgttacttaaagaacagttttcaaatacttacagcaatctgattttgacagctaggtctctagacaagctgtacaatttcgcggactgctccggattacacctgatatttgccctgaatgcactgcgacggaatccaaacaacagctggaacagttcgagcgccttatctctgctcaagtattctgcctctaaaaagtataatattagctgggagctgggtaatgaacctaacaattacaggaccatgcatggccgggcagtgaacgggtcccagttaggcaaagactacatccagcttaagtccctgctgcagcccattagaatatatagcagggcgagcctgtacggacctaacattggcagaccaaggaaaaacgtgatcgctctgcttgacggttttatgaaagtggctgggtccacagttgacgcagtgacgtggcaacattgctacatcgacgggcgggttgttaaggtcatggacttcctcaagacccgactccttgatacactgagcgatcagattagaaagattcaaaaggtggtgaacacctacactcccggaaaaaaaatctggctcgagggcgtggtgacaacatccgccggcgggacaaacaacttgtccgactcttatgcagctggatttctctggcttaacacgttaggcatgctggcaaatcaaggaatagatgtggtgatcagacactctttctttgatcacgggtataaccacctggtagatcagaatttcaatccgctgcccgactattggctgtcactgctgtataaacggctgattggtcctaaggtactggcagtccacgttgcaggattgcagcgaaagccccggcccggccgcgttatcagagacaaactgcgtatttatgcccattgcaccaaccatcataatcacaactacgttcgtgggtcaatcacattgtttattattaacctgcaccgcagtagaaaaaagatcaaactggctggcaccttgagggacaaacttgtgcaccagtatctgctgcaaccatacggccaggagggactcaagtctaagagcgtgcagctgaatggacagcccctggtaatggtcgatgacggcacccttccagagctgaaacctcgccccctccgggcaggacggacgctggtgatccctccagttaccatgggattctatgtggtaaaaaatgtgaacgctctggcatgtaggtaccggtag

SEQ ID NO: 119738 - DNA, 1443 bp, Artificial Sequence
  Description of Artificial Sequence: Synthetic coding sequence
atgcgagtgctgtgcgccttcccagaagccatgccttccagcaactcccggcctcccgcatgtctggcccctggggcactgtatcttgccttgctcctgcacctgtcgctgtcctctcaggcaggggaccgcaggcccctgcccgtggaccgggcggctgggttgaaggagaaaacactgatcctcctcgacgtttctaccaaaaatccggtgcggaccgtgaacgagaacttcctttctcttcaactggacccaagcattattcacgacggttggctggactttctgtctagcaagcgcctggtgactctcgccagaggtctctctccagccttcctccggttcggtggtaaaaggactgatttcctccagtttcagaacctgcgaaaccctgcaaaatcacgtggcggccctggaccggactactatctgaagaactacgaggatgagcctaacaactataggaccatgcatggcagggctgtcaatggcagccagctgggaaaagactacattcagctgaagagtttgctgcaaccgattcgtatttactcccgcgcctccttgtacggccctaatatcggccgccccaggaaaaacgtgatcgcgctccttgacgggttcatgaaagtggccgggtcgacggtggatgcagttacttggcagcactgttatattgacggccgggtcgttaaagtaatggattttttgaagacacggctgctcgataccctgagcgatcagattaggaaaatacagaaagtggtgaatacatacactcctgggaagaagatttggttagaaggcgtagtcactacatcagctgggggaacgaataatctgtctgattcttatgctgcgggcttcctgtggctgaatacactggggatgttagccaaccaaggcattgatgttgtcattagacacagcttctttgatcacggttacaatcatctcgtagatcagaatttcaaccccttacccgactactggttgagtctcctgtacaagaggttaatcggtcccaaggtgctcgccgtccacgtcgccggtctgcaacggaagccgcgccccggccgagtcatccgggataaactccgcatatatgcccattgcaccaaccaccacaatcataattatgtgagagggtcaatcactctctttattattaatttacacagaagccggaagaagatcaaactggctggaaccttgagagataagttggtccatcagtacctgctgcaaccttatggccaggaggggcttaaatctaaatcagtacagttgaatggacaaccgctggtgatggttgatgacggaacactacccgagctcaagccacgcccactgagagcagggaggaccctggttattccacctgtgaccatgggtttctatgtggtaaagaacgtgaatgctctcgcctgccgctatcgatag

SEQ ID NO: 119739 - DNA, 1251 bp, Artificial Sequence
  Description of Artificial Sequence: Synthetic coding sequence
atgaaacgagagcgcggggccttatcgcgagcaagcagagcgctgaggttggcgccatttgtatacctgcttctcatacagaccgatcctctggaaggtgtcaacattacctctccagttcgtctgatccacggaactgttggtaagagtgccctgctgtcagtccaatacagttctacaagcagcgatagacccgtggttaagtggcagctgaagagagacaagcccgtgacagtcgtacagagtattggaacagaagttatcggtactctcaggccagactaccgggacagaatccgactgtttgaaaatgggagcttgctcctctctgatctgcaactggcggatgaggggacctatgaagtcgagatctctataacagatgacacctttacaggtgagaagaccattaatttgacggtggacgtgccaatcagccgtccccaagtgttggtggcttcgacaacagttctggaactgtctgaagccttcaccctaaattgttctcacgagaatggcaccaagcccagctatacatggctcaaggatggcaagcccctgctcaatgacagccgcatgctgctctccccagatcagaaggtattaacgattacaagggttctgatggaagacgacgatctgtacagctgtatggtagaaaatcccattagccaaggcaggagtctgccggtgaagatcaccgtctaccgcaggagttcgctctatattattctatccactggcggcatatttctgctcgttaccttggtgacagtttgcgcctgttggaagccttccaagaggaaacagaagaaattggaaaaacagaacagcctggagtatatggaccagaacgacgacagattgaagccagaagccgacaccctgccacgaagcggagagcaagagcgaaaaaaccctatggctctgtacatcctgaaggacaaggactctccagagaccgaggagaacccggcccctgagccacgatccgctacagagccaggcccacctggttatagcgtttcccctgcagttccaggtcgaagtccaggactccccataagaagtgctagaagataccctcggagccccgctcggtctccagccaccggaagaacccacagtagtcctccccgcgccccttcatcccccgggagaagcagatcagccagtcgtacccttcgtactgccggtgtacacattatccgcgaacaggacgaggccggacccgtggaaatctcggcttag

SEQ ID NO: 119740 - DNA, 1104 bp, Artificial Sequence
  Description of Artificial Sequence: Synthetic coding sequence
atgaagcgagaacgcggggccctaagtagggcctccagagctctgcggctggccccatttgtctacttgctgcttatccagactgaccctctggagggggttaatattacatccccggtgcgactcatccacggaaccgtgggtaaatcagccctgctctccgtgcagtacagttcgaccagcagcgacagaccagtggtgaaatggcagctcaaacgggataagccagttactgtcgttcagagcattggcactgaggtcatcgggaccctgaggcccgactaccgcgaccgcatcagactgtttgagaacgggtccctgttactcagtgacctccaactggccgatgagggaacatatgaagttgagatttcaataacagatgatacttttactggggaaaagactatcaacttaacagtggacgtgcctatctctcgcccgcaggtgctggtggcctccaccacagttctggaactgtcagaagcttttactttaaattgctcccacgagaatggcactaaaccttcttacacctggttaaaggatggcaaaccactcctgaatgatagccggatgctgttatctcctgaccaaaaagtgctcacaataacaagagtgctgatggaagacgatgatctctacagttgtatggtggagaaccccatcagccaggggaggagtctcccagtcaagataactgtgtatagacggagctctctttacataatcctgagcacaggtgggatcttcctgctcgtgactcttgttactgtttgtgcatgttggaaaccgagcaagaggaaacagaagaaactcgagaaacaaaatagtctcgaatacatggaccagaatgacgaccggctcaaacccgagggtgaactgcctgcgacccagtccccaattccctcaacaatccgaagcgttggttgctgggaaaaagcggaattgggagacaaggagaactcttcagcaggaactctgccatctgatctgggtgcctccaaagggaaagagccggagccagcatctctcgcctcttcacacagcctacctcgcagacacgctatgcctagcactctttcagtttcagtccacgaatag

SEQ ID NO: 119741 - DNA, 669 bp, Artificial Sequence
  Description of Artificial Sequence: Synthetic coding sequence
atgagccagaccaagatgctgaaggtgcgtgtcacgttgttttgcatccttgccggaattgtgctggcgatgaccgccgtcgtgaccgaccactgggcggtgctgtctccacatatggagcaccacaacacaacctgcgaagcagcacatttcggcttgtggcgcatttgcaccaagagaattccaatggacgactctaaaacctgtgggccaattacactgcccggggaaaaaaattgttcgtactttagacatttcaacccaggggagagttccgagatctttgagttcaccactcagaaggagtactcgatctccgctgccgcaattgccattttttctttaggattcataatcctcggctctctttgcgtcttacttagtctgggcaaaaaacgggattatctcttacgccctgcaagcatgttctacgcttttgccggcctgtgtatcctggtgagcgtggaagtgatgagacagtccgtaaaacggatgattgacagcgaagacacggtctggatcgagtattactactcatggtcgtttgcatgcgcctgtgcagcctttattctcctgttcttgggtggtctcgccctgctgcttttttcactcccgcgtatgcctcgcaatccctgggaaagttgcatggatgctgagccagaacattag

SEQ ID NO: 119742 - DNA, 633 bp, Artificial Sequence
  Description of Artificial Sequence: Synthetic coding sequence
atggacctcgaggagttcttgagcgagaatgggatcccacccagcccttctcagcatgatcactcaccacatccccccggcctccagccggccagttcggccgctccaagcgtgatggacttgtcatctcgtgcaagtgctccactacaccctgggatccctagtccaaattgtatgcagagcccaataaggccagggcaacttctgccagccaaccggaacaccccaagtcctatcgatcccgatacgatccaggtaccagtcggatacgagcccgaccccgccgacctagcactgtcgagcatcccaggccaggagatgttcgaccctcggaagcgaaaatttagcgaagaagagctaaagccacagcctatgattaaaaaagcgagaaaagtctttatccccgacgacttaaaagatgacaagtactgggcccgccgcaggaaaaataacatggcagcgaagcggtcaagagacgcccgacggttaaaggaaaaccagattgccatcagggcctcctttttagagaaagagaattccgctctgaggcaggaagtcgctgatctccggaaggaactggggaaatgcaagaacattctggccaagtacgaagccagacatggccctctttag

SEQ ID NO: 119743 - DNA, 1095 bp, Artificial Sequence
  Description of Artificial Sequence: Synthetic coding sequence
atgcatccccaggtggtgatcctaagcctgatcttgcacctggctgacagcgtggcaggtagtgttaaggtgggcggcgaggccggtccaagcgtgacattgccttgccactattccggcgcggtgacctctatgtgttggaatagaggtagctgtagcctgtttacatgtcaaaacggcattgtgtggactaacggcactcacgtgacttacagaaaggacacacgctataaactcctcggagacctcagtcggagagatgtatcactgaccattgagaacactgcagtgtctgactccggtgtgtactgctgcagagtcgagcaccgcggatggttcaatgacatgaagatcaccgtgagtctggagatcgtcccacccaaagtgaccactacccccattgttactacagttccgacggttacaaccgttaggacttcaacgaccgtccctacaactaccaccgtgccaatgaccaccgttcccacaaccacagtacccaccacaatgagcatccccacgaccacaacagtcctcaccactatgaccgtgtcaacgacgacgtcggtgccgaccacgacttctatacctactaccacatccgtgcccgtgaccaccactgtgtcaacctttgtcccgcccatgccattgcccagacagaatcacgagcccgttgccacatcaccgagtagtcctcaaccggctgaaactcacccaacgacattgcagggggctattcggcgcgagccgaccagttccccattgtacagttacaccactgatggaaatgacaccgtgacagagtcgagtgacggcctgtggaataataatcagactcagctcttcctggaacacagtcttctgactgccaatacgacgaaaggcatctacgctggagtctgcatttctgttctggtcctgctcgcactactcggtgttatcattgctaagaagtatttctttaagaaggaggtgcagcaactgtcggtctccttttccagcctccagattaaggcccttcagaacgccgtggaaaaagaagtgcaagcagaggacaatatatacatcgaaaacagtctgtacgccaccgattag

SEQ ID NO: 119744 - DNA, 1206 bp, Artificial Sequence
  Description of Artificial Sequence: Synthetic coding sequence
atgcaccctcaggtggtgattctgagcctgatccttcatctggcagatagtgttgccgggtccgtgaaagtggggggagaagccggcccatctgttacactcccatgccactacagcggcgcggtaacctccatgtgctggaatagaggttcctgcagcctctttacatgccagaacggcatcgtgtggacgaacgggacacacgttacgtaccgaaaggacactcgttacaagctccttggcgatctgagtcgacgtgacgtgtccctgacaattgagaatactgctgttagcgatagcggagtgtactgctgtagggtcgaacaccgcggttggttcaacgatatgaagatcacagtttctctggagatagtgccccctaaggtcacaacaacgcctattgtgaccactgttcctacagtaacaacagtgcgtacctctaccaccgtaccaacaacaacaactgttcctatgacgaccgttcccactacaaccgtgccaacaactatgtccattcctactaccaccactgtcctgacaaccatgactgtgagcaccaccacgtccgttccaaccacaacgtccatccccacgacgacttcagttcccgttaccactacagtctctacattcgtgccccccatgcctttgccaagacaaaatcacgagccggttgcgacctcaccatctagcccacagcctgctgaaacccaccctaccactctgcagggggcaatcaggagggaacccaccagcagccctctttacagttataccactgatgggaatgacactgtgactgagtcttccgatggtctgtggaataacaaccagactcaactttttttagagcatagtctgctgaccgcaaatacgactaagggtatttacgctggcgtctgcatatccgtcctggtacttctggccctactcggtgtaatcattgctaagatgtttcacctggcagcatttaaacttaaattgtgcaagatgcaactgaagagaaagtccaaacagaaaaccattagcacactgaggattgtgttcatgcccaggaccaagacacagtggtgtagtctccgggtgtatgcccatgaatgccggcgcctgaacaggcaccaacatattaggcgtctcctggaccctaagaccatctttctgtttcagtttcatttggcattccagcacgtgagtgatactggctag

SEQ ID NO: 119745 - DNA, 672 bp, Artificial Sequence
  Description of Artificial Sequence: Synthetic coding sequence
atgcatccccaggtggtgatcctaagtctgattcttcacctagcagacagcgtggccgggtctgttaaggtgggaggggaggcagggcctagtgtaaccttaccttgtcactattctggcgccgtcacatctatgtgctggaacagggggtcctgctctcttttcacctgccagaatggcattgtgtggacgaatggcactcacgtaacatataggaaggacacccgatataagctcctcggcgacctcagtcggcgtgacgtcagcctgactatcgaaaatacagccgtgtcagatagcggcgtgtattgttgtcgcgtcgaacaccgcggatggtttaatgacatgaagattaccgtgtccttagagattgtgccacctaaggttactactacccccatcgttactacagtcccaactgtcaccacggtaaggacttcaacaactgtacccaccaccactacggtgcccatgaccacggtgcccacgacaaccgttcccacgacaatgagcatccccaccacaaccaccgtgctcactacaatgaccgttagcactaccacttctgtccctaccaccacctccatcccaacaacaacctccgtccccgtcacgactaccgtcagcacttttgtgcccccgatgccccttcctcgtcagaatcatgaatag

SEQ ID NO: 119746 - DNA, 1095 bp, Artificial Sequence
  Description of Artificial Sequence: Synthetic coding sequence
atgcatccacaggtggtcattctgagcctgattctccacttagccgattcggtcgctgggtcagttaaggtgggcggagaggcgggtcccagcgtgaccctcccttgccactactctggggccgtcacgagtatgtgttggaatcgcgggtcttgtagcctattcacctgccagaacggcatcgtgtggacgaacggcactcatgttacatacagaaaagacacccggtacaagctgttgggagatctatcccgaagagatgtgtcccttacaattgagaatactgccgtctctgactcgggggtatattgttgccgagtggagcacagaggttggtttaacgatatgaagattactgtgtcactggagatagtgccgcctaaggtgacaacaacccccatcgttactacagtgcctaccgtgaccaccgtgagaaccagtaccacagtcccaactaccactaccgtacccatgacaactgtccccactactactgttccaacaactatgtctatcccaactacaactacagtccttacaaccatgactgtaagtaccactacttcagtccccactacaacttctattcctaccacaacaagcgtcccggttaccaccacagtctcgacttttgtgccaccaatgccactgccacggcaaaatcatgaacccgtggccacaagcccatcttccccccaaccagcagaaacgcatccgactacccttcaaggagctatccgccgcgaaccaacctcgtccccgctgtattcttacacaacagatgggaatgacactgttacggagagcagtgacggactttggaacaacaaccagactcagttattcttggagcacagcctgttaacagcgaacaccaccaaggggatatacgcgggtgtatgcatttccgtactggtgttattagccctcctcggcgttatcattgccaaaaagtatttcttcaaaaaagaagtccaacagctctccgtgtcgttctcctctctgcagataaaagccctgcagaatgcagtggagaaggaggtgcaggctgaggacaatatatatatagagaatagtctctacgctaccgactag

SEQ ID NO: 119747 - DNA, 1095 bp, Artificial Sequence
  Description of Artificial Sequence: Synthetic coding sequence
atgcatccacaggtggtgatcctgagcctaatcttgcatctggcagattctgtcgccggttccgtgaaagtcggcggcgaggccggacccagtgtcaccctcccctgccattacagcggagctgtaacatctatgtgctggaatcgcggcagctgctccctctttacttgccagaatggcattgtatggaccaacggaacgcatgtgacctataggaaagacacacggtacaaactgctgggggacctgtcaagaagggatgtgagtctcacgatcgagaacactgccgtttctgattcaggcgtatattgctgtcgggtcgagcatagaggatggtttaatgacatgaagattaccgtgtcccttgagatcgtgcctcccaaagtgactacaacgccaatcgtcacgacagtgcctaccgttaccactgtacgcacgagtacaacggttcccactaccacaacagtgccgatgaccaccgtgcctacgacgaccgtccctaccacaatgtcgatacccaccacaactacagttctcacaaccatgaccgtgagcacaacgacaagtgttccaactacgacctcgattcctaccaccacttctgtgcccgtaactaccaccgtctcgactttcgtaccacctatgccactaccgagacagaaccatgagccagtggctaccagcccatcatctccgcaacctgcagaaacccacccgacgacattgcaaggtgcgattagacgggaacccactagctcccccttatacagctatactacagacggaaatgataccgtaacagaatcaagtgacggcctatggaacaacaatcaaactcagctatttctggaacacagtctgctcacagcaaatactacgaaggggatttacgctggagtttgcattagtgtcctagtgctgttagccttgcttggggtcatcattgctaaaaagtacttcttcaagaaggaagtccaacagctgtccgtttccttttcttcgcttcaaattaaggccttgcagaacgccgttgaaaaggaggtgcaggccgaggacaacatatatatcgaaaatagcctgtacgccaccgattag

SEQ ID NO: 119748 - DNA, 522 bp, Artificial Sequence
  Description of Artificial Sequence: Synthetic coding sequence
atggaacccggcgccggacatctcgacgggcacagagccggttctccgtctctccggcaggccctctgtgatggctccgccgttatgttcagcagtaaggaaagaggtagatgtacagtcatcaattttgttccactcgaggctcccctgaggagcactccgagatcccggcaggtgactgaggcttgtggcggagaagggcgggcagtgcccctgggctccgaaccagaatggagcgtcgggggcatggaggccaccttggagcaacatctggaggatacgatgaaaaatccctcaatcgtcggggtcctctgtaccgacagccagggactgaaccttggatgtagaggaaccctttcagacgagcatgctggggtaatttcagtcttggcccaacaagcggctaaactgacaagcgatcctaccgatatccctgttgtgtgtctggaatctgacaatggtaatatcatgatccagaaacacgatggcataacagtggcagtccataagatggccagttag

SEQ ID NO: 119749 - DNA, 267 bp, Artificial Sequence
  Description of Artificial Sequence: Synthetic coding sequence
atgggcaattggggcttaggaatcgctccatgggtagacggggagagtgaactagagttccgcaggctgggcatgcaggggccactggaagccctacggcgcagagagtggaatacccagcgtgcttcgttttcattttccttcctcattgctctatctccccacacagttgactattgtcatagttacgaactcttcaatcgcagatggcatggccatgtgctcgcaactcagcggccctctttgttcattctgatgctggtgtag

SEQ ID NO: 119750 - DNA, 2334 bp, Artificial Sequence
  Description of Artificial Sequence: Synthetic coding sequence
atgggccgggggtctgggacctttgagaggctcctcgacaaggcaacatctcagcttctgctggagacagactgggagagtatcctgcaaatctgcgaccttatcaggcagggggatactcaagccaagtacgcagtcaactccattaagaagaaggtcaatgacaagaatccccacgtcgcgctctacgcgctcgaggtgatggaatccgtggtaaagaattgtggccaaactgtgcacgacgaagtggccaataaacaaactatggaggagttgaaagatctcctgaagagacaagtggaggtgaatgtgaggaacaagattctctacctgatacaggcatgggcccacgctttcaggaatgagccaaagtataaagtcgtccaggatacataccagatcatgaaggtcgaaggacacgtattcccggagtttaaagaatctgatgccatgttcgccgccgaacgggccccagattgggtggacgccgaagagtgtcaccgctgtagggtgcagtttggggtgatgacacggaagcaccactgtcgagcctgcggccaaattttttgcggtaaatgtagtagtaaatacagcactatccctaagttcgggattgaaaaggaggtacgggtctgtgagccctgctacgaacaattaaatcgaaaagccgaaggaaaagcaaccagtaccaccgaactgccccccgagtacctcacaagccctctgtctcaacagagtcaactgccacccaagcgggacgaaacagcgctgcaggaagaggaagagcttcagctagctctggcactgtcccagagcgaggcggaagaaaaggaaaggctgagacaaaagtctacatatacatcctaccctaaggcagaacccatgcccagcgccagtagtgccccccctgcatccagcctgtactcaagtcctgtgaattccagcgcacctcttgcagaggatatcgaccccgagctggcccggtatcttaatcggaactattgggagaagaagcaggaagaggcaagaaaaagccctactccttccgccccagtgccactgactgagcccgccgcacagcccggggagggccacgcagcgcccaccaatgtggtcgagaaccctctgcctgagacagacagccagcccattccgccatccggcggcccattctctgaaccccaatttcacaacggagagtctgaagagagtcacgaacagttcctgaaggcattgcagaacgctgtcacaacttttgtgaatcgcatgaaatctaaccacatgcggggccgttcaattactaatgattcagcagtgctaagcctcttccagagcataaacggaatgcatcctcagctgcttgaactgcttaaccagctggatgaaaggaggttgtattatgaagggctgcaagacaagctggctcagatccgggatgctagaggcgcgctttcagcactgagagaggagcacagagagaagcttaggcgcgcagctgaggaagcggagcggcagcgccagattcagctcgcacaaaaactagagataatgcgacagaagaagcaagagtatttggaggtccagaggcagctagcaatccagcgattgcaggagcaggagaaagaacgccaaatgcggctcgagcagcagaagcagaccgtccagatgcgagcccaaatgccggcttttcctttgccttatgctcagctccaggccatgcccgccgctggaggagtgctctaccagccctcaggccccgcgtcatttccgtccacattcagcccagcaggatcagtcgaaggctcccccatgcacggtgtgtacatgagtcagccggcacctgcagcgggcccatacccctcaatgccaagcacggccgccgatcctagcatggttagcgcctacatgtacccagcgggagccactggcgcccaggccgctccccaggcccaggctggccctactgcctctcccgcctactcttcctatcagcccacacctaccgcaggttaccagaacgtagcctcccaggccccccagtcactgcccgccatctcccaaccaccacaatcctccaccatgggatatatgggatcccagtccgtgagcatggggtatcagccttacaatatgcagaacctcatgaccacccttccatcacaggacgcgagtcttcctcctcagcagccatacatcgccggccagcaaccaatgtaccaacagatggctccatcagggggtccccctcagcagcagccgccagtcgcccagcagccacaagcgcaggggccacctgcacagggaagcgaggcgcagcttatcagcttcgattag

SEQ ID NO: 119751 - DNA, 2076 bp, Artificial Sequence
  Description of Artificial Sequence: Synthetic coding sequence
atgggacgcggtagcgggacctttgaaaggctccttgataaggcaacatcccaactgctgctcgagacagattgggagtccatcctgcagatttgcgatcttatccgccagggcgatacccaagccaagtacgccgtcaacagcattaagaaaaaggtcaacgacaagaaccctcacgtcgccctgtatgccttggaagtaatggagtcagttgtgaagaactgtggtcagacagttcacgatgaagtggcaaataagcagacgatggaagagctgaaggacttgctgaaaaggcaggtcgaagtgaacgttcggaataagattctctacttgatacaggcttgggcccacgcattccggaatgagcctaaatacaaggtggtgcaggatacataccaaattatgaaggtcgaaggtcatgtcttcccggagttcaaagaatctgatgctatgttcgctgctgagcgggcccccgattgggttgacgccgaagagtgccaccgttgccgtgttcagtttggggttatgaccaggaagcaccactgtcgggcgtgcggacaaatcttttgcggcaagtgctctagcaagtattccactatccccaaattcggaatcgagaaggaggttcgcgtttgtgaaccgtgctatgaacaactgaacagaaaggcagaagggaaggccacctctactactgagttgccacctgaatacttaacgtcgcccctctcacagcagtcacagttaccccccaaacgcgatgaaaccgcgcttcaggaagaagaggagctccagctcgctcttgccctgagccagtcggaagcggaggagaaggagcgactgcgccaaaaatcaacctacacctcctatccgaaagccgagcctatgccaagcgcctcgtctgctcctccagcatcctcattgtacagttcccccgtgaacagctccgcccctctcgcagaagacattgatccagagctggctaggtatctgaataggaactattgggaaaagaaacaggaagaggctcgcaagagtcccacaccgtccgcccctgtccctctgacagaacccgccgcccagcccggggaaggacacgccgccccaactaacgttgtggagaatccattacctgagacagactctcagccaatacctcctagtggaggccctttttctgaacctcagttccataacggcgagagcgaagagtcccatgagcagtttctgaaagccctgcaaaacgccgtcactacatttgttaatcggatgaaatccaaccacatgagagggcggagcataactaatgatagcgccgtgctatcactgttccagagcatcaatggtatgcacccccagttactggaactgcttaatcagctggacgaacgacgcctgtattatgaggggttgcaggacaagcttgcccaaatcagggatgcaagaggggccctgtccgctttaagggaggaacaccgcgagaaactccgaagggccgcagaggaagccgaaagacagcgacagatccagcttgcacagaaacttgagattatgatgcatggcgtctatatgtcccagcccgctcccgctgcagggccatacccctcaatgcctagcactgccgctgaccccagtatggtgagtgcgtacatgtatccggcgggagcgaccggggctcaggctgcccctcaagctcaagccggccctacagcaagccctgcatactcctcttaccagcccacgccaactgccggctatcaaaatgtggcctcacaggctccccagtccctcccggcaatcagtcagcctccccagtcttctaccatgggctacatgggctcacagagtgtgagcatggggtaccagccttataatatgcaaaacctcatgaccacactgccttcacaggatgcaagtttgccaccccaacaaccatacatcgccggtcaacaaccaatgtaccagcagatggccccttccgggggcccacctcagcagcaaccaccagtagcacagcagccccaggcccagggaccccctgcccagggcagcgaggctcagctcatttctttcgattag

SEQ ID NO: 119752 - DNA, 324 bp, Artificial Sequence
  Description of Artificial Sequence: Synthetic coding sequence
atgagattgagcaagacacttgtcgatatggacatggctgactactctgctgccctggatccagcctacacaactctggagttcgagaacgtgcaagtactgaccatggggaacgacttcgtggccgccgccagtagacagatcgaagcctcacctcccactagtctcgaacacatctggaggggggggcagtttagcactggaagacatgtgcctatcaggcggcaccagcctcagcgagcacagcagcccgggtgccagagacctgtgtgccatctacgcggaccgggacacggacagacacttagatgtctggaactttag

SEQ ID NO: 119753 - DNA, 1425 bp, Artificial Sequence
  Description of Artificial Sequence: Synthetic coding sequence
atgagactgtccaaaaccctggtggacatggacatggctgactattcggccgctttggatccagcctatactacactggagttcgagaatgtgcaggtactaacaatgggcaacgatacttccccctctgaaggcaccaatctcaacgcacctaatagcctgggcgtcagcgccctgtgcgccatatgtggagaccgagccactggtaagcattacggcgcctcatcctgcgacgggtgtaagggatttttcaggaggtcagttcggaaaaaccacatgtattcctgcaggttctcacggcaatgtgtggttgacaaagacaaacgcaaccagtgtcggtactgcagactgaagaagtgctttcgggccgggatgaagaaggaggctgtacagaatgaaagggaccgtataagcacccgtcggtcgtcctacgaggactcctcactaccttcaatcaacgcgcttctccaggctgaggtgcttagccgtcaaatcacgtccccagtgtctggcatcaatggcgatatccgggccaagaaaattgcctcaatagcagacgtctgtgaatctatgaaagaacagttgctggtcttggtggagtgggccaagtatattccagctttctgcgaacttcctctggatgaccaggtagcgctgctgcgtgcgcacgccggggagcacttattactgggtgcaacaaaacggtcgatggtgttcaaagacgtactgctgttagggaacgattacatagtgcccaggcattgccctgagctggccgaaatgagccgcgtatctattcgaattctggacgagcttgtgctgccctttcaagaacttcagatagacgacaacgagtacgcttacctgaaagcaattattttttttgatccagatgcaaaggggctttctgatccaggaaagataaaacgtctcaggtctcaggtacaggtatctttggaagactacattaacgataggcagtatgactccaggggcaggttcggggaactgctcttgttgctgcccacattgcagtccattacgtggcagatgattgagcaaattcagtttattaagcttttcggcatggctaaaatcgataatctcctgcaagaaatgctgctgggtggaagcccttccgatgcccctcatgctcatcatcctctgcacccccatctaatgcaggaacatatgggtacgaatgtaatagtcgccaacactatgcccacccacctgagtaatgggcaaatgtgcgagtggccccgacctagaggacaggctgcgactccagaaacaccacaaccttctcctcccggcggcagcggatccgaaccatataaactcctgcctggcgccgtggcgaccattgtcaaacccctgtccgccatcccccaaccgactatcacaaaacaagaggtcatctag

SEQ ID NO: 119754 - DNA, 1359 bp, Artificial Sequence
  Description of Artificial Sequence: Synthetic coding sequence
atggtctcagtcaatgcccccttgggcgctcccgtggaaagctcctatgatacttccccttcagagggtactaaccttaacgctccgaactccctcggtgtgtctgcactgtgcgctatttgcggcgaccgagccaccggcaagcattacggggccagtagttgcgacgggtgcaagggtttcttccgccgttccgtgaggaaaaatcacatgtactcctgtagattctcgagacagtgtgtagtggataaggacaaacgaaatcagtgcagatactgtaggcttaagaagtgcttcagggctggaatgaagaaagaagcagtgcagaatgaaagagatcgtatcagtactcggaggtccagttacgaggacagcagtctgccaagtatcaatgcgctactgcaggccgaggtgttgtctcgccagatcacctctcctgtgtcaggtatcaatggtgacatacgagccaaaaagattgcaagtattgccgacgtgtgtgagtctatgaaagagcagctgctagtgctggtagaatgggctaagtatataccggccttttgcgagttacctctggacgaccaggtagcactacttcgggcccatgctggagaacacctgttacttggagcaactaagagaagcatggtatttaaggacgtcctgttgctaggcaacgactacattgtgccaaggcattgtcccgaattggccgagatgtcccgtgtgtcaatccgcattttggacgagttggttctgccttttcaggaactgcaaattgacgacaatgagtatgcatatctcaaggcaatcattttttttgacccagatgccaaaggcctgtctgacccaggtaaaatcaagaggttaaggagccaggtccaggtgtccctggaagattacattaacgacaggcagtacgattctcgaggtagatttggagagctcctcctcctactaccaacactccaatcaataacgtggcagatgattgaacagattcagtttattaaacttttcggaatggcgaaaatcgacaacctgctgcaggagatgctgctcggcggtagtcccagcgatgccccacacgcccaccatccactccacccacatctcatgcaggagcacatgggaaccaacgtcattgttgcaaacactatgccaacacatttaagtaatggtcagatgtgcgagtggcctcggccacgcggacaagctgccacaccagagactcctcagccatctccacccggaggctctggatccgaaccatacaaactgctgccaggagccgttgcaaccatagtgaaacccttgagtgcaattcctcagcctacaattaccaagcaggaggttatttag

SEQ ID NO: 119755 - DNA, 1515 bp, Artificial Sequence
  Description of Artificial Sequence: Synthetic coding sequence
atgaggctgtcgaaaaccctggtagacatggacatggcagactattccgccgctctggaccccgcatacaccaccctggaattcgagaatgtgcaagtgctgacaatgggaaacgtcctgctcccacttaggctggcgcgcttacggcacccactacggcaccactggtccatatctggaggagtggacagctcaccgcagggagacacttccccatctgagggtacaaacctgaatgcaccgaacagcctgggggtaagcgctttatgtgccatttgtggcgacagagccactggcaaacattacggcgccagctcatgtgatggatgcaaaggcttcttccgcagatcagtcaggaaaaaccatatgtactcctgtagattcagccgacagtgcgtcgtcgataaggacaaaaggaatcagtgtaggtattgcagactcaaaaaatgctttagagcgggaatgaagaaagaggccgtgcagaacgagagagaccgcatctccacccgacgcagctcttacgaagacagttccctcccgtcaatcaacgcacttcttcaggccgaggtcttgtctcggcaaatcacctcacccgtatcaggcattaatggtgacattagagcaaagaagatcgcttcaattgcggacgtgtgtgaatcaatgaaagaacagttattggtcctggtcgagtgggccaagtatatccctgccttctgtgaattgccactcgatgatcaggtggccctgttgcgagctcacgcgggcgagcatctattgcttggagccaccaaaaggagcatggtgtttaaggatgtgctgcttctcggaaatgattatattgtgcctcggcattgtcccgagctggctgaaatgagccgggtttccattcggatcctcgacgagcttgtgctgccattccaagaacttcagattgatgataatgaatacgcctacctcaaagcaattatctttttcgatcccgatgctaaaggcttgagcgacccgggcaaaataaaacgtctccggagccaggtccaggtgagcctcgaggattatattaatgacagacagtacgactcaagaggtagattcggggaactcctcctcctgctgcctactctccaaagcattacctggcagatgatcgagcagatacagttcatcaagctgtttggaatggccaagatagataacctgcttcaggagatgcttctgggtggatccccctcagacgccccccatgcacaccatccacttcatccacacctcatgcaagagcacatgggcacgaatgtcattgtagccaacacgatgcctactcacctgagtaatggccagatgtgtgagtggcctaggccacggggtcaggcagccacacctgaaactccccagccctcccctcccggggggtcaggtagcgagccatataagctgcttcccggcgccgtcgccaccatcgttaagcctctgtctgcaataccccagccaactatcaccaagcaggaggtcatatag

SEQ ID NO: 119756 - DNA, 1395 bp, Artificial Sequence
  Description of Artificial Sequence: Synthetic coding sequence
atgcgactatctaagacactggtcgacatggatatggcggactactccgccgcccttgacccagcctacactactctcgagtttgagaatgtgcaggtcctgacgatgggtaatgatacatcaccttcagagggcaccaatctaaacgcaccaaactctctgggcgtctccgccttgtgcgctatatgcggagaccgagccacaggaaaacattatggtgcaagcagttgcgatggatgtaaagggttttttaggcgctctgtcagaaagaatcatatgtattcctgtcggttctcccgccagtgcgtcgtagataaggataaaagaaaccagtgtcgctattgcagactgaagaaatgctttcgcgcgggtatgaagaaggaggccgttcaaaacgaacgagacaggatctccacaagacgcagttcgtatgaagactcaagccttccgtcgataaacgcactgcttcaagctgaggtcctgtccaggcagatcacctctcctgtgagcggcataaacggcgatatccgagctaagaaaatcgcatccatcgccgatgtgtgcgagtctatgaaggagcagctcctcgtgctggtggagtgggcaaaatacattcccgctttttgcgaactgcctctcgacgatcaggtcgccctactgcgggcccacgcaggagagcacctgctgttaggcgccaccaagagatctatggtctttaaggacgtactgctgctcggaaatgattatatcgtgcccaggcactgtcctgagctggctgagatgtctagagtctctattcgaattctggatgaactcgttctgcctttccaggagctgcagatcgatgacaatgaatacgcatacctgaaagccattatcttctttgaccctgacgcaaaaggactgtccgatcccggtaagatcaaaaggctgcgaagccaggtgcaggtctcattggaggactatatcaatgacaggcaatatgacagccgcggcaggttcggcgaattactcctgctgctgccaactctccagagcattacctggcagatgattgaacagatccagttcattaaactctttgggatggcaaaaattgacaatctgctgcaagaaatgctgttgggggggagcccatctgatgcaccgcatgctcatcatcctctgcacccacacctgatgcaagagcatatggggacaaatgtgattgtcgccaatacgatgcccacgcatctcagcaacggccagatgagtactcccgagacccctcaacctagcccacccgggggatctggttcagagccatataaactcctgccgggagccgtggccacgattgtcaagcccttatcagcgatcccccagcctactatcaccaagcaagaggttatttag

SEQ ID NO: 119757 - DNA, 1254 bp, Artificial Sequence
  Description of Artificial Sequence: Synthetic coding sequence
atgcggttgagtaagacccttgtcgatatggatatggctgactattctgcagcattagatcccgcttatacaacattggagttcgaaaacgtgcaggtacttactatgggcaacgatacttcaccatccgaagggaccaatttgaacgcaccgaactctctgggcgtgagtgccctttgtgctatatgcggggaccgggccaccgggaagcattacggcgccagctcttgcgacggttgcaaggggttttttcggcggtcagtccgtaaaaatcacatgtatagctgtcggtttagccgacagtgcgtcgtcgacaaggataaacgcaaccagtgcaggtactgcaggcttaaaaaatgttttcgggccgggatgaagaaagaggccgtccagaacgaaagggacagaatcagtactcgaaggagcagctacgaagatagtagtctcccttcaatcaatgccttacttcaggctgaagtgctctcccgccaaattacgtcaccagtatcggggataaatggagacatcagggctaaaaaaatagcaagcatagcggatgtttgcgaatcaatgaaagagcaactgctcgtcctggttgaatgggctaagtatatccctgccttctgcgagttacctctggatgaccaggttgccttgcttagggcacacgccggagagcatctgttgctgggagctacgaaacgaagtatggtgttcaaagacgttctgctcctgggtaacgattatatagttccccggcactgtcccgagctggcagaaatgtcacgtgtgtctatccgaattctcgatgaattggtcctccccttccaggagctccagatagatgacaatgagtacgcttacttgaaggccattattttcttcgatcctgatgcaaagggattgagtgaccctgggaaaattaaaagactccgttcacaggtgcaggtgtcactggaggactacatcaatgaccgccagtacgatagccgggggaggttcggcgagctcctgctactcctgcctacactacaatccattacctggcaaatgatcgagcaaatacagtttattaaactcttcggaatggccaaaatcgacaacttgctccaggagatgttgcttggcggaccgtgccaggcacaggaaggacgtggatggtcaggcgattcacctggcgacaggccccacactgtgtcttccccactgtcatcactggccagtcctctttgccgctttggtcaggtggcatag

SEQ ID NO: 119758 - DNA, 1329 bp, Artificial Sequence
  Description of Artificial Sequence: Synthetic coding sequence
atggtgagcgttaatgcaccattaggcgcacctgtcgagagttcatatgatacatcaccatctgagggcaccaacctgaacgcccccaattcactgggggtatcagcattgtgtgccatctgcggcgatcgggccacgggaaagcactacggcgcctcttcttgcgacggctgtaaaggatttttccgccgcagcgtccgcaagaaccacatgtactcgtgcaggttcagcagacaatgcgtggttgacaaggacaagcgaaatcagtgccgatattgcagactgaagaagtgcttccgggctggaatgaagaaggaggccgttcagaacgaacgagataggatcagcactcgcaggtcgtcctatgaggactcatcgctcccctctattaatgctttgctgcaggctgaagttttgtccaggcaaatcactagccccgtcagcggcataaacggcgacatcagggcaaaaaaaatcgcttccattgcagacgtctgtgaaagcatgaaggaacagcttctggtgctggttgagtgggccaaatacataccagctttctgcgagctgcctctagacgatcaggtggccctcctgagagctcacgccggcgaacacttgctgctgggcgctacaaagcggagcatggtgttcaaggacgtcctccttctcggcaatgactacatcgtgcctcgccactgcccagagctcgctgagatgagccgtgtttcaatccgcatcctggacgagctagttctcccatttcaggagctgcagatcgacgacaatgagtatgcatatctgaaagccatcatcttttttgaccccgatgctaagggtctgtcggaccccggaaagataaaaagactgcgctctcaagtacaagtcagcttggaagattacatcaatgaccggcagtatgactcgaggggacgttttggagaactcctactcctcctgcccaccctccagtcaattacgtggcaaatgatcgaacaaattcagttcataaagctattcggaatggctaagattgacaatcttcttcaggaaatgctgttagggggaagccccagtgatgcccctcacgcccatcatcctttgcatcctcacttaatgcaggagcatatgggcaccaacgttatagttgcaaataccatgcctacacacttgagtaatggacagatgtcgactcccgaaactccgcaaccctcaccccctgggggctcaggctccgaaccctataagttgctccccggcgctgttgccaccattgttaaaccattgagcgccatacctcagcctactatcacgaagcaggaagttatatag

SEQ ID NO: 119759 - DNA, 1227 bp, Artificial Sequence
  Description of Artificial Sequence: Synthetic coding sequence
atgaatactactgataacggcgtgaactgtctgtgcgccatttgcggcgacagagccaccggtaagcactacggggcttccagctgcgacggctgcaaaggatttttcaggcgcagtataagaaagagccacgtatactcctgtaggttttctagacagtgtgtggtcgataaggacaagcggaatcagtgccgttactgtcggttaagaaaatgttttcgggcggggatgaaaaaagaagcggtgcagaatgaacgagacagaatcagcacaaggaggtcaaccttcgacgggtctaatattccctcaatcaacacgctggcacaggcggaggtccgctctaggcagatcagtgtgtcaagccccggctctagcacagacataaacgtcaagaaaatcgcatccataggagatgtctgcgaaagtatgaaacagcagctgctcgttttagtggagtgggctaagtacattccagccttttgtgagcttccgttagatgaccaggtggccttacttagagcacacgccggagaacacttactgttgggtgcaactaaacggtcaatgatgtataaggatatcctcctgctgggaaataattatgtgattcatcgcaatagctgcgaggtggaaatctctagggtggctaaccgtgtccttgacgagctggtccggcccttccaggagatacagatagatgacaatgaatatgcgtgtctcaaggccatagtctttttcgaccctgatgccaaagggctctccgaccccgttaaaataaagaatatgcgctttcaggtgcaaatcggtctcgaagattatatcaatgaccgtcagtacgactcgcgggggcgtttcggggaactgctgctcctgctgcctactttacagtccattacttggcaaatgattgagcagattcagttcgttaagctctttggtatggtgaagatcgataaccttctgcaggagatgctgctcgggggagcctccaacgacggttcccacctgcatcatcccatgcacccacatttgtcacaggatcccctgactggccaaaccatcttgctcgggcctatgagcacattggttcatgctgatcagatttctaccccagagaccccactgccgagtcccccacaaggcagtgggcaagaacaatacaagatcgctgccaatcaggctagtgtgattagccaccaacacctctcaaagcaaaagcagctgtag

SEQ ID NO: 119760 - DNA, 1338 bp, Artificial Sequence
  Description of Artificial Sequence: Synthetic coding sequence
atggacatggccaactacagcgaggtgctagacccaacatatactacactcgagtttgagacaatgcaaatcctttacaactcgtctgactcctcagcccccgagactagcatgaacactactgataacggtgtgaactgcctgtgcgctatttgtggggatagagccaccgggaaacactacggtgcttccagctgcgatgggtgcaaaggctttttcagaagatctatccgtaagagtcacgtttactcgtgccggttcagccggcagtgtgtggtcgacaaggataaaagaaatcagtgccgttattgccgcctccgcaaatgcttccgggccggcatgaaaaaggaagccgtccagaatgagagggaccggatctcgacccggcggtctacctttgacgggtctaacatccccagtataaatacactcgcacaagctgaggtgcgcagtagacagatttctgtgagttccccaggcagctctaccgacattaatgttaaaaagatcgcttcaattggggacgtatgtgagtccatgaagcagcagcttctggtgctggtcgaatgggctaagtatatccctgcattttgcgagctgcccctagatgaccaagtcgccctcctgcgggcacacgcaggagagcacctgctgttgggggcgaccaagaggtcgatgatgtataaggacattctgctcctaggcaacaattatgttattcaccggaacagctgcgaggtcgagatcagccgggtagccaatcgcgttctcgacgaactcgtgcgccctttccaggaaattcagatcgatgataacgagtatgcatgccttaaggcgattgtctttttcgacccagacgccaaggggctgtcagaccctgtaaaaattaagaacatgcgctttcaggtccagattggccttgaagattatatcaatgacagacagtatgattcccgggggagatttggtgagcttctgttgttacttcctactcttcagtccatcacatggcagatgatcgagcagatccagtttgtaaaattgtttgggatggtaaagatcgacaatctgctgcaggagatgctgctgggcggtgcgagcaacgatggatctcacctgcaccaccccatgcatcctcacctcagccaggatccccttacaggtcaaacaatcttgttggggcccatgagcactcttgtgcatgctgaccagatcagcacccctgaaacacccctcccatctcccccgcagggaagcgggcaggagcaatataagatcgccgcgaaccaggctagcgtgatttctcaccagcacctgtccaagcagaaacagctgtag

SEQ ID NO: 119761 - DNA, 723 bp, Artificial Sequence
  Description of Artificial Sequence: Synthetic coding sequence
atgtccaggagcaacagacaaaaggagtataaatgcggagacttggtgttcgcaaaaatgaaggggtaccctcattggccagcaaggatcgacgaaatgcctgaagccgctgtcaaatccaccgccaacaaatatcaagtcttcttttttggaacacacgaaaccgcctttctaggtcctaaggacctgtttccctatgaggaatcaaaggaaaagttcggtaagccgaataaaaggaagggattttcagaggggctgtgggagattgagaataaccccacagtgaaagcctcaggctaccagagcagccagaagaagtcctgtgtggaggaacctgagccagagcccgaggctgcagagggtgacggagataaaaagggaaacgccgaagggagtagtgacgaagaggggaagctggtaatcgatgagccagcaaaggagaaaaatgaaaagggcgcactgaagcggcgcgccggcgatcttcttgaagattccccgaagcgtccgaaggaagccgagaatcccgaaggcgaagagaaagaagctgctaccctggaggtcgaacggcctctcccaatggaggtcgagaaaaacagcaccccaagcgagcccggatccgggcggggtccacctcaagaagaggaggaggaagaggatgaagaggaggaggctactaaggaggatgctgaagcccccgggatacgggaccatgaatctctttag

SEQ ID NO: 119762 - DNA, 771 bp, Artificial Sequence
  Description of Artificial Sequence: Synthetic coding sequence
atgcacccagagggaggccaattcgtccctcagctcctcggacatctgctcgccaccaaactcaagaggtttctcttatccaaaggcggcaggcgggcccagatcccagatgtcagccgcgccacccctcatactattgacgaaatgcctgaggcggccgtgaagtccactgccaacaaatatcaggtcttttttttcggtacgcatgaaacggccttcctcggacccaaagacttgtttccatatgaagagagtaaagagaagttcggcaaacctaacaagcgcaagggattctccgagggtctctgggagatcgagaataacccgacagtgaaagcgtcgggttatcagagctctcagaagaaatcctgcgtggaggagcctgaacccgagccagaggcagcggaaggtgacggagataagaaggggaacgcagaggggagcagtgacgaggaaggcaaattagtcatagacgaaccagcaaaagagaagaatgagaagggcgctctgaagcgaagggccggcgacttgctagaggattcaccgaagagacctaaagaggctgagaatcccgaaggtgaagagaaggaggctgccaccctggaggtggagaggcctctgcctatggaggtggaaaaaaactcaaccccatctgagccagggagcggccgggggcctccccaggaagaggaagaagaggaggatgaggaagaggaagcaactaaggaagatgcggaagctccaggaatccgcgatcatgagagtctgtag

SEQ ID NO: 119763 - DNA, 702 bp, Artificial Sequence
  Description of Artificial Sequence: Synthetic coding sequence
atggagcaacgggcagggggaaaccgggtgcagaccagcaccctgaactgcgcaggcgcagcggtcatcgacgagatgccggaggctgctgtgaaaagtacggcaaataagtaccaggtcttctttttcgggacgcacgagaccgccttcctggggccaaaagacctgtttccttacgaggagtctaaagaaaagttcggaaaaccgaataaacggaaaggcttcagcgagggcctgtgggagatcgagaataatcccaccgttaaagcctcagggtaccaatcctcccagaagaagagctgtgtcgaggagccagagccagagcctgaggccgctgagggagatggagacaaaaaagggaacgctgaaggatcaagcgatgaagaggggaagctcgtgatcgatgagccggccaaagagaagaatgagaaaggcgcactgaagagacgagccggagatctcctcgaagatagccctaaaagacccaaggaggccgagaaccctgagggggaggaaaaagaagccgctactttggaggtggagagacctcttccaatggaggttgagaagaactctaccccctccgaaccgggtagtggaagagggccgccacaggaggaggaagaagaagaagatgaagaagaggaggccactaaggaggatgctgaggcgccaggtattcgggaccacgaaagcctgtag

SEQ ID NO: 119764 - DNA, 789 bp, Artificial Sequence
  Description of Artificial Sequence: Synthetic coding sequence
atgtctagaagtaatcgccagaaggaatacaagtgtggtgacctcgtgttcgccaaaatgaaaggttaccctcactggcccgcccgcattgatgagatgcctgaagccgctgtcaagagcactgctaataaatatcaggtatttttttccggccctacaagaagacacagctgggcaccgaaaacaagctctctgacaagaaatccacgccgctcacttgccagcccaacacgaggaaagggaagtgcacgcggctgtggccgctcccgtacaaccctgctgtcaaggctacccgcgatttcaccacccccatcttgtactgaaccctgtctgcctggccagtgggtgtaccctggagctaaccctactgagtccagtcagaaaaagtcatgcgtagaagaacctgaacccgaacccgaagctgccgaaggggacggcgacaagaagggcaacgccgaaggctcttctgacgaggagggtaagttggtcatagatgaaccggcaaaggagaaaaacgaaaaaggcgccctgaaacgcagggccggggacctgctcgaagattctcccaagaggccaaaagaggcagagaatcctgaaggcgaagagaaggaggcagcaacactggaggtggagaggccactgcccatggaagtcgagaaaaatagtactccttctgagcctgggtcagggcggggacccccacaggaggaggaagaggaggaggacgaggaagaggaggctaccaaagaagatgccgaagctccgggtatcagagatcacgaaagatag

SEQ ID NO: 119765 - DNA, 627 bp, Artificial Sequence
  Description of Artificial Sequence: Synthetic coding sequence
atgccagaagcagccgtgaaatctacggcaaacaaataccaggtgtttttctttgggactcatgagacggctttccttggtcctaaagatctcttcccttacgaggagtccaaggagaaatttggaaaaccaaataagcgcaagggctttagtgaggggctctgggagatcgaaaacaaccccacggtaaaagcctccggctatcagagtagccagaaaaaatcttgcgtggaagaacctgaacctgagccagaggctgcagagggcgatggagataagaagggtaatgcggaggggagttccgacgaggagggcaagcttgtgatcgatgaacctgcgaaagaaaagaacgagaagggagccctaaaacgccgtgccggtgatttgttagaggactctcccaagcgtcctaaggaggccgagaatcctgaaggcgaggagaaggaggcggccaccctcgaagtcgagcggccactacccatggaggtcgagaagaactccacaccgtctgaacccggcagtggacgcggtccacctcaggaagaggaggaggaggaagacgaggaagaggaagctaccaaagaggatgctgaggccccagggatcagagatcacgagtcgctgtag

SEQ ID NO: 119766 - DNA, 723 bp, Artificial Sequence
  Description of Artificial Sequence: Synthetic coding sequence
atgagtagatctaaccggcagaaggagtataaatgcggtgacttagtgtttgctaaaatgaagggttatcctcactggccagcacgcatcgacgaaatgcctgaggccgctgtgaagtccactgctaacaaatatcaggttttcttcttcggtacacacgagactgccttcctggggcctaaagacctgttcccttatgaggaatccaaggaaaaatttgggaaaccgaataaacggaagggcttttccgagggtctgtgggagattgagaacaacccgacggttaaagcatcggggtaccagagctcccagaaaaaatcttgcgtcgaagaacctgagcctgagcccgaagcagccgaaggcgacggcgacaaaaagggaaatgccgaggggtccagcgacgaggagggaaagttggtgatagacgagcctgccaaagagaagaatgaaaagggggccctcaaacgcagggctggcgacctgctggaagattcccctaagcgtccaaaggaggcggaaaaccccgaaggcgaggagaaggaagccgctacattggaagtcgaacggccgctgccaatggaggtggagaagaactccactccaagcgaacccgggtctggccgtggtcctccccaggaggaagaggaggaagaggacgaggaagaagaagctacaaaggaggacgccgaggcccccggcattagagatcatgagtctctttag

SEQ ID NO: 119767 - DNA, 2676 bp, Artificial Sequence
  Description of Artificial Sequence: Synthetic coding sequence
atgcatgccattaacggattcgttttcgggaacctgcccgagctaaatatgtgcgctcagaagcgcgtcgcatggcatctgttcggcatgggaaacgaaatcgacgtgcacaccgcattctttcatgggcagatgctgaccacccggggacatcatactgacgtggccaatatcttccctgctacatttgtcactgctgagatggtaccctgggagcccgggacatggctgatctcttgccaggttaatagccattttcgcgatggtatgcaggccctgtacaaagtgaagtcttgctctatggcccccccagttgacctccttacaggaaaagtgagacaatatttcattgaagcacacgaaatccaatgggattacggtcctatggggcacgatgggtctacagggaaaaaccttcgagagccaggctccatatcggataagtttttccagaaaagcagcagcaggatcggggggacttactggaaagtgcggtacgaagccttccaggacgaaacatttcaagagaaaatgcacctggaggaggatcgccatctggggattctcggccccgttataagggctgaagttggtgacacaatacaggttgtgttttataatagggctagccagcctttttctatgcagcctcatggggttttttacgaaaaagattacgagggcactgtgtacaacgacggatctagctaccctgggctggtggcaaaacccttcgaaaaggtgacctacagatggacagtgccccctcacgctggacctacggctcaggaccccgcttgtctcacctggatgtacttttctgctgccgaccccattagggatacgaatagcggccttgtcggccctctgctggtctgccgagctggggcgcttggtgcagatggcaaacagaaaggagttgataaagaattctttctgttattcaccgtgcttgatgaaaacaagagctggtattcaaacgcaaaccaggcagcagccatgttggattttcggctgttgtctgaagacattgaggggttccaggactcgaatagaatgcatgccatcaacgggtttctcttctccaacctgccgaggcttgacatgtgcaagggcgacaccgtggcgtggcacctactgggcttaggaaccgagactgatgtgcacggcgtgatgttccagggcaataccgtgcagttacaaggcatgaggaaaggagcggcaatgctgtttccacatacattcgtgatggctattatgcagcccgataacctgggtacatttgagatttactgtcaggcgggatcccaccgcgaggccggcatgcgggccatctacaatgtctcccagtgcccaggacaccaggcaacaccaagacagagatatcaggctgcgcggatctattacattatggctgaggaagttgagtgggattactgtcctgatcggagttgggagagagagtggcacaaccagtcagagaaagactcttatggttatatcttcttatctaataaggacggcctgctaggaagtaggtacaagaaggctgtctttagggagtacactgatggcacctttcgaattccccgcccccggaccggacctgaagaacacttggggatcctcggccctcttatcaaaggcgaagtaggcgatattttgaccgtggtgtttaaaaataacgcctcaaggccctatagtgtgcatgcacatggcgtcttggagtctactactgtttggcccctggcggcagagccaggcgaggtggtgacctatcagtggaatatcccagaaagatccgggccaggaccaaacgattccgcttgtgtgagctggatctattattccgcagtggaccccatcaaagacatgtatagtgggctcgtgggacccttagctatttgccagaaagggatactcgagccacatggaggacgctctgacatggatagagaatttgccctgttgttcctgattttcgatgaaaataagtcatggtatctggaggagaacgtggctactcacggttcacaggatcccggttccataaacctacaggacgagacatttttggaatccaataaaatgcacgcgataaatggaaagttgtatgctaacctgcgcggcctgacgatgtaccagggcgaaagagtcgcatggtacatgctggccatgggacaggatgtggatctccataccattcactttcatgcggaatcctttctgtatcgtaacggcgaaaactatagagccgatgtggttgatctcttcccaggcactttcgaggtcgtggagatggtagcctctaacccaggcacgtggctcatgcactgtcacgttaccgatcatgtgcacgccggaatggaaactctattcacagtatttagcagaaccgagcacctgtccccacttacagtgattacgaaggagacagaaaaggccgtgcctccgagagacatcgaagagggtaatgtcaaaatgctaggtatgcagatacccattaaaaacgtagaaatgcttgctagcgttctggtcgccattagtgtgacactgctgttggttgtcctcgccctggggggcgttgtgtggtatcagcacaggcaacgcaagcttagaaggaatagacggtcaatactcgatgatagtttcaaactcttgtcattcaagcaatag

SEQ ID NO: 119768 - DNA, 3477 bp, Artificial Sequence
  Description of Artificial Sequence: Synthetic coding sequence
atggaatccggtcacctcctttgggcactactcttcatgcagtctctttggccgcaactgacagacggcgccaccagggtgtactacttgggaatccgcgacgtccagtggaactatgcacccaagggccgcaatgtgatcactaatcagccactggactcagatatcgtagcatcctctttcctgaagtccgataaaaataggatcggtggcacatataaaaaaacaatttacaaagagtacaaggatgactcctacacggatgaggtggcgcagcctgcctggctgggcttcctcggacccgtccttcaggccgaggtcggagatgtaatactgattcatctgaagaatttcgcaacacgaccatacacaattcaccctcacggggtgttttatgagaaggatagcgaaggatcactgtaccctgatggatcatccgggccactaaaggccgatgattccgtgcctcctggcgggtcgcacatttataattggacaattccagagggccatgctcccactgacgctgaccccgcttgtttgacctggatttatcatagtcatgtcgacgcccctcgggacattgctactggactcatcggcccactcattacttgcaaacgcggcgcactggacggcaattctcctcctcagcggcaggatgtagaccatgattttttcctcctgttctctgtcgtggatgaaaacctttcttggcacttgaatgaaaatattgccacatattgcagtgaccctgcctctgtggacaaagaggacgagacctttcaagagagcaatcgcatgcatgcaattaacgggttcgtcttcggtaatctgccagagctgaacatgtgtgcccagaagcgcgtggcttggcatctgttcggcatgggcaacgagattgacgtacatacggccttttttcatggccaaatgctgaccactagagggcaccacacggatgtggccaacatttttccagctacattcgtgacagccgagatggtgccctgggaaccgggcacctggcttatatcctgccaggtgaatagccatttccgtgacggtatgcaagccttatataaagttaagtcgtgctccatggcaccgcctgttgatctccttacaggtaaggtaaggcaatatttcattgaagctcatgaaatccagtgggactacgggccaatgggccatgacggctctaccggcaagaacttgagggaacccggttcaatttccgataaatttttccagaaatcatcgagtcgcataggggggacgtactggaaagttcggtacgaggcttttcaggacgaaacattccaggagaaaatgcatctcgaggaagatcggcacttagggattctcggacctgtcatcagagccgaggtcggagacaccatccaagtggttttttataaccgggcttcacaaccgttcagtatgcagcctcacggggtattctacgagaaagattatgaggggaccgtgtacaatgatggttcatcttatccaggcctggtagctaagcctttcgagaaggtcacctatagatggaccgtacctccccacgcagggccaactgcccaggatcctgcctgtttaacgtggatgtatttctcggcagccgatcctatccgtgataccaactctggcctggtgggacctctcctggtctgtagagccggcgccctgggtgccgacggtaagcaaaaaggggtagacaaagagttcttccttctgttcacagtgctggatgagaataaaagctggtactctaatgccaaccaggctgccgccatgctggacttcaggctcttgagcgaagacatcgaaggtttccaggattccaacaggatgcacgcaatcaatggctttctgttttctaatttgccaaggctggatatgtgcaagggagacaccgtggcctggcacctgctgggactgggtaccgagactgacgttcacggggttatgttccagggaaatactgtgcagctccagggcatgcgcaagggagctgccatgcttttccctcatacttttgtaatggcgataatgcagccagacaacttggggactttcgagatctactgccaggcgggctcccaccgcgaagctggcatgcgtgccatttataatgtgagtcaatgtccggggcatcaagctacaccccggcaaaggtaccaggctgcccgcatctattacattatggccgaggaagttgaatgggactattgtcctgataggtcatgggagagagagtggcacaatcagtccgagaaggattcatatggatatatcttcctgagcaataaggatggactccttggcagcaggtacaaaaaagcggtatttagagaatacactgacggcaccttccgcatccctcgcccccgcaccggacccgaagaacacctgggaattctcggtccccttattaaaggagaggtaggagatatattaactgtcgtgttcaagaacaacgcctccagaccatattctgtccacgcacacggtgtcctggaatctactacagtctggcctctggccgctgagccgggcgaagtggtcacctaccagtggaacatccctgagcgcagtggtccaggacccaatgattcagcctgtgtgtcttggatctattactccgcagtggatcctatcaaggacatgtattccgggctggtcggccccttggctatctgccaaaagggtatacttgagcctcacgggggccgctctgatatggaccgggagtttgccctgttatttcttattttcgacgagaataaatcctggtacctggaggagaatgtagccactcacggatctcaggaccctgggagcatcaatcttcaggacgagactttcctcgagagcaataaaatgcacgccatcaacggcaaactgtatgccaatctcagggggctgaccatgtaccaaggcgaacgtgtggcttggtacatgctggcgatgggccaggatgtcgatctccacacaatccactttcacgccgaaagttttctctaccggaacggtgagaactacagagcagatgtagtcgacttgttcccaggaacgttcgaggttgtggagatggtcgcctctaacccaggcacttggctcatgcattgccacgtaactgatcacgttcacgctggcatggaaactttgtttaccgtattctccagaaccgaacatctgtctcccctgacagtgatcacaaaagagacagagaaagcagtccctcctcgtgacatagaagagggtaatgtgaaaatgcttggcatgcagatccctataaaaaatgtggagatgctagcgtcggtactggtcgccattagcgtgacactgctgttggtggtgctcgcactgggcggggttgtctggtatcaacataggcagcgaaagctgagaagaaatcgcagatccatactagatgactctttcaagttattatccttcaagcaatag

SEQ ID NO: 119769 - DNA, 3486 bp, Artificial Sequence
  Description of Artificial Sequence: Synthetic coding sequence
atgtgggctatggagtctggtcatttactctgggccctgttattcatgcagagtttatggccacagctgaccgacggagccactcgcgtgtattacctcggaattagggatgttcagtggaactacgcgcccaaaggtcgcaacgtgataaccaaccaaccccttgattctgatatcgtggcatccagcttccttaagtctgataagaaccggatcgggggaacctacaaaaaaaccatttataaagagtacaaagacgatagctataccgatgaagttgcccaaccagcatggttgggattcctcggccctgtcctgcaggcagaagtcggcgatgtcatcctaattcacctgaaaaacttcgctaccagaccctacacaatccatccccacggcgtgttctacgagaaagatagcgaaggatctctatatccagacgggtcctccggccctctgaaagcagatgactcggtgccacctgggggatcacacatctacaactggaccattcccgaagggcatgcacctacggatgcagaccctgcttgtctcacatggatctaccacagccatgttgacgctcccagggatattgcaacaggcctcataggccccctgatcacctgcaagcgcggcgcgttggatggaaactctccaccacagaggcaggacgtagatcacgatttctttctccttttcagcgtggtggatgaaaatctgagttggcatctgaatgaaaacatagccacatactgttccgatcctgcttccgtcgataaggaggatgaaacttttcaggagagcaacagaatgcatgcgattaacggctttgtcttcggaaacctacccgagctgaacatgtgcgctcagaagagggttgcttggcaccttttcgggatgggcaacgaaatagacgtccacaccgcgttcttccacggacaaatgctcaccacaagggggcaccacacagacgtagctaacatttttccggctacgtttgttactgctgagatggtgccctgggaacccgggacctggctgatctcatgtcaggtaaacagtcatttcagagatgggatgcaggcactctacaaggttaagagctgctctatggcccctcccgtggacttgctcacaggaaaggtcaggcagtatttcatcgaagcgcacgagatccagtgggattacggacctatgggccacgatgggtccacaggtaaaaatctgagagaacccggaagtatcagcgataagtttttccaaaagagctcaagccgaattgggggcacatactggaaggtgcgatacgaagcattccaagatgaaacttttcaagaaaagatgcatctggaagaagaccgacacctcggtatccttgggccggtgattcgcgctgaagttggtgatacgatccaggtcgtcttctataaccgggcgtcccagcctttctccatgcaacctcatggcgtgttttacgagaaggactacgaggggacagtgtataacgacgggtctagttatccaggccttgttgctaaacctttcgaaaaagtcacctatcgctggaccgtaccaccgcacgccggacccaccgcccaggatcctgcgtgtcttacgtggatgtactttagcgccgcagacccaattcgggataccaacagcggtctcgtgggacctctgttagtttgcagggcaggggctttgggagccgacggaaaacagaagggggtcgataaggaattctttttactcttcactgtattggatgaaaacaaatcatggtactctaatgctaatcaagctgctgctatgctcgacttccgcctgctgagtgaagatatcgaggggttccaagacagtaataggatgcacgccataaacgggttcctgttttccaatctcccacggcttgatatgtgcaaaggggatacagttgcatggcatctattggggctgggcacagagactgatgttcatggagtgatgtttcaaggaaatacagtccagctacaggggatgcgaaagggcgctgccatgctgttccctcacacattcgtgatggccatcatgcagccagataacctgggcacatttgagatttattgtcaagccggctctcatcgagaagccgggatgagggctatctataacgtgagccaatgtcctggccaccaggctactccgagacagcgctatcaggctgctaggatttattacattatggcggaggaagtggagtgggactactgtcccgaccgaagctgggaacgggagtggcataatcaatctgagaaggacagctatggctacatctttttgagcaataaggacggcttattgggaagccgctataagaaagcagtgttccgggagtacactgatgggactttcagaataccgcggccacggactgggcccgaagaacacctgggcatactgggtccactcatcaaaggggaagttggggatattcttactgtggtgttcaaaaacaatgcatcgcggccctattccgtccatgcgcacggcgttctggagtcaacgacggtctggcccttggctgctgaacccggcgaagttgtgacttaccaatggaatatccctgagcggtcaggacccgggcccaacgactcagcatgcgtttcctggatctactactcagccgtagacccaattaaggatatgtacagcggcctcgtggggccgttagccatttgccaaaagggtatactggagccccatggcggtagatctgacatggatagggaatttgctctgctgtttttaatttttgatgaaaacaagagctggtacctcgaagagaatgtggcgacccatggcagccaggatccgggctctatcaacctccaggacgagacctttctggagagcaataaaatgcatgcgattaatgggaagctttacgcgaacttgagaggcctcacgatgtatcagggggagagggtggcctggtatatgctagcgatggggcaggatgtagaccttcacactatccacttccacgccgagtccttcctttatcgaaacggtgaaaattatcgggccgatgtggtggatctgttccccgggaccttcgaggttgttgagatggttgcatccaaccctggaacatggctgatgcattgccatgtcacagaccacgtccatgccggaatggagacactgttcacagttttttccaggaccgagcacctgagcccattaacagtcattactaaggaaacagaaaaggctgttccaccccgtgatatcgaagaagggaatgtgaaaatgctcggtatgcagatccccattaaaaatgtcgagatgttggctagcgtcctcgtggccatcagcgtgaccctgctgctagttgtgcttgccctaggcggtgtggtctggtaccagcatagacagcgaaaactgcgacgcaatagacggtctattctggatgattcatttaagctgctctcttttaagcaatag

SEQ ID NO: 119770 - DNA, 2910 bp, Artificial Sequence
  Description of Artificial Sequence: Synthetic coding sequence
atgtgggctatggagtcaggacacctcctgtgggcactcttgttcatgcagagtctatggcctcagctgaccgatggcgccacacgggtctattacttagggattcgggacgtgcaatggaactatgctcctaagggcagaaacgtgatcactaaccagccactcgatagtgacatagtggcctcctcattcctgaagtctgacaaaaaccgcatcggcggcacatataagaagaccatctacaaggaatacaaagatgacagttatacggacgaagtggcacagcccgcttggctcggtttcttgggaccagtgcttcaggctgaagtcggagacgtgatcttgattcacctcaagaacttcgcgactcgcccttacactattcatcctcatggcgtgttttacgaaaaagactctgagggctctctgtatccagacgggtcaagcgggcctctgaaggcagacgatagtgttccacctggggggtcccacatatacaattggactattccagaagggcatgccccaactgacgcggatcccgcttgtctgacctggatttaccactcacacgtagacgcccccagagacattgctactggcctcataggtcccctgataacatgcaagagaggggccctcgatggtaacagccctcctcagcggcaggacgtcgaccatgactttttcttgttattttctgtcgtggatgagaatctcagctggcatctgaatgagaacatcgcaacgtattgtagcgacccagcaagtgtggataaagaggacgaaacattccaggagagtaaccggatgcacgcaatcaacggcttcgtttttggtaacctgcctgagctgaatatgtgtgcccagaagagggtcgcctggcacctcttcgggatggggaatgagatcgacgtccacactgcctttttccatggacagatgctcactactcgaggacatcacaccgatgtggctaacatttttcccgctaccttcgtcacagccgagatggtaccctgggaaccggggacatggctaatttcctgccaggtcaacagccacttccgcgacggcatgcaggccctatacaaagtgaaatcctgctctatggctcccccagtcgacctgctgacagggaaggtgcgccaatatttcatcgaggcccatgagatacagtgggactacggtcctatgggacacgatgggtctacagggaagaacctgagagaaccggggagtattagcgacaagtttttccagaaatccagctccagaattggcgggacctactggaaggtacgctacgaagccttccaggatgagacatttcaggagaagatgcatctggaggaggataggcaccttgggatcttaggacccgtgatccgggcggaggtgggagacaccatccaggtagtgttttataatcgcgcttcacagcccttcagcatgcagcctcatggggtcttttacgagaaggactacgagggcacagtatataacgatggcacttttgaaatatattgccaggctggatcccatcgggaagcaggtatgcgtgccatctacaatgtaagccagtgtcctggccaccaggccacgccgaggcaacggtatcaggctgcacgtatctattatattatggcagaggaggtggaatgggactactgtcctgacagatcttgggagcgagaatggcacaaccagagcgagaaggactcatatggctatattttcttgtctaacaaagatggactgctcggttccagatacaagaaggctgtgtttagggaatacaccgacggtacattccgaattccgaggccgagaaccggtccggaggagcacctggggatcctgggcccactgattaagggtgaggtgggcgatatattgaccgtggtatttaaaaataacgcgtctcgaccttattccgtgcacgcacatggggtgcttgaatcgaccaccgtttggccgctcgcagcggagcccggcgaggtcgtcacctaccaatggaatattcctgaaagatcagggcccggccctaatgacagtgcatgtgtctcttggatctactactctgccgtggatccgatcaaagacatgtattccggacttgttggtcccctagcaatatgccaaaaagggatcctagagccccatggagggcggagcgacatggaccgagaattcgccctattattcttaatcttcgatgagaataaatcctggtacttggaggaaaacgttgctacccatgggtctcaggaccccggctccatcaacctgcaggatgagacctttctggaaagcaataaaatgcacgctattaacggcaagctctacgctaatctccgaggcctaactatgtaccagggcgagcgcgtcgcttggtacatgctggcaatggggcaggatgtagacctccatacaattcatttccatgctgagtctttcctgtatcggaatggagagaactatagagccgacgttgtggatctatttcccggcacgtttgaggtagttgagatggtagcgtcaaatccaggaacttggctcatgcattgtcacgttacggaccacgtacatgccgggatggaaactttgttcacagtgttcagccgaaccgagcatttgtcgcccctcacggtcattactaaagagacagagaaagctgtccctccgcgggatatcgaggaaggtaacgttaaaatgctcgggatgcagattcctattaaaaacgtggagatgctcgcttctgtgctcgtggccatatcagtcaccctccttctggtggtattggccctgggcggggtggtttggtatcagcacagacagcggaagctcagacggaacagaagaagtatcttagatgactcctttaagctactgtcgttcaaacagtag

SEQ ID NO: 119771 - DNA, 2436 bp, Artificial Sequence
  Description of Artificial Sequence: Synthetic coding sequence
atggaatcaggtcatttgctttgggcactgctcttcatgcagtcattgtggccccagttaacagacggcgccactagagtttactatttaggaattcgtgatgtccagtggaactacgccccaaaaggcagaaacgtcataacaaaccaaccccttgacagcgacatcgtggcatccagtttcctcaagtccgacaaaaacagaatcggcggtacttacaaaaagactatctacaaggagtacaaagacgattcgtatacggatgaggtggcccaaccagcatggttgggctttctgggcccagtgcttcaagctgaggtcggtgacgtgattttaatccacctcaaaaacttcgctacgaggccgtatacaattcatccccatggcgtcttctatgaaaaagacagcgagggaagtctttacccagatggaagcagcggccccctgaaagcagacgactccgtgcctccaggcggcagccacatctacaactggacaatcccagagggacatgccccaacggacgcagaccccgcttgcttgacttggatctatcacagccatgtagacgcccctcgcgatattgcaaccggactaataggcccacttattacttgtaagagaggcgcactggatggcaactcaccaccacagcgacaggatgtggatcacgatttcttcctgcttttctccgttgtggatgaaaacctctcatggcatctgaacgaaaacatcgctacttactgttctgacccagcttcagttgacaaggaagacgaaacattccaggaatccaacagaatgcatgccatcaatggtttcgtctttgggaacctgcccgagttgaacatgtgtgctcaaaagagggttgcctggcatctctttgggatgggtaacgagattgacgttcataccgctttcttccacggccagatgctcacaacaaggggccaccatacagacgttgctaatatttttcccgcgacatttgtcactgccgaaatggttccatgggaacctggcacctggctaatttcttgccaggtgaactcgcacttcagagacggaatgcaggccctctataaggtaaaatcttgctccatggcacccccggtcgatttgctgacaggaaaggtccggcagtacttcatcgaagcacatgagatccagtgggattacggacccatggggcatgacggcagtactggcaagaacctccgcgaaccaggctcaataagcgataagtttttccaaaaatcgagcagccggattggtgggacctattggaaggtaagatatgaagcttttcaggacgaaacctttcaggaaaagatgcacttggaagaagacaggcatctggggatcctgggaccggtgattagagccgaagttggcgatacaatccaggtagtattctataaccgcgcatctcagcccttcagcatgcagcctcacggcgttttctacgaaaaagattatgaggggacagtctacaatgatgatcccatccgggacacgaacagtggtctggtgggaccattgctcgtctgtagggctggcgctctgggagcagacggaaagcagaaaggtgttgacaaggaattctttctactcttcacagtgctggacgagaacaaatcctggtactctaatgctaaccaagccgccgcgatgttggattttcggctgctgtccgaggatatagagggctttcaagactctaataggatgcatgccattaacggtttcctgtttagcaacctccctcggttggacatgtgtaaaggggacaccgtggcctggcacctcctggggctgggaacggagacagatgtgcacggggtgatgtttcagggaaataccgttcaactgcaaggaatgagaaagggagccgctatgcttttcccccacaccttcgttatggccattatgcagccagacaacctgggaacttttgagatctattgccaggccggatcccaccgcgaggccgggatgcgagctatttataacgtatctcagtgccctggacatcaggctacacccaggcagaggtaccaggcagcgaggatatattacataatggccgaagaggtcgagtgggattattgcccggacagaagctgggagagggaatggcataaccagtccgaaaaagacagctacggatacatatttctgtcaaataaagatggtctcctcggatcccgctataagaaagccgtttttagagagtacactgacggtacatttaggataccacggccgagaacgggccccgaagaacatctgggaattttgggacccctcatcaagggtgaagttggtgacatcctgacagtggtgttcaaaaacaatgcaagccgcccttactccgtacatgctcacggggtccttgagtccaccactgtgtggccgctggcagctgagccttag

SEQ ID NO: 119772 - DNA, 3483 bp, Artificial Sequence
  Description of Artificial Sequence: Synthetic coding sequence
atgtgggccatggaaagtggccacttactgtgggcgctgctgtttatgcagagtctgtggcctcagctcaccgacggggccacaagggtctattacctcggaataagggatgtgcaatggaattatgcccctaaggggcgcaacgtgattacaaaccagccgctggatagcgacatcgttgccagtagcttccttaagtctgataagaatcgtatcggcggtacttataagaagactatttacaaagaatacaaagacgacagctacactgatgaggtggcacagccagcatggctgggttttctcgggcccgttcttcaggcggaagttggagatgttattttaatacacttgaagaattttgcaacaaggccatacacaatccatccgcatggcgtattctacgaaaaagactctgagggctccctgtatcccgatggatctagcggacctctcaaggccgacgattctgtgccaccgggagggagtcacatctacaactggacaatccccgagggtcacgcaccgaccgatgcagaccccgcgtgcctcacatggatttaccattctcacgtggacgctccccgcgacatcgcaaccgggctgattggaccacttattacatgcaaacgcggcgcactcgacggaaatagtccacctcagagacaggacgtggaccacgacttctttctcctcttctctgtggtggatgaaaacttgtcctggcatttaaacgaaaacatcgcaacttactgttcagaccctgcctcggtggataaagaagacgaaacattccaagagtccaatcggatgcacgcgatcaacggattcgttttcgggaacctgcctgagctgaacatgtgtgcgcaaaagcgagtggcctggcatttatttgggatgggtaacgagatcgatgtacatacagcatttttccatgggcagatgttaacgacacgcggacaccacactgatgtcgcgaacatctttccagcaaccttcgtgaccgccgagatggtaccctgggagccgggtacatggctcatatcctgtcaggtgaattcacattttcgagatggaatgcaggcactgtacaaagtgaagagctgctctatggcgcctcccgtggatctgctgactgggaaggtccgccaatattttatagaggcccatgagattcagtgggattatggccccatgggccacgatgggtccacaggaaagaacctcagagaacccggtagcattagcgataaatttttccagaagagctcaagtcgaatcggaggcacgtattggaaagtccggtacgaagcttttcaagatgagactttccaggagaagatgcacctggaggaagatcgccacctcggaatattgggacctgtcatccgtgccgaggtcggagatacgatccaagtagtcttctataatagagctagccagcctttctctatgcagccacatggcgtcttctacgagaaggattacgaagggacagtgtacaatgatggttcatcctaccccggccttgtagcaaagcccttcgagaaggtcacctaccgctggacggtcccccctcacgctggtccaacagcacaagaccccgcctgtctgacatggatgtacttctcggctgctgaccctatccgggatacgaactctgggctggtaggccctttgctggtctgtcgagctggagcgctcggagcagacggcaaacagaaaggcgtcgacaaagaatttttcttgttatttactgtgctcgatgaaaacaagagttggtattccaacgccaaccaggcagccgctatgttagacttcaggttgttatccgaggacattgaaggatttcaagactctaatagaatgcatgccattaacggattcctgttttctaatctcccccggcttgatatgtgtaaaggggatactgtggcttggcatctgctgggcctcgggactgaaacagatgtccacggggttatgtttcaggggaacaccgtgcagctgcagggtatgcgtaagggcgctgccatgctgtttcctcacaccttcgttatggccataatgcagcccgataatctgggaacttttgaaatctactgtcaagcgggcagccacagggaagctgggatgcgagccatatataacgtgagccagtgcccaggccatcaggccactccccgtcagcgttatcaggctgcgaggatctactacataatggccgaagaagtggagtgggattattgtccggatcgctcatgggaaagggagtggcacaaccagtctgagaaggattcatatggctacattttcctgagcaacaaggacggcctcctgggctcacgctacaaaaaggccgtgtttcgagagtacaccgatggcacatttcgaataccacgtccccggacaggtcctgaggaacatctgggtatcctggggccgctgatcaaaggggaggtaggcgacatcctcacagtagtcttcaagaacaatgcttcacggccgtactctgttcatgcacacggagtactggagtccaccactgtgtggccacttgcagccgagccaggcgaagtcgtcacttaccagtggaacataccagaaagaagcggcccagggccaaatgatagtgcttgtgtctcttggatctattacagtgctgtagacccgatcaaggacatgtactcaggtctggtgggaccccttgccatctgccagaagggtattctggagcctcacggcgggaggtccgacatggatcgtgaatttgccctcctattcctcatttttgacgaaaacaaatcttggtatttagaggagaacgtggcaacgcacgggtctcaggacccagggagcatcaacctgcaggatgagaccttcctcgagtcaaacaagatgcatgccattaacggtaagctctacgcaaacttaagaggccttacgatgtaccaaggggaaagggtggcttggtacatgttggctatgggtcaggacgtggacttgcacactattcatttccacgcagagagctttttatatcggaacggagagaattatcgcgccgatgtggtggatttgttccctggaacctttgaagttgtggagatggtggcctcgaatcctgggacttggctcatgcactgccatgtcactgatcatgtgcacgcaggaatggaaacactgtttactgtcttctcccgcaccgagcacttatcgccactgaccgtgatcaccaaggagactgaaaaagtccctccacgtgatattgaggaagggaatgttaaaatgctgggaatgcagattcccattaagaacgtggaaatgctggcttccgtgctggtcgctatcagcgtaacgctgctgcttgttgtgctcgcactcgggggcgtggtgtggtaccagcacaggcagcgcaaactccgtagaaaccgtaggtcgattctggacgactcctttaaactgctctctttcaaacagtag

SEQ ID NO: 119773 - DNA, 627 bp, Artificial Sequence
  Description of Artificial Sequence: Synthetic coding sequence
atggagtctggccacctcttatgggcactgctgttcatgcagtccctgtggcctcagctcacggatggtgccactcgcgtctattatctcggtatcagggatgttcagtggaactatgcccctaaagggcgcaatgttatcactaatcaaccactggattccgacatagtagccagcagctttctcaaatccgataaaaaccggattgggggaacctacaaaaaaactatctacaaggaatacaaggacgactcgtatacagacgaggtggcgcagcccgcttggttaggcttcctgggccctgtcctgcaagccgaggtaggggacgtcatcctgatacacttaaagaacttcgctacacggccctatacgatccacccacacggcgttttttacgagaaagattcagagggcagcctgtatcccgatggctcttcaggccccctcaaggctgatgatagtgtgccaccgggcgggtctcacatatacaactggacaattcctgagggtcacgccccaacagatgccgatcctgcttgtcttacctggatctatcattcccacgtggatgctccaagggacatcgctacgggcttgattggacctctgataacctgtaagcggtag

SEQ ID NO: 119774 - DNA, 3639 bp, Artificial Sequence
  Description of Artificial Sequence: Synthetic coding sequence
atgacccagactctgccgtaccacctatcactactgaatgtgctgttcccagggccctgctcccggcattttaagtttaggcgcggcaagtgcgcccagcctgcttggcgcaaggtgtctgctccaagccaagacctgttgatcacaaaagtcatgtgggccatggaatccgggcacttactatgggccctgctttttatgcagagcctttggccccaactgaccgatggtgcaacgcgtgtgtattacctgggcatccgcgatgtccagtggaattatgccccgaaaggacgaaacgtcatcacgaaccagcccttagactctgacattgtggcaagctctttcttgaagtctgataaaaatagaatcggcggtacttataaaaagactatttacaaggagtataaagacgacagttacacagatgaagtggctcaacccgcatggctgggcttcctgggcccggttctgcaggccgaggttggtgatgtaattttgattcacctgaagaatttcgctacccgcccctacaccatccatccccacggggtgttttatgaaaaagattcagagggttctctctatccggacggaagcagtggacctttgaaggccgacgatagcgttccacctggtgggtcgcacatctacaactggaccattcctgaaggccacgcacccaccgacgctgaccctgcatgcctgacgtggatttatcactctcacgtagatgcccctagagatatagctacagggctgatcgggcctttaattacctgcaaacgcggtgccctggacgggaattcgccgccgcaacgccaggacgtggaccacgacttcttcctcctgttctccgttgttgatgagaatctgtcctggcatcttaatgagaatattgccacctattgttctgatcccgcctcggtggacaaggaagacgaaaccttccaggagagcaaccgaatgcatgctatcaacgggtttgtgtttggcaacttgcccgagcttaacatgtgtgcacagaaaagagtggcttggcatctgtttggtatgggaaatgaaattgatgtgcacacagctttttttcatggccaaatgctgactactcgtggacaccacacagacgtggccaacatttttcccgccacctttgtgacagctgaaatggtgccctgggagcctggaacctggctgatcagctgccaggtcaactcccatttccgggacggcatgcaggctctgtataaggtaaaaagttgcagtatggctcccccagtcgacctgctgacaggcaaagtgagacagtactttattgaggcacacgaaatacagtgggactatggacctatgggccacgatggcagtaccggcaagaatctgagggagcctgggagtattagcgacaagttctttcagaagtcctcttcacggatcggcggtacatactggaaagtgagatacgaggccttccaagacgagaccttccaggaaaagatgcatttggaggaggatcgccaccttgggatactgggccccgttatccgcgccgaggtcggagatactatccaggttgtattctacaacagagcaagtcagccttttagtatgcagccccacggggtcttctatgagaaggactacgagggaaccgtgtataacgacgggtccagttatcccggactggttgctaaaccattcgagaaagtgacttaccggtggaccgtaccgccccacgcgggacccacggcccaggatccagcttgtctcacatggatgtacttttcagccgcggaccccattcgcgacacaaattcaggcctggtggggcccctgttggtttgcagagccggcgccttgggggccgacggaaagcaaaagggtgtggataaggagttttttctgctttttaccgttttagacgaaaataagagttggtattctaacgccaaccaggcagcagctatgctggattttcggctgctttccgaggatatagaaggcttccaggattctaatcgcatgcacgctattaatggtttcttgttctccaacctgcctaggctcgatatgtgcaagggggacaccgtggcctggcacctgctcggcttgggaaccgaaaccgacgtccatggtgtaatgtttcaggggaatactgtgcagcttcagggcatgcggaagggggccgctatgttgtttcctcatacctttgtgatggcgattatgcagcctgacaatcttggtaccttcgagatctactgccaggccggttcacacagggaggctggaatgagggcaatctacaatgtttcccagtgcccaggtcaccaggctaccccacggcagcgttatcaagccgcgcgaatctactacattatggctgaggaggtggagtgggattactgccctgataggagctgggaacgggaatggcataatcaatccgagaaggactcatatgggtacatatttctatctaataaagacggcctcctgggttctaggtacaaaaaagcagtgtttagggaatacaccgacggcacattccggatcccacgtccccgtacaggccccgaggagcatcttgggattcttggccccctcattaagggagaggttggagacattctcaccgttgtgttcaagaacaatgccagccgcccttactccgtccacgctcatggcgtgctggaaagtacgacagtgtggcctctggccgccgaacccggcgaggtagtcacctaccagtggaacataccagaacgcagtggtccaggaccaaatgatagtgcctgcgtcagctggatttattacagtgcggtcgacccaatcaaggatatgtatagcggattagttgggccactagcaatttgccagaagggcatccttgaaccacatggcgggcgatccgacatggacagagagttcgcgctcttgttcctgattttcgatgagaataaaagctggtatcttgaggagaacgtggctactcacgggtcccaagatcccggatccattaatctccaggacgaaacgtttttagagtcgaataaaatgcacgctattaatgggaagctgtatgcaaacctgcgggggttgaccatgtaccaaggggagagggtggcatggtatatgctcgccatgggacaggacgttgaccttcataccatccattttcatgctgaaagctttctgtacagaaatggagaaaattatagagccgatgtagtggatctgtttccaggaacttttgaagtggtcgaaatggttgcgtctaaccctgggacatggctcatgcactgtcacgtgacagaccacgtccacgctggaatggagacactgtttacggtgttctcacgcaccgaacacttgtctccattgactgtgattacaaaggaaacagagaaggcagtcccacccagagatatagaggagggcaatgtcaagatgcttggaatgcagataccaatcaaaaacgtagagatgctggcctcagtattggtggcaatctctgtgactcttctccttgtagtgttagctctgggaggtgtggtgtggtatcagcaccggcagagaaaactcagacgaaatagaaggtcaatcctagatgattcctttaaattattatcctttaagcagtag

SEQ ID NO: 119775 - DNA, 1254 bp, Artificial Sequence
  Description of Artificial Sequence: Synthetic coding sequence
atggctcagaaggaggggggaaggaccgtgccttgctgctccagaccaaaggtagcagctctcacagcggggaccctgctgcttctgactgctattggagccgcgtcgtgggcaatcgttgccgtcctcttaagaagtgatcaggaacccctatacccggtgcaagtgagttcagccgatgcaaggcttatggtctttgacaagacggagggtacttggcgcctcttatgctcaagcagatcgaacgcgcgtgtggccgggctgtcatgtgaggagatgggatttctccgagcactgactcatagcgagctcgatgttaggactgctggcgctaacggcacaagtggcttcttttgcgtcgacgagggaaggctgccacacacccagcggttgctcgaggtgatctccgtatgcgattgtccccgaggaagatttctggccgccatttgtcaagattgcgggcggagaaagctgcccgttgaccggattgtgggtgggcgcgatacctcgttagggagatggccctggcaggtaagtttgagatatgacggcgcccatctctgcggaggaagccttttgagcggagactgggtcctgaccgcagcgcactgttttccggagcgtaaccgggtgctgtccaggtggcgggtgttcgctggagccgtggcacaagctagcccacacggtctccagctcggcgtccaggctgtggtctatcacggcgggtacctcccctttagagatcctaattctgaagagaactctaatgacatcgctttagtgcacctctcaagtccattgccactcacagagtacatccagccagtgtgtctccccgctgctggtcaggccctggttgatggcaaaatctgcacagttactgggtggggcaacacacaatactacgggcaacaggccggggtgttacaggaggcgcgagtccccataatttccaacgacgtttgcaatggtgctgatttctacggaaatcaaataaagccaaaaatgttctgtgcgggctaccccgaaggtgggatagacgcttgccagggtgactcggggggtccctttgtatgcgaggacagcattagccgaacaccaaggtggagactgtgtggaatcgtttcctggggcaccggttgtgcattagcccagaagcctggtgtgtataccaaggtcagcgattttcgggaatggatcttccaagctatcaagacacactcggaggctagcggtatggtgacacagctttag

SEQ ID NO: 119776 - DNA, 1254 bp, Artificial Sequence
  Description of Artificial Sequence: Synthetic coding sequence
atggcacagaaggaaggggggcgcacagtgccttgctgcagtaggccaaaagttgcggccctcaccgctggcacattattgttgctgacagcaatcggggcagcaagttgggccattgtcgctgttctgctgcgttcggaccaggagcctctctatcccgtccaggtgtcaagcgctgacgcaagacttatggtgttcgacaaaaccgagggaacgtggaggctcctgtgttcatcccgctcgaatgctcgcgtggccggactgtcctgtgaggaaatgggtttcttgagggctctgacccacagcgagctggacgttcggacagcaggagctaatggtacatcaggctttttttgcgtcgacgaggggcggcttccccacactcaaaggctcctagaagtgatctctgtatgcgattgcccccggggtagatttcttgctgctatatgtcaagattgcggtcggagaaaactgcccgtcgataggatcgtgggcgggcgggacaccagcctgggtcgctggccatggcaggtctccctgcggtacgatggggcccacctttgtggtgggtcactgctgtcaggagattgggttctgaccgccgcgcattgttttccagagcgcaaccgtgtcctctcccgctggcgggtcttcgctggggccgtggcacaggcttcgccacatggtttgcaactcggggtgcaggctgtggtgtatcacggaggctatctgcctttccgagacccgaactcagaagaaaactccaacgacatcgctctggtccacctttcttctccattgccactcaccgagtacattcagcccgtatgcctcccggctgcaggccaggctttggtggatgggaagatctgcaccgtaacaggctggggcaacacacaatactatggccaacaggccggcgtcctacaagaggccagagtacctattataagcaacgatgtgtgcaacggcgctgacttttatgggaaccagataaagccaaaaatgttctgcgcgggctaccccgagggcgggatcgatgcctgccagggtgacagcggcggcccattcgtgtgcgaagactctatctcccgaacaccacgatggcgactgtgcggcattgtctcatggggtaccggctgcgcactcgctcagaaacccggcgtctacacgaaagtctccgacttccgggagtggatcttccaggccattaagacgcactctgaagcatctggcatggtaacccagttatag

SEQ ID NO: 119777 - DNA, 1182 bp, Artificial Sequence
  Description of Artificial Sequence: Synthetic coding sequence
atgtgtaaaatgaggacacgcgaggacatgcagctaggtaatgagggccccgggaccgctctaaggctaattcacctgcaggtgagcagcgctgacgcaagattaatggtattcgacaagactgaagggacctggcgcctactgtgctcatccagaagtaacgctagagtggcaggacttagctgcgaggaaatgggctttttgcgagctctaacccactcagagctagatgtgagaaccgccggcgcaaacggaaccagcggtttcttctgcgtagatgaaggcagactcccgcatacccagcgtctcctggaagtcatctccgtatgcgactgccctcgtggtcggttcctggctgcaatctgtcaggattgcggcagaaggaagctgcctgtagatcggattgtcggcggccgcgacacctcgctaggccgttggccctggcaagtctccttgcggtatgatggggctcacctatgtggtggcagcctcctcagtggcgactgggtgttaacggcagcccactgctttcctgaacggaacagagtcctgagtagatggcgtgttttcgctggtgcagtcgcccaggcgagtccccatgggctccagctcggggtccaggcagtggtctaccacggcggctacctcccgttccgtgacccaaattccgaggagaacagcaacgacatcgccttggtgcacctgtcgtctccactgcctctcaccgagtacattcagcccgtctgtttgccagccgcagggcaggccctggtggacgggaaaatatgcactgtgaccgggtgggggaatacacagtactacggccaacaggctggtgtgcttcaggaagctcgggtccccatcatctcaaatgacgtgtgcaatggggcagatttttatgggaaccaaatcaagccaaagatgttctgtgcaggctaccctgaaggcgggatcgacgcctgtcagggggactctggagggcctttcgtatgcgaggactcaattagtagaacaccccggtggcgtctgtgtggaatcgtctcctggggtaccggttgcgccctagcccagaagccaggggtctacactaaggtttccgattttagagagtggatcttccaggctatcaaagtgaaagtcggatccaggtgggaacctggttggggccggctcggggtgtag

SEQ ID NO: 119778 - DNA, 2103 bp, Artificial Sequence
  Description of Artificial Sequence: Synthetic coding sequence
atgaaatgcgtcctggtcgcaaccgagggggctgaagtgctgttttactggaccgaccaggagttcgaggagtccttacggttgaagttcggtcagtctgaaaacgaagaggaggagctaccggcgctcgaggatcagctgtcaacactcctcgcgccagtgatcatcagcagtatgacaatgttagagaagctgagtgacacatacacttgttttagcaccgagaatggtaacttcctgtatgtgcttcatctgtttggggagtgtctgttcatcgccatcaacggcgatcacaccgagagcgagggcgacctgagaaggaagttgtatgtactaaaatatctctttgaggttcatttcggattagtgacagtggatggccacctgatccggaaggagttacgcccccccgatctggcccagagagtgcagctgtgggaacattttcagagcctgctatggacgtatagcagattgcgagaacaggaacaatgctttgcagtcgaggcactcgaacgattgatccatcctcagctctgcgagctctgtatcgaggccctggaacgccacgtgatccaagcggtgaacacaagtccggagcgggggggcgaggaagcgctacacgcgtttttactcgtgcactccaagcttctggctttttattcttctcatagtgcgtcctcgctgcgtccagcggacctcttagcgcttattcttctggttcaggatttgtaccccagcgagtctacagcagaagacgatatacagcctagcccccggcgggcccgctccagtcaaaatattcccgtacagcaggcctggtctccacacagcaccgggcctacgggtgggagtagcgccgaaaccgagaccgactcttttagtctgccagaggagtacttcaccccggctccatcgcccggagaccagagtagcggctccactatatggctcgagggaggaacccctccaatggacgcactgcaaattgcagaagatacgcttcagaccctggtccctcactgccccgtgcccagtgggcctaggagaatctttttagatgctaatgtcaaggagtcatactgccccctggtgcctcataccatgtattgtctgcctctctggcagggaataaatctggtgctcttaacacgcagcccttccgctcccttagctctcgtgttgtcccagttaatggacggtttcagcatgctggagaagaaactcaaggaggggccagagcccggagcgagtttgcgatcccagcctttagtaggcgatttgcgacagagaatggataagtttgtgaagaatcggggcgctcaggagatccagtctacctggctggagtttaaggcgaaagccttcagtaagtccgagccagggagtagctgggaactcctgcaggcatgcggaaagttgaagcgtcaattgtgtgccatctaccggctgaattttctcacgaccgccccttcccgcggagggcctcacctgccgcagcaccttcaggaccaagtgcagagactgatgcgcgaaaagctaactgattggaaggatttcctgcttgtcaagagccgacgcaatattacaatggtgagctatctcgaagactttccagggctggtgcattttatttacgtggacaggaccactggccaaatggtggcaccatcgttaaactgtagccagaagacatcgagcgagctgggcaaggggcctctcgccgcattcgtcaaaacaaaggtgtggagcctcatacagctggcacgccgctatttgcaaaaaggctatacaacgctcttatttcaggagggggacttctactgctcctattttctgtggtttgaaaacgacatgggatacaagctacagatgatcgaggtgccggtgctgtctgacgactcagtgcccatcggcatgctaggcggcgattactatagaaagctcctgcgctattattctaagaaccgacctaccgaagctgtgcgttgttatgaactgttggctctgcatcttagtgtgattccaactgatttattagttcagcaggcagggcagcttgccagacgcttgtgggaagcgtcccgaatccctctcttatag

SEQ ID NO: 119779 - DNA, 975 bp, Artificial Sequence
  Description of Artificial Sequence: Synthetic coding sequence
atgaagtgcgtgcttgtggcaacagagggtgccgaggtactcttttactggactgatcaggaatttgaagagtctctgcgactgaagtttggacagtccgaaaacgaggaggaggaacttcccgccctggaggatcagctttcaaccttgctggcccctgtgatcatttcaagcatgacaatgctcgagaagctatcagacacttatacctgcttctccacggagaacgggaacttcttatacgtgcttcacctgtttggggagtgcctattcattgccatcaatggtgaccataccgagagtgagggcgatctgcggcgaaaattatacgtgctgaagtacctcttcgaggtccattttgggctggtgactgtggacggccacctgatcagaaaggaactgaggcccccagacctggcgcaacgggtgcagttgtgggaacactttcagtctttactatggacctatagccgcctgagggagcaggagcagtgttttgccgttgaggcactggaaaggctgatccacccacaactttgtgagctgtgtatagaggccctcgagagacacgtaatacaggccgtcaatacctccccagagaggggtggggaagaggctctgcacgcctttcttctggtccattcaaaactcttagccttctactcctctcatagcgcatcaagtctccggcccgccgaccttttagcactgatattgctggttcaggatttgtacccttctgagagcacagctgaagacgatatccagccatctccaagaagggccaggtcctcgcagaatatcccggtgcaacaggcatggtcacctcacagtaccggaccaaccggcggcagcagcgccgagaccgaaaccgacagcttcagtctgcctgaagagtattttaccccagctccttcacctggggatcagagctccggagaagatcgtagaaaggccggtgggaacaatagttag

SEQ ID NO: 119780 - DNA, 981 bp, Artificial Sequence
  Description of Artificial Sequence: Synthetic coding sequence
cggctcatccatcctcagctgtgtgagctttgcatcgaagcattagagcgccatgtgattcaggctgtgaacacctctccagagagaggcggggaggaagccctccatgccttcctgctcgtccactccaagcttctggctttttactcctcgcattcggcctcttctctgagaccagcagatctcctggcccttatactcctagtgcaagatttgtatccatcggaatctacggcggaagacgatattcaagagactgactctttcagcctccctgaagagtactttactcccgctccttcacccggggaccaaagctccggctccaccatttggttagaaggcgggactcccccaatggatgccctccagattgccgaagatactctccagacattggtgcctcattgtccggtgccatcaggaccgcgaagaattttcttagatgccaatgtgaaagaatcatactgccctctggtgccacacaccatgtattgtctgcctctgtggcagggcattaatctcgtgctgttgaccaggtctccatctgcccctttggctttggtgttaagtcagttgatggacggttttagcatgctcgaaaaaaagctcaaagagggacctgagcctggagcctccttgaggagtcagccacttgtgggagacctccgtcagcgaatggataagttcgtcaaaaatagaggcgcacaagagatacagtccacctggctggagttcaaggctaaggccttttctaaatcagaacccgggtcatcatgggaacttttacaggcctgcgggaagctcaagagacaattgtgcgcaatataccgattgaacttcctgactacggccccatctcgtggaggaccccaccttccccagcatctgcaagatcaagttcagagactgatgcgcgaaaaactaactgattggaaggatttcctcttggtgaagtctcggagaaatatcaccatgtag

SEQ ID NO: 119781 - DNA, 2103 bp, Artificial Sequence
  Description of Artificial Sequence: Synthetic coding sequence
atgaaatgcgtgttggtggcaactgagggcgccgaagtgctcttctactggacagatcaggagtttgaggagagtctgcgattgaaatttggccagagcgaaaacgaggaagaggaattgcccgctctcgaagaccagctaagcactctcctcgctcccgtgataatctcatccatgacaatgcttgagaagctatctgacacttacacttgtttttctaccgaaaatggaaatttcctgtacgttcttcacctgttcggagaatgcctctttattgccatcaacggcgaccacacggaaagcgagggcgacctccgccgcaagctttatgtcctgaaatatctgttcgaggtgcattttggactggtcaccgtcgacggtcatttgattcggaaggagctgcgccctcccgaccttgcccagagggtccagctgtgggaacacttccagtcactcctgtggacttacagccgcttacgagagcaggaacagtgcttcgccgtagaggccttggaaagattgatccatcctcagctctgtgaactctgcatcgaagcgctcgaaagacacgtaatccaggccgtgaacacctcccccgagagaggaggagaggaggcgttgcacgccttcttgctggtgcactcaaaactacttgcattttacagcagccattctgcaagttcgctccggcccgctgacctcctagccctgatcctcctcgttcaggatttatacccaagtgagtccaccgcagaggatgatatccaaccctctcctcgaagagcaaggtcatctcagaatattccagtccaacaggcttggtcacctcatagcacaggccctacgggcggtagctccgcagaaaccgaaacggatagcttttctctacccgaggaatatttcacccctgcccccagcccaggcgatcagtccagcggcagcactatctggctggagggagggaccccacccatggatgcactacagatcgccgaagacaccctccagactcttgtcccacactgccccgttcccagtgggccaagacgtatattcctggacgccaatgtgaaggaatcttattgtccccttgtgccccataccatgtactgcctgcccctctggcaggggataaacctggtgctgctgacacgctctccaagcgctcctctcgctctggtcctttcccagcttatggatgggttctcaatgctggaaaaaaagcttaaggagggccccgagcctggcgcctctctgcgctcccagcccttggtcggggacctccggcagcggatggataagtttgtgaagaatcgaggtgcccaagagatccagagcacatggctcgagtttaaagccaaagccttctcaaagtcagagccaggtagcagctgggagctcttgcaggcttgcggtaagctgaagcggcagctctgcgcaatttataggctgaacttcttgaccaccgctccaagcaggggcggtccccatctgccgcagcatttgcaggatcaggtgcagcgtctcatgagagagaagctcaccgattggaaagactttctgctcgtgaagtccagacgtaatattacaatggtgtcatacttagaggacttccctgggctagtccacttcatctatgtagatcgaacaaccggtcaaatggttgccccatcactgaactgttcccaaaaaacctcctcagagctcgggaagggcccccttgccgccttcgtgaagacaaaagtgtggtccctgatccaactggcacgcaggtatctacaaaaaggatataccacactgcttttccaggaaggagatttctattgtagctattttctttggtttgagaacgacatgggctataagctgcaaatgattgaagtacccgtgctgagtgacgacagtgtacctatcggcatgctgggaggagattactacagaaagctgctgaggtattactccaagaacagacccaccgaagctgtccgctgctacgagctcctggctctgcacttatccgtgattcccaccgaccttttagtgcagcaggccgggcagctcgctcgccggctctgggaagctagccgaatccctctgctatag

SEQ ID NO: 119782 - DNA, 2004 bp, Artificial Sequence
  Description of Artificial Sequence: Synthetic coding sequence
atgaagtgtgtattggtcgctacggaaggggcagaggtactcttttactggactgaccaggaattcgaagagtccttgcggctcaaattcggtcagagcgagaatgaagaagaagaactccctgccctcgaggatcaactgagcactctgctggcccccgtgattatctcctctatgacaatgctggagaaactcagcgatacctacacttgcttttccactgagaacggcaatttcctgtacgtgctgcatctgttcggggagtgccttttcattgcaatcaacggagatcacacagagtcagagggggacctgcgacggaaactctatgtgctaaaatatttgttcgaagtccactttggcttggttactgtggatggccaccttatccggaaggagttgagacctccggacctcgcacaacgcgtacagctatgggaacattttcagtctctgctctggacgtactcccgtctacgggagcaagaacagtgtttcgcagtcgaggccctggaacgactcatacacccacagttgtgtgaactctgtattgaagcattggaaagacatgtcatacaggcagtcaacaccagtcctgagagaggcggagaggaggctctgcacgcatttctgttggtccactcaaaactgctcgcgttttactcctcccactcagcctcgagccttcggccagcggatctactagccctgatccttctggtccaggacctgtacccatccgagtccaccgctgaagacgatatccaagaaactgattccttttcactaccagaggagtacttcacccctgcaccaagtccaggtgaccagagtagcggatccacgatctggctagagggcgggacgccacccatggacgccctgcagattgccgaggacaccctgcagacattagtgcctcactgtccggttccctctggcccacgtcggatctttctggatgctaatgtgaaggaatcctactgtcctctggttcctcacacgatgtactgcctacccctctggcagggcatcaacttggtccttcttactcggtcccccagtgcccccttagcgctcgtcctgtctcagctcatggacggtttcagtatgctggagaagaagctcaaggaagggcctgagccgggtgccagcctgcgaagtcaacctttagtgggcgacctcaggcagcgcatggataaattcgtgaaaaaccgcggcgcccaggaaattcagtccacatggttggagttcaaggctaaggccttttcgaagtctgagcctgggagtagttgggaactcctccaagcctgtggaaaattgaagagacagctgtgcgcaatctaccggctgaatttcctcaccactgcacccagtcgaggtggtccccatctgcctcagcacctccaagatcaggtgcagagattgatgcgagagaagctgacagactggaaagatttccttttggtcaagagcaggcgcaatatcacgatggtatcttatttagaggacttccctggccttgtacacttcatatacgtcgatcgaaccaccggtcagatggtcgctccttcactgaactgcagccaaaaaacttcttcggagctgggcaagggcccactggcagcatttgtgaagaccaaggtgtggtcactgattcagctagccagaaggtatctccagaaagggtacacaacactgctatttcaggagggggacttctactgttcatactttctctggtttgaaaatgacatgggctacaaactgcagatgatcgaggtacctgtgctttccgatgacagcgtgcctattggaatgctcggaggcgactactacagaaaactcttgcgctactacagcaaaaaccgaccaacggaggccgtcaggtgctacgaattgctcgctctgcacctgagtgtcattcccactgatctgttagtgcagcaagctgggcaattagcccggcgtctctgggaggcttcaagaatccccctcctgtag

SEQ ID NO: 119783 - DNA, 480 bp, Artificial Sequence
  Description of Artificial Sequence: Synthetic coding sequence
tgactgaggccgcccgatttagctcagagggtccagctgtgggagcactttcaatcgctgttgtggacctatagtagactccgtgagcaggagcagtgttttgccgtcgaggctctggagaggcttatacatccgcagctgtgcgaactgtgtatcgaggccctggagcgtcacgtgatccaggcagttaacaccagtcctgagcgtgggggggaagaggcgctgcatgcttttctactggtgcattcaaaactcttggctttctacagctcgcactctgcctcgtcactgcgacccgcagaccttttggccctcatactcctggtccaagacctgtatcccagcgaatcaacagctgaggatgatatccaggaaaccgacagttttagtctccccgaggaatatttcacaccagccccaagccctggggatcagtctagcggtgaggatcggcgtaaggctgggggaaacaattcatag

SEQ ID NO: 119784 - DNA, 3015 bp, Artificial Sequence
  Description of Artificial Sequence: Synthetic coding sequence
atggtgcaactgtataacctgcatcccttcggtagtcaacaggttgttccgtgcaaactggagccggacaggttctgcggcggaggcagagatgctctgtttgtcgctgccggttgcaaggtagaggcgttcgccgtggccggccaggagttgtgccagcccaggtgtgcgtttagcactttggggagagtgctccggttggcatactctgaagccggcgattatctggtagcgattgaggagaagaacaaggctaccttcctgcgggcttatgtcaattggagaaataaaagaaccgagaactccagagtatgtattcgaatgattggccataatgtggagggccccttttccaaagcgttccgggaccagatgtacatcattgagatgcctttgtccgaggcgcccctttgcattagttgttgtcctgtgaaaggcgacctgttggttggctgcacaaacaaactggtgctgttctccctgaagtatcagatcatcaacgaggagttttcactcctggacttcgagcgttcactcatcatacatatcgataacataaccccagtcgaggtttccttttgcgtggggtacgtggcagttatgtccgatctcgaggtgctcatagttaagttggagtcaggaccaaaaaatggcgagagagttcaccaccatccccacaagaccaacaatcgtattcgaaggacagaggaaggcatctccaatgagattagccagctcgagtccgacgatttcgtgatttgccagaaaccgttggagttactgggcgagaaatctgaacagtccggactgtcagtcactcttgagtctaccggactcgctgacgagaagaggaaatattctcacttccaacaccttctctatagaaggttcgccccagacatctccagctacgtactttcagacgacattaagttgcattccctgcaacttctaccaatttaccagacaggcagcctgacgagtgacggtaagaacttaagtcaagaaaaagagctcttgagcctgttctgctttttctccctgccccatgtcggttacctgtatatggttgtcaagtccgttgagttaatgtctgtgtatcagtacccggagaagtcgcaacaggccgtcctgacaccccaattccttcatgttattacttccaacaatctccaatgctttacagtgcggtgcagcgcggctgcagccagagaagaggacccatatatggacacaacgctaaaagcttgtcctcctgtctccatggatgtgtgtgcattgcggatccagctattcatagggctgaaagccatttgccattttaagaatcacattatccttcttactaaggccgaacctgaggctattccagagcggaggcagtctcccaagcgcctgctgagcagaaaggacacttcggttaagattaaaatcccacctgtcgcagaggctggctggaatctgtatatagtgaataccatttcacccgtgcagctctacaaggaaatggtagactactcaaatacgtacaagaccgttaagacccagtcttgtattcaccttctgagtgaggcccatctactcgttagagctgctctgatggacgccagtcaactcgagcccggagagaaagctgaactactagaagcttttaaggagtcctgtgggcacttgggcgactgctactctagactggacagccagcacagccatttaacattgccctattataaaatgagcggtctctctatggcagaggtccttgcccgcaccgactggaccgtggaggacgggctgcagaaatatgaaaggggactaattttttatatcaatcattccttgtatgaaaacttggatgaagagctgaacgaggaactcgccgccaaggtcgtacagatgttctatgtagccgagccgaagcaagtgccacacatactgtgcagtccttccatgaagaacataaaccctctcacagctatgtcgtacctccggaagttggataccagtggttttagcagtatccttgtgaccctcactaaagctgccgtggcccttaagatgggtgacctggatatgcacagaaatgaaatgaagtcccattccgagatgaaactggtgtgtgggttcatccttgaaccccgcttactgatccagcagaggaagggccaaatcgtgcccaccgagctcgcactgcacctgaaggaaacacagcccgggctcttagtggcgtcagtcctaggcttgcaaaagaataacaagatcggtattgaggaggccgacagcttttttaaagtactgtgtgcaaaggacgaggataccatccctcagcttctagtggatttctgggaggcacaactggttgcctgtctacccgatgttgtcctccaagagctattcttcaagttaacatctcaatatatatggagactaagtaaacggcagccgccggatactactcctctcaggaccagcgaggacttgatcaacgcttgttctcactacggcctcatctatccatgggttcatgtagtgatcagcagtgatagtctcgccgataagaattacaccgaagatctctcaaaacttcagagcctaatatgtggacctagcttcgatatcgcatcgattataccttttttggaaccgcttagtgaagatacaatagctggattatctgtgcatgtcctgtgccgcacccgcctgaaggagtacgaacaatgtattgatatcctgcttgagaggtgtcccgaggccgtaatcccttacgccaaccatgagctgaaagaggaaaataggaccttatggtggaaaaagctgttgccggaattgtgtcagcgaatcaagtgtggcggcgaaaaatatcagctttacctaagctcacttaaagaaacgctcagcattgtcgccgtggaactcgaactgaaggactttatgaatgtgctgcccgaggacggtaccgctacattcttcctcccatatctgctctattgtagccgcaaaaagccactgacctag

SEQ ID NO: 119785 - DNA, 1587 bp, Artificial Sequence
  Description of Artificial Sequence: Synthetic coding sequence
atggctacttccacatcaacggaagccaaaagtgcttcatggtggaactatttttttctctatgatgggtctaaggttaaagaagagggtgatcccacacgggcagggatctgctatttttatccgagccagacattgctcgaccagcaggagctcctttgtgggcagattgcgggtgtggtgcgatgtgtctccgatataagtgacagcccaccgacgcttgtaagattgaggaagctcaaattcgcaatcaaagtggatggggattacctgtgggtcttaggctgcgccgtggaacttccagacgtatcatgtaagcgctttctcgatcaactcgtgggcttttttaatttctacaacggacccgtgtcattagcttacgagaactgttcccaggaggaactcagtacagaatgggacacgtttattgagcaaatacttaagaataccagcgacctgcacaagatcttcaactctctgtggaacctggaccagactaaggtggagcctctgctgttgttgaaagcagctagaatactccaaacttgccagcggagcccacatatcttggctgggtgcatcctctataagggactcattgtatctacccaactacccccttcactaacagcaaaagtgctgctacatcgaaccgcaccacaggaacagagactcccgacaggtgaggacgctcctcaggaacatggaaaatggatgctgtggtcttttaaaaaccgtgtgacccatcagaacccaaacggcgccgccttgccccccaatgtgcaaatcattccggtgttcgtcacgaaagaggaggcgatcagcctgcacgaattccctgtggaacaaatgactaggagcctagcttctccggccggactccaggacggatctgcccagcaccaccccaaggggggaagtacctcagccctgaaggaaaacgcaacggggcacgtggaatcaatggcttggacaacccctgatccaactagtcctgatgaagcatgccctgacggacggaaggagaatggatgcctcagcggacacgatttggagagtatccggccggccggtctgcacaacagtgccagaggggaggtcctggggctgagttcatcgctcgggaaagagctcgtcttcctgcaagaagaattagacttgtccgagatacatatacccgaagctcaggaagttgagatggcttctggtcattttgcatttctacacgtccctgtgcccgacggacgcgccccatactgcaaggcctccttaagcgccagcagctccctggaacccactcctcctgaggatacagctattagcagccttagacccccttccgccccggaaatgcttacccaacacggagcccaagaacagctggaagaccatcccggccactcatcccaggcccctatcccccgggccgatcctctgcctaagagcactgtgttatttagcggcggatgcgtcaaaggatccgatacacaactgtgcgttcccggactagtgtggtacctggagccgcagttttactacgttatcgtccggcacttcttcgatagcatgagacagaccgccgggtag

SEQ ID NO: 119786 - DNA, 2127 bp, Artificial Sequence
  Description of Artificial Sequence: Synthetic coding sequence
atggccaccagtacctccacagaggccaagtcggctagttggtggaactatttttttctttacgacggatccaaggtcaaagaggagggcgacccaacgcgagcaggaatttgttatttctatcctagccaaacactgctcgatcagcaagaactgctgtgcggtcagatcgcgggcgtggtgcgttgcgtgtccgatatctccgactcacccccaaccctggtgcgcctacgtaaattgaaattcgccataaaggtggacggagactatctgtgggtgctgggatgcgcggtcgagctcccagatgtctcgtgcaaacgttttctggatcagttggtgggcttcttcaatttctacaacggaccagtctcactcgcttacgagaattgttcacaggaggagctgtctacggaatgggacacatttatcgagcagatcctgaagaacacctccgacctgcacaaaattttcaactccctatggaacctcgatcagactaaggtcgaaccccttttactgcttaaggcggcgaggatcctgcaaacttgccagaggtcaccccacatcctggcaggctgtatactttacaagggtttgattgtatccacccagctgccacctagtctgactgccaaggtccttctgcaccgcacggctccacaggagcagcgactcccaaccggagaagacgccccccaagagcatggcgccgcactgccacctaatgttcagattattcccgtttttgtgactaaggaggaagccatcagcttacatgagttccctgtcgagcagatgaccaggagcctggcatcaccagccgggctccaggatggatccgcccagcaccacccaaaaggaggctctacctcagcacttaaggaaaatgccacaggccatgttgaatctatggcatggaccacccccgacccgacctctccagatgaagcttgccctgacggccggaaggagaacggatgtttgtctggccacgacctggagtctatccgaccagcaggcctgcacaacagtgcacgaggagaggtactggggctctcctctagcctcggcaaagagttggtcttcctgcaggaggagttggacctgtcagaaatacacatacccgaggcacaggaggtcgaaatggcctccggccatttcgctttcctgcacgtccccgttcctgatggaagggccccttattgcaaggcatctctgagcgcttcatcttcccttgagcctaccccgcctgaggacactgcgatatctagccttcgaccgccctcggcacctgaaatgctgactcagcacggtgcccaggaacagttagaagatcatccaggtcactccagccaggccccaatcccccgggctgaccctctgcctagacggacgcggcggccattgctgttacccaggctcgacccggggcaacgaggaaataaattgcccacaggtgaacaggggctggatgaagacgtggacggagtttgtgaaagccatgcagccccagggttggaatgttccagtggctcagccaattgtcagggcgctggtccctctgctgatgggatcagttctaggctcacgcccgccgagagctgcatgggtctggtgagaatgaacctgtacacgcactgtgtgaagggcttggttctcagcctgctagccgaggagccgctgctcggcgattcggcagcgatcgaagaagtatatcatagctctcttgcgagtctcaacggactcgaggtgcacctcaaggagacactcccacgagacgaggccgcctccacttcttctacctataattttacacactatgatcggatccaatctctgcttatggcaaacctgcctcaggtggcgactcctcaagaccgacgcttcttacaggctgtgagccttatgcactcagagttcgcacaactgcctgccctttatgagatgactgttcggaatgcaagcacagcagtgtatgcctgttgcaaccccatccaagaaacttattttcagcagctggcccccgcagcccgttcgtccggtttccccaacccacaggatggcgcctttagcctttctggcaaagcaaagcagaaacttctgaaacacggagttaacttactctag

SEQ ID NO: 119787 - DNA, 2166 bp, Artificial Sequence
  Description of Artificial Sequence: Synthetic coding sequence
atggcacctttgtgttcgctagcccgctggaattacttttttttatatgacggtagtaaggtgaaggaggagggcgaccccacccgggctggcatctgctatttttacccgagccaaacacttctggaccaacaagagttgctttgcggtcagatcgctggcgtggtgcgctgcgttagtgatatctccgactcccctcctacactagtacgtctcaggaaactgaaattcgccattaaggtggacggcgattatctgtgggtgctggggtgcgctgttgagctgcccgacgttagctgtaagagattcctcgaccagctggtgggattctttaacttttacaacggcccagtgagccttgcatatgagaactgctctcaggaggagctttcgacagagtgggacaccttcattgagcagattctgaaaaacacaagtgacttgcacaaaatcttcaactctctatggaatttagatcagactaaagtagagcctcttctgctcctgaaggcagctcgtatcctgcagacgtgtcagagatctccgcacattttggcaggctgcattctgtataaaggactcatagtttccacacaacttcctccatcgctgactgcaaaggtcttgcttcacagaaccgctccccaggaacagcggttaccaaccggtgaggacgcgcctcaagaacatggcaaatggatgttgtggtcttttaagaatcgcgtgacccaccagaatccaaatggtgctgccttgcctccgaatgtgcagattataccagtgtttgttaccaaagaggaggctatctcgctacacgagtttcccgtggagcagatgacgaggagtcttgcaagtcccgctgggctgcaggatgggtcggcccagcaccaccccaagggcggatccactagtgctctgaaggagaatgccactggccacgtggagagcatggcttggaccacccctgatcccacaagcccagatgaggcttgtcccgatgggcggaaagaaaacgggtgtctctcggggcacgacctggaatcgattagaccggctggcctacacaacagcgcccgaggggaggttctgggactgtcctctagcttgggaaaagaactggtctttttgcaagaagagctggatctgtcagaaatccatatcccggaggcccaagaagtagagatggctagcggacatttcgccttcctgcatgtgccagttcctgatgggagagctccatactgtaaggcatccctgagtgcctcatctagccttgagcccaccccccctgaggacactgctatcagtagcctgcggccacctagtgctcctgaaatgctgacacagcacggcgcacaggagcaactcgaagatcaccccggccattcatcccaggctccaatcccaagagcagacccgttgccccgaagaacccgacgcccccttttactgccccgcctcgatcccggacagcgaggaaataaactcccaactggtgagcagggtctggatgaagatgtcgacggtgtttgcgagagccacgccgcccccggcctcgagtgcagctcggggtccgctaactgccaaggagccggccccagcgctgatggcatttcatccaggttgacacccgccgagtcttgcatgggcctggttcgaatgaacttgtacacgcactgtgtaaagggtcttgttctcagcttgctggccgaagaaccgttgctcggtgacagcgctgcaatcgaggaagtgtaccattcttcattagcaagtctgaatggtctggaggtccacctcaaggagactcttccaagagatgaggctgcctctactagttctacctacaattttacccattatgaccgcattcagagcttattaatggctaacctgccgcaggttgctacaccgcaggacagacgattcctacaggcagtttcattgatgcacagtgagtttgcgcagctccctgccctgtacgagatgaccgtcagaaatgccagcactgctgtatacgcatgttgcaaccccattcaggagacttactttcagcagctcgctcccgccgcacgctcctccgggtttcccaatcctcaagatggcgccttttcactgtccggaaaagcgaagcagaagctgctgaaacacggcgtcaatctactatag

SEQ ID NO: 119788 - DNA, 2127 bp, Artificial Sequence
  Description of Artificial Sequence: Synthetic coding sequence
atggcaacaagtacttctaccgaggccaaaagtgcctcttggtggaactatttcttcctttacgatggtagcaaagtgaaggaggaaggagaccccaccagggcgggcatatgttacttttatccatctcagactctgctagaccaacaggaactgctgtgtggccaaatagccggcgtagtgcgatgcgtaagtgacattagtgattctcccccgactttggtgagactgaggaagctgaagttcgcaatcaaggtcgacggtgattacctttgggtcctcggctgtgctgtcgaactgcctgacgtttcctgtaaaaggtttttagaccagcttgtaggcttcttcaacttttataacgggccagttagcctcgcctacgaaaactgctcccaagaggagctatccacagaatgggacacttttattgaacaaattttaaagaacactagtgatctccacaaaattttcaactcgctatggaacctggatcagacgaaagtggaacctttactgctgctgaaggcagctcgcatccttcagacgtgccaacgctcgccgcacatcctggctgggtgtatcttgtataaggggcttatcgtgagcacacagcttccaccatccctgaccgccaaagtgctgctgcacaggaccgctcctcaggaacaacgccttcccaccggcgaagatgctccacaagagcacggcgctgcactgccgcctaatgtacagattattccagtcttcgttacaaaggaggaggccatttctctacatgagtttccggtggagcagatgactcggtcactggcgtccccagccggcctccaagatggcagcgcacagcatcatcccaagggcgggtccacttcagcccttaaggagaacgccacaggccatgtcgagtccatggcatggactaccccggatccgacaagtcccgacgaagcttgtccagacggccgcaaggaaaacggatgccttagtggccacgacctggaaagtatccgtcccgcgggactgcacaactccgccagaggagaggttttgggcctgagttcctctctgggcaaagagctggtgtttctgcaggaagaactggatctcagcgagatacacatcccggaggcacaggaagttgaaatggcttctggacatttcgcgttcctccatgtacctgtaccggacgggcgcgctccctattgcaaggcgtccctcagcgcctctagtagtctggaacccacacctcccgaggatacagccatctcaagtttgaggccaccctccgcacccgaaatgctgacccaacacggcgcccaagaacagctcgaggaccatccagggcatagctcacaggcaccaattccccgagccgacccactgccccgacgaaccaggaggccgctcctgctgcctaggctggacccaggccagcgcgggaataagttgcctactggagaacaagggcttgacgaagacgtagatggggtgtgcgaaagtcacgccgcccccggattagaatgtagctccggatcagccaattgtcagggagcaggaccttccgccgacggtatctcctctagactcacacccgctgagtcatgtatgggcctggttcggatgaacctgtacacccactgcgtgaaggggctcgttctgagcctcttagctgaggagcccttgttaggggattcggcagccatcgaggaggtgtaccatagctcattagcttccctgaatggcctagaggttcatctgaaagagaccctgcctagagatgaggccgcctctacatccagcacttataacttcactcattacgatcggattcagagcctgttgatggcaaacttgccccaagtcgcaaccccccaggatcgcagatttctccaggctgtgagtctgatgcactcagaattcgctcaactgcctgccctgtacgagatgacggttaggaatgcctctaccgccgtctacgcctgttgtaatcccattcaagagacctattttcagcagcttgcccctgcggcacggtcctctggttttccgaacccacaagatggcgccttttccctctccggtaaggctaaacaaaaactccttaagcatggggtcaacttgctttag

SEQ ID NO: 119789 - DNA, 2112 bp, Artificial Sequence
  Description of Artificial Sequence: Synthetic coding sequence
atggccccactatgttcactcgcgaggtggaactatttttttctttatgacggctcaaaagtcaaagaggagggcgacccaactcgagccgggatctgctatttctatcctagccagaccctgttagatcagcaagagctgctgtgtgggcaaatcgctggcgtagtccggtgcgtgagcgacattagtgattccccccccaccctcgttaggctgaggaagctgaaattcgccattaaagtggatggtgattatctgtgggtgttaggctgcgcggtggagctgcccgacgtcagctgcaagcgcttccttgaccagttggtgggcttttttaacttctataacggtccagtgtcattggcctatgaaaactgctctcaggaggaactgtcaacagaatgggacacgttcattgaacagatcctcaaaaacacaagtgacctgcataaaatatttaactccctgtggaacctcgaccaaaccaaggtggaaccccttctgctcctgaaggctgctaggattctgcagacctgccaacggtcaccccacatcctcgccgggtgcatactgtacaaaggcttgatcgtgagcacccagctgcctccttccctcaccgctaaggtgctcttacacagaacagctccacaggagcagcgcctgcccaccggcgaagacgccccacaggaacatggcgcagcactcccaccaaatgtgcagattatccccgtgttcgtgacaaaggaggaagcgatatctcttcacgagtttcctgtcgaacaaatgactagatccttggcgtctcctgctggtcttcaagacggttccgcccaacatcatccaaaaggaggatcaacctcggctctgaaagagaatgccacaggccacgttgaatccatggcttggaccacccctgatccaaccagtcccgacgaggcctgtccagacgggagaaaagaaaatggctgcctaagcggccacgacttagaaagtattcgccctgccggcttgcacaacagtgctagaggggaagtactcgggctaagttcctctcttggtaaggagttggtgttcctgcaggaagagttggacctgtcagagatccatatacccgaagctcaagaagtggagatggcctccgggcactttgcctttctgcatgttccggtgccggatggccgcgctccctactgcaaagcctcactgtctgcctcttcttcgctggaaccgacgcccccagaggacaccgctatttcatcactgcgacccccaagtgctcccgaaatgctgacccaacatggtgcacaagagcaactggaagaccatcctggtcatagtagccaggcgcctatcccccgagcagatccccttccaaggcggacacgtcggccactcctgctgcctagacttgatcccgggcagcgtggtaacaagctgcctactggcgaacaaggacttgatgaagatgtagacggagtgtgtgagagccacgccgcccctggtcttgaatgtagctcagggagtgcaaattgtcagggcgctggaccaagcgctgacggcatttctagccgacttaccccagccgaatcatgtatgggtttagtgcggatgaacctatatacacattgcgtcaaggggttagtgctgagcctgttggctgaagagcctcttctgggagacagcgcagcgatcgaagaggtctaccacagttcacttgcttcactgaacggccttgaggtgcacctgaaggagacccttccccgagacgaagccgccagtacgtcaagtacttacaatttcacacattacgacaggattcagagccttctgatggccaacctcccgcaggtcgcaactccgcaggaccgcagattcctgcaagccgtgagccttatgcactcagagtttgcgcaactgcctgccttatacgagatgaccgttagaaatgcctcaacggccgtctatgcctgctgtaatccaatccaggagacatactttcagcagctggccccagctgctcgcagcagcggcttccccaatcctcaggacggggccttctcgctctccgggaaggcaaagcagaagctgctcaaacatggcgtaaatcttctgtag

SEQ ID NO: 119790 - DNA, 3390 bp, Artificial Sequence
  Description of Artificial Sequence: Synthetic coding sequence
atggcttttgtcccagttatcccagaatcttattcccacgtcctggcagaattcgagagccttgaccccctgctcagcgccctccggttagattctagcaggctgaagtgcaccagcatcgccgtcagccggaagtggcttgctcttggcagtagtggtggtggcctgcacctgattcagaaggagggttggaagcaccgattgttcctatctcaccgtgaaggagctatctcccaggtggcatgttgcctgcacgacgatgattacgttgctgtggctactagtcaggggctggtggtagtctgggagctgaaccaggaaaggaggggcaagcctgaacaaatgtacgtgagctctgagcacaagggacgtagagtgacggccctgtgctgggataccgcaatcctgcgggtcttcgtgggggatcacgctgggaaggtgagcgctatcaaactgaatacctcaaagcaggcaaaagcggccgctgccttcgtaatgttccccgtacagactataactacggttgactcctgtgtggttcagcttgattacctggatgggcggctgttgataagttctcttacacggtcttttctgtgtgacaccgaacgggaaaaattttggaaaattggcaataaagagcgggatggggagtatggggcatgctttttccctggaagatgctctggaggccaacagccactgatatattgcgcccgtcctggaagccgcatgtgggaagtaaatttcgacggcgaggtgatttccacccaccagttcaagaagctcctgtcactacctccgctcccggtgataaccctgaggtctgaaccacagtatgatcataccgcaggctcctcccagtcactgtcattcccaaaactattacatctctccgaacactgcgtgctcacctggaccgaacggggtatctatatctttattccacagaacgtgcaggtgttgctttggagcgaagtcaaggacatccaggacgtcgccgtctgccgtaatgagctgttctgcctgcacctgaacggtaaggtttcgcatctgtctcttatctccgttgaacggtgcgtcgaacgcctcctcaggaggggcctgtggaacttggccgcacgtacatgctgcctctttcagaacagtgttattgcatctagggcccgtaagaccctcacggccgataaacttgagcaccttaaatcgcagcttgatcatggcacttataacgacctgatctcacagctggaggagctgatattgaaattcgagcccctcgacagcgcttgttcctcgcgacgatcaagcatctcttcacacgagtcttttagtatcttagatagcggcatctatagaattatttcatcacgcagagggtctcagagcgacgaagactcttgctctctacactcccagaccttgtcagaggacgagaggttcaaggagttcacgtcccaacaggaggaggacctgcccgatcagtgttgcggaagccacggaaacgaagataacgtgtctcacgcaccagtcatgttcgaaaccgacaaaaatgaaacctttttgccttttggaatacccctgcccttcaggtccccaagcccactagtgagcctgcaggccgtgaaggagagtgtttcctcatttgtccggaaaactactgagaagatcggtaccttacataccagcccagacctgaaagtcagacctgaattgcggggcgatgaacagagctgcgaggaagatgtttcatcggacacttgccctaaagaggaagatactgaagaagaaaaggaagtgacctcccctccaccggaggaggaccggtttcaggaattgaaggtcgccactgctgaggcaatgaccaaactgcaggacccactagtgctgtttgagagtgaatctttgcggatggtgctgcaagagtggcttagccatctggagaaaaccttcgccatgaaagactttagtggggtgagcgacacagacaactctagcatgaagctgaatcaagatgtgctgctggtgaacgaatccaaaaagggaattctcgatgaagacaatgagaaagagaagagagattctttgggcaatgaagagagcgttgataagaccgcttgtgaatgtgtgaggtcaccacgcgagagtctggatgacttatttcagatatgcagcccatgcgccattgcttcaggactgcggaacgacttggccgagttgactactttgtgtctagagctaaatgtgctaaattcaaaaataaagtcgacaagcggacatgttgatcacactcttcagcaatacagccctgagattttggcctgccagtttcttaaaaagtacttcttcctgctgaacctaaagcgtgccaaggaatccattaagctatcttattctaattccccatctgtgtgggatacattcatcgaaggtcttaaggagatggccagttctaatcccgtatacatggaaatggagaaaggggacttacccactcgacttaaactcctagacgatgaggtcccctttgattcacctctgctcgtggtgtacgcaactcgcctgtacgaaaagtttggagagtctgccctccgatcactgattaagttctttcccagtatacttccgagcgatattatccagctctgtcatcaccacccagcggaattcctcgcatacttagatagtttggtgaagtccagaccagaggaccagaggtctagctttctggagagtctccttcaacccgagagtctgcggctcgattggctccttcttgctgtgagtttagatgccccccctagcacctcgacaatggacgatgagggctatccgaggccccactctcacctgctcagctggggatatagtcaactgatcctgcatctgatcaagcttcccgcagactttatcacgaaagaaaaaatgaccgacatctgcaggtcctgcggcttttggcctgggtatctgatcctgtgcctggagttggaaaggaggcgagaggccttcacaaacatagtctatctgaatgatatgagcctgatggagggtgacaatggctggatccctgagactgtggaggagtggaagcttctcctccacctaatacagtcaaaaagcacgcggcctgcaccccaggagtccttaaacggaagcctatccgatgggccatctcctataaatgtcgaaaacgtggctttgttactcgctaaggccatgggccccgaccgggcctggtctttactgcaggagtgtgggctggcgctcgaactcagcgagaaattcacacggacttgcgatatcctacgcatcgctgaaaagcggcagcgggcactaatccaatctatgctggaaaaatgcgacagatttctctggtcacagcaggcttag

SEQ ID NO: 119791 - DNA, 3048 bp, Artificial Sequence
  Description of Artificial Sequence: Synthetic coding sequence
atgtacgtaagcagcgaacacaaggggcgccgagtgactgctctgtgttgggataccgcaatcctgagggtgtttgttggggatcatgcaggcaaggtgtctgcaatcaaacttaatacttccaaacaagctaaggctgccgcggcatttgtgatgttccctgtgcagaccatcaccacggtcgattcttgtgtggttcagttggattacctggatggtaggctgctaatctcgagtctaacgaggagttttttgtgcgatacggaacgcgagaaattctggaagattggcaataaagaacgggacggggagtatggcgcctgtttttttcctggaagatgctctggagggcaacaacccctcatttactgcgctcggcctggatcacgcatgtgggaagtcaactttgatggggaagtcatctccacacaccagttcaaaaaattactctctttacctccacttcctgtgatcacactgcgaagcgaacctcagtacgatcataccgcgggcagtagtcagagtctcagctttccgaagttgctgcatctcagtgaacactgcgtgctgacttggacggaacgcgggatctacatctttataccccagaatgtgcaggtcctgttgtggtctgaggtcaaggatatccaggatgtggcagtttgtagaaatgagttgttctgcctccatttgaacggcaaggtttctcacctctccctgattagcgttgagcggtgtgtggaacggctcctgcggagaggcctttggaacctggccgctcggacctgttgcctctttcagaactcagtgatagcatcccgcgctcgtaaaacccttactgccgataagcttgagcatttgaagtcccagctggatcacggcacatacaatgacctcatctctcagctagaggagctaattctgaagtttgaacccctcgattcagcttgcagttcccgcaggtccagtattagttcacacgaatcatttagtattctggattccggaatataccgcataataagctcacgcaggggctcccagtccgacgaagactcatgtagtctgcatagtcaaacactctccgaggatgagaggttcaaggaattcacatctcagcaagaggaggacctacctgaccaatgttgcggctctcatggtaatgaggacaatgtgagccatgcacctgtaatgttcgaaaccgataagaatgagaccttccttccgtttggaatccctctccccttccgcagtccctccccgctagtgtccctgcaagcagttaaggaatctgtgagcagcttcgtgcggaagaccacagaaaaaattggcaccctgcacacaagccctgacttgaaagtgaggcccgaactgcgcggagacgagcaatcctgtgaagaagacgtttcctccgatacttgtcccaaagaagaggatacagaagaagaaaaggaggttacaagcccaccaccagaagaagatcgattccaagagctcaaagtggccaccgccgaggccatgaccaagctccaagaccccttagtgctctttgagtccgaaagtctgcgcatggttcttcaggaatggctgtcacacctcgagaagacctttgccatgaaggattttagtggggttagtgatactgataatagcagtatgaagctgaaccaggatgtgctgttggtcaatgaatccaaaaaaggaatccttgacgaggacaacgagaaagagaagagggacagtctgggcaatgaggagagtgtcgataaaaccgcctgcgaatgtgtgcggtcaccgagagaatctttagacgacttatttcaaatatgctcaccctgcgccattgcttccggactgagaaatgatctcgctgaacttaccaccctttgccttgaactaaacgtgcttaactccaagattaaaagcactagtgggcatgttgaccacacactgcagcagtacagtcccgagatacttgcgtgtcagtttctgaagaaatacttttttttgttgaacctgaagcgggcgaaggagagtattaaactttcttatagtaattctcccagtgtgtgggatacgttcattgaaggccttaaggagatggcctcctctaaccctgtgtatatggaaatggagaagggagacctccccactaggcttaagctgttggacgacgaggtgccatttgattctccactgctggtggtttatgccacgcgcctgtatgagaaattcggcgagagcgcactcaggagtctgattaagtttttcccttctattctgcccagtgacattatccagctgtgtcatcatcacccggccgaattcctagcctacctagactctctcgttaagagtcgtcccgaggaccagcggagtagctttttggagtctctgctacaaccagaatccctcaggctggattggctgctcctcgctgtaagtttggatgcgcctccgagcaccagcactatggacgatgaaggctacccgcgcccccattcccacttgctgagttggggttactctcagctgatcttgcacctcattaagctaccggccgacttcataacaaaagaaaagatgaccgacatttgccgcagctgcggtttctggcctggttatctgatcctgtgcttggagcttgaacggaggcgtgaggctttcactaatatcgtgtatctgaatgacatgtcactgatggagggagacaatgggtggattcctgagacagtcgaagagtggaaactcctgctgcatctgatacagtctaagtccacaagacccgcccctcaggaatccctaaacgggtctctgagcgacggaccaagtcctattaatgtggaaaatgtggcattgctgctggccaaagccatgggacctgatagagcttggtccctactgcaggagtgcggcctggcgctggaattgagtgaaaaattcacacggacttgcgatatccttcggattgctgagaagcgacagcgagcactgatccagtccatgctcgagaaatgtgatcggtttctgtggagccagcaggcctag

SEQ ID NO: 119792 - DNA, 3048 bp, Artificial Sequence
  Description of Artificial Sequence: Synthetic coding sequence
atgtatgtatcctcggaacataagggcagaagggtaaccgctttgtgttgggatacggcaatcctgcgcgtattcgttggggaccacgcaggaaaagtgtctgctataaagttgaatacatctaaacaggctaaagccgcagctgcttttgtgatgttccccgtgcagacgattactacagttgattcttgcgttgtccagttagactatctggacggaagactgctgatctcctccctcacacgctcctttctttgcgatacagagagagaaaagttttggaagatcgggaacaaggaacgcgatggggaatatggggcttgtttctttcccggacgctgtagtggaggccaacaacctcttatttactgtgctcggcccggtagccgaatgtgggaggtgaatttcgacggagaggtgatctctacccatcaatttaaaaagcttctgagtctgcctcctctgcccgtgatcaccctcaggagcgaacctcagtacgatcacacagccggctcatctcagtccctgtcgtttcctaaactgctgcacctgtctgaacattgtgttctgacgtggacagaacgcggtatttatattttcatcccccagaacgtgcaggtgttgctctggtccgaggtgaaagacattcaggatgtggccgtctgtagaaatgaattgttttgcctccatctgaacggaaaggtttcacacctgtccttaatttcggtcgagaggtgcgtcgagcggttgctgagaagggggctctggaatctggccgcccggacttgttgtttatttcagaatagcgttatcgcctccagggcccggaagaccctgacagctgacaagctcgaacatctgaagtcccagctggatcacggcacctacaatgatctgattagtcagctggaggagctgattttgaagtttgagccgctggattccgcctgcagcagccgcagaagctctatttccagccatgaatccttttccattctggactcgggcatctatcgcatcatttcaagcagacgggggtctcaatcagatgaggattcatgctctttgcacagccagacgctgtctgaagacgagcggttcaaagagttcacatctcaacaggaggaagatctgcccgaccagtgctgtggatcacatggaaacgaggacaatgtttctcatgcaccagtgatgttcgagacagacaaaaatgaaacttttctgcctttcggcatcccactgccattcagaagccccagtcctctcgtgagcttgcaagctgtgaaggagtctgtgtcttcctttgtgcgtaaaaccaccgagaagattgggacactgcacacctctccggatctgaaagtgcgtccagaactgagaggggacgaacagtcttgcgaagaagatgtcagcagcgacacctgccccaaagaagaggacactgaggaggaaaaggaagtgaccagcccccccccggaggaggatcgtttccaggagcttaaagtcgcaaccgctgaagccatgactaagctgcaagatcccctcgtgctgtttgaaagcgagagcctgcgaatggtgcttcaggagtggctttctcacttggaaaagactttcgcgatgaaagatttttccggagtgtctgacactgacaattccagcatgaagctcaaccaggacgtgctactcgtgaatgaatctaaaaaaggaatcctagatgaggacaatgaaaaggagaaacgtgactccctgggaaatgaggagagcgtcgacaagaccgcatgcgagtgcgtccgcagcccaagagagtccctggatgacctctttcaaatttgcagcccatgtgcaattgcgagcggactgagaaatgacctggcggaattaactactctttgtttagaacttaatgttctcaactcaaaaataaaatctacaagcggacacgtagaccacaccctgcagcaatactcgccagagatcttagcctgtcagtttctcaagaaatacttctttctgctgaaccttaagagggccaaagagtccatcaaactgtcctatagcaattcccccagcgtgtgggatacctttatcgagggtctgaaagaaatggcctcgtccaacccagtttacatggagatggagaagggcgatctgcctactagactcaagcttctcgatgacgaagtcccctttgatagcccgctgttagtagtttacgccacaaggttgtacgaaaaattcggggagagcgcgcttaggagcctgatcaagtttttcccatcgatcctgcccagtgatataatccaactctgccatcatcatcccgcagagttcttagcctatctggacagcctggtgaagtctcgccccgaggaccagcgctcatctttccttgaaagtctgctccagccggagtctctacgactggactggttactgctcgcagttagcctggatgctcctccatccacaagtacaatggacgacgaaggatacccacgtcctcattcacacctgttgtcttggggctacagccagctgatcctccaccttatcaagttaccggctgattttattaccaaggaaaaaatgaccgacatctgcaggtcatgcggtttttggccagggtaccttatactctgcctcgaactcgagaggaggcgagaggcattcactaatattgtgtatcttaatgacatgtctctgatggagggggataatggatggatccccgagacagtcgaggagtggaaactcttattgcatttaatccagagcaaaagcacaaggccagctccgcaggaatcgttgaatggttcgctctccgatggcccctcacccatcaatgttgagaatgtggcactgctgctggcgaaggctatggggcccgatagagcctggagcctcctgcaggaatgcggcttagccttggagctgtccgagaagtttactagaacctgtgacatcctgcgcattgctgaaaagaggcaaagagctctgattcagtcgatgctagagaagtgcgaccggtttctctggtctcaacaggcgtag

SEQ ID NO: 119793 - DNA, 2328 bp, Artificial Sequence
  Description of Artificial Sequence: Synthetic coding sequence
atgaagcgttctggcaccttacgacttctgagtgacctgagcgctttcgggggagctgccaggttgagggaattggtcgcaggagattctgccgtccgggtgaggggttcccccgatggccgccacctgcttctattgcgccctccaggcgctgttgccccacagctccttgtggcaagtcggggaccgggcgccgaattagaacgcgcgtggcctgcgggccagccttctcccctggacgccttcttcctgccgtggcccgcacgcccggcgctcgtcttggtctgggagagtgggttagccgaggtgtggggcgccggcgttggacccggatggcgcccactgcagtcaaccgaactgtgcccgggaggcggtgctcgcgtcgtggcagtggcagctctgcgcggaagactcgtgtggtgcgaggaacgtcaggcacgggcagagggccccagcggcagtcccgccgccgctttttcccattgcgtttgcgtgcggaccctagaacctagtggagaagcctccacatccctgggaaggactcacgtgttgttgcaccattgcccggcctttggccttctcgctagctgcaggcagctcttcctggttcccactgccacaacttggccaggcgtggcccacgtgttgctcatttggagccccggcaaagggaaggtgatggtagcagcaccacgtctgggtctgagctacagcaagagcctgaatccaggacggggcgatacttgggattttagaaccctactgagagggcttcctggtctattgagccctcgagaaccgctggctgtgcatacatgggctccaaccccacaaggcttgttactgctggactttggtggaactgtgagcctgctccaaagccatggaggcacaagggcagtgggcaccctgcaagaggcaccagtgggaccctgggggtccgccgccctcgggacctttcaaggcacactggcctgtgtattgggcagcaccctcgagcttctcgatatggggtcaggacagctgctcgaaaggaaggtcctgtctaccgacagagtccacttattagagcctcctgcgcccggcatggaggatgaagaagagctagagactcgaggaaacttgcggctgttgtctgcacttggcctcttctgcgtgggctgggaggcgccgcaaggagtggagctgccttctgccaaggatctggtgtttgaggaggcttgcggttactaccagagaaggtctctgagaggagcgcaactgacccctgaggagttacggcactcctccaccttccgggcaccccaggcactggccagtattttgcagggccatctgcctcccagtgcccttcttaccatgctccgtacagagcttagggattaccgcgggctcgagcagctcaaagcgcagcttgtggcgggggatgatgaagaagctggctggaccgagttggctgagcaggaggtggctagactgttgaggacggagctgattggagaccagctggctcagctgaatactgtgttccaggcccttccgacggctgcctggggcgctaccttacgcgctcttcaattgcagctggacggtaatgggaagttgcgcagccaggcgcctcctgacgtttggaagaaggtgctggggggcattacagccggcaaagagcctccaaatgggatcttaccccccttcgagttattgtgtcagtgcctctgccaacttgaaccccgttggctgcccccctttgttgagcttgcccaacaacaaggaggtcctggctggggcgccggtggccctggcctacccctttacagaagggccttggctgtgctcggtgaggaaggaacccgacctgaagccctcgagctcgaattgttgctctcctcagggagaccgaaggccgtactgcaggctgttggacaactggtgcagaaagaacaatgggaccgggctcttgacgccggactggctctcggtccgtccagcccattactgcgttccgagatctttaagctgttgctagccgaattcgcacagcatcgccgacttgacgcacatcttccgcttttgtgcaggctgtgtcctccagagctggctcctgcagagctactgctgttgttgcggacataccttcccgatgaagtggggccacctacccccttcccagaacccggggctgaaccccctttgacggtaggattactgaaggccctgctcgaacagaccggcgcccaaggctggctatccggtccagttctcagtccatatgaagacatcctatgggaccccagtacacctcctcccactccccctagagatctgtag

SEQ ID NO: 119794 - DNA, 1596 bp, Artificial Sequence
  Description of Artificial Sequence: Synthetic coding sequence
atgctaggcttcctgtcgagggggccttctatgaaactttgtatgggattggcctgcgttttgtccctgtggaatactgtgtccggcatcaagggagaggctaaaaaggaaaagggcatgacttttcttccgaccactgtgtccggcttgcgtgaggaggaaagaaaggagaaaggtgtagcgtttctggctactaccgagctgccggcccggtcgattgatctgtcagctctcaacctaacagagttagttaacggtatgctttcgcgggcgctcaaggatagcaaaaagttctttagcctgctctccgttacttcatacagctcgttcgctttccataagttttctgttgccgtttataatatttcaaacctgaagaccgtagaccctgcgaaatttcccactcgctattgctactgtctgaacaatcggactaatgatctgtcggactttactgctctgcttgtcgatatcattggtaattctacctcgtacctaaccgaaattttcaaatctacctctatcctaagtgtgaaccagagtaatgaaagcgactgtatatttatctgcgtcatgacaggcaaatcgggtagaaatttaagtgacttttgggagattgaggagaagtacccgattataaactacacattcaccagcggccttagtggcgtcctgggtgctgccaccagggggacagccagaacgtctaaacccaccaccaagagccagaaaactctgccatcgacatctcccggtcactggacccaaagcaccccttgggccagtgccctgcggagctccccatggacagagacagcggcgccctcagaaacagaggagactctgaataccggacgaccacccgagctacccgcccgtgctaccgcgacctggttctctgcgtctcacacactgcctgccctggctacccggcgcgttgccagaactcagtggctgacagctgaccggcagacatgggcctccatcagctccgtgccttgggcgcaaactattagcgagaagaagcccggtggttccctgtgggaaacccgctcctcacctccaacgacagccggaacggaggaggccatgaatacaaccagtctgctcgcacccgcagccgagattatggctactccaggctcccctagccaggccagccccacgttgggcgcctttacgcacggcacacagacccctagccccacaaaggccacagcccctagatatccgcaaactggcgatctctctgcggaatggcccttcactgctggggaggagcctgttctggtgccacgtcctcatcaggtgtcaagatgtccacagcccctgttcaaggtaggagcaatggctgctgctcccttgactttggcaattcagaggctgaatccctgccttatggaactgtgccagttctttcagcagtgtctttgtatgtcccagaggtcaccccggaccgaggatatgaggtactgcctggaatattattcttggttcctgaaaaacgctacctacatctgccagagagtgaaacgagtcagccatagccacactctgaaacaaaaatgcttagagaacatttgcaaaagcgtttag

SEQ ID NO: 119795 - DNA, 558 bp, Artificial Sequence
  Description of Artificial Sequence: Synthetic coding sequence
atgagtccatcactgcaggaaggcgctcaactgggcgagaataagccctctacgtgctctttctccattgagaggatcctggggctggaccaaaagaaggactgtgtaccactcatgaaaccccacaggccgtgggccgacacctgttcctcttctgggaaggatgggaacctctgcctgcacgttcccaatcccccgtcaggaatatccttcccgtctgtggtagatcaccctatgcccgaggaaagggccagcaagtacgaaaattacttcagcgcgagcgaacggctctcacttaagcgagaactctcatggtaccggggcaggagacctcgtaccgcctttacccagaatcagatcgaggtcctcgagaatgtgttcagggtgaactgttaccctggtatcgacatccgtgaggacctggcgcagaagttaaacttggaggaggacaggatccagatttggttccagaaccggagagccaagctgaagagatctcatcgggaaagccaattcctgatggcaaaaaaaaactttaatactaacctgctggagtag

SEQ ID NO: 119796 - DNA, 324 bp, Artificial Sequence
  Description of Artificial Sequence: Synthetic coding sequence
atgtctccttcccttcaggagggcgcccagcttggcgagaataagccctccacatgctcattctccattgaaaggatcctgggtctggatcaaaaaaaggactgcgtgccattgatgaaaccacatcgcccatgggcagatacatgctctagctccggcaaggatgggaacctgtgtttacatgtgcccaacccacccagcggtataagttttccctccgtcgtcgaccatccaatgccagaggaacgtgcttccaagtacgagaattatttttcagccagcgaacgtctctcactaaagcgcgaactttcctggtatcgttag

SEQ ID NO: 119797 - DNA, 1263 bp, Artificial Sequence
  Description of Artificial Sequence: Synthetic coding sequence
atggaagtgcccccccggctcagccatgtgcctccacctttatttccatccgcccctgcgaccttagcttctcgaagcttgtcccactggagaccaaggccaccgcgccagctcgcacccctccttccgtctcttgcacccagcagcgcgcgccagggtgctcgccgcgctcagaggcatgtaacggcgcagcagccctctcgactggcggggggcgcagctatcaagggaggtcgccggaggcgtcctgacctcttccgacggcatttcaagagcagcagcatacagcgctcagctgctgctgctgctgctactcgcacagcgagacagcacccgccagctgactcttcagtgactatggaggacatgaatgaatacagtaatatcgaggaattcgcagaaggttccaaaataaatgccagcaaaaatcaacaggatgatgggaaaatgttcataggcggtttgtcatgggacacctccaaaaaggacttgaccgagtatttgtcccgcttcggcgaggtcgtggactgcacaataaagaccgacccagttactggacgctctagaggttttggctttgtgctctttaaggatgcagcctccgtcgataaagtcctggagcttaaggaacacaaattggacggcaagctgatcgatccaaagcgcgcaaaagcgctgaagggcaaagagccccctaaaaaagtgtttgtgggaggactgtcacctgatacctctgaggaacagattaaggaatattttggagcctttggagagatcgagaacatcgaactgcccatggacacaaaaactaacgagcgtcgcggcttctgttttataacctatacagatgaggaacctgtaaagaaactacttgagagtaggtatcaccagattggcagtgggaagtgtgagattaaggttgcccagccgaaggaggtctacagacaacagcagcagcagcagaaaggggggcgcggggctgccgcaggtgggcgaggcggcaccagaggtcgcggcagagggcaggggcagaactggaaccagggttttaacaactactatgatcaggggtacgggaactataactctgcctatgggggggatcagaactatagcggttacggcggatatgattacactgggtataactacggaaattatggatatgggcagggctacgctgactacagtgggcagcagagcacctacggcaaggccagccgagggggtgggaatcatcagaacaactatcagccatattag

SEQ ID NO: 119798 - DNA, 735 bp, Artificial Sequence
  Description of Artificial Sequence: Synthetic coding sequence
atggaagacatgaatgaatattctaacatagaagaattcgccgaaggttccaagatcaatgcgagcaagaaccaacaagatgatggaaagatgttcatcggtggattgtcttgggatacaagcaaaaaagacctgaccgagtacctgagtcggtttggcgaggtggtggactgcaccattaagacagacccagtgactggccgctctagaggcttcgggttcgtactctttaaagacgctgcgtctgtggacaaggtactggagctaaaggagcataaactggatggcaaactgattgaccctaagagggccaaagccctaaaagggaaagaaccaccaaagaaagtttttgtgggcgggctctctcccgatactagtgaggagcaaatcaaagagtattttggtgcctttggcgagatcgagaacatcgaactgcctatggacaccaaaaccaatgagcggagagggttctgcttcatcacctacaccgatgaggaaccagtgaaaaagctgttggaaagtcggtatcaccaaattggtagcggaaagtgcgaaattaaggttgcacaacccaaagaagtgtacaggcagcagcaacaacaacagaaaggtggacgtggcgcagcagctggaggtagaggcggcacacgaggtcgaggccgagggcagcagagcacctatggaaaagcctctaggggggggggaaaccaccagaataactaccagccttattag

SEQ ID NO: 119799 - DNA, 1263 bp, Artificial Sequence
  Description of Artificial Sequence: Synthetic coding sequence
atggaggtcccccctcgactctcccacgtgcctcctcctctgtttccctcagctcctgcaaccctggcatctagaagtcttagtcactggaggcccagacctccccgacaactggctcccctactccccagcttggcgccctcttctgcccgacagggcgccaggagagcccaacgtcacgtgactgcgcaacaaccgagtcggcttgccggaggagccgctataaaagggggaagacgcagaaggcctgacctgttccgaaggcactttaagtcctcttccatccagcgatcagctgccgcagcggctgctacgcgaactgctcgacagcaccctccagcggactcctctgtgacaatggaagacatgaacgaatacagcaatatcgaagagttcgccgagggatcaaagatcaacgcctctaagaatcagcaggatgacggaaagatgttcatcggaggactgtcatgggatacgagtaagaaagatctcaccgaatacctgagccgctttggagaagtggttgactgcacaataaagaccgatcctgtaaccggcaggtcccgcgggttcgggttcgtgttgttcaaggatgccgcttccgtcgacaaagtgctggagctgaaggaacacaagttagacggcaagcttatcgatcctaagagagccaaggccctgaaagggaaggagccaccaaaaaaggtatttgtgggcggactgtctcctgacacttctgaggaacaaattaaagaatactttggggccttcggagagatagaaaacattgagctccctatggatacgaagacaaacgaacgccggggcttttgtttcattacatacacggatgaggaacccgtgaaaaaacttctggaatcccgataccaccagataggcagtggaaagtgcgaaattaaagtcgctcagccgaaggaagtatataggcagcaacagcaacagcaaaaaggcggacgcggtgctgcagcaggcggcagagggggcacccgtggaagaggtagaggccaaggacagaattggaatcaagggttcaacaattattacgaccagggatatgggaattacaatagcgcctatggcggggatcagaactactcggggtacggtgggtacgattacaccgggtataattatggcaactacggttacggccagggttacgcagactattctggtcagcaatcaacatacggtaaagcaagcagaggcggggggaaccatcaaaataactatcagccttattag

SEQ ID NO: 119800 - DNA, 1902 bp, Artificial Sequence
  Description of Artificial Sequence: Synthetic coding sequence
atggctaatcaagtaaatggcaacgcagtccagctgaaagaggaagaagagcctatggatacaagctcggtgactcataccgagcattacaaaactcttattgaggccggattacctcagaaagtggctgaacggctggacgagatctttcaaactgggcttgtggcctacgtggacttagacgagcgggccattgacgctcttcgagagtttaacgaggaaggagcgctctcagtgttgcaacagtttaaggagagcgatctgtcccacgtgcagaataagagcgctttcctgtgcggcgttatgaagacataccggcagagggaaaaacaggggtccaaggtacaggagagcacaaagggacccgatgaggccaaaattaaggcccttctggagcggacaggatacactctggatgtgaccactgggcagcgtaagtacggcggccccccgcctgattccgtatattcaggtgtgcaacccggcattggtacagaagtttttgtgggtaagattcctagggacttgtacgaagatgagctggtgcctctcttcgaaaaggccggcccaatttgggatttgcgcctgatgatggatcccttgagtgggcagaacagaggatacgcatttattaccttctgcggtaaagaggccgctcaagaggccgtgaagctctgcgattcttatgagatacggccggggaaacacctgggtgtctgtatcagtgtggcaaataatcggctgttcgttgggagcatcccaaagaataaaactaaggagaacattctggaggagttcagtaaagtgacagaaggcctggtggacgtaatcctttatcaccagcccgacgacaaaaagaaaaatagagggttctgcttcctcgagtacgaagaccacaaaagcgctgcccaggcccggaggcggctcatgagtgggaaggtcaaagtatggggcaatgtcgtgacagtggaatgggcagatccggttgaggagcccgatcctgaggtgatggccaaagtgaaggtgctgtttgttcgcaacctggctacgaccgtgactgaggaaatactggagaaatccttcagcgagtttgggaaactcgaacgtgtgaaaaagttaaaagattacgcgtttgttcacttcgaagatagaggagccgcagttaaggctatggatgagatgaacggaaaggagatcgaaggcgaggaaatagagatcgtgttagcaaagccacccgataaaaagcgcaaggagcggcaggctgcgcgtcaggcctcacgatctaccgcttacgaagactactattatcaccccccgcccagaatgccaccccctattagggggcgtggtagaggcggagggagaggaggctacggatacccgccagattattacggatacgaagactactacgatgattattatggttacgactaccatgattatagaggaggctacgaggatccatactatggatacgatgatggatatgccgtacgcggcaggggcggaggacggggcggccgaggagctcccccccccccacgcggacgcggggctcctccacctcgaggacgggccgggtattcccagcgcggcgctccattagggcctccacgaggcagccgtggagggagagggggcccagcccagcagcagcggggtcgggggtcaaggggttccaggggcaaccgtgggggcaatgtaggcgggaaaaggaaggccgacggttataaccagcctgactcaaagcgcaggcagacgaataatcagcaaaattggggttctcagccaatcgcgcagcagccattgcagcaggggggcgattactctggcaactacggttataataatgacaatcaggagttctatcaggacacctacggccagcagtggaaatag

SEQ ID NO: 119801 - DNA, 1902 bp, Artificial Sequence
  Description of Artificial Sequence: Synthetic coding sequence
atggcaaatcaggtcaacggtaacgcagtgcaacttaaggaggaagaggagccgatggatacttcctcagtgacccacaccgaacactacaagacattaattgaagctggattgccccagaaagtggccgagcgccttgatgaaatattccaaaccggcttagtcgcatatgtagacctcgacgaaagggcgatcgacgccctgagggaattcaacgaggagggggccttgagtgtccttcagcagtttaaggaatctgacctgagccacgttcaaaataagtcagctttcctgtgcggagtgatgaagacctataggcagcgggagaagcagggcagcaaggttcaggaaagtaccaaaggaccagacgaggccaagatcaaagccctgttggaaaggacaggctacactctggatgtgacaacagggcaacggaaatatggcggaccaccccccgattctgtatatagcggcgttcagccaggcattggcacggaggtgttcgtaggcaaaattcctagggatttatatgaagatgagctggtgccactttttgaaaaggcagggcccatctgggacttgaggctgatgatggatccgctaagcggccagaaccggggctatgcgttcattaccttctgcggaaaggaagccgcacaggaagcagtgaagctttgcgacagctacgaaatccggccagggaaacatctaggcgtgtgtatcagcgtggcgaataatcggctttttgtgggctccatccctaaaaataagactaaagaaaacattttggaagagttctccaaagtgactgagggcctcgttgacgtcattctgtaccatcagcctgacgataagaaaaaaaacagaggcttctgcttccttgagtacgaagaccacaaaagtgctgcacaagcccgcagacgcctgatgtctggaaaggtcaaggtctggggcaacgtggtgaccgtggagtgggcagaccctgtggaagaacctgacccagaggtgatggctaaggtgaaggtgttgtttgtgcgaaacctggctacaactgttaccgaggaaatcctggagaaaagtttctcagagtttggaaaactggaacgagtaaagaagctgaaagattatgcattcgtgcacttcgaagacagaggagcagctgtcaaagcaatggatgaaatgaacggaaaagagatcgagggcgaggaaatcgaaatcgtcctggccaaaccccctgataaaaagagaaaggagaggcaggctgccagacaggcttcaagatctactgcctacgaggactattactatcacccacccccccggatgcctcctccgatccgcggccgaggacgcggaggaggcagaggtgggtatggctaccctcctgactattatggatacgaagactactacgatgattactatgggtatgattatcacgactataggggtgggtatgaagatccatactacggctacgacgacggctatgctgtgaggggtagaggcgggggacgaggagggaggggagcacctcctccgcctcggggccgtggggccccaccaccacgtgggcgagctggttactctcagcggggagcccccttaggccctcctaggggcagcagaggtggaagaggaggtcctgcccagcagcagcggggcaggggttcgagagggagccggggaaaccgcggaggcaacgtcggcggcaaacgaaaggccgatggatacaatcaacccgactccaagcggagacagaccaataatcaacaaaactgggggagccagcccatagcgcagcaacctctgcagcaaggcggggattattccggcaactatggatacaataatgataatcaggaattctaccaggatacttatggacagcaatggaagtag

SEQ ID NO: 119802 - DNA, 1911 bp, Artificial Sequence
  Description of Artificial Sequence: Synthetic coding sequence
atggctaatcaggtgaacgggaacgccgttcagttgaaggaggaggaggaacctatggatacttcctcagtgactcacacagaacactataagacgcttatcgaagcgggccttccccagaaagtggcagagagactggatgagattttccagacaggactggttgcatacgtggatcttgacgagagagccatcgacgctctgcgggagtttaacgaggaaggcgccttgtctgtgctgcagcagtttaaggagtctgatctttcacacgttcaaaacaagagtgccttcttgtgcggagttatgaaaacatatcgccagcgggagaagcagggctctaaggtgcaggaaagtacaaagggccctgatgaagccaaaataaaggctctcctcgagcggactggatacacacttgatgtgacaacagggcagcggaagtacggcgggccgccgcctgactctgtctacagcggagtgcagcctggtattggtaccgaggtgttcgtcggaaaaattcccagggatctctacgaagacgagctggttccgctgtttgaaaaggccgggcccatctgggaccttagattgatgatggaccctctttcgggccagaatcgcggatacgccttcattactttttgtgggaaggaagccgctcaggaagccgtgaaattgtgcgattcatacgaaatcagacccggtaaacatctgggagtgtgcatttcggtggccaacaaccgtctttttgttggatccataccaaaaaacaagaccaaagagaacattttggaggagttttctaaggttaccgggcttaccgaaggcctcgtggatgtgattttgtatcatcaaccagatgataaaaagaaaaatcggggcttttgcttcctggagtacgaagaccacaagtcagccgctcaggcaaggcggagactgatgtcaggcaaggtgaaagtgtggggtaacgtggtgaccgtggagtgggctgacccagtggaagaaccagatcctgaggtcatggcgaaggtgaaggttctgttcgtgagaaacctggcaaccaccgtgacagaggagattttggagaagtccttttcagagttcgggaaattagagagggtgaagaagttgaaagactacgccttcgttcactttgaagataggggagcagcagtgaaggctatggatgagatgaatggtaaggagatcgagggggaagagattgaaatagtgctcgcaaagccccccgataaaaagaggaaggaacgacaggctgccaggcaagcgtcccgctcaacagcatacgaagactactactaccacccacctcctaggatgcctcctccaatcagagggcggggcaggggggggggtcgtggtggatacgggtatccacccgattactatggttacgaggattactatgacgattattacgggtacgattatcatgattatagaggcggctacgaggatccctactacggttacgacgacggctacgcagtcaggggccggggcggtgggcgaggagggcgcggcgctcccccgccccctcgggggcggggagcacctcctccacgagggagagctggctactctcagcggggtgcacctttgggcccccccaggggttcccgcggaggtcgaggtggtcccgcacaacagcagaggggacggggctcccggggcagtcggggaaacagggggggtaacgtgggtggtaaacgcaaggctgacgggtacaaccagcctgactccaagaggagacagaccaacaatcaacagaactgggggtcacaaccaatcgcacaacagccattacaacaaggtggtgattattcggggaactatggttacaacaacgacaatcaggaattttatcaggacacctacgggcagcaatggaaatag

SEQ ID NO: 119803 - DNA, 1422 bp, Artificial Sequence
  Description of Artificial Sequence: Synthetic coding sequence
atgaaaacataccgacaacgcgaaaaacagggttctaaagtgcaggagtcaacgaaaggtcctgacgaggcgaaaattaaggctttgctggaacgtaccggatatacactggatgtgacaaccggccaacggaagtatggcgggccaccacctgactctgtatactccggagttcagcctggaatcgggaccgagtgtgatagctacgagattcggcctggtaaacacctcggtgtctgcatatcagtcgcaaataataggttgttcgtgggcagcataccaaagaacaaaacaaaggagaacatattagaagagttcagtaaggtaaccgaaggactcgtcgacgtcatcctgtaccaccagcccgatgacaagaagaagaaccgtggattctgttttttagagtatgaagaccataagtctgcagctcaggctcgacgccgactaatgagcggaaaggtcaaagtgtggggaaacgtcgtgacagttgaatgggcggaccccgtggaagagcccgatccagaggttatggctaaggttaaggtgctattcgtgcggaacctggccaccacagtgacggaggagatcttagagaagtcgttcagcgagtttggcaaactcgaaagggtgaaaaagctgaaggactacgcattcgtccattttgaggataggggcgctgccgtcaaagcgatggacgagatgaatggtaaggagattgagggtgaagaaatcgaaatcgtgcttgccaagcctcccgataagaagagaaaggaaagacaggccgcacgccaagcctccaggtctacagcctatgaggactactactaccaccctccccctcgcatgcctccacccatccgcggccgcggacgaggcggaggtcgcggagggtatggctatcctcctgattattacgggtatgaagactactacgacgactactatgggtacgactatcacgactaccgaggggggtatgaggatccatattacgggtatgacgatggatatgccgtgcgtggccgaggaggtggcagagggggtcgcggcgctcctcctcctccaagaggccgcggggccccacctcccagaggcagagcgggctactcccaaaggggagcacccttaggtccccctcgcggatctagggggggtaggggcggacccgctcaacagcaacgcggccgaggtagccggggatctagagggaaccgcggcgggaatgtgggaggaaaaaggaaggctgacgggtataatcagcccgatagcaaacggcgccagactaataaccaacagaactggggctcacagcccattgcacaacaaccgctgcagcaggggggagactactctgggaactacggatacaataacgacaaccaagagttctatcaggacacatatggccagcaatggaagtag

SEQ ID NO: 119804 - DNA, 1788 bp, Artificial Sequence
  Description of Artificial Sequence: Synthetic coding sequence
atggctaatcaggtcaacggaaatgcagttcagctgaaggaggaggaggagcctatggatacctcgagtgttacccatacagaacactacaaaaccttgattgaggctggcctcccccagaaagttgccgagcggttggatgagatattccagaccggcttagtcgcttacgtggatctggacgaacgagcaatcgatgcactacgagaatttaatgaggagggcgcccttagtgtactccagcaatttaaggaatctgatctctcccacgtgcagaataagtctgccttcctgtgcggggtgatgaaaacatatagacagcgagaaaaacaaggctctaaggtccaggagagtaccaaggggccagatgaagcaaaaatcaaagtgtttgtaggaaaaatccctagagatctctatgaggacgaactcgtgccactgtttgaaaaggccgggcccatctgggacctccggctgatgatggacccactgtccggtcagaatcggggctacgcattcattacattctgtgggaaggaggccgcacaggaggctgtcaagctgtgcgacagctatgaaattcggcccggcaaacacctgggggtatgcattagtgtcgctaataataggctgttcgtgggatccattcccaaaaataaaactaaggagaatatcctggaggagttcagcaaggtaaccgaaggccttgttgatgtgattctctaccatcagccggacgataagaagaagaacagggggttctgtttcctggagtatgaggatcataagtcagcagctcaggctcggaggaggctcatgtccggaaaagtgaaagtctgggggaacgtggtgacagtcgagtgggcggatcctgtggaggaaccagacccagaggttatggctaaggtcaaagtcctctttgttaggaatttggcaactacagttaccgaggagattcttgagaaaagcttcagcgaatttggtaagctggagcgagtgaaaaaactgaaggattatgctttcgtgcactttgaggataggggagcagccgtaaaggctatggacgagatgaatggaaaggagattgaaggcgaagagattgaaatcgtgctcgctaaaccaccagacaagaagagaaaagagcgccaggctgcacggcaggcgtcaagaagtactgcttacgaagactattactaccaccctcctccccgcatgccccccccaattcgcggacgaggacgaggcggagggcgcgggggttatggatacccacctgattattacggctatgaagattattacgatgattactatgggtacgattaccacgattaccgcggggggtatgaggacccttactatgggtacgatgatgggtacgcggttaggggacggggcggggggcgaggggggcgaggcgcacccccgccacccaggggaaggggcgcccctcctcccaggggacgcgcaggatattctcagagaggcgcgccactcggaccccccagagggagtagagggggccgggggggccccgcacaacaacaaagaggccgtgggagcagaggaagtcggggcaacagggggggcaacgtgggtgggaaacgcaaggctgatggatataatcagcctgactcaaagcggagacagaccaacaaccagcagaattggggatcccagccgattgctcagcagcctctccagcaggggggggactattcgggcaattatggttataataacgacaatcaggaattctatcaggacacctacggccagcagtggaagtag

SEQ ID NO: 119805 - DNA, 2304 bp, Artificial Sequence
  Description of Artificial Sequence: Synthetic coding sequence
atgcggagctgggctttttcttatttggacgcaatggacaatatcacaagacagaaccagttctacgacacccaggtaatcaaacaagagaacgaatccgggtatgagcgtcgccccctggagatggaacaacaacaggcctaccgccctgaaatgaagactgaaatgaagcagggcgccccgacatccttccttccgccagaagcgagccagcttaagcccgacagacagcaattccaaagccgtaagaggccttatgaagaaaaccgaggaagggggtatttcgagcatagagaggaccgccgcgggagatccccccagcctccggcggaagaggacgaggacgacttcgatgataccctggtggcaatcgatacttacaactgtgacctccacttcaaggtggcccgggacagaagtagtggctaccccctgacaatcgagggttttgcctacttgtggagcggagcccgcgcctcatatggagtgaggcgcggtagagtttgtttcgagatgaagattaacgaggagatcagtgtcaaacacctgccatccaccgaaccggacccgcacgtagttcggatcggatggtcgctggactcatgctccactcaactgggcgaagagccgttctcctacggctacggaggcaccggcaagaaatcgaccaacagccgtttcgaaaattacggagacaaatttgctgaaaatgatgtgattggttgttttgcagacttcgagtgcggcaatgacgttgagctgtcttttacaaaaaatggaaagtggatgggaattgccttccgcatccagaaggaagcccttgggggccaggcactctatccacacgtgttggttaaaaactgtgccgtggaattcaatttcggtcagcgcgcagaaccctattgcagcgtattgcccggatttaccttcatacaacatttaccactaagcgagaggatccgggggactgtcggtcctaagagcaaggccgaatgtgaaatactgatgatggtaggcctgcccgccgccggcaaaaccacatgggctatcaagcacgcagcctctaatcctagcaagaagtataacatcttgggcaccaacgcaataatggacaaaatgcgggtgatgggccttagacgacagagaaattatgcaggcagatgggatgtcctgattcagcaggccacacaatgcctcaatcggttgatccaaattgcggcgcggaaaaagaggaactacatcctggaccagaccaacgtgtacggaagcgcgcagcgtaggaaaatgaggccatttgaggggttccagagaaaggctattgtaatctgtcctacggacgaggacctgaaagacagaaccatcaaacgaacagacgaggagggaaaggatgtaccggatcacgcagttctggagatgaaggccaattttacactcccagacgtcggggacttcttagacgaggtgctgtttatagagctgcagcgagaggaggcagacaagctggtgcggcagtacaacgaggaagggcgtaaagccggtcctccacctgagaagagatttgataatagggggggtgggggatttaggggcaggggtggaggcggggggtttcagcgctacgagaatcgtggaccccccggaggtaatcgcggcggtttccagaatagaggcggaggctcaggaggaggaggcaactacaggggcggctttaataggagcggtggagggggttactcacagaatcggtggggaaacaataaccgcgataataataatagcaataatcgcgggtcctataaccgggcaccacaacagcagccaccgccacagcagccacccccacctcagcctcctccccagcaaccaccgcctcctccgagttattctccagctagaaatccacccggggcctcaacatacaacaagaattccaatattccgggcagctccgctaatacctctacaccaactgtctcgtcatattccccgcctcaaccaagctattcacagcctccgtataaccaaggcgggtatagtcaagggtacacagcccccccacctcccccccctccccccccggcgtataactatggcagttatggcggctacaatcccgccccctacacgccaccgccccccccgacggctcaaacctatccccagccatcctacaaccaatatcagcagtacgctcagcagtggaaccaatattaccaaaatcaggggcagtggcccccctactatggaaattatgactacggatcctatagcggcaatactcagggcggcacgtcaacccagtag

SEQ ID NO: 119806 - DNA, 369 bp, Artificial Sequence
  Description of Artificial Sequence: Synthetic coding sequence
atggacgtgagaagactgaaggtgaatgaattacgggaagagttgcaacggcggggccttgatactcgcggtctgaaggcagagctggcagagaggcttcaggcagctctcgaggcagaggaacctgacgacgagagggaactggacgcagatgatgagcctgggaggcccggccatatcaatgaggaagccgagctccagcccgccactctgcagcccggtaggctgcagcccggactccattcccccactgcttccacttccactactacatgtctgcaactgtgggagctcaggcgcctccagcctgggccattgtatcccaccgcaactccacattgtaccgacttgccgtctgcacagctgtag

SEQ ID NO: 119807 - DNA, 2271 bp, Artificial Sequence
  Description of Artificial Sequence: Synthetic coding sequence
atggacaacattaccagacagaaccaattctacgatacacaggtcatcaagcaagaaaacgagtccggttacgaaaggaggccgctggagatggagcagcagcaggcttatcggccagagatgaaaactgaaatgaagcagggagcccccacgtcatttctcccacccgaggctagccagcttaaacctgatagacaacagttccagtcccgtaagagaccttatgaagagaaccgcgggcggggttacttcgaacaccgcgaggaccggcggggaaggtcgccccagcctccagcagaggaggatgaggatgatttcgacgacacgctcgtcgcaattgatacctataattgcgatctgcactttaaagtggcccgggacagatcctcaggatatcccctgactattgaagggttcgcttacctctggagcggtgcaagagcttcatacggagtccgaagaggccgagtttgcttcgagatgaagataaacgaagagatctccgtcaaacacctgccgtcaaccgaaccagaccctcatgttgtgcggatcgggtggtcgctggattcatgtagtacacagctgggggaggaacctttctcttacggctacgggggcaccggcaagaagtctaccaacagccgttttgagaactacggcgataaatttgcggagaacgacgtcattgggtgcttcgcagactttgagtgtggcaatgacgtcgaactaagctttaccaaaaacgggaagtggatgggtatagctttccgcattcagaaggaagccctgggcggccaggcgctttaccctcacgtgctggttaaaaactgcgctgtcgaatttaatttcggccagagagcagagccgtattgtagcgtgctccccggctttacctttatccaacacctgcccctctcagagagaatcagggggaccgttggacctaagagcaaggccgagtgcgagattctcatgatggtgggtctgcccgccgctggcaagactacttgggccattaagcatgccgcttcaaatcccagtaagaagtacaatatattagggacgaacgccatcatggataagatgcgggttatgggcttgcgtagacagcgtaattatgcaggccgctgggacgtcctgatccagcaggcaacacagtgcctgaatcggctgatccagatcgctgcgcgtaaaaaacggaactatattctggatcagacaaacgtgtacggcagcgcccaaaggagaaagatgcggccgttcgaaggctttcagaggaaggcgatcgtgatatgccccaccgacgaagacctcaaggataggactattaaaaggacagacgaagagggtaaagacgtcccggatcacgccgtgctcgagatgaaggccaacttcacactgcccgatgtgggagactttctggacgaggtactttttattgagctgcaacgcgaggaggctgataagttagtacgtcagtacaatgaggagggacgcaaggcagggcccccgcctgagaagagattcgacaaccggggcggcggggggtttagaggacgtggcggaggtggaggctttcagaggtacgaaaaccgcgggccgcctggcgggaaccggggcgggttccagaaccggggaggcgggtccgggggcggcggaaactatcgagggggcttcaaccgttcaggtgggggcgggtattcccagaatcggtggggaaataacaacagggacaacaataactctaacaacaggggatcctataatcgcgcgccgcagcaacagccgccacctcaacagcccccccccccccaacctcccccccagcagcctcctcccccaccctcctactctccagcgaggaacccccctggggcgagcacttacaacaagaattccaacattcccggatcatcggcaaatacctctactcccacggtaagctcttacagtcccccccagccaagttacagtcagccaccatacaaccagggcgggtattcccagggatacaccgcccccccacctccgcccccaccgccccccgcttacaactacgggtcttatggaggatataatcctgcaccgtacacccccccgccacctcctacagcccagacctatccccagccgagctataatcagtatcagcagtacgcccagcagtggaaccagtattatcagaaccagggacagtggcctccttactacggtaattatgattatggctcctattccgggaacacacagggaggaacatccacccagtag

SEQ ID NO: 119808 - DNA, 2259 bp, Artificial Sequence
  Description of Artificial Sequence: Synthetic coding sequence
atggatgtgcggcgcctgaaggtgaacgagctgcgggaggagctgcagagacggggtctggataccagagggctcaaagcggagctagcagagcgcctccagccaccgcctcctgggctccagccccatgctgaaccaggtggctacagtgggccagacggacactacgctatggataacatcactcggcaaaaccagttctacgatactcaagtgatcaaacaggagaatgagtctggatatgagcgccgaccactggagatggagcaacagcaggcttaccgaccagaaatgaaaactgagatgaaacagggtgctccaacctcatttcttccaccggaggcctcccagctgaagcccgaccgtcagcagttccagagccgcaaacggccatatgaagaaaatagaggaagaggctattttgagcatcgtgaagatcgacgtggccggtcacctcagccaccggccgaagaggacgaggatgatttcgatgatactctggtggccattgacacatataactgcgatctacacttcaaagttgccagagacaggtcaagcggttatcccctgaccatcgaggggttcgcctacctctggtccggcgcacgagcatcctacggcgttcgccgcgggagggtctgtttcgagatgaaagattttgagtgcggaaatgacgttgagctcagcttcacaaaaaacggaaaatggatgggcatcgctttccgcatacagaaagaggccttggggggccaggcactttatcctcatgtgctggtcaagaactgtgccgtagagttcaactttggacagagggccgagccgtattgttcggtcctgccagggtttacgttcatccagcacctgccccttagcgagcgaatacggggcacagtgggcccgaagtcaaaagcagagtgcgagattctgatgatggtgggcctgccagcagccggcaagacaacctgggcaatcaagcatgctgctagtaatccctctaagaagtacaatatccttggcactaacgcaatcatggataagatgcgggtgatgggcctacggagacaacggaattatgccgggcgttgggacgttctgattcagcaggccacacaatgcctgaaccgactcattcaaattgctgctcgaaagaaacgaaactatattcttgatcaaaccaacgtttacgggtctgctcagcggcgaaaaatgagaccatttgagggctttcagcgcaaggcaattgtaatctgcccaacagacgaagatctaaaagaccgcactattaaaagaaccgatgaggaaggcaaagacgtgcccgatcatgccgttctggagatgaaggctaatttcaccctccccgatgtcggtgattttctggacgaagtacttttcatcgagctgcagcgggaagaggcagacaagctggtgagacagtacaatgaagagggcaggaaagcaggacctcctcctgagaaacgtttcgacaatagaggtgggggagggttccgggggcggggaggaggcggcgggtttcaacggtatgagaaccgggggccccctggcggcaaccgcggaggctttcagaatagaggcggcgggagcggcggggggggaaactatagaggaggctttaaccgcagtgggggtggtggctattctcagaatcgctggggcaacaataatagagataataacaactccaataaccgaggcagctacaacagggccccccaacagcagccaccaccccaacagccccctccaccgcagcccccgccccaacagccaccacctccaccctcatattctcccgctcgcaatcccccaggtgcttccacatacaacaagaatagcaacatacctggctctagcgcaaacacatcaacacccactgtgtcctcctattcacctccacagagctttggcttcttccctagtactttccagccaagctatagccagccgccttacaaccagggaggatattctcaggggtatacagccccgcccccaccgcccccacctcctcctgcctacaactacggctcatacggcgggtacaaccccgccccatacacccccccaccaccacccacggcccagacgtacccacagcccagttataaccaatatcagcaatacgcccagcaatggaatcagtattaccagaaccagggccagtggccaccttactacggcaattacgactatgggtcctactctgggaatacccaagggggcactagcacccagtag

SEQ ID NO: 119809 - DNA, 2571 bp, Artificial Sequence
  Description of Artificial Sequence: Synthetic coding sequence
atggacgtccggagactgaaggtgaatgaactgcgggaggagcttcagcgccgtgggctggatacacggggcctgaaggctgagctggcagaacgcctgcaggccgcgctggaggctgaggaaccagatgatgagcgggagcttgacgctgacgatgagcctggtagacccggccacattaatgaggaggtggaaactgaaggcggcagtgaactcgagggaactgcgcagcccccacccccgggccttcaaccacacgccgagcccggcggatatagcggcccggacggtcattacgcgatggataatatcacaagacagaatcaattctatgacactcaagtgataaagcaagaaaacgagagcgggtatgagcggcgccccctggagatggagcagcagcaggcttatcgcccagagatgaaaacagagatgaagcaaggggccccaacctctttcctgcctccagaagcgagccagctgaaaccagacagacagcagttccagagcagaaagcgaccttatgaggagaaccgcggacggggctacttcgaacaccgcgaggatagaaggggacgctctcctcagcctccagctgaggaagatgaagacgactttgatgacacactcgtggctatagacacctataattgcgacctgcatttcaaagtggctcgcgaccgctcaagtggttaccctttgactattgaggggttcgcgtatctgtggagtggtgcgcgagcctcttatggagtcaggcgaggccgcgtgtgttttgagatgaagatcaacgaagagataagcgttaagcacctaccgtccactgaacccgaccctcatgtggttcgaatcggttggtcgttggactcctgtagcacgcagctcggagaagagccattctcgtatggctatgggggtactggtaagaaatccactaattctagatttgaaaactatggcgacaagttcgccgaaaacgacgtcattggatgtttcgccgactttgaatgcggaaacgatgtggagttatcctttactaagaacggcaaatggatgggcattgccttccgcatacagaaggaggccctgggcggccaggcactctatcctcatgtattggtgaaaaattgcgctgtcgagtttaatttcggtcagcgagccgagccatattgttctgtcctgccaggtttcaccttcatccagcacctgccgctttccgagcgaattagaggcaccgtggggcctaaatccaaagccgagtgcgaaatcctgatgatggtaggcctgcctgccgcagggaagaccacctgggccattaaacatgcggccagcaacccgtcaaagaagtataatattctgggcactaatgccatcatggacaagatgagggtgatgggcctgcggcggcagaggaattatgcaggtcgatgggatgtattgatccagcaggcaactcagtgtctaaaccggctgattcaaatcgccgcccgcaaaaaacgcaactatatactcgatcaaaccaacgtttacggcagcgctcagaggaggaaaatgcggccgtttgagggcttccagagaaaggccatcgtcatttgccctacagacgaggacctgaaggacaggaccataaaacgaacagacgaggaggggaaagacgtccctgatcacgccgtgctagagatgaaagcgaacttcacacttccggatgtcggggattttctcgacgaggtgctttttatcgagctccagagggaggaagctgacaagctggttcgccagtacaacgaagaagggagaaaggctggcccgccacccgaaaagagattcgataacaggggcggtgggggctttcgcggccggggaggaggcggagggttccagaggtacgagaacaggggccctcccggcggaaaccggggtgggttccaaaatcgcgggggcggcagcgggggtgggggtaactatcgtgggggttttaacagatcaggcggcggaggttactcccaaaatcggtggggtaacaacaatcgcgacaacaacaatagtaacaatcggggaagctacaaccgagccccccagcagcaacctcccccacaacagcctcccccaccgcagccgcctccccagcagcctcccccccccccaagttattccccagcccggaatcctcctggggcatcaacttacaacaaaaattccaacatccccggctctagtgctaacacttccacacccaccgtgagcagctactcccctccccagccctcttatagccaaccgccatataaccagggtggctatagccagggctataccgccccccctcccccaccacctcctcctcccgcttacaattatggaagctatgggggctataaccctgctccatacaccccccccccgcctcccactgcccagacctacccccagccatcgtacaatcaatatcagcagtacgctcagcagtggaaccagtattaccagaaccagggtcagtggccgccttattacgggaattacgactacgggagctatagcggcaacacgcaaggcggcacatccacccaatag

SEQ ID NO: 119810 - DNA, 2751 bp, Artificial Sequence
  Description of Artificial Sequence: Synthetic coding sequence
atggactgtgagcattccctatcactgccttgtcgtggcgccgaggcttgggagatagggatcgataaatatctctacgccatgcggctaagtgatgagacccttatagacataatgactagatttcggaaagagatgaaaaacggtctgtccagggacttcaatcccactgctacagtgaaaatgctcccgaccttcgtgcgcagcattcccgacggaagtgagaaaggcgattttattgcattggacctgggcggtagtagctttcgaatcctgcgggttcaggtgaatcatgagaaaaatcagaatgtgcacatggaaagcgaggtctatgacaccccagaaaatatcgttcacggctctggtagccagctttttgaccatgtagcagaatgcttgggggatttcatggaaaagcgaaagattaaggacaagaagctgcctgtcggctttacattttcctttccctgccagcagtcgaaaatcgacgaggccatcttaatcacctggacaaaaaggtttaaggcctctggggttgagggcgccgacgtcgtgaaactcctgaacaaagcgatcaagaagcgcggtgactacgacgctaacatcgtggccgttgtgaatgatacagtgggaaccatgatgacatgcgggtacgacgatcagcactgtgaagtaggactgatcattggcaccgggactaacgcctgctatatggaggaactgcgccacatagatctggttgagggcgacgaaggtcgcatgtgtatcaacaccgaatggggggccttcggagacgatggaagcctggaggatatccggaccgagtttgacagggagatagaccgaggatctctgaatcctgggaagcagctgtttgaaaaaatggttagtggcatgtatctcggcgaattggtgagacttattctggtgaagatggccaaggagggattgctgtttgagggcagaataacacccgagctcctgacccgtggaaaattcaacacgtctgacgtgtccgctatcgagaagaataaagaaggactccataatgccaaagaaatcctaacccgattgggggtggagccctctgatgacgactgtgtgtctgttcaacacgtatgcactatagtgagcttccggagcgctaacctagtggccgctaccttaggcgccattctaaatcgcttgagggataataaaggcaccccaaggcttagaactactgtgggcgttgatggttccctctataagacccatccacagtacagcagacgcttccataaaaccctcaggaggctggtcccagattctgatgtacgattcctcttgagcgaaagtggcagcggcaaaggggctgccatggttactgcagtggcttaccgcctcgccgaacagcaccgacaaatcgaggagacgctggcccatttccatctgactaaagacatgctgctggaggtgaagaaacgcatgagagctgagatggaactcggccttaggaaacagactcataacaacgcagtcgttaagatgctaccttcctttgtccgccggacacctgatggcacagaaaatggggatttcttggcacttgacttgggaggcacgaactttcgggtgctgctcgtgaagattaggtcgggcaaaaagcgcacagtggagatgcacaataagatttacgccatcccgatcgaaattatgcaggggacaggagaagagctgttcgaccatattgttagctgcataagcgacttcttggactacatgggtatcaaaggaccccggatgcctctgggtttcacattcagttttccttgccagcagactagcctggacgctggcatacttatcacttggacgaagggattcaaggctaccgattgcgttgggcacgacgtggttaccttacttcgcgacgcaataaaacgaagggaagagttcgacttggacgtggtggctgtggttaatgataccgtaggcacaatgatgacatgcgcctacgaagagccgacttgtgaagtgggcttgatcgttgggactggatccaatgcctgttacatggaagaaatgaagaacgtggagatggtagaaggcgatcaggggcagatgtgtataaatatggagtggggggccttcggggacaacggttgtttagatgatattcgaacccattacgatcgtctggtggatgaatactcactcaacgccgggaagcagaggtacgagaaaatgatctctggaatgtacctgggggaaattgtgagaaacatattgattgactttaccaaaaaggggttcctgtttcgcggtcagattagtgagacgctcaagacacgaggcatcttcgaaaccaagttcctgagtcagatcgaaagcgacagattagcgctcttgcaggttcgcgcaatcctacagcagttgggactgaattccacatgcgacgacagtattttagtgaagactgtctgcggcgtcgtgagcaggcgcgctgcccagctgtgcggtgcagggatggcagcagtcgttgataagattcgggaaaatagggggctggataggctcaacgtgaccgtgggggtggacggcacgctgtacaagctgcacccacactttagtcgtattatgcaccaaacagtaaaggagctttcacctaagtgtaatgtgagttttttgctcagcgaggacggttccggaaaaggcgccgcccttatcactgcggtcggcgtgaggctaagaaccgaagctagttcatag

SEQ ID NO: 119811 - DNA, 2754 bp, Artificial Sequence
  Description of Artificial Sequence: Synthetic coding sequence
atgatcgccgcccagcttcttgcttactattttaccgagttgaaagatgaccaagttaagaaaattgacaaatacctctatgctatgcgcctcagtgatgaaactcttatagacatcatgactaggttccgtaaggagatgaaaaatggtctctcccgcgatttcaaccccaccgcaactgtgaagatgctgccaaccttcgtgaggtcaatccccgatggatctgagaagggggactttatcgccctggacctcggaggcagcagtttcagaatactaagagtgcaggtgaatcacgagaagaatcagaatgttcacatggagtctgaagtgtacgatacccctgaaaacatcgtgcatgggtccgggagtcagttgtttgatcacgtcgctgagtgcctgggcgacttcatggaaaaaaggaaaattaaagacaaaaaactgcctgtgggtttcactttcagtttcccgtgtcaacagagcaagatagatgaagccattcttatcacctggacaaaacgattcaaagcttccggtgtagagggcgccgacgtggtaaaattactgaataaagcgatcaagaaacgcggagattacgacgctaacatcgtggcggtcgtcaacgacactgtcggaactatgatgacctgtggttatgatgaccagcactgcgaagtgggtctgatcatagggactggcaccaatgcttgctacatggaggaacttagacacattgacctagtcgagggagatgaagggagaatgtgtataaacacagaatggggggctttcggcgatgatggttcccttgaggatatccgcacagaattcgatcgcgaaatcgatagaggctccctgaacccagggaagcagttgtttgagaaaatggttagtgggatgtacctcggcgagctggtgaggcttattctcgtgaaaatggccaaggaaggactgcttttcgagggtcgaataacacccgaactgttgaccagagggaagtttaatacatcagacgtgtcagcgatcgagaagaataaggaaggtctgcataacgctaaggaaattttgacaagactgggggttgaaccgagcgacgatgattgcgtatccgttcagcatgtgtgtacaattgtctcgttccggtcagcaaaccttgtcgccgcgaccctgggagccattctgaatagattgcgtgacaataagggcaccccaagactgcgaacaacagtcggggtggacggttccctatacaaaacccatcctcagtactctcggcggtttcacaagactctgagacgtctcgtgcctgactcagatgtgcgctttttgttaagtgagtccggctctgggaagggggccgccatggttactgcggtcgcctaccggcttgctgagcagcatagacagatcgaggaaactttggcccattttcacctgacgaaagacatgctcctggaggtgaagaaaaggatgcgtgcagaaatggaactcgggttacgaaagcagacccataacaacgcagtcgtgaagatgcttcccagtttcgtgcgccgtacacctgatgggactgagaacggggactttctggccttggacctggggggcactaatttcagagttcttttagtgaagatccgcagcgggaagaaacggacagttgagatgcataataagatttacgctatcccaatcgagattatgcagggaaccggcgaggagctattcgaccacattgtatcatgtatttcagatttcctggactacatgggaatcaaggggcctagaatgccactgggattcactttcagtttcccttgtcagcagacctcacttgatgcgggaattttaattacctggacgaaagggttcaaagcgacagactgcgtgggccacgacgtggtgaccctcctccgagacgccatcaaacgtcgcgaagaatttgacttggatgtggtcgccgtggtcaatgacacagtgggtacgatgatgacctgtgcttacgaggaacctacctgcgaggtgggactgatagttggtactggatctaacgcctgctacatggaggaaatgaaaaacgtggagatggtagagggcgaccagggccagatgtgcatcaacatggaatggggcgcttttggcgacaacggctgcctggacgatatcagaacccactacgaccgactcgtcgatgaatattcactgaacgctggaaaacaacggtacgagaagatgatttcagggatgtatctaggtgaaatcgtacggaacatattaatcgatttcactaagaagggttttttgtttcggggtcagattagcgaaacattaaaaacaagagggatatttgaaacaaagtttctatcccagatcgaaagcgatagacttgcgctgctgcaggtccgggccatcctgcagcaacttggcctgaactccacctgcgatgacagtatactggtcaaaaccgtgtgcggagtggtcagcaggagagcggcacagctatgcggagcagggatggcggccgtcgtggataagatacgcgaaaatcgaggcctcgacagattgaacgtcacagtcggggtcgatggaaccctgtataagctgcacccccatttttctagaatcatgcaccagacagtgaaagaactctcaccaaaatgcaacgtaagcttcctcctgtccgaagatggctccggcaaaggggcagcactgattaccgccgtgggggtccggcttcgcacagaggcctcctcctag

SEQ ID NO: 119812 - DNA, 2718 bp, Artificial Sequence
  Description of Artificial Sequence: Synthetic coding sequence
atggccaagcgcgcacttcacgacttcattgataagtatctctatgctatgcgcttaagtgatgagaccctaatagatataatgacacgatttcgcaaagagatgaagaatggccttagcagggacttcaatcccacggccacagtgaagatgctgcccacattcgttcgttcaattcctgatggtagcgagaaaggagattttatagctctagaccttggggggtccagctttcgcattctgcgggtccaagtgaaccacgagaagaatcagaacgtccatatggaatccgaggtgtacgacaccccagaaaacatagttcatggcagtggatcacagttgtttgaccatgtggctgagtgtctgggcgattttatggaaaaacgcaagattaaagacaagaagctgcctgtcggatttacatttagttttccgtgccagcaaagcaagatcgatgaggcaatcctaataacttggaccaaacgtttcaaggcatcaggcgtcgaaggagccgatgttgtaaaactgttaaataaagcaattaaaaaacgaggagattacgatgcaaatatagtcgctgtggttaatgataccgtgggtactatgatgacctgtggatatgatgaccagcactgcgaggtgggtttgattataggtaccggtaccaacgcgtgctatatggaggaactgagacatattgatttggtggagggggacgaaggacgcatgtgcatcaacaccgagtggggagcattcggcgatgacggcagtctcgaagatattcgaacagagtttgaccgcgagattgaccggggcagtctgaatccggggaaacagttattcgaaaagatggtttcaggcatgtacttgggtgagttggtgcgcctgatacttgttaagatggccaaggaaggtctactgttcgaggggagaatcacgccagaattgctcacgaggggtaagtttaatacatcggatgtttctgccattgagaagaacaaagagggactgcataacgctaaagagattctgaccagactgggcgttgaaccttcggatgacgactgtgtctctgtacagcacgtctgcactattgtgtccttcagatcagccaatctggtagcagcgaccttaggagcaatccttaataggctgcgagacaataaaggcacaccaaggctcaggacaactgtgggcgtggacggatcattgtataaaacacatccgcagtactctcgccggtttcacaagacccttcgcagactggttccggattctgacgtgcgctttctcctctcagaaagcggttccggaaaaggagccgcgatggttactgccgtcgcttaccgactggcagagcagcaccgccagatcgaagagacgctcgctcacttccacttgaccaaggacatgctgcttgaagtcaaaaagaggatgcgagccgagatggagctaggcttacggaaacaaacacataacaacgccgtggtcaagatgttgccttcctttgtccggcggacccctgatgggactgaaaatggagacttcttagctctggatctgggcgggacaaacttcagagtgctgctggtcaagatacggtcaggaaagaagaggacagttgaaatgcacaacaaaatttatgcaatccctatcgagatcatgcaggggacgggggaagagctctttgaccacatcgtttcatgtatatccgactttctcgattatatggggattaaagggccccgaatgccattagggtttactttttctttcccgtgccagcagacctcattggacgcaggcatcctgatcacatggacaaaaggctttaaagccactgactgtgtcggccatgacgtggtgacccttctgagagacgcaataaagcggcgagaggagtttgatctggacgtcgttgcagtcgtgaacgacactgtggggactatgatgacttgcgcctatgaggaaccaacttgcgaagtggggcttatcgtggggactggctcaaacgcctgttacatggaggagatgaaaaatgtggagatggtggaaggtgaccaaggacagatgtgtatcaatatggaatggggcgccttcggagataacggatgcctcgacgacatcaggactcactatgaccggctcgtggatgagtactctctgaacgcaggaaaacagcggtatgaaaagatgatctccggcatgtacctcggggagatagtacgcaatattttaatcgacttcaccaaaaaggggttcctctttagaggccagatttccgagacactgaagacacggggcatttttgaaaccaagttcttgtcccagatcgaaagcgacagactcgctctccttcaggtgagggccatccttcaacagctgggactgaatagcacttgtgacgatagcatcctcgtgaaaacggtatgtggggttgtatctcgcagagctgctcagctttgcggcgccggcatggcagccgtggtagacaagattcgtgagaacaggggacttgatcgtttaaatgtgactgtgggcgtggacggtacactgtataagctgcatcctcacttttcccgcattatgcatcagacagtgaaagaactgagcccaaagtgcaatgttagcttcctgttaagtgaggacggctccggcaaaggtgccgctctcatcactgcagtgggcgtgcggctgcggaccgaggccagtagttag

SEQ ID NO: 119813 - DNA, 2766 bp, Artificial Sequence
  Description of Artificial Sequence: Synthetic coding sequence
atgggccagatatgccaacgcgagagcgccacggcagccgaaaaacctaaacttcacttgctggcagaatccgagatcgacaaatatctatacgcaatgcgtttgtctgacgaaactcttattgacattatgacacgcttccgcaaggagatgaagaatggacttagcagggatttcaatcccacagcaaccgttaagatgctacctaccttcgtccggtccattccagacggcagcgagaaaggcgattttatagccttagacctaggtgggtcatcatttagaatcctgcgcgtgcaggttaatcacgaaaagaatcagaacgtccacatggaatcagaggtctacgatactcccgagaacatcgtgcatggatctggttctcagctcttcgaccacgtggcagaatgtctgggcgattttatggagaagcggaagatcaaggacaagaagctgcccgtaggtttcacgttctcatttccctgtcagcagtcaaagatcgatgaagctattctcataacctggactaagcggttcaaagcgtccggggtagagggggccgatgttgtgaagctccttaacaaagcaatcaaaaagagaggcgactatgacgcaaacatcgttgccgtggtgaacgatacggtaggaacgatgatgacctgcggatacgacgaccagcactgcgaggttgggctcataattggtacaggcaccaatgcctgctatatggaggaattgcgccacatcgatttagttgaaggcgacgagggcaggatgtgtatcaacacggaatggggcgcgttcggtgatgatgggtcgctggaagatattaggaccgagttcgatagggaaattgaccggggttccctgaatccaggtaaacagctgttcgaaaaaatggtgtccgggatgtacctcggagaactagtccgattaatattggttaagatggcgaaagagggcctgctgttcgaggggcggatcacccctgaactgctgacccgcgggaagttcaacacaagtgacgtcagtgctatcgaaaagaataaagaagggctacacaacgcaaaggaaattctaacacggttgggagtagaaccgtccgacgacgactgtgtgtccgtccagcacgtgtgtaccatcgtctccttccggtctgcgaaccttgtggctgcaaccttgggggcgatccttaaccggctaagggacaacaagggtacccctaggttaagaactaccgtgggagtcgatgggtccttgtacaagactcacccacagtatagccgcaggtttcacaagaccttgcggcgcctggtccccgactcagatgtgaggtttttgctgagtgaatccggcagtggtaaaggtgcagctatggtgaccgctgtagcctaccgactagctgaacaacatcgccagatcgaagaaactctggctcattttcaccttacaaaggatatgctcctggaggtcaagaagaggatgcgagccgaaatggaattagggttacgcaagcaaacccacaacaatgcagtcgtcaagatgcttccctcctttgtgagaagaacccccgatgggacagaaaacggcgatttcttagcactcgatcttggcgggaccaatttccgcgttctgttggtgaaaatcaggtccggcaagaaacgaaccgtcgagatgcacaacaagatttacgctatccctattgaaataatgcagggtactggcgaggagcttttcgaccatatcgtttcatgcatatcagattttcttgactacatgggcattaaaggaccaagaatgcctcttgggttcaccttttcttttccctgtcaacagacatcattggatgcagggatactgatcacctggacaaaaggcttcaaggctactgactgcgtagggcacgatgtggtgaccctgctaagagacgccattaaacgtagagaagagtttgacctggacgtcgtggccgttgtgaacgacacagtgggcaccatgatgacgtgtgcttacgaggagcctacctgcgaggtgggcttgattgtggggacaggatcaaatgcatgttacatggaggaaatgaaaaacgtagagatggtggagggcgatcagggtcagatgtgcattaacatggaatggggagccttcggggataacggctgcctagatgacattcggacacattatgatcgccttgtggatgagtattctctgaacgccggaaagcaaaggtacgagaaaatgattagcggcatgtacctcggcgagatcgtgcgtaacattttaattgatttcacgaagaaagggttcctgttccggggccagatatcagagacactcaaaactcgggggatttttgagaccaaatttctgtcacagatcgagtctgaccgcctggccctgttgcaagtgcgcgctattctgcagcagctggggttgaatagtacatgcgatgactccattcttgtcaagaccgtatgcggggttgtgagccgacgggcagcacagctgtgcggggctggcatggctgcggttgtagacaaaattagagagaataggggactcgataggctcaacgtgactgtgggcgtcgacggaacgctttataagctgcaccctcactttagtagaatcatgcatcaaaccgtcaaagagctttcaccaaaatgtaacgtgtcctttctgttgagcgaagatggcagtggtaaaggagcagcactgatcacagcggtcggcgtgcggttaagaactgaagcctcttcttag

SEQ ID NO: 119814 - DNA, 2748 bp, Artificial Sequence
  Description of Artificial Sequence: Synthetic coding sequence
atgatagcggctcagcttctggcatactactttaccgagctgaaagatgatcaagtcaagaaaatcgataaatatctgtatgctatgcgcctctccgatgagactctgatcgacatcatgactagattcaggaaagagatgaagaatgggttaagccgggactttaatcccaccgccaccgtcaaaatgctccctacgtttgtccgtagcatccccgacgggagtgaaaagggggactttattgccctcgacctcggaggatccagttttagaatcctcagagtgcaggtgaatcacgagaaaaatcagaacgtacacatggagagtgaagtttacgatacccctgagaatatcgtccacggttccggaagccagctcttcgaccacgtggccgagtgccttggagattttatggagaaacgcaagatcaaagataaaaagttgccagtgggctttaccttcagcttcccgtgtcagcagagtaagatcgacgaagctatactcatcacatggacaaaaaggtttaaggctagtggggtggagggcgccgatgtagtcaagcttctgaacaaggccatcaagaaacggggggattacgacgcgaacattgtggctgtcgttaacgacaccgtggggactatgatgacctgcgggtatgatgatcagcactgcgaagtcgggctcataatcggcactggaaccaacgcatgctacatggaggagctgcgccatatcgacttagtggagggagatgagggcaggatgtgtataaataccgagtggggggcatttggggacgatggcagtctggaagatattcgcaccgaatttgatcgggaaatagaccgtgggagcctgaaccctggaaagcaactctttgaaaagatggtctcgggcatgtatttgggggaactcgttaggctcatcctcgtcaagatggccaaagaggggttactgtttgaaggacgtatcacacctgaactcctcacgcgcgggaagttcaacacatccgacgtgagtgccatcgagaaaaacaaagaagggctgcacaatgctaaggagattctgacccggctcggagtggaaccatccgacgacgattgtgtgtccgtgcagcacgtgtgcacaatcgtatctttccggtcagctaatttggtggccgccacactgggagctatacttaatcgacttcgagataataaggggacccccaggctccgaactactgtcggcgtagatggttctctgtacaagacgcacccacagtactctcgaagattccacaaaacattaagaagactggtgcccgattcagatgttcgattcctactttctgagagtgggtccgggaaaggggccgctatggtgactgccgttgcatacaggctggctgagcaacacaggcaaattgaggaaactctggcccattttcatctgaccaaagatatgctgctggaagttaagaaaaggatgcgggccgagatggagctcggccttagaaagcaaacgcataacaacgcagtagtgaagatgctccccagcttcgtgcggcgaacaccagacggcaccgagaatggggacttcctcgccctggatctcggcggcactaatttcagggttctgctggttaagatccggtccgggaagaaaagaaccgttgagatgcacaacaaaatttacgccatcccaatcgagataatgcagggtactggagaagaactcttcgatcacatagtctcctgtatcagtgactttttggactacatgggcatcaaggggccgcggatgcccttgggatttacattttcttttccttgccagcaaacaagcctggatgctggcatattgattacttggaccaaaggatttaaagccactgattgcgttggacacgacgtcgtaaccctcttgcgagacgccattaagaggcgcgaagaatttgacttggacgttgtggccgtcgtgaacgatacagtgggcactatgatgacctgcgcctacgaagaaccgacctgtgaagttgggttaatcgttggcacaggaagcaacgcctgttatatggaggagatgaagaatgttgaaatggtcgagggcgaccagggccagatgtgcatcaatatggaatggggcgccttcggcgataatggctgtcttgacgacatccggactcattatgatcgcctcgtggacgagtattccctgaatgcaggtaaacaacgttacgagaaaatgatctccgggatgtacctcggggagatcgtcaggaacattctaatcgatttcacaaagaaaggattcctatttcgtgggcagatcagcgaaacactgaagaccaggggcatctttgagacaaaatttctatcgcagatcgaaagtgaccgcctggccctgctccaggtgcgtgcaatactgcagcagttgggcctgaactcaacgtgcgacgattctatcctggtgaagacagtatgcggggttgtctctcgtagggcagctcagctgtgtggagctggcatggccgcagttgtcgacaagatccgcgagaatagggggctggaccggctcaacgtcaccgtgggcgttgatggaactctgtacaaattgcacccacatttcagccgcattatgcaccagaccgtcaaagagctgtcacccaaatgcaatgtttcttttctgttgtctgaagacggctccggaaaaggtgctgcactgatcactgccgtgggcgtaagactgcggacagaggcttag

SEQ ID NO: 119815 - DNA, 345 bp, Artificial Sequence
  Description of Artificial Sequence: Synthetic coding sequence
atggcgaaaagagccctccacgacttcatagataaatatttgtatgccatgcgactgagcgatgaaacccttatcgacatcatgactcgctttaggaaagaaatgaaaaatggactgtctcgtgattttaatccaaccgccactgttaagatgctccccacattcgtccgatctatacccgacggttctgagaaaggggatttcattgctctggatctgggggggtctagttttcgcatcctgcgagtgcaggtaaatcacgaaaaaaatcagaacgttcacatggagtcagaagtgtatgacacacccgaaaatattgtgcacggctcaggctctcagctttag

SEQ ID NO: 119816 - DNA, 876 bp, Artificial Sequence
  Description of Artificial Sequence: Synthetic coding sequence
atggactgcgagcattccctgtccctcccttgtcgcggtgcagaggcttgggaaatcgggattgataagtatttgtacgccatgaggctgtccgacgagaccctgattgacatcatgactcgattccgcaaagagatgaaaaatggactgtccagggactttaaccctaccgccacggtgaaaatgctgccaacttttgtacgttccattcctgacggctccgagaagggagacttcatagccctcgacctgggtggtagtagttttagaattttaagagttcaggtgaaccacgaaaaaaaccaaaacgtgcatatggagagcgaggtgtacgacacccctgaaaacattgttcacggctccgggtctcagttgtttgatcatgtggcagagtgcctcggcgactttatggaaaagaggaaaattaaggacaagaagctacctgtggggtttactttttcgtttccttgtcagcagagcaagatcgacgaagctatactgattacatggacaaagcgtttcaaggcctcgggagtcgaaggagccgatgtggttaaactgctaaataaagccataaagaaacggggtgactatgacgctaatatagtggcggttgtgaatgacacagtgggtacgatgatgacctgcggatatgacgatcaacactgcgaagtcggactaataataggcacgggcactaatgcttgctatatggaggaacttagacatattgacctcgtggagggggacgaaggacgcatgtgtataaacacagagtggggtgccttcggtgacgatggaagcttagaagacatcaggaccgagttcgacagagagatcgataggggctcactgaacccagggaagcaactttag

SEQ ID NO: 119817 - DNA, 2859 bp, Artificial Sequence
  Description of Artificial Sequence: Synthetic coding sequence
atggggcagatctgccagagagagtccaggcagggcctggccatgctccctcgactttttctgaacccctggagacaggtgatcctactcccccagcccccgaaagtgttggggctccaagcaacagcagctgagaagcctaagctccatctgttggccgagagcgaaatcgacaaatacctgtatgctatgcgcttaagtgatgagacattaatcgatatcatgaccaggtttaggaaggagatgaagaacggattaagtagggactttaaccctactgcaactgtgaagatgctgccgacattcgttagaagtataccagacggaagtgagaagggagactttattgccctggatcttggaggaagcagttttcgaattttgcgcgtgcaggtaaaccacgagaaaaaccagaacgttcacatggagtcagaggtgtatgacaccccagagaacatcgtgcacggctccggctcgcagctcttcgatcacgtcgccgaatgcctgggcgactttatggaaaaaaggaaaatcaaagataaaaagcttcccgtgggcttcaccttctctttcccctgtcaacagtcaaagatagatgaggcaatcctgataacatggaccaaaagatttaaggcttccggcgtggaaggcgcagacgtggtgaaactgctcaataaggccattaagaaacggggggattacgacgcgaatatcgtggctgtggtgaatgatacagtagggaccatgatgacttgcgggtatgacgaccagcactgcgaggtggggctgattatcgggacaggcacaaatgcctgctatatggaggaactgcgtcacattgatcttgttgagggtgatgaggggagaatgtgtatcaacaccgagtggggcgctttcggcgatgacggcagcctggaagacatccgcacagagtttgatcgagagatcgatcgtggcagcctgaaccctggaaaacagttattcgagaaaatggtcagcgggatgtatctgggggaacttgttagactgatactcgttaagatggcgaaggagggtttgctgttcgagggacgaatcacccccgaactgttgacccgcggcaagtttaacaccagcgacgtctctgccatcgagaagaacaaggaagggctccacaacgctaaggagattctaacacggctgggtgtggagccgtcagacgatgattgcgtcagcgtgcagcacgtgtgcaccatagtgtccttccgctccgccaacttagtggcagctaccctgggagcgattctgaaccggctgcgcgataataagggcactcctaggctccggactaccgtcggagtggacggctccctgtataagacacacccccaatattcccggaggttccataaaaccctgagaaggctggtacccgattctgacgtgcgtttcttactgagcgagagcgggtccgggaagggtgcggccatggttactgccgtagcttaccgcctggcagaacaacacagacagatcgaggaaacactggctcactttcacttaaccaaagatatgctgctggaggttaaaaaacgcatgagggctgagatggaactaggactgcggaaacaaacacacaataacgctgtcgtgaagatgctgccttcattcgtgaggcggactccggacggaaccgagaacggcgacttcttagccttggacttgggtgggaccaacttccgcgtactacttgtcaaaataaggtcaggcaaaaagcggacagttgagatgcacaataaaatatacgctatccctattgagatcatgcagggtacaggagaagagttattcgatcatatcgtatcttgcatctccgacttcctcgactatatgggtataaaggggccacgcatgcccctgggcttcaccttttcctttccgtgccaacagacttctttagatgccgggattctgatcacctggacaaaggggtttaaggcgactgattgtgtgggccacgatgtcgttaccctcctgcgggacgctataaaaaggcgcgaggagtttgatctggacgtcgttgcggtagtgaacgacaccgtgggcacaatgatgacctgtgcctacgaggagccgacctgcgaggtcggtctcatcgtgggtacaggaagtaatgcttgctacatggaggaaatgaagaatgtggagatggtggaaggtgatcagggtcagatgtgcatcaatatggagtggggagccttcggcgacaacgggtgcctagacgacatccgcacacactatgatcgcctggtcgatgaatacagtcttaacgccggtaaacaacggtacgaaaaaatgatctccgggatgtacctcggtgaaatagttagaaacatcttgatcgacttcaccaagaagggttttctctttcggggccagatcagcgaaaccttgaaaactcgcggtatcttcgagacaaagttcctgtcacagatcgagtccgatcgattagccctcctccaggtcagagccatactacagcagctaggtctgaatagtacctgcgatgatagtatcttggtaaagaccgtgtgtggggtggttagtcgccgggccgcccaactgtgtggtgctgggatggccgccgttgtagataaaatccgggaaaacagaggcctcgacaggctcaatgtgaccgtcggcgttgatggaaccctgtacaagttacacccacactttagccgcataatgcatcagaccgtcaaagagctctccccgaaatgcaacgtgtctttccttctctccgaggacggctctgggaagggtgctgcgttaataaccgctgtgggcgtccggctgcggactgaagctagttcatag

SEQ ID NO: 119818 - DNA, 420 bp, Artificial Sequence
  Description of Artificial Sequence: Synthetic coding sequence
atgggccagatttgtcagcgcgaatctgcaactgctgccgagaagcctaagttacacctgctggccgagtctgagatagacaaatatctgtacgccatgagactttcggacgagacgctgatcgatattatgacccgtttccggaaggaaatgaagaacgggctcagtcgagatttcaatcccaccgcaacggtgaagatgttgccaacgtttgttcgaagcatccctgatggaagtgaaaagggcgacttcatagccttagacctgggagggtcctcctttagaatcttacgtgtgcaggtgaatcatgaaaaaaatcaaaatgtgcacatggagtccgaggtgtatgatacaccagaaaatatcgtacacggaagcgggtcccaactctttgaccatgtggctgagtgcctcggctag

SEQ ID NO: 119819 - DNA, 2754 bp, Artificial Sequence
  Description of Artificial Sequence: Synthetic coding sequence
atgatcgccagccaccttcttgcttattttttcactgaactgaatcatgaccaggtccagaaggtggaccagtatttgtaccatatgaggctcagcgatgagaccctattagaaatatcgaagagattccgtaaggagatggaaaaaggtctaggtgccacgacacatccaactgctgctgtgaaaatgcttccaacatttgtccggtcaactccagatggaaccgagcacggcgagtttttggctctcgatttgggcgggactaatttcagggttctgtgggtgaaggtgacggacaatgggctgcagaaagtggagatggagaatcagatctacgctattccagaagacatcatgagaggaagtgggactcagcttttcgaccatatcgccgagtgcctagccaacttcatggataagcttcagattaaagataaaaaactgccactgggctttacatttagcttcccatgccatcaaacaaaactggacgagtcattcctggtctcttggacaaaagggtttaagagtagtggggttgaaggtcgggatgtggtggctctgatcagaaaagccattcagcgtcggggggacttcgatatcgatatcgtggctgtcgtgaatgacacggtggggaccatgatgacatgtggctatgacgaccacaattgtgaaattggactcatcgtgggcaccggcagcaatgcatgctacatggaagaaatgcgccacatcgatatggtcgaaggcgacgaggggcggatgtgtattaatatggagtggggcgcgtttggcgacgacggtagtctgaacgacatacgcactgaattcgatcaggagattgacatgggaagcttaaatccaggcaaacagctcttcgaaaaaatgatttcaggaatgtacatgggcgagctcgttagactcatactggtcaagatggcgaaagaggaactgctgtttgggggaaagctgagcccggagctcctgaacacgggacgcttcgagacaaaggacatttcagacattgagggggagaaagacgggatcagaaaggctcgcgaggtgctcatgcgtttgggactggatcccacccaggaagattgcgtggcaacccatcgcatctgtcagatcgtgagtactagatcggcttccctgtgcgctgctaccctcgccgccgttttgcagaggataaaggaaaataaaggagaagaaaggctgcgctccactattggggttgacggcagcgtctacaagaaacacccccacttcgcaaaacggctccacaagactgtgagaaggctcgtgcctggctgtgatgtgcgatttcttcgtagtgaggacggctcaggcaagggcgcggcgatggtcacagccgtagcttaccggcttgccgaccaacatcgcgcgagacagaagacgttagaacacctgcagctctctcacgatcagctgcttgaggtcaagcgccgcatgaaagttgagatggaacgaggactctctaaggagactcacgcgtcagcaccagtaaagatgcttcccacatacgtttgtgccacacccgacgggaccgaaaaaggagattttttggctctggatttgggagggactaacttccgcgtcctcctagtccgagtccgtaacgggaaatgggggggagtggagatgcataataaaatatatgcaatcccccaagaggtgatgcatggcaccggggatgagttgtttgatcacatagttcaatgtattgcagacttccttgagtacatgggcatgaagggagtgtcactacctctcggctttacattcagtttcccctgtcagcagaattccctcgacgagtctatcttgctcaaatggaccaagggatttaaggctagcggttgtgagggcgaagacgtcgttactctactcaaagaggctatacatcgccgcgaagagttcgacttagatgtggtggccgtggtcaacgacactgttggcaccatgatgacttgtggttttgaggatccacactgcgaagtcggactcatagtaggcaccgggtcaaacgcctgttatatggaagaaatgcgaaatgtagaactggttgagggtgaagagggacggatgtgtgttaatatggaatggggggccttcggggataacggatgcctcgatgacttccgcacggagttcgacgtggctgttgatgaactgtctctcaacccaggtaaacagagatttgaaaaaatgatctccgggatgtacttgggtgagattgtccgtaatatcctcattgactttacgaaaagagggctgcttttccggggaagaatctcggaaagactgaaaaccagaggcatctttgagacaaagttcctgagccaaattgagagtgactgcctcgcattgctacaggtgagagctattctgcagcatcttgggctggagtctacatgtgacgattccattattgtgaaagaagtgtgcacggttgtagcccggagggctgcacagctgtgcggagccggcatggcagcggtggtggacagaattagggagaaccggggattggatgccttgaaggtaactgtcggagttgatggcaccctgtacaaactgcacccccactttgccaaggtgatgcatgaaactgttaaggacctggctccgaaatgcgatgtctcctttttgcaaagcgaagacggcagcggtaagggggctgccctgataactgcggtggcatgcaggatccgcgaggcaggacagaggtag

SEQ ID NO: 119820 - DNA, 2670 bp, Artificial Sequence
  Description of Artificial Sequence: Synthetic coding sequence
atgcgcctatccgacgagaccctgttggagatctctaagcgcttccgcaaagagatggaaaaaggcctgggtgctacaacccatccaactgccgccgttaagatgctgcctacattcgtcagaagcactcctgacggcacagagcatggggaattccttgctcttgatctcggagggacaaattttagagtgctttgggtcaaggtaaccgacaatggcctgcagaaggtggaaatggagaaccagatctacgctattcctgaagatatcatgcgtggtagcggcactcagctcttcgatcatattgcagagtgcctcgctaactttatggataaattacagattaaagacaaaaagctgcctctgggtttcacattttccttcccatgccaccagacaaagttggacgaaagctttctggtcagttggacaaagggattcaaatcatcaggcgttgaggggagggacgttgtcgcattgatccgaaaggctatccagcgacgtggcgatttcgatattgatatagtcgccgtagtgaacgacactgtgggtacaatgatgacctgcggctacgatgaccacaactgcgagataggactgattgtgggaactggcagcaatgcctgttacatggaggaaatgcggcatatcgacatggtagaaggagacgaaggacgaatgtgtattaatatggagtggggagccttcggggatgacggatccttgaatgacattcgcacagagtttgaccaggagatcgatatgggcagtctcaatcccggaaaacagctgtttgagaagatgatttctggcatgtacatgggggagttggtacgactcatccttgtaaaaatggcaaaagaagaacttctttttggtggtaaactcagccctgagcttctaaataccgggcggttcgagaccaaggatatctctgacattgaaggcgaaaaagacggaattaggaaggctcgagaagtgctcatgaggctgggcctggatcccactcaggaggattgtgtagccacacaccggatttgccaaattgtgtcaacgaggtccgccagtctctgtgctgcgacattggctgcggttctgcagagaattaaggaaaataagggggaggagaggctgagaagtacgatcggagttgatgggtccgtctacaaaaagcatcctcattttgctaaacgactccataagactgtacgcaggctggtgccaggttgcgacgtgcgatttttgagatctgaggatgggagcggcaaaggagccgcgatggtaacagcagtcgcctaccggctggcagaccagcatcgcgctcgccagaaaacactcgagcacctgcagctgtcccatgaccagctgctggaagttaagcggcgaatgaaggtggagatggaaagaggcctgtcgaaagagacccatgcctcagcgccagtgaaaatgctgccaacctacgtgtgtgcaactcctgacggcaccgagaagggagactttttagcactcgacctcgggggcaccaatttccgcgtgctgttggtgcgcgtgaggaatgggaagtggggcggcgtcgagatgcataacaaaatatacgcgattccgcaggaagtgatgcacggaacgggagacgaactgtttgaccacatcgtgcagtgtatagctgatttcttggaatatatgggcatgaagggggtgtcgcttcctctaggcttcaccttcagctttccttgtcaacagaattctctggatgagagtattctcttgaaatggactaagggcttcaaggcctctggatgcgagggcgaagacgtcgttactctgctgaaagaagccattcacaggcgcgaggagttcgacctagatgttgtggcagtagtgaatgacactgttggcactatgatgacatgtggtttcgaagacccacactgcgaggtaggtctgatcgtcggcaccgggtcaaacgcctgctatatggaggagatgcgcaacgttgaactggtggagggcgaggagggccgaatgtgcgtgaatatggagtggggtgccttcggagataacggttgtctcgatgacttccgcactgagtttgatgtcgctgtggatgaattgtctctaaacccaggcaaacaacggtttgaaaagatgatttccggaatgtatctgggagagatcgttcgcaatattcttatcgattttaccaagagagggctactgttccgcgggaggatttctgagagactcaaaacccgagggatttttgagacaaaattcctgtctcagatcgagagtgattgcctggcactgttgcaggtccgagccattctacagcacttgggcctggagtccacttgtgatgactctatcatagtgaaagaggtttgtactgttgtggcgcgccgcgccgcacagctgtgcggcgcaggaatggcggccgtcgtcgaccgcatccgtgagaatcggggcctggatgcactgaaggttacggtcggcgtggacggcaccctgtacaaactccacccccattttgctaaagtgatgcacgagactgtaaaggacctagcgcctaagtgcgacgtatcttttctccagtccgaagacggatccggtaagggggctgctctcatcactgcagtagcctgccgtattagggaggcaggccagagatag

SEQ ID NO: 119821 - DNA, 2754 bp, Artificial Sequence
  Description of Artificial Sequence: Synthetic coding sequence
atgattgcaagccacttgcttgcctacttctttaccgagctgaaccatgaccaagtccaaaaagtggaccagtacttatatcatatgagactcagcgatgagacgctgcttgaaataagcaaacggtttcgaaaggagatggagaagggcctaggggcaacaacccaccctaccgctgctgtgaaaatgcttcccacttttgtgcgctctacccccgacgggacagagcatggtgagttccttgcgctcgatcttggcggaaccaacttcagggtgttatgggttaaagtgaccgataacgggctgcagaaagtagagatggagaaccaaatatacgccatccccgaagatataatgcgcggatccggcacccagctcttcgaccacatcgccgagtgcctggcaaacttcatggataagttgcagattaaagataagaagctgccactggggtttacattctccttcccctgccatcagaccaagttggatgagagtttcctggtgtcatggacaaaagggttcaaaagcagtggcgtggaggggagggatgtggtcgccctgatcaggaaggccatccaacgcaggggtgatttcgatatagatatagtggcagttgtgaatgatactgtgggtaccatgatgacgtgcggctacgatgatcacaactgtgagatcggactgattgtaggtacaggtagcaatgcttgctacatggaggagatgcgccatatcgacatggtcgaaggagatgaagggcgcatgtgtatcaatatggagtggggcgcttttggcgacgacggttctttgaacgacattaggactgaattcgaccaagaaatcgatatgggtagcctgaatccagggaagcaactgtttgaaaaaatgatttccggcatgtatatgggtgaactcgttcggctgatcctcgtcaagatggccaaagaggaactgctgtttggcggaaagttaagtcctgagttactgaacaccggccggttcgaaacaaaagacatctctgatatagagggggagaaggacggcattcgaaaggcccgagaagtgctcatgagactcggtttggatcctactcaggaggactgtgtcgcgacgcatagaatttgtcaaattgtgtccactcgctctgcttcgctgtgtgccgccactctcgctgccgtcctgcaacggataaaggagaataagggagaggaaaggctacggtccactataggtgtggatggctccgtctataagaagcatccccactttgcaaagcgattgcataagaccgtgcgccgcctggtgccgggttgtgatgtacgttttttgaggtcagaggacggctcaggtaaaggtgcggctatggtgaccgctgtcgcctataggctagccgaccaacacagagcgcgccaaaaaacgctggagcacctgcagctgagtcacgaccagctgctggaagtcaagcggcgcatgaaagtggagatggagaggggcttgagcaaagaaactcacgcctccgcccccgtcaagatgctgcctacctatgtctgtgctacaccagacggaaccgagaagggggatttcctcgcccttgacctgggtggaacgaacttccgtgtgctcctggtgcgagtccgaaacggtaagtggggaggggtggaaatgcataacaaaatatacgcaatcccccaggaagtgatgcacggtaccggcgatgagctgttcgaccatattgtccagtgcatcgcagatttcctagagtatatgggcatgaagggagtcagtctgcctctgggatttacgtttagtttcccctgccagcagaactcactcgatgaatctatcttattgaaatggaccaaaggattcaaggctagtgggtgtgaaggagaggatgttgtgaccctccttaaagaggcaatccaccgaagagaggaattcgacttggatgtggtggccgttgtgaacgataccgtgggaaccatgatgacctgtggattcgaggacccccactgcgaggtgggacttattgttggtactggatctaacgcctgctacatggaggaaatgcgaaatgttgagttagttgaaggcgaagaaggtaggatgtgcgtgaatatggagtggggagcgttcggtgacaatgggtgtctggatgacttccgtacggagtttgatgtggccgtggacgagctctcactgaaccctggaaaacagcgatttgaaaagatgattagcggtatgtacttgggcgagattgttaggaacattttgattgatttcacgaaaaggggacttcttttccgcggccggatcagcgagcgattgaaaactcggggcatcttcgaaacaaagtttctctcgcagattgagtccgattgcctcgcccttctgcaagtgagggcgatcctccaacaccttggactcgagagtacctgcgacgactcaattatcgtcaaagaggtatgcaccgtggtagcaagaagggccgcccagttgtgcggggctggcatggccgccgtcgttgacaggatccgggagaatcgcgggttggacgctctgaaggtgacagtgggggtggatggaaccctgtataagctgcaccctcattttgccaaggtgatgcacgaaaccgtgaaagatctggcccctaagtgcgatgtgtccttcttgcagtctgaagatggttccgggaagggagcagcgttaattactgctgtcgcctgcagaatacgcgaggccggacagcggtag

SEQ ID NO: 119822 - DNA, 2772 bp, Artificial Sequence
  Description of Artificial Sequence: Synthetic coding sequence
atggactccattggaagctccggacttaggcagggggaagagacactgtcctgctcggaagaaggtttgcccggccccagcgattcctctgagctggtgcaggaatgcctccagcagttcaaggtgacacgggctcaattgcagcagattcaggcttcactgctgggaagcatggagcaagccttaagaggacaggcttcgccggcccctgccgttcgcatgctacccacgtacgttggaagcaccccacacgggaccgagcaaggggattttgtcgtgttagagctcggcgctacaggagccagcctgcgggtcctgtgggtgacgcttacagggatcgaggggcatcgcgtcgagcctaggtcccaggaattcgtaatcccccaggaggtaatgctcggcgcgggccaacagctgttcgatttcgccgcccattgtttgtctgaattcctagacgcccagccagtcaacaaacagggtcttcagctcgggttctcttttagttttccatgtcaccagacagggttggacagatcgaccctgatctcatggactaaagggttccggtgtagtggcgtggaagggcaggatgtggttcaactgctcagagatgccattcggcgccagggggcttacaatatcgacgtggtcgcagtcgttaatgataccgtcgggacaatgatgggctgtgagcccggggtgaggccctgtgaggtaggacttgtggtggatacaggtacgaacgcatgctacatggaggaagctcgccacgttgcagtcctggacgaggaccgggggagggtgtgtgtgtccgtggagtggggatcctttagcgacgatggggcactgggccctgtcctgaccacttttgaccacactctcgaccacgaaagcctcaaccctggagctcagagattcgaaaagatgatcggtggactgtatttgggagaattggtgcgcctggtgttggctcatctcgccagatgtggcgtcctcttcggaggctgcactagccctgcactcctgtctcagggctctatactgctcgagcacgtggccgagatggaagatccttccacaggagccgctagagtccacgcaattctacaggaccttggtctatcccctggcgcttccgacgttgaattagtacaacatgtatgtgctgctgtgtgcacccgcgccgcacagctgtgtgccgctgctcttgctgctgtcctcagttgtcttcagcactcccgagaacagcagacactccaggtggccgtagccacaggtggtcgtgtttgcgaacgccaccctcgcttttgttctgtgctacaaggcaccgtgatgctgctggccccagagtgtgacgtgagtcttataccgtcggtggacggcgggggcaggggagttgccatggtgaccgccgtagctgctaggctggcagcccaccggagactcctcgaggagaccttagcccccttccgcttgaaccacgaccagctggccgctgtgcaggcccagatgagaaaagccatggccaagggcctgcggggcgaggcctctagtttacgcatgctgcctaccttcgttagagctacacccgacggaagcgagcggggtgatttcttggccctcgacctgggcggaacaaacttccgggtgttgctggtgagagtaaccaccggggtgcagatcacctcagagatatatagcatccccgagacggtggcgcaggggagcggccagcagttgtttgatcacatagtcgactgtatcgtggactttcagcagaagcagggactcagcggtcaatccctgcctttaggcttcaccttttcgtttccctgccgccagctgggccttgatcaagggatcctcttgaactggaccaagggattcaaggcctcagactgtgagggacaggacgttgtttccttgctacgcgaagctattaccaggagacaggcagtcgagctgaacgtcgttgccatcgtgaatgatactgtgggaaccatgatgtcctgcggctatgaggacccaagatgcgaaataggcctcattgttggtacggggactaacgcgtgctacatggaggaactcagaaacgttgccggagttccaggggattctggacgtatgtgtattaacatggaatggggggcatttggcgacgatgggtctctggctatgctgtcgactagatttgatgcgtcggttgatcaggcatctatcaaccccggaaagcagcgatttgagaagatgatctcagggatgtatctcggcgaaatagttcggcatattctgttgcacctgacgtctctcggcgtgctcttcagaggccagcaaatccaaagactccagactcgggatatcttcaagaccaagtttctttccgaaattgagtccgactctttagctcttaggcaagttcgggccatcctggaagatctcgggctgcctctgactagcgacgacgcccttatggtgttagaagtgtgccaggccgtctctcagcgtgctgcccagctctgcggtgctggagttgccgccgtggtcgaaaaaataagggagaacagggggttggaagagcttgccgtttccgtgggggtcgatggcaccttgtataaactccatcctcggttcagcagtctagtggcagccaccgtgagggagctcgcgccacgctgcgtcgtgaccttcctacagtcagaagacggtagtggaaagggcgccgcattggtgaccgccgtcgcctgccgtctcgcccagcttacaagagtctag

SEQ ID NO: 119823 - DNA, 1590 bp, Artificial Sequence
  Description of Artificial Sequence: Synthetic coding sequence
atgacttctagtaggctctggttttcactcctactggctgccgcctttgcgggcagagccactgcgctgtggccctggccacagaatttccagactagcgaccaacgctatgttctgtatcccaacaactttcaatttcagtatgacgtcagcagcgcggcccaacccggctgcagcgtgctggatgaagccttccagcggtaccgggatttgttgtttggttcaggttcctggcctagaccctatctgaccggtaagaggcacacactggaaaagaatgttctggttgttagcgtagtgaccccaggttgtaatcagctgccaaccttggaatccgttgaaaattatacccttactatcaacgacgatcaatgccttctgttgtcagaaacagtctggggcgccctcaggggattagaaactttctctcaactcgtatggaaatcggccgagggcacctttttcatcaataaaacagaaattgaggattttccgcgcttcccccacagaggactgctgctggatacgtccagacactatctgcctctgtcctcaatattagataccctcgacgtaatggcttataacaaactgaacgtgttccattggcatttagtggacgacccatcatttccatacgagtcgttcacatttcccgagcttatgaggaagggaagttacaatccagtaacacacatctacacggctcaggatgtgaaggaagttattgaatatgcgaggctgaggggaatccgagtactggctgaatttgacaccccaggccacacactgagctggggtcctggcatacccgggttactgactccatgttattccggctctgaaccttccgggaccttcggaccagttaacccttcccttaataatacttacgagtttatgagtacatttttcttggaggtatccagcgtctttcccgacttctatctgcacctgggaggagatgaagtagactttacatgctggaagagcaaccccgagatccaggacttcatgagaaaaaaagggtttggtgaggacttcaaacagctggaatccttctacatacagactctcctggacattgtgagcagctatgggaagggatacgttgtctggcaggaggtatttgacaataaggtgaagatacagccggacacaattatacaggtttggcgggaggatatccccgtgaactacatgaaagaattggaactggtcaccaaggctggcttccgtgccctgctgtccgcaccttggtacctcaaccgcatatcttacgggcctgattggaaagatttctacatcgttgagcctctggcattcgagggcaccccagagcagaaagcccttgttatcggtggtgaggcctgtatgtggggcgagtatgtggacaatacgaacctcgtgccgaggctttggccacgggccggagctgtcgctgaaagactgtggagcaataagcttacctccgatctgacctttgcatacgaacggctttcccattttcggtgcgagctcctgcgtaggggtgtccaggcacagccgctcaacgtaggcttttgcgagcaagagtttgaacagacttag

SEQ ID NO: 119824 - DNA, 906 bp, Artificial Sequence
  Description of Artificial Sequence: Synthetic coding sequence
atgatgacgtctgtctacagcagtttaagactctcaggagaactgagcgaagacgtcatggcatacaataagctcaacgtattccattggcatcttgtggatgatccaagtttcccctatgagtcttttacctttcctgagttaatgcgcaaaggctcttacaatcccgtgacccacatctataccgcacaggacgtgaaggaggtgattgagtatgcacgcctgaggggaatccgcgttcttgcagagttcgataccccaggccataccctgagttggggtccgggtatccccggtctgctgaccccctgttacagcggcagtgagccttccggcacatttgggcccgttaatccttccctaaacaacacctacgaattcatgtcaacattttttttggaggtgtcaagcgtcttccctgatttttacctacacctgggcggggatgaggtcgatttcacatgctggaagtctaatcctgagatacaggactttatgagaaaaaaaggattcggcgaagattttaaacagcttgaatcgttttatatccagacattactcgatatcgtgagttcttatggcaagggatatgtggtctggcaagaggtgttcgacaataaagtcaaaatccagcctgatactatcatccaagtgtggcgagaggacattccggtgaactacatgaaagagctggaactggtgacgaaagccggcttccgcgcactgctgtccgccccttggtacctgaacagaatttcctatggaccggattggaaagacttttacatcgtcgagcccctggcctttgagggaactccagaacagaaagccctggtaattgggggcgaggcttgcatgtggggtgaatacgtggataatactaatcttgtgcccagactatggtag

SEQ ID NO: 119825 - DNA, 507 bp, Artificial Sequence
  Description of Artificial Sequence: Synthetic coding sequence
atggcctacaacaagcttaacgtttttcattggcacctcgttgatgatccaagtttcccttacgagtcatttaccttccctgagctcatgcggaagggttcgtacaacccagtgacacatatttatacagcacaagacgttaaggaggtgatcgaatatgcccgcctccgagggatcagggtcctagctgaattcgataccccaggacatacactatcctggggaccaggaatcccaggcctcctcactccctgctattctggctcagagccttcagggaccttcggacctgtcaatccctcactgaacaatacgtacgagttcatgagcacgttttttttggaagtgtcttcagtgttccccgacttctacttacaccttgggggagatgaggtcgacttcacttgttggaaaagtaacccagaaattcaagattttatgcgtaaaaaaggctttggggaagacttcaaacagctggaaagcttctacattcagacctatccttag

SEQ ID NO: 119826 - DNA, 1671 bp, Artificial Sequence
  Description of Artificial Sequence: Synthetic coding sequence
atggagctctgcgggctcggcctccctaggccaccaatgttgctggcactactgctcgccactctgttagcggcgatgcttgctctgctgacacaagtggccctggtggtccaggtggccgaggccgcccgcgcgccaagcgtgtcagctaaacccggccctgccctgtggcctctgccactactcgttaaaatgacacccaacctgctgcacctggccccggagaatttttatatttcccactccccaaatagtaccgcaggcccgagctgtaccctgctagaagaggccttcagaagatatcacggctatattttcggattctacaagtggcaccacgagccagctgagttccaggccaagacacaggtccaacagctgttagtgagcattacactgcagagcgagtgtgatgcattccctaatatatcaagtgacgagtcctacactctgctggtcaaagagccggttgctgtgcttaaggctaatcgtgtgtggggagctctacgcggtctagaaacattctcccaactggtgtaccaggactcctatgggaccttcacaattaacgaaagcacaatcatcgattcaccccggttctctcaccgcggaatacttatcgatacctccaggcattatctccctgtgaagattatcttaaaaactctggacgccatggccttcaacaagttcaacgtcctgcactggcacattgtggacgatcaaagtttcccatatcaatcaatcacgtttccagagctgagcaacaaggggagctactccctcagccacgtttacacccctaacgatgtcaggatggtgatcgaatacgcgagactgcgagggataagggtcctcccagagtttgacacccccgggcacactctatcttggggaaagggccagaaagacctgctcaccccgtgttacagcaggcaaaacaagctcgacagtttcggacctataaaccctacattgaataccacgtacagctttctgacaaccttttttaaggagataagcgaggtcttcccggatcagtttatccatttaggtggagatgaagtggaatttaagtgctgggagagcaaccccaaaatccaggattttatgcgccaaaaaggattcggcacagacttcaaaaaattggagagcttttacatccagaaggtgctcgacataattgcaacaattaataaaggctccatagtctggcaggaggtcttcgacgacaaggccaagctcgcccccgggaccatagtcgaggtatggaaagactctgcgtaccctgaggagctctcacgggtcacagccagtggatttcccgtgatcttgtccgctccgtggtacttagatcttatcagttatggccaggactggaggaaatactataaagtggaacctctggatttcggtggcactcagaagcaaaagcagttgtttattggcggagaggcctgtctgtggggggaatacgtggatgctacgaacctgaccccccgtctctggccgagagcctccgctgtgggcgagcgattatggtcttctaaagacgtgcgtgatatggatgatgcctacgatcgccttaccaggcacagatgtcggatggtcgagcgcggcatcgccgcccaaccgttatatgcagggtattgcaatcatgaaaatatgtag

SEQ ID NO: 119827 - DNA, 996 bp, Artificial Sequence
  Description of Artificial Sequence: Synthetic coding sequence
atggcatttaataagtttaacgttctgcattggcatatagttgacgaccaaagtttcccttaccagagcattacttttccggaactgtccaacaagggctcatatagtctcagccacgtctacactcccaatgacgtgagaatggtcatagaatacgccagactgcgggggattagagtgctgcccgagttcgacactcccggccacaccctctcgtggggaaagggacagaaagatctactgaccccctgttatagtcgacagaataaattagattccttcgggcccataaaccccactctgaacacaacgtacagtttcttaactacattctttaaagagatttccgaggttttcccagatcaattcattcatctgggcggagacgaggtcgaatttaagtgctgggaaagcaaccctaagatacaggactttatgcgacagaaaggctttggcactgacttcaaaaaactggaatccttttatatccagaaagtcctggacatcatcgctacgataaataaaggatcaattgtttggcaggaggtattcgatgataaagcaaagcttgccccagggactatcgttgaagtttggaaggacagcgcctaccccgaagagttgagcagagtaaccgcttcaggattccccgttattctgagcgccccgtggtacctcgacctgatctcctacggacaggactggcgaaaatactacaaggtggaacccctggactttggcgggactcagaagcaaaagcaactgttcatcggcggagaggcctgtctgtggggtgagtacgtggacgctaccaacctgactcccaggctatggccaagagcctctgctgtgggggaacgattgtggagctcaaaagatgtgagggatatggacgatgcgtacgacagactgacaaggcaccgctgcaggatggtggagagagggattgcagcccagcccctgtatgcaggatattgtaaccacgagaacatgtag

SEQ ID NO: 119828 - DNA, 2376 bp, Artificial Sequence
  Description of Artificial Sequence: Synthetic coding sequence
atgtggaacatgctgattgtcgcaatgtgtctcgctttactgggctgcctgcaggcccaagaactccaggggcacgtgagcattatcctgcttggagcaacaggcgacctggcgaaaaagtatttgtggcaaggcttgtttcagttatatctggacgaagccggcagggggcactctttttctttccacggtgctgccctgaccgcgcctaaacagggacaggagctgatggctaaggcactggagtcactgtcctgccctaaggacatggccccttcgcactgcgccgagcacaaagaccagttcctgcagctgagtcagtaccggcaactgaagaccgcagaagattatcaggccttaaacaaggatatcgaggcccagctgcagcacgcggggttaagagaagccggccggatcttttatttttcggtgcctcctttcgcgtatgaggacatcgcaagaaacatcaatagctcctgccggccaggcccaggagcttggcttagggtcgtcctggagaaaccttttggccacgatcacttctctgcccaacaacttgctaccgaactgggaactttctttcaagaagaagagatgtatcgggtcgaccattatctgggcaaacaggccgtggcccagattctcccttttcgcgaccagaatcgaaaggccttagatggactgtggaatagacaccatgtggaaagagtggagatcatcatgaaagaaacggtcgatgccgagggaaggacaagtttctatgaggaatacggcgtgattcgagatgtgctccagaaccatctaacagaagtactgacgctggtggccatggagctgccccacaatgtgtcctccgcagaagctgtgctgcgccacaaactgcaggtgttccaggcgctgcgggggttgcagcgaggctccgccgtcgtgggccagtaccaatcatactccgagcaagtgagacgggagctccaaaaaccagattccttccattccctgactccaacgtttgccgcagtgctcgtgcacatcgacaatcttcgctgggagggggtccctttcatcctgatgagtggtaaggccctggacgagcgggtgggttatgccagaatcctattcaagaaccaggcctgttgtgtgcagtccgaaaagcattgggcagccgcccaaagtcagtgcctccctcgccagctcgtgttccacataggccacggcgacctgggttcccccgctgttttagtgtctcgcaacctcttccgtccgtcactgcccagctcttggaaggaaatggagggaccacctgggctccgtctctttggctccccactcagcgactactacgcctatagccccgtaagagagagagatgctcatagcgtccttctgtctcacatctttcacggccgaaagaacttctttatcacaaccgagaaccttctcgcctcctggaacttttggaccccccttctggaatccctagcccacaaggcaccccgactgtacccgggaggagcagaaaatggacggctactggactttgagtttagcagcggccgcctgtttttttcgcagcagcaacccgagcagctggtgcctgggccgggaccagcacctatgccttcggacttccaggtactgcgagctaaataccgggagagtcccctggtgtccgcatggtccgaggagttgatcagcaaattagccaatgatatcgaggctactgccgtgcgggccgtaaggcgattcgggcagtttcacctggccctatctggggggagttctccagtggctcttttccagcagctcgccaccgcccactacggtttcccatgggcccacactcacctgtggctggtggatgaaaggtgtgtgccactgagcgatcctgaaagcaatttccagggcttgcaagcacacctactccagcatgtgcggattccttactacaacatccaccccatgccagttcatctccagcaacgtctgtgcgcagaggaggatcagggggcccagatctacgccagagagatctccgcactggtcgccaactctagctttgacctggtgctgcttggcatgggagccgatggccacaccgcctcactgtttcctcaaagccccactggcctagatggagagcaactcgtcgtcttgacaacctccccaagccaacctcacagacgcatgagtctgtctctcccgctgatcaacagagccaagaaggttgctgttctggttatggggcgcatgaaaagagaaatcacaacactggttagtagagtgggtcacgagccgaagaaatggcctattagcggcgtgctaccccacagcggtcagctggtctggtatatggactatgatgcttttctgggctag

SEQ ID NO: 119829 - DNA, 1968 bp, Artificial Sequence
  Description of Artificial Sequence: Synthetic coding sequence
atgggcagatgggcctgggtccccagcccatggccccctcccgggttaggtccttttctccttctactgttgctactcttgctcctcccacgagggtttcaacctcagcccggcggcaatagaaccgaatctcctgagcccaacgcgacagcgaccccggccatacccacgattctagtcacaagcgttacatccgagacccccgcaaccagcgcccccgaggccgagggtcctcagagcggcggcctccccccaccgcccagagcagttcctagcagttcgtccccacaggcgcaggcactgacagaagatggtcggccatgccggttcccattccggtacggagggcggatgctacacgcgtgtaccagcgaaggctccgctcatcgtaagtggtgtgcgaccactcataactatgatcgcgatcgcgcatgggggtattgtgtcgaggcaactcccccgcccggcggcccagccgcacttgacccctgcgcctctgggccatgtcttaatggagggtcttgctcaaatacacaggatccccagagctatcattgctcttgccctagggcgtttactgggaaagactgtggcaccgagaaatgcttcgacgagaccaggtacgagtatttggaaggtggcgaccgctgggcacgcgtgcgccaaggacacgtagagcagtgcgagtgttttggcggtcgtacctggtgcgagggaaccagacatacagcctgtctctcatcgccttgcctgaatggtggcacctgccacctgatcgtcgctacaggaacaacggtgtgtgcatgtccacctgggttcgctggtcgactctgtaacattgagccagacgaacgctgctttttgggaaatggaacaggatatagaggagttgcgtcgactagtgccagcggcctgtcttgtctggcctggaattcagatctgttgtatcaggagctgcatgtcgactctgtaggcgccgctgccttgctggggctggggccacatgcttattgtcgcaacccagacaacgatgagagaccttggtgttatgttgtgaaagacagtgcactgagttgggagtactgccggttggaggcctgcgagagcctgacaagggtgcagctctctcccgacttgctggccactctgccagaacccgctagtcctggcagacaggcctgcgggcggcggcacaagaagcgcacctttctgagaccccgaatcatcggcggaagcagctcccttcccggctcccacccctggctggccgcaatctacatcggggattctttttgcgcgggaagtctggtacatacatgctgggttgttagtgccgcccactgcttttcccactcccctccaagagattccgtgtctgtcgtattggggcaacatttcttcaatcgaaccacagacgtgacacagacattcggcattgagaaatatattccttatactctctattccgtctttaatccaagtgatcacgatctggtgttgatccgcctgaaaaaaaaaggcgaccggtgtgcaactaggagccaattcgttcagcccatatgtttgcccgaaccagggtctacatttcctgcggggcacaaatgtcaaattgcaggatggggacacctcgatgaaaacgtgagcggatacagtagcagtctccgcgaagccctagttcctttggttgccgatcacaaatgcagcagtcccgaagtgtacggagcggacataagcccaaacatgttgtgcgccggatacttcgattgcaaaagcgacgcctgccagggtgatagtggtggaccactggcatgcgagaaaaatggcgtggcctatctgtacggcattatctcttggggcgatgggtgtgggaggctccataagcccggagtttataccagggtcgctaactatgttgactggatcaacgatcggattagacccccgaggcggctcgtagccccaagctag

SEQ ID NO: 119830 - DNA, 3807 bp, Artificial Sequence
  Description of Artificial Sequence: Synthetic coding sequence
atgtcttccgtagccgtgcttacccaggaatctttcgctgaacatcgcagcgggctcgttccacaacagattaaggtggcaaccctcaactccgaagaagaaagtgaccctcctacatataaagatgccttccctccgttgcccgaaaaggcagcctgtctggagtctgctcaggaaccttctggcgcctggggaaacaaaatccgcccgataaaggcgtcagttattacccaggtttttcatgtccctcttgaggagaggaagtataaggatatgaatcagttcggggagggggaacaagctaagatctgccttgaaattatgcaaaggacaggcgctcacctcgagctttctctggccaaggaccagggcctgtccattatggtgagcgggaagttggacgccgtgatgaaagcacgaaaggacatcgttgcccgccttcaaacccaggcatcagcgacagtcgcaattccaaaagagcatcatagatttgtaatcggtaagaacggggagaaactgcaggacctggagttgaaaacagccacaaagatccagatcccacgtcccgacgatccttctaatcaaattaaaatcaccggaacaaaggagggcatagagaaagctcggcacgaggtactgctgatttctgctgagcaggacaaacgcgccgtagagcggttagaggtggaaaaggcttttcacccttttattgcagggccttacaaccgcttagtgggcgagatcatgcaggagaccgggacccgcattaacatcccaccccctagtgtgaatcgcacagaaatagttttcaccggtgagaaagagcagctcgcacaggccgtggccaggataaaaaaaatctacgaagagaaaaaaaaaaagaccactaccatcgcagtggaagtaaagaagtcccagcataagtacgtgattggacctaagggtaattctctgcaggagatacttgaacgaaccggggtgtctgtagaaattccccctagcgacagcatttctgaaaccgtcattttgcgaggcgaaccagagaagttgggccaggctctgacagaggtatacgctaaggctaattcattcactgtttctagtgtggcagcaccgtcttggttgcataggttcattatcgggaaaaaaggccagaacctcgccaagatcacacagcagatgccaaaagtacatatagagttcacagagggtgaagacaaaatcacactggagggccctaccgaggatgtgaacgtcgcccaagaacagattgaagggatggttaaggaccttatcaaccgtatggattacgttgagatcaacatcgatcataaattccaccgccaccttatcgggaagagtggagccaacattaatagaattaaggatcaatataaggtttccgtgcgcatccctcccgattctgagaagagtaatttgattcgtatcgaaggggacccccaaggagtccagcaggccaagcgcgagctcctagagctagcctcccgcatggagaatgagcgaacgaaggacctgattattgaacagcggtttcatcgcacaataataggtcagaagggagaaagaatccgggagatccgtgacaagtttcccgaagtgatcattaacttcccggatcccgcccagaaatccgacatagtccagctccgggggcctaagaatgaggtcgaaaaatgtaccaagtatatgcagaaaatggtcgccgatctggtagagaactcttactccatcagcgtcccaatctttaagcagttccacaagaatatcatcggaaaaggtggggctaatataaagaagatcagagaagaatctaacaccaagatcgacctgcccgcggagaactcaaatagcgaaactatcatcattaccgggaaaagagccaactgtgaagcagccaggtcccgcatcctgtctattcagaaggatctcgcgaatatcgcagaggtcgaggtgagcataccagctaaactccataacagcctcattggaacaaaaggccgcctgattagaagcataatggaagagtgcggcggtgtacacatccattttccagtggaaggttcaggcagcgacacagtggttatccgaggcccctcatccgacgtggagaaggccaagaagcagctgctccatctggctgaggagaaacagaccaagagtttcacggtcgatatcagagctaagcctgaatatcacaagtttttgatagggaaaggcgggggaaaaatcagaaaagtgagggactcaaccggtgctagggtcattttccctgccgcagaagacaaggatcaagacctaataactattatcgggaaggaagatgccgtgagggaagctcagaaggagctcgaagccctgatacagaacctcgataatgtcgtagaggactccatgctcgtcgatcccaaacaccaccgccatttcgtaattcggagaggtcaggtgctgcgcgaaatcgccgaagagtacggaggcgttatggtgagttttccgcggagcggcacacagtccgacaaagttacgctgaagggagctaaagactgcgtggaagccgctaagaagcgaatacaggaaatcattgaggatctggaggcacaggtgactctggaatgcgcaatcccccagaagtttcaccggtctgtaatggggcccaagggatctaggattcagcagatcacgagggattttagtgttcagatcaagttccctgaccgcgaagagaacgctgtccatagcactgagccggtggttcaagagaacggcgatgaggccggcgaaggaagggaggctaaagactgtgatcctggctccccacgccgctgcgacattatcattatctccgggaggaaggagaagtgtgaggccgccaaggaggccctggaagcccttgttccagtcactatagaggtggaggtcccatttgacttgcatcgatatgtaattggacaaaagggaagtggaatcaggaagatgatggatgagttcgaagtcaacatccacgttccggctccagaattacagtcagatattattgccattaccgggctggctgctaatctggaccgcgctaaagcaggattgcttgaacgggtgaaggagttacaggccgagcaagaagaccgtgctcttcgctcctttaagctctccgtgaccgtagaccccaagtatcatccaaaaatcatcggacgtaagggagccgtcataacccagatccgactggaacacgacgtgaatatccagttcccagataaggatgatggaaaccagcctcaagatcagatcactatcacgggatatgagaagaacaccgaggccgcccgtgacgccatactgcgcatcgtgggcgagctcgagcaaatggttagcgaggacgtaccactggaccaccgagtacatgcccgcatcattggagcccgggggaaggcgatccgcaaaattatggacgagtttaaggtagatatccgctttcctcagtcaggcgcgccagatccaaattgcgttactgtcaccggactccctgagaacgtcgaagaggccattgaccacatcctgaatttagaggaagaatatttggctgatgtcgttgacagtgaagccctgcaagtgtatatgaagccacccgcccacgaagaagcgaaagcaccttctcggggttttgtggtgagagacgcaccttggactgcttcctctagtgagaaggctccggacatgtccagctccgaggagttccctagctttggcgcacaggtcgcccccaaaactctgccctggggaccgaaaaggtag

SEQ ID NO: 119831 - DNA, 3807 bp, Artificial Sequence
  Description of Artificial Sequence: Synthetic coding sequence
atgagctccgtggccgtcctgacccaggaaagcttcgccgaacaccgtagtgggttggttcctcagcagattaaagtcgccactctgaactcggaggaagaaagcgacccccctacttataaggatgccttccccccccttccggaaaaagctgcatgcctggaatcggctcaggaaccaagtggagcctggggaaacaaaatcaggcctattaaagcatctgtcatcacccaggtttttcatgtccccctagaagagcggaaatacaaggacatgaatcagtttggagagggagagcaggctaaaatctgcttagaaattatgcagcggacgggagctcatctagagctctccttagcaaaagaccaagggctgtccatcatggtaagcgggaaattggacgccgtcatgaaggctcggaaggacattgtggcccggctgcagacacaggctagcgcgactgtcgctatcccaaaggaacaccatcgctttgtgattggtaagaatggtgagaagctacaggaccttgaactgaaaactgctaccaagattcagatccccaggcctgatgatccgagcaaccagatcaagataactggaacgaaggaagggattgaaaaggcaagacacgaagttcttctaatttccgccgagcaagacaaacgagcggtggagcggttggaagtggaaaaggccttccatcctttcatcgccggcccttataaccgcctcgtgggagaaatcatgcaagaaacaggcacccggataaatatacctcctccttccgtcaacaggaccgagatcgtctttacaggcgaaaaggagcagttggcccaggcggttgcaaggattaaaaagatttatgaagagaaaaaaaaaaagacaactaccattgccgtggaagtcaagaagtctcaacacaaatatgtaatcggcccaaagggcaactcattgcaggaaatcctggaacggacgggcgtatccgtggaaattccaccctctgacagcatttctgagactgtaatcttgcgcggggagcctgaaaagctcggacaagctctgacagaagtttacgcaaaagcgaatagcttcacagtgagctccgtggccgccccctcatggctgcaccgatttattataggcaaaaagggacagaacctggcgaagatcacgcagcagatgccaaaggtgcacatagagttcacggagggggaggataaaatcacgctggaggggcccacagaggacgttaatgtggcccaggagcaaattgaagggatggttaaggacttgattaacagaatggattacgtggagataaacatcgaccacaagttccacagacacttaattggaaagtcaggcgcgaatattaaccggatcaaagaccagtataaggtcagcgtcagaattcctcctgacagtgagaagagcaacctgattagaatagaaggggacccccagggggtacaacaggccaagcgtgagctcctggaactggccagcagaatggaaaatgagcgcaccaaggatctcatcatagagcaacggttccacaggaccattatcggtcaaaaaggagaacggatccgggagatacgagacaagttccccgaagtaataatcaatttcccggacccggcccaaaaatctgatattgtacaactccgcgggccgaagaacgaggtggagaagtgcactaaatacatgcaaaaaatggtagctgatctcgtggaaaattcatactctatctctgtcccgatctttaaacagttccacaagaacataataggtaagggcggcgctaacataaaaaagattcgggaggagagcaatacaaaaatcgacctgcccgccgagaactccaatagcgaaaccatcatcataaccggcaagcgcgcaaactgtgaggccgcaagatcacgcatcctgagcatccagaaagacctcgctaacatcgctgaggtcgaagtgagcatccccgctaagttgcataatagtttaattggcactaaagggaggctcattcgctctataatggaagaatgcggcggtgtccacattcattttcctgttgagggttccggaagtgataccgtcgtgattcgtggtccctcctctgatgtcgaaaaagccaagaagcagctgctccaccttgctgaggaaaagcagactaagagctttactgtggacatcagagcaaagcccgagtatcataaatttcttatcggcaaggggggagggaagataagaaaagtgagagactccactggagcccgcgtgatatttccagctgccgaggacaaggatcaggacctgatcactatcattggcaaggaagatgcagtgcgcgaagcccagaaggagctagaggccctcatacagaatctggataatgtggtggaagattcgatgctggtggatcccaagcatcaccgccatttcgttattcgacgaggccaagtcttgcgagagatagctgaggaatatggcggcgtcatggtgtcgttccctaggagtgggacacagtccgataaagtaacgctgaaaggcgccaaggactgtgtggaggccgccaaaaaacggatacaagagatcattgaggatctggaagcgcaggtcactctggagtgcgccatcccccaaaaatttcaccgttctgtaatgggccccaagggatccaggattcaacagatcacacgcgacttcagcgttcagattaaattccctgatcgcgaagaaaacgccgtacacagcacggagcccgtagtgcaggagaatggggacgaggccggagaaggcagggaagctaaagattgcgatcccggaagcccacgaaggtgtgacattattattatatctggcagaaaagaaaagtgcgaagccgccaaagaggccctcgaggctctcgtccccgtcactatcgaagttgaagtaccttttgatctccaccggtacgttattggacagaaaggcagtgggattcgtaagatgatggatgagttcgaggtaaatatacacgtccctgcccctgagctgcaaagtgatataatcgcaataacaggcctggcggctaatctggatcgtgctaaagccggcctgctggaacgagtgaaggagctgcaggccgaacaggaagaccgggctctccggtcttttaagctttctgtgactgtggatcccaagtatcaccctaaaattatcggccggaagggggcagtgatcacacagatcagactcgagcacgacgtgaatatccaatttcctgacaaggatgacgggaaccagccccaggaccagataacaattacaggatacgaaaaaaatacagaagcggccagagatgcaattctaaggattgtgggcgaactggagcagatggtctcagaagatgtacctttggaccaccgggtgcatgcccgaattattggcgcgagggggaaagccattcgcaaaatcatggatgaattcaaggtggacatcaggtttccgcagtctggagcgccggaccccaattgcgttacagtaactggattacctgaaaatgtggaggaagctattgaccacatcttgaacctcgaggaggagtacttggccgacgttgtggacagtgaggccctccaggtctatatgaagccacctgcccatgaggaagccaaagcaccctccagagggttcgtcgtccgcgatgcaccctggacagcgtcaagcagtgagaaagcaccagatatgtcttctagtgaagaattcccatcttttggggcacaggtcgctcccaagaccctgccatggggacctaagaggtag

SEQ ID NO: 119832 - DNA, 3807 bp, Artificial Sequence
  Description of Artificial Sequence: Synthetic coding sequence
atgtctagcgttgccgttctgactcaagagtcctttgcagagcacaggtccgggctcgtgccccagcaaattaaggtggcaaccctgaacagcgaggaggaatctgaccctcccacctataaagatgcatttcccccccttcccgagaaggctgcatgtctggaaagtgcccaggaaccttctggtgcttggggaaacaaaatcagaccaattaaggcgagcgttataacacaggtgtttcacgttcctctcgaggagcggaagtacaaagatatgaaccagtttggggagggcgaacaggcaaaaatctgcctggagattatgcagcgcacgggcgcccacctcgaactgtcactggcaaaagatcagggcctgtcgataatggtgagcggtaagttagacgccgtgatgaaagctcggaaggacatcgtggcccggttgcagacccaggcttcagccactgtcgctatcccaaaagaacaccacagatttgtcataggaaaaaatggcgagaagttacaggatctcgaactcaagacagcgacaaagatccaaattccccggccagatgatccgtccaaccaaattaaaataactggcaccaaggaagggatcgagaaagcacggcacgaagtgctgctgatatcggctgagcaggataaacgcgcagtggagaggcttgaagtggagaaggcctttcaccctttcatagccggaccatacaatcggctagtcggagaaatcatgcaggagaccggaacgcggattaacatcccccctcccagtgtcaacagaactgagatcgtctttaccggggaaaaggagcagctcgcacaggctgtggctaggataaaaaagatatatgaggagaaaaaaaagaagaccacgacaattgccgtggaagtgaagaagagccagcacaagtatgtcatcggtcctaaaggaaatagcctccaggagattctcgagcgcacaggggtctcagtggaaatcccacctagtgactctataagcgaaacagtgattctgcggggagaacccgaaaaattgggtcaggcactgaccgaggtctatgccaaagcaaacagcttcacagtttcttctgtggctgcccccagttggctccacaggttcattatagggaagaaaggccagaatctcgccaagattacacaacagatgccaaaagtgcacatagagttcactgaaggcgaagacaagatcactctggagggaccaacagaagacgtaaacgttgcgcaggagcagatcgagggcatggtcaaagatctgatcaatcggatggactacgtcgagattaatatcgatcacaagtttcaccgccacctgataggcaaatcaggcgcaaacatcaaccgtattaaagaccagtacaaggtgtcagtgcggatacctccggactcagagaagagtaatctcatccggatagaaggagacccgcagggcgtgcagcaggccaaacgagagctcctggaattagcctcgagaatggagaatgaacgaacgaaggacctgattatcgagcagcggttccaccgaaccataatcggacaaaagggcgagagaatcagggagattagggataaatttccagaggtgatcataaacttccccgatcccgctcagaagagcgatattgtccagctgcgaggccctaaaaatgaagtggaaaagtgcactaagtacatgcagaagatggtggccgacctagtcgagaactcttattctatctctgtgccaattttcaaacagttccacaagaatatcattgggaaggggggagccaacatcaaaaagatacgcgaagagagtaacaccaagatagaccttcccgccgaaaatagcaacagtgaaacgataatcattacggggaagagagccaactgtgaagccgcccggtcccggattctatccatccagaaggatcttgcaaatatcgccgaagtggaagtctctatcccagctaagctccataactcgctgataggaacgaaaggccggcttattcgcagtattatggaggaatgcgggggcgtccatatccacttccctgttgagggaagtggctccgacaccgttgttatccgagggccaagttcagacgtcgagaaggccaagaagcagcttctccacctggcagaggagaagcaaaccaagtcatttacagtggacattcgagccaaaccggaatatcacaaatttctcatcggaaagggcggtggaaagatccgaaaggtgagggattccactggcgcccgggttatcttcccagcagctgaggacaaagatcaggatctgattactatcattggtaaagaggatgcagtgagagaagcccagaaggagcttgaagctttaatccagaatctggataacgtggtggaggattcaatgctcgtggaccccaaacatcacagacactttgtaataagaagaggccaggtgctgcgcgagattgctgaagagtacggcggagtgatggtttcttttcctaggtctggaacgcaatccgataaagtgactttgaagggcgcgaaagattgcgttgaggccgctaagaagagaatacaagagatcatagaggacctcgaggcacaggtgactctggaatgcgcaatcccacagaaattccatcgaagtgttatgggtcccaaaggatcgaggatccaacagatcactcgggactttagcgtccagattaagttcccagatcgcgaagagaatgcagtacactcaactgaaccagtggtgcaggagaacggagacgaggcgggtgaggggcgcgaagcaaaggattgcgacccagggtctcctcgccgatgtgatataattatcatcagcgggagaaaggaaaaatgtgaggctgctaaggaggctctggaggcactggtgcctgtgacaattgaagtagaagttccattcgatctgcacaggtacgtcataggacaaaaagggtctggaatcagaaaaatgatggatgagttcgaagtcaatattcatgtccctgctccagagctgcagtcggacatcattgccattactggcctcgccgcaaacttggatcgtgccaaggccggacttctggagcgggtcaaggagcttcaggccgaacaggaggaccgggccctgagatccttcaagctatccgtgaccgtcgacccaaagtatcacccaaagataataggtcgaaagggggccgtgattacacagattcgcctcgagcacgacgtgaacatccagtttcctgacaaggacgatggtaaccagccccaggatcagatcactatcactggttatgagaaaaacaccgaggcagcacgggacgcaatactacggattgtgggcgagctggagcaaatggtctcagaagacgtccccttagaccacagggtgcacgcgcgcatcattggagctcgaggaaaggccatcaggaaaattatggatgaatttaaagtagatattcggttcccccagagcggtgctccggacccgaactgtgtcaccgttaccgggctgcctgagaacgtggaagaggccatagaccacatcttgaacctggaagaagaataccttgccgacgttgtggattcagaggcactgcaggtatatatgaaacctcccgctcacgaagaggctaaggccccgtctcgcggattcgtggtccgcgacgcaccctggaccgccagctcctctgaaaaagccccagacatgtcttccagcgaggagttcccatcattcggcgcccaggtcgctccgaaaaccctcccctggggtccgaagaggtag

SEQ ID NO: 119833 - DNA, 249 bp, Artificial Sequence
  Description of Artificial Sequence: Synthetic coding sequence
atgagttctgtggctgtgttgactcaagagtcatttgccgaacacagaagcggactggtgccccagcagatcaaagtagctactttaaattccgaagaggaaagtgacccaccaacctacaaggatgccttcccccctttgcccgagaaggccgcctgcctggagtctgcgcaggaaccttctggcgcctggggaaataagattcggccgataaaggcaagcgtaatcacccaggtcttccatgtttag

SEQ ID NO: 119834 - DNA, 45 bp, Artificial Sequence
  Description of Artificial Sequence: Synthetic coding sequence
atgtcctcagtggctgttctcacccaggagtccttcgccgaatag

SEQ ID NO: 119835 - DNA, 210 bp, Artificial Sequence
  Description of Artificial Sequence: Synthetic coding sequence
atgagcagcgttgcggtcttaacccaggagtcatttgctgagcaccgttctggcctggtgccccagcaaatcaaggtagcaacactcaatagtgaagaagaaagtgaccctccaacatacaaggatgcctttccccctctgccggaaaaagctgcatgcctggagtcagcacaagagccctcaggcgcatggggaaataagatcagatag

SEQ ID NO: 119836 - DNA, 165 bp, Artificial Sequence
  Description of Artificial Sequence: Synthetic coding sequence
atgagttctgtcgcggtgctcactcaggagtcttttgccgagcataggtcaggactggtgcctcagcagattaaggtggcaaccctgaacagcgaggaagagagtgaccctcctacttataaggatgcattcccgccgcttcccgagaaggcggcgtgcttgtag

SEQ ID NO: 119837 - DNA, 675 bp, Artificial Sequence
  Description of Artificial Sequence: Synthetic coding sequence
atgagcagtgtggctgtactgacgcaggagagcttcgccgaacaccgcagcggtcttgttccccagcagatcaaggtggctaccctcaatagcgaggaggaatcagacccccctacgtacaaggacgcattccctcccctgcctgagaaggccgcctgcctggaaagcgcccaggagccaagcggagcctggggcaacaagatcaggcctattaaggctagcgtcatcacacaagtatttcatgtcccactggaagaacggaaatacaaagatatgaaccagttcggagagggggaacaggctaagatttgtctggagatcatgcagcgaactggagcccatctcgaactgagcctggcaaaagatcagggactctctatcatggtgtccggaaagctggatgctgttatgaaagccagaaaagacatcgttgctagattacaaacacaagcgtccgcgactgtagcaatcccgaaagaacaccaccgatttgtaatcgggaagaacggagaaaaattgcaggacctagaattgaagactgctaccaagatacagatccctcgcccggatgacccatcaaatcagatcaagataactggcaccaaagaaggcatcgagaaagcgcgccacgaggtccttctcattagtgcagagcaagacaaacgcgccgtttag

SEQ ID NO: 119838 - DNA, 246 bp, Artificial Sequence
  Description of Artificial Sequence: Synthetic coding sequence
atgagctctgtggcggtgctgacccaggagagcttcgccgaacacagatccggtttagtgccgcagcagatcaaagtggcaacactgaattcggaggaagagtcagatccccctacctacaaagacgcctttccgccactgccggagaaagcagcatgcttggagagcgcccaagagccatcgggcgcttggggcaacaaaataaggcctattaaggcctccgtgataactcaggtctttcattag

SEQ ID NO: 119839 - DNA, 240 bp, Artificial Sequence
  Description of Artificial Sequence: Synthetic coding sequence
atgagttcagttgccgtcctcactcaggaaagcttcgcagaacatagatccggtctggtacctcagcaaatcaaggtcgccacccttaattccgaagaagagtccgacccccccacttacaaggacgccttcccacctttgcctgaaaaagcggcatgtctggagagcgcccaagagcccagcggggcttggggaaataaaatccgaccaatcaaggcttccgtcatcacacaggtctag

SEQ ID NO: 119840 - DNA, 291 bp, Artificial Sequence
  Description of Artificial Sequence: Synthetic coding sequence
atgtcgtcagttgcggtgctgacacaagaaagtttcgctgagcatagatccgggctggtcccacagcagatcaaagtggcaaccctcaacagcgaggaagaatccgaccctcccacctataaagatgcctttcctccgctaccagagaaggctgcatgtctcgaatccgctcaggagccgagcggggcctggggcaacaaaatcaggccaatcaaagcttccgtgatcacacaggtcttccatgtccccctcgaggagcggaaatacaaggacatgaaccagttcggttag

SEQ ID NO: 119841 - DNA, 60 bp, Artificial Sequence
  Description of Artificial Sequence: Synthetic coding sequence
atgagctctgtcgcagtcctgacacaagaatcctttgccgagcaccgctctgggttatag

SEQ ID NO: 119842 - DNA, 3708 bp, Artificial Sequence
  Description of Artificial Sequence: Synthetic coding sequence
atgcacttagctgagagggatcggtggttgttcgtggctacagtgatgatgcacttcgtgagcatcaagagcggttttccagggctctgcgtgggcgttcgcagcacaatgagttccgtggcagtgttgacccaggagtcctttgccgaacataggtccggtctagttccccagcagattaaagttgcaacgctgaattccgaagaagagtcagatccccccacatacaaggacgccttcccaccattgcccgagaaggcagcatgcctggagtcagctcaggaaccatcaggagcatggggtaacaagatccgtcctattaaagcctctgtgatcacgcaagtatttcatgtgccgctcgaagagaggaagtacaaggacatgaaccagtttggggagggcgagcaggccaagatctgtctggaaattatgcagagaacaggagcgcatctggaattgagtctggccaaggatcaggggctctccattatggtgagtggcaaactcgacgccgtcatgaaggcacggaaggacattgttgctcgccttcaaacccaggcctccgccacggtggcgatccctaaggagcaccaccgcttcgtgattggcaagaatggagaaaagcttcaggacttggaacttaagacggctacgaagattcagatcccaaggcctgacgacccatccaatcaaatcaagatcaccggaacaaaggagggcatcgagaaagctcgtcatgaggtactattgatcagcgcggagcaggacaagcgcgccgtagagagactcgaggtggaaaaggctttccatcccttcattgcgggaccctataaccgtttggtcggtgagattatgcaggaaactgggacgcggatcaacattccccctccatccgtgaaccgcaccgagattgtgtttaccggagagaaggagcaactggctcaggccgttgcacgtattaagaaaatatacgaagagaaggccaattcgttcacagtatccagcgtcgcagctccctcttggctccacaggttcattattgggaaaaaaggccagaacctcgcgaagatcacacagcagatgccgaaggtgcacatcgaatttactgaaggcgaggacaaaattacgctggagggtccaactgaggatgttaacgtagcccaagaacagattgaagggatggtgaaggatctgattaatagaatggattatgtcgagatcaatattgaccacaagttccaccggcacctgataggcaaaagcggggcaaatataaataggattaaagaccagtataaggttagcgttagaatccccccagactccgaaaagtccaacttaataagaatcgaaggggacccccagggagtgcaacaggctaagcgcgaactgctagagctggcctcccggatggagaatgaaaggaccaaagacctaatcattgagcagaggttccaccgaacgatcattggacagaaaggagagcgtatcagggaaatacgagataaattccccgaggtgattataaattttccggaccccgcacagaagagtgatattgtgcagctgaggggcccgaagaacgaagtcgagaaatgtacgaaatacatgcaaaagatggtggctgatttggtggaaaactcgtattccatcagcgtgcctatcttcaagcagttccataaaaatatcattgggaaggggggagccaatattaagaagattcgcgaggaaagtaacacaaagattgacttaccagccgaaaactctaattcagagaccatcattattaccggcaaaagggccaattgtgaagccgcccgcagcagaatactctccatccagaaggacctagctaatatcgcagaggtagaagtaagtattccagcaaaactccacaattcgctgatcggaactaaggggcgcctgattagatccattatggaggagtgtggtggagtgcacattcattttcctgtcgagggatctggaagcgatacagtggtgatccggggtccctcttcagacgttgagaaggctaaaaagcagctccttcacttagctgaggagaagcagacaaaatccttcactgttgacatccgggcaaagccagaatatcataagttcctcatcggcaaaggcggaggaaaaataagaaaggtgcgtgacagcactggcgccagggtgatctttcctgccgctgaggacaaagaccaggacctgattaccatcatcggtaaggaggacgcagtccgggaggcccagaaagaattggaagccctaatacagaacctcgacaatgttgtcgaggattccatgctggtagacccgaagcaccatcgccattttgtcattcgtcggggacaagtgttgagggagatcgccgaggagtatggcggagtgatggttagtttcccccgcagcggcactcagagcgataaggtcacactgaaaggggctaaggattgcgtggaagccgctaagaaaagaatacaggaaataattgaagatttggaggctcaagtgaccctggagtgcgcaattccccaaaagtttcataggtccgtgatgggccccaagggtagtaggatacagcagattactcgggacttctccgtccagatcaagttccctgaccgggaagagaatgcggtgcactctactgagccggttgtccaggagaacggcgatgaggcaggcgagggccgcgaagccaaagattgcgaccctggcagccctcgacggtgtgacataattataataagcggcaggaaggagaaatgtgaggctgcaaaggaggctctcgaggcacttgtacccgtgaccattgaggtggaggtgcccttcgatctgcacagatacgtgattggccagaagggcagcgggataagaaaaatgatggatgagttcgaggtgaatattcacgtccctgcgccggagctacagtccgatatcatcgccatcactggactggcagccaacctggatagagcaaaggccgggctgctcgaacgagtgaaagagttgcaagcagagcaggaggaccgggctctccggtcatttaaactttccgtgaccgtcgacccaaaataccatcctaaaataataggccggaaaggcgctgtgatcacccagattaggctcgagcatgatgtcaatatccagtttcccgataaggatgatggaaaccagcctcaggatcaaattactattaccggctacgaaaagaacacggaagcggcaagagatgcgattcttaggatagtgggggagctggagcagatggtgagcgaggacgtcccactggaccacagagtgcacgcccgcatcatcggtgccaggggaaaagctattcgtaagatcatggatgaatttaaggtggatattaggttcccccaatctggcgcgccagatcccaattgtgtgacagtgaccggtctgcctgagaatgtggaagaagccattgaccacattctcaatctcgaggaagagtacctcgctgatgtagtcgactcagaggcacttcaggtctacatgaaacccccagcacacgaggaggccaaggccccatcacgtggattcgtagtgcgggatgccccctggactgcgagtagcagtgagaaggcgcccgatatgagtagttcagaggagttcccttcttttggcgcccaggtggcccccaagacactgccttggggaccaaagcgctag

SEQ ID NO: 119843 - DNA, 666 bp, Artificial Sequence
  Description of Artificial Sequence: Synthetic coding sequence
atgagtagtgtagctgtgctgactcaggagagctttgctgaacacagaagcggattggtgcctcaacagatcaaagtcgcaactctaaattccgaggaagagtccgacccccctacctataaggatgcattcccgccactcccagaaaaggctgcttgcctggagtccgcccaggagcctagcggcgcttgggggaacaaaattagaccgatcaaagccagcgtgatcactcaggtttttcatgttcctcttgaggagcgcaagtacaaagatatgaaccagttcggggaaggggagcaagccaaaatatgcttggagattatgcagcggacaggagctcatttggaattaagtctcgctaaagaccagggcctctccattatggttagtggcaaactcgacgcggtcatgaaagcacgcaaggatatcgtcgcccggctgcaaactcaggctagcgccactgtggccattcccaaagagcaccacaggtttgtcatcgggaagaacggcgagaagctgcaggatctggagctgaaaactgcaacaaagatccagatccctcgacctgatgatccaagtaaccagatcaaaatcacaggaactaaagagggcattgagaaggcccgccacgaagtcctcttgatcagtgcagaacaagacaaatag

SEQ ID NO: 119844 - DNA, 426 bp, Artificial Sequence
  Description of Artificial Sequence: Synthetic coding sequence
atgtcttcggtcgctgtcctgacacaggagtcatttgcagaacacagaagcggactggtgccccaacagattaaagtcgctacacttaactctgaagaagaatctgatcctcccacctacaaagacgcatttcctcccctgccagaaaaggctgcttgcctggagtctgctcaggaacccagtggggcgtggggcaacaaaattaggcccattaaggcttctgtgatcacacaggttttccacgtgcccttggaggagcgcaaatacaaggacatgaatcagtttggcgaaggggaacaggccaagatatgtctggaaatcatgcaaaggacaggtgcccatcttgagctgtccctggcaaaagaccagggcctctcgattatggtgtctggtaaattggatgcggttatgaaggcaaggaagtag

SEQ ID NO: 119845 - DNA, 381 bp, Artificial Sequence
  Description of Artificial Sequence: Synthetic coding sequence
atgagttctgtggctgtcctcacacaggaatccttcgcagagcaccgatctggactggttcctcagcagattaaagtcgctacgctgaactcagaagaggaaagcgaccctcctacatataaggatgcattccccccgcttccagaaaaagccgcgtgcttagagtcagctcaagaaccctcgggcgcctggggcaataagatccgaccaatcaaggcaagtgtcatcacacaggtgttccacgtgcccctcgaggagagaaagtacaaagacatgaatcagtttggcgagggagagcaggcaaaaatctgtctggaaatcatgcagcgaaccggagcccacctcgaactgagcctggccaaggatcagggcctgagctag

SEQ ID NO: 119846 - DNA, 444 bp, Artificial Sequence
  Description of Artificial Sequence: Synthetic coding sequence
atgtcatcggtggccgtgttgacgcaagaaagctttgccgaacacaggtccgggctggtccctcagcaaatcaaagtggccaccctgaatagtgaggaggagtctgatccccctacctataaagatgcgttccctccactccccgagaaggccgcgtgtttagaatccgcccaggagccttcaggggcatggggaaacaaaatccggcccattaaggcctcagtcattacgcaggtgttccacgtgcccctggaggaacgaaaatacaaggacatgaaccagtttggggagggggagcaagccaaaatatgcctcgagatcatgcaaagaactggcgcacatctggaattgtccctcgctaaggatcaaggactgtcgatcatggtgtccgggaagctggatgccgttatgaaagctcggaaggatatcgtcgctaggctgtag

SEQ ID NO: 119847 - DNA, 54 bp, Artificial Sequence
  Description of Artificial Sequence: Synthetic coding sequence
atgtccagcgtggctgtcctgacccaggagtctttcgccgaacacagatcctag

SEQ ID NO: 119848 - DNA, 495 bp, Artificial Sequence
  Description of Artificial Sequence: Synthetic coding sequence
atgagctcagttgcagtgttaactcaggagtcctttgccgaacatcgctcaggtctagtgcctcagcaaattaaggtggccactctgaactctgaggaggagtccgatcctcccacgtacaaagatgcatttccccccctgccggagaaagccgcttgcctcgagtctgcccaggaaccgagcggggcctggggaaataagattcgccctataaaagcgtctgtgatcacgcaggttttccatgtccctctggaggagcgcaagtacaaagatatgaaccagtttggagaaggagagcaggccaaaatatgtctcgaaatcatgcagcggactggagctcacctcgaactttctctggctaaggatcagggcctgagcatcatggtgtcagggaagctggacgcagttatgaaggcaagaaaagatatcgttgccaggctgcagacacaggcgtctgcaactgtagcaatcccaaaagagcaccatcggttttag

SEQ ID NO: 119849 - DNA, 144 bp, Artificial Sequence
  Description of Artificial Sequence: Synthetic coding sequence
atgtcttcggttgctgtgctcacccaggaaagtttcgccgagcatcggtctggtctggtcccccagcagattaaagtcgctacactcaattccgaagaggagtctgatccccccacctataaggatgcctttcccccactatag

SEQ ID NO: 119850 - DNA, 1044 bp, Artificial Sequence
  Description of Artificial Sequence: Synthetic coding sequence
atggagaatctgatgactagtagcacactgccgccgctgtttgcagacgaggacgggtccaaagagtctaatgacctcgccaccaccggactgaaccaccctgaagttccttacagttccggcgctacgtcgtccacaaacaatccagagttcgtagaggacctgtctcaggggcagctgctgcaatccgaaagttcgaacgcggctgagggaaacgagcagcgccatgaagacgagcagcgttcaaagaggggcggatggtccaaaggacggaaacggaagaaacctctccgagacagcaatgctcctaagagcccattgaccgggtacgtacgcttcatgaatgagcgtagggaacagctcagagctaagcgcccggaggtgcctttccccgagatcactcggatgttagggaatgagtggagcaaattacctcctgaagaaaaacagaggtaccttgacgaggctgacagggataaggagaggtacatgaaggaattggaacagtaccagaaaactgaggcctataaagtctttagtcgaaaaacacaagatcgtcagaaagggaagagccacaggcaagacgctgctcgccaggcgactcatgaccacgagaaggagaccgaggtaaaagagcggtccgtgttcgacatccccatctttaccgaggaatttctgaaccatagcaaagcaagggaggcggagctcaggcagctgagaaaaagcaatatggagttcgaggaaaggaacgccgctctacagaagcacgtagaatccatgcgcacagccgttgagaagctagaggtcgacgtcatacaagagcggtctagaaacacggtgctgcaacagcaccttgagactctccgacaagtccttacctcatcctttgcatccatgcccctccctgggagcggggagacccctacggtagatactatcgactcctacatgaacaggctgcactcaatcatcctcgccaatccacaggacaatgaaaacttcatcgccacagtcagagaagtggtgaatcgtctcgatcgctag

SEQ ID NO: 119851 - DNA, 1044 bp, Artificial Sequence
  Description of Artificial Sequence: Synthetic coding sequence
atggagaatctgatgactagttctaccctcccccctctgtttgcagacgaggatggctccaaagagagcaatgacttagccaccactgggctcaaccaccccgaagtgccatacagttcaggagctacatcctctacgaataaccctgagttcgttgaagatttgagccagggccagctgctgcagagcgagagtagtaacgccgcagaaggaaatgagcagcgacacgaagatgagcagaggtccaagagaggaggctggtcaaaagggcgcaagcgaaaaaagcccctgagggatagtaacgctccaaagtcacctctgacaggttacgtgaggttcatgaatgagagaagggagcagctccgagctaaacgtcccgaggttccatttccggaaattacaaggatgctcggtaatgaatggtcaaagctaccacccgaggagaaacagaggtacttagatgaagccgatagggacaaggaacgctacatgaaagaactcgagcagtaccagaagaccgaagcctataaggtgttctcgcgcaagactcaggacaggcagaaagggaagtcccatagacaagacgccgccagacaggctacgcacgaccatgagaaggagactgaggtgaaggagcgtagcgtttttgatatcccgatcttcacagaagaatttctcaaccatagcaaagctagagaggccgaactccgacaactgagaaagtctaacatggagttcgaggaacgcaatgccgcactgcaaaagcacgttgaaagcatgcgaaccgctgtagaaaagttagaggtagacgtcatccaggagcgctctcggaacaccgtgctgcagcaacacctcgaaaccctgcgacaagtcctcacatccagtttcgccagcatgcccctaccaggttcaggggagacacccacggtcgacactattgattcctatatgaatagactgcattctataatcctggctaacccacaggataatgaaaactttatcgcgacggtacgagaggtggtgaacagacttgacaggtag

SEQ ID NO: 119852 - DNA, 471 bp, Artificial Sequence
  Description of Artificial Sequence: Synthetic coding sequence
atggagaatctgatgacaagttcaaccctgcctccgctgttcgctgatgaagacggatctaaagaatctaacgacctcgcgactacaggcctcaaccacccggaggtgccttacagtagtggagccacctcctctaccaacaaccctgaatttgtggaggacctgagtcagggccagctgctccagtccgagtcttccaatgctgcagaaggtaacgaacagcggcacgaagatgagcagaggtcaaaacgaggcggatggtcaaaaggccgcaaaaggaaaaagccactgcgtgatagcaatgcccctaagagcccgctcacgggttatgtgaggtttatgaacgagcggcgagagcagctccgggccaagagacctgaagtcccatttccagaaataaccagaatgctgggaaacgagtggagtaagctgccgcccgaagagaaacagaggtaccttgacgaagcgtag

SEQ ID NO: 119853 - DNA, 303 bp, Artificial Sequence
  Description of Artificial Sequence: Synthetic coding sequence
atggagaacctgatgacctctagtaccctgccccccttattcgctgacgaggacgggtccaaagagagcaatgatctggccaccactggcttgaaccatcctgaggtcccctactctagcggtgccacaagctccaccaataaccctgaattcgtggaagacctatcccaaggccagctgctacagtcggagtccagcaatgccgctgaggggaacgaacagcggcacgaggatgagcaaagatcaaaacgtggaggctggtccaaagggagaaaacggaagaagccccttagagacagctag

SEQ ID NO: 119854 - DNA, 489 bp, Artificial Sequence
  Description of Artificial Sequence: Synthetic coding sequence
atggagaacctgatgacatcgtccactctcccacctttatttgccgacgaagacggcagtaaagagtccaacgacttggctaccacagggctcaatcaccctgaagtgccatacagtagcggtgctacaagttctaccaacaacccagaattcgtcgaggatcttagccagggccaactgctgcagagcgagagctcaaatgccgcagaaggcaacgaacagcggcacgaagatgagcagcggagcaaacgcggtggttggtcgaaagggagaaagcgcaagaaacctctgcgtgactctaatgcaccaaagtcccctctaaccgggtatgtgcgattcatgaacgagaggagggagcagttgagggccaagagacccgaggtccctttccccgagataactcgcatgttgggaaacgagtggtctaaattgccacctgaagagaaacagcgctatcttgatgaagcagacagggacaaggaaaggtag

SEQ ID NO: 119855 - DNA, 954 bp, Artificial Sequence
  Description of Artificial Sequence: Synthetic coding sequence
atgagtcacggtcctaaacagcccggtgccgcggccgctccggcaggagggaaggctccggggcagcacggcggcttcgttgtcacagtaaagcaagaaagaggtgaagggcccagagccggggaaaagggtagccatgaagaagaacctgtgaagaagagggggtggcccaaaggaaagaagaggaaaaagatcctccctaatggcccaaaggcaccagttaccggatatgttcgattcctgaacgagcggcgcgaacaaatccgcaccaggcacccagatctcccatttccagagataactaaaatgctcggcgccgagtggagtaaactgcagcccacagagaaacagaggtacctcgatgaagccgaacgcgaaaaacaacagtatatgaaggaactgcgtgcctaccagcaatcagaggcctacaagatgtgcactgagaagatccaggaaaagaaaattaagaaagaagattcttcttccgggttgatgaatactcttcttaatggacataagggtggcgactgcgacggtttcagcacatttgatgtgcccattttcacagaggagtttctggaccaaaacaaggctagggaggcagaactgaggaggctgcgaaaaatgaatgtcgccttcgaggagcagaacgccgtcctgcagagacatacccagtccatgagctccgccagagagaggctcgagcaagagctggccctcgaggagcgccggacactggcattgcagcagcagctccaagcagttaggcaggctttgacagcgagtttcgcaagtttgccggttcctggcacaggagagacacccacactcggcaccctggatttttatatggcaagactgcacggcgccatcgaaagagatcctgctcaacacgagaaactgatcgtgcgtataaaagagatcctcgcccaagtcgcatcagagcatttgtag

SEQ ID NO: 119856 - DNA, 807 bp, Artificial Sequence
  Description of Artificial Sequence: Synthetic coding sequence
atggacactcgcgtgggcacagcaatggctagcccccctagtatgttccctagtagcctcaagtcttcatggaccaaaacaaagagggtgagacgctcatttggggccgaagacgagtgcggcctccgcggtgctgaacggggcacagcggaggcacatgcagagcacgagcagcgcgccagggcatcaggcgctggagccggcgctggcggcgctgaggatgcaggcgcagcagccgcggcccccgggcgcgctccaggtgcacaccgccagttacgtcttactgccggcgccggccacggcagaaacgcgcacgccggacactctggcctcctacacggccctgcgtctcgctctcatagggctcgacctcggccagccagagaagctcaccgaccccaccagggtaaccctggacccggtaggcagcgggctccagtgaggtctggacgtgcccatgacgctgaagaaaaactctgggcacgaccatgtcacactccgcctagaggaagagaagccggcggcccacctgggccagggccaatcttacacctgggcggatcaagtccacctaagattaaattcctgcagcacccctttagttttcaaagcccacaaccgcctgaacccgggaagtctacacgtgacactccacggcgtacatcacaaccgcgagtacctcttctgggtggccaaactaggtacaccggttctcccggtcacccccaggataccggccagacgaaaccaaccccatctactagacaagatccacccaactactcactgcgaggagcagttccctag

SEQ ID NO: 119857 - DNA, 648 bp, Artificial Sequence
  Description of Artificial Sequence: Synthetic coding sequence
atgtcccatggccccaaacaacccggcgcggccgccgcacctgcaggaggcaaagctcccggccagcacggtggatttgttgttacggtgaagcaggagagaggagagggcccgcgagctggagagaagggttcacacgaagaggaacctgtcaaaaagcgagggtggcctaagggaaaaaagagaaaaaaaattcttccaaacggacctaaggcaccggttacggggtacgtgcgattcctcaacgaaagacgagagcagatcaggacccgacatcccgatctgccctttccagaaatcacaaagatgttgggagccgagtggtctaaactccagcctactgagaagcagaggtacctggatgaagctgagagggaaaaacagcagtacatgaaggagctgcgcgcgtaccagcagtccgaggcatataagatgtgtacggagaagatacaagagaagaaaatcaaaaaagaagactcatcatctgggttgatgaataccctgctaaacggtcataagggcggtgactgcgacggcttcagcaccttcgacgtgcctatttttacagaggaattcttagaccaaaataaggcccgtgaggcggagcttagaaggctgaggaagatgaacgtggccttcgaagaatag

SEQ ID NO: 119858 - DNA, 429 bp, Artificial Sequence
  Description of Artificial Sequence: Synthetic coding sequence
atgagtcacggaccaaaacagcctggggcggcagcagccccagcagggggaaaggcccctggccagcacggtggttttgtcgtcaccgttaaacaggagagaggcgaaggcccccgcgctggagagaagggctctcatgaagaggaacccgtgaagaagcgagggtggcctaaggggaagaagcgaaagaagatactgccgaatggacctaaagccccagtgaccggttacgtgcggtttttaaacgaaaggcgcgagcagatcagaactagacacccagacctgccattccccgaaatcaccaagatgttaggggctgaatggtcaaaactccagccgacagagaagcagagatacctagatgaagccgagagggaaaaacagcagtatatgaaggagcttcgcgcttatcagcagagtgaagcttag

SEQ ID NO: 119859 - DNA, 324 bp, Artificial Sequence
  Description of Artificial Sequence: Synthetic coding sequence
atgagtgaatcatcctcaaaatcgtcacagcccctagcttcgaagcaggagaaagacggtactgaaaagcgtggtcgtggacgtcctcgcaagcaaccacccgtgagtcccggaaccgcccttgtcggatctcaaaaagagccatctgaggtacccacgccgaagaggccacggggaaggccaaaagggagcaaaaacaaaggggcagcaaaaactagaaagacgaccacaacccccgggaggaagccgcgcggtcgccccaaaaaactggaaaaagaggaggaggagggtatctcacaagaatctagcgaggaggagcagtag

SEQ ID NO: 119860 - DNA, 291 bp, Artificial Sequence
  Description of Artificial Sequence: Synthetic coding sequence
atgagcgagagtagttctaaatcatcccaacctttggccagtaagcaagaaaaggatgggacagaaaagcgggggaggggccgccccagaaaacagccccctaaagagccttctgaggttcctacacctaaaaggccaagaggtcgcccgaaaggcagcaaaaataaaggggcagccaagacccggaagaccaccactacccccggacgcaagccaagaggtagacctaagaaattagaaaaagaggaggaagaaggaatttctcaggagagctcagaagaggagcagtag

SEQ ID NO: 119861 - DNA, 291 bp, Artificial Sequence
  Description of Artificial Sequence: Synthetic coding sequence
atgtccgagagctcatcaaaaagttcacagcctctagcctccaaacaggaaaaagacggcactgaaaagcgcgggcgcggaagaccaagaaagcaacctccaaaagagccctcagaagtcccaacacctaaacggccaagaggcaggccaaagggatccaaaaataagggcgccgctaagaccaggaaaacaacaacaacacctggcaggaagcctcgcggccgccctaagaaactggagaaagaggaggaagagggcatctctcaggagtctagcgaggaggaacagtag

SEQ ID NO: 119862 - DNA, 324 bp, Artificial Sequence
  Description of Artificial Sequence: Synthetic coding sequence
atgtccgagagttcttccaagtcgagccaaccactagctagtaaacaagagaaggatggaacagaaaagcgcggtcggggccggccccgaaaacagcccccagtatcccccggcactgcccttgtgggttctcagaaggagccttcagaggtcccaaccccaaaacgccctagggggaggccaaaagggagcaagaataagggtgcggccaaaacgcggaagaccaccaccactcccggcagaaagcctagaggacggcccaagaaactggaaaaggaagaggaagagggaatcagccaggagtctagtgaagaagaacaatag

SEQ ID NO: 119863 - DNA, 291 bp, Artificial Sequence
  Description of Artificial Sequence: Synthetic coding sequence
atgtcagagtcaagcagtaaaagcagtcagccactcgcaagtaaacaggagaaagatggaacagaaaagcggggccgtgggcggcctcgcaaacagcctcctaaggagccaagtgaggtgcccacgccaaaacgacctcggggtcgacccaagggctcaaaaaacaagggcgcggccaagacccgcaagacaacaacgacccccggccgaaagccccgcggccgcccaaagaaactcgagaaggaggaagaggagggcatctcccaggagtcttctgaagaggaacagtag

SEQ ID NO: 119864 - DNA, 987 bp, Artificial Sequence
  Description of Artificial Sequence: Synthetic coding sequence
atgagtgaatcctcctccaagtcctcgcagccactggcatctaagcaggaaaaagacggaactgaaaaaagaggccgggggagacccaggaagcagccaccagtctcacctgggacagcactcgtagggtcccagaaggagccttccgaagtgcctacaccgaagagacctcggggacgcccgaaaggaagtaaaaataaaggggagggtggtagggggggccatctggcgggagtccttggtggtggggcagttacgcacgcctgcaggctgttactgacgggcggtgcagcaagcttctgggactggaccgccctgttgagatcacatcggccgcaccccttccccagacccaccatcaccaccgcctcgggcagacacccacacctccctccagtacctagcccccctcactacactgctcatcagccactccaaggaagtcatggcctgtccggagaacagttctcccctggactgtctagtcaactgccgccccccactcacgcatacactcacgctctgctggataaagcgaacatcccactcagccgaacgctccacctcctacggcctcacagcctcggggggggcgatattgccttgtgggcgttcggccttggagcaccctccctccttcttcactgttccctgtggcttcccatcgtggggcctggtcgcgtaccactcgccctgaaaggagctcaggccccttcacatccgggtactccatatagcaccgcactggccgcagcgggtgtggccaacggcggcggttgttggcctcccggattcccacagcccaactgcctctgtcaccacgttggcctgaccttccatcccagtccaacctccctcgttcccgtgctcggttggaccgcgccctttggctaccgaaaggcgggtggagtcagtccgctgctcccactgcactgcgggcatagtccactggccctgcgcctcgggagcgaatacatactctggtag

SEQ ID NO: 119865 - DNA, 291 bp, Artificial Sequence
  Description of Artificial Sequence: Synthetic coding sequence
atgtcagaatccagttctaaaagttctcagcctctggcgtctaagcaggaaaaagacggaaccgaaaagagggggagggggagacctcggaagcagccgcccaaggaacctagtgaggttcccactccaaagcgtcccaggggtcgacctaagggatccaaaaataaaggtgctgccaagactagaaagaccacaacaacccctggaagaaaacccagggggaggcccaaaaaacttgaaaaggaggaagaagagggaatctcacaggagtccagcgaggaagaacaatag

SEQ ID NO: 119866 - DNA, 324 bp, Artificial Sequence
  Description of Artificial Sequence: Synthetic coding sequence
atgtcagagtcttcctccaagagctcccagcccctcgcgtccaagcaagaaaaagatggcacagaaaagcggggcaggggcagacctaggaaacaaccccccgtcagccccgggacagccttggtcggatcacagaaagaacccagcgaggtgcctacaccgaagcgcccacggggacggcccaaaggctctaagaacaagggggctgccaaaacacggaaaaccacaactactcccggacgcaagcccagaggtagaccaaagaaacttgaaaaagaggaggaggaggggattagccaggagagtagcgaggaagaacagtag

SEQ ID NO: 119867 - DNA, 321 bp, Artificial Sequence
  Description of Artificial Sequence: Synthetic coding sequence
atgagcgccagaggggagggcgccggccagccgagtacaagcgcccagggccaaccagctgcccccgcaccccaaaaaaggggacgtggccgccctcgaaagcagcagcaagaacccaccggggagccttcaccgaagcgaccaaggggaagaccaaagggcagtaagaacaaatctccgagtaaggccgcacaaaaaaaagctgaagccaccggcgagaagaggccgcgcgggcgtcctcgaaagtgggataacctgttacctcgaaccagctcaaagaaaaaaaccagtcttggaaattccaccaaacggtcccattag

SEQ ID NO: 119868 - DNA, 357 bp, Artificial Sequence
  Description of Artificial Sequence: Synthetic coding sequence
atgagcgctcggggagagggggctggacagccgtccacgtctgctcagggccagcccgcggctccagccccacaaaaacggggaagaggccggccccggaagcagcaacaagagcctactggggaacccagccccaaaaggccgcgtgggcgcccaaagggcagcaagaataagtctccctcaaaggccgcacaaaagaaagccgaggctacaggtgaaaagagaccccggggcagacccagaaaatggccccaacaagtggtgcagaagaaacctgctcaggtgaacgtggccctgccaggcaaagatcaccccggtaacctgatctatctgctgttctcaaagaacgccacatag

SEQ ID NO: 119869 - DNA, 273 bp, Artificial Sequence
  Description of Artificial Sequence: Synthetic coding sequence
atgtcagcccgcggggagggggccggccagccgagcacttccgcccagggccagccagcggcacccgccccacagaagcgaggacgaggaagacctcggaagcaacaacaggagcccacgggagagccaagccctaagaggccgagagggaggcccaagggcagtaaaaacaagtcgccttctaaggccgcccagaaaaaagctgaagccaccggtgagaaacgaccacggggccgacctcgaaaatgggaggagttctacattgcggcctag

SEQ ID NO: 119870 - DNA, 330 bp, Artificial Sequence
  Description of Artificial Sequence: Synthetic coding sequence
atgagtgccaggggcgagggagccggccagccttccaccagcgctcagggacagcctgctgcacctgccccacagaaacgcggacgaggacggccacgtaaacagcaacaggaaccaaccggcgagcctagccccaagcggccccgaggccggccaaaaggaagtaaaaataagtctcccagcaaggcagcccagaaaaaagcagaagcaacaggtgagaaaaggccacgcggaaggccgaggaaatggcctcagcaggtcgtgcaaaagaagccagcacaggaagagaccgaggagacctcctctcaggaatctgctgaagaagactag

SEQ ID NO: 119871 - DNA, 279 bp, Artificial Sequence
  Description of Artificial Sequence: Synthetic coding sequence
atgtctgcgcgcggggagggtgcggggcagccttctacgtccgctcaaggacagcctgcagcccccgctccccaaaagcgaggccgtgggagacccagaaaacagcagcaagaacctactggtgaaccttctccgaagcgcccaagaggcaggcccaagggcagcaaaaacaagagcccatctaaagcggctcagaagaaggccgaagcgacaggcgaaaagaggcctagagggcgcccaagaaagtggtggttgctgatgaaaagtccctgctggtag

SEQ ID NO: 119872 - DNA, 312 bp, Artificial Sequence
  Description of Artificial Sequence: Synthetic coding sequence
atgtccgcccgcggggagggcgcaggccagccttccaccagtgcgcaaggtcaacctgcggccccagccccccagaagcgcgggagaggcagacccaggaaacagcagcaggagcccaccggcgagccttctccgaaacgcccaaggggcagacctaagggctccaagaacaagtcccctagtaaagccgcccagaagaaggctgaagccaccggtgagaagcgtcccagagggaggccccgtaaatggttgagggcacaggccctagacagcgatggactgggcagcaattcgggccccagcctctcttag

SEQ ID NO: 119873 - DNA, 261 bp, Artificial Sequence
  Description of Artificial Sequence: Synthetic coding sequence
atgagcgcccgcggcgaaggtgcaggccagccttccacctcagcccaagggcaacctgctgctccggccccccagaagcgtggtcgtgggaggccgcgcaagcaacagcaagagcccaccggggaaccatcccccaaaagacctcggggccgccctaaaggatccaagaataaatccccgagtaaggccgcacaaaagaaggctgaagccaccggcgaaaagagacccagaggacgacctcgaaagtggctccagaactag

SEQ ID NO: 119874 - DNA, 300 bp, Artificial Sequence
  Description of Artificial Sequence: Synthetic coding sequence
atgtcagcacgtggggaaggcgcggggcagccctcaactagcgcacagggtcaacccgctgcccccgccccacaaaagcgcggtcgaggcagaccacgcaaacagcagcaggagcctaccggggagccatcgccaaaacggcccagaggaagacccaagggatcaaaaaataaatctccaagcaaagcagctcagaagaaagccgaggccactggcgagaaaagaccacgcgggcgtccccggaagtggccacagcaggtagtgcaaaagaaacctgctcaggtacgccatagtcattag

SEQ ID NO: 119875 - DNA, 477 bp, Artificial Sequence
  Description of Artificial Sequence: Synthetic coding sequence
atggggaagggcgacccaaagaaacccagagggaaaatgagtagttacgcttttttcgtgcagacctgccgcgaggagcacaaaaagaagcacccagatgctagcgtcaatttctcagagttctcaaagaagtgcagcgagcggtggaaaaccatgtctgcaaaggaaaagggcaaattcgaggatatggccaaagctgataaggctcggtacgaacgagaaatgaaaacatacattccccctaaaggagagaccaagaagaagtttaaggatcccaacgctccaaagaggccaccctccgcgttcttcttgttctgttctgagtatagaccaaagatcaagggtgagcatcccggattgtccatcggggacgtagccaagaaattgggtgagatgtggaacaacaccgcagcagatgataaacagccctacgagaagaaagccgctaagctgaaggaaaaatacgaaaagttttag

SEQ ID NO: 119876 - DNA, 648 bp, Artificial Sequence
  Description of Artificial Sequence: Synthetic coding sequence
atgggcaagggcgacccaaaaaaaccaaggggcaaaatgagctcttatgctttcttcgtgcagacctgccgggaggaacacaagaaaaagcaccccgatgcaagtgtgaatttcagcgaattctctaaaaagtgtagcgagagatggaaaaccatgagtgccaaggagaagggcaaattcgaagacatggcgaaggctgacaaagcccgatacgagagagagatgaagacatacatcccccctaaaggggagacgaaaaagaagttcaaggaccccaatgcaccaaaacgtcccccttccgccttcttcttattctgttcggagtatcggcccaagattaaaggggagcatccaggcttgtcaataggagacgttgcaaaaaagcttggggaaatgtggaataacacggccgccgatgacaagcaaccctacgagaagaaagccgctaagctgaaggagaaatatgagaaagacatcgcagcctaccgggcgaaaggaaagccagacgccgctaaaaagggtgtagtgaaggcagagaaaagtaaaaagaaaaaggaggaggaggaggacgaagaggacgaggaggacgaggaggaggaagaggacgaagaggacgaggacgaggaggaagacgatgatgacgagtag

SEQ ID NO: 119877 - DNA, 648 bp, Artificial Sequence
  Description of Artificial Sequence: Synthetic coding sequence
atggggaaaggggaccccaaaaagcctcggggcaagatgtccagttatgcctttttcgttcagacctgcagggaagaacacaaaaagaagcacccagatgcctctgttaatttttcagagtttagtaagaagtgctctgaaaggtggaaaactatgagcgccaaggagaaagggaagttcgaggacatggccaaagccgacaaagcacgatacgaacgtgagatgaagacatacattcccccaaagggggaaacgaaaaaaaaattcaaggacccgaacgcccctaagaggccaccctccgctttctttcttttctgcagcgaataccggcccaaaatcaaaggagaacatcccggcctaagcatcggcgacgttgccaagaagttgggcgagatgtggaacaataccgccgcagatgacaagcagccgtatgaaaaaaaggccgccaagttaaaggaaaaatatgagaaagacatcgcggcttatagagccaaaggaaaacctgatgccgccaagaaaggcgtcgttaaggcggagaaatcaaaaaagaaaaaagaagaagaggaggacgaagaggacgaagaagatgaggaggaagaagaggacgaggaagacgaagacgaagaggaagacgacgatgacgagtag

SEQ ID NO: 119878 - DNA, 294 bp, Artificial Sequence
  Description of Artificial Sequence: Synthetic coding sequence
atgggaaaaggggatcctaagaagcccaggggtaaaatgtcttcgtacgcattttttgttcagacctgtcgcgaagaacacaagaaaaagcaccctgacgcctctgtgaatttctccgaattctctaagaagtgctctgagagatggaaaaccatgtctgccaaagagaagggcaagtttgaggacatggccaaagccgataaagcacggtacgaacgggagatgaaaacttatattccccctaaaggggaaaccaagaaaaagttcaaagaccccaatgcacctaagcgctag

SEQ ID NO: 119879 - DNA, 477 bp, Artificial Sequence
  Description of Artificial Sequence: Synthetic coding sequence
atggggaagggggaccccaagaaacccaggggtaagatgtcgtcatacgcttttttcgtgcagacttgccgcgaggagcacaaaaagaagcacccagacgcatctgttaacttctccgagttctccaagaaatgcagtgagcgttggaaaacaatgagcgctaaagagaaggggaagtttgaagacatggccaaagccgacaaagcgaggtatgaaagggagatgaaaacttacattccccccaaaggtgagaccaagaagaagttcaaggaccctaatgcaccaaaacgcccaccaagtgccttcttcttgttttgcagcgagtatcgccccaagatcaaaggagaacatccaggattatccattggagacgttgcgaagaagctgggagaaatgtggaacaacactgctgccgatgacaaacaaccttatgaaaaaaaggccgctaagttgaaagaaaagtatgagaaattttag

SEQ ID NO: 119880 - DNA, 648 bp, Artificial Sequence
  Description of Artificial Sequence: Synthetic coding sequence
atgggaaagggcgaccctaagaagccccgaggcaaaatgagctcatacgcatttttcgtgcagacatgtagggaagaacataagaagaagcaccccgacgcttccgtgaacttctccgaattcagcaagaagtgctccgagcgatggaagaccatgagtgcaaaagaaaaggggaaattcgaggatatggctaaagccgataaggctcgatacgagagagagatgaagacctatatacccccgaaaggcgagacaaaaaaaaaattcaaggaccctaacgccccaaagaggccccccagcgccttcttcctgttctgtagcgagtatagacctaaaattaagggcgagcaccctggcctcagcatcggtgatgtggccaaaaagctgggcgaaatgtggaataacactgccgcggacgataagcagccctatgagaagaaagccgccaagttgaaagaaaaatacgagaaggatatcgcagcgtaccgcgccaagggtaagccagacgcagccaagaaaggcgtggtcaaagctgagaaatcgaagaagaaaaaagaggaggaggaagacgaagaagatgaagaggacgaggaagaagaagaagatgaggaggatgaagatgaagaggaggatgatgatgatgagtag

SEQ ID NO: 119881 - DNA, 648 bp, Artificial Sequence
  Description of Artificial Sequence: Synthetic coding sequence
atgggtaagggtgaccccaagaagcctaggggcaagatgagctcttatgctttttttgttcagacttgtcgcgaagagcataaaaagaagcatcctgatgcatctgtcaatttctccgagtttagtaagaaatgtagcgagcgatggaaaacaatgagtgccaaggaaaaggggaagttcgaagatatggctaaggctgataaggcccgatacgagagagaaatgaagacgtatattcctcctaagggcgagactaagaagaagttcaaagaccccaacgccccaaaacggccacccagcgccttcttcctattctgcagcgagtacaggcctaagatcaaaggagaacacccggggctcagtatcggtgacgtcgcaaagaagttaggggagatgtggaataatacagccgctgacgacaagcagccatacgagaagaaggccgcaaagttaaaggaaaagtatgagaaggacattgccgcgtaccgagcgaagggaaaaccggatgccgcaaagaagggggtggtgaaggcagagaagtccaagaaaaaaaaggaagaagaagaagatgaagaggatgaggaggacgaggaagaggaggaggacgaagaggatgaggatgaggaggaggacgatgatgacgaatag

SEQ ID NO: 119882 - DNA, 489 bp, Artificial Sequence
  Description of Artificial Sequence: Synthetic coding sequence
atgggaaagggagaccctaagaaaccacgcggtaagatgagttcttatgcctttttcgtacagacatgtagagaagagcacaagaagaagcacccagacgctagcgtcaattttagcgagttctctaaaaaatgctccgagagatggaaaactatgtctgcaaaggagaagggtaaatttgaggacatggccaaggccgataaagccagatacgaaagggagatgaaaacctacatcccccccaagggcgaaactaagaagaaatttaaggatccaaacgctccgaagcgtccccccagcgccttcttcctgttttgcagtgagtacagacccaaaatcaaaggcgagcaccccggactgagtataggggacgttgccaaaaaattgggtgaaatgtggaacaacacggctgcagatgacaagcagccctatgaaaagatactgctacacatcgaactgaaggaatcgctgatgcagcaaaaaagatag

SEQ ID NO: 119883 - DNA, 630 bp, Artificial Sequence
  Description of Artificial Sequence: Synthetic coding sequence
atgggaaagggagatcccaataaaccacgaggcaaaatgagcagttatgccttttttgtgcagacgtgtagggaagagcacaaaaagaagcatcccgattcaagcgtgaacttcgcagaattttccaaaaaatgcagcgaacgttggaagactatgtctgccaaggagaagtcaaaattcgaggacatggccaagtcggacaaagcgcggtatgaccgagagatgaaaaattatgtcccgccaaaaggcgacaagaaaggaaagaagaaggatcctaacgcgccaaagcgcccaccaagcgccttcttcctgttttgtagcgaacaccggccgaagatcaaaagtgaacatcctggactatccatcggggatacggcaaagaaattgggggagatgtggtctgaacaatccgccaaagacaagcaaccctacgaacagaaagccgcaaagcttaaagaaaaatatgagaaggatattgccgcatacagagccaagggaaagtccgaagcaggtaaaaaggggccgggaagacctaccggttcaaagaaaaagaacgagcccgaagacgaagaggaagaagaagaggaggaagatgaagatgaggaggaggaagatgaggatgaggaatag

SEQ ID NO: 119884 - DNA, 630 bp, Artificial Sequence
  Description of Artificial Sequence: Synthetic coding sequence
atggggaagggcgaccccaacaagcctcgtgggaagatgtcctcgtatgcgttttttgtgcagacctgtagagaggaacacaagaaaaaacacccagattcatcagtgaattttgcggagttttccaaaaagtgctcggagaggtggaagactatgagtgccaaggagaaaagcaagtttgaggatatggcaaagagcgataaggcaagatatgatagggaaatgaaaaattatgtgcccccaaagggtgacaaaaagggtaagaagaaggacccaaatgcacctaaacggccaccctctgccttcttcctgttttgcagcgagcaccgtccgaagattaagtccgaacaccccgggttgtctattggtgacactgccaagaaactgggggaaatgtggtccgagcaaagcgcaaaggataaacagccctatgagcaaaaggctgccaagctgaaggagaagtatgagaaggatattgcggcctaccgagccaaggggaagtccgaagccggaaagaaaggtcctgggagacccaccggctccaagaaaaaaaatgagccggaggacgaggaagaagaagaggaggaagaggatgaagacgaggaagaggaagacgaggacgaggaatag

SEQ ID NO: 119885 - DNA, 630 bp, Artificial Sequence
  Description of Artificial Sequence: Synthetic coding sequence
atggggaaaggggatcccaacaagcctcgcggtaagatgtcttcttacgctttcttcgtgcagacatgccgggaagagcacaagaaaaaacaccctgactcctctgtcaatttcgcggagttcagtaagaagtgtagcgaacggtggaagactatgtcggcgaaagaaaagtccaagtttgaagacatggcaaagtctgataaggccagatacgacagggaaatgaagaattacgtgccacccaaaggagataagaaaggtaagaaaaaagaccccaatgcccctaagaggcccccctccgctttttttctgttctgtagcgaacataggccaaagattaaatccgagcatcctggcctcagcattggggacacggctaagaagctaggcgaaatgtggtctgagcagtcagccaaggataagcagccttacgaacagaaggctgccaagctgaaggagaagtacgagaaggacattgccgcctacagagctaagggaaaaagcgaggccggcaaaaaagggcccggcaggcccacgggttcaaagaagaaaaacgaacctgaagacgaggaagaggaagaggaggaggaagatgaggatgaagaggaagaggacgaggacgaggaatag

SEQ ID NO: 119886 - DNA, 405 bp, Artificial Sequence
  Description of Artificial Sequence: Synthetic coding sequence
atggggaagggggatcctaataaaccgagggggaaaatgagctcctacgctttcttcgttcagacctgccgcgaagagcacaaaaagaagcaccccgatagcagtgtgaacttcgcagagttctcaaagaagtgctctgagcgctggaagacaatgtcggccaaggagaaatccaaattcgaggacatggccaagagcgacaaggcaagatatgaccgagagatgaagaactacgtaccacctaaaggtgataaaaaagggaaaaaaaaggacccaaacgcgcctaaacgccccccatctgccttttttctgttctgcagcgaacataggcccaagataaagtcggaacaccccgggttgagtataggggatactgccaagaaactgggagaaatgtggtcatag

SEQ ID NO: 119887 - DNA, 603 bp, Artificial Sequence
  Description of Artificial Sequence: Synthetic coding sequence
atggccaaaggggaccccaaaaaacctaagggcaaaatgtcagcctatgcattctttgttcagacctgtcgggaggaacataaaaaaaaaaaccctgaggtgccagttaattttgccgagtttagtaagaagtgcagcgaacgatggaagacaatgtcgggaaaggagaagtcgaaattcgatgaaatggctaaagctgataaagtgcgctatgaccgggaaatgaaggactatggcccagcaaagggtggtaaaaagaaaaaggatcctaatgctcctaaaagacctccatcaggattcttcctattttgtagcgaatttagacccaaaattaaaagcacaaatcccggtatctcgatcggcgatgtcgcaaaaaagctgggcgaaatgtggaataatctcaatgatagcgagaaacagccatacataaccaaagcagcaaaacttaaggaaaagtatgaaaaagatgttgcagactacaagagcaagggaaagttcgacggggccaagggacccgccaaggtagcacgaaagaaggtggaagaggaggacgaagaagaagaggaggaagaggaggaggaggaggaggaggaagatgagtag

SEQ ID NO: 119888 - DNA, 567 bp, Artificial Sequence
  Description of Artificial Sequence: Synthetic coding sequence
atggccaaaggagacccaaaaaagcccaaaggcaagatgtccgcgtacgcgttcttcgtacaaacctgcagagaggaacacaaaaaaaagaaccctgaggtgccagtgaacttcgctgaattctctaaaaagtgctccgaaagatggaagactatgagtggcaaggaaaagtcaaaattcgacgagatggccaaggccgataaagtccgctacgatagagaaatgaaagattacggccccgcaaagggagggaagaaaaagaaggacccgaacgcccctaaacggccaccctctggattctttctcttttgctccgagtttagaccgaaaattaagagcaccaatcctggaatctccatcggcgatgtggcgaaaaagctgggagagatgtggaacaacttaaacgattcagaaaaacagccctatattaccaaggccgcaaagcttaaggagaagtacgagaaggatgtcgctgactataaatccaaaggtaaatttgatggggcaaaggggcccgccaaggtagctcggaaaaaggtggaggaggaggatgaggaagaggaatag

SEQ ID NO: 119889 - DNA, 462 bp, Artificial Sequence
  Description of Artificial Sequence: Synthetic coding sequence
atggccaagggagatccgaagaagcctaagggaaagatgtctgcctacgccttctttgttcagacatgtcgagaagaacataagaagaaaaacccagaagtcccagtgaactttgcggagtttagcaagaagtgctcggagcgctggaaaaccatgtccggcaaggagaagtccaaatttgatgaaatggctaaggcagacaaggttcgatacgacagggagatgaaagactacggccctgctaaaggcggtaagaaaaagaaagatcccaatgcacccaagcgccctccttccggatttttcctgttttgttctgaattccggccgaaaattaaatccaccaacccaggtattagcattggcgatgtagccaagaaactgggtgagatgtggaataacctaaacgactccgagaaacagccctacatcactaaggcggcaaagctgaaggaaaagtactag

SEQ ID NO: 119890 - DNA, 603 bp, Artificial Sequence
  Description of Artificial Sequence: Synthetic coding sequence
atggcaaagggagatccgaaaaagcccaaaggaaaaatgtcagcttatgcattttttgttcaaacgtgccgggaagaacacaagaagaaaaaccccgaagtcccagtgaactttgcagaatttagcaagaagtgtagcgagcggtggaagacgatgtccgggaaagagaagtcaaaattcgatgagatggccaaagctgataaggtgaggtacgacagggagatgaaagactacggaccagccaagggagggaagaagaaaaaggaccccaatgcacctaaaaggcccccttccggattttttctattctgtagcgaatttagaccaaagataaaaagcaccaaccccgggatttctatcggggatgtggcaaagaaacttggcgagatgtggaacaacctgaacgactccgagaagcagccgtatatcacaaaggcggctaagctgaaggaaaaatatgaaaaagatgtggccgactacaaaagcaagggcaagttcgatggggccaaggggcccgcaaaggtggctagaaagaaggttgaagaggaggatgaggaggaagaagaggaagaggaggaagaggaagaggaggaagatgaatag

SEQ ID NO: 119891 - DNA, 582 bp, Artificial Sequence
  Description of Artificial Sequence: Synthetic coding sequence
atggccaaaggagacccaaagaaacccaaggggaagatgtcagcttacgccttcttcgtccagacttgtcgagaggaacacaagaagaaaaaccccgaggtcccggttaactttgcagaattcagcaagaagtgctctgaaaggtggaagacaatgtccgggaaggagaagtccaagttcgacgagatggcgaaagctgacaaagtgcgatacgaccgtgaaatgaaggattacggtccagccaaaggcggcaagaagaagaaagaccctaacgccccaaaaaggcctccctccgggtttttcctcttctgttctgaattccggcccaaaatcaagtccaccaatcccgggatctcaatcggcgatgtggccaaaaaactgggggagatgtggaacaatctgaatgattcagaaaaacagccctacataactaaggcagcaaaactgaaagagaaatatgaaaaggacgttgctgattacaaatccaaaggaaagtttgacggcgccaaggggcccgccaaagtcgcaaggaaaaaagttgaggaggaagatgaggaggaagaggaagaagaggaggagtag

SEQ ID NO: 119892 - DNA, 273 bp, Artificial Sequence
  Description of Artificial Sequence: Synthetic coding sequence
atgcccaaaagaaaggccgaaggagacgcaaagggtgataaggccaaggtgaaggacgaaccccagagaaggagcgcacgcctgtctgccaagccggcgccccccaagccagaaccaaagccaaaaaaggcccccgctaaaaaaggtgagaaggtgcccaagggaaaaaaaggtaaggccgatgccgggaaagaaggaaacaacccggctgaaaacggagatgccaaaactgaccaggcccagaaagccgaaggagccggtgatgccaagtag

SEQ ID NO: 119893 - DNA, 234 bp, Artificial Sequence
  Description of Artificial Sequence: Synthetic coding sequence
atgcctaagcggaagagtccggagaacacagagggaaaagatgggtccaaagtaacaaagcaggagccgactcgccggagcgcccgcctcagcgctaagcccgcaccgcccaagcccgagcccaagccccgtaagacatccgcgaaaaaggagcctggcgctaaaatcagccgcggggccaaggggaaaaaggaggagaagcaagaggccgggaaagaggggactgagaactag

SEQ ID NO: 119894 - DNA, 300 bp, Artificial Sequence
  Description of Artificial Sequence: Synthetic coding sequence
atgcccaagcgcaagtcccctgagaacacagagggcaaggacggctctaaggttaccaagcaggaaccaaccaggcgaagcgctagactgagtgccaagcccgccccacccaaacccgagccaaaacctcgcaagacttctgcaaaaaaggagcctggcgctaagattagccggggagcaaaaggcaaaaaggaggagaagcaggaggccgggaaggagggtacggcccctagtgagaacggagagactaaggcggaggaggcgcagaaaactgagtctgttgataacgaaggagagtag

SEQ ID NO: 119895 - DNA, 507 bp, Artificial Sequence
  Description of Artificial Sequence: Synthetic coding sequence
atggtgctctttttcagaatcaacctgcaaaccaagaagtgcaaacagaagggaaaaggcgaacagcgcgaaaataggcctaagtggctaaccaagaaactgaagaagacctacctgcggaagacgggaaagaggaggttgagacgggttcagccccttatgaaacaggaacgtaagaagcccagcttgattaacaatcacatcccgtgcttgataagtggaccatgtttaccctcctgtacaattcagcggaatattttcataaactatttcgtgaatgcctccttcctggtggccctggagaccttcctgcgccgacgcgaatcccacctgatcccttttttcaaatgcaagtgcttcttcctgcgaggcgaaatcatttgctggctctttattttctggtacaaccagaaaatcgtctgggatatcgaactttgggaggctctaactgtgtccggcgtcagcctgacattccaccgctggggcgtttctttctacatcctgtag

SEQ ID NO: 119896 - DNA, 303 bp, Artificial Sequence
  Description of Artificial Sequence: Synthetic coding sequence
atgcctaaacgtaaggtatcctcggccgagggagcggcgaaagaagaaccaaaacgccgcagcgctcggctgtccgccaagccaccagcaaaagtcgaggctaagcctaaaaaagctgccgcaaaggataaaagttccgataagaaggtgcagactaaagggaagcgcggcgcaaagggcaagcaggccgaggtggctaaccaggagaccaaggaggaccttcctgctgaaaatggggagacaaagacggaggagagtcccgcttcggacgaggcaggcgaaaaagaggcgaaatcagactag

SEQ ID NO: 119897 - DNA, 582 bp, Artificial Sequence
  Description of Artificial Sequence: Synthetic coding sequence
atgggtaaacagaatagtaagctacgcccagaaatgctgcaggacctcagagaaaatactgagtttagcgagctggagctccaggagtggtacaagggttttttaaaggactgcccaacggggattctgaacgtcgacgaatttaagaagatttatgccaacttttttccatacggcgatgcaagtaaatttgctgagcatgtcttcagaacttttgataccaacagcgatggcacaattgattttagggaattcattatcgcgctgtccgtgacaagtaggggcaggcttgaacagaaactcatgtgggctttttccatgtacgatctggacgggaacggttatatttctagagaagaaatgcttgagattgtgcaggcgatctacaagatggtcagctccgttatgaagatgcctgaggatgagagcacccctgagaaaagaactgagaaaatcttccggcaaatggacactaacaatgatggaaaacttagcctggaggaattcatcagaggagcaaagtccgatccctccatcgttcgcctcctacagtgcgatccctcaagtgcgagccagttttag

SEQ ID NO: 119898 - DNA, 582 bp, Artificial Sequence
  Description of Artificial Sequence: Synthetic coding sequence
atgggtaaacagaattccaagctgcggccagaggtgttacaggacctgcgcgagaacaccgagtttactgaccacgagttgcaagagtggtacaaagggttccttaaggactgtccaacagggcacttgaccgttgacgaatttaaaaaaatttacgcaaattttttcccatatggcgacgcctccaagttcgccgagcatgtgttcagaacattcgacactaacggtgacggtacaatagacttccgggagttcatcatagcactctcagtgactagtcgagggaagctggagcagaagctgaagtgggctttctcgatgtacgacctggacggtaatggatacatttcaaggagcgagatgttagaaatcgtgcaagcaatctataagatggtgtcctctgtcatgaagatgcctgaggatgaatctactccggaaaagaggacagacaaaattttcaggcagatggacaccaacaacgacgggaaactgtcgctcgaggaattcataaggggcgccaagagcgaccccagcatagttcgactgctgcagtgtgacccgagtagtgccagtcagttctag

SEQ ID NO: 119899 - DNA, 582 bp, Artificial Sequence
  Description of Artificial Sequence: Synthetic coding sequence
atgggtaagcaaaatagtaagctgcgacccgaagtcctccaggacttgcgggagaacacagaattcacagatcacgaactccaggagtggtacaaaggtttcctcaaagactgccctactggccatcttacggttgatgaatttaagaaaatctatgcaaatttcttcccatacggcgatgccagtaagtttgccgaacacgtttttcggaccttcgacaccaacggagatgggaccatagatttccgcgagttcattattgcgctctccgtgacatcacggggtaaactggagcagaagcttaaatgggccttctctatgtacgatcttgatggtaacggttacatttcgcggtcagaaatgttagagatcgtgcaagctatctataagatggtaagctctgtgatgaaaatgcccgaagacgaaagcacgccagagaagagaaccgataagattttccgccagatggacaccaacaacgacggcaagttgagtctggaggagttcattagaggagctaagagtgatccttccattgtgagactccttcaatgtgacccatcatcagcaagccaattctag

SEQ ID NO: 119900 - DNA, 93 bp, Artificial Sequence
  Description of Artificial Sequence: Synthetic coding sequence
atgggtaagcagaactccaagctacgcccagaagtgctccaagacctgcgtgagaacacagaatttacagaccatgagctgcaggaatggtag

SEQ ID NO: 119901 - DNA, 3054 bp, Artificial Sequence
  Description of Artificial Sequence: Synthetic coding sequence
atgaaactgctgaagcccacatgggtcaatcacaacggcaaacccatcttctctgtggacatccatccagacggcaccaaatttgcgacggggggacagggtcaggatagcggcaaggttgttatctggaacatgtccccggtcttgcaggaagacgatgagaaggatgaaaacatcccaaagatgctgtgccagatggataatcatctagcctgtgtgaattgcgtgaggtggagcaactccggcatgtatctggcttcaggtggggacgacaaattgatcatggtctggaaacgagctacatatatcggcccttcaacagttttcggaagcagcggcaaactggccaatgtggaacaatggcggtgcgtgtccattctgagaaaccactctggagacgtgatggatgtggcctggtcgccccatgatgcctggctggcatcctgttcggttgataacacggtcgtgatttggaacgcagtgaaatttcctgagatcctcgcaactctgcgtggacattcgggcctggtgaaggggctgacctgggatccagtgggcaaatacatcgccagccaggccgatgacagatcactgaaagtgtggagaaccctggattggcagctggaaactagcatcaccaagccgttcgacgagtgtggcggaaccacccatgttctacgcctttcgtggtcccccgacggacactatctagtcagtgctcatgccatgaataatagcggacctaccgctcagatcatcgaacgcgaaggctggaagacgaacatggacttcgtcggccaccggaaggcagtaacagtagtcaagtttaacccgaaaattttcaaaaagaaacagaagaacggctccagcgccaaaccaagctgcccatactgctgttgcgctgttggatcaaaggacagatctctgagcgtgtggctcacctgcctgaagaggcctttggtggtaattcatgagcttttcgataagtcgataatggacatctcttggacactgaatgggttgggcatcctggtatgctccatggacgggtccgtcgcattcctcgacttttcacaggatgagttaggagatcccctgagtgaagaagagaagtctaggatccatcaatccacttacggcaagagcttagccattatgaccgaagcacagttgtctacagctgtaatagagaatccggagatgcttaagtatcagaggcgccagcagcagcaacaactggaccagaagtccgccgccacgagagaaatgggttcggctacatccgtcgccggtgtggtcaacggtgaatcactggaggatattaggaaaaacctgcttaagaagcaagtagagacccgtacggcagacggccgtcgccgaatcacaccgctgtgcatcgctcagttggacacgggcgatttctctaccgcttttttcaactcaatacccttgtcagggtccttggctggaaccatgctttccagtcatagttccccgcagctccttcctctggatagttctacacccaactcctttggtgcgagcaagccctgtaccgagcctgtggtggccgcttctgcacgcccggcaggtgatagcgttaacaaggactctatgaacgctacgagtaccccagcagcactttcaccttcggtgctcactaccccctctaagatcgagccaatgaaagccttcgactcccggtttactgaacgatctaaggccacgccgggtgccccagcattgacaagtatgacacccactgcagtagagcgattgaaagagcaaaacttagtaaaggagcttagaccgcgcgacttactggagagctcttccgatagcgacgagaaagtgcccctcgccaaggctagttctctttccaagaggaaactcgaattggaggtagagaccgtggagaagaagaaaaagggtcgccctcgcaaagattccaggctgatgccagtgtccctctctgtgcagagtccggctgcattgacggcggagaaggaagcaatgtgtttgtcagctcccgcactggctctgaagctgcctattcccagtccccagagggccttcacccttcaggtgtctagtgacccatccatgtacatcgaagtcgagaatgaagtcaccgtggtcggtggcgtaaaattatcacgacttaaatgtaaccgtgaggggaaggagtgggaaaccgtcctaacaagcaggattcttacggccgccggttcctgcgacgttgtatgcgtcgcatgtgaaaagcgaatgctgtcggtgttcagtacctgcggccgccggctattgtcaccaatcctgctgccttctccaatttccactctccactgcaccgggagctatgtaatggccctgaccgccgccgccactttgagcgtttgggacgtccacaggcaagtggttgttgttaaagaggagtccctgcactccatcctggctgggagcgatatgacagtgagtcagattctactcacccagcacgggatacctgtgatgaacctctctgacggtaaagcgtactgtttcaacccgtctctatccacttggaacctagtgtccgataaacaggactccttagcccaatgcgcagattttagatcaagcttgccaagccaagatgctatgctttgtagtggccctctcgcaatcattcagggcagaaccagtaattccggacgtcaggccgcccgcctgttcagcgtgccgcacgttgttcagcaggaaacaacgctggcttaccttgaaaatcaggtggccgccgccctcacccttcaatcctcccacgaataccgtcactggttgctggtctacgctagatacctggtcaatgagggattcgaataccgcctgagggagatctgtaaagatctgcttggtcctgtgcattattctaccggtagtcagtgggagtccacagtagtgggacttagaaagcgagagctgctcaaggagctgctgccagtgatcggccagaaccttagatttcagcgcctttttaccgaatgtcaggagcagctagacattcttcgagacaagtag

SEQ ID NO: 119902 - DNA, 2433 bp, Artificial Sequence
  Description of Artificial Sequence: Synthetic coding sequence
atgaagcttctgaagcccacgtgggtgaatcataatgggaaaccaatcttctccgtagatatacacccagacggaaccaagtttgctacaggcggccagggtcaagactcaggtaaagtcgtcatttggaacatgtcccctgttttgcaggaagatgacgagaaagatgagaacattcccaaaatgctttgtcagatggataaccacctcgcatgcgtgaactgcgtgaggtggagtaattccggcatgtacctggcttctgggggcgacgacaaactcatcatggtgtggaagcgcgcgacttacatcgggccctctacagtcttcggatccagcggcaagctggcaaacgtcgaacagtggcggtgcgtctctatccttcgcaatcactctggcgatgttatggatgtcgcctggtcacctcacgacgcatggctcgcgagctgcagcgtcgacaacacggttgttatctggaatgccgtaaaattcccagagattctggccacacttcgcggacattccgggttggtcaaaggtctgacatgggatcctgtcgggaagtacatcgcaagtcaggcagacgaccgttccttgaaggtatggcggaccctagactggcaactagaaacgagcatcactaagccattcgatgaatgcggggggactacccatgtgcttaggttgagttggtcccccgatggccactatttggtgagcgcgcacgctatgaacaactccggaccaacagcgcaaattattgagcgggagggatggaagaccaacatggattttgtcgggcaccgaaaagccgtgactgtggtgaagtttaatcccaagatctttaagaagaagcagaaaaacggctcttcggcaaagccatcctgtccctattgctgttgtgccgtgggaagcaaagatcggagcctttctgtatggctgacctgcctcaaacgccctcttgttgtaattcacgaacttttcgataaatccattatggatatctcctggaccctgaatggcttgggtatactggtatgtagcatggatgggagtgtggcattcctggactttagccaagatgagctgggagatcctctgtcagaggaagagaagtcgcgcattcaccaatccacctatggtaaatcgctcgccatcatgacggaggcccagttaagtaccgccgtgatcgagaatcccgaaatgctcaagtaccagcgcaggcagcagcaacaacaactggaccaaaaaagcgccgccacaagggaaatggggagcgccaccagcgtggccggagtagtcaacggtgagtcgctggaagatatccggaagaacttattgaaaaaacaagtggaaacacgtaccgctgacggccggcgcaggatcaccccactctgtattgcacagctggacactggcgacttcagtaccgccttttttaattccattccattgagcggctccttggctgggaccatgctgtcctctcatagctctcctcagctcttaccactcgactcaagcaccccaaactcatttggcgcctccaagccctgcacagaacccgttgtggctgcttccgcgagacctgccggtgactcggtgaacaaagattcaatgaatgccacctcaacacccgcagcactgagccccagcgtactgaccaccccatctaaaatagagcctatgaaagctttcgactcccgatttaccgaacgttccaaggccactccgggtgctccagcgctgacatcaatgactccgaccgccgtggagcgcgatgtgcaccggcaggtcgtggtagtcaaggaagagtctctgcacagcattctcgccggttcagatatgaccgtgtcacagattctgttgacccagcacggtattcccgttatgaacctttctgacggcaaggcctattgctttaatccttcccttagcacctggaacctcgtgtccgataaacaggactccctggcccaatgtgctgattttagaagcagtctgccttcccaggacgcgatgttgtgcagcgggccccttgccatcattcagggccgcacgagtaactcaggacgacaagcagcccgattattttcagtgcctcacgtggttcagcaggagactacacttgcttacctggagaaccaggttgctgccgcgctcacccttcagagctcccacgaatatcgtcattggctgctagtgtacgcacgatatctggtaaacgagggatttgagtaccgtctgcgtgagatttgtaaggacctgctgggtccggtccattattctacaggcagccaatgggagtccacagtcgttggattacgcaagagagaactcctgaaagagcttcttccagtgatcggtcaaaacctgcggttccagcggctgttcacggaatgccaggagcagctggacatccttcgcgataaatag

SEQ ID NO: 119903 - DNA, 1815 bp, Artificial Sequence
  Description of Artificial Sequence: Synthetic coding sequence
atgctttccagccacagttcccctcagttgctacctctagattcatccacccctaattccttcggtgcctcaaaaccatgtactgagcccgtggtggccgcctcagcccgcccggcgggcgacagcgtcaacaaggattccatgaatgctaccagcactcccgcagccctctccccttccgtgcttacgacccccagcaagattgaacccatgaaagcttttgacagcagattcactgaacggtccaaggctaccccaggcgcgcccgccctgacctcaatgacacctactgccgtcgagcgcctgaaggaacagaacctggtgaaggagctccgacccagagacctgctggagtctagtagtgatagtgacgagaaggtgcctctggccaaagctagctccctctctaaacgaaagttagaattggaagtcgaaacagtggagaaaaagaaaaaaggtaggccccggaaggactcccgcttaatgcctgtgagcctctctgttcagagtccagccgcattgacagcagagaaagaggctatgtgcttgtccgcaccggccctcgcactgaaactccctatcccaagcccacaaagggcattcaccctacaagtcagttccgaccctagcatgtatatcgaggtggagaacgaagttaccgtggtcggaggagtcaaactctccagactgaaatgcaacagggaaggcaaggagtgggagaccgttctcactagtcggatcctcacggcagcaggcagttgcgacgtcgtgtgcgtcgcctgcgagaaaagaatgttatctgtgttcagcacatgcgggcgccgtctcctgtcacccatcctactgccaagccccatcagcacgctgcactgtacgggttcctacgtgatggccctgaccgccgcagctaccctaagcgtttgggacgtccatcggcaagttgtggtggtgaaagaggagtcactgcacagtatacttgccgggtctgacatgaccgtatctcagattctcctgacccagcacggcattcctgtgatgaatctgagtgacggaaaggcttattgttttaacccatcattgtccacatggaatctggtctccgacaagcaggactccctcgcacagtgcgcggacttccgtagttctctgcctagccaagacgcaatgctctgctccgggccacttgccattattcagggccggacaagtaacagcggaaggcaggcagctaggctgttttctgtgccccacgtcgtccagcaagagactacactggcctacttggaaaatcaggtggccgctgctctgacactgcagtcatcacatgagtatcgtcactggctcttggtttacgctcgctatctggtgaacgaaggctctgccgaggagggcgccgcagaaggcgctgccacaagtcatagagccgagcctcctatccccgccccactacacagagtaagcggtaccgcccgacatcccgaagggcaggtggcttgtccaagcttaccatggcttcagcaaggacaagggcatactcttgccgcggatgacatgcaagaccggctgagccccgaccaagctgtaggcggcggagatacgggtcgccgctgcgctgtgctgcaccagagacagccatcatccctgggtaggtgcgctttatgccctggaagcgatatcgcgtccggtggcgggtctagtagtctccctcccagccctagatgtggtgctagggcaggcgcattacctaggtgcccaggagcatctaaggccgtgccggggctcccttcacccgccaggccccaaggcggacactag

SEQ ID NO: 119904 - DNA, 2922 bp, Artificial Sequence
  Description of Artificial Sequence: Synthetic coding sequence
atgtccccggttttgcaagaagatgacgagaaggatgagaatatccctaagatgctgtgccagatggacaatcatctggcctgcgtaaactgcgtaaggtggtccaattcaggcatgtatctcgcatccggcggcgacgacaagctgattatggtgtggaaacgggctacgtacatcggcccatcaaccgtgttcggcagcagcggcaagctcgcaaacgtggaacagtggcggtgcgtgagcattctgcgcaaccactctggggatgttatggatgtagcctggtctccccatgatgcctggttggcgagctgttctgtggataacactgttgtcatctggaatgccgtgaagtttcctgagatcttggctaccctgagaggccactcaggactagtgaagggtttaacttgggatcctgtcgggaagtacattgcttctcaggccgacgatcgatcccttaaagtttggagaacactcgattggcagctggaaacaagtatcactaaacccttcgacgagtgtgggggaacgactcacgttttaagactaagctggagtcccgacggccattatctggtgtctgctcacgccatgaacaatagcggacctacagcccaaattatcgagcgagagggatggaagacgaatatggatttcgtcggccatagaaaagccgtgaccgtggtcaagtttaaccctaagattttcaagaagaaacagaaaaatggctcaagtgctaagccttcctgtccctactgctgctgcgcggttgggtctaaggaccgatccctgagcgtgtggctgacttgtctgaagagaccgctcgtggtgatccatgagcttttcgataagtcgatcatggacatctcgtggacactgaacggcctggggattctggtatgttccatggatggcagcgtggcctttctggatttttctcaggatgaacttggagatccacttagtgaagaggaaaagtccagaatccaccagagcacctatgggaagtctctcgccattatgactgaagcccagctcagtactgctgtcatcgagaatccagagatgctgaaataccaacgtcgacagcagcagcaacaacttgaccaaaagtccgccgcaacacgcgagatgggtagcgccaccagtgtcgcaggagtagtcaatggggagtccctggaagatatccggaaaaacctccttaagaaacaggttgaaactcgtactgccgacgggcgaagacggataactccactgtgcatagctcagctggatacaggagatttctccaccgccttctttaatagtatccccctgagcggttcacttgccgggaccatgctgtcctcccactcatccccacagctcttgcctctggacagcagcacccccaactcattcggagcaagcaagccctgcactgagccggtggtggccgcctcggcccgtcctgccggagactcggtgaacaaggactcaatgaacgctacttcaactcccgcagcgctcagccccagcgtgcttactaccccctccaagattgaacccatgaaagccttcgattctcggttcacagagcggtcaaaagccacccccggagcccctgcactgacctccatgacccctacggcagtagaaaggttgaaagagcagaatcttgtgaaggagctccgccctagagatctgctggagagcagcagcgattccgatgagaaggtgccactggccaaggccagttctctgtctaagaggaaactcgagttagaagtcgaaacagtggagaagaagaagaagggaaggcctaggaaggactccaggctgatgccagtctctctgtccgttcagtcaccagctgctctcaccgccgagaaggaagcaatgtgtttgtccgccccagccctcgccttgaagctccccatcccttccccacagagggcttttactttgcaagtgtcctcagatccttccatgtacatagaggttgaaaacgaagtgactgtggtcggaggggtcaaactctcgcggttaaagtgtaacagggaggggaaggagtgggaaactgtattaacctctcggatcttgacggcagccggcagttgtgatgtggtctgtgtcgcttgcgaaaagcggatgttatccgtgttcagcacatgcggcaggaggctgttgagtccaatcctgctgccctccccaatatcaaccctgcactgcacaggaagctatgtcatggcccttacagctgcagctactttgtctgtctgggacgtgcacaggcaggtcgtcgtcgtcaaggaagagtcgctacacagtattctggccggaagcgacatgactgttagccagattcttctcactcagcacggcattcccgtgatgaacctgtcagacggtaaagcttattgttttaacccttcactgagtacctggaatttagtatctgacaagcaggacagcctggcccaatgtgccgatttcagatccagcctgcctagtcaagacgctatgttgtgtagtgggccgctcgctattatacaaggacgcacgtccaattctgggcgccaggcagcgcgcctcttcagtgtgccccacgtggtgcaacaagaaaccacgcttgcctatttggaaaaccaggtagccgccgctcttacactacagtcctcccacgagtatcggcactggctgctcgtgtacgccaggtatctcgttaatgagggcttcgagtaccgactgcgggaaatttgtaaagacctactaggacccgttcactatagtaccggatctcagtgggagtctacagtggtggggctccggaagagagaactactgaaagagctgctcccagtaattggacagaacctgcggtttcaaagactcttcaccgaatgccaggagcagttggatatccttcgggacaagtag

SEQ ID NO: 119905 - DNA, 2421 bp, Artificial Sequence
  Description of Artificial Sequence: Synthetic coding sequence
atgtctccggtgctccaggaggacgacgagaaagacgaaaatattccaaagatgctctgccaaatggacaaccatttggcctgtgtgaattgtgttcgatggtccaattctgggatgtatcttgcaagtggcggggatgacaaactcatcatggtgtggaagcgggctacatacatcggtcctagcacagtgttcgggagcagtggcaaattggccaatgtagaacaatggagatgcgtctccattctacgtaatcacagcggggacgtaatggacgtggcctggtccccacacgacgcttggcttgccagctgcagtgtcgataacaccgtagtcatttggaatgcggtgaaatttccggaaatcttagcaacccttcgtggacacagcggactcgtgaaaggattaacatgggaccctgtcggaaaatacatagccagtcaagccgacgaccgtagtctcaaggtgtggagaactctggactggcaactagaaactagcataacgaaaccctttgatgagtgtggcggaaccacacatgtgctgagactgtcttggtcccctgacggacactacttagtaagtgcgcacgctatgaacaacagcgggccaacggcccaaatcattgaacgcgaaggctggaagaccaacatggatttcgttggtcacaggaaggccgttaccgttgttaagtttaaccccaagatcttcaaaaaaaaacagaaaaatggaagtagtgccaagccttcgtgcccatattgctgttgcgcggtaggtagcaaagaccgatctctgtctgtctggctgacttgcttgaagcggcctctggtagtgattcacgaactattcgataagtccattatggatatctcatggaccttgaatgggctcggcatcctggtctgcagtatggacggttcagtggcattcctcgacttctctcaagacgaactcggcgaccccctaagcgaagaggaaaagtctaggattcatcagagtacatacggcaagtctctggcgattatgaccgaggcgcagttgagtaccgctgtcatagagaacccagagatgctgaaatatcagaggcgacagcagcagcagcaattagaccagaaaagcgccgcgacgcgtgagatgggtagtgctacatccgtggctggcgtggttaacggtgagagcctggaggatatcaggaagaacctgctgaaaaaacaagtggagacgaggactgccgacggccgtcgtcgcatcacaccactctgtatcgcgcagttagatacaggcgatttctccacggccttcttcaattcaattcccctgagcggttccttggccggcaccatgctgagttcacactcaagcccccagctactgcccctggactcttcgacaccaaattctttcggcgcgtccaaaccgtgtactgagcccgtggtcgcggcttcagctcggcccgcgggagactcagtgaataaggactccatgaacgccacatcaacacctgcggccctgagtcccagtgtgctgaccaccccttctaaaatagagccaatgaaagctttcgacagccgcttcactgaacgctcaaaagcaacgcccggagcgcctgcactcacgtccatgacacccaccgccgtggagcggctgaaagagcaaaacctggtaaaggaacttaggcccagggatctgctggagagtagttccgatagcgacgaaaaggtgccactagccaaagcctcttctctttccaaacgcaagctggagctggaggtagaaaccgtggaaaaaaagaagaaaggccggcccaggaaggatagccggctgatgccagtctccctctccgtccagtctcctgctgcactgacagcagaaaaagaggccatgtgcctctctgcaccagcgctggctcttaagctgcccattccctcacctcagcgagccttcacattacaggtctcgtccgatccatctatgtatatcgaggtcgagaatgaggtgacagtggttgggggcgtgaagctgtctcgcctaaagtgcaaccgggaaggcaaagagtgggagacagtgttgacctcgagaatcctaacagccgccggctcttgcgacgtggtctgtgttgcgtgtgaaaagagaatgctaagtgtcttcagtacttgtggcagacgcctgctatcgcctattctgctccccagcccaatttcaaccctgcactgcacgggcagctacgtgatggcactgacagccgccgctactctttccgtgtgggatgtccacagacaagtggtggtcgtcaaggaggaatcactccattcaatcctggccgggacttggttcctgacttctcgaactcattggctgagcgttcaaaccttgggagccgcttgtcatcctcgcaccccgtgttgcgcccaagataggtag

SEQ ID NO: 119906 - DNA, 156 bp, Artificial Sequence
  Description of Artificial Sequence: Synthetic coding sequence
atggcttctagtatgagatccttattttctgaccacggaaagtacgtagagagtttccggagatttcttaatcatagcaccgagcaccagtgcatgcaggagtttatggataagaagctccccggcatcatcgggcggtatcagaactgctgttag

SEQ ID NO: 119907 - DNA, 879 bp, Artificial Sequence
  Description of Artificial Sequence: Synthetic coding sequence
atggcatcatctatgaggtctcttttttccgatcacggcaaatacgtggagtcttttaggaggttcctcaatcatagtacggaacatcaatgtatgcaggagttcatggataaaaaattgcccggaattataggaaggatcggcgacaccaagagcgaaatcaaaattctgtccatcggtggtggggccggtgagatcgacctgcagattctatctaaggtgcaggctcaatatcctggagtttgcatcaataacgaggtcgtggagcctagcgccgaacagatcgccaagtataaagagctggtggccaaaaccagcaaccttgagaacgttaaatttgcatggcataaggagacttccagtgagtaccaatcacgaatgctcgagaaaaaggagctccagaaatgggactttattcacatgatccagatgctctactacgtcaaagatatccccgcaactttgaagtttttccattccttgctcggcacaaacgctaagatgttgatcatagtagttagcggctcttccggctgggataagctgtggaagaagtatggctcccgatttcctcaggatgacttatgccagtacatcaccagcgatgatctcacacagatgttggacaatctcggcttaaagtacgagtgctatgacttgctgagtacaatggacatcagtgattgctttatagacgggaacgaaaacggcgacttactatgggactttttgacggaaacttgcaatttcaacgccacagctccgccggacctacgcgccgagctgggaaaggatctgcaggaacccgaattctccgcaaagaaggaaggcaaggtgctcttcaataatacgctgagctttatcgtgatcgaagcctag

SEQ ID NO: 119908 - DNA, 381 bp, Artificial Sequence
  Description of Artificial Sequence: Synthetic coding sequence
atggcgtcttccatgagaagtttgtttagcgaccacggcaagtacgttgaatcctttaggcgctttctgaaccattccacggagcatcagtgtatgcaagaattcatggacaaaaagctgcctggcatcatcggcaggattggcgacacaaagtccgagatcaaaatcctgtccattggcggcggagccgattgcctgatccggggaagctctcgcgttcttaaaaggaattcatgcttcattctctgttcaacaaggcagaaagacaagccagggatgcgtatacacgacgaaaggagcagcgaactgcccttcggagccgcccgcttggaatctaaaagcgcatttccgtcctttctggtgtcgttcatcctgttttag

SEQ ID NO: 119909 - DNA, 879 bp, Artificial Sequence
  Description of Artificial Sequence: Synthetic coding sequence
atggcttcttcaatgcggtcgctgttcagcgaccacggcaaatacgtcgagtcatttcggcgattcttaaaccactccaccgagcatcagtgcatgcaggaatttatggacaagaagctgccaggaatcataggcagaataggtgatacaaagtctgaaattaagatcctgtctatcggcgggggagccggcgagattgacctccagattctgagtaaagtacaagcacagtatcccggggtatgcatcaataatgaagtcgttgaaccaagcgccgagcagattgcaaagtataaagagctcgtggccaagacctctaacctcgagaacgtgaagttcgcatggcacaaggagacatctagcgagtaccagagccgcatgctggagaagaaggaattacagaaatgggattttatccacatgatacagatgctttactacgtcaaagacatcccagctaccctcaagttttttcatagtctgctgggcactaacgccaagatgctgatcatagtcgtgtccgggtcatctgggtgggataagttgtggaaaaaatatggtagtaggttccctcaggacgatctctgtcagtacattacctctgacgatctgacacagatgctagataatctgggcctcaagtatgaatgttatgacctattaagcaccatggatatttccgactgcttcattgacggtaacgagaacggcgacttgctgtgggattttctgactgaaacgtgtaacttcaatgccacggccccccccgacctgcgcgcagagctcggcaaggatctgcaggagcccgagttcagtgcaaaaaaggagggcaaggtcttgtttaacaacaccctgtccttcattgtgatcgaggcatag

SEQ ID NO: 119910 - DNA, 1464 bp, Artificial Sequence
  Description of Artificial Sequence: Synthetic coding sequence
atgtccttgccgaattcatcttgtcttctggaggacaaaatgtgcgagggaaacaaaaccacgatggccagcccccagctcatgccactggtggtcgtattatccacgatatgcctggtgactgtggggcttaacctgctcgtgctgtacgcagtgcggtccgagcgtaagctccataccgtgggaaacctgtacatagtgtccctatccgtcgccgatctgattgtgggtgccgtcgtgatgccaatgaacattctctatctgctgatgagcaaatggtcccttggaagaccattgtgcttattttggttgagcatggactatgtggcttccactgcttcaattttctccgtatttatactgtgtatcgatcgttataggtccgtgcagcaaccactgagatacctcaagtaccgaacgaaaacccgagcttcagctaccatcctcggagcctggtttctgtcttttctctgggtgatcccgatattgggctggaatcacttcatgcagcagacttcagttcggcgcgaagacaaatgcgaaaccgacttttacgatgttacgtggtttaaggttatgacagctatcataaacttctatctccccactctcctcatgctgtggttctacgctaagatttacaaagctgtcaggcagcactgccagcaccgggagcttatcaacaggagcctccccagctttagcgagattaaattgagaccagagaatccaaagggcgatgccaagaagcctgggaaagagtctccatgggaggtactcaagcgcaaaccaaaggatgctgggggggggtccgtgcttaaaagcccttcgcagactccaaaggagatgaaatcacccgttgtgttctcccaagaagacgacagggaggtggacaagttgtactgctttcctcttgacatcgttcatatgcaggcggccgccgaagggtcttctcgtgattatgtggccgttaacaggtcccacggacagctgaagaccgatgagcagggcttgaatacacacggagcctcagagatcagcgaggatcaaatgcttggcgattcgcaatccttttcgagaacagacagtgacaccaccacggaaaccgctcccggaaagggtaagctaaggtcagggtcaaatacgggtctagattatatcaagttcacctggaaacggcttaggagtcacagtcgccagtatgtatctgggctgcatatgaaccgtgagcggaaagctgccaaacagctcggcttcatcatggcagcttttattctgtgctggataccgtatttcatattctttatggtcatagccttttgtaagaactgctgtaatgaacacctgcatatgttcactatttggcttggctacataaattccaccctgaatcctttaatatatccgctttgtaatgagaattttaaaaagactttcaagcgtatattgcacattcgaagctag

SEQ ID NO: 119911 - DNA, 39 bp, Artificial Sequence
  Description of Artificial Sequence: Synthetic coding sequence
atgtccttgccaaattcgagctgcctgctggaagactag

SEQ ID NO: 119912 - DNA, 1464 bp, Artificial Sequence
  Description of Artificial Sequence: Synthetic coding sequence
atgtcactgccaaattcaagttgtctccttgaagataagatgtgcgagggaaataagaccaccatggcatccccccagctaatgccgttggtagtggtgcttagtacaatttgcttagtcaccgttgggcttaacctgctagtgctctatgccgtgcgcagtgagcgcaagctacacaccgtcggcaacctgtacattgtctccttgagtgtcgccgatctgatcgtaggcgcagtcgtgatgcccatgaacattctgtacctgctgatgtctaaatggtcactggggcgtccactgtgccttttctggctgagtatggactatgtggctagtaccgcctctattttttctgtgttcatcctttgtattgacagatataggagtgtccaacaaccactgcgctaccttaagtatcgtaccaaaactcgggcctcagctaccatcctgggcgcatggttcctcagcttcctatgggtgatccctatccttggctggaaccatttcatgcaacagacttccgtgaggcgagaggataaatgcgaaaccgacttctatgacgtaacttggtttaaagtgatgacggccataataaatttctatctgcccaccctcttaatgttatggttttacgccaagatctataaagctgtgcggcaacattgccaacatcgggaattgataaatcggtccctgcccagcttcagcgagatcaagctgcgcccagagaacccaaaaggagacgctaagaaacctggcaaagagtctccttgggaagtgcttaagaggaaacctaaggatgcaggtggcgggtccgtactcaagagccccagccaaacacccaaggagatgaagtcaccggtcgtattttcccaagaggacgacagggaggttgataagctctattgtttcccgttggatatagtgcatatgcaggccgcagcagagggaagcagccgagactacgtggccgttaataggtcccatggccagcttaagaccgatgagcaaggactgaacactcacggagctagcgaaattagcgaagaccaaatgttgggcgatagccagtcattcagtcggacggattcagatacaactacagaaactgctccaggaaaaggaaaacttcgctccgggagcaacaccgggttggattatataaaatttacctggaagagactgcggagccacagtagacagtacgtatccggactacatatgaatcgggaaagaaaagctgctaagcagcttggatttatcatggcagccttcattttatgctggattccatacttcatcttcttcatggtgatcgcattctgcaagaactgttgcaatgagcacctgcatatgtttacaatttggctggggtatatcaacagcaccctaaacccgttaatctaccccttgtgcaacgagaacttcaaaaagacttttaaacggatcctccacatccgctcttag

SEQ ID NO: 119913 - DNA, 1464 bp, Artificial Sequence
  Description of Artificial Sequence: Synthetic coding sequence
atgtccttgcccaactcctcatgtctgctcgaagacaagatgtgcgagggcaataaaactaccatggcttctcctcaactcatgccattggtggtagttctgagcaccatctgtctggtcacggtgggcctcaatttacttgtgctgtacgctgtcagaagtgagagaaagttacacaccgtgggcaatctttatatagtgagtctgtctgttgctgacctgatcgtcggcgcagtcgtcatgcccatgaacatcctgtatctcctcatgtcgaagtggtctctggggcgccctctgtgtctgttctggttatctatggattacgtagcctctaccgcctcgatcttctcagtctttattctctgcatcgatagataccgcagtgtacagcagccacttcgttacctaaaataccgaacgaaaacacgtgcaagcgccactatcctgggtgcctggttccttagcttcctgtgggtgattcctatcctcggttggaatcatttcatgcagcagacaagcgtgcgccgggaggataagtgcgaaaccgatttttatgacgtaacatggttcaaagttatgacggccattattaacttttatctgccaactcttctcatgttgtggttctatgccaagatctacaaggcagtgcgacagcactgccagcaccgggaactgattaacaggtcccttccttctttctccgagatcaaattgcgacctgaaaacccaaagggcgatgctaaaaagccaggcaaggagagcccctgggaagtcttaaagaggaagcctaaggacgcgggcggaggcagcgtgctaaaatcacccagtcagacaccaaaggagatgaaatctccagtggtattttcccaggaggatgaccgtgaagtggacaagttgtactgctttccactcgatatagttcacatgcaggccgctgctgaggggagctctcgcgactacgttgcagtgaaccggagccacggacaactgaaaactgacgagcaggggctgaacactcacggggcatccgagatatcagaagatcagatgctcggggattcccagtcgttcagccggactgattcggatacaaccaccgagaccgcccctggtaagggaaagttaagatcagggagcaacacagggctggactacatcaagttcacatggaagcgcttgaggagtcatagccggcaatacgtttccggtttgcacatgaatcgggagcggaaggccgccaaacaactcggcttcattatggcggccttcatcctgtgctggatcccatattttatattttttatggtgattgcattctgtaaaaactgctgcaatgaacatcttcacatgtttaccatctggttgggctatatcaactctacactcaatcctctgatatacccgctgtgcaatgagaattttaaaaaaacttttaagcgcatattgcacatcaggagttag

SEQ ID NO: 119914 - DNA, 816 bp, Artificial Sequence
  Description of Artificial Sequence: Synthetic coding sequence
atggccgcccctcaagacgtccacgtgagaatatgtaaccaggagatcgtgaagtttgatttagaagtgaaagctctgatccaggacatccgggactgctctggtccactcagcgctctcacagagctgaatactaaggtgaaagagaagttccagcagctgcgccataggattcagcctgttctttatcaacgggctttcatctggactgctagtacctttttcttcaagcttacgtatagtttgactgatttctctagcacgcagcatgactttaactcccccaccacacctgtaaccttctcagacctggaacagctggctaaggaacaggacaaggagtccgagaaacagctcttactgcaggaggtcgagaaccacaagaagcagatgctgagtaatcaggcttcatggagaaaggccaacctgacctgcaagatagctatcgataatctggagaaagctgaactgctgcaggggggagatctactaaggcagaggaagactacaaaggagtccctggctcagacctctagcaccattactgaatcgttgatggggatctcgagaatgatggcccagcaagtgcagcagagcgaagaagcgatgcagagtctagtcaccagctcccgaactatcctcgatgccaacgaggagtttaagtccatgtctggtacgatacaattgggcaggaagctgattaccaagtacaatcgccgagagctcacagacaagcttctgatatttctggctctggctctctttctggccacagtcctctatattgtcaaaaagcggttgttcccctttctgtag

SEQ ID NO: 119915 - DNA, 1194 bp, Artificial Sequence
  Description of Artificial Sequence: Synthetic coding sequence
atggctcccaatgggactgcgtcttccttctgcctggatagtacagcctgcaaaattactatcacagttgtcttggccgtgctgatccttatcaccgtggctggaaatgtggtggtttgtcttgctgttggtctaaacagaagactccggaacctcaccaactgcttcatcgtcagtctagcaattacagaccttctgttaggtctgctagtgctgccttttagcgcaatttaccagctgtcttgcaagtggagcttcggaaaggtgttctgtaacatttatacatcactcgatgtcatgctctgcacggcaagtatcctgaacctcttcatgatttccttagaccggtactgcgccgtcatggatccactgagataccccgtgctcgtcacccctgttagagtggctataagtctcgtgcttatatgggtgatcagtataaccctctcgttcctgagtattcacttgggctggaatagccggaacgaaactagcaagggaaatcacacaacatctaagtgcaaagtgcaggttaacgaagtctacggattagtggatggccttgtgaccttctatttaccactgctgatcatgtgcataacatattaccgcatattcaaagtggccagagaccaggcaaaaaggatcaaccatattagcagctggaaggccgctactatccgtgagcataaggccacagttacactggccgcggtgatgggcgcctttattatctgttggtttccttatttcaccgcgtttgtgtacagagggttacgcggcgacgatgccataaatgaggttcttgaagccatcgtactctggcttggctacgcaaattccgccctgaatcctattttgtacgccgctttaaacagagattttcgtactgggtaccaacagctgttttgctgtagattagccaaccggaattctcacaagacttcccttaggtccaatgcatcccagctgagcagaactcagagtagagagcctagacagcaggaagagaagccgttaaaactccaggtctggtctgggactgaggtcacagccccgcagggggcgaccgatcggccttggttatgcctcccagaatgctggagcgtcgaactaacccattcttttattcatttgtttatccacagctttgccaatattcatcccatacccacaacctgccaggagttgtag

SEQ ID NO: 119916 - DNA, 1173 bp, Artificial Sequence
  Description of Artificial Sequence: Synthetic coding sequence
atgcctgacaccaacagcaccatcaatctctcactgtcaacccgcgttacgctggcattttttatgagtctagtagcgttcgccataatgctgggcaatgcccttgtcattctcgcttttgtagtggataagaatttgcgacatagaagctcttacttcttcctgaacctcgcgatttccgatttctttgtgggggtaatctccattcccctatatatccctcacacgctgttcgagtgggacttcggaaaggagatctgcgtcttctggctgaccactgactacctgctgtgcacggcaagcgtgtacaacattgtgctcatctcgtacgatcggtatctgtcagtctctaacgccgttagctaccgaacacagcatacgggggtgttgaaaatcgtgactctcatggttgccgtgtgggttctcgcatttctcgtgaacgggccaatgatactcgtcagcgagagttggaaggacgaaggctctgagtgtgaacccgggtttttctccgagtggtacattctggccattacatcctttctcgagttcgttatccctgtcatcctggttgcctactttaatatgaacatttactggtcactgtggaagagagaccacctcagccgatgtcaatcgcatccagggcttaccgctgttagctccaacatctgtggacactcttttcggggacgcctttctagtcggcgatcactgagcgcctcaactgaggttcctgcttcttttcatagcgaacgacagcgacggaagtcttcgctaatgttctcatctcggactaagatgaactcaaataccattgcatccaaaatgggaagcttctcccagtccgattctgtggcactccatcagcgggaacacgtggaactgctcagagctcgacggcttgccaagagtctcgctattctcctcggtgtgttcgctgtttgttgggctccttacagccttttcacaatcgtgcttagcttttattccagtgcgacaggcccaaagtccgtctggtaccgcatagccttctggctccagtggttcaatagctttgtgaaccccctcctgtatcctctgtgtcataaaagattccagaaagcatttctcaaaatcttttgcattaagaagcaacccctcccgagtcagcattcccgttccgtcagctcttag

SEQ ID NO: 119917 - DNA, 909 bp, Artificial Sequence
  Description of Artificial Sequence: Synthetic coding sequence
atgcccgacacaaattctaccatcaatctgagcctgagtacaagagtcactctcgcattttttatgtccttggtggccttcgctatcatgctcggtaacgcactggttattctggcattcgttgtggacaagaatctgcgacatagatcaagttacttcttcctgaacctggccataagcgatttctttgtcgtaagcgagtcttggaaggacgagggatcagagtgtgaacccggatttttttccgagtggtacattctcgctattactagttttctggagtttgttattccagtgatcctcgtggcctattttaacatgaatatttactggtctctttggaagcgggatcacttatctaggtgtcagtcccatcccgggcttacagcagtttcctcaaacatctgcggacacagcttcaggggcagactgtcctctcgccgatctctaagtgctagtaccgaggtgccagccagcttccattccgaaagacagaggagaaagtcaagtctgatgttcagctctagaacgaagatgaatagtaatacgatagcttcaaaaatggggagttttagtcaatcagacagcgtagccctgcaccaacgtgagcacgtcgagctgctgcgagctcggcgactggcaaaatctctcgcaatcctgctgggcgtgtttgcagtctgctgggccccctattcactttttaccatagtgctttcgttctactctagcgcgaccggaccgaagtcggtgtggtatcgtatcgcgttctggctccaatggttcaatagctttgtgaaccctctgctgtaccctctctgccacaagagattccagaaggctttcctaaagatattctgcattaaaaagcagcctctcccaagtcagcactcccgttctgtaagttcctag

SEQ ID NO: 119918 - DNA, 174 bp, Artificial Sequence
  Description of Artificial Sequence: Synthetic coding sequence
atgaagttctttgtcttcgccctagtcctggcattgatgatctccatgatctctgccgatagccacgaaaagcggcatcacggctataggagaaagtttcatgagaagcaccatagccaccgggaattccccttttatggtgattacggctccaactacctttacgacaattag

SEQ ID NO: 119919 - DNA, 174 bp, Artificial Sequence
  Description of Artificial Sequence: Synthetic coding sequence
atgaaattctttgtcttcgcgctggtgcttgccctgatgatttctatgatctcagcagattcccacgaaaagcgtcaccacggttaccgccgaaaattccatgaaaaacaccactctcatcgagagtttcctttttatggggattacggatctaactacttgtacgataattag

SEQ ID NO: 119920 - DNA, 156 bp, Artificial Sequence
  Description of Artificial Sequence: Synthetic coding sequence
atgaagtttttcgtattcgcccttatccttgcgctcatgctctctatgaccggagccgacagccacgcgaaaaggcaccatggctacaagcgaaagttccatgagaagcatcacagtcaccgaggatacagatccaactacctctacgacaattag

SEQ ID NO: 119921 - DNA, 156 bp, Artificial Sequence
  Description of Artificial Sequence: Synthetic coding sequence
atgaagttctttgtgtttgccttaattctcgctttgatgctgtccatgacaggcgccgactctcacgccaagcggcaccacggatataaaaggaaattccacgagaaacatcatagtcatcgcggctaccgatcaaactacctttacgacaactag

SEQ ID NO: 119922 - DNA, 1989 bp, Artificial Sequence
  Description of Artificial Sequence: Synthetic coding sequence
atgatggaaccagaggagtaccgagagcggggcagggaaatggtggactacatatgccagtatctgtccaccgtacgcgagcggcgggtgacgcctgacgtgcagccaggatacctgcgggcccagttgcctgaatcagcccctgaagatccagactcttgggattccatatttggcgacattgagcgaatcatcatgcctggtgttgtgcattggcagtccccccacatgcatgcttattaccctgctttgacatcttggcctagtctgttgggcgacatgctggccgatgccattaattgtctcggatttacctgggcctctagtcccgcatgcaccgaactcgagatgaacgtgatggactggctggccaagatgctggggcttcccgaacactttctacaccaccacccaagctctcaaggaggcggagtactccaatcaacagtgtcagaatcgactctgatcgccttgctcgcagcccgcaagaacaaaatccttgagatgaaaacttctgagccggacgctgatgagtcatgtctgaatgcccgcctcgtggcctatgcttcggaccaagctcacagttcagtggagaaagctggactgatttccctggtaaagatgaagtttctaccagtggacgataacttcagtctcagaggcgaagccctgcagaaggctatcgaggaggacaaacagcggggactggttcctgtgtttgtctgcgctactctgggaacaacaggagtgtgcgcctttgactgtctgtccgaactggggccaatttgtgctcgggagggattatggctgcacatagacgcagcttacgccggcactgcttttctctgccccgagtttagaggatttctgaagggcatcgaatacgctgattcctttaccttcaatccttcaaagtggatgatggtgcatttcgactgcactggtttttgggttaaggataagtataagcttcaacagacctttagcgttaacccaatctacctacggcacgccaattcgggcgtagccactgactttatgcactggcagattcctcttagtcgccgtttccgttctgtgaagctttggttcgtgatccgctcattcggtgttaagaatctgcaggcacacgttaggcacgggacggaaatggctaaatactttgagtctctagtccgaaacgacccttcatttgaaatccctgccaagcgacatctcggactggtggtatttcgcctgaagggacccaattgtctcaccgagaacgttttgaaggaaatagccaaggccgggcgcctgtttttgatccccgcaactattcaggacaaactgattatccgatttacagtcacgtcacagtttaccaccagagatgacattctgagagattggaatttgatacgggacgcagcaaccctcatcctttcccagcactgtacaagtcagccatctccccgggtgggcaacctcatctctcagatccgaggggcaagggcttgggcttgtgggacaagcctgcaatccgtctccggagcgggtgacgatcccgtccaggcgaggaagatcatcaaacagccccagagagtgggcgctggaccaatgaagcgggagaatggactgcaccttgagaccctcttggatcccgtcgacgactgcttctcggaggaagctcctgacgcgacaaaacacaaattaagcagcttcctgttttcatatctcagcgtccagactaaaaaaaagactgtgaggagcttatcatgtaacagtgtacctgtttctgcccaaaagccgcttccaaccgaggcctctgtgaaaaacggcggctccagcagagttcgcatcttttctaggtttcccgaagatatgatgatgctgaaaaagtcagcattcaaaaagctgatcaagttctactctgtgcccagcttccctgagtgttcatcacagtgcggtttgcagctgccatgttgccctctgcaggccatggtgtag

SEQ ID NO: 119923 - DNA, 2100 bp, Artificial Sequence
  Description of Artificial Sequence: Synthetic coding sequence
atgggccaccacagaccctggctgcatgcttcagtgctgtgggctggggtggcgtcactcttgctgcccccagctatgacgcaacagttaagaggagacggcctgggatttagaaaccgcaacaactcaacaggcgtggcaggacttagtgaggaggctagcgctgagctgcggcatcacttgcacagccctcgcgatcacccggacgagaataaggacgtgagtactgagaacggccaccacttctggtcccatccagacagggagaaggaagatgaggacgtaagcaaggagtacgggcacctgctgcccggacaccgctcccaagaccacaaagtgggagacgagggcgtttcaggggaggaggtcttcgccgagcacggaggccaggctaggggccatagaggccatggatccgaggacactgaggatagtgctgagcacagacaccatctgccaagccatcggagccactcccaccaggacgaagacgaagacgaggtggtgagctctgagcatcatcatcatatactgcgccatggccaccgcgggcacgacggcgaggacgatgagggcgaggaggaggaggaagaggaagaagaggaggaagaagcctctaccgaatacggccatcaggcgcaccgccatcggggccacggaagtgaggaagatgaagatgtgtccgacgggcaccaccaccatggaccttctcacagacatcaaggtcatgaagaagacgacgacgatgacgacgacgatgatgacgatgatgatgacgacgacgtcagtattgagtaccgccatcaagcccatagacaccagggtcacgggatagaggaggacgaagacgtgagtgacgggcatcaccatagggatccctcgcaccggcacagatcacatgaggaggacgataatgacgacgacgatgtctccacggagtatgggcatcaggctcatcggcaccaagaccatcgcaaagaagaggtggaggctgtatccggagagcaccatcaccatgttccagatcatcgacatcagggtcaccgggatgaggaggaggatgaggatgtttccacagagagatggcaccagggtccccagcacgttcaccacgggctggtcgatgaggaggaagaagaggaagaaattacagttcaattcggtcactacgttgcctctcaccagcccaggggccacaagtccgacgaagaagactttcaagatgaatacaagactgaagttcctcaccaccaccaccatcgcgtgccccgggaagaggacgaagaggtcagcgccgaactcggacaccaggctcctagccacaggcagtcccatcaagacgaagaaaccggccatgggcagaggggcagcatcaaggaaatgagtcaccatcccccaggtcatactgtcgtaaaggaccgcagccaccttaggaaagacgattcggaagaagaaaaggagaaggaggaagatccgggatctcacgaagaggacgacgaatctagcgagcagggcgagaaggggactcaccacggatcccgggaccaggaagacgaggaagacgaagaagagggacacggcttatcccttaatcaggaggaagaggaagaagaggataaagaagaagaggaggaggaggaagatgaggaacgaagggaggagcgtgcggaggtcggtgctcccctgtcccctgaccacagtgaggaagaagaagaggaggaggagggtttggaggaagacgagccaaggttcacgatcatcccaaatccattagatcgtagggaagaagccggcggagcgtccagcgaagaggaatctggcgaggataccggtccacaggacgcacaggaatatgggaactaccaaccgggatccctctgcggctactgctctttttgtaatcgatgtactgagtgtgaatcttgccattgcgacgaggaaaatatgggagaacattgtgatcagtgtcagcactgccaattctgttatctttgtccgctggtgtgtgaaacggtgtgcgccccgggctcctacgtagattacttctcttcttccctgtaccaggccctagccgacatgctggaaacccctgaaccatag

SEQ ID NO: 119924 - DNA, 1170 bp, Artificial Sequence
  Description of Artificial Sequence: Synthetic coding sequence
gaagatgacaatgatgatgacgacgtaagcaccgaatacggccatcaagctcacagacaccaagaccatcggaaggaggaggtcgaggccgtcagtggagagcaccatcaccacgtgcccgaccatcgacaccagggacacagggacgaggaagaggacgaagatgtgtctacagaacgctggcaccagggacctcagcacgtgcaccacggcttggttgatgaggaagaagaggaagaggagatcaccgtccagttcgggcactacgttgcctcccaccagcccagaggccataagagtgacgaggaagactttcaggacgagtataagacggaagtccctcatcatcatcaccacagggtgccgcgggaggaagacgaagaggtatcggcggagctgggacaccaagccccatcacacaggcaatcacaccaagacgaggaaaccggacatggtcagcgcgggtccataaaggagatgagtcaccacccccctggccatacagtggtaaaagaccgttcccacctacgaaaggacgatagtgaagaggagaaggaaaaggaggaagatcctggatcccacgaggaggacgatgagtcatcagagcagggcgagaagggtacacatcacggatcgagggaccaggaagacgaggaagatgaagaggagggccacgggctgtctctaaatcaagaagaagaagaggaggaagatgaagagagacgagaagagcgagctgaggtcggagccccactgagtccagaccatagcgaagaggaggaggaggaggaggagggtctggaagaagacgagccgcgttttactatcatacccaatccgcttgacagacgcgaagaggccggaggtgcaagcagcgaggaagaaagcggtgaggacaccggtccacaggacgctcaagagtatggcaattaccagcccgggtctttgtgtggatactgcagcttttgcaataggtgtacagagtgcgaaagctgtcactgcgatgaagaaaatatgggcgagcattgcgatcagtgccagcattgccaattctgttacctttgccccctggtatgcgaaaccgtttgcgcacctggctcttacgtggattatttcagcagctcgctatatcaggccctggcagacatgctggaaactccggagccctag

SEQ ID NO: 119925 - DNA, 1365 bp, Artificial Sequence
  Description of Artificial Sequence: Synthetic coding sequence
atggggcatcaccggccgtggctgcatgcttcagttctgtgggccggagttgctagcttgctgttgcccccagctatgacacagcagctgaggggcgacggactgggcttccggaatagaaataaggatgtgtcaactgagaatgggcatcacttttggtctcaccctgatagagaaaaggaggatgaagacgtgtccaaggagtatggccacctactcccaggacacaggtcccaggaccacaaagtaggtgatgagggtgtgtcaggtgaggaggtctttgccgaacatggcggccaggcacgcgggcaccgtgggcacgggtctgaagacacagaagattccgcagagcacagacatcacctgccttcccaccggagccattctcaccaagatgaggacgaagacgaggtggttagctccgagcaccatcaccacatcctaagacacggccacagaggacacgatggcgaggacgatgaaggagaggaagaggaggaggaggaagaggaggaggaagaggcatcaactgagtatggacatcaagcgcatagacatcgggggcacgggtctgaggaagacgaagacgtgtctgacgggcaccaccaccacggtccttcacacagacaccagggccacgaggaagacgacgatgacgacgacgacgacgacgacgacgacgacgatgatgacgtcagcatcgagtaccgtcatcaggcacataggcaccagggccacggcattgaagaggatgaagatgtctctgatggacaccatcaccgcgacccctctcaccggcataggtcacatgaagaggacgacaatgatgacgacgacgtctcaactgaatacggtcaccaagcccacagacatcaggaccaccgcaaggaggaagtcgaggccgtgtctggggagcaccaccatcacgttcctgatcacagacaccaagggcaccgggacgaagaagaggacgaggatgtctccacagaaagatggcatcagggacctcagcacgtgcaccacggcctagtcgacgaggaggaggaggaggaggagatcactgtccagttcggtcactatgtggcctctcaccagcctcgggggcataaatccgacgaggaggattttcaggacgagtacaagactgaggtccctcaccaccaccatcacagagttcctcgagaagaggatgaggaagtgtctgccgaacttggacatcaagcacctagccacagacagtcgcaccaggacgaagaaaccgggcacggtcagcggggaagcataaaagaaatgagtcaccatccccctggccacacagtcgtcaaagatcggagccacctgagaaaggatgactccgaagagtag

SEQ ID NO: 119926 - DNA, 381 bp, Artificial Sequence
  Description of Artificial Sequence: Synthetic coding sequence
atggctgacgaaatagctaaggctcaggtagcacgacccgggggggatacgatcttcggcaagatcatcagaaaagagattccggccaagatcatcttcgaggatgatcgctgcctcgcattccatgacatctcacctcaggcccctacccacttcttggttattccaaagaaacacattagccagataagcgtagctgaggatgatgacgagagtctgttggggcatctgatgatagtgggaaaaaaatgcgcagccgacctgggtctcaacaaaggataccggatggtcgtaaatgagggttccgacgggggccagtctgtgtaccatgtgcacttacatgtcctgggcggcaggcagatgcattggcctcccggctag

SEQ ID NO: 119927 - DNA, 492 bp, Artificial Sequence
  Description of Artificial Sequence: Synthetic coding sequence
atggcggctgcggttgtgctggctgccggactccgggctgctcggcgagccgtggccgcgaccggggttagaggcggacaagtccggggggccgcgggagtgacagacgggaacgaagtggctaaggctcagcaggccactcccggtggggccgcccctacaatcttctcccggatcctggataaatccctccctgccgatatcctctacgaggaccagcaatgtctggtctttcgtgatgtcgcgccccaggccccagtgcacttcctggtgataccgaaaaagcctattcctagaatttcgcaggccgaagaggaggaccagcagctgctgggccatttgctactggttgctaaacagacagctaaagcagaaggcctgggagatggctaccgcctagtgattaacgacggaaagcttggggcccaaagtgtgtatcatttacacatccacgtgctcggaggtagacagttgcagtggcccccgggctag

SEQ ID NO: 119928 - DNA, 615 bp, Artificial Sequence
  Description of Artificial Sequence: Synthetic coding sequence
atggctaaagtacaagtgaacaacgtggtggtgctggacaacccgtctcccttctacaatcctttccaattcgagatcaccttcgaatgcatcgaggacctaagcgaagacctggagtggaagatcatctacgttgggtctgcagagagtgaagagtacgaccaggtgctcgacagcgttttagtcggtcccgtgccggccggccgccacatgttcgtgtttcaggctgacgctcccaatcctgggctgatccccgacgctgacgctgtgggggtgaccgtagtgctcattacctgcacttaccgggggcaggaattcattcgcgtggggtattacgtcaataatgagtacaccgaaactgaactacgcgagaaccccccagttaaacctgacttttctaaattacagcgaaacattttagcaagtaatcccagagttaccaggtttcacatcaattgggaagataacactgaaaagttggaggacgcagaaagtagcaatcccaacctgcagtccctgctttccacggacgccttgccgagcgcttcaaaaggatggtccacttctgagaactcccttaacgttatgctggagagtcacatggattgtatgtag

SEQ ID NO: 119929 - DNA, 1329 bp, Artificial Sequence
  Description of Artificial Sequence: Synthetic coding sequence
atggcaggcgaaggcgaccagcaggacgctgcccacaacatgggcaatcacctcccgctccttccagctgagtccgaagaagaggatgagatggaggtggaggaccaggatagtaaggaggcaaagaaacccaacattatcaactttgataccagtctgcccacctctcacacctacctgggagccgacatggaggaattccacggtaggactcttcacgacgatgatagttgtcaggtgatcccagttttgccccaggtgatgatgatcctgatacccgggcagaccctgccactccaattatttcaccctcaagaggtgtctatggtgcggaacctgatccagaaggatcgaacatttgctgttcttgcatactctaatgttcaggagagagaagcccagttcgggacaactgctgaaatttatgcgtaccgagaggaacaggattttggaatagaaatcgtgaaggtcaaggctattggccgtcaacgattcaaagtgcttgagcttcgaacccagagcgacggaatccagcaagcaaaggttcagatcctccctgagtgcgttttaccgagcacaatgagcgcggtgcagctggaaagcctgaataagtgccagatttttcctagtaaaccagtgagtagggaggaccaatgttcttacaagtggtggcaaaagtatcagaagcgaaagttccactgtgcgaatttaacatcatggcctaggtggttgtatagcctctatgacgcagaaacattgatggacagaattaagaaacaactgagggaatgggatgagaatttgaaggatgattccttaccgtctaaccccattgacttctcataccgagttgctgcatgtctcccaatcgacgacgtacttagaatccagctcctgaagattggttctgcaatccagcgtctgagatgtgaactggatattatgaacaaatgcacctctctatgttgtaagcagtgccaggagacagagatcaccacaaaaaacgagatcttttccctgagcctgtgcggtccaatggctgcctatgtcaatccccacggatatgttcacgaaaccctgacggtgtacaaggcatgtaatctcaacttgataggcaggccgagcaccgaacactcatggtttcctggatacgcatggaccgtggcacagtgcaagatttgtgccagccacatcggatggaaattcacagctactaagaaagatatgtcaccccagaagttttggggcctcacacgctcggcccttttacccaccatccccgatactgaggacgagatctcacccgacaaagtaatcctttgtttgtag

SEQ ID NO: 119930 - DNA, 1308 bp, Artificial Sequence
  Description of Artificial Sequence: Synthetic coding sequence
atggctgaacgcgcagcacttgaagaactggtgaagctgcagggtgaaagggttaggggtctaaagcagcaaaaggcaagtgccgaacttatcgaggaagaagttgcaaagcttctgaagttgaaagcacagcttgggcctgatgagtccaaacagaaatttgtgcttaagacgcccaagggaacacgcgattattccccaagacagatggccgtccgagagaaggtgttcgacgtgatcattagatgtttcaaaaggcacggcgccgaagttatcgatacgcccgtgttcgagctgaaggatttcgacatcgccggtaactttgatcccatgataccagatgctgagtgcctgaaaatcatgtgcgagatcctgtcctcactgcagatcggcgattttctggttaaagtcaatgatcgcaggatacttgacgggatgttcgccatttgcggcgtgtctgattctaagtttcgtactatctgctcttccgtggataagttggacaaagtgtcttgggaggaggtgaaaaacgagatggttggggagaaagggctggcacctgaagtagcggacaggataggcgactacgttcagcagcacggcggcgtgtccttggtggagcagctgctgcaggacccgaagctgagccagaataagcaggccctggagggattgggggatttgaaactgttatttgagtatctcactttattcggaatcgacgataagatcagttttgacctttctctggcccgtggactggattactacaccggagtaatttacgaggccgtactgctgcaaacacctgcccaggccggggaagagcccttgggggtcgggagtgtggctgccggcgggcggtacgatggccttgtcggcatgtttgacccaaagggtagaaaagtgccttgcgtgggtctgtccatcggggtagagcgtattttctcgatagtcgagcagaggttggaggccctagaggaaaagatacgaacaaccgagacccaagtgctggtggcttccgctcagaaaaaactgctggaggaacgtcttaagcttgtcagtgagttatgggatgccggaattaaggctgagctgctctataagaagaatccaaaactactgaatcaattgcagtattgtgaagaagccgggatcccactggttgccatcatcggggagcaagagctcaaagacggagttatcaagctgaggagcgtgacctctcgcgaggaggtggacgttcggcgagaggacttggtggaagaaatcaagcgtcggactggacagcccctttgtatttgctag

SEQ ID NO: 119931 - DNA, 1188 bp, Artificial Sequence
  Description of Artificial Sequence: Synthetic coding sequence
atggcagagcgcgcagcattagaggagctggtgaagttgcagggcgagagagtgcggggccttaagcagcagaaggcatccgccgagctgatcgaggaagaggtggccaagctgctgaagttgaaggcccaactgggtcccgacgagtccaagcaaaagtttgtgctgaagacaccaaaagatttcgacatagctggcaacttcgaccccatgattcccgacgctgagtgcttaaaaatcatgtgcgagattctttcaagcttacaaattggcgattttctggtgaaggtgaatgacaggcgaatccttgatgggatgtttgctatctgcggcgtgtctgattccaaattccggaccatttgcagctccgtggacaaactggacaaggtctcatgggaagaggtgaagaacgaaatggtaggggagaagggactagcgcctgaggttgccgaccgtattggtgattatgtacagcagcacgggggagtttcactggtggagcagctactgcaagatccaaagctatcgcagaataagcaagcccttgaaggtctgggagatctaaagttgcttttcgaatatttgactctttttgggattgacgataagattagcttcgatttgtccttggcaagagggctggattactacacaggcgtgatctacgaagctgtcctgctccagacgcccgcccaagccggagaggagcccttgggcgtgggctcagtggccgctggggggagatacgatgggctggtgggaatgttcgatccgaagggccgtaaagtgccctgtgtgggtctgagtattggcgtagagaggattttttctatcgtggagcagcgtctggaggccttggaggaaaagattcggacaaccgaaacccaggtgctggtggcttcagcgcagaaaaaacttctggaagagcgcctgaaactggtctccgaactatgggacgccggcatcaaagctgagctgctgtacaaaaagaaccctaagctgctgaatcagctgcagtattgtgaagaggcaggtatcccgctggttgctataatcggcgaacaggagctaaaggacggagtcattaagctccgatcggtgacatcccgcgaagaggtggacgtacggagggaggacctggtggaggagatcaaacggcgtactggacagccactctgcatttgctag

SEQ ID NO: 119932 - DNA, 1410 bp, Artificial Sequence
  Description of Artificial Sequence: Synthetic coding sequence
atggctgagcgggctgccctagaagagctagttaaactgcaaggcgagagagtacgtggtctgaagcagcaaaaagcatcagccgagctgatagaagaggaggtcgccaagctcctcaaactcaaggcccagttggggccagatgagtctaagcaaaaatttgtgctcaaaacacccaaggagacactaatgggcaaatatggagaggattctaagttaatctatgacctgaaagatcagggcggggaactgctatctctgagatacgatttgactgttcctttcgcacgctaccttgccatgaacaagctgactaatatcaaacgatatcacatcgcaaaggtgtatcgtagagacaaccctgccatgacccggggaagataccgggagttctatcaatgtgactttgacattgcgggcaacttcgaccccatgatcccagacgctgaatgtctgaaaatcatgtgtgagatactatccagcctgcagatcggggactttctggtgaaggtgaatgatcgtaggatcctggacgggatgtttgccatctgcggtgtatccgattccaagttccggaccatttgttcttctgttgacaagcttgataaagtttcatgggaggaggtgaagaatgaaatggtgggagagaagggtttggccccagaagtagcagaccgaatcggagattacgtgcagcagcacggtggcgtttctctggtcgagcagttgcttcaagatcctaagttgtcccagaacaagcaggcgcttgaagggctgggggatctgaagctcctgtttgaatacctgacccttttcggcatcgatgataagatcagcttcgacctgtcgctagcacggggcctcgactactacaccggggtcatttacgaagcagtccttttacagacaccagcgcaggctggcgaagagcctttgggggttggcagtgtggcagccggcggaaggtacgacggactcgtgggaatgtttgaccccaaaggccggaaggtgccatgcgtgggtctttccatcggagtggaacgcattttctctatcgtggagcagcgtttggaagctttagaagaaaagattagaaccaccgaaacccaagtactcgtggccagcgcccagaagaagttgttggaagagcggctcaaactggtatcagaactatgggatgctggcattaaagccgagctgctgtacaaaaagaacccaaaacttctgaatcagctgcaatactgtgaggaggcagggatccccctcgtggccatcattggcgagcaggagttaaaggacggggttattaagctgagaagtgtcacttctagggaagaagtggatgtgcgcagagaagacctggtggaggagatcaaacgacgcacaggccagcccctctgtatctgctag

SEQ ID NO: 119933 - DNA, 945 bp, Artificial Sequence
  Description of Artificial Sequence: Synthetic coding sequence
atgaccagaggacggtatcgagagttctatcagtgtgactttgatattgcaggcaactttgatcccatgatcccagacgccgaatgcctcaagattatgtgcgagattctctccagcctccaaatcggtgatttcttagtaaaagtgtcctgggaagaggtgaaaaacgaaatggtcggagagaaggggttggccccggaggttgcagaccgcattggggattatgtgcaacaacacggtggagtctccttagtcgaacagctgctccaggaccccaagctctcccaaaataagcaggcactggagggtctgggagatcttaaactgttgttcgagtatctgacgctatttgggattgacgataagatcagtttcgatctgagcttagcacgcggcctggattattatacaggggttatctatgaagccgtgttgttgcagactcctgctcaggcaggtgaagaacccctaggggtcggtagcgtagcagccgggggcaggtacgatggtctggtcggaatgttcgacccaaaagggcgaaaggtgccttgtgtgggactctcaattggggtggagcgaatattctctatcgtggagcaaagacttgaagccctcgaggaaaaaatacgaaccacggaaacacaggtccttgtggccagcgctcagaagaagctccttgaggagcggcttaaacttgtgagcgaactttgggacgcagggatcaaggctgagcttctctacaaaaagaaccccaagcttctgaaccagctccaatattgtgaagaggccggaatcccgctagtggctatcataggcgagcaggaactcaaggacggcgtgatcaagttaaggtccgttacatcacgtgaggaggtggacgtacggcgggaggatctggtcgaggagatcaaaagaagaaccggtcaacctctgtgtatttgctag

SEQ ID NO: 119934 - DNA, 1530 bp, Artificial Sequence
  Description of Artificial Sequence: Synthetic coding sequence
atggcagaacgagccgcgttagaagagttagtgaaactccagggagaacgcgttcggggtctcaaacagcagaaggctagcgcggaactgattgaggaggaagtggcgaaactgctcaagctgaaagcccagctgggacctgacgagagcaaacagaaattcgtgctcaaaacaccaaagggaacccgcgattatagtccgaggcagatggccgtgcgcgaaaaagtgtttgatgtgatcattcgttgctttaaacgccatggggctgaggtaatcgacacaccagtctttgagctgaaagaaacacttatgggcaagtatggagaagatagcaagctcatctatgacctgaaggaccaaggcggcgagctgctttctctcagatatgacctgaccgtgcctttcgcccgatatctagctatgaataagctcaccaacataaagcggtaccacatcgctaaagtgtatcggagggacaaccctgctatgacccgaggcaggtacagggagttttaccagtgcgacttcgatatagccggcaattttgacccaatgattcctgacgccgagtgtctcaagatcatgtgtgaaatcctgagttccctgcaaatcggtgactttttggtcaaagtcaacgacaggcgcattcttgatgggatgttcgccatttgtggcgttagcgactctaaattccgaacgatctgttcaagtgttgacaagctggataaggtatcttgggaagaagtgaaaaacgagatggtcggcgaaaaaggactcgccccggaggtcgccgaccgaattggcgattatgtccagcagcacgggggagtgtcccttgtggagcaactacttcaggacccaaagcttagtcagaataaacaggctctagagggactcggtgacctaaaattgctctttgagtatcttacacttttcggaatagacgataagatttcctttgacctgagcttggccaggggactcgactactacacgggggtaatctatgaggctgttctgctacagacccccgcccaggctggagaagagcccctcggggtgggctccgtggcggccgggggacgatatgacggtctggttggcatgttcgaccccaagggacgaaaagtgccttgtgtggggctttccattggcgtggagcggatcttctcaatcgtcgaacagcggctcgaggcactggaagaaaaaatcaggacaaccgaaacgcaggtcctcgtagcctcagcgcagaagaagttgctggaggagaggttgaagctggtgtcagaactgtgggacgctggaatcaaggctgagctgctttataaaaaaaatcctaaacttctgaaccagctgcagtattgcgaggaagctgggattcctctggtggccattatcggtgagcaggagctgaaggatggggttatcaaattacgctcagttacatcccgagaagaggtagacgtccgaagagaggatttggtcgaagaaattaagcgacggacagggcagccactgtgcatctgctag

SEQ ID NO: 119935 - DNA, 1323 bp, Artificial Sequence
  Description of Artificial Sequence: Synthetic coding sequence
atggcagtgagagaaaaggtctttgacgttataatccggtgttttaaaagacatggggcagaggtgattgacacgcccgtttttgagcttaaagaaacactgatgggaaaatacggcgaggattctaaactcatatacgatctgaaagaccaaggtggggaactgctgagtctgcgttacgacctcactgtgcccttcgcccgatacttagccatgaataaactgaccaacattaagaggtaccatattgctaaggtctacaggcgagataatccagctatgactagggggagatatcgggagttttaccaatgtgacttcgatatcgccggtaatttcgaccctatgattcccgacgctgaatgtctgaagataatgtgtgaaatactctcctccttacaaattggagactttcttgtgaaagtgaacgatagacgtatcctggacggtatgttcgcaatctgcggtgtgagcgacagcaagttccgcactatctgctcctccgttgacaaactggacaaggtgagttgggaggaggtcaagaatgagatggtcggagaaaagggactggcgccagaggtagccgaccgcatcggtgattatgttcaacagcatggaggggtgtccctcgtcgagcagctcttgcaggaccccaaattgagccagaacaagcaagcacttgagggcctcggggacctgaagctgctgtttgagtacttaacccttttcggcatcgatgataagattagctttgatctctccctggctcggggtcttgattactacacaggggtcatatacgaagccgtcctcttgcaaacgccagcccaagctggcgaagaaccactgggggtgggttcagttgctgccggcggccggtacgatggtttagttggtatgtttgatcccaagggtcggaaagtgccgtgcgtgggcctatcaataggcgtagaacggatcttttcaatcgtggagcagagactcgaggccctggaggagaaaattaggaccaccgagacacaagttctggtcgctagcgcccaaaaaaaactgcttgaggaacgtctgaagctggtgtccgaattatgggacgccgggatcaaggctgaactgctctataaaaaaaatcctaagctcctgaaccagctgcagtactgtgaggaagcgggtataccactcgtggccattataggcgaacaagaactgaaagacggtgtgataaaacttagatctgtgaccagtcgcgaggaggtcgacgtgcgaagggaagatttagtggaagagatcaagcgccggactggacagcccctctgcatctgttag

SEQ ID NO: 119936 - DNA, 867 bp, Artificial Sequence
  Description of Artificial Sequence: Synthetic coding sequence
atggctgaacgcgccgctctagaggagctggtcaaacttcaaggtgagcgcgttaggggactgaagcagcaaaaagcatcagcggagctaattgaagaggaagtggcaaagctgctgaaactcaaggctcagctcggtcccgatgaatctaagcagaaatttgtgctgaaaacaccgaagggcactagggattattcccccaggcaaatggcggtgagggagaaggtattcgatgtcattatccgctgcttcaagcgtcatggggctgaagtcatcgataccccagttttcgagctgaaggtcaacgaccgcagaattctggatggaatgttcgctatctgtggggtgagtgatagcaaattccgaacaatatgctcgagcgttgataaactggataaagtgtcttgggaggaagtgaaaaatgagatggtgggggagaagggcctggcccccgaggtagcagataggattggagattacgtacagcagcacggcggagtgagcctggtagagcagcttctgcaggatcctaagctctctcagaataagcaagccctggaggggcttggcgaccttaaactgctttttgaatacctaaccctgtttggcattgacgacaagatctcttttgacctaagcctggcacgaggcttggactattacacaggcgtgatttatgaagccgtcctgcttcaaacgcctgcccaagcgggggaggagccacttggcgtgggttccgtcgccgctggcggtcgatacgacggcctggtcggtatgttcgacccaaagggaagaaaagtgccgtgcgtgggcctgtccatcggcgtagaacggatcttctctatcgtggagcagcgcctggaatag

SEQ ID NO: 119937 - DNA, 1350 bp, Artificial Sequence
  Description of Artificial Sequence: Synthetic coding sequence
atggccgaacgcgctgcactggaggaactggtgaagctgcagggggagcgtgtgcgggggctgaagcagcagaaggcttcagctgagttgatcgaagaagaagtggcgaaactgctgaaactcaaggcacagctgggccccgacgagagcaagcaaaaattcgtgctcaagactccgaaggaaacgctcatggggaaatacggagaagactccaagcttatttacgacctcaaagatcaggggggtgagctgctgagtttgagatacgacctcacggtgccttttgcaagatatctcgcaatgaataagctgacaaatattaagaggtaccatatagccaaagattttgacattgctggtaacttcgacccgatgatccctgacgctgagtgcctgaaaatcatgtgcgagatactgtcctcactgcagatcggtgattttctagttaaagtaaacgatagaaggatcctggacggaatgttcgccatttgtggggtgtcagacagcaaatttcgtacgatttgctcctccgtggacaaactcgacaaggtaagttgggaagaagtgaaaaacgagatggtaggtgaaaaaggtttagctcccgaggttgcagatcgaatcggtgactatgttcaacagcacgggggagtttcgcttgtagaacaactgctgcaggatcccaagttgagccagaataagcaagccttggaaggacttggagatctgaaattattattcgaatacctgacactgtttggcatcgatgacaaaataagtttcgacctgagcttagcgagaggcttggattactatactggtgtcatttatgaggctgtattgctacagacacctgctcaggccggggaagaaccgctaggagtgggctctgtggcagctggcgggaggtatgatggcctcgtgggcatgtttgaccctaagggacgcaaggtgccgtgcgtcgggttatccattggcgtggagaggattttctctatagtcgaacagagattagaagctctcgaagagaaaattaggacaaccgaaacccaagtgctggtcgcctccgctcaaaagaaactgctcgaagaacgcctgaagcttgtgagcgagctgtgggatgccggaataaaggcagagcttctatataagaaaaatccaaaattactcaaccagttgcagtactgcgaggaggccggaatccccctggtggcaataattggggagcaggagctaaaagatggcgtgataaagctgagaagtgtgaccagtcgggaagaggtggatgtgaggcgtgaggaccttgttgaggaaatcaaaagacgcacaggccaacctttgtgtatctgttag

SEQ ID NO: 119938 - DNA, 1470 bp, Artificial Sequence
  Description of Artificial Sequence: Synthetic coding sequence
atggccgagcgggcggcactggaagagctggttaagttacagggcgaacgtgtgcggggtctcaagcagcagaaagcttcagcggagctcatcgaggaagaggtggccaaactactcaagttgaaagcccaattgggccccgatgaatcaaagcaaaagtttgtgctgaagacaccgaaggggacccgggattattccccaaggcagatggccgtccgtgagaaggtctttgatgtgataatccgctgctttaaaaggcacggagccgaagtcatagatactcctgtctttgagctgaaggagaccctaatgggaaaatacggggaagattccaaattaatttacgatctgaaggaccagggcggggagctcctgtctctgaggtacgatctgaccgtgcccttcgcccgctacttggcaatgaataagctgaccaatattaaacgatatcacatcgccaaagatttcgatatcgccggcaatttcgatcctatgattcccgacgccgagtgtctcaaaatcatgtgtgaaatcctgtcttctctgcaaatcggggacttcctcgtaaaggtcaacgacaggagaatccttgacggaatgttcgccatctgtggggtcagtgactctaaattcaggaccatctgctcatctgtggacaagctcgacaaagtgagctgggaagaggttaaaaatgagatggtgggggaaaagggactcgcacccgaagtagccgatcggatcggagattacgtacaacaacacggtggcgtctcgttggttgaacagttactgcaggatccaaagttaagtcaaaacaaacaggctctagaggggctgggcgatctcaagctgctatttgagtacctgacactgtttggaattgatgataaaatctcattcgatttgtcactggccagggggcttgactattacaccggcgtgatctacgaggccgttctgctgcagacacccgcacaggccggagaggaaccgcttggcgtgggatccgttgctgccggtggccggtatgacggactcgtggggatgtttgacccaaagggtcggaaagtgccatgtgtgggtctctctatcggagtggagcggatctttagcatcgtcgaacagcgcctggaagccctcgaggagaagatcaggacaactgagactcaagttcttgtggcatctgctcaaaagaaactgctcgaggagcgcctgaaattagtatctgagctctgggatgctgggataaaggcagagctcctgtataaaaaaaaccccaaactactgaatcaactgcagtattgcgaagaggcaggcatccccttagtggctataataggcgaacaggagcttaaagatggggttattaagctccgttctgtaacgtcaagagaagaggtggatgtcagaagagaagacctggtggaggagataaaaagaagaactggtcaaccattatgtatttgctag

SEQ ID NO: 119939 - DNA, 1017 bp, Artificial Sequence
  Description of Artificial Sequence: Synthetic coding sequence
atgatggctatgaattcaaagcagccctttgggatgcaccctgtcctgcaagagccgaagttcagctccctgcattcaggatccgaggccatgaggcgggtctgtttgccagccccccagcttcaagggaacatttttggttcatttgatgaatcactgctagcaagggctgaggcccttgcagcagttgatatcgtcagccatggaaagaatcatcctttcaaaccagacgctacttatcacacgatgagttccgttccctgcaccagcacctctagcacagttcctatatcacatcccgcagccctcacttcacacccacatcatgccgtgcaccaggggcttgaaggggatctcctcgagcacatcagccccactctcagtgtgagcgggctgggtgctcccgagcactcggtgatgcctgcccagattcacccccaccatctgggtgcaatgggacacctccatcaggccatgggaatgagtcacccccacactgtggctccacactccgcgatgcctgcctgtctctcagatgttgaatcagatcccagagaacttgaggcgtttgcagagcgcttcaagcagagacgtattaagctcggcgtcacacaggctgatgtgggggccgcgctagcaaacttgaagataccaggcgtcggatcgctgtcccagtctaccatatgccgctttgaaagtctgaccttatcacacaataatatgatcgcacttaaacccgtcctacaagcttggcttgaagaggctgaggctgcgtacagggaaaaaaacagcaagccagagctgtttaatggatctgagcggaagcgaaagcgcacctctattgcggccccagaaaaaagatcacttgaagcctattttgccattcagccgaggccatcgagcgagaagattgccgcaatagctgagaaattggacctgaaaaagaatgtggtgcgagtgtggttctgcaaccagaggcagaaacagaaaaggatgaaatattcagccgtgcattag

SEQ ID NO: 119940 - DNA, 1038 bp, Artificial Sequence
  Description of Artificial Sequence: Synthetic coding sequence
atgacgctgctcgaagtgccatttgcgcggtacttggccatgaacaaggtcaagaaaatgaaacgataccacgtcggtaaagtctggcggagggaatcacctacgattgttcaaggccgctatagagaattttgccaatgtgactttgacattgctggacagtttgatccgatgatcccagacgctgagtgtctaaagatcatgtgtgagattctgagcggactgcaactgggagacttcctgataaagatggcctggaaggatgtgagacacgagatggttgttaagaagggactcgcccctgaagtggccgaccggatcggcgactacgtccagtgccatgggggtgtaagcctagtggagcagatgtttcaagacccacgtctgtctcagaataagcaggcactggagggccttggggacctgaaactgctgtttgagtacctcacgctgtttggaatcgccgacaaaataagttttgacctgagccttgcgagagggctagactactacacaggcgttatctacgaggctgtcttgctgcagacccctacccaggccggggaagagcccctcaacgtgggatctgtggccgcgggaggccggtacgacgggttggtgggcatgtttgacccaaagggccacaaggtgccctgtgtgggtctttctattggggttgagcgaattttttacatcgtggagcagcgcatgaagactaaaggagaaaaggttcgcacgacagaaactcaggtgtttgtggctaccccgcaaaaaaacttcctacaggagagattgaagctaatcgccgaactctgggattcaggtataaaagccgagatgttgtataaaaacaatcccaaactgctgacccagctgcactattgcgagagcacgggaattcctttagtggtgattatcggcgaacaggagctcaaggagggcgttatcaagatccgctcagttgcttcaagagaagaggtggcaatcaaaagagaaaacttcgttgccgagattcaaaagcgtctctctgaatcatag

SEQ ID NO: 119941 - DNA, 1179 bp, Artificial Sequence
  Description of Artificial Sequence: Synthetic coding sequence
atgccacttcttgggctgctgccaagacgagcctgggcaagcttattgagccagttactccgaccaccttgtgcttcctgtactggggcggtgcgctgtcagagccaggtcgccgaggcagtgctgacctcccagctaaaggcccatcaggagaaacccaacttcatcattaaaactcctaaagacttcgatatcgcaggccagttcgacccgatgatccctgacgccgaatgtctaaagataatgtgcgagatcctgtctgggttgcagctgggtgatttcctgatcaaagtcaacgataggcggatagtggacggtatgttcgccgtgtgcggagtacctgaaagtaagttccgcgcaatctgctcctccatcgacaagcttgataaaatggcatggaaagacgttcggcacgaaatggtcgtcaagaagggcctcgccccagaagtcgccgataggattggggactacgttcagtgtcatggcggagtgtccctggttgaacagatgtttcaggatcctcggctgtcccagaacaagcaggccctcgaaggactgggcgatctgaaattgctctttgagtaccttacgctcttcgggatcgcggacaagatctctttcgatctatctctcgcgcggggattggattattatacaggagttatttatgaagcagtgctgctccagaccccaacccaggcgggtgaagaacctctcaacgtgggcagcgtggcagctggaggcagatatgacggcctggtgggcatgtttgaccccaaggggcataaggtgccctgcgtggggctgagtatcggcgtggagcgcatcttctacattgtggagcagcgcatgaagactaaaggagagaaggtcaggacaactgagacccaagtgtttgttgctacaccccagaaaaacttcttgcaagaacggctcaagttgatcgctgagctctgggacagtggcataaaagccgagatgttatacaagaataatcctaaactgctgactcaactgcactattgcgaatctaccggcatccctttagtagtgatcattggggaacaggagctgaaggagggggtgataaagatacggagtgtggcttctagggaagaagtagcaataaaacgagaaaattttgtggcagagatccaaaagagactgtcggaatcctag

SEQ ID NO: 119942 - DNA, 1401 bp, Artificial Sequence
  Description of Artificial Sequence: Synthetic coding sequence
atgcccctgttgggcctgctgccacgccgggcttgggcatcacttctttctcagttgctcaggcctccctgcgcgtcttgtacgggcgccgttaggtgccagagccaggtcgctgaggccgtgcttacctctcaacttaaggcacatcaggagaaacctaactttatcatcaaaacgcccaaagagaccctcaccgagaagtacggcgaggatagcggattgatgtacgacctcaaggaccagggcggtgagctgctgagcctgcgctatgacttgaccgtgccatttgcacgctacttggcaatgaataaggtgaagaagatgaagagataccatgttggaaaggtgtggcggagggagtccccaactatcgttcaaggtcggtatagagaattttgccaatgtgactttgatatcgccggccagtttgacccgatgatacccgacgctgaatgtctgaagatcatgtgtgagatactgtcaggactgcagttgggtgattttctgatcaaagtgaatgatcgtcgcatcgtggatgggatgttcgctgtctgcggtgtccctgagagcaagttccgagcaatctgtagtagtattgataagcttgataaaatggcatggaaagacgtaagacacgagatggtcgttaaaaagggcctcgccccagaggtcgctgaccgcattggcgactatgtgcaatgtcacgggggagtcagcttggttgagcaaatgtttcaggacccccgactgagccagaacaagcaggcactggagggtttaggcgatctgaagctattatttgaatacttgactctattcgggatcgcagataaaatctcattcgatctgagcttggctaggggtttagactactacaccggagtaatttatgaggccgtgttgcttcagactcccactcaggcaggggaagaacccctgaacgtaggctccgtggcggccggcggacgctatgacggtcttgtggggatgttcgaccccaagggacacaaggttccatgcgttgggttatctattggggtggagagaatcttctacattgtggagcaaaggatgaagacaaagggggagaaggttaggactacagaaacacaggtgtttgtggccacaccccagaagaacttcctccaggagagactcaagctaatcgcagaactgtgggattccgggatcaaagctgaaatgctgtacaaaaataaccctaaactgctgactcagctgcactactgtgagtccacagggattcctctagtggtaataatcggtgagcaagagctcaaagaaggggtcatcaaaatacgaagtgtcgcatcccgtgaggaagtcgcaattaagagagagaatttcgtagctgagatacagaagcgattgtccgaaagctag

SEQ ID NO: 119943 - DNA, 1005 bp, Artificial Sequence
  Description of Artificial Sequence: Synthetic coding sequence
atgccactactaggcctcctgccccggagagcctgggcatcactcctgtcccagctgcttagacctccgtgtgcttcttgcacaggggccgtcagatgccagagtcaggattttgatatcgccgggcaatttgatccgatgatccccgacgccgagtgcctcaagattatgtgcgagattctcagcgggctccagttgggcgattttctgattaagatggcatggaaggatgtccggcatgagatggtcgtcaagaagggcctggctcctgaggtggccgacagaattggagattatgtccagtgccatggcggggtctcattggttgaacagatgttccaggacccacggctctcgcagaacaaacaggccctggaagggctgggcgacttaaagctactctttgaataccttactctttttggaattgcagacaaaataagtttcgacctttccctggctagaggacttgactactataccggggtcatctatgaagcggttcttctgcagacacctacccaggccggtgaggaacccctaaacgtaggctctgtggcagccggcggtcggtatgacggattagtggggatgtttgatcctaagggccataaagtgccttgtgtgggtctgtcaattggggttgagagaatcttctacatcgtggaacagaggatgaagacaaagggggagaaagtgagaacgacagagactcaggtctttgttgccacacctcaaaaaaattttctccaggaaaggttaaagctgatagctgagctttgggactcaggcatcaaggcggagatgctgtacaaaaacaacccgaaactgctcacgcagctccactattgcgagtcaaccggtattcctctggtcgtgatcatcggggaacaagagctcaaggagggcgtgattaagattcgtagcgtggctagtagggaagaggtggccatcaagagggaaaacttcgtagcggagatccagaagcgactatctgagtcgtag

SEQ ID NO: 119944 - DNA, 1446 bp, Artificial Sequence
  Description of Artificial Sequence: Synthetic coding sequence
atgccactgttgggactgctgccaagacgagcatgggccagcttgctgtcccaactgcttaggccgccatgtgcatcatgtactggcgccgtgcgatgtcaatcccaaggcacacgcgatctgtctcctcagcatatggtcgtgcgcgagaaaatcctggacctggtgatcagttgctttaagcggcatggggcgaagggcatggacacaccagcctttgagttgaaagagacactcactgaaaaatatggcgaagacagcggtttaatgtacgaccttaaggaccagggtggagagctgttgagcctgcggtacgacctgacagtcccgttcgctagataccttgcaatgaataaagtgaaaaagatgaagcgttaccacgtaggaaaagtgtggagacgtgagagtcctacgatcgtgcagggccggtatcgtgagttttgtcagtgtgattttgacatagctggtcagttcgacccgatgattcctgacgccgagtgcctgaaaatcatgtgtgaaattctgtccggcttgcagctgggtgacttccttatcaaggtgaacgatcgcagaatagtcgacggaatgtttgccgtgtgcggagtacctgagtccaagtttcgcgccatttgctcctcaattgataaactggacaagatggcatggaaagatgtaagacatgagatggtagtgaaaaagggcctcgcacccgaggtggctgaccgcattggcgattatgtgcagtgccatggtggagtctccctagtggagcaaatgtttcaggatccacgactttcacagaacaaacaggctctggaggggctgggggatctaaagttgctcttcgaatacctgacactgtttgggatcgccgataagattagctttgatctctctctggcacgcgggcttgactactacactggcgttatttacgaggctgtgctgcttcagactcctacacaagcaggtgaagagcctctcaacgttggctcagtggccgccgggggaaggtacgacggcttagtcggtatgttcgaccctaaggggcataaagtgccatgtgtcggtctatcgattggtgtagagcggatcttttacattgtagaacagcgcatgaagacgaaaggggagaaggtccgaaccacggagactcaagtatttgtggccacaccacaaaagaactttctgcaagaaaggcttaaattgattgcagaactgtgggattctggcattaaggctgagatgctgtataagaacaaccccaagttactgacccaacttcactattgcgagagtactgggatccccctcgtggtgatcattggggaacaggaactgaaagagggagtgatcaagatcagatcggtagcatccagagaggaagtggcgataaagagggaaaacttcgtcgccgaaatacagaagcgcctgagtgagtcatag

SEQ ID NO: 119945 - DNA, 1185 bp, Artificial Sequence
  Description of Artificial Sequence: Synthetic coding sequence
atggattcagctctgtcagacccccacaatggcagtgccgaggcagggggtccaaccaactccacaaccaggccaccgagtacaccagaaggcatagcactcgcctacggcagcctcctgctcatggcactactccctatattctttggcgccttgcggagtgtcaggtgtgctcgggggaagaatgcctcggatatgccagaaacgatcactagtagggatgccgccagatttcccatcattgcttcttgtaccctcttaggcttgtacctgttcttcaaaatcttcagccaggaatacattaatctactgcttagcatgtacttcttcgtgttgggaatcctggccttgagccataccatctcaccatttatgaataaatttttcccggcctctttccctaacaggcaataccaactattgttcacacagggcagtggggaaaataaggaggagatcatcaattacgaattcgatacaaaggaccttgtgtgcctaggcctgtcttctatcgttggggtgtggtaccttctaaggaagcactggatcgcgaacaacctatttggtttggccttttctctgaatggggtggaattgctgcatctcaataacgtgagcaccggttgcattctcctgggtggcctgttcatttacgacgtcttctgggtgttcgggaccaatgtgatggtcacagtggctaaaagttttgaggcgcccattaaactggtcttcccacaggacttgttggagaaaggcctggaggccaataatttcgctatgttaggcctcggtgacgtggtgatcccgggaatcttcattgccctgctgctgcgtttcgacatatcccttaaaaaaaacacccacacctacttttacacatccttcgctgcttacatatttgggctgggcttaactattttcatcatgcatattttcaagcacgctcagcccgcgctgttatatctcgtacctgcctgtatcgggttccccgtgctggtggcattagctaagggcgaggtaactgagatgttctcctatgaatctagcgccgagattttgccgcatacacctcggcttacacacttcccgactgtgtccggatcccctgcttcactcgctgattctatgcagcagaagctggccgggcctcgccgtcgccggccccagaatccaagcgctatgtag

SEQ ID NO: 119946 - DNA, 1134 bp, Artificial Sequence
  Description of Artificial Sequence: Synthetic coding sequence
atggatagtgcattgtcagatccccataatggctcggcggaggcaggaggaccaacgaatagcacaaccaggcccccaagcacacccgaaggcatcgctctggcttacggctctttactcctgatggccttgctaccaattttcttcggagctttacgtagcgtgagatgcgctcgcgggaagaacgcctctgacatgcccgaaaccattacttccagagatgcggctaggttccccatcatcgcctcttgcacattactcggactgtacctgttcttcaaaatctttagccaggagtatatcaacctgctcctgagtatgtatttctttgtgctaggtattcttgcactttcacatacaataagtcctttcatgaacaaattttttcccgccagctttcctaatcggcagtatcagctgctattcacccagggcagtggcgaaaataaagaagagattatcaactatgagtttgacactaaagacctcgtatgcttggggctttctagcatcgttggagtttggtatttgctgcgtaagcattggattgcaaacaatctgttcgggctggccttttccctgaatggcgtcgagctgttacaccttaataacgtgtcaaccgggtgcatcctactgggcggactgttcatttacgacgtgttttgggtgtttgggacgaacgtgatggtcaccgtcgccaaaagcttcgaggcacctattaaactcgtcttccctcaagatctcttagaaaaggggcttgaagcaaacaacttcgccatgctcggtctgggagacgtggtgatacccgggatcttcattgccctgctccttcggttcgatattagcctgaaaaagaatacacacacctacttttacaccagctttgccgcttacatctttggcctgggactgactatctttatcatgcatatctttaaacacgcacaacccgccttgttatatttggtgcccgcctgtattggattccccgtgctcgtggccctggccaagggagaagtcaccgagatgttttcttatgaggagtctaatccgaaggaccccgccgccgttaccgaatctaaagagggcacggaagccagcgccagtaaaggactggagaagaaggagaaatag

SEQ ID NO: 119947 - DNA, 1008 bp, Artificial Sequence
  Description of Artificial Sequence: Synthetic coding sequence
atggactcagcactgtccgatccacacaatggatccgcagaggcaggaggtcctacaaactccaccaccagaccaccttccacccccgaggggatagcacttgcctatggctccctattgctgatggccctattgcccatcttctttggcgccctccgctcggttaggtgtgccaggggaaagaatgcatccgatatgcctgagacaatcacttctcgcgacgccgcgagatttcctatcattgcctcatgcacccttctcgggctctacttgttcttcaagatcttctcacaggagtacataaacttgctgctatcaatgtatttttttgtgctcgggatactggcacttagccacacaatatcgccatttatgaacaaatttttccctgctagtttcccaaatagacagtatcaactgcttttcacgcagggatcgggtgaaaataaagaagagatcatcaactatgaatttgacacgaaggaccttgtctgtctagggctctcaagtatcgtcggagtttggtatctgctgaggaaagtttttgggaccaatgtcatggttacagtagcgaagagcttcgaggctccaattaaacttgttttccctcaggatctcctggaaaaaggactggaggctaacaattttgcgatgttaggccttggggacgtcgtcatccctggaatttttatcgcactgctgctgaggttcgacatcagtttgaagaagaatacgcatacctatttttatacgtcattcgcagcatatattttcggcttgggtttaactatatttattatgcacatatttaaacacgcccaacccgcgcttctgtatttggtgcctgcatgcattgggtttcccgtgctcgttgccctcgcaaaaggagaggtgaccgaaatgttcagctatgaagagtccaatccaaaggacccagcggctgtaaccgaaagtaaggagggcacggaggcctccgcctcaaaaggcctcgagaaaaaggagaagtag

SEQ ID NO: 119948 - DNA, 1281 bp, Artificial Sequence
  Description of Artificial Sequence: Synthetic coding sequence
atggactctgcgctgagcgacccacacaatgggagcgctgaggcgggcggaccaactaactccaccactcgtccaccatcaaccccagaagggatcgccttggcttatgggtcactcctcctcatggccctcttgccaatcttttttggagccttgagaagcgtgcgttgtgccaggggaaagaacgctagcgacatgcccgagaccatcaccagcagagacgcggcccgatttccaatcatcgcctcttgtacacttcttgggctttacttgtttttcaagattttttcgcaggagtatattaacctgttgttaagtatgtacttcttcgtactcgggatcttagcacttagccatacaatctcgcctttcatgaataaattcttcccagcaagttttcccaacaggcaatatcagttgctgttcacacagggcagcggggagaacaaggaggaaattattaattacgagtttgacacaaaagatttagtttgtctcggcctgagtagtatagtcggagtctggtaccttctcagaaagcactggatcgccaacaatctttttgggctggcattttctttgaatggtgtagaactgctgcacctcaacaacgtgtcgacgggttgcatcctccttgggggtttatttatttatgacgtgttctgggttttcggcaccaacgtgatggtgacggtcgctaagtctttcgaggcccccatcaagctggtgttccctcaggaccttctggaaaaagggcttgaggcaaataacttcgctatgttggggctgggtgacgtggtgattcccgggatattcattgccctgctgctgcggtttgatatttctctgaaaaagaacacacatacatatttctatacttccttcgcagcgtacatctttgggttgggtctaacaattttcattatgcatatctttaagcacgcccagccggcgcttttgtacctggtgcctgcttgcattggatttccagtccttgtggctctcgccaagggggaagttaccgagatgttctcctatgagtcttctgcggaaatcctgccccacacacctagactgacgcactttccaaccgttagcggctcaccagccagcctggctgattccatgcagcagaaactagccgggcccagaagaaggagaccccaaaaccctagtgctatttacgaggagagcaaccctaaagatcccgctgctgtgaccgagtcgaaggagggaacagaagccagtgcttccaaaggactggagaaaaaagagaaatag

SEQ ID NO: 119949 - DNA, 3411 bp, Artificial Sequence
  Description of Artificial Sequence: Synthetic coding sequence
atgttctcccggaaaaaacgggaactgatgaagacaccttctatctccaagaaaaatcgtgcaggctctccttctcctcagccaagtggtgagctacctagaaaggacggagctgatgcagtctttcctgggccgtctttagagccccctgcaggatcaagtggggtaaaggcaaccggaaccctgaaacggcccactagcctctctcgccatgcaagcgcagcgggatttcctctcagcggagcagcttcatggacactgggacgcagccacagatcacctctgacagcagcaagcccaggagagttacccaccgaaggagccggaccagatgtggttgaggacataagtcacctgctggccgacgtggctcggtttgccgaaggactcgaaaaactgaaagagtgtgtccttcgcgacgatctgttggaagccaggcgtccaagggctcacgaatgtctgggcgaagctctccgggttatgcaccaaataatcagtaaatacccactcctgaacaccgtggagacattgaccgccgctggcacacttattgcaaaagtgaaggctttccattacgagtctaacaatgacctggagaagcaggagtttgagaaggcgttggagactatagccgtggccttttcttcaacagtgtcagaattcctcatgggggaagtggactcatccacgctgctcgctgttccccccggcgactcgtcacagagcatggaaagtctgtatggacctggctctgaaggaactccgcccagccttgaagattgcgacgcaggctgcctgccagctgaggaggtggacgtgctcctccagcgctgcgaagggggcgtggatgctgccctgctctacgcaaagaacatggctaagtatatgaaggacctaatttcatatctggaaaagcggacaactcttgaaatggagttcgccaaggggctgcagaaaattgcgcacaactgccggcagagcgtgatgcaagagccacatatgcctctcctgagtatctattcactggcgcttgaacaggatttagagttcgggcactctatggttcaggccgtgggtaccctgcagactcagaccttcatgcagccgttgaccctgagaagattggagcatgaaaaaagacgaaaggaaattaaggaagcctggcacagggcccagagaaagctccaagaggcagagtccaaccttcgaaaagctaagcagggctacgtacaaaggtgtgaagaccacgataaggccaggtttcttgtggccaaggccgaggaagagcaggcagggagtgcgccaggagcgggctccaccgccacgaaaacacttgacaaaaggaggcggttggaagaggaagctaagaacaaggccgaggaggccatggcaacttaccgtacgtgcgtggcggatgcaaaaacccagaagcaggagttagaggacacgaaggtcactgctctcaggcagatccaggaggtgatacggcagagcgaccaaaccataaaatcagctaccatatcatactatcagatgatgcacatgcagactgcacccttgccagttcacttccagatgctgtgcgagtccagcaagttatacgatcccggccaacaatacgcttcccacgtcaggcagcttcagcgcgatcaggaacctgatgttcactatgatttcgaacctcatgtttccgccaatgcttggagcccggtaatgagggcaagaaaatctagcttcaatgtgagtgacgtggcacgcccagaggccgctgggagccctccggaggaaggtggttgtacggaaggcacaccagccaaggaccaccgggcaggtagggggcaccaggtgcacaagtcttggccactgagcatatctgattccgatagcgggctggatcctgggccaggggctggtgactttaaaaagtttgagcggacatcttcatccggaactatgtcctctaccgaggagttggttgatcccgacggaggtgcaggcgccagcgccttcgaacaggccgacctcaatggcatgactcccgagcttcccgtggccgttccttcgggcccctttcgccacgaaggcttaagcaaagccgctcggactcacagactgcgcaagctcaggaccccagctaagtgcagggagtgtaattcctacgtttattttcaaggcgccgagtgcgaagagtgttgtctcgcctgtcataagaagtgcttggagacccttgctattcaatgtggccacaagaagctgcagggccggctacagctcttcggccaagacttctcgcatgctgcccgctctgcccctgacggagtcccttttattgtgaagaaatgcgtgtgcgagatcgagagacgggccttgaggacgaaggggatttatcgcgtaaacggtgtgaaaaccagagtcgagaaactgtgtcaggcatttgagaacggcaaggagctggtcgagctgtcgcaagcttcccctcacgatattagcaacgtactgaagctgtacctccgccagctgcctgaacccctgatttcctttcggctataccatgaacttgtgggtttagccaaagacagtctaaaagcagaagcagaagcaaaggccgcatctcgcggtagacaagatgggtccgagtctgaagccgtggcggttgccctggcagggaggttgagagagctgctacgggacctgccaccagaaaacagggccagcctccaatacttgctcaggcacctgcggcgtatagtggaagttgagcaggacaacaagatgaccccaggcaacctgggaatagtgttcggtcctaccttactgcggcccagacctacagaggccaccgtgagcctgagtagtcttgttgactacccacatcaagcaagagtgatcgagaccctcatcgtgcattatgggctggtattcgaagaggaaccagaggagactcccggcggacaggacgagagttcaaatcagcgggcggaagtagtcgtccaggtgccctacctcgaggccggcgaggccgtagtttaccccctgcaggaggcggctgcagatggctgccgagaatccagggtggtgagcaacgattcagactccgacctggaagaagcctctgaattgctttcttcctctgaggccagcgccctggggcatctcagttttctggaacaacagcagtcagaagctagccttgaagttgctagtggatcacacagcggcagtgaggagcaactggaagccactgcccgagaggacggcgatggcgacgaggacgggcctgcccagcagttatctggctttaataccaatcagagtaacaatgtactgcaagcacctctaccccccatgagactcaggggaggtcgcatgactttaggatcttgtagagagcggcagcctgagtttgtttag

SEQ ID NO: 119950 - DNA, 3393 bp, Artificial Sequence
  Description of Artificial Sequence: Synthetic coding sequence
tcctactcgccatacagggcgggcagacagggaccacagcaaagaggtcgagaccccgggatccaactcacggaactccctaggaaggatggggcagacgctgtgttccccgggccctccctcgagccccctgcaggttcatctggcgtgaaggcgaccgggactctgaagcgccccactagtctcagcagacatgcctctgcggccgggttccccctgagtggagccgcatcctggaccttaggtagatcgcaccggtcccctttgactgcagcttctcccggggaattaccgacagagggggctggacctgacgtggtcgaggatatttcacacttgctcgcagatgtcgcaaggttcgccgagggcctcgaaaaactcaaagaatgcgtactgcgggatgatctcctcgaagctaggaggcccagagcccatgagtgcctaggagaagctcttcgggtgatgcaccaaataatatccaaataccctctacttaacacggtggagaccctgactgccgctggcacactgatcgcaaaggttaaagcgtttcattatgagtccaacaatgatcttgaaaagcaggaattcgagaaagctctggagacaattgctgtcgctttctcaagtacagtgtccgaatttttgatgggagaagttgactcaagtaccttactggccgttcctcctggcgacagcagccagtccatggagtcgctctacggtccggggtcagaggggacaccgccctccctggaagattgcgacgccggctgcttacccgccgaagaagtggacgtactgctgcagaggtgtgaaggcggtgttgacgctgccctgctgtacgctaagaatatggccaagtatatgaaagatttaatcagctacctggaaaaacgaaccacactggaaatggagttcgccaagggcctccagaagatcgcacataactgtaggcagagcgtcatgcaggaaccacatatgcctttactcagtatctactccctggcccttgaacaggacttggagttcgggcactcaatggtccaagcagtgggtactttgcagacccagacattcatgcagcctctcacactgcgacgtctcgagcacgaaaaacggcgaaaggagattaaagaggcctggcatagagcccagagaaaactccaagaagccgaatcaaatctgaggaaggccaaacagggttatgttcaaagatgcgaggaccacgataaagcacggttcctggtggctaaagcagaggaagagcaggccgggagtgctcctggggcaggcagcacagctacaaagactttagataagcgaaggcggttggaggaggaggcaaagaataaagccgaggaagccatggcaacatacaggacctgcgtggccgacgccaagacgcagaaacaagagcttgaggacaccaaggttacggccctcagacagatccaggaagtcatcagacagtcggaccaaactataaaatcagcaactatatcctactatcagatgatgcacatgcagactgcgccgctgccagttcacttccagatgctctgtgagtctagcaagctttacgatccgggccagcagtacgccagtcatgtaagacagctgcagagggatcaggaaccagacgtccactatgactttgagccacatgtgagcgcaaatgcatggtccccggtaatgcgcgcgcgcaaaagcagtttcaatgtaagcgatgtggctcgccctgaagctgccggctcgccaccagaggaggggggctgtactgaaggcacccccgctaaggatcatcgagcagggaggggccatcaggtccataagtcctggcctttgagcattagcgattccgattctggcttggacccgggccccggagctggcgatttcaagaaatttgaaaggacctctagcagtggtaccatgtcatccacggaggagcttgtcgatcccgacggaggcgctggcgcttctgcattcgaacaggctgatctgaacggcatgaccccagaattgccggtggccgttccatcagggccgttccgccacgaaggtctgagtaaagctgcccgcacacacagactgcgaaaattgcgaacacccgctaagtgccgggaatgcaattcgtatgtatacttccagggcgctgagtgcgaagaatgttgcttagcctgccataagaagtgcttggaaaccctggccatccagtgcggacacaagaagctccaaggccgtttacagctgttcggtcaggatttctcccatgcagctaggtccgcacctgacggtgtgccttttattgtgaaaaaatgtgtttgtgaaattgagcggagggccctgcgaaccaaggggatatatcgcgtgaacggggttaaaacacgggtagagaaactgtgccaggccttcgagaacgggaaggagctagtggagctgagccaagcctcccctcacgacatctccaacgtactgaagttatatctgcggcagttgcccgagcccctcatcagctttagactctaccacgaacttgtgggtctggccaaggacagtttgaaagcagaagccgaggcgaaagcagcgagcaggggcagacaggacggttcagaatccgaagcagtggccgtcgccctcgcagggcgtcttagagagcttttgagggatttgccacccgagaaccgcgcatcccttcagtacctgctgaggcatctgagaagaattgtggaggtggagcaagacaacaaaatgacacctggaaacttgggtatagtgtttggaccaactctattgagacccaggcccaccgaagcaactgtgtctctatctagcctcgtggattacccccatcaggcccgcgtgattgagaccttgattgtgcactatggactggtgttcgaggaagagccggaagagactcccggtggacaggatgagagcagcaatcagcgtgccgaggtcgtggtgcaggtcccctacttagaagcaggagaggctgtggtgtacccattacaggaagccgctgcggatggctgcagagagtctagggttgtctccaacgattcggactccgaccttgaggaagcatctgaactgttgtcttcttcagaggcttcagccctgggtcacctgagttttctcgagcagcagcagtccgaggcaagcctggaagtcgcttctgggtcccatagtggatccgaggagcagctggaggcaactgccagagaggatggggacggggacgaggacggaccggcacagcagctgtctggatttaacacaaaccaatcaaataacgtgttgcaagcaccactgccaccaatgcggctgcggggggggaggatgaccctaggcagctgtcgggagaggcagccggagtttgtctag

SEQ ID NO: 119951 - DNA, 3015 bp, Artificial Sequence
  Description of Artificial Sequence: Synthetic coding sequence
atgcaccaaattatctctaaataccctcttcttaataccgttgaaaccctcaccgccgccggaacccttattgccaaagtgaaagcctttcattatgagagcaacaatgacctcgaaaagcaggagtttgagaaggctctagagacaatcgctgtagctttcagcagcacagtgtcggagttcctgatgggcgaagtggacagctctacgcttctagctgttcccccaggggatagttcacaaagcatggagtctctgtatggaccgggttctgaaggcactcctccttctttggaggactgtgacgccggctgcctcccagcagaagaagtggatgtccttctacagagatgtgagggaggcgtggatgcagcactgctatacgcaaaaaatatggccaagtacatgaaagacctcatttcctatttggagaaaaggacaacactcgagatggagttcgcaaaaggcctgcagaaaattgcgcataattgtagacagagcgtgatgcaggagcctcacatgcctctgctctcaatatactctctggctctggaacaggatttggagttcggacactccatggtgcaggcagtcgggaccctccagacccagacctttatgcagccactcacactgagaagactcgagcacgagaaaaggaggaaagagattaaagaagcatggcaccgggcgcagagaaaactgcaagaggctgagtcgaacctccgaaaagccaaacagggatacgtccagcggtgtgaggatcacgataaggcacgattcctggtagccaaggcggaggaggagcaggcaggcagcgcaccaggggccggctccacagcaacaaagaccttagacaaacgtaggcgccttgaggaggaagcgaaaaataaagctgaggaggctatggccacctatagaacttgtgtggctgacgccaagacacagaaacaggagttagaggatacaaaggttaccgccctacggcaaatccaggaagttattagacagagcgaccagaccattaaatcagcaaccatctcctactaccagatgatgcacatgcagacagcgccattacctgtccactttcagatgctgtgcgagtcatccaagctatatgaccctggtcagcaatacgcatcccacgtgcggcaactgcagcgtgaccaggagcccgacgtacattatgacttcgaaccacatgtctctgccaatgcctggtcccccgtgatgagggcgcggaaatcttctttcaacgtgtccgacgtagcaagacctgaagccgccggcagcccccctgaggagggcgggtgcactgagggcaccccagccaaggaccatcgtggcgaatgtccagcagggccgcgggggggaaggtggctacccgctacgcaccctggcccaagcccggagaccccgctgagccccgctggccggggtcatcaggtgcacaaatcatggcccctctctatcagcgactccgattcaggcctggatcccggaccaggcgcaggagactttaagaaattcgaaaggacaagttcaagcggaactatgtcctcaactgaggaattggtggaccccgatggaggagctggagcatcagccttcgagcaagctgatctgaatgggatgacccccgaattgccagttgcagtgcctagtggaccttttagacacgagggcttgagtaaggctgcccggacgcatcgtctacgcaaactacgcacgcccgccaaatgccgggagtgtaactcctatgtctatttccagggggcagagtgcgaggagtgttgcttagcctgtcataaaaaatgcctagaaaccctggcaattcaatgtggccataagaaattacaaggccgcttgcagctcttcggccaagattttagtcacgctgctaggtccgcgccagatggcgtgccctttatagttaagaagtgtgtgtgcgaaatcgaaaggcgggccctgaggacaaaagggatttatcgtgtcaacggagtcaaaacacgagtggaaaagttatgccaggcatttgagaacgggaaggagctagtggaactctcccaagctagtcctcacgacatctctaatgtactgaagctatatcttcgccagctccccgaaccactcatctccttccggctgtatcacgaactggttggtttagcaaaggactccctgaaagccgaggccgaagcgaaagccgctagccggggaagacaagatggctccgagagtgaagcggtggccgtagcacttgcaggaagactcagggagctccttagagacctgcctcccgaaaaccgagcgtcattgcagtacttgctcagacacctgcgaagaattgttgaggtggaacaagataacaagatgacacctgggaatctcggcatagtgttcgggcccaccctgctgagacctcgccccaccgaagcaacggtttcattgtcttccctggtggactacccacatcaggcacgggtgattgagacacttattgtccattacgggttagtattcgaagaagagcctgaggaaactccgggcggtcaggatgagtcctcaaatcagcgcgcagaggtagtggtccaggtcccctacctagaagcaggagaagccgtggtgtaccctctgcaagaggctgctgcggatggttgcagagaaagccgggtggtgtctaatgattcggacagcgatttagaggaagcatccgagctgctgagttccagtgaggcatccgcacttggacacctttcttttctggagcagcagcagtcagaggccagcctggaagtggcttcgggttcacatagcggctccgaggaacagcttgaggcaaccgcacgcgaggatggtgacggtgatgaggatggcccagctcagcaactctccggttttaataccaaccagtccaataatgttttgcaggcccctttacctccgatgcggctgcgcggcggtcgcatgacgctgggttcctgcagagaaagacagccagagttcgtttag

SEQ ID NO: 119952 - DNA, 3459 bp, Artificial Sequence
  Description of Artificial Sequence: Synthetic coding sequence
atgagccgaggtcagcgcgtcctgaagggcctgcttggctgggtgtgcacctggacctgggcctggcgcgcacgcctcggggcgcgcggctgtggactccacgtgctatgccctcgcgacctacccctcccgccagaggaactcccgcggaaagacggtgctgatgcggtgtttcccggtccaagcctggagcccccagcgggaagcagcggtgttaaagccactgggacactgaaaagacctaccagcctcagcagacacgctagtgccgccggctttccactttcaggggccgccagttggacgttaggacggagtcatcggtccccgctcaccgccgctagcccgggtgaattgcccacagagggcgcagggcccgatgtggtggaggatatcagtcatcttttagctgatgttgcaaggtttgccgaaggtctcgaaaagctgaaggaatgtgtcctcagagatgatctcctagaggccagaaggccaagagcccatgaatgcttgggcgaggctctgagagtgatgcaccagatcatttcaaagtacccgctgctcaacacagtcgagacacttacagccgccggaaccctgatcgctaaggttaaggcctttcattatgagtctaataacgatttggagaaacaggaattcgagaaggccctggagaccatcgcagtagcattctccagcactgtcagtgaattcctcatgggtgaggtggacagttcaactctgttggccgtacccccgggggactctagccagagtatggagtctctctatggacccggaagtgaaggaacaccgccaagtctcgaagactgtgacgctggctgcttgccagccgaagaagtggacgtgttacttcagagatgtgagggcggggtggacgctgcactgttgtatgcaaagaacatggccaaatatatgaaagacctgataagctacctggaaaagagaacgacgctcgagatggagttcgccaagggactgcagaaaattgcacataattgccgacagagtgtgatgcaggaaccccacatgcccctcctatctatctacagcctggcactggaacaggatctggaattcgggcatagtatggttcaggccgttggcacgctgcagacacagacattcatgcagccgctgacattgcgacgtctggagcatgagaagcgccgtaaagagatcaaggaagcctggcatagagcccaaagaaaactacaggaagctgaatcgaacctacggaaagccaagcagggttacgtgcaacggtgtgaggatcacgacaaggcgcgcttcttggtggcaaaggctgaagaggaacaggccggctccgctccaggagcaggcagcactgcaactaagactctggacaagaggcgccgcctcgaggaagaagcaaagaacaaagccgaggaggcaatggcgacctacaggacttgtgtcgctgacgcaaaaacacagaaacaggaattggaagatacgaaggttaccgcccttcggcagattcaggaggtgatccgtcaaagcgatcagactataaagtcagccaccatttcctactatcagatgatgcacatgcagacggcccccctgcctgttcactttcaaatgctctgcgagtctagtaagctgtatgacccaggacagcaatacgcatcccatgtcagacagctgcaacgggaccaagagcccgatgtccattatgatttcgaaccccacgtgtccgcgaacgcgtggagtccagtgatgagagctcggaagtcgtcatttaatgtgagcgacgttgctcggcctgaagctgcaggcagcccccccgaagagggaggatgtacagagggaacaccagccaaagatcatcgcgctggtcgggggcaccaggttcacaagagctggcccctctctatatcggatagcgattcaggactggatcctggccccggcgccggtgatttcaagaagttcgagcgaaccagcagttcaggtacaatgagcagcacagaggagctggtggatcctgacgggggggctggggccagcgccttcgaacaagctgatctcaatggcatgaccccagaactgccagttgcagtgccctcaggaccctttcggcacgagggtctttcaaaagctgctcgaacacatcgactgagaaagctacgcactccggctaaatgtagggagtgcaatagttacgtgtatttccagggcgcagaatgtgaggagtgttgcctggcctgtcacaagaaatgtcttgagactctggcaattcagtgcggccacaaaaagctgcaaggccgcttgcagttgttcggacaggatttctctcatgccgcccgctcagcccccgatggtgttccatttatcgtaaagaagtgtgtctgcgaaattgagcggagggcactaagaactaagggaatctatagggtgaatggcgtgaaaactcgcgttgaaaaactctgtcaagcctttgaaaatggcaaagaactcgttgaactttcccaggcctcaccacacgatatttctaacgtgctaaagctgtatctgagacagctgcccgagcccctcatctcatttcgtttgtaccatgaactagtaggcctcgccaaagatagtcttaaggccgaggccgaggccaaagccgctagccgcggccgacaagatggaagcgaaagtgaggctgtcgctgtcgcgttggccgggaggctccgcgagctcctgcgagacttgccacccgagaatcgggcgtcacttcagtatctgctccggcacttgcggcgcattgtggaagtggagcaagataacaaaatgacaccaggtaacctgggcatcgtgtttgggcccacgctgctccggccacgtcctaccgaggccaccgtgtcgctgagttctctggtggattatccgcaccaagcacgcgtgatcgagacccttatcgtccattacggcctagtgtttgaggaggagcctgaggaaacccccggtggccaggacgaatcgtcaaatcagcgggccgaggttgtggtgcaagtaccttatcttgaggctggcgaagccgtcgtgtatcctcttcaggaagccgccgcagatggctgtcgggaatcaagggtggtgagtaatgactccgacagcgatctggaggaagccagcgaactcttgtccagttccgaagcaagtgcactggggcatctatcatttttagagcagcagcagtctgaagcaagcctcgaagtggcttccggtagtcacagtggaagtgaagagcagctagaggccaccgcacgggaggatggcgatggggatgaggacggacctgcccagcagctgtcaggctttaacaccaaccagagtaacaacgtactgcaggctcctctgcctcccatgcggctcaggggcggccgcatgactttgggcagctgtcgggagcgacaacccgaattcgtatag

SEQ ID NO: 119953 - DNA, 3060 bp, Artificial Sequence
  Description of Artificial Sequence: Synthetic coding sequence
atgtgcatatgtgggacagctcaccccgtgctcgatgagggaccagtgaggtgtcgcgctggccctcgagacttgctagaagcaagacgaccgagggcccacgagtgcctcggagaggccctgcgggttatgcatcagataataagtaaataccccttactaaatactgtcgaaacactcaccgccgcaggaactttaattgccaaagtcaaggcctttcattatgagtctaacaatgatcttgaaaaacaggagtttgaaaaagccctggagaccattgccgtcgctttctcatcaaccgtttccgaattcctgatgggcgaagtagactcatcaacccttttggccgttcccccaggcgacagttcacagagtatggaatctttatatggtcctggcagtgagggtacacccccgtctctggaagactgcgatgctgggtgcctccccgcagaagaggtagacgtgcttctccaacggtgcgagggcggcgttgacgccgcactgctgtacgccaagaacatggcgaagtatatgaaagacctgattagctacctcgagaaaagaacaaccttagaaatggagtttgccaaaggattacaaaagatcgcccacaattgtaggcagtctgttatgcaggaaccccacatgccgcttttaagcatatattccttggcgctggagcaagatctcgagtttggccactctatggtgcaggctgtagggactctgcaaacacaaactttcatgcaaccactgaccctgaggcgcctggaacacgaaaagcggaggaaagagataaaagaagcgtggcaccgcgctcagcgcaagttacaagaggccgaatcgaatttgcgaaaggcaaagcagggatacgtgcagcgctgtgaagatcatgacaaagcacggtttttggtggctaaagctgaggaggagcaggccggctcagctccaggggccggaagcacagcgactaaaaccctggacaagcggaggcgcctcgaagaagaggcaaagaataaggccgaagaagctatggctacctacagaacatgcgttgctgacgcaaagacacaaaagcaagagctcgaggacaccaaagttacagctcttagacaaatccaagaggttatacgacagagtgaccagactattaaaagcgccacaatctcatactatcagatgatgcatatgcagaccgcacccctgcccgtccattttcaaatgctgtgcgagagttctaagctgtatgaccccggccaacagtatgccagtcacgttcgccagctgcagagggatcaagagccagacgttcattacgactttgaaccacatgtcagtgccaatgcctggtccccagttatgcgggccaggaaatcaagctttaacgtgtctgatgtagcccgacccgaggctgccggcagccctcccgaggaaggcggatgcactgaaggcacccccgccaaggaccacagggcagggcgcggtcatcaggtccacaaaagttggcctctctctatctctgattccgattctggactcgatcccggacctggcgcgggcgactttaaaaagttcgagagaacgagttcatccggtaccatgagctccactgaagagctggtagacccagacgggggcgctggcgcaagcgccttcgagcaagctgacctgaacgggatgactcccgaactgcccgtggctgtaccctcagggcccttcagacatgaggggctctccaaagctgcacgtacccacagactaaggaagctgagaacccctgccaagtgcagggagtgcaactcctacgtgtacttccaaggagctgagtgtgaggaatgttgtctggcctgccataagaagtgtctggagaccctggccatccagtgcgggcataagaaactgcagggacgcctacagcttttcggccaggatttctctcatgcagccaggagtgctccagatggcgtgccattcatcgtcaaaaagtgcgtgtgcgaaatcgaacgccgtgctttgcgcaccaaaggaatttacagagtcaatggggtcaagacaagggtcgaaaagttgtgccaggcattcgaaaacggcaaggaactcgtggaactttctcaggcatctccccacgatataagtaacgtgcttaaactgtatctgaggcaactgcccgagcccttaatctcctttaggttgtaccatgagttggtgggattagctaaggactcgctcaaagccgaagccgaggcgaaggcagctagccggggccggcaggatggctcagagtcggaggctgttgccgtggcccttgctggacgcttacgggagctgctccgcgacctaccccctgaaaaccgggctagcctgcagtatttactcaggcacctgaggcgtattgtggaagtggaacaggataacaaaatgacccctgggaacctcgggattgtgttcggcccgactttgctcaggccacgtcccacagaggccaccgttagcctgagtagcctggtggactatccccaccaggccagagtcatcgagactctcattgtgcattacggattggtgttcgaagaagaaccggaggaaacacctggcggccaagatgagtcttccaatcagcgggcagaagtggtagtacaggttccctacctggaagcaggggaagccgtcgtctaccccctgcaggaggctgccgctgacggctgcagagaatcacgcgtcgtctctaacgactctgactccgacctcgaggaggcaagtgagctcctgtcctcaagcgaagcatctgcgctcggccatttatctttcttggaacagcagcagtcagaagcaagtctggaggttgcttccggctctcactccggatccgaggagcaacttgaagctacagctagggaagacggggacggcgatgaagacggaccagcacagcagctctcagggtttaacacaaatcagagcaacaacgtcctgcaggctccgcttccacccatgagactccgcggaggacgcatgactctggggtcttgccgcgaaagacagcctgagttcgtgtag

SEQ ID NO: 119954 - DNA, 2847 bp, Artificial Sequence
  Description of Artificial Sequence: Synthetic coding sequence
atgttcagcagaaagaagcgcgagctcatgaagaccccttccatcagtaagaaaaacagggcgggcagccctagtcctcagcccagcggagaactgccgcggaaagacggcgctgatgccgtattcccgggcccgtcgctggagccccctgccggtagcagcggcgttaaagccaccggcactctcaaacgccccacaagcctcagtcgccacgctagtgccgccggcttccctctcagtggggctgcatcatggacccttggtcgatcacatcgatcccctttgacggcagcatctcccggagaactcccaacagaaggtgccggccccgatgtggtggaagacatttcacacctattggcagacgtagcacggtttgccgaaggcctcgagaagcttaaagagtgcgtgctgcgggacgatctcttggaggccaggcggccacgcgctcacgagtgtctgggggaggctctcagagtgatgcatcagatcatttccaaatatcctctcctaaacacggtggagacccttaccgccgccggcaccttgatcgccaaagtaaaggcatttcattatgagtcaaacaatgacctcgagaaacaagagtttgaaaaggcccttgaaaccattgccgtggcctttagcagcaccgtgagtgagttcctgatgggtgaagtggactcgtctactctcctcgcagtgcctccaggcgactcttcgcaatcaatggagtctctctacggcccgggtagcgagggcaccccgccctctttggaggattgcgacgctgggtgtctccccgccgaagaagtcgacgttctcctgcagcgttgtgagggaggcgttgatgcagcactgttgtacgcaaagaatatggccaaatatatgaaagatctgatttcttatctggaaaaaaggaccacgctggagatggaatttgccaaaggactgcagaaaatagcacacaactgcaggcagagcgtgatgcaagagccacatatgccactattgagcatatactctttagccctcgaacaggacttggaatttggacactctatggttcaggctgtagggacacttcaaacgcagacattcatgcagcccctcacattgcgcaggttggagcatgagaaaaggcgtaaggagatcaaagaggcatggcaccgagcccagcggaaactgcaggaggctgagtccaatctgcgcaaggctaaacagggctatgttcagcgatgcgaagaccatgataaagccaggttcctggtagccaaggctgaggaggagcaggccggatctgctccaggagccggcagcacagctactaagacgctcgacaagcggcggcggctcgaggaagaagctaagaataaggccgaggaagcgatggcaacataccgaacctgcgttgctgatgctaagacgcagaaacaagaattggaggacactaaggtgaccgcactgcggcagatacaggaggtcatccgccagtctgaccagacgatcaaatctgccacaatctcatactaccaaatgatgcacatgcaaaccgcccctcttccagtgcattttcagatgctctgcgaatccagcaaactgtatgaccctggacagcagtacgcctctcacgtgcgacagctgcagcgagaccaagagcctgacgtgcattatgactttgagccccacgtcagcgctaacgcttggagtcccgttatgcgtgcccgtaaatcttctttcaatgtcagtgacgtggcaaggcccgaagctgccgggagcccccccgaagaagggggctgcaccgaaggcacccccgcaaaggaccacagagcggggagagggcaccaagtccataagtcatggccactgtctataagcgatagtgactcagggctggatccaggccctggggccggggatttcaaaaagtttgaaagaacctcttccagtggtaccatgagttccactgaggaactcgtcgaccctgacggaggcgcaggggcctccgctttcgaacaggccgatctgaacggcatgactccagagctccccgtggccgtgccttctggcccattccgtcatgagggactctccaaagcggcccgcacccatagactgcgaaagttgcgcacacctgcgaaatgtagggaatgtaactcatacgtgtacttccagggtgccgagtgcgaggagtgttgcctggcttgtcataagaaatgtctggaaacgctggctattcagtgcgggcataagaaattacagggacgcctccaactttttggccaggatttcagtcacgcagcccggagtgcaccagacggggtcccattcattgtaaaaaagtgcgtttgtgagatagagagacgggcactccgaacaaaaggtatttatcgggtcaacggagttaagacccgtgtggagaagctgtgccaggccttcgagaatggtaaagagctggtcgagcttagccaggccagtccacacgacattagcaacgtgctgaagttgtaccttaggcagctccccgaacccctgatttcattccgactctaccacgaactggtaggcctcgctaaggattctcttaaggctgaggccgaggctaaggcggcaagtaggggacggcaggacggctctgaaagcgaagccgtggccgtagccctggcaggacggctgcgcgaattactgcgagatctgcccccggagaacagggcttctttacagtatctgttgaggcacctgcgcagaattgttgaggtggagcaggacaacaagatgacaccaatgcggctacggggcggacgcatgacactaggctcttgccgcgaacgccagccagaatttgtgtag

SEQ ID NO: 119955 - DNA, 3492 bp, Artificial Sequence
  Description of Artificial Sequence: Synthetic coding sequence
atgttttctagaaaaaagcgcgaattgatgaaaaccccgagtataagtaaaaagaaccgagcagggtccccatctccacagccttcaggcccccattttattagtggagaaaccgaggccgtcagcagacccgagaacccttttaatgagctgcccagcgatctccccaaggagctgcccaggaaagatggagcagatgccgtgtttcctgggccatcactggagccaccagccggctccagcggggttaaagcgacaggcacacttaagcgacccacgagcctttctcggcacgccagcgcagctggcttcccgctctccggtgcagcttcttggacactgggccgcagtcacagaagtcccttgacagccgcctcaccaggagagctgcccactgaaggagctgggcctgatgtggtcgaggatatatcccacctgctagctgacgtggccagattcgctgagggtttggagaagctgaaggagtgcgtcctgagagatgaccttctcgaggcacgtagaccccgtgctcacgagtgcctcggagaggcactgcgagtcatgcatcagatcatttccaagtaccccctgctcaataccgtggaaactttaactgctgccgggactctgatcgccaaggtgaaagcctttcactacgagagcaacaatgacctagaaaagcaggagttcgagaaggcattggagactatcgcagtcgctttctcaagcacagtcagcgagttcctgatgggggaagtagactcgtctacccttctggccgtgccgccaggtgactctagtcagagtatggagagcctctatgggcctgggtcagaggggacgccaccttcgcttgaagactgtgacgcaggctgtctccccgccgaggaggtcgatgtgctcctccagaggtgcgaagggggcgtcgatgccgccctgttgtacgccaagaatatggccaagtacatgaaagaccttataagctatctagaaaagcgaaccactttggagatggaatttgccaaaggtttgcaaaaaattgcccacaattgtaggcaatcggtcatgcaagagccgcatatgcccctgctgtctatctactccctggccctggagcaagacttggaattcggtcatagcatggtgcaggcagtgggcacacttcaaacccagacattcatgcagccgctcacacttcggagactggaacacgagaagcggcgtaaggagattaaagaggcgtggcatcgagcacaacgcaagttacaggaggcagagagtaatctcaggaaggcaaagcagggctacgtccaaaggtgcgaggaccacgataaggcacgattcctggttgctaaagccgaggaggaacaggctggctctgctccaggggccgggtctaccgccacaaaaactcttgataaaaggagacggttggaggaagaagcgaagaataaggccgaagaggccatggcaacttaccggacatgcgttgcagacgcaaagactcagaagcaagagttagaagatacaaaggtcacggccttgcggcagatccaggaagtgatccgacaaagtgaccaaactattaagagcgcaactatctcgtactaccagatgatgcacatgcagacagcgcccctgcccgttcacttccagatgctgtgcgagtctagcaaactctacgaccctggccagcagtatgcgagccacgtgcggcagctccagcgggaccaggagcccgatgttcactacgacttcgagcctcatgtgtccgctaatgcttggtctccagtgatgcgggcacgaaagtcaagtttcaatgttagcgacgtggcccggccggaagccgctggttctcccccggaggagggaggctgtaccgaaggtacgcctgccaaagaccacagggccggcagaggtcaccaggtgcataagtcatggcctctgtcaatctctgacagcgactctgggctggacccggggccaggtgccggagatttcaagaagtttgagagaacctccagctctgggaccatgtcttcaactgaggagctggtggacccggacgggggcgccggcgcgagcgcgtttgaacaggccgatctaaatggaatgacccctgagctgcctgtggctgttccaagcggaccgtttcgccacgaagggctgagcaaagccgcccgcacacataggcttcgcaagctgcgcactcctgctaagtgccgggagtgcaatagctacgtttatttccagggagcagaatgcgaagagtgctgcctcgcctgccacaagaagtgtcttgaaaccctggctattcaatgcgggcacaagaagctgcagggccgcctgcagctctttgggcaagattttagccatgccgcgcgctccgctcctgatggcgtgccatttatagttaaaaagtgcgtttgtgaaatcgagcgccgagcgctgcgaacgaagggcatctatcgggtcaatggtgtaaaaacccgcgtcgagaaattatgccaagcctttgaaaatggcaaggagctcgttgagctgagccaggctagtccacacgacataagcaatgtgctgaaactctatctccggcagctgccggagccacttatcagtttccgactataccacgagttagttggactcgccaaggatagtctgaaggctgaggcagaggccaaggcagcctctcggggccggcaggacgggagtgaaagcgaggcagtggccgtagccctggcgggaagactccgcgaactattacgcgatctccctccagaaaacagagctagcttgcagtaccttctgaggcacttacggagaattgtggaagtggagcaagataataagatgactcctggaaacttggggattgtgtttggacctaccttgctcagaccacgtccaacagaagccacagtgtcactatctagtctggtggactacccccaccaggccagagtgattgagacattgattgttcactatggtttggtatttgaagaagaacctgaggagacccctggagggcaggacgaaagttcaaatcaacgggccgaggtcgttgtacaggtgccctacctagaggccggtgaggcagtggtttatcccttgcaggaggccgctgcggatggctgcagagaaagtcgggttgtatctaatgacagtgactctgacttagaagaggcatctgagctattaagcagctctgaagcaagcgcactggggcatttgtcctttcttgaacagcagcagtcagaggcgtctctggaggtcgctagtggatcccattctggctcagaagagcagctcgaagcgactgctagggaagacggggacggagacgaggatggccctgcccagcaattgagcggctttaacaccaaccagagtaataacgtcttgcaggctcctctccctcctatgcgactaaggggagggcggatgactttggggagttgtcgggagcggcaacctgagttcgtgtag

SEQ ID NO: 119956 - DNA, 420 bp, Artificial Sequence
  Description of Artificial Sequence: Synthetic coding sequence
atgtctatttcgagtgcactggccatggtttttatgggagccaagggaaacaccgccgctcagatgtcccaggcgctgtgtttttcaaagatcggaggcgaagatggcgacattcatagagggtttcagtccctgcttgtcgcaatcaaccgaaccgatacagagtatgtactgcggactgccaatggactgttcggcgagaagtcctatgacttcttgacagggtttacggactcctgcggcaaattttatcaggctaccatcaaacagctagactttgtaaacgacacagaaaagtcaacaacacgtgtgaactcctgggtcgcagataaaacaaagggggaaaacattctgctgttttacttcgataatatcctgaattcgttcattgtatccagcttgcagaattgccagatctag

SEQ ID NO: 119957 - DNA, 162 bp, Artificial Sequence
  Description of Artificial Sequence: Synthetic coding sequence
atggagatctttatcgaggttttctctcactttctcctgcagctcacagagctgaccctgaatatgtgcttagaacttccgactggctccctagagaagtcattgatgatttcaagccaggttcttcagattcccgtagctaactctacaaagcaacggtag

SEQ ID NO: 119958 - DNA, 648 bp, Artificial Sequence
  Description of Artificial Sequence: Synthetic coding sequence
atgagcgagaccgtcccaccggcccctgccgcttccgcggcacccgagaaacccctggcaggtaagaaagccaagaagcccgcaaaggctgcggctgcctccaagaagaaaccggctggcccctccgtgtcagagctcatcgtacaggccgccagcagctcgaaggaaagaggaggagtgagtttagccgccctgaaaaaagccctcgcggccgcaggatacgatgtggagaagaacaacagcagaataaagctcggtatcaagagcctcgtttcaaagggaaccctggtgcagactaagggtactggcgcctcaggcagctttaagttaaacaaaaaggcttctagtgtagagacaaagcctggagcctccaaggtggccaccaaaacaaaagcaactggggcttccaagaagttgaaaaaagcaacaggggcctctaagaagagtgtgaaaactcccaagaaagccaagaagcctgccgccacacgcaagtcatccaaaaatccaaagaaaccaaaaactgttaagccgaaaaaggtcgccaaaagcccggcaaaagccaaggccgtcaaaccaaaggccgcaaaagcccgggtcactaaacccaagactgccaaacctaagaaggctgcccctaaaaagaagtag

SEQ ID NO: 119959 - DNA, 681 bp, Artificial Sequence
  Description of Artificial Sequence: Synthetic coding sequence
atgagtgagaccgctccagccgagacagcaaccccagcccctgtagaaaagtcaccagcgaagaagaaagcgaccaaaaaggctgcaggagccggggccgccaagcggaaagcaacaggtccaccggtgagcgagctgattacgaaggctgtggccgcctctaaggaaaggaatggcctgtccctggcggccctcaaaaaggctttggccgctggaggatatgatgtggagaagaataatagccgcattaagctgggtttgaagtccctagttagtaagggtaccctggtgcagacaaagggaacaggcgcctcgggctctttcaagcttaacaaaaaagccgcctctggcgaggccaagccgaaagcgaaaaaagccggcgcagcgaaagcgaagaagcctgctggcgcaacacctaaaaaagcgaaaaaggccgccggagccaagaaagctgtcaagaaaacaccgaagaaggccaagaaacctgccgctgccggggtgaagaaggttgccaagagcccgaaaaaggctaaagccgctgctaagccaaaaaaagcaactaagtccccagctaagccgaaggcagtgaaaccaaaagccgccaagcccaaagcagcaaagccaaaagccgcaaagcccaaggctgccaaagccaaaaaggccgcagccaagaaaaagtag

SEQ ID NO: 119960 - DNA, 642 bp, Artificial Sequence
  Description of Artificial Sequence: Synthetic coding sequence
atgagtgaaaccgccccagcggcccccgccgccgcacctcccgctgagaaagcccccgtgaagaagaaggccgcaaagaaagccgggggcactccgcgaaaagcctccgggccccctgtgtcggaactgattaccaaggcagtggccgcatcaaaagagagaagtggtgtgagcctcgctgccttgaagaaggcacttgccgcagcagggtatgacgtggagaagaataactccagaattaagctgggactgaagagtctggtgtccaagggtacccttgtgcagaccaagggcacaggcgcctccggaagcttcaaactcaacaagaaagcagcaagtggggaggcgaagccaaaggtcaaaaaagccggaggaacaaaaccaaaaaaacccgtaggggccgctaagaagccaaagaaggcagccgggggagccacccctaagaaatccgcgaaaaagaccccaaagaaggcaaagaagcccgccgctgccaccgtcactaagaaagtcgctaagtcacctaagaaagctaaggtggctaagccgaagaaagctgctaagtctgcagctaaagccgttaaacccaaagccgctaaacctaaagttgtgaaacccaaaaaagccgcacctaaaaaaaagtag

SEQ ID NO: 119961 - DNA, 666 bp, Artificial Sequence
  Description of Artificial Sequence: Synthetic coding sequence
atgtctgagacagctccgctcgcccccaccatacctgctccagccgagaagacacccgttaagaagaaggccaaaaaagctggcgccacagccggaaagagaaaagcctctggtccaccagtgtccgaactgataaccaaggccgtggccgcctcaaaggagagatctggggtttctctggccgccctaaaaaaggccctcgctgctgcgggatacgacgtggagaaaaacaatagccggatcaagctaggtctgaagtccctggtgagcaaaggcacattggttcagactaagggcacgggcgcctctggttcatttaagctgaacaagaaggcggcatcaggagagggaaaacctaaagcaaagaaagcaggtgccgcgaaacccaggaagcccgcaggggccgctaaaaaacctaagaaagtggccggtgccgccacgccgaaaaagagcatcaaaaagacacctaagaaggttaagaagcccgccaccgccgcgggcacaaaaaaggttgccaagtctgccaaaaaagtcaaaactccccagcccaagaaggccgcaaagagcccagctaaggccaaggccccaaagcccaaagccgcaaagccaaagagcggcaaacccaaggtaaccaaagcaaaaaaagcagcccccaaaaaaaagtag

SEQ ID NO: 119962 - DNA, 660 bp, Artificial Sequence
  Description of Artificial Sequence: Synthetic coding sequence
atgagcgaaaccgcccccgccgcaccagcagctccggcgccagccgaaaagactccagtgaaaaaaaaggcccgaaaaagtgcgggtgcagccaagaggaaggcttccgggccccccgtaagcgagctgatcaccaaggcggtggcagcctccaaggagcgaagcggcgtgtctcttgccgcactaaagaaggctctcgccgccgcaggctatgacgtggagaaaaataattctcggattaagcttggcctaaaatccctggtttctaagggtaccttagtacagactaagggaaccggggctagcggatcgtttaaactgaacaaaaaggctgcatctggtgaggctaaacccaaggccaaaaaggccggggcggcgaaggcgaagaagccagctggggcagcaaagaagccaaaaaaagctacaggggcagccactccgaagaaatcagccaagaaaacccctaagaaggccaagaagcccgccgccgccgccggggccaagaaagctaagtcgccgaaaaaggccaaagctgccaagcctaaaaaagccccaaagtcccccgcaaaagccaaggcggtaaagcctaaagcagccaagcccaagacagccaagcctaaagcagctaaaccgaagaaggctgcggctaagaaaaaatag

SEQ ID NO: 119963 - DNA, 624 bp, Artificial Sequence
  Description of Artificial Sequence: Synthetic coding sequence
atgtccgagacggtgccggctgcaagtgcttccgcaggcgtcgctgcaatggagaaactgcctacaaagaaaagaggccggaaacccgcaggcctgataagcgctagtagaaaggtaccgaacctcagcgtcagcaaattgataactgaagctctatccgtgagtcaggaacgggttggcatgagtcttgtcgctcttaagaaagccctcgccgctgctgggtatgatgtcgaaaaaaacaactcccgtataaaactctcactcaagtcgcttgtcaacaagggaattttagtgcaaacaaggggcacaggcgcctctgggtcatttaaactttccaaaaaggtgatccctaaaagcacgaggtctaaggccaaaaagtccgtcagcgccaaaaccaagaagctggttctctctagggacagcaaatctcctaagaccgcaaaaacaaataagcgagcaaagaagccgagggctacaacccccaagactgtccgctctggtcggaaagcgaagggagccaaggggaagcagcaacagaaaagtcctgtgaaggcacgcgcttccaagagtaagctcacacaacaccatgaggtgaacgtaagaaaggcgactagcaagaaatag

SEQ ID NO: 119964 - DNA, 393 bp, Artificial Sequence
  Description of Artificial Sequence: Synthetic coding sequence
atgtcaggccggggaaagcagggtggaaaggccagagccaaagctaaaacaaggtcttctagagctggactgcagttccctgtcggacgagttcacagactgttgcgtaaaggcaactatagtgagcgagtgggcgccggggccccagtgtatctggctgctgttctggagtatctcacagccgaaatattagaactcgcaggaaatgccgccagagataacaagaagacaaggattatcccgaggcacttacaactggccatccggaacgatgaggaactgaataaattactgggacgcgttactatagcccagggcggagttctgcctaacattcaggcagtactgctccccaagaagaccgagtcacatcacaaggcaaagggtaaatag

SEQ ID NO: 119965 - DNA, 393 bp, Artificial Sequence
  Description of Artificial Sequence: Synthetic coding sequence
atgagtggtagggggaaacagggtggcaaggctagggccaaggccaaatctagaagttccagagcgggacttcagtttccagtagggagggtccacagactcctcagaaaggggaactatgccgagagagtgggggctggagcccccgtgtatctggctgccgtgctggaatacctgacggccgagattctcgagttagcggggaatgctgcccgagacaataagaaaacacgtatcatccctagacatctgcagcttgccatcagaaatgatgaggaactgaacaaactgctgggacgtgtgacaattgcccagggtggcgttctgcccaatatccaggctgtgctcctccctaaaaaaaccgagtctcatcacaaagccaaaggaaaatag

SEQ ID NO: 119966 - DNA, 393 bp, Artificial Sequence
  Description of Artificial Sequence: Synthetic coding sequence
atgtccggacgcggaaaacagggtggcaaggcccgcgccaaggccaagtcacgatcttcccgcgctgggctccagtttcccgtcggtagggtgcaccggttgttaagaaaagggaactacgccgaacgcgtgggcgctggcgctcctgtgtatctggccgccgtcctggaatatctcactgccgaaattctcgagctcgcagggaacgctgctagagacaataaaaaaacaaggataatcccccgtcacctgcaactggccattaggaacgacgaagagctaaataaactccttggacgagtcactatcgcccagggaggagtactgccgaacattcaagcggttctgctgcccaagaaaaccgaaagtcaccacaaggctaaggggaagtag

SEQ ID NO: 119967 - DNA, 393 bp, Artificial Sequence
  Description of Artificial Sequence: Synthetic coding sequence
atgtccggccgcggaaagcagggcggcaaagcacgggcaaaggcaaagactaggtccagccgggcaggacttcagtttccagtgggaagggtccaccggttgctgagaaaaggtaattactctgaaagggtgggcgcaggtgcccccgtctacctagctgcggtccttgagtaccttacagccgaaatcctggaactcgccggaaatgccgcgcgggataacaagaagacccgaatcattcctaggcatctgcaactggccatccggaatgacgaagagctgaataaacttctcggaaaagtgacgattgcccaaggcggcgtcctccctaacatccaggcagtcctgttgcctaagaaaacagagtcccatcacaaagcaaagggaaaatag

SEQ ID NO: 119968 - DNA, 393 bp, Artificial Sequence
  Description of Artificial Sequence: Synthetic coding sequence
atgagtggacgggggaaacaaggggggaaggctcgcgcaaaggcaaaaaccaggagctcacgggccggcttgcaattccccgtgggacgcgttcataggctcctgagaaagggcaactatagcgagagagttggcgccggcgcccccgtgtatctagcagccgtactggagtacctgaccgccgaaattctggaactggctggaaatgccgccagggataataagaaaactagaatcatcccaagacatttgcaactcgctatcaggaacgatgaggaactgaacaagcttttgggacgggtgacaatcgcacaaggcggggtattgcctaacatccaggccgtgctgctcccaaaaaagacagaatcgcaccataaggcaaaaggtaaatag

SEQ ID NO: 119969 - DNA, 393 bp, Artificial Sequence
  Description of Artificial Sequence: Synthetic coding sequence
atgtccgggagggggaagcagggaggaaaggcccgagcaaaggccaagacacggagttctcgcgccggactacaatttcccgtggggagggtgcaccgactcctcaggaagggcaattacgctgagagagtgggtgccggggcaccagtttatttggcagccgtactcgagtatctgaccgccgaaattctcgagctcgccggcaacgcagccagagataataagaaaactcgaattatccctagacatcttcaactcgccatccggaacgatgaagagctaaacaagcttctggggaaggtgacaattgcacaagggggcgtccttcctaatattcaggctgttctattgcctaaaaagactgagagccaccataaagccaagggcaaatag

SEQ ID NO: 119970 - DNA, 387 bp, Artificial Sequence
  Description of Artificial Sequence: Synthetic coding sequence
atgagtggcagaggcaagcagggggggaaagcacgcgccaaagccaagacgaggtcttcccgtgccggactgcagtttcccgttgggagagtacacagactgctccgaaagggcaattatgccgagagagtgggcgctggagctcctgtgtaccttgccgcggtgctcgagtaccttaccgcagagattttagagctcgctggcaatgctgcacgggacaataagaaaacaagaataattccgcggcatctgcagctggccatcagaaacgacgaggaactgaacaaactgctgggtaaggtcactatagcgcaaggcggcgttttaccaaacattcaggctgtcctccttccaaagaaaaccgagagccatcataaaaccaagtag

SEQ ID NO: 119971 - DNA, 393 bp, Artificial Sequence
  Description of Artificial Sequence: Synthetic coding sequence
atgtccggcaggggtaagcagggaggaaaagcgcgggccaaagccaagactcgctccagccgcgccggactccaatttcccgtaggcagagtgcataggttactgcgcaaaggtaactacgcagagcgcgtaggcgcaggagcccctgtatacttggccgctgtgctggaataccttaccgccgagatcctcgagctggccggcaacgccgccagggataataagaaaactaggattatcccccggcacttgcagctggcaattcgcaatgacgaggaactgaacaagctcctgggcaaagtgacaatagcccaggggggagtgctgcctaacattcaggcggtgctgctcccgaaaaaaacagaaagtcaccacaaggctaaaggaaaatag

SEQ ID NO: 119972 - DNA, 393 bp, Artificial Sequence
  Description of Artificial Sequence: Synthetic coding sequence
atgtcaggcagaggaaagcaggggggcaaggcacgggcaaaggcaaagacccgatccagccgggctggactccagttcccggtcgggcgcgtccaccgactcctcagaaagggtaattacgcagagcgggtcggagctggtgctccagtgtaccttgccgcggtgctggaataccttacagctgaaattctcgaactcgccggtaacgccgcccgcgataacaaaaaaactcggataataccccggcatttgcagctggccattcgcaatgacgaagagttgaataagcttttaggaaaagttaccattgcccaagggggggtcttgcctaacattcaagcagtgttactccctaagaaaactgaatcgcaccacaaagcgaaaggcaagtag

SEQ ID NO: 119973 - DNA, 393 bp, Artificial Sequence
  Description of Artificial Sequence: Synthetic coding sequence
atgagcggtcgggggaagcaaggcggcaaggccagggctaaggcaaaaactaggagctccagagcaggactccagttcccggtgggcagagtgcaccgacttctcaggaagggaaactatgctgaaagagttggagctggagcacccgtgtatttagccgcagtgttagaataccttaccgcagagatcctggagcttgctgggaatgcagctcgggacaacaaaaagacgaggatcatacctcgtcatttgcagctcgccatcagaaatgatgaagagttaaacaagctactaggaaaggtgacaatcgctcaggggggagttctgcccaacatccaagcagtgttgttacctaagaaaacagaatctcatcacaaggctaagggaaagtag

SEQ ID NO: 119974 - DNA, 384 bp, Artificial Sequence
  Description of Artificial Sequence: Synthetic coding sequence
atgcccgaggtcagctccaaaggagccacaatctccaaaaaagggtttaagaaagcagtcgtgaagacacagaaaaaagaggggaaaaaacggaaaaggacccggaaggaaagttatagcatctatatctacaaggtcttgaagcaggtccatccagatacagggataagcagcaaggccatgtcgattatgaactcatttgtgacagacatcttcgaacgtatcgcttcagaggcctccagattagcgcactatagtaagcgaagcactattagttctcgagaaattcagaccgctgtgagactgttgctgcctggcgagcttgctaagcacgcagtatctgaggggactaaagcagtgacaaaatatacttcttccaagtag

SEQ ID NO: 119975 - DNA, 381 bp, Artificial Sequence
  Description of Artificial Sequence: Synthetic coding sequence
atgcctgagccttctaagtcagcacctgctcccaagaagggcagcaagaaagctatcactaaggcccagaagaaggacgggaagaagcggaaaagaagcagaaaggaatcctattcaatctacgtttacaaagtgctgaagcaggttcatccagacactgggatctcttccaaggcaatgggcataatgaattctttcgtcaatgacatattcgagagaattgcgggagaagcttctcggctagcgcattacaataagcgaagtaccattacgtctagggaaattcaaaccgccgtccggttgctgctcccgggagaactcgccaagcatgccgtgagtgagggcaccaaagccgtgaccaagtacacctcctctaagtag

SEQ ID NO: 119976 - DNA, 381 bp, Artificial Sequence
  Description of Artificial Sequence: Synthetic coding sequence
atgcctgaacccgcaaaatcagccccagctcctaagaaagggtccaaaaaggctgtaaccaaagctcaaaaaaaggatgggaagaagaggaaacggtcaagaaaggagtcctattctgtatacgtatataaggtcttaaagcaggtgcacccagacacaggaattagttccaaggctatgggtatcatgaatagtttcgtgaatgacattttcgagcggattgccggtgaggcatctcggctggcacactacaataagcggtctaccatcaccagtcgggagattcagaccgccgtgaggctgttactcccgggggaactggctaagcatgccgtctccgaagggacaaaagctgtgaccaagtatacatctagtaagtag

SEQ ID NO: 119977 - DNA, 381 bp, Artificial Sequence
  Description of Artificial Sequence: Synthetic coding sequence
atgcctgagccagccaagtccgctcccgcgccaaaaaaggggagcaaaaaggctgtgactaaggcccaaaagaaggacgggaaaaaacgaaagcgaagcaggaaagagagctactcagtgtacgtgtacaaagtgcttaagcaggttcaccccgacaccggtatcagctccaaagccatgggcattatgaactcctttgttaacgatattttcgagcggattgccggcgaggcgtcccgcctcgcacattacaataagcgctcaactatcacctctagagaaatccagaccgccgttaggttactgttacccggcgaactcgccaaacatgcagtgtctgagggcacaaaggcagtgactaagtacacctcctctaagtag

SEQ ID NO: 119978 - DNA, 381 bp, Artificial Sequence
  Description of Artificial Sequence: Synthetic coding sequence
atgccggaaccgaccaaatcagctcctgctccgaaaaaaggtagcaaaaaggctgtgactaaggctcagaagaaggatggcaagaaacgaaaacgctccagaaaggagtcttattctgtctatgtctataaagtgctgaaacaggtacacccagacacagggatttccagtaaggctatgggaattatgaactctttcgtgaacgatatattcgagaggatcgcaggcgaggcttcccggttggctcactacaacaagaggtctacaatcacttcccgggaaattcaaactgcagtccggctgctattgcctggcgaactggcgaagcacgccgtaagtgaaggcactaaggccgttactaaatacacctctagtaaatag

SEQ ID NO: 119979 - DNA, 381 bp, Artificial Sequence
  Description of Artificial Sequence: Synthetic coding sequence
atgccagaacccaccaagtctgcccccgccccgaaaaagggctcgaagaaagccgtgacaaaagcccagaaaaaagatggcaaaaagcgaaagaggtcaaggaaggagagctatagcgtgtacgtctataaggtgctgaaacaggttcacccagacacgggcatctcatctaaggcgatgggcataatgaatagttttgtgaatgatattttcgagagaatcgccggggaggccagccgtcttgctcactataataagcggtccaccataacctctcgcgagatccaaacagccgtgaggttgttgttaccaggtgaactggccaagcatgccgtttcggagggcaccaaggctgtcacaaagtatactagctcaaagtag

SEQ ID NO: 119980 - DNA, 381 bp, Artificial Sequence
  Description of Artificial Sequence: Synthetic coding sequence
atgcccgagcccgcaaagtcagcccctgctcccaaaaaggggtccaagaaggccgtgactaaggcccagaagaaggatggaaagaagcggaagcgctcccggaaggaaagctattctgtttatgtctataaggtgctgaaacaagtccacccagataccgggatctcctccaaagcaatggggatcatgaatagctttgtaaacgatattttcgagcgtattgccggagaagcttcacgactggcacattataataagcggagcaccatcacttcccgggaaattcagactgccgtaagactactactgcccggggaactggctaaacatgcggtatccgaaggaacaaaagcagtgactaagtacacaagctccaaatag

SEQ ID NO: 119981 - DNA, 381 bp, Artificial Sequence
  Description of Artificial Sequence: Synthetic coding sequence
atgccggagcccgcaaaatctgcacccgcgcccaagaaaggaagtaaaaaggctgttacgaaggcccagaaaaaggatggcaaaaagagaaaacgttcccgcaaagagagctacagtgtgtatgtctacaaagtcctcaaacaggttcatcccgacaccggcatatcatctaaagctatgggaatcatgaattccttcgtgaatgatatcttcgaaagaatcgctggggaggcctcaaggctcgcacattacaataagaggtcaactattaccagtagagaaatccagaccgccgtgcgcctgcttctgcccggggagttagctaagcacgctgtatccgaaggcaccaaggctgtgaccaagtacacctcctccaagtag

SEQ ID NO: 119982 - DNA, 381 bp, Artificial Sequence
  Description of Artificial Sequence: Synthetic coding sequence
atgccagaaccagcaaagagcgccccagctccgaagaaagggtcgaagaaggctgtgaccaaagctcagaaaaaagatggcaagaaacgcaaaagatcccggaaggagtcttatagcgtttacgtttacaaagttctgaagcaagttcaccccgatactgggattagttcaaaagctatgggcataatgaatagtttcgtgaatgatatttttgagcggattgctggtgaggcctcccgactagcccactacaataaacgctcaacaattacatccagagaaatacagactgctgtaagactgctgttgccaggcgaactggcgaagcatgccgtgtcagaggggacaaaagcagtgaccaagtacaccagcagtaagtag

SEQ ID NO: 119983 - DNA, 381 bp, Artificial Sequence
  Description of Artificial Sequence: Synthetic coding sequence
atgcccgatcctgctaagtctgccccagcccccaaaaaggggtccaagaaagctgtaacaaaagcacagaagaaagatggcaaaaagcgaaagaggtcccgaaaagagagctattcagtgtatgtatacaaagtactgaagcaagtgcatccggacacagggatctcttccaaggccatgggaattatgaattctttcgtgaacgacatattcgagcgaatagccggcgaggccagtagactggcacactataataaacgcagcactattacatcgcgggagattcaaacggcggtccgactgctgctacctggggagcttgccaaacatgctgtgtctgaaggcactaaggccgtgacaaaatacacttcttccaaatag

SEQ ID NO: 119984 - DNA, 381 bp, Artificial Sequence
  Description of Artificial Sequence: Synthetic coding sequence
atgccagaacctgccaaatcggctcccgcacccaaaaagggtagcaaaaaggctgtgacaaaagcacagaaaaaagacggtaaaaagcgaaagcggtcgagaaaagagtcatactcggtatacgtctacaaggttcttaaacaggtccatcccgacactgggattagtagcaaagctatggggattatgaatagcttcgtgaatgacattttcgagaggatcgctggggaagcgtccaggcttgcccattataataagaggtccaccatcacttccagagagatacaaaccgctgtgaggctgctactcccaggcgaactggctaagcacgctgtttccgaagggacgaaagcggtgacaaagtacacttcatctaaatag

SEQ ID NO: 119985 - DNA, 381 bp, Artificial Sequence
  Description of Artificial Sequence: Synthetic coding sequence
atgccagaactggccaaaagcgctccagccccaaaaaaggggtcgaagaaggcggtgaccaaagcccaaaaaaaggatggtaaaaagaggaagcgaagtcggaaagaatcttactcagtctatgtttataaggttctcaagcaggtacaccctgacacaggcatctcaagtaaggctatggggattatgaactcattcgtgaacgatatcttcgagcggatagcttctgaggcctcgaggctggcccattataacaagcgtagtacaatcacgagtcgagagatccagaccgcagttcgattactgctacccggagaactcgcgaagcatgctgtgtctgaagggactaaagcggtgacgaagtacacttccagtaaatag

SEQ ID NO: 119986 - DNA, 381 bp, Artificial Sequence
  Description of Artificial Sequence: Synthetic coding sequence
atgcccgaacctgtgaagtctgctcccgtgccaaaaaagggtagcaagaaagcaatcaataaagctcagaagaaagatggtaaaaagagaaaacggtctagaaaggaaagctactccgtatatgtgtataaagtcctgaagcaggtacacccagacactggcatcagctcaaaagctatgggaatcatgaacagcttcgtgaatgacatcttcgagaggattgcaggagaggcctctcggctcgctcattataataaaaggtcaacaattacatcacgggaaatccaaaccgcagtccgactgctgctgcccggcgagctagcaaagcacgctgtcagtgaagggaccaaggccgttaccaagtataccagctccaagtag

SEQ ID NO: 119987 - DNA, 381 bp, Artificial Sequence
  Description of Artificial Sequence: Synthetic coding sequence
atgccagaaccttccaagtcagctcctgcccctaagaagggttcaaaaaaggctgtgacgaaggctcagaagaaagacgggaagaagaggaagaggtcgcggaaagagagttattctgtgtatgtgtacaaagtgctgaaacaggtgcaccccgataccggaatttcttcaaaagcaatggggatcatgaattcatttgtcaacgacatttttgagcgcatagccggcgaggccagtcgcctggctcactataacaaacgctccacgatcacctctcgtgaaattcagactgccgtacggttgcttctgccaggcgaactggcaaaacacgctgtgagcgaggggaccaaagccgttactaagtacactagtagtaaatag

SEQ ID NO: 119988 - DNA, 381 bp, Artificial Sequence
  Description of Artificial Sequence: Synthetic coding sequence
atgccagaaccatcaaagagcgcccctgctcccaagaaggggtcaaaaaaagccgtcacgaaggcccaaaagaaggacggcaaaaaacgtaaacggtccaggaaggagagctactctgtgtatgtatacaaagtcctcaaacaagtccaccccgataccggcattagctcgaaagcgatgggaattatgaacagctttgtgaacgacatctttgagagaatcgcgggtgaggcctcacggcttgcccactataacaaacgcagcaccataacgtcccgagagattcagacagcggttcggctgctcttacctggcgaactcgcaaaacacgctgtgtcagagggaacaaaggcagtgactaagtacacgagcagcaagtag

SEQ ID NO: 119989 - DNA, 381 bp, Artificial Sequence
  Description of Artificial Sequence: Synthetic coding sequence
atgcccgaccccgcgaaaagcgcccctgccccaaagaagggatctaagaaagccgtcaccaaggcccagaagaaggatgggaaaaaaagaaagaggtctcgcaaggaatcctatagcatctatgtgtataaggtgcttaagcaggtccatcctgatacaggcataagctcaaaagcaatgggtattatgaattcttttgtgaatgatatctttgaaagaatagcgggtgaggcctcacgccttgcccattataacaagcggtccaccattacatcgagggagatacagactgcagtgcggctcttgttgcctggcgagcttgctaaacatgccgtgtctgagggcacaaaggcggtaacaaagtacacctcaagtaaatag

SEQ ID NO: 119990 - DNA, 411 bp, Artificial Sequence
  Description of Artificial Sequence: Synthetic coding sequence
atggcacggaccaaacagaccgcccggaaatctaccggaggaaaggccccccgcaagcaactcgctacgaaagctgcaaggaaatcagctccggcgacgggtggcgtcaagaaaccccatcggtataggcccggaacggtggctctccgagagattcgccgctatcagaaatctactgagctcctgattaggaagcttccattccagcggctggtaagagagatcgctcaggactttaaaacagatttgagattccagtccagtgcggtaatggcgttgcaagaggcctgcgaggcttacctggtgggtctgttcgaggatactaacctttgcgccatccacgcgaaaagggtgaccatcatgcccaaagatatccaactggcccgtcgaatcagaggcgaaagggcctag

SEQ ID NO: 119991 - DNA, 411 bp, Artificial Sequence
  Description of Artificial Sequence: Synthetic coding sequence
atggcgaggactaaacagactgccagaaaaagtactgggggaaaggcgccccggaagcaattagcaacgaaggcagcgagaaaatcagcaccagctacaggcggtgtgaaaaaaccgcaccgatacagacctggtacagtcgccctgagggagattagaagataccagaagagcacagagctcttgataagaaagctgcctttccagagactggtccgcgagatcgcgcaggactttaaaacagatctacggttccaatcttccgcggttatggcgcttcaggaggcctgcgaggcatacctggttggcctgtttgaagacactaacctttgtgccattcacgccaagcgggtaacaatcatgcctaaagacattcagcttgcccggcgcatccgaggagagcgagcttag

SEQ ID NO: 119992 - DNA, 411 bp, Artificial Sequence
  Description of Artificial Sequence: Synthetic coding sequence
atggccaggactaagcagactgcccgcaagagcaccggaggaaaggctccgagaaaacagctggccactaaggccgcacgaaaaagcgcccccgcaactggaggcgtgaagaaaccacaccgataccgtcccggcaccgttgccttaagagagatcaggcgttaccagaagagtaccgaactgctgattcggaagttgccatttcagcgactggtccgagaaattgcccaagactttaaaacagacctaaggtttcagagcagtgccgtgatggctctgcaagaggcatgcgaagcatacctggtcggtctcttcgaagatacaaatctatgtgcaatacatgccaagagagtcactataatgcccaaagacatccagctggccaggcgcatcagaggagagcgggcctag

SEQ ID NO: 119993 - DNA, 411 bp, Artificial Sequence
  Description of Artificial Sequence: Synthetic coding sequence
atggcgcggacaaaacagacagcccgcaaaagcacgggtggcaaagctccaaggaagcagctggctaccaaggctgctaggaagtccgcacccgctactgggggagtgaagaaacctcaccgataccgccccggaacagtcgcgttacgagaaatcaggaggtatcagaagtcaacggagctccttataaggaagttgccctttcagcggcttgtgcgtgagatcgcgcaggattttaaaactgacctgagattccaaagctccgccgtgatggcgcttcaggaggcttgcgaagcctatctggttgggttattcgaggacaccaacttgtgcgcgatccatgcaaaaagggtcaccattatgccgaaagatattcagctggccagaaggattagaggagagcgcgcgtag

SEQ ID NO: 119994 - DNA, 411 bp, Artificial Sequence
  Description of Artificial Sequence: Synthetic coding sequence
atggcaaggacgaagcagacggccaggaagagcacaggtggcaaggctcctcgtaaacagctggcgacaaaggccgcaaggaaaagtgcacccgccacggggggagttaagaagccacacagatataggccaggcactgtcgcattgcgtgagatccgccgataccaaaaatccacagagctcctcattcggaagcttccctttcagcggcttgtgcgggaaattgcacaggatttcaagaccgacttgaggttccagtccagcgcggtgatggccttacaggaggcttgtgaggcgtacctggtgggacttttcgaagacacaaacttatgtgctattcacgctaagcgggtgacgatcatgcctaaggatattcagcttgcacggcgcatacgaggcgaacgggcatag

SEQ ID NO: 119995 - DNA, 411 bp, Artificial Sequence
  Description of Artificial Sequence: Synthetic coding sequence
atggccaggaccaaacagaccgcccggaagagcacaggcggcaaggcacccagaaagcagctggccacaaaagcagccagaaagagtgcacctgccacaggcggtgtgaagaaaccccaccgatatagacccgggacagtggctcttcgcgaaattagaagatatcagaaaagcactgaattgctaatccgaaagctgccctttcaacgcctggtcagagaaatcgcgcaggactttaagacagacctgcggttccagtcatctgccgtgatggcgctgcaggaagcctgtgaagcttatctcgtgggcctgttcgaggatacaaatctgtgtgcaatccacgccaagcgcgtgaccattatgccaaaagacatccaactggccagacgaattaggggagaaagggcatag

SEQ ID NO: 119996 - DNA, 411 bp, Artificial Sequence
  Description of Artificial Sequence: Synthetic coding sequence
atggctaggacaaagcagactgcaagaaaatccacgggtggtaaggcccctcggaaacaattggctaccaaggccgccagaaaaagcgcaccagccacgggcggagtgaaaaagcctcacagatacaggcccggtaccgtcgcattgagggagatccgccgctaccagaagtccaccgaattactgatccggaaactgccttttcagaggttggttagggaaattgcccaggattttaaaactgacctcaggtttcagtcctccgccgtcatggcactacaggaagcttgtgaagcatatctggtcggcctgtttgaggatacgaatttgtgtgccatacacgcaaaacgggtgactattatgcccaaagatatccagcttgcgaggcgaattcggggcgagcgagcctag

SEQ ID NO: 119997 - DNA, 411 bp, Artificial Sequence
  Description of Artificial Sequence: Synthetic coding sequence
atggctcggaccaagcagactgcccgaaagagtaccggcggtaaagcacctcgaaagcagttggccaccaaggctgctcgaaaatccgcaccagccactggtggtgtcaagaaaccacaccgttatcggcctggaactgtcgcattgcgggagatcaggaggtatcagaaaagtacagagctcctgatccgaaagctgcctttccagagacttgtcagagagatcgcccaggacttcaagactgacttacggttccagagtagtgccgtcatggctctgcaggaagcttgcgaggcctacctcgtgggactattcgaagacacgaatctgtgcgctattcatgctaaacgcgtgactatcatgccaaaagatattcaattggcaaggcgaatcaggggcgagagggcctag

SEQ ID NO: 119998 - DNA, 411 bp, Artificial Sequence
  Description of Artificial Sequence: Synthetic coding sequence
atggccaggactaagcagacagctcgaaagtctacaggcggtaaggctccacggaaacagctggcaacgaaagcagccagaaagagcgcccctgctacgggtggggtaaagaaaccccatcgctacaggccaggaactgttgcgctgagagaaattagacgctaccagaagtccaccgagcttttaatccgcaaactgccgtttcagaggctcgtgcgggagattgcacaggattttaaaaccgatcttcgctttcagagctccgcagtgatggccctacaagaggcatgcgaggcatacctggtggggctgtttgaggatactaacctgtgcgccattcacgccaaaagagtgactatcatgcccaaggatatacagttagctaggagaatcaggggcgagagggcatag

SEQ ID NO: 119999 - DNA, 411 bp, Artificial Sequence
  Description of Artificial Sequence: Synthetic coding sequence
atggccaggactaaacagactgctcggaagagcactgggggaaaggctcccagaaagcagctggctactaaggccgctcggaagtcggcgccagcgacaggaggagtgaagaagccacatcggtaccgtccaggcactgtggccctgagggagatccgaagatatcagaaaagtaccgagctgttaattcgcaagctccccttccagcggttggtgagagaaattgcacaggacttcaagacagatctgcgattccagagttcggccgtgatggccctgcaggaggcttgtgaggcatacctggtgggactgttcgaggatactaatctctgtgccatccacgccaaacgcgtgaccattatgcctaaagacatacaattggcacggagaatcaggggcgagcgcgcatag

SEQ ID NO: 120000 - DNA, 411 bp, Artificial Sequence
  Description of Artificial Sequence: Synthetic coding sequence
atggctagaacgaaacagactgcccggaagagcaccgggggaaaggctccgagaaaacagctggcaaccaaggctgctcgaaaatcggcaccggctacaggcggggtaaagaaaccccacaggtacagacccggcaccgtagccctacgcgagattcggcggtaccagaaatccacagaacttctgattcggaagctgccgttccagagactggttcgcgagattgcgcaggactttaagactgatctgcgtttccagagtagcgccgtcatggccttgcaggaggcatgtgaagcatacctggtcggtctgttcgaagacaccaacctatgtgcaatccacgccaaacgcgtgacaatcatgccaaaagatattcagcttgcgcggcgtatcaggggggagagggcatag

SEQ ID NO: 120001 - DNA, 339 bp, Artificial Sequence
  Description of Artificial Sequence: Synthetic coding sequence
atgtcaggacggggcaaaggcggaaaaggattagctaaggccaagacctgcagctccttacccggcctgcagttccccggtcgagtgcggcatttgttccggaaaggcaactactttgagcccgtgggagctggggctccagtgtatttgcagtatttagcagctgaaattctcgagctagttggaagcgcgatcagagataaaactcgctctatcatcccaaggcacctccagctcgccattcgcaacgatgaagaggttaataaacagctggggaatgttaccattgctcagggcggggtgctgtcaaacattcaggccgtcctcctccccaaatag

SEQ ID NO: 120002 - DNA, 312 bp, Artificial Sequence
  Description of Artificial Sequence: Synthetic coding sequence
atgtctggccgggggaaaggagggaagggcttgggtaaggggggtgcgaagcgccaccgcaaggtgctccgggataatatccagggaatcactaaacccgccatacgtaggttggcccgacgcggaggagtgaagagaatctcaggactgatctatgaggagacacggggcgtgctgaaagtcttcctggagaacgttatacgcgacgccgttacctacacagaacacgctaaaagaaaaactgtgacagcaatggatgtggtgtatgcgctgaaacggcagggtcgcacgctttacgggtttgggggctag

SEQ ID NO: 120003 - DNA, 312 bp, Artificial Sequence
  Description of Artificial Sequence: Synthetic coding sequence
atgagtggccggggtaagggaggtaaggggctgggcaagggtggtgccaaaagacatcggaaggtgcttagagataacatacagggaatcaccaagcccgcaattcgcagactggcccggagaggtggagtgaaacgtatttccgggctgatttatgaggaaaccaggggtgtcctcaaagtgtttctcgaaaacgtgatccgggacgcagtcacatatacagaacacgcaaagcgaaagacagttacagcgatggatgttgtctatgcgcttaaaagacagggtagaacgctctatggattcggcggctag

SEQ ID NO: 120004 - DNA, 312 bp, Artificial Sequence
  Description of Artificial Sequence: Synthetic coding sequence
atgagtggcagaggcaaggggggcaagggtctgggcaaaggcggtgccaaacggcatcgcaaggttctgcgcgataacattcagggcattactaagcccgccatccggagactggccagaaggggaggtgtcaaacgcatctcaggacttatttatgaagaaacacgaggggtactgaaagtgttcctagagaacgtgattagagacgccgtcacatatacagagcacgctaaaagaaaaaccgtgacagccatggacgtcgtgtatgcactcaaacgccaggggcgcaccctgtatggctttgggggatag

SEQ ID NO: 120005 - DNA, 312 bp, Artificial Sequence
  Description of Artificial Sequence: Synthetic coding sequence
atgtccggccgaggaaaaggcgggaaagggttgggaaaaggcggcgcaaagcggcaccgaaaagttctgcgcgacaacattcagggcattaccaagccagccatccggcgactggctcggcgtgggggagtgaaaaggattagcggcctgatttatgaagaaactcgaggagtactgaaggtgtttctcgaaaatgtcatccgtgatgccgtgacttacacggaacatgcgaaaaggaagaccgtgactgccatggacgtggtctacgctttaaaacgacagggccgcactctatatggttttggcggctag

SEQ ID NO: 120006 - DNA, 312 bp, Artificial Sequence
  Description of Artificial Sequence: Synthetic coding sequence
atgagtggtcgggggaaaggggggaagggtctcggcaagggaggggccaagaggcacaggaaagttttaagagacaacatacagggcatcactaaaccggcaataaggcgcctggctcggcgcggcggagtaaagagaatcagtggcctgatctacgaggagacaagaggagtactcaaagtcttcctggagaatgtgataagagacgcagtgacctacaccgagcatgctaagcgtaagacggtcacggctatggacgttgtgtatgccctgaaacggcaagggagaaccctgtacgggttcggggggtag

SEQ ID NO: 120007 - DNA, 312 bp, Artificial Sequence
  Description of Artificial Sequence: Synthetic coding sequence
atgagcggacgtgggaagggaggcaaaggtctcggaaaggggggtgcaaaacgccatcggaaagttctgagagacaacatccagggcatcacaaagccagcgattcgacgcctggcacggcggggtggagtgaagaggatctctggtcttatatacgaggagacaaggggggtactgaaggtcttcctggagaatgttattcgcgacgccgtgacgtataccgaacacgccaaacgaaagactgtgacggccatggacgtggtttacgccttaaaacggcagggccgtactctgtatggcttcggtggctag

SEQ ID NO: 120008 - DNA, 297 bp, Artificial Sequence
  Description of Artificial Sequence: Synthetic coding sequence
atgtccgttcggggtaaagcaggcaaaggattaggcaagggaggagctaagtgccaccgcaaagttctgagcgacaacattcagggcatcacgaagtgtactattcgcaggctggcacgccatggaggtgtcaagcggattctgggattaatttacgaagagacccgccgtgtgtttaaggtgttcctcgagaatgtgatttggtatgcagtaacgaataccgaacacgcgaagcgaaagactgtcactgcgatggcagtggtatacgttctgaagcgtcaaggccgcaccctatag

SEQ ID NO: 120009 - DNA, 312 bp, Artificial Sequence
  Description of Artificial Sequence: Synthetic coding sequence
atgtcaggaaggggcaaagggggtaaagggctaggcaagggcggagctaaacgtcacagaaaggtattacgtgacaacattcaaggcatcactaaacctgcaattcggcgcctcgcacgaaggggcggcgtcaagcgcattagtggcctaatttacgaagagaccagaggagtgctcaaggtgtttcttgagaacgtgatccgggatgcggttacatacaccgagcacgccaagagaaagaccgttacagcgatggacgtggtctacgcacttaagcgccagggcagaacactatacgggtttggaggttag

SEQ ID NO: 120010 - DNA, 312 bp, Artificial Sequence
  Description of Artificial Sequence: Synthetic coding sequence
atgagcgggagaggaaaaggcggaaaggggcttggcaagggaggcgctaagaggcacaggaaggtcctgcgagacaacattcagggaatcaccaaaccagcgattcgccgattagcacgcaggggaggagtcaagaggattagcggccttatttacgaagaaactagaggcgtcctcaaagtgtttctggagaacgtgatcagggacgctgttacctatactgagcatgccaaaaggaaaacggtaacggctatggacgtagtctacgctctgaaacgccaggggcgcaccctgtatggatttggtggatag

SEQ ID NO: 120011 - DNA, 312 bp, Artificial Sequence
  Description of Artificial Sequence: Synthetic coding sequence
atgtccgggagaggcaaggggggtaagggactgggcaaagggggagctaaaagacaccgaaaggtcttgagggataatattcagggaattaccaagcccgccatccgacgactggcccgaagagggggcgtgaaacgaatctcaggtcttatttatgaggagacccggggcgttttgaaggtattcctcgagaatgtcatccgtgatgctgtgacctacactgagcacgccaaaaggaagacagtgacagcaatggacgtcgtctacgcattgaaaagacaagggaggacactgtacggttttggcggttag

SEQ ID NO: 120012 - DNA, 312 bp, Artificial Sequence
  Description of Artificial Sequence: Synthetic coding sequence
atgtctggccgagggaaaggtggtaaggggctcggtaaaggcggggctaagagacatcgtaaagtgttaagagacaatatccaggggatcaccaaaccagccataaggcgactagcccgtaggggtggagtgaagagaattagtgggctgatatatgaagagacccgcggtgtgttaaaagtatttctagaaaacgtcattcgcgacgccgtgacctacaccgagcacgctaagcgcaaaaccgtgaccgccatggatgtagtttatgcattgaagcggcaggggaggaccctctatgggttcggaggctag

SEQ ID NO: 120013 - DNA, 312 bp, Artificial Sequence
  Description of Artificial Sequence: Synthetic coding sequence
atgagcggcagagggaaaggtggaaagggtctgggcaaaggtggtgccaaacgccatcgtaaggtgcttcgggataacattcagggcattactaagcctgcaataaggcgtctagcacggcgagggggagtcaaacggatctccggattgatatatgaggaaacgagaggggttctgaaggttttcctggaaaatgtgatacgagatgctgtcacttacacagagcatgccaagcggaagactgtgacagcgatggacgtggtgtatgctctaaagcgccagggacgcaccctttacggctttggaggctag

SEQ ID NO: 120014 - DNA, 312 bp, Artificial Sequence
  Description of Artificial Sequence: Synthetic coding sequence
atgtccgggagaggaaagggcggcaagggtttagggaaaggtggggcgaagcgccacagaaaagttcttcgcgataacattcaaggaatcacgaagcctgccattcgcagactcgctcggagaggcggtgtgaagagaatttctggccttatttatgaagagaccagaggggtgctgaaggtcttcctcgagaacgtaatacgggacgctgtaacatacacggagcatgcaaagcgcaaaacggtgacagccatggacgtagtgtatgctttgaaacgtcagggacgcacactgtatgggtttggcggctag

SEQ ID NO: 120015 - DNA, 390 bp, Artificial Sequence
  Description of Artificial Sequence: Synthetic coding sequence
atgagcggccggggtaagcaaggtgggaaggcacgggctaaggccaagagtcggtcaagcagggctggacttcaattccctgttggtcgggtgcataggctgcttagaaaaggcaattacgcagagagggtgggtgctggagctcccgtatatatggccgcggtgctagaatatctgactgctgaaatactagaactggctgggaatgcggcccgagataacaagaagaccaggattatcccccggcacctgcaactagccatcaggaacgatgaggaactcaataagctgttgggcaaagtcacaatcgcgcagggtggggtcctcccaaatattcaagctgtgctgttgcctaagaagactgaatctcacaaagctaagtccaagtag

SEQ ID NO: 120016 - DNA, 381 bp, Artificial Sequence
  Description of Artificial Sequence: Synthetic coding sequence
atgccagaaccagccaaatccgccccagcccctaagaaaggctccaaaaaagctgtcaccaaagcccaaaaaaaagatgggaagaagagaaaacggagtcgaaaggaatcatactcgatttacgtgtacaaggttctgaagcaggtgcatcctgacacagggatctcatctaaagcgatgggcatcatgaattcttttgtgaatgatatctttgaaaggattgccggggaggcctctcgcctcgctcattacaataaacgtagtaccattacttctagagagattcaaacggctgtcaggttgctcttgcctggtgagctcgcaaaacatgctgtgtcagagggcactaaagcagtgactaaatatacaagctcaaaatag

SEQ ID NO: 120017 - DNA, 411 bp, Artificial Sequence
  Description of Artificial Sequence: Synthetic coding sequence
atggcccgcacaaagcagacagcccggaaatcgacaggcggtaaagccccccgaaaacagcttgctactaaggctgcgagaaagtcagctcccgctacaggcggggtcaagaagccgcataggtacaggcccggaacagtggctctccgggaaattaggaggtaccagaaatcaacagaactgttgatacgaaagcttccatttcagcgtctcgtcagggagattgcacaggactttaaaactgatttgaggttccagtccagcgccgtgatggctctacaggaggcctcggaggcctatcttgtgggcctgttcgaggataccaatctgtgtgctattcatgccaaaagggtcacaattatgccgaaggatatccagctggcccgacgtataagaggcgaacgagcatag

SEQ ID NO: 120018 - DNA, 411 bp, Artificial Sequence
  Description of Artificial Sequence: Synthetic coding sequence
atggcacggacaaaacagaccgctaggaaatccaccggaggcaaagcccccagaaaacagttagcaacaaaggtagcccggaaaagtgcccctgccactggcggggtgaagaagccacaccggtaccggcccggaaccgtagccttgcgggaaatacgccggtaccagaaatccacggaactacttatccgcaagttgccctttcagcgattgatgcgggaaattgcccaagattttaagactgatctacgatttcagtcctctgcggttatggcactccaagaggcttgcgagagttacctggttggcctgtttgaagataccaacctatgtgtgattcatgccaaaagggtcactatcatgcctaaggacatacagctggctagacggattcgcggagagagagcttag

SEQ ID NO: 120019 - DNA, 684 bp, Artificial Sequence
  Description of Artificial Sequence: Synthetic coding sequence
atggagggacagagtggaagatgtaagatcgtggttgtcggtgacgccgagtgtggcaagaccgctctcctgcaagtgttcgcaaaggacgcatatccaggcagctacgtcccaaccgtgtttgagaactacaccgcaagcttcgagatcgacaagagaaggatcgaactgaacatgtgggatacaagtgggtcatcatattatgataacgtgaggccccttgcataccccgacagcgatgctgtgctgatatgtttcgatattagccggcccgagacactggatagtgtactgaagaagtggcaaggggaaacacaggagttctgtccgaatgcaaaagtcgtgctggtgggctgcaagcttgacatgcgcaccgacttggccaccctccgtgaactcagcaaacagcgtctcatccctgtgacccatgagcaggggactgtgctggctaaacaagtaggggctgtatcatatgttgagtgctccagtcggagctccgagcgcagtgtgcgcgacgtgtttcacgtggctacggtggctagtctgggtaggggacaccgtcagttacgccgcactgactccagacgcggcatgcaacggtcggcccaactttccggccgccccgatcgcgggaatgagggtgagatacacaaagatcgggccaagtcttgtaatctaatgtag

SEQ ID NO: 120020 - DNA, 3114 bp, Artificial Sequence
  Description of Artificial Sequence: Synthetic coding sequence
atgaacagccctaacgaaagtgatggaatgagcggacgcgaaccaagccttgaaatcctcccccgtacctcactccacagcattccagtaaccgtggaggtgaagcccgttctaccacgcgccatgccgtcatcaatgggaggaggcggcggcgggtcccccagtccggtggaactgaggggcgcactggtgggcagtgtggatccaaccctgagggaacagcaattacagcaagaactgctggccctaaagcagcagcagcaattgcagaagcaattactgttcgccgagtttcagaagcaacacgaccatctcactagacagcacgaagtacaactccagaaacatcttaaacaacaacaagagatgctggcagccaagcaacagcaagagatgcttgcagctaagcgccaacaggagctggaacaacagcgacagagagagcagcagcgccaggaggagttggagaaacaacgactagagcaacaactgctgatactgagaaacaaggaaaagtcaaaagaaagcgctatagcctcaactgaagtcaagctgaggctgcaagagtttttgctttccaaatccaaggaaccgactccggggggcctgaaccatagcctgccacagcatcctaaatgctggggggcacatcatgcgtcacttgatcagtcttcacctccacaaagcgggccacccggcacccctccgtcgtataagttaccactccctggcccttatgacagccgcgatgacttccctttgagaaaaacagccagtgagcccaacctgaaagttcgttctaggctaaagcagaaagtcgcagaacgaaggtcatcccctctcctccggcggaaggatggaacagttatttcaacatttaagaaacgcgcggtggaaatcaccggggctggacccggtgctagcagtgtttgtaactccgcccctggcagcggccctagctcgcccaacagttcacacagcacaattgcagaaaacggtttcacgggatccgtgccaaacatccccaccgaaatgttaccacagcatcgagcactgccactggattcctcaccgaatcagtttagcctctacacctcccccagcttgcctaatatcagcctggggctacaggctacagtgacagtcacaaatagccacctgactgcttctcccaagctcagtactcaacaggaagccgaaaggcaggctctgcaaagcctgagacaggggggaacacttactggcaagtttatgtctacgtcaagcattccgggatgcctgctcggcgtggcactcgaaggcgatgggtctcctcacggtcatgccagtttgctgcagcacgtgttactcctggaacaggcacgacagcagtcaactcttatcgccgtgcctctgcacggccagagccctttggtgactggtgagcgcgtagccacgagcatgagaaccgtaggcaagctccctaggcatagacctctgtcgaggacgcagtcttctccacttccccaaagtcctcaggctctccagcagctcgtgatgcagcagcagcatcaacaatttctggagaagcaaaagcagcagcagttgcagctggggaagatattaactaaaacaggagagctacctcgtcagccgacgacacatcctgaggagactgaggaggagctaacagaacaacaggaggtgttgctgggcgagggcgcactgacgatgccccgggagggatctaccgagtccgaatctacccaagaggatctcgaggaagaagatgaggaggatgacggtgaagaagaggaggattgtatccaagtgaaagatgaggaaggcgaatcaggggccgaagaaggccctgacctggaagagccgggggccggctataaaaagctgttctcggatgcgcagccattgcagcccttacaggtctatcaggccccccttagccttgccactgtacctcaccaggctctaggtcggacccagtcatccccggccgcaccaggcggaatgaagagtcctcccgatcagcctgtgaagcacctgttcacaacaggcccaatatcacagaaaatgtacgcagtgcttccttgcggcggtatcggtgtcgactccgacactgtttggaatgagatgcactccagtagcgcggttcggatggccgttggttgtctgctagagttggctttcaaggtggccgcgggcgagcttaagaatggctttgcaatcatacgaccccccggtcatcatgccgaggagtctaccgcgatgggattctgcttttttaactctgtggccatcacagccaagctgctgcagcaaaaacttaacgttggaaaggtcctgattgtggattgggatattcaccatggtaatggaacccagcaggctttctacaacgatccttctgtgttgtacatctccctccaccggtatgataatggtaatttctttccagggagtggggcacctgaagaagtgggaggcggaccaggcgttggctataatgtgaacgtcgcctggaccggtggtgtggatccgcccatcggggacgtagagtacctgactgcctttcgtacagtggtgatgcccatcgcacatgagtttagcccagacgttgtcctggtgtcagctggctttgatgccgtggaaggccacctatctccactgggaggctattccgtcaccgcacgatgttttggacacctcacacgccagctgatgaccctagctggtgggagggtggttctggctctggaaggcggccatgaccttacagcgatctgcgatgcctctgaagcctgcgttagcgctttgttgagcgtggaactgcagcccctcgatgaggccgtgctccagcagaaacctaacatcaatgccgtcgccactctggaaaaggtgattgagattcagtctaagcactggagctgcgtgcagaagtttgctgctggactggggcgttccctaagggaggcccaggccggggaaacggaagaggcagagacagtctccgccatggctctgctgagcgtcggggctgagcaggcccaggccgccgctgcccgggagcactcccctaggcctgcagaggagccaatggagcaggaaccagctctgtag

SEQ ID NO: 120021 - DNA, 3369 bp, Artificial Sequence
  Description of Artificial Sequence: Synthetic coding sequence
atgaactctccgaacgagtcagatggcatgtccgggagggagccttccttggagatcttacccaggacctctttacattcgatacctgtcaccgtggaagttaaaccagtattgccccgggcaatgcctagctcaatgggaggcggcggtggcggcagcccatcccccgtcgagctacgaggcgcgttagtcggatcagtggatcccacactgagggaacaacaattacagcaggaactgctcgctctaaagcagcaacaacagttgcaaaaacagttgctctttgccgaattccagaagcaacatgaccatctcacacgacaacatgaggtccaactacagaagcatctcaagcaacagcaggaaatgctggccgccaaacaacaacaggagatgctcgctgcgaagagacaacaggagctggagcaacagaggcaacgagaacaacagcgacaggaagagctggagaagcaacggctcgagcagcagctgctgattttgcggaacaaggaaaaatctaaggagtctgccatcgcaagcactgaagtcaaacttaggctccaggagttcctactgagcaaatccaaagagcccaccccaggcggcctgaaccattcccttccacagcatcccaagtgctggggcgcccatcacgcgagtctcgatcagtcgtccccaccgcagtcaggacctcccggcacccctccaagctacaagctgccacttccgggcccatatgattccagggacgatttccccctgcggaagaccgcatcagagccgaacttgaaagtacgctctagactgaagcagaaagtggctgagcggagatccagtccccttttacgcagaaaggatggcaccgttatctccacttttaagaaacgagcagtggaaatcacgggggctgggccaggcgcatccagtgtgtgcaacagtgcaccgggctctggaccctcctcccccaactcctcacattcgactattgccgaaaacggctttacaggcagcgtgcctaacatcccaacagagatgctgccgcagcaccgcgccctacctctggattcttcccctaatcagttcagtctgtacacctcccccagtttgccaaacatttccttgggtctgcaagccaccgtcaccgtgaccaatagtcacttgactgcttccccgaagctctctactcagcaagaagcagagaggcaggccctgcagtcactcaggcagggcggtaccctcacggggaagtttatgagtacttccagtattcctggctgtctactcggagtcgccctggagggcgacggcagcccacatggacacgcttccctgctacagcacgtcttacttttggaacaggcaaggcagcagagcacgttgatcgccgttcccctgcacgggcagagccccctcgtgaccggggagcgggtcgccacatccatgaggacggtggggaagctcccacggcataggccgctttctcgcacacagagttccccattgccacagtcacctcaggccctccaacagttagttatgcagcagcagcaccagcagttcctcgaaaagcagaagcaacaacagctgcagttgggaaagatattgacgaagacaggcgagttgccccggcagccaacgacccatcctgaggagaccgaggaggaactgaccgagcagcaggaagtgttactgggagagggcgcgttaaccatgcctcgggagggcagtaccgagtctgaaagtacacaggaagacttggaggaagaagacgaggaggacgacggggaagaggaagaagattgtatacaggtgaaggacgaagaaggcgaaagcggagcggaggagggccccgatttagaagaaccaggcgccggctataaaaaactgttttccgacgcacaacccttgcagccccttcaggtataccaggcacccctgtctctggcaactgtgcctcaccaggctctgggaagaacacaaagctctcccgctgctcctggtggcatgaagagtccgcccgatcagcccgtgaagcacctcttcacaaccggagtggtgtacgacactttcatgctgaaacaccagtgtatgtgcggaaatactcacgtgcaccccgagcacgccggtcgaatacagagcatttggagcagacttcaggagaccggacttttgtccaaatgtgagcggattaggggacgaaaggccacactggacgaaatccaaacagtgcattctgagtaccacacgctcctttacggcaccagccccctgaacagacagaaacttgactccaaaaagttgctcgggccgatcagccaaaagatgtatgccgtcctcccctgtgggggaatcggggtggactctgatactgtttggaacgaaatgcactcttccagcgccgtgcgaatggctgtcgggtgcctgctcgagctcgcctttaaagttgctgctggcgagctgaagaacgggtttgctatcatcaggccccccggacaccacgctgaggaaagtactgctatgggtttttgtttcttcaacagtgttgccatcacagccaagctactgcaacagaaactgaacgtgggcaaggtgcttattgtggactgggacattcaccacggaaatgggacacagcaagctttctacaatgatccctccgttctctacatatccctacatagatatgataacggaaatttcttcccaggcagcggcgcacccgaagaggtggggggcgggcctggcgtaggttacaatgtgaacgtcgcgtggacaggaggcgttgaccctccaatcggcgatgtggagtacctcacggcttttcgcaccgtagtcatgcctattgctcacgagttttctccggatgtcgtgctggtgtccgccggctttgatgctgttgagggacacctttcacccctgggcggatacagcgtcactgccaggtgcttcgggcacttaaccaggcaactcatgaccctggcaggcggccgggtggtcctggcgcttgaagggggtcatgaccttactgctatctgcgacgcctcagaggcatgcgtctcagctttgttgtccgtcgaattacagccacttgatgaggcagtgttgcaacagaaacccaacatcaacgctgtggcaaccctcgaaaaggtgatcgagattcagagtaaacactggtcgtgcgttcagaaattcgccgccggactcggtcggtctctgcgggaagcacaggctggagagaccgaagaagccgaaaccgtctctgcgatggccctactgtctgttggtgccgagcaggcccaagctgctgccgcccgcgaacatagccctcggccagcagaggaaccaatggaacaggaaccagccctctag

SEQ ID NO: 120022 - DNA, 1776 bp, Artificial Sequence
  Description of Artificial Sequence: Synthetic coding sequence
atgatgtccagtcctgcacagtccagatccccggacctgatgtggaatctcgtgccctgggtacttttctgcggctgttgcaggatctttcccgatggggttgcgggccgcgaacagctcctcgcccaacagagaatgcatagcatgattagctccgtggacgtcaaatcagaggtgcctgtaggcctggaacccattagccctctcgacctgagaacagacctgaggatgatgatgccagttgtggatcctgtggtcagggagaaacagctgcagcaggagctgctcctgatccagcagcagcagcagattcaaaagcaattacttatcgcagaattccagaagcaacacgagaaccttactcgacagcaccaggcccaattgcaggaacatattaaggaattactggcgatcaagcagcaacaggagctgctcgaaaaagaacagaagttggagcaacaaagacaggagcaggaggtggagcgccaccggcgcgagcaacagttgcccccgctcagaggaaaggaccgcgggagagaaagggccgttgcctcgaccgaagtcaagcagaagctgcaggaatttctgttgagcaaaagcgcgacgaaagacactcccactaacggaaagaaccactccgtgtcaaggcatccaaagctctggtacaccgccgcccatcacacgtcactcgatcaatcctctccccccctttccggtacgtctccctcctacaaatacaccttgccaggagcacaagatgcaaaggacgactttccgcttcgcaaaactgagagctcagtgtcttcttctagccccggatccgggccaagctctccaaacaatggaccaaccggcagtgttacagagaatgagaccagcgttttgccccccactccacacgccgagcagatggtgtcccagcaaaggatattaattcatgaggattccatgaatttgctaagcctttacacgtcaccctcacttcccaatatcacattagggttaccagctgtgcccagtcagctgaacgccagtaactcgctgaaggaaaagcagaaatgtgagacacagacacttagacaaggagtgccgcttcctggccagtatggcggtagtatcccggcaagcagttcccacccccatgtgacactggagggtaagccccctaacagtagtcaccaggctttgttgcagcatctcctgctgaaggaacagatgcgacagcagaagttattagtcgccggtggggtccccctgcatccacagagcccactggctaccaaagagaggatctctccagggattcgaggaacacacaagttacccaggcatagacctcttaacagaactcagagcgccccgctgccccagagtaccctcgcccaactcgtcattcagcagcagcaccagcaatttttggagaagcaaaaacagtatcagcaacagatccatatgaacaaactgttaagtaaatcaattgagcagctaaagcagccgggatcccacctcgaggaggcagaggaggaactgcagggggatcaagctatgcaggaagatcgtgcaccctcaagtggtaactctaccaggagtgactcatcagcttgcgtggacgacaccctaggacaggtcggcgccgtgaaggtaaaagaggaaccggtcgatagcgacgaggacgcccagatccaggaaatggagagcggcgagcaagctgcctttatgcaacaagtgatcgggaaagatctagctccaggatttgtgattaaggtcataatctag

SEQ ID NO: 120023 - DNA, 2772 bp, Artificial Sequence
  Description of Artificial Sequence: Synthetic coding sequence
ctgcacaagctctctagtcttgttgacgtgaagagcgaagtgcccgtcgggctggagcctatatcacccctggacttgcgcaccgacctccggatgatgatgccagtcgtggatcctgtggtccgggaaaagcagctccagcaggaacttttgctgattcagcagcagcaacaaatccagaaacagctgctgatcgcagagtttcaaaaacaacacgaaaatctcaccagacaacatcaggcccagctgcaggagcacatcaaagagctgctggcaattaagcagcagcaagaattgctagagaaagaacaaaagctggaacaacagcgccaagaacaagaagtggagcgtcacaggcgggaacagcagctaccaccgctccgggggaaggacagaggcagggagcgtgccgttgcgagcacggaggtaaagcagaagctgcaggagttcctactctctaaatccgccactaaggacacccccacgaatggtaaaaaccactctgtgagccggcatcctaaactctggtataccgccgcccatcatactagtctcgaccaatcttcgccgcctctgtcaggtacttctcctagctataagtacacccttcctggagcccaggatgccaaagacgactttcctttgagaaagaccgcaagcgagccaaatctaaaggtccgctcccgactaaaacaaaaagttgccgaacgacgatcatctcctctcctaaggcggaaggatgggaatgtggtgacatcttttaagaaacgcatgtttgaggtgacagaatcgagcgtgtcatcatctagtccaggcagtgggcccagcagcccaaacaatggacccacaggaagcgtaacagagaatgagacctcagtgttgcctcccacaccacacgccgaacagatggtgtctcagcaaagaatcttaatccacgaagatagcatgaatctgctatcactgtacacatcaccaagtctccctaacatcaccctgggactcccagccgtgcccagtcaactgaacgcatcaaactcactgaaagagaagcagaagtgcgagacccaaacacttcgccaaggggtgccactaccagggcagtatggaggcagcattcctgcatcctcaagtcatccacacgtaactcttgaaggcaagccacctaatagcagtcaccaagcactattgcaacacctgctgcttaaggaacagatgaggcaacagaagttgctggtcgcgggcggcgtgccactgcaccctcaatcccctcttgctactaaggagagaatctctccgggaattcgtggtacacacaaactccctcggcatcgccccctaaatcgcacccagagcgcaccgcttccacagtctactctcgctcagctggttattcagcagcagcaccagcaatttcttgaaaagcagaagcaataccagcaacaaatccacatgaacaagccctttctggagccgactcacacgcgggcgctctcggtccgacaggccccactagccgcagtggggatggacggactggaaaagcaccgactggttagtcggacccactctagtccggccgcatccgtgctgcctcaccctgctatggaccgaccactgcagccaggctcagcaaccgggatcgcctacgatcctctgatgttaaagcaccaatgcgtctgcggaaattccactacccatcctgagcatgcaggccggattcagagcatttggtcgcggttacaggagacaggactgctcaataagtgcgaacgaattcagggacggaaagccagtctagaggaaatccagcttgttcattctgaacatcattctcttctctacgggacaaatcccctggacggccaaaagctagaccctcgcattctgctgggggacgattcccaaaaattctttagtagtttaccttgcggcggcctcggggtggattcagacaccatatggaacgagctgcacagctccggggccgcacggatggccgtgggttgtgtgattgagttggcatccaaagtggctagcggcgagctcaagaacgggtttgctgttgtaagacctccaggccaccatgctgaagagagcacggcaatgggcttctgttttttcaactcagtcgccattacagccaaatacctcagggaccaactgaatataagcaagattcttatagtggacctggacgttcatcatgggaatggcacccagcaggctttttacgctgatcctagtatcctttatataagcctgcaccgctacgatgaaggtaacttctttccagggtccggtgctcccaacgaggtggggaccggtctgggggaaggttacaacattaacatagcttggacggggggactagacccccccatgggcgacgtggaatatttggaagctttcaggaccattgtgaaaccagtcgcaaaggaattcgatccagatatggttcttgttagcgctggatttgatgccctcgagggccatactccaccacttggcggctataaagttacggccaaatgcttcggccacctcacgaaacagttgatgaccctcgctgacggcagggtggtgttagccttggagggggggcatgatctgaccgcgatttgtgacgcatcggaggcttgtgttaatgccttattgggaaatgaattagaacctctcgcggaagacatcctccatcagagtcccaatatgaatgctgtcatatctctacagaaaataatcgagattcagtctatgtcgctgaagttttcatag

SEQ ID NO: 120024 - DNA, 3078 bp, Artificial Sequence
  Description of Artificial Sequence: Synthetic coding sequence
atgcatagcatgattagttccgtggatgtcaagtcagaggtcccggtgggcttggagcccatctccccgctcgatcttagaacagacctccgcatgatgatgcccgtggtggacccggtggtgcgggaaaagcagctgcagcaggagttgctcctgatccagcagcagcagcagatacagaagcagctgcttattgccgaattccagaaacagcatgagaatttgactcgtcagcaccaggcccagttgcaggagcacatcaaactgcaacaggagctgttagcaatcaagcaacagcaggagcttctggagaaggagcagaagctggaacagcagaggcaggaacaagaagtcgagcgccataggcgcgaacagcagcttcccccactgcgcggcaaagatagagggcgtgagagggcagtggccagtacagaggtaaagcagaaactgcaggagttcctcttgtcaaaatcagcaactaaagacacacccacaaacggaaagaatcactcggtgtcacgccacccaaagttgtggtacactgccgctcatcacacgtcactcgatcagagttcaccgcctctctccggtacatccccaagttataagtacacactccccggcgctcaggacgcaaaggacgatttccccttgaggaagaccgaatccagcgtctcctcgagcagtccaggctctggtcctagttccccaaacaatggtcctacaggtagcgtcaccgaaaacgaaacgtcggtccttccaccaactcctcacgccgaacagatggtgtctcaacagcggatcctaattcacgaggatagcatgaatttgttaagcctctacacttccccaagtctgcctaatattaccctgggtctgcccgctgtgccctcacagctgaatgcttccaattccttaaaggaaaaacagaaatgcgagacacagaccctcagacaaggcgtcccattacccggccagtacggcggctctatcccagcctctagttcacacccccatgtcaccctcgaaggaaagccacccaacagtagtcaccaagccctgcttcagcatctcctgctgaaagagcagatgcggcagcagaaactgctcgtggccgggggagtaccactgcacccccagagtcccctggcaaccaaagagaggatttcccctggaatcagaggcacacacaagctcccccggcacaggccgctgaataggactcagtctgccccactgccgcaatcaactctcgctcagctagttatccagcagcaacaccaacaattcttagagaaacaaaaacagtaccaacaacagatccacatgaataaactgctttcaaaatctatcgaacagctgaaacaacccggcagccatctggaggaggctgaagaagaactacagggggaccaggccatgcaagaggatagagccccaagcagcggaaacagcaccaggtctgattcttccgcctgtgtggacgacacactcgggcaggttggtgccgtgaaagtgaaagaggagcccgtagacagtgacgaggacgcccaaattcaggagatggagagcggggaacaggccgcattcatgcaacagccctttctagaacctacccacactagggcactcagtgtgcgtcaggcacctcttgccgcggtcggcatggacgggcttgaaaagcaccgactggtctcccgcacacattctagtccagctgcctctgtgctgccccatcccgctatggaccgtcccctgcagcccggttccgcaacagggatcgcttatgacccactaatgctgaaacaccagtgtgtatgcgggaactccactacccatcccgagcacgctggcagaatccagtccatctggtctagattgcaggagacagggctgctaaacaaatgtgaaagaatccaggggcgtaaggcctctctggaggaaatccagttagtgcactctgaacaccattccctgttgtatggaactaaccccctggacggccaaaagcttgatcctagaatcctgttaggtgatgatagccaaaaattttttagtagcttgccatgtgggggactcggagtcgacagcgacacaatttggaacgagttacactccagtggagctgctcgaatggcagtcggctgcgttattgagctagccagcaaggtggccagcggggaactcaaaaacggctttgcagtggtgcgacccccagggcatcatgcagaagagagtacagctatggggttctgcttctttaacagtgttgcaatcactgctaaataccttcgtgaccagctgaacatcagtaagatcctgatcgtggacttagatgtgcaccatggaaatggaactcaacaggcattctacgccgatcccagcatactatacatctcacttcaccggtacgacgaggggaatttcttccccgggtcaggagctcccaatgaagtcggcactggcctgggggagggttacaacataaacatcgcttggaccggaggactcgatccccctatgggcgatgtggagtacctggaagcgtttcggaccatcgtcaagcccgtcgcgaaagagtttgaccctgatatggtcctggtctctgcaggatttgacgcacttgagggccacacaccgcccctgggaggctacaaggttacggccaaatgctttggtcacctgacaaagcagctcatgactctcgccgacgggcgggtggtgctggccttagagggggggcacgacctgactgcaatttgcgacgcatccgaagcctgcgttaacgcacttttagggaacgagctggagcccctggcagaggatattctgcaccagagtcctaacatgaacgccgtgatctctctacagaagataattgagatacagtctaaatattggaagagtgttagaatggtggccgtcccgcggggatgtgctctggccggagcgcagcttcaagaggagacggaaactgtctcagccctggcttcactgacagtggatgtggaacaacctttcgcacaggaagattcgagaacagcgggcgaaccgatggaagaggagcccgccctttag

SEQ ID NO: 120025 - DNA, 1773 bp, Artificial Sequence
  Description of Artificial Sequence: Synthetic coding sequence
atgcattccatgatctcgtccgtggatgtaaaatctgaagttcctgtcggcttggaaccaatctctcccctcgacctgaggacagacctgcggatgatgatgcccgtggtagatccagtggtgagggagaagcaattgcagcaagaattattactcatccagcagcaacaacaaatccaaaagcagttactgatcgctgaattccagaagcagcatgagaaccttacaagacagcaccaggcccaacttcaggagcatattaaagagctgcttgccattaagcagcagcaggaactgttggagaaggagcaaaagctcgagcagcaacgccaggagcaggaagtggagaggcataggagggagcagcagcttccacctctgcgaggcaaagaccgcgggcgcgagagagccgtggccagtaccgaggtaaaacagaaactgcaagagttcctcctaagcaaatctgctacaaaggacacgccaacaaatggcaagaatcattcagtgtcccggcaccccaaattatggtacactgctgcgcaccatacaagtcttgatcagagcagcccaccactgtctggcactagtccttcttataagtatacgcttcccggcgcacaggatgctaaggatgattttcccctgagaaaaaccgcgtcagagcctaatctgaaggtgaggtcacgattgaaacaaaaagtcgcggagcggcgctctagcccactgttacgccggaaggacgggaatgtggtgacttcttttaagaaaaggatgttcgaggtgaccgaatcgtccgtgtcatctagctcacctggctcaggaccttcgagccctaataacggtcccaccggctccgtgactgaaaacgaaacctcggtcctacctcccaccccccatgcagagcaaatggtcagccagcagagaatattgatccacgaggactccatgaatctcctgagtttgtacacatccccttccttaccaaacatcacactggggctgcccgcggtgccttcccaactcaacgcatccaattccctgaaggagaaacaaaagtgcgagacgcagacactgcgccagggggtgccactacccgggcagtatggagggagcataccagcctccagctcccaccctcatgtaactctggaagggaaacctcccaacagcagtcaccaagcactgctacagcacctgctgctaaaagagcagatgcgtcaacagaaactgctggtggccggaggcgtaccattgcatcctcagtccccacttgctacaaaggaacgcatttctcccggcattagaggcacacacaagctgcctcggcaccggcccctgaacagaacgcaatctgcacccttgccccaatcgacactagcccagctcgtgatccagcagcaacaccaacaattcttagagaaacagaaacaataccagcaacaaatccatatgaataagctactatcaaagtcaatcgaacagctgaaacagccaggcagtcacttggaagaagcagaagaggagctgcaaggcgatcaggcaatgcaagaggatcgtgctcctagtagcggcaatagcacccgatccgatagcagcgcatgcgtagatgatacactgggacaggtcggagctgtgaaagttaaggaagagccagtagactctgatgaggacgcacagatccaagagatggagtccggagaacaggctgcatttatgcagcaggtgattggcaaagacctggcacctggtttcgtgatcaaagttattatctag

SEQ ID NO: 120026 - DNA, 1734 bp, Artificial Sequence
  Description of Artificial Sequence: Synthetic coding sequence
atgcttcagactatttacgaaagtgacagctgtttctcgtccgacggagtcgctggccgagagcagctcctggctcagcaacggatgcatagcatgattagttcagtcgacgttaagtcggaggtgcccgtcggactggaaccaatctctccgctggacctccggacagatctccggatgatgatgcccgtggttgatccagttgtgcgcgagaaacagttacagcaggaattgctgctgatccagcaacagcagcaaattcagaaacagctgctgattgcagaattccaaaagcagcacgagaaccttacacggcagcaccaggcccaattgcaggaacacataaagctgcagcaggagctgctcgctatcaagcagcagcaggagctgttggagaaagagcagaagctggaacagcagcgccaggaacaggaggttgaacgccacagacgagagcagcagctgccccctttgcggggcaaagataggggcagggagagagctgtcgcatccactgaagtcaagcagaaattgcaggagttcctcctgtcgaagtctgctacaaaggacactcccactaacggaaagaaccattccgtctccaggcaccctaagttatggtacacagctgctcatcatacctctctggaccaatccagtcccccactttccggaacctcgccctcttataaatacacactcccaggggcccaggatgcaaaggacgacttcccactgaggaaaacggaaagctctgttagctcctcgagtccaggttcggggcccagcagtcccaacaatggcccaacggggtctgtcaccgaaaacgagaccagtgtcctgccaccgaccccccatgcagaacagatggtttcgcaacagcgaattctcatccacgaagactctatgaaccttctctccttatacacctcgccaagccttcccaacatcactcttggattacccgcagtccccagtcagctgaatgcttctaacagcctcaaagagaaacagaagtgtgagacacagacacttcgccaaggcgtgccattaccagggcaatacgggggaagcattcccgctagctcttcccatccgcatgtcacactggaaggaaaacctccaaattcatcacaccaggctctattgcagcacctgctgctcaaggaacagatgagacaacaaaaacttctcgtagctggtggcgtaccgttacacccacaatcacccctggctactaaggaacgcatttccccaggcattcgaggcacacacaagcttccaagacacaggcccctgaatcggacgcagtctgctcccctcccacagtcaacactggcccaactggtcatccagcagcagcaccagcagttcttggagaagcagaagcagtaccaacagcaaatacacatgaacaagctgctgagtaagagcatcgagcagttgaagcaacctggcagccaccttgaagaagctgaagaggaactgcagggggatcaggcaatgcaggaggaccgcgccccttccagcggtaatagtactcgaagcgactcttccgcttgcgtggatgacacccttggacaggttggggctgtaaaagtaaaagaagaacccgtggacagcgacgaagacgcccagatccaggagatggagagcggcgaacaagccgccttcatgcaacaggtgatagggaaagatctcgcacctggcttcgtaatcaaggtcatcatctag

SEQ ID NO: 120027 - DNA, 3201 bp, Artificial Sequence
  Description of Artificial Sequence: Synthetic coding sequence
atgcacagtatgatcagttcagtggatgtaaagagcgaggtgcctgtgggtctggagcctattagccccctcgacctgcgcactgatctgcggatgatgatgcccgttgtggatcctgtagtgagagagaagcagctgcagcaagagctgctgctcattcagcaacagcaacaaatccaaaaacagctcctgatcgcagagttccagaagcagcacgagaacctgactcggcagcaccaagctcagctgcaggaacatataaaggagctcttggcaatcaaacaacagcaggagctgctggaaaaggaacagaagctggaacagcaacgacaagagcaagaagttgagcggcatagaagagagcagcaattgccacctcttaggggcaaggatcgcggaagggagagggcagtcgctagcaccgaggttaagcagaaacttcaggaatttctgctgagtaaaagtgctacaaaggatactcccaccaatggcaaaaaccacagcgtgtcgcggcaccccaaactgtggtataccgctgcccatcataccagcctcgaccagagctctccccccctgagtggtacaagcccatcatacaagtacaccctgccaggagcacaggacgccaaggacgattttccgctgcggaagaccgcctcagaacctaatctgaaagtgcggtcccgactcaaacaaaaggtcgcagaacgccggtctagcccccttctgaggcgcaaggacggtaatgtagttaccagcttcaagaagcgaatgttcgaggtgacagagtcctcagtctctagttcgtctcccggctccggaccatcaagtccaaacaatgggcccactggttccgtgacggagaatgagaccagcgtcctgcctccaactccccatgccgagcagatggtatcccagcaacgcatcctcattcatgaggattcaatgaatctgctgtctctctataccagcccatctctgcctaacatcactttgggacttcctgccgttccatcccaactgaacgcttctaattccctgaaagagaagcaaaagtgcgaaacccagactctgcgacagggcgtccctctccccggtcagtacggcgggtcaatccctgccagctcctcgcatccccatgtcacccttgagggtaagcccccgaattcttcccaccaagcgctcctgcagcatcttctcttgaaggaacagatgaggcagcaaaagctgctggtggctggcggggttcctctccaccctcagtcacccctagctacgaaagagcggatttctcctggcataaggggaacacacaagcttccccgccacagaccccttaatcgtacacaatcggcccctcttccccagagcactctggcgcagctcgttattcagcaacaacaccagcagttcctggagaaacaaaagcagtatcagcagcagatccacatgaacaagctgttgtctaaatccatagaacaattgaagcagcccggatcacatctggaggaggccgaggaagagcttcagggggaccaggccatgcaggaggacagagcacctagcagtggaaactccacacgcagtgatagcagtgcctgcgtggatgatactttgggccaggtcggagcagtgaaggttaaggaggagcccgtggattcggacgaggatgctcaaatccaagaaatggagtccggggagcaggccgcttttatgcaacaacctttccttgagcccacccacacccgcgctcttagtgtgcggcaggcccccttggccgctgtgggcatggacggcctggagaaacatcgcctcgtatcccgaacccacagtagtcctgcagcttctgtgttacctcacccggctatggataggccactgcagcccgggagcgcaacagggattgcgtacgatcctctcatgctcaagcaccaatgcgtgtgcggaaactctacaacccaccccgagcacgccggccggatacagagcatctggagccgattgcaagagactgggctgttgaacaagtgcgaaaggatacaaggcaggaaagccagtttggaggagatccagctggttcattcagagcaccatagcctcctctacggtaccaacccactggacgggcagaagctggaccctcggattctgctgggcgacgattctcagaagttctttagttctctgccatgtggcggccttggagtcgattccgacacaatctggaacgagctgcacagttccggggccgccaggatggctgtgggctgtgtcatcgaacttgcaagcaaagtcgcctcaggagaactcaaaaatggcttcgctgtggtgcggccaccgggccatcatgccgaagagtcaacggctatgggattttgtttcttcaactccgtggccatcactgcaaagtatctccgcgaccagctgaacattagcaagatactcatcgtcgacctggacgtgcaccacggcaacgggacacagcaagcgttctacgctgatcccagtattctgtacatctcactgcataggtatgacgaggggaatttctttcctggctcaggtgctccaaacgaggtgggcactggccttggcgagggttacaatatcaacatagcatggacggggggtctggacccccctatgggagatgtggaatacctggaggcgttccgcacaatagtcaaacccgtggccaaagaattcgacccggacatggttctggtttccgctggatttgatgcactcgagggacatacgcctcctttgggcggttacaaagtgacagccaaatgcttcggacacctgactaagcagctcatgacattagccgacggcagggtcgtgttggccttggaaggagggcatgacctgactgcaatttgtgatgcatccgaggcttgcgtgaacgcgttattgggaaatgaacttgagcccctcgcggaggatattctgcaccagtctcctaatatgaatgccgtgatctctctacagaagataattgagatccagagtaagtactggaaatcagtaaggatggttgccgtccctcggggctgtgcactggcgggtgctcagctgcaggaagagacagagaccgtgtcagcactcgcttccctaacggtggacgtcgagcagcccttcgcacaggaggattcccgtacagccggggagcccatggaagaggagccagccctgtag

SEQ ID NO: 120028 - DNA, 447 bp, Artificial Sequence
  Description of Artificial Sequence: Synthetic coding sequence
atgcactccatgatctcaagtgtagatgttaaaagtgaggtgcctgtgggccttgagcccatctcccccctagatttacgaactgatctaaggatgatgatgcctgtggtcgatccagtggtccgggaaaaacagctgcagcaggagttgctgctcatccaacaacaacaacagatccagaagcaacttcttattgccgagtttcagaagcaacatgagaatttaacccgtcagcaccaagcccagctgcaggagcacatcaagctgcagcaggaactgctagcaattaagcagcagcaagagctgctcgaaaaggaacagaagttagagcaacagcggcaggagcaggaagtggagaggcacagaagagagcagcagctgccacctctgcgcggtaaagaccgcggccgagaaagagccgtggcatccacagaagtcaagcaatag

SEQ ID NO: 120029 - DNA, 417 bp, Artificial Sequence
  Description of Artificial Sequence: Synthetic coding sequence
atgcattcaatgatctctagcgtggacgttaaatccgaagtgcccgttggccttgagccaatatccccattagacttacgtactgacctcagaatgatgatgcccgtggtcgacccagtcgttcgcgagaagcagctgcagcaggagcttctgctgatccagcagcagcagcagattcaaaaacagctcctgatcgcagaatttcagaagcagcatgaaaaccttacaagacagcaccaagcccagttgcaggagcacattaagctgcagcaggaactcctcgccatcaaacagcagcaggaactactggaaaaagaacaaaaactcgaacagcagcgtcaggaacaggaggtagagcgccatagacgggagcaacagctcccgccacttcgcggcaaagacagaggcagagaatag

SEQ ID NO: 120030 - DNA, 1767 bp, Artificial Sequence
  Description of Artificial Sequence: Synthetic coding sequence
atgatgtcttctccagctcagccagatctgatgtggaacctggtcccatgggtgctgttctgcggatgctgccggattttccctgacggcgtggctggacgggagcaactgctggcccagcagagaatgcacagtatgataagttccgttgatgtgaagagtgaagtacccgtcggcctggaacctatctcccctctcgatctgcgaacagacctgcggatgatgatgcccgtggttgaccctgtggtgagagagaagcaacttcaacaagaactcctcctaatccagcagcagcagcagatccagaagcagctgctgatcgctgaattccaaaagcagcacgaaaacctgactcgccagcatcaggcccagctgcaggagcatatcaaggaactactggccatcaagcagcaacaggagctcctggaaaaggagcagaagctggagcagcaaaggcaagaacaggaagttgaaaggcaccggagggagcagcagctgcccccactgcgtggcaaggaccgaggcagggagcgggctgttgcctcaactgaggtgaagcaaaaactgcaggagttccttcttagcaagagcgcgaccaaggatacccccaccaacggcaagaatcactctgtctctcgacaccctaagctctggtacaccgccgcccatcacacatcactcgatcagagctctcccccattgagcggtaccagcccctcttataaatatacactgccaggagcccaagacgccaaggacgacttccctttgagaaaaactgaatccagcgtcagctcctcctcccccggctccgggcctagcagccccaacaacggacccaccggtagtgttaccgagaacgagacttcggtcctgcctcccacaccacacgcagaacaaatggtctcgcagcagagaatcctgatacacgaagattcaatgaaccttcttagcctgtacaccagcccatcgctcccaaatatcaccttggggctgcctgccgtgccttctcagctcaacgcctccaactctctaaaggagaaacagaagtgtgagactcaaaccctgagacagggggtgccactgccaggacaatacggcggctccattccggctagctcatcacacccacacgttaccctggaggggaaaccacctaactcaagtcaccaggccttattacagcatctattactgaaagagcaaatgcggcagcagaaactcctcgtggctgggggggtcccactgcacccacagtcgcccctggccacaaaggaaaggatcagccctgggattagagggacacacaagctacctagacaccgccccctaaacaggacacagagcgcaccactccctcagagcaccctcgcccagctggtgattcagcagcaacaccagcagtttctggagaaacagaagcagtatcaacaacaaattcacatgaacaagttgttaagcaagagcattgagcagcttaagcagccggggagccacctggaagaggctgaggaggaactgcagggcgaccaggccatgcaggaggacagagcccccagctcgggcaattcaactcgctccgatagttcagcctgcgttgacgatacgctcggccaggtgggcgcagtgaaagtcaaggaagaacctgtggacagcgatgaggatgcgcaaatacaggaaatggaatccggcgagcaggccgcattcatgcagcaggtgataggtaaagatttggcgccaggctttgtgatcaaagtaataatttag

SEQ ID NO: 120031 - DNA, 1641 bp, Artificial Sequence
  Description of Artificial Sequence: Synthetic coding sequence
atgcattctatgatttcatcagtggacgttaaatcagaagtgcctgtagggctagaaccaataagccctctagacctgagaaccgacctgcgaatgatgatgccggtggttgaccccgtggtgcgcgaaaaacagctgcagcaagaactcctgctcatccagcagcagcaacagatacaaaagcagctgttgatagctgaatttcaaaaacagcacgagaacctcacccgccaacatcaggcccaactccaagaacatataaaggagttactggcgatcaaacagcaacaagagctcctggaaaaagagcagaagttggagcagcagaggcaggaacaggaggtcgagcgacataggcgggagcagcaactgcctcccttgagagggaaagatcgaggccgcgagcgggctgtggcctctaccgaagtgaagcagaagttgcaggaatttctactgtctaagtcggctactaaggatacccctacgaatggcaagaatcattcggtaagtcgacatccaaagctctggtatactgccgctcatcacacgagcctcgatcagtccagccctccactgagtgggacctctccctcttacaaatacacactgcctggcgcccaggatgctaaggacgatttccctctgcgaaagaccgagagttccgtctcatctagttctcctggctccgggccgtcatcacccaacaatgggcccactggttccgtgactgagaacgagacaagtgtgctgccgccgactccccacgcggagcagatggtaagccagcagcgaatcctgatccacgaagatagtatgaacctgttgtcgctgtatacctccccctctttacctaacattacgctgggattacccgccgtcccaagtcagcttaatgctagcaactccctcaaagagaaacagaagtgcgagacccagaccctcaggcagggagtgcccttgccgggccagtacggcggttccatcccggcctcatcttcccacccgcatgtgaccctggaaggcaagccaccaaactcttcgcaccaagctctgctacagcacttactcctgaaggagcagatgcgacaacaaaaattactggtcgctggcggcgtacccctgcatccgcagagccccctggccacaaaagagaggattagccctggcatacgcggcactcataaactccctcgacataggccactgaatcgtacacagtcagcccctcttccccagtcaacccttgcacagctggtgattcagcaacagcatcaacagttcctggagaagcagaagcagtatcaacagcagatacatatgaacaaactgctctctaagagtatcgaacagttgaagcagccagggagccatctggaggaagccgaagaggaactgcaaggagaccaggccatgcaggaggatagggctccttcctctgggaattctactcggtctgactcctcagcctgcgtggatgacactttaggtcaagttggggccgtgaaggtaaaagaggaacctgtggactcagacgaggatgcgcagatacaggaaatggagagtggcgagcaggcagctttcatgcaacaagtgattggcaaggacctggcacccgggttcgttatcaaagttatcatatag

SEQ ID NO: 120032 - DNA, 3036 bp, Artificial Sequence
  Description of Artificial Sequence: Synthetic coding sequence
atgcattctatgataagctcagtggacgtgaagtctgaggtcccagtgggactcgaaccgatttccccattagatctcagaacagaccttagaatgatgatgcccgtcgtggatcccgtcgtacgtgagaagcagctgcagcaggagctgttgctgatccagcaacagcagcagatccagaagcagctgcttatagcagagtttcaaaagcagcatgagaaccttactagacagcaccaggctcaactgcaggagcatataaaggagctgttggccattaagcaacaacaggaattactggagaaagagcagaagctggagcagcagagacaggagcaagaggtcgagagacatcggagggagcagcagcttccacctcttcgaggcaaggaccgtggcagggagcgggccgtggctagtaccgaggtgaaacagaagctgcaggagttcttactgtcaaagagtgccactaaggacacaccgacaaatgggaaaaaccatagtgtgtcccgtcatcccaagctgtggtacacagccgcacatcatacatctctcgatcaatccagtccaccactgagcgggacatcccccagttacaaatataccctgcccggagcgcaggatgctaaggacgacttcccactgaggaagactgcttccgagccgaacctaaaggtcaggtctcgccttaagcagaaagtggccgaacgccgatcttcaccactgctacggcggaaggacggtaacgtagtcacatccttcaagaagcgaatgtttgaggtcactgagagcagcgtgtcttcctcatctcctggttctggccctagttcgccaaataacgggcccacagggtcagtcacagagaacgaaacctctgttctacctcctacacctcacgccgaacaaatggtttcgcagcagcgtattctcatccacgaggatagcatgaacctactgagcttatatacatcacccagcctaccaaatatcacactgggcctacccgcagtgccttctcagcttaatgcatctaactcgttgaaggaaaagcaaaagtgcgagactcagactcttagacagggcgtgcccttgccaggacagtatggaggcagcatcccggcatccagcagccacccccatgtgacactcgagggaaaaccgcccaattccagtcaccaggcattacttcagcatctgcttttaaaagagcagatgcggcagcaaaagcttctagttgcagggggtgtgcccctgcatcctcagagcccactggcgactaaagaacgtatttcacccggcattaggggtacccacaagctgcctcgccatcgtcccctgaataggacgcaaagtgcgcctcttcctcagtcaaccctggcccagttggtcatccaacaacagcatcagcagtttcttgaaaagcagaagcagtaccagcagcaaatccacatgaataagctcctgagtaaatctatcgagcaactgaaacagccgggatcccacttggaagaggcggaagaggaactccaaggggatcaagcaatgcaggaggatagggctccctcctctggaaactctactcgctcagattcaagcgcctgtgtcgacgatacactggggcaggtcggggcggttaaggtcaaggaagagcccgtcgattcagacgaggatgcccagatccaggagatggagtcaggcgagcaagctgccttcatgcaacaaccattccttgagcctacccatactcgcgcactctctgtgcggcaggcccccttagccgccgtggggatggacgggctcgaaaaacaccgacttgtatcccgaactcactcctccccagccgcgtcggtgctgccgcaccccgctatggataggccactgcagccgggctcagcgacgggcattgcttacgatcctcttatgctgaagcatcagtgtgtgtgcggaaactccacaacccaccccgaacacgcaggccggatacaaagcatttggtctagattacaggaaaccggtctgcttaataaatgtgaacgcatccagggtaggaaggcgagcctggaagagatccagctcgtgcactcagagcatcactccttgttgtatggtaccaaccctctcgatgggcagaaactggatccaagaattctactcggtgacgactcccagaaattcttctctagcctgccgtgcggaggactcggggtcgactccgacactatctggaacgaattacattcttctggggcagcccgcatggctgtgggatgcgtaattgagttggcatccaaggtggcctctggggaattgaaaaatggtttcgcggtggtgcgccccccaggtcatcatgccgaggaatcaactgctatgggattttgcttcttcaattccgtagcaatcacagccaagtatctgcgggaccagttgaacatatcaaaaattctgattgttgaccttgatgtgcaccatggcaacggaacccagcaagccttctatgccgaccccagcattctatacatttccctccacaggtatgacgaaggcaatttttttcccggatccggagcacccaacgaggtgggaaccggactgggggagggctataacataaacattgcctggacaggcggtctggaccctcctatgggcgacgtggaatatctcgaggcgttccgcacgatcgtcaagcctgtcgcgaaggagttcgacccggacatggtgctggtgagtgcgggttttgacgctcttgagggacacacaccgcctctcgggggatacaaggtgacagctaagtgttttggccatctgactaaacagttaatgacactcgccgatggccgtgtggttctggccctggaaggtggccacgatctcaccgctatttgcgatgcaagcgaggcatgtgtcaacgcacttttaggcaacgaattggagcccctagccgaggacattctccatcagagcccgaatatgaatgccgtgatatcccttcagaaaatcatagaaatccagtctatgtccctgaagttttcgtag

SEQ ID NO: 120033 - DNA, 72 bp, Artificial Sequence
  Description of Artificial Sequence: Synthetic coding sequence
atgcactcgatgatttcctccgtagacgttaagtcggaagtacccgtgggactggagccaataagtccttag

SEQ ID NO: 120034 - DNA, 3210 bp, Artificial Sequence
  Description of Artificial Sequence: Synthetic coding sequence
atgcatagtatgattagcagcgtcgacgtgaaatcagaggttcccgtcgggctcgaacccattagtcctctggatctgcgaacagacctcaggatgatgatgcctgtggtggatcctgttgtcagagagaagcagttgcagcaagagctcttactgattcaacagcagcaacagatccagaagcagcttctaattgcggagttccaaaaacaacatgagaatttgaccaggcagcatcaagcacagctgcaggaacatatcaaactacaacaggaactcttggccataaaacaacagcaggaactgttagagaaggagcagaaactggagcagcagcgccaggagcaagaagtggaacggcacagacgagaacaacaactgcccccgttgcgagggaaggacagagggagggagcgagccgtcgccagcaccgaagtgaagcagaaactgcaggaattcctattgagcaagagtgctaccaaagatacccccaccaacggaaaaaatcacagcgtaagccgccaccctaagctgtggtatactgccgcccatcatacttccctggatcagagctctccccctctgagtgggacttctccgagttataaatatactctccccggagcccaggatgccaaggacgatttcccactccgcaagaccgcctctgagcccaacctcaaggttcggtccaggctgaaacaaaaagtagctgagagaagaagtagccccctgctgcgacgaaaggatggtaacgtagtcacgtcattcaaaaaaagaatgtttgaggtgaccgagagctccgtgagctcttcaagtcccgggagtggtccttctagcccaaataacggtcctactggttctgttactgaaaatgagacgagcgtgctacctcccactccccatgctgaacaaatggtgtcccagcagcgcatcctcatacatgaagatagcatgaatctgttatcgctctatacatcaccgtcactccctaatataactctggggctcccagctgtgccttcacagctgaacgccagcaattctctcaaggaaaagcagaagtgcgaaactcagaccctgcgacaaggggttcccttgcctgggcagtacgggggatcaatacctgcctcctcatcgcatccccatgtaacactggagggaaagccgcccaactcctctcaccaggcgctgcttcaacacttgctcctcaaggagcagatgagacagcagaaactgctcgtagcgggaggggtgccccttcatccacagagcccgctggccactaaggaacggatatccccaggcattcggggcacccacaaacttcctcgccacaggccactgaatcgaacacagtcagctcccttgccacaatcaaccctggcacagctcgtgatacagcagcagcatcagcagtttctggaaaaacaaaaacagtaccaacagcagattcacatgaataaactgctatccaagtccattgaacaactaaagcagccagggtcccatctcgaggaagccgaggaagagctacagggtgaccaagcaatgcaggaggacagggcgccctctagcggcaactccactcgctcagactcctctgcgtgcgtcgatgataccctgggacaggttggagctgttaaagttaaggaggagcccgtagactccgatgaagatgctcagatacaggaaatggaaagcggggaacaagccgccttcatgcagcagcctttcctcgagcccacacatactcgcgcccttagcgttaggcaagctcccttggcggccgtgggcatggacgggctggagaaacatagacttgtgtcaaggacccattcgtcacccgcagcttcagtgctgcctcacccggccatggacagacccctgcaacctggcagcgccacgggaattgcgtatgacccccttatgctgaaacaccagtgtgtatgcggtaacagcaccactcaccctgagcatgcgggaaggatccagtcgatttggagtcggctccaagagacaggattactaaacaagtgtgagcgcattcaggggcgcaaagcttcactggaggagatccagttggtgcactccgagcaccacagcctcctgtatgggactaatccacttgatggccagaaattggaccctagaatcctcctgggcgatgactctcagaagtttttcagtagtctgccttgtggcggattgggcgtggacagtgacactatctggaatgaattgcatagttcaggagcggctaggatggccgtggggtgcgtcatcgaattggctagcaaagtcgcttcgggcgaattaaaaaatggatttgccgtggtgcgaccacccggacaccacgctgaagagagtacagctatgggtttttgtttctttaactcggttgcaattaccgccaagtatcttagggaccaactgaatatctctaaaattcttattgtagacctggatgtgcatcatggcaatggaacccagcaggccttctacgcagacccaagtattttgtacatctcacttcatcgatatgacgaaggcaattttttcccgggaagtggtgctcctaacgaggtaggtacaggcttgggtgaagggtacaatattaatattgcctggacgggagggctcgaccccccaatgggagacgtggagtacctggaagctttcagaacaatcgtcaaaccagtagcaaaagagttcgatcctgacatggtcttggtgtcggccggattcgatgccctagagggccacactcctcctctggggggctataaggtgacagccaagtgcttcgggcacctgactaagcagttgatgaccctggctgacgggagagtcgttctcgccctagagggagggcatgacctgacagccatctgtgatgcctccgaagcgtgtgtgaatgctttgctgggtaacgagctggagccgctcgcggaggacatactgcaccagtctccgaatatgaacgctgttatcagcctccagaaaatcatcgagatccagtctaaatactggaaatccgtgcggatggtggcagtgccgcgaggttgtgcgctggccggagcccaactacaagaggagaccgagaccgtgtccgcgttggcaagcttgactgttgacgttgaacaaccttttgcccaagaagacagccgtactgccggtgagccaatggaggaagagccagccctgtag

SEQ ID NO: 120035 - DNA, 1689 bp, Artificial Sequence
  Description of Artificial Sequence: Synthetic coding sequence
atgatgatgccagtcgtcgatccagtcgttcgcgaaaagcagctgcagcaggaactgctgctgatccaacagcagcagcagattcagaagcagttactcattgcagaattccagaagcagcacgaaaacctaacccggcaacaccaggcgcaattgcaagagcacatcaaattacaacaggagctgttggccatcaagcaacagcaggaactgctggagaaggagcagaaattggagcagcagaggcaggagcaggaagtcgaacggcaccggagagagcaacaactgccaccacttcgcggcaaggaccgtggcagagagagggccgtggcttctaccgaggtgaagcagaaactgcaggagttcttactatcgaagtccgcgaccaaggacacccccaccaacggcaagaatcactcagtgtcaagacaccctaagctgtggtataccgccgctcaccacaccagcttggatcagagttctcctccactgagtggcacctcaccctcatataagtacaccctccccggagctcaggatgccaaggacgactttcctctgcggaaaaccgcctccgagccaaatcttaaagtgcgcagtaggctaaagcagaaagtggctgagcgaagatcctctcctttgctcagacgcaaagatggaaacgtggtgacatcgtttaaaaagaggatgtttgaagtgacagaaagttctgtgtccagttcatcacccggatcaggaccctcctcccctaataacggcccaaccggctccgtaactgaaaacgagactagcgtgcttcctccgaccccccatgcagaacaaatggtgtcccagcagcggattctgatccatgaggactcgatgaatctcttgtccttatacacctcgcccagtctccctaacataactctgggcctgccagccgtcccaagccaattaaacgccagtaattctttgaaggagaaacagaaatgcgaaacacagacacttagacagggtgttcctctgcctggccagtacgggggcagcattcctgctagtagcagtcacccacacgtgaccctggagggaaagcctcctaactctagtcaccaggccttacttcagcacctgctcctgaaggaacagatgcgccagcagaagcttttggtcgctgggggcgtaccgctgcatccacagagcccgctggccaccaaggagcgcataagcccagggatcaggggtacccacaagttacccagacaccggcctctgaacaggacccaatcggcgcctctgccccagtctaccctggctcaactagtgatccaacagcagcatcagcagttcctggaaaagcagaagcagtatcagcaacagatacacatgaacaaattactgagtaagagtatagagcagctcaagcagccagggagccatctcgaggaggcagaggaggaactgcagggagatcaggcaatgcaggaggatcgcgcacccagcagcgggaactcaacgcgcagcgatagcagcgcttgtgttgatgacacgctcggacaggtaggtgccgtgaaggtgaaggaggagcctgtagactctgacgaagatgctcaaattcaagaaatggagtcaggtgagcaagcggccttcatgcagcaggtcataggcaaagatttagctccaggattcgtcatcaaggttatcatctag

SEQ ID NO: 120036 - DNA, 1542 bp, Artificial Sequence
  Description of Artificial Sequence: Synthetic coding sequence
atgatgatgccagtagtggacccggtggtccgagaaaagcagttgcagcaagagctgctgctgattcaacagcagcagcagatccagaaacagttactgatcgctgagttccagaagcagcacgaaaacctgactcggcagcaccaagcccagttgcaggaacatatcaaagagttgttggcaataaagcagcagcaggaattgctcgagaaagagcaaaagctagaacagcaaagacaagaacaagaggtggagcgccatcggagggaacagcaattgccgcccctgcgaggtaaggaccggggcagggagcgcgctgtggcgtccactgaggtgaagcaaaagctgcaggaattcctattatctaagtcagccactaaggacactccgaccaatggtaagaatcactctgtaagccgacatccaaagctgtgggccgcccaccacactagcttggaccagagcagtccccccctctcaggaacatctccgagctataaatacaccctacctggggcccaggacgcaaaagacgatttccccctgcgcaagaccgagtctagcgtttcgtcttcatctcccggatcaggcccctcatccccaaataacggtcccacgggaagtgtgacagagaatgagacaagcgttttgccacccacaccccacgccgagcagatggtgagtcaacagagaattctcattcacgaagattccatgaatctgctgtctctgtatacttctcccagcttacccaacataactttgggtttaccagcagtcccctctcagctcaacgcaagcaactccctgaaggaaaagcagaagtgcgaaactcagacgttgaggcagggtgtgcccctgccgggacagtatgggggctcaattcctgccagtagctcacacccacatgtcaccctggagggtaaacctcctaattcttctcatcaggcgctgctgcaacacctgctgctgaaggaacagatgcgacagcagaaattgctcgttgctggtggagtcccccttcatccacagagccccctggcaactaaagagaggataagtcccggaattcgcgggactcataagcttccccgccaccgccccctcaaccgcacgcagagtgccccgttgcctcagagtactctcgctcagctggtgattcaacagcagcatcagcagtttctcgagaagcaaaagcagtatcaacagcagatacacatgaataaactgctgtctaaatccatagagcagttaaagcagcctggcagccatttggaggaagctgaggaagagttgcagggcgatcaagctatgcaggaggaccgggccccgtcaagcggaaattctacacgcagcgactcaagtgcttgcgtggatgacaccttagggcaggtcggggctgtgaaagttaaagaggaaccagtcgacagcgacgaggacgcccaaattcaagagatggaatctggtgaacaagcggcctttatgcagcaggtaataggcaaggatttggctcccggatttgtgatcaaggtgattatatag

SEQ ID NO: 120037 - DNA, 1980 bp, Artificial Sequence
  Description of Artificial Sequence: Synthetic coding sequence
atgcgagtcaatcacactgtatccactatgctgccaacctgcatggtgcatcgccagacaatgtcatgcagtggagcaggggggattacagcctttgtcgcatttagagatgttgccgtctactttacacaggaagagtggagattattgagccccgctcagaggacactccatcgggaagtgatgttggaaacctacaaccacctggtttctctggagatcccttcatccaaaccaaaactaattgcccagctggagaggggcgaagccccttggcgtgaagaaagaaaatgtccactggatttatgtccagagtctaagcctgaaattcaactgtcaccatcttgtcccctgatcttttcatcccaacaggccctctcgcaacatgtgtggctcagccacttgagccaactgttcagctcactgtgggccgggaatccactacaccttggcaagcattatccagaggaccagaagcaacaacaggatcctttctgctttagcggcaaggcagagtggatccaggagggagaagatagccgtctgttgttcggacgcgtcagcaagaacggcacctcaaaggcattgtccagtcctccggaagaacaacaacctgctcagtctaaggaggacaataccgttgtcgatattggcagctctcccgagaggagggcggacctggaggagactgacaaggtcctgcacggcttggaggtaagcggatttggggagataaagtatgaggagtttggcccaggatttattaaggaaagcaatctgctgagcctccagaagacccagacaggagagaccccgtatatgtacaccgagtggggggatagtttcggaagcatgtccgtgctgatcaagaacccccgcactcacagtgggggcaaaccttacgtgtgccgggaatgtggtagagggtttacatggaagtctaatttgattacccaccagcgcactcattcaggggagaagccttatgtctgtaaggactgtgggcggggtttcacctggaagagcaacctgtttacacatcaacggacccactcggggctgaagccatatgtatgcaaggagtgtggccaatcattttctctgaagtccaacctgatcacacaccagagggcgcacaccggagaaaagccttatgtctgtagggaatgcggtagaggcttccgccagcatagtcacctggttcgacacaagagaactcacagtggcgagaagccttacatttgccgggagtgcgagcaaggttttagtcagaagtctcatttgatcagacatctgcgtacacatactggagaaaagccgtacgtgtgtaccgagtgtggtaggcacttcagctggaagagcaatttgaagacccaccagaggacccacagcggggtgaaaccctatgtgtgcctggaatgcgggcaatgtttttccctcaaaagcaacctaaataagcatcagagatctcacacaggggagaagccctttgtgtgtacagaatgcggaagaggtttcactcggaagagcactcttagtactcatcagcgcacacacagtggggagaaaccgttcgtgtgcgccgaatgcggtaggggctttaatgataaaagtaccctaattagccaccagcgcacccatagcggcgagaagccctttatgtgtcgcgagtgcggacgacgattccgtcaaaagcctaacctgttcagacacaaacgcgctcatagcggagcattcgtttgtagagaatgcggccaaggattctgtgccaagctgactctgattaagcatcagcgggcacacgccgggggtaaaccgcatgtgtgcagggaatgcggacaggggttctctcggcagagtcatctcatccgtcaccaacgcactcactccggcgagaagccctacatttgccggaaatgtggaagagggttctctcgcaaaagcaacttgattcgccaccagcggacccacagtggttag

SEQ ID NO: 120038 - DNA, 1923 bp, Artificial Sequence
  Description of Artificial Sequence: Synthetic coding sequence
atggcaactgggctattaagggcaaaaaaggaggcatttgtcgcctttcgcgacgtggccgtgtactttactcaggaagagtggagactcctgtcacccgcacagcgaaccctgcaccgcgaagtgatgctggaaacctacaatcaccttgtctccttggagatcccctctagcaagccaaaactgatcgcccagctggagagaggcgaagcaccatggcgggaagaacggaagtgtccactggacctatgcccagaatctaagccggagatacagctgtctccctcatgccctctcattttttcctcacagcaggctcttagccagcacgtctggttgtcccatctgtcacaattattcagttctctttgggccggcaaccccctgcatctcggaaaacactacccagaagaccagaagcagcagcaggaccctttctgcttctccggaaaggcagagtggattcaagaaggagaggactcccgcctgctctttggccgggtgtctaaaaatggcacgtcgaaggccttaagctccccacccgaagaacaacagcctgctcagtctaaagaggacaacaccgtcgtagacatcggaagctcccctgagcggagggccgatctggaagagactgataaagtgctgcacggactggaggtgagtggcttcggagagattaagtacgaagaattcggtcctggcttcattaaagaaagcaacctgctgtcgctgcagaaaacccagactggagaaaccccatacatgtacaccgagtggggcgactccttcggatctatgtcagtcctcattaaaaatcccaggacccattccggcgggaaaccttacgtatgtcgcgagtgtggcaggggattcacttggaaatccaacttgattacacatcaaaggacccactctggtgaaaagccttacgtgtgtaaagattgcgggcgagggtttacctggaagagcaacttgtttacacaccagagaacccatagtggtctgaagccgtatgtgtgcaaggaatgtgggcagagttttagtctgaagtcaaacctgatcacccaccagcgagctcacacgggcgagaaaccctacgtttgccgggagtgtggtcggggttttcggcagcacagccacctggtgaggcacaaacgcactcacagcggcgagaagccctacatctgtagagaatgcgagcaagggttcagtcagaaatctcacttgattcgacacttgagaacccataccggcgaaaaaccctacgtttgtacagagtgtggcagacatttctcctggaaaagtaatctcaagacccaccaacgtactcacagtggagtcaagccttacgtgtgccttgaatgcggtcagtgttttagtctcaagtccaacctgaataaacaccagcgaagtcatacaggagagaaaccatttgtctgtaccgaatgcggccgcggattcacgcggaagtccacattatccacccaccagcgcactcactctggggaaaaaccattcgtatgtgctgagtgcggccgaggatttaatgacaaatcaaccctcatcagccaccagcggacgcactcaggcgagaaacccttcatgtgcagagaatgtggacggagattccgacagaagccaaacctgttcagacataaacgggcacactcaggtgcatttgtctgtcgggaatgcgggcagggattctgtgccaagctgactctgatcaagcaccagcgagctcatgccggcggcaaaccgcacgtgtgcagagagtgcggccaagggttctccaggcaatcacatctcatccgccatcaaagaactcactctggtgagaaaccttatatatgccgaaagtgtgggcgtggctttagtaggaagagcaacctgattcgccaccaacgcactcattctggatag

SEQ ID NO: 120039 - DNA, 1317 bp, Artificial Sequence
  Description of Artificial Sequence: Synthetic coding sequence
atgctcgagacctacaaccatctggtctccttagaaatccccagctccaagcccaagctgatcgctcagttggagaggggggaagccccctggcgcgaggaacgtaagtgtccactggacttatgccccgagagtaaacccgagattcaactgtccccttcttgcccgttgatcttctcttcacagcaagccctgagtcagcatgtctggctgagccacttgtcacagctgttctctagcttatgggccggaaatccactgcacctcggtaagcattacccggaagaccagaagcaacagcaggatcctttttgcttctccggtaaagctgaatggattcaggagggagaagattcacggcttctgttcggcagggtctccaagaatgggacgagtaaggcgttatccagccctcctgaggagcaacaacctgctcagtctaaagaggataacaccgtcgtagacatcggtagttcacctgaaaggcgcgcggatctcgaagagacggacaaagttttgcacgggctggaggtgtctggctttggcgaaatcaagtacgaagaattcggtcctggttttatcaaggaaagtaacctattatcactccaaaaatcccaccttattaggcacttgcgcacgcatactggagagaagccctatgtttgtacagagtgtggcaggcacttcagctggaaatctaatctcaaaacacatcaacgaacacactccggagtgaaaccatacgtgtgtctggaatgcggccagtgcttttcactgaagagtaacctcaataaacaccaaagatcgcacacgggagaaaagccctttgtgtgtacggaatgtgggagaggcttcacccgcaagtctactctgtcgactcaccagcgaacccacagcggagagaaacctttcgtttgcgccgagtgtggcaggggcttcaacgacaagtcaactctaatatcgcaccaaaggacccatagcggggaaaagccctttatgtgccgagagtgcgggcgaaggtttagacagaagccaaaccttttccgtcacaaacgggctcatagtggagcgttcgtgtgcagagaatgcgggcagggattctgcgctaaattaactcttattaagcaccaacgggctcatgcaggcgggaagccacacgtgtgcagggagtgcggccaaggcttttcccggcagtcccacctcattcgccatcagagaacacacagcggcgaaaagccctatatctgccggaaatgcggcagaggattctctcgcaagtcaaacctgatcaggcatcagcgaacacacagtggctag

SEQ ID NO: 120040 - DNA, 1797 bp, Artificial Sequence
  Description of Artificial Sequence: Synthetic coding sequence
atgttggagacgtataatcacctcgtctccttagagatcccatccagtaaacccaaacttatcgcccagctcgaaagaggagaggcaccctggagagaagaacggaagtgcccgctggacctgtgtccagagagtaaaccagaaattcagctcagcccatcatgcccactgattttttcatctcagcaggccctgtctcagcatgtgtggttaagtcacctatctcagctgttctctagcctgtgggcagggaaccctctccatcttggcaagcactaccctgaagaccagaagcagcagcaggacccattctgcttttctggaaaggcagagtggattcaggagggagaggactcaagactactcttcggaagagtgtctaaaaacgggacgagcaaggccctgtctagtccacccgaggagcagcagccggcccagtccaaggaggataataccgtggtcgacatcgggagttccccggagaggagagctgacctggaagaaacagataaggttctacatgggttggaggttagtggatttggggagattaagtatgaggagtttggcccagggtttataaaagaatcaaacctactgtccctgcaaaaaacccagacaggcgagactccttacatgtatactgagtggggcgattcttttggcagcatgagcgtcctgattaaaaacccaaggacacactccggcggtaagccctatgtgtgccgggaatgtggacgaggattcacatggaagtctaatttgatcacccatcagcgcacccattccggagaaaagccttacgtgtgcaaggactgcggccgggggtttacatggaaatccaatctcttcacccaccagagaacacatagcggcctaaaaccgtatgtgtgcaaggaatgtgggcagtctttttctctgaagtctaacctgataacgcaccagagggcccatacaggcgagaagccgtatgtttgtcgcgagtgcggtcggggcttccgccagcactcacacctagtacgccataagcgcacacattccggagagaaaccgtatatatgcagagaatgcgagcagggcttctcccagaagtcccacctaattagacatcttagaacccacacaggggaaaagccctatgtgtgcactgaatgcggaaggcatttttcatggaaatctaacttgaaaacgcaccagaggacgcatagtggagttaagccttatgtgtgtctggagtgtggccagtgcttctcccttaaatccaatctaaacaaacaccaacgaagccacactggcgaaaaaccattcgtgtgcacagagtgtgggcggggtttcacccggaaatccaccctgagtacccatcaacgtacacactcaggcgagaagcctttcgtatgtgcagaatgtggtagagggttcaacgacaaatccacactgatctcgcatcagcgcacccactccggagagaagccctttatgtgtcgcgaatgtggaagaaggtttaggcagaaacctaaccttttccgccacaagagagcgcacagtggggcatttgtttgtcgggaatgtggacagggtttttgtgccaaactgaccctgataaaacaccagcgtgctcacgcaggtggaaaaccacatgtctgccgggaatgtggacaggggttctcaagacaaagccacttaatcagacatcagagaacccacagcggggaaaagccttacatctgtcgcaaatgtggtagaggattcagtcgcaagtcaaatctcatacgtcatcagcgtacacattccgggtag

SEQ ID NO: 120041 - DNA, 2190 bp, Artificial Sequence
  Description of Artificial Sequence: Synthetic coding sequence
agttggctgggacccgggaaggccagcttgctacgtagtttccctcacctctgtacacttttacccgatttccgcctccaggacccccagcgcgctcctgcgttccacctatcttctgaaaccctgccgttcagcaggaaatcaacacaagagacgcgaaaaatggccactggacttctaagagccaaaaaagaggcattcgtggcatttcgagatgtggctgtctattttactcaagaagagtggcgtctgctgagccccgcccagcgtacactccaccgagaggtcatgctggaaacatacaatcacttagtgtctctggagatcccttcctcaaagcctaagcttatagcacagctggaacgcggggaggctccctggcgagaggagcgaaagtgcccccttgatctgtgccccgctgagagcaagcccgagatccaactctcgccctcctgccccctcattttttcatcccaacaagctttgtctcagcacgtgtggttgtctcacctttctcagctatttagctccctgtgggctgggaaccctcttcatctggggaaacattatcctgaggatcagaaacagcagcaagatccattctgtttttctggcaaggcggagtggattcaagaaggagaggatagcagactgcttttcgggagagtctcaaaaaacggcaccagcaaggccttgagctctccccctgaggagcagcagccggcccaatcgaaggaggacaataccgtggtggacattggcagctctccggaaaggcgggcagacctggaagagactgataaggtcttgcatgggctagaggtgagcggcttcggtgaaattaagtatgaggaattcgggcccggcttcattaaggagagtaacctgttgtccctccaaaaaactcagactggggagacgccttacatgtacacggagtggggggattcctttgggtctatgtcagtactgattaagaatcctaggacgcactccggcgggaagccctacgtctgcagagagtgtgggagagggtttacatggaagagcaacctaattactcaccagcggacacattcaggcgagaagccctacgtctgcaaagactgcggccgaggatttacctggaaatccaacctttttacccaccaacgaacgcacagtggcttgaaaccatatgtgtgtaaggaatgtgggcagagtttctcccttaagagcaatctgataactcaccagagggcacacacgggggagaagccatacgtatgccgagaatgtgggcgcgggttccgccaacacagccacttggtcaggcacaagaggacacattcaggggagaagccctacatctgcagagagtgtgagcagggcttttcccagaagagtcatctgatccgacatttgcggacacacactggcgaaaagccatacgtgtgcacggagtgcggaaggcacttttcctggaagtcgaatctaaagacccaccagaggacccactccggtgtaaagccgtatgtgtgccttgaatgtgggcagtgcttctcccttaaaagcaacttgaacaaacatcagcggtcacacactggggaaaaacccttcgtatgtacagaatgtggaagaggattcactcgtaaaagtacactctccacccaccagaggacgcacagcggcgaaaaaccattcgtgtgtgccgagtgcggtcgtggattcaatgataagagcacactcatttcccatcaacggacccacagcggagagaaacccttcatgtgtcgcgaatgcggccggcgattccgacagaagcctaatttgttccgacacaagagggcccactcaggggcctttgtctgccgcgagtgcggacagggtttctgtgccaagctgacactgatcaagcaccagcgggctcacggtggaagtttgatgtgcgctggatctgtggggaaagcactggcgggtagccacacttctctggacaccaggggccatatacaggagaggtcactgatattcgcggagtctgtcgacggagcacttgtcggctcccctacgctctcagatatccgcggacacactcaagaccggaattttatgtgtattgggaatgtcgtccagcccctcgctcgctctcatacctcttctgataccagaggccatacacagtgctgcggatttttttcgcactgctag

SEQ ID NO: 120042 - DNA, 1161 bp, Artificial Sequence
  Description of Artificial Sequence: Synthetic coding sequence
atgtatactgaatggggggattcctttggctcaatgtccgtacttattaaaaatccgcgcactcacagtggagggaagccctatgtctgccgcgaatgtgggagaggctttacttggaagtctaaccttatcactcaccaaagaacccactccggcgagaagccctacgtctgcaaggactgtggcaggggtttcacgtggaagagcaatttattcacacaccaaagaacgcactccggcttgaagccctatgtgtgcaaagaatgtggccagagcttttctttaaaatcaaatctcatcactcatcaacgggctcatacgggcgagaagccttatgtctgtcgcgagtgcggacgggggtttcggcagcactctcatcttgtccgccataaaagaactcattctggagagaagccgtatatatgtagggagtgtgaacaagggttctcccaaaaatcacacctcattagacacctaagaactcacaccggggagaagccatacgtgtgcacagaatgtggacggcacttttcatggaaatctaatctgaagactcaccagagaacacattctggcgtgaaaccctacgtgtgcttagagtgtgggcaatgtttcagtctgaaatcaaatctgaacaagcaccaacggagtcacacaggggagaagcctttcgtgtgcactgaatgtgggcgaggattcacacggaagagcacactctctacccatcaacgcacacactccggagagaagccctttgtatgcgctgaatgcgggagggggtttaatgataagagcaccttgataagccaccagaggactcattctggggagaaacccttcatgtgtagggaatgtgggcgcaggttcaggcagaaacctaacctttttaggcataagcgcgcccattcaggagcttttgtgtgtcgtgagtgcgggcaaggcttctgcgcaaaactgaccctcatcaagcaccaacgagcccatgccggcggcaaaccacacgtttgtagagaatgcggccaaggcttctctcgacagagccatcttatccggcatcagcgcactcactctggcgaaaaaccttatatctgccgtaaatgtggccgtggctttagtcggaagtcgaatttaatcaggcaccagcgtacacattcagggtag

SEQ ID NO: 120043 - DNA, 612 bp, Artificial Sequence
  Description of Artificial Sequence: Synthetic coding sequence
atgggtggtagcctgcgcgtggccgtccttggggcacccggggttgggaagaccgctattatccgccagttccttttcggcgattaccctgaacgtcaccggcctacagatgggcctcggttgtaccgtccagcagttctgctggacggcgcagtgtacgatctgagtattcgggacggggatgtagctggacccggtagttcccccggcggcccagaagaatggcccgacgccaaagactggtccctccaggatacagatgctttcgtgctagtttatgacatttgctctccagatagcttcgactacgtcaaggcactgcggcagcggattgccgagactagacctgccggtgctccagaagctcctatactggtagttggcaataaacgagatcgccagcggctgagatttggaccgaggcgggcgctggccgccctggttcgccgagggtggcgctgcggttatttggaatgtagcgcgaagtacaattggcatgttttgaggctgttccgggagctgctccgctgcgcgctagtccgggcaaggcccgcacatccggctttacggcttcagggcgccttacatcctgcacgatgtagtttgatgtag

SEQ ID NO: 120044 - DNA, 1479 bp, Artificial Sequence
  Description of Artificial Sequence: Synthetic coding sequence
atggacctcctgaaggctatcacatccccattggccgccggtagcaagccctccaaaaagaccggcgaaaagtcatctgggtcctctagccacagtgagtcgaagaaggaacaccatcggaagaaagtatctgggtcatctggcgagctgcctcttgaagacgggggctctcacaagtccaagaaaatgaaacccctgtacgtaaacaccgaaaccttgactctcagagaacccgacgggctgaaaatgaagctcatcttatcgcctaaggagaaagggtccagcagcgttgatgaggagtccttccagtaccctagccaacaggccactgtaaaaaaaagttcgaaaaagagcgccagggatgaacagggcgcccttctccttggtcatgagctgcagtcttttctgaagacagcccggaagaaacacaaaagctctagtgacgcccattcctctcctggacctgagggatgtggatctgacgcttcacaatttgccgagagccactccgccaatctggacctgtccgggctcgagcctatcctggtcgaaagcgacagctctagcggcggagaattggaagccggggagctggtaatcgatgattcataccgggaaattaagaagaagaagaaatctaagaagagtaagaaaaagaaagacaaggagaagcataaagagaagcgccattcaaagtctaaacgatctttgggtctgtcggctgtgcccgtcggtgaggtgacagtgacttccggccccccaccttccattccatacgctggcgcagcagctcctccccttcccctgcctggcctgcataccgatgggcattccgagaagaagaagaagaaggaagaaaaggacaaagaacgggaacgcggcgagaaacccaaaaagaagaacatgagtgcctatcaggtcttctgtaaggaataccgggtgaccattgtagccgatcacccaggcattgatttcggagagctctcaaaaaagctggctgaagtgtggaaacagctccccgagaaagataaactgatctggaagcaaaaggcccaatacttgcagcataagcagaataaggcagaagcaactaccgtgaagaggaaggcatccagttcagaaggctcaatgaaagtgaaagcaagcagcgtcggagtcttgagcccccagaagaagagtcctcccacaaccatgctattaccagcaagccctgccaaagccccagagacagaacctatcgacgtggctgcgcatctccaactgcttggcgagtcgctgtctctgataggtcacagactgcaggagacagagggcatggtggccgtctctggcagtctgtccgtgttgctggatagcatcatctgcgccttgggtccactggcatgtctgacaactcagctgccagaactaaacggctgtccaaaacaggtgcttagcaatacactggacaatatcgcatacattatgccagggctgtag

SEQ ID NO: 120045 - DNA, 1896 bp, Artificial Sequence
  Description of Artificial Sequence: Synthetic coding sequence
atggtgtctaaattgagccagttgcagactgagctgctggcagccctgttagaaagcggcctgtcaaaagaggcactgattcaggcgctcggggagcccggaccctacctgctggcaggcgaaggccccctcgataagggcgagtcttgtggtggcggacgcggcgagttggctgagctgcccaatggactaggcgagaccagagggagcgaagacgaaacggatgacgacggcgaagacttcacaccgcccatcctcaaagagcttgaaaacctgagtccagaggaggcagcccaccagaaagcagtagttgagactctactgcaggaagacccctggcgggttgccaaaatggtgaaatcctatttacaacagcacaatattcctcaacgcgaggttgtcgatacaaccggccttaaccagtcacacctgtcccagcatctgaataaggggacaccaatgaagacccagaaaagggccgccctgtatacctggtatgtgcggaaacagagggaagtggctcaacagttcacacacgccggccagggaggcttgatagaggaacccaccggcgatgagctccctacaaagaagggcaggcgcaaccggttcaaatggggccccgcaagccagcagatcctgttccaagcatatgaaagacagaaaaatcctagcaaagaagaaagagaaacactcgtggaggagtgtaatcgggccgagtgcatccaacgcggagtctccccttctcaggcccaaggtttgggcagcaatctggtgaccgaagtgcgggtctacaactggttcgcaaatcggaggaaagaagaggcgtttaggcacaagcttgccatggacacatacagcgggcccccacccggcccgggtcctgggccggcgttgcctgcgcactcttctccagggctgcctcctcccgcattgagcccatccaaggtgcatggtgttaggtatggccagccagctacgtccgaaacggccgaggttccctcttcctctggaggcccattggtcactgtatcgactcccctgcatcaggtaagtcctaccggactagaaccctcacattccctcctctcgacagaggccaagctagtcagcgcggctggtggccccctcccccctgtatccaccctgactgccctgcacagtctcgagcaaacgtctccaggcctgaatcagcagcctcagaatttgatcatggcatccctgccgggcgtcatgacaatcggccccggggagcctgcctctctagggccaacgttcaccaatacaggtgcatctaccctggtgatcggcctggcttccacacaagcccaatctgtgcccgtgatcaactccatggggtcttccctgactactctacagcccgtccaattctctcagcccttacacccttcttaccaacagcccctcatgccaccggttcagtctcacgtgacccagagccccttcatggcaaccatggctcagttacagagcccccatgccttgtattctcataaacccgaggtagcacagtacacccacacaggactgctgccccagaccatgcttatcaccgacaccactaatttgtctgcactcgcgtctctcacccccaccaagcaagtcttcactagcgatacagaggcctctagtgagtctgggcttcacacacccgccagccaggctaccacattgcatgtaccttcccaggaccctgcctctatccagcacctccagccagcccacaggctttccgcctctcctaccgtctcttctagtagcctggttctgtaccaatctagcgactcaagtaacggccagtcgcatctcctccctagtaaccactccgtcatcgagacctttatctctactcagatggcctctagcagtcaatag

SEQ ID NO: 120046 - DNA, 1719 bp, Artificial Sequence
  Description of Artificial Sequence: Synthetic coding sequence
atggtctcaaagctctcccagctgcaaaccgaacttctagcagcgctgctggaatccgggttgtcaaaggaggctctgatccaggcactgggtgagcctggtccttacctcttggctggagaaggtccactggataagggtgaatcatgtgggggcggccggggagagctggccgagctgccaaatggtctcggagagacacgaggaagcgaggacgagactgacgacgatggagaagattttaccccgcccatattgaaggaactggaaaatttatcgccagaggaagcagctcaccagaaagcggtagtggagacactgctacaggaggatccttggcgggtcgccaaaatggtgaaaagctatcttcagcaacacaacatcccccagcgcgaggtcgtggacacaaccggtctgaatcagagccatttgtcacagcatttaaacaagggcacccccatgaaaacccagaagagggccgctctgtatacatggtatgtaaggaagcagcgtgaggtggcccagcagtttacccatgcagggcaggggggactgattgaggagcccacaggggatgaactgccaacgaaaaaaggccgtaggaatagatttaaatgggggccagcatcacagcagattctcttccaagcctatgaaaggcagaaaaatccctccaaggaggagagagagacactcgtggaggaatgtaaccgagccgaatgtatccagcgcggcgtgtcaccctcacaagcccagggactcggctcaaacctggtgactgaggtccgggtctataactggttcgcaaaccgccgaaaggaagaggccttccgtcacaaattagctatggacacctatagtggtcctcccccggggcctggccctggacccgctctgccagcgcattcatcacccgggctccccccacccgccctgtccccgtctaaagtgcatggggtcaggtatggacagcctgccacgtccgagaccgcagaagtaccttcttcctcaggcgggcccctcgtgaccgtgtcgacgcccttgcatcaggtttcaccgaccggactcgaaccgagtcacagtttactgtctaccgaagccaaacttgtgtctgcagcaggaggtccactccccccggtgtccaccctaactgctctccatagtctggagcagaccagccccggactaaaccagcaaccccagaacctgattatggcgagcctcccaggtgtgatgaccatagggcccggggagccagcatccttggggcccaccttcactaacacaggagctagtactctggtgataggcctcgccagcacgcaggcacagagcgtccctgttatcaattccatggggtcctctttgactacgcttcagcctgtgcagttcagccagcccctccacccatcttaccagcagcccctcatgccccctgtgcaatcccacgtgacacaaagcccctttatggcaaccatggctcagctgcagtcaccacacggtgagagaccagtcccccacacagctggagacgatgacagggggtggttgtccatggacgctggcgaaaggggcgcttggcaggcattgcagagtgcatgcgtgtctggtacgtccgtgttcccttacagctcaaacggccaaagccacctgctgccctcaaaccactcagtgatcgagaccttcatttccactcagatggcgtccagtagtcagtag

SEQ ID NO: 120047 - DNA, 1566 bp, Artificial Sequence
  Description of Artificial Sequence: Synthetic coding sequence
atggtttccaaacttagccaactccaaacagagttgttggccgccctgcttgaatccggtctgtcgaaggaggccctgattcaggcattgggcgaaccaggcccatatttgctggcaggagagggcccacttgataaaggtgaatcctgcggcggcggacggggggaactagcggaactgcccaacggcttaggagaaaccaggggtagcgaggacgagactgacgacgatggagaagattttacgccaccgatcctgaaagaactggaaaacctgtcacctgaggaggcagcccatcagaaggctgtggtcgagacgctcctgcaggaagatccatggcgcgtggcaaagatggttaagagctacctccagcagcataatataccgcagcgggaagtggtagataccaccgggcttaaccagtcacacctgtctcagcatcttaacaagggaacacccatgaagactcaaaaacgggctgctctatatacttggtatgtccgtaagcagcgggaggtagctcagcagtttactcatgccggccagggaggattgatcgaggagccaacaggagatgaattgccgacgaaaaaaggacgacggaaccgctttaagtggggccccgctagccagcagatcctgtttcaggcctacgagcggcaaaagaacccttcaaaggaggaaagagaaacactcgttgaggaatgtaacagggccgagtgcatccagcgcggagtgagcccctcacaggcccaagggcttggttcaaacctcgttactgaggtacgcgtttacaactggtttgcaaatcggcgaaaagaggaggccttccggcacaagctggctatggacacttactctggcccgccgcccgggccaggtccggggcccgctttgcctgctcactccagccccggcctcccacctccagccctgtcaccatctaaggtccatggcgtgcgatatgggcaacctgctacatccgagacagccgaggtcccatctagttccggaggccctctggtgaccgtcagtacccctctccatcaagtttcacctactggcttggagccctcacactctctgctctccacggaggccaaactggtgagtgctgcgggaggacccttacccccagtgagtacgctgactgccctgcactctttagagcagactagcccaggtcttaatcaacagccgcaaaacttgataatggcttccctgcctggggtcatgaccatcggtccaggcgagcccgcaagcctgggtcccacttttactaacactggcgcttcaactcttgttataggcaagcttgtcggaatgggaggtcatctgggggggcgattgatgggccagccccaaaaccccggcgccggtcgagccacagggacacactcttttatccatcagcacgtgttcattcagtgtctgctatggacgtctcactgtgcgactagcgtcatacctggggacagcagcaacggtcagtcccatctgcttccctccaatcatagtgtaattgagacttttatcagtacccagatggcatcctcatcccagtag

SEQ ID NO: 120048 - DNA, 1572 bp, Artificial Sequence
  Description of Artificial Sequence: Synthetic coding sequence
atggtttcaaagctcagccaattacaaactgagttacttgctgcactgctcgagagcggcttatcaaaagaagccctgatacaggctctgggagagccggggccgtaccttctggccggcgaggggcctctggacaagggtgagtcgtgcggtggaggcaggggggagctggctgaactgcccaatgggctgggagaaaccaggggtagcgaagacgaaactgatgacgatggcgaggattttaccccccccattttaaaggaattagaaaatctttccccggaggaagcggctcatcagaaagccgttgtcgagactctattacaggaggacccctggagagtggcaaagatggttaaaagttatctccagcagcacaacattccacagcgggaggtcgtggataccacaggacttaatcagagccacctctcccagcacctgaataaggggacccctatgaaaacgcagaagagagccgccttgtacacctggtacgtacgcaagcagcgcgaggtggctcaacagtttacacacgcaggccagggaggcctgattgaggaaccgactggagatgagctgcccacaaaaaagggcagacgaaatagattcaaatgggggcccgcttctcagcagatccttttccaggcatatgaacggcaaaaaaacccttcaaaggaagaaagagagactctggtcgaggaatgtaaccgtgccgagtgcattcagcgaggagtgtccccctcccaggcacagggtttagggtcaaacctcgtcactgaagtcagcgccgctggggggccactgccccctgtgagcacacttaccgccctccattccttggagcagacatctccagggctgaatcagcagccccaaaatctgattatggccagcctgccgggcgtgatgaccattggaccgggtgaacctgcctcgctgggtccaacattcaccaatacgggggctagtaccctggttataggccttgcgtcaacccaagctcagtccgtcccagtgatcaattcgatgggctcttctctcacgacgttgcaaccagtgcaattcagccagcccctgcacccttcatatcagcagcctctgatgccacccgttcaaagtcatgtaacacagtctccttttatggcaacaatggcacaactgcagagcccacacgcactctacagccataagccagaagtagcacaatacacacatacaggccttttaccgcaaacaatgcttattacagacacaacaaacctctcagccctcgccagcctaactcctaccaagcaagtgttcacttcagacactgaggcctcgagtgagagcggcctgcatacacctgccagccaggcaaccacactgcacgtcccttctcaggaccccgccagtattcagcacctccagcctgcccaccgtctttccgcatcccctacggtgagcagctctagcctggtcctctatcagagctcggactccagcaacgggcaatcgcacctccttccatcaaatcactccgtgatagaaaccttcatcagcacccagatggcctctagctctcagtag

SEQ ID NO: 120049 - DNA, 1812 bp, Artificial Sequence
  Description of Artificial Sequence: Synthetic coding sequence
atggttagcaagctgagtcagctgcaaaccgaactcctggcagctctgttagaatcagggttgtctaaagaggcactaatacaggcactcggggagcctgggccatatctcctggcaggcgaggggcccttagacaaaggcgagagctgcgggggtgggaggggagagctcgcggagctgccaaacggccttggcgagacaaggggcagcgaagacgaaacggatgacgacggcgaggacttcacacccccaatactgaaagagctcgagaacctgagcccagaggaggcagcccaccaaaaagccgtggtagaaacactgctgcaggaagatccctggcgagtcgctaagatggtcaagtcatacctacagcagcataacatcccacaacgggaggtcgtggacacaactggactgaaccagtcgcatctgagtcagcatcttaataagggcaccccgatgaagactcagaagagggctgccctttacacatggtacgtgagaaagcaacgcgaagtagcccagcagtttacccacgctggccaggggggcctgattgaggaacccaccggtgatgagctgcctaccaagaaggggcggcgcaatcggtttaaatggggcccagcctcccagcagattttgttccaggcttatgagcgtcagaaaaatccctccaaagaagagagagaaactttggtggaagagtgcaatcgtgcagagtgcattcaacgcggtgtgagtccgtcccaggcccaaggtctagggtctaacttagttacggaggtgcgagtgtataactggttcgccaacaggagaaaagaggaggcgtttcgccacaaattagcaatggacacctactccggccctcctcctggtcctggtcctggtcccgccctgcctgcccattcgagccctgggctgcccccacctgcgctgtcccctagtaaggtccacggcgtgagatatggacagccagcgacgtctgagaccgctgaggtaccttcctcttcagggggacccttagtcacagtttctacacccttacaccaggtgtcgccaacaggccttgaaccatcccattccctgttaagtaccgaggcaaagctggtaagcgcagctggcgggccacttccccccgtttcaacgctcactgcactccactcgctggaacagacttctcctggcctgaaccagcagccccagaacctcattatggcttcgctcccaggggtgatgacaatcggacctggagaacccgcgagccttgggccgacatttactaacaccggcgcctccactcttgtcatcggattggcatcaacacaggctcaaagtgttcctgttattaattcaatggggtcatctctgacgactttacagccagtgcagttctcccagcccctgcacccaagttaccagcaacccctgatgcctccagttcagtctcatgtcacccagtccccattcatggccaccatggcccagcttcaatctccccacgctttgtattctcataaacccgaagtcgcacagtatactcacactggcctattgccacagacgatgttaattaccgacactaccaatctgtccgccttggctagcctcacccctacaaagcaggtgttcacaagcgacacagaggcttcaagtgaaagcggcctgcacactcccgctagccaggccactacgctgcacgtcccctctcaggatccagcctcaattcagcatctacagccggctcaccgtctgtcggcctccccaacagtgagcagcagtagtttggtcctctatcagtcgctcgggctctag

SEQ ID NO: 120050 - DNA, 837 bp, Artificial Sequence
  Description of Artificial Sequence: Synthetic coding sequence
atggtgtccaaactgtcccagctacaaacagagctcctggcagcgctgctcgagagcgggttgtcgaaggaggccttgatccaggcactgggcgagcccggcccgtaccttctggccggcgaaggccctttggataagggtgagtcctgtggcggcggaaggggggaactggcagagctgccaaatggtttgggggaaacccgcggaagtgaagacgagactgatgacgacggtgaagacttcaccccgccaattttaaaggaactggaaaatctgtcacctgaagaggcagcacatcaaaaggccgttgtcgaaaccctgttgcaggaggacccgtggcgcgtggcaaagatggtaaagagctacttgcagcagcataatattcctcagcgggaggtagtcgacacaaccgggttgaatcagtcacatttatcccagcatctcaataaaggaactccgatgaaaactcagaaaagagccgccctgtatacctggtacgtgcgaaaacagagagaagtggcccagcgtcgcaatgcttcacgggaaggatgtccccatcaccgccacagaggttgggctcctactagtagccggaggtgtgtctccactacagggctgcccactggggccaagaagaagccgtcgggcacctcttggccctggacccgcaccgcagggccaccacaggggcaggccagagatctcagatgcccactcactgccccactcgcctgccttcacctccccagcccaccagtccggagcactgtgtgtgccatggacagcctgcggcccgtgcggctgcaaaagtacccgcaggcggccgcggtgccatag

SEQ ID NO: 120051 - DNA, 360 bp, Artificial Sequence
  Description of Artificial Sequence: Synthetic coding sequence
atggtgagtaagctctcccagctgcaaacagagctgctggctgccctgttggagtccgggctctccaaagaagccctgattcaggctttaggcgaacctggtccttacctcttagccggcgagggcccactggataagggagaaagttgtggggggggcagaggagagttggctgagcttccgaatggtcttggcgaaacaagggggtcagaggatgagacggatgatgacggggaggatttcacaccacctatcctgaaagagttggaaaacctttcacccgaagaggctgcacatcagaaagccgtggtggaaacattactgcaagtgcacccgtgtagggccggtagggccgactag

SEQ ID NO: 120052 - DNA, 1989 bp, Artificial Sequence
  Description of Artificial Sequence: Synthetic coding sequence
atggttagtaaactgtctcagcttcagaccgaactgttggctgcgctgctagagagcggtctaagcaaagaggctctcattcaggcactgggggaacccggaccgtatctgctggccggcgagggcccattggataaaggggagtcatgcggcggaggccggggggagctagccgagctccccaatggtcttggcgagacccgtgggagcgaagacgagaccgacgacgacggagaggactttacgccgcccatactgaaagagctggagaatttatccccggaggaggcagcccaccaaaaagctgttgtggaaacgctattgcaggaggacccctggagagtcgccaagatggtgaaatcatacctccagcagcacaacatcccgcagagggaggtggttgacactaccggactgaatcaaagtcatctgtctcaacatctgaacaagggcacacctatgaagacccaaaagagagcagcgctttatacctggtatgttagaaagcagagagaagtggcacagcagtttacacacgctggccagggaggcttgatcgaggaacccaccggcgatgaactgccaacaaaaaagggcaggcgtaacagatttaagtggggccccgcttcacagcagatcttgtttcaggcttatgagcgccaaaaaaaccctagcaaggaggaacgagaaacacttgtagaagagtgcaaccgggcagaatgtatccagcgcggagttagtcccagccaggcacaaggtctgggaagcaatcttgtcactgaggttcgcgtatacaactggttcgcaaaccggcgaaaggaagaggctttccgccacaaactggcaatggacacttattcaggccctccaccaggtcctggacccggcccagctttgcccgcacattcttcaccaggcttaccgccccccgctctttctccgagcaaagtccatggtgtgagatacggacaaccagcaacgagtgagaccgcagaagtaccgagctcatccggaggaccattagtgaccgtgtccacacccctgcaccaagtaagtcccacggggctcgaaccaagtcactccttgttgtctacagaggcaaaactcgtgagtgccgcaggagggcccctccctccagtttcgacgcttaccgccctgcactccctcgaacagacctccccaggtcttaaccagcagcctcagaacctgataatggcttccctgccaggagtaatgaccataggcccaggcgagcccgcctctctggggcccacattcaccaacacgggcgctagtaccctcgtcatagggctggccagcacacaggctcagtctgtcccagtgattaattcgatgggctcttctctcactacactgcagcccgtccaattctcgcagcctttacatccttcctatcagcagcctctcatgcccccagtgcagtcccatgtgacccaatcaccattcatggctacaatggcccagctccagagccctcacgcgctgtactcacacaagccagaagtcgcacaatacacccacaccggcttgctcccccagaccatgctcataaccgacaccaccaatttatcagctcttgctagtctgacccctactaagcaagtccggagtcgtccggctggtcctccccttgcttgtgaccgggcacctcacccccacattccacgggcccaggaggcggccctgctgccgcaggtgttcactagtgatacggaagcttcatccgagtcgggtctacacactccagcgtcccaagcgacaaccctgcatgtgcccagccaagatccagcttctatacaacaccttcaacccgcacacaggctttccgcatctcccaccgtatcatcctcgagcttggtgctgtatcagagctccgattccagtaacgggcagtcacatttattgccctctaaccactctgtgatagaaacatttatatccactcagatggccagctctagccagtag

SEQ ID NO: 120053 - DNA, 744 bp, Artificial Sequence
  Description of Artificial Sequence: Synthetic coding sequence
atggtgagcaagctgagtcagctccagaccgagctgctggctgccctccttgagagcggcctgtctaaggaggccttgattcaagctctcggcgagccaggaccttacctgctggccggagaaggcccgctggataaaggagaatcatgtggagggggcagaggagaactggccgagttacctaacggattgggagagactcgcggctcagaggacgaaaccgacgatgatggtgaggactttaccccacccatcctgaaagaacttgaaaacctgagcccagaggaggctgcgcatcagaaggcggtagtcgaaaccctgctgcaggaggatccctggagagtggcaaagatggttaagtcctacctccagcagcacaacattccacagcgcgaagttgtcgataccacaggcctgaaccagagtcacctgtcccagcaccttaacaagggcaccccgatgaaaacccagaagagggcggccctgtacacctggtacgtgcggaagcagagggaagtagcgcaacagttcactcacgccgggcaaggcgggctaatcgaggagccaactggggacgagctgccgactaagaagggcaggcggaatcgttttaaatggggcccagcgagtcagcagatcttgttccaggcctatgaaagacagaaaaatccatccaaagaggagcgggaaacactcgtggaggagtgcaacagatgtgctctgtggactgcttgtgatcaatag

SEQ ID NO: 120054 - DNA, 1359 bp, Artificial Sequence
  Description of Artificial Sequence: Synthetic coding sequence
atggtctctaagttatctcagcttcagacagagttgctcgcagccctgctcgaatctggtctctccaaggaggcactgattcaggccttaggagagcccggtccgtatctgttagcgggtgagggaccactggataaaggagaaagctgcggggggggtaggggtgaattggccgaactccccaatggcctgggcgagacccgtggctctgaggacgaaacagatgatgacggagaagacttcactcccccgattctgaaagaactggaaaatctgagccccgaggaggccgcgcaccagaaggccgtagtggaaaccttactccaggaggatccctggagagtggccaaaatggtgaagtcgtacctgcagcaacataatataccacagagggaggtggtggacactactggcttaaatcagagtcacctgtctcagcacctgaacaagggaaccccaatgaagacacagaagagggctgcattgtatacatggtacgttcggaaacagcgagaagtggcccagcagtttacacatgccggtcaagggggactgattgaggagcctactggagatgagctccctactaaaaaagggcgtaggaaccgcttcaaatgggggcccgcttcacagcaaacttcaccaggcctcaaccagcagccacagaatctgatcatggcctccctgcccggagtgatgactattggaccgggtgagcccgcctcgctgggcccaacatttacaaatacaggggctagcacgctggtgatagggttggcttctacccaagcacaaagcgtccctgtcataaattccatgggtagttcccttactactctgcagcccgtgcaattcagccagccactacatccatcataccagcagccactaatgccacccgttcaatcacatgtcactcaatctcctttcatggcaactatggcccagttacagtcccctcacgccctgtacagtcataaacccgaggtcgctcagtatacccataccggattgcttccccagactatgttaatcactgacacgacgaatctgtctgccctggccagcctgactcccacgaaacaggtttttacaagcgacactgaagctagtagcgagtcaggccttcatacccctgcaagccaggccacaaccctgcacgtgccttcccaggacccagcatccattcagcacctgcagccagcacaccgcctaagcgcttctcccaccgtgtcttcctccagtcttgtcctgtaccagtcaagtgattcatcaaacggccagagtcaccttctgccatccaaccacagtgtgattgagacctttatttctacccagatggcttctagttcccagtag

SEQ ID NO: 120055 - DNA, 1212 bp, Artificial Sequence
  Description of Artificial Sequence: Synthetic coding sequence
atggtgaaatcctatctgcagcagcataatatcccccagcgagaagtcgttgacaccaccgggcttaatcagagccatctctcacagcatctcaataaagggacgcccatgaaaacccagaagcgagcagcactgtatacttggtatgtcaggaaacagagagaggtggcccaacagtttacacacgccggccagggtggtctcattgaagaacccacaggcgatgagttgccaaccaagaagggaagacggaatagatttaaatggggacccgccagtcaacaaatcttgttccaggcttatgagcggcagaaaaacccttctaaagaggagcgtgaaaccttagtagaagagtgcaatcgggccgagtgcatccagcgcggggtgagtccgtcacaggctcagggcctgggcagcaatctggtgaccgaagttcgagtgtataactggtttgccaaccgccgcaaggaagaggctttcaggcacaagctcgcaatggacacctactccggtccaccccctgggcccggcccgggcccagccctgcccgcccatagcagcccaggacttccacctcctgcgctgagcccaagtaaggtccatggcgttagatatggtcaaccggccacatctgagaccgctgaggtgccatccagcagcggcggacctttggtgacagtgagcacacccctgcaccaggtgagccccaccggattagagcccagccactcactccttagtaccgaggccaagctggtgtctgccgctggcgggccccttccacctgtctcgacgttaacagctctacattcactcgagcaaacctcccccggactgaatcagcagccccaaaatctgattatggcttctctgcccggggtgatgacaataggccctggtgagcccgccagcctcgggccaactttcacaaataccggagcgtctacactggtgataggaaagctagtaggcatgggcggacacctcggcgggcgactaatggggcaaccccagaacccaggagccggaagggcaacgggtacacactccttcattcacaccacctgcatctatcccgtgcccacattggaccagagtttgtgttatatatcggacacatgggtgaatcagaccgaccagaatttgtcaaacagctctcgcgaggccgggacgaaacacaatacgagcatcctttggtacctgaggcggtag

SEQ ID NO: 120056 - DNA, 1185 bp, Artificial Sequence
  Description of Artificial Sequence: Synthetic coding sequence
atggtgagcaaactttcacagctgcagaccgaattgctggcagccctacttgaatccggtttgtcaaaggaggccctcatccaggcattgggcgaacctggtccttacttacttgctggtgaggggccactggataaaggtgaatcatgtggcggcgggcgcggtgagctcgccgagctgcccaacggcctgggtgagacgagaggctcagaagatgaaaccgatgacgacggtgaggattttacaccaccaattttgaaggaactggaaaatctgagcccagaagaggccgcccaccagaaagccgtggtagaaaccctgctgcaggaagatccttggcgggtggctaagatggtcaagagctatttacagcagcacaacatcccccagagagaagttgtggataccaccggcctgaaccagtcccatctttcccagcatctgaacaaaggcacgcctatgaagactcagaaacgtgccgcactgtacacgtggtacgttcgaaagcagcgcgaagtggctcagcagttcacgcatgccggacaggggggcctgatcgaggagccaaccggcgatgagttacctaccaaaaaaggcagaaggaaccgcttcaaatggggccctgccagccagcagatcctcttccaggcttacgagcgccagaagaaccccagtaaggaggagagagaaactctggtggaggagtgcaatcgggctgaatgtatccagcgcggtgtgtctccctctcaagcccagggccttggatctaatctagtcacagaagttagagtgtataactggttcgccaatcggcggaaagaagaagcattcaggcataagctagctatggacacatacagcggtccaccacccgggcccggccccggacccgcactgcccgcacatagcagtcccgggctaccaccacccgcactttcaccttccaaggtccacggcgtaagatatggccaaccagccacgtccgaaactgcggaagtgccgagcagcagcggtggcccgctcgtaaccgtgtcaacccctcttcaccaggtgtctccaacagggttggagccttcccattccctattatcaacagaggcaaagcttgtctcggcggcgggtggccctttgccaccagccgcctgctcgcagcctggccgtgtcgctcggcttttcaatttttag

SEQ ID NO: 120057 - DNA, 1917 bp, Artificial Sequence
  Description of Artificial Sequence: Synthetic coding sequence
atggtgagtaaactctctcagctccagaccgagctcctggcagcgctcttggagtctggactgtctaaggaagcccttatacaagccctgggagaaccggggccctatctgctggccggcgagggtcccctggataaaggagagagctgcggcggaggacgaggtgagttggcagaactaccaaatgggctcggtgaaactcggggcagcgaggacgaaacagatgatgacggcgaagactttactccaccgatcttgaaggagctggagaacctttctccggaagaagcggctcatcaaaaggccgtcgtagagaccttgctacaggaggatccctggagggtggctaagatggtgaagagctacttgcaacagcacaatattccgcagcgcgaagttgttgacactacaggcttgaaccagtcgcatctctcccagcacctcaacaaaggtactccaatgaagactcaaaaacgagcagctctgtacacctggtacgtgagaaagcaacgggaagttgctcagcagtttacccatgctggccaggggggtctgatcgaagagcccaccggagacgaactcccaaccaaaaagggccgaaggaacaggtttaagtggggtcccgcctcccagcagatcctgttccaggcttatgaacgccagaagaatccaagcaaagaggagagagagacactggtggaagaatgtaatagggctgagtgcattcagcgaggggtgagtccttcacaagcccagggactgggcagtaatttagttactgaagtgcgggtctataactggttcgccaaccggcgaaaagaagaagctttccgtcataagttagccatggatacctactctggccccccccctggacccggccctggccccgcgctcccagcccacagctctccgggactgcctcctccagcactgtctccatctaaggttcacggggtgcgctacggccagcccgccacctcagagaccgccgaggtaccatcaagctccggagggccgttagtcaccgtatctacccccctacaccaggtcagtcccacaggacttgagccctcacacagccttctgtccacagaagctaaactggtctctgcggcgggggggccacttccacccgttagtacattaacagctctgcacagtctggagcagacaagtccgggcctgaaccagcagccccagaacctgataatggcatccctccccggcgttatgacgatcggccctggagagccagcctcactgggcccaacatttacaaatacaggcgccagtactttagtgatcggattggcaagtacacaggcccagagtgtcccagtgatcaactcaatggggagcagtttaaccaccctccagcctgttcagttctcacagcctcttcacccttcatatcagcagccgctgatgccgcctgtccagagccacgttacccagtcccccttcatggcgaccatggcgcagctccagagccctcacgccctgtattcccacaagccagaagtggctcaatacacgcacaccggcctactaccccagaccatgctaatcaccgatactacgaacttgagcgccctggcaagcctcacccctacgaagcaagaggcagcactgctgccacaggtgtttacttccgatactgaggcctcatcagagtcaggattacatacgccggcttcacaggcgacgacactgcatgtgccctctcaggatcccgcttctattcagcacctgcagccagcgcaccggttgtcagccagtcccaccgtatctagctcatctcttgtgctgtaccaatcctccgacagctccaatggacagagccacctgctgccgagcaaccactccgtgattgagacattcatttcaacccagatggcctccagcagtcagtag

SEQ ID NO: 120058 - DNA, 1416 bp, Artificial Sequence
  Description of Artificial Sequence: Synthetic coding sequence
atggtgtccaagctgtcacagctgcagaccgagctgcttgccgctctattggaatccggactgtccaaagaagcgttgatccaagctctgggggaaccagggccctacctgcttgctggggagggcccactggacaagggagagtcatgcgggggagggcggggagagctagctgaactacctaacggtttgggtgagacacggggatccgaggacgaaaccgatgacgacggcgaggactttacccctcctattctgaaagagcttgaaaatctttcgcctgaggaagctgcgcatcagaaggccgtggtggagaccctcctgcaggaagatccttggagggtagcgaagatggtaaagtcgtacctgcagcaacacaacattccccagagagaggtggtggacaccactgggctcaaccaatcccatttatctcagcatttaaacaaaggtacacccatgaagacccagaagcgggcggctttgtacacttggtatgtgaggaaacagcgggaggttgctcagcagttcacacacgcaggacagggtggcctcattgaagagcctacaggcgacgagttaccaacgaaaaagggaaggcgaaacaggtttaagtggggccccgcctctcagcagatattattccaagcttacgaacgtcagaagaaccccagcaaggaagaaagggagacccttgtggaggaatgcaatcgggcagaatgtatccagagaggcgtgtctccctcacaggcccagggtctagggtcaaacttagttactgaagtcagagtctacaactggtttgcaaatcgccgaaaagaggaagcctttagacacaaactcgcgatggatacatacagtggccccccccctggccccggacccgggcctgcgctgcctgcccatagcagtccgggactgccccctccagccctgagcccaagcaaggtgcatggagtgagatatggtcagccggcaacttcagagactgccgaggtgccaagcagctctggtggcccactcgtaacagtatccactcccctgcatcaggtctctccaaccggccttgagccttctcattcccttctctcgaccgaggctaagctcgtttctgctgcaggtggcccattacctcccgtgtcaaccctcacagctctccactcccttgagcaaacttcgccaggccttaatcagcaaccccaaaatctgatcatggcctccctccccggcgtgatgactatcgggcctggagagccagcatctttaggtcctaccttcaccaacacaggcgcatctaccctggtgattggactggcatccacgcaagcccagtctgtgccagtgattaattcaatggggtcttccttaacaacactccagcctgtgcagttctcgcagcagggtccaagttcatag

SEQ ID NO: 120059 - DNA, 1359 bp, Artificial Sequence
  Description of Artificial Sequence: Synthetic coding sequence
atggtgagtaagctgagccagctgcaaacagaacttctggccgcgctgctggaatctgggttatctaaagaggcgctcattcaggcgctgggagaaccgggcccatatctcttggcaggcgaggggcctctggacaaaggcgaaagctgcggtggcggtcgtggcgagctggctgaattgcccaatggcctgggtgaaacccgggggtccgaggatgagaccgatgacgatggggaagactttacccccccaattctgaaagaactggagaatttaagccctgaagaggctgcgcaccagaaggccgttgtggagactctcctccaggaagacccttggcgcgtggccaaaatggtcaagagctacctgcagcagcataacatcccccagcgggaagtggttgatactaccggcctgaatcaatcccacttatcacagcatctgaacaaagggacccctatgaagactcaaaaacgggccgccctgtacacatggtatgtgagaaagcagagggaagttgcccaacaattcacccatgcaggccaggggggcctgatcgaggagcccacaggtgatgagctccccaccaaaaagggaagacggaatcgcttcaaatggggccccgcatcccagcaaatcttattccaagcatacgagaggcagaagaacccatcgaaagaggagcgtgaaactctggttgaggagtgtaatcgggccgagtgcatccagaggggagtgtcgccatctcaggcacagggtctaggcagcaacctggttactgaggttcgcgtctacaactggtttgcaaataggaggaaagaagaggcattccggcacaagctagccatggatacgtatagcgggcctcctcccggacctggcccaggccccgcgctgcccgcccatagcagtcctggcctgcctcctccagccctgtccccgagcaaagtccacggtgtgagatacggccagcccgcaaccagcgagactgccgaggtcccttcctcttctggcggtcctttggtgaccgtgtccactcccctgcatcaagtgtcaccgacaggcctggaaccctcacattctcttttgtcgactgaggctaaactggtcagcgcagcaggcggccctctcccgcctgtgagcacgcttaccgcgttgcacagtctagaacagacttctccaggcctgaaccagcagccccagaatctgatcatggcatctctccctggtgtcatgaccatcgggcccggggagcccgccagtctgggacccacattcaccaacacaggcgcatcaaccttgccactctttggagccggtgttgccgagcttacccggcagcaaggtcccagcagttag

SEQ ID NO: 120060 - DNA, 1071 bp, Artificial Sequence
  Description of Artificial Sequence: Synthetic coding sequence
taatggctggtaggattctggggaggcagcggctgcaaggagtttggcctgtgcctacccgcgggccgccagacacagccaacaaggtggggcagacgcctggcgtggtggactagggccgcctggccatgcgggtcacgcgcgatggtgtccaagttgtctcagttgcagacagagcttttggcagcgctcctggagtccggtctgtcaaaggaggctctgatccaagcccttggcgaaccggggccctatctgcttgccggggagggtcccctcgacaagggggagagttgcggaggaggtagaggagagctggccgaattgcccaatggcctgggagagacaaggggatcggaggacgagaccgatgatgatggagaagattttacaccaccgatactgaaagaactcgaaaacttaagccccgaagaagctgcacaccagaaggcagttgttgaaaccctgctacaggaagatccttggcgcgtagcaaaaatggtgaagagctacttgcagcagcacaacatcccccagcgagaagtggttgacacaaccggacttaaccaatctcacctgagtcagcacctgaacaagggcacccctatgaagacccaaaaaagagccgccctgtacacttggtacgttagaaaacagagagaagtcgctcagcagttcactcatgctgggcagggggggctgatagaagagcccactggagacgagttacctaccaaaaaggggcgaaggaataggtttaaatggggacctgcaagtcagcaaatcctctttcaggcatatgaacgccagaagaatccaagtaaagaggagcgggaaaccctagtagaggaatgcaaccgtgctgaatgcattcaaaggggggtctccccctctcaaccccagccagcagaatatcggtcccaggccgggctgagttcctggggacccccaccaccttgccagcatccggattcaaccgcacagctcggagccgacattcctaggccacaaccagctgctcctgagccacaccatggactgacatcctggggacacgatcatcgcgcctggtag

SEQ ID NO: 120061 - DNA, 2247 bp, Artificial Sequence
  Description of Artificial Sequence: Synthetic coding sequence
atgctgggcacgctgagagcaatggagggagaagatgtggaggacgatcagctcttgcagaagttgcgcgcaagccgcaggcgatttcagaggcggatgcagcgccttatcgagaagtacaaccagccttttgaggatactccggtggtgcagatggctactttgacctacgaaacaccccagggcctgcgcatctggggaggtcggctcataaaggaacgcaatgagggggagattcaagactcgtccatgaaaccagctgacagaactgacggttctgtgcaggccgccgcgtgggggccagaactgccttctcataggaccgtccttggcgcagacagcaagtctggcgaggtggacgcaacatcagatcaggaagagtctgttgcatgggccctggcgcccgctgtgcctcagtcacccctgaagaacgagctgcgacgcaagtatctgacccaggtagatatactgcttcagggcgccgagtacttcgagtgtgctgggaaccgcgcagggcgggacgttcgcgtcacacctctgccttctctggcatcgccagccgtgccggcccctgggtattgctccagaatttctcgaaaaagtcctggggaccccgccaagcccgcatcatcccctcgcgaatgggatcccttgcacccttccagcactgacatggccctcgtaccgaggaatgactctttgtcactgcaggaaacctccagcagctccttcctttccagccagcccttcgaggatgatgacatctgcaacgtgaccatttctgacctgtacgctggcatgctacactcgatgtcgcgtctgcttagcactaagccttcctcaattatttcaacgaaaactttcatcatgcagaattggaattcacggcgacgccaccgttacaagtccagaatgaacaagacatattgcaagggcgctcgccgctcgcaaaggagttccaaggagaacttcatcccttgcagcgagcctgtcaagggcacaggcgctctccgtgattgcaagaatgtattagatgtttcatgtagaaaaacaggcctgaaactggaaaaggcctttctggaggtcaacaggccacagatccataaactggacccaagttggaaagagcggaaagtgaccccctctaaatactccagcttaatttatttcgattcttccgccacttataatctggatgaggaaaaccgattccggactctcaagtggcttatctctccagttaaaatcgtctctcgcccaacgattcggcagggacacggggaaaatagacaacgggagatagaaattcgctttgaccagcttcaccgtgagtactgcctgagcccccggaatcagccccgcagaatgtgcctgcccgactcatgggcaatgaatatgtaccggggggggcccgccagccctggtgggttgcagggactcgaaacacgccgcttgagtctgcccagcagtaaggccaaggcaaagtcactgagcgaggcctttgaaaacctcggaaaacgctccctagaggctggcaggtgcctgcctaagtcagactcatcatcctctctcccgaagacaaaccctacacacagtgcaacccgaccgcagcagacatcagatttacatgttcagggaaactcatctggaattttccgaaagagcgtcagccctagtaagaccttgagcgtgccggacaaggaggttcccggccacggtagaaatcggtacgatgagatcaaagaggagttcgataagctgcatcagaagtattgcctgaaaagccccggccaaatgacagtgccattatgcatcggtgtatccacagataaagctagcatggaagtccgataccagacagaaggatttctcgggaaactcaatccagatccacactttcaggggtttcaaaagcttccttctagtcccctgggctgcagaaaatctctcctcgggagcaccgcaatcgaggctccttccagtacttgcgttgctcgcgctattactagagatggaacacgtgatcatcagtttcctgccaagcgaccgcgattaagtgaaccccaggggtccgggagacaggggaacagcctcggagcctctgatggggtagataacacagtgcgccctggggatcagggctcgtcctcccagccaaactcagaggagcgcggggaaaataccagttaccgcatggaggaaaagtccgacttcatgctggaaaagctcgaaactaagtctgtgtag

SEQ ID NO: 120062 - DNA, 2085 bp, Artificial Sequence
  Description of Artificial Sequence: Synthetic coding sequence
atgcttgggacacttcgcgcaatggaaggggaggatgttgaggacgaccagcttttgcagaagctcagggcaagcaggcggaggttccaacgccgcatgcagcgtctgatagagaaatataatcagccttttgaagacaccccggtagtacagatggcgacactgacttacgagacacctcagggacttagaatttggggcggtaggctgattaaggagcgtaatgaaggagaaattcaacctgctgtgccacagtcacctctaaaaaacgagctgcggcgcaagtacctgactcaagtggacattttgctgcagggagccgagtacttcgaatgtgccggcaaccgtgctgggcgcgacgtcagggtgactcccctgccaagcctggcaagtcctgctgtgcccgctcctggatattgtagccgtatatctagaaagagccctggtgatcctgccaaaccagcctcctcgcctagagagtgggatcctctgcacccaagtagcaccgatatggcgctggtgccccggaatgattccctttcattacaggaaacatcatccagcagttttctttcctctcagccttttgaggatgacgacatttgcaatgtgaccatctccgatctgtacgccgggatgctgcattccatgtcacggttgttgtctaccaagccgagttccatcatcagcacaaagacattcattatgcagaattggaacagtaggcgccggcataggtataagagcagaatgaataaaacatattgtaaaggggccaggcgctctcagagaagctctaaagagaacttcattccttgcagcgaacccgtgaagggcaccggcgcccttcgggactgcaaaaatgtgttggacgtcagttgtaggaaaactggcctgaagttagagaaagcttttctggaggtgaaccgaccccagatacacaaattagacccatcctggaaagagcggaaagtcacgccgtctaaatacagttctctgatatactttgacagctctgcaacctacaacctcgatgaagagaatcgatttcgcacactcaaatggttgatcagccctgttaaaatagtgtccaggccgacaattaggcaggggcatggagaaaaccggcagcgggagatagagataagatttgaccagctgcaccgagaatactgtctttcccctcggaatcaacctcgtagaatgtgtctacctgattcatgggccatgaacatgtatagagggggtcctgcgagccccggcgggctgcaggggctggaaacgcgccggttaagtctgccaagctccaaagctaaggccaaaagcttgagtgaggcatttgaaaaccttggcaaaaggagcctggaggccggtagatgcctgcctaagtcggattcttccagctctttgcccaaaactaaccccacacattctgcaacaaggccccaacaaacttccgatctccatgtccaaggaaatagtagcggcatctttagaaaatcagtgagcccgagtaagaccctatccgtgcctgacaaggaagtgcccggccatggacgcaaccgctatgatgaaatcaaggaagagtttgacaagcttcaccagaagtattgcctcaaaagtccaggccagatgactgtgccgctgtgcattggagttagcactgacaaggcatccatggaagtacggtaccaaaccgaggggttcctgggcaaactgaatcctgatccccacttccaggggtttcaaaagctcccaagttccccgttgggatgtcggaaaagtttgctgggatcaaccgccatcgaggctccaagctcaacatgtgtggccagagccattacaagagatggcaccagggaccatcagttcccggcgaaacgcccgcgcctctctgagcctcagggctcagggcggcagggtaacagtctgggagccagtgacggagtggataatacagtccggcctggggaccaaggatcaagcagccagcccaactcggaggaaaggggcgagaatacctcataccgaatggaagagaaatcagattttatgctagaaaagttagagaccaaaagcgtgtag

SEQ ID NO: 120063 - DNA, 1992 bp, Artificial Sequence
  Description of Artificial Sequence: Synthetic coding sequence
atgctggggaccttacgcgccatggagggagaagacgtggaggatgaccagttgctgcagaagctacgtgcttctcgacggcgctttcagcggcgcatgcagcgtcttatcgagaagtataaccaaccctttgaggacacacctgtggttcagatggccaccttgacgtatgagaccccacagggcctccggatatggggcggcaggctaatcaaagagcgaaatgagggtgagatccagtgtgcagggaatagagctggcagagatgtacgcgttacccccctgccatcattggcctcaccagcagtgcctgctcccgggtactgttcaaggatcagccgaaagagccccggtgatcctgctaaacccgcgagctcccctcgcgagtgggacccactgcatcccagcagcaccgacatggccttggtgccaaggaatgacagcctgtctctccaggagaccagttcgtcctcattcctgagttcccagccctttgaagacgacgacatctgtaacgtcactatcagtgatctctatgccgggatgctccactccatgagccggctactttctactaagccatctagcattatcagtacaaaaacgttcataatgcagaattggaatagtagacggaggcatcggtataagagcaggatgaataaaacgtattgtaagggggcccgacgcagccaacgtagcagcaaggaaaatttcatcccttgtagtgaaccagtgaagggaaccggcgccctgagggattgtaagaacgtcttggacgtgtcatgcaggaagactggactcaagctcgaaaaggcctttctggaagtaaaccggccacagatccacaagctggacccttcatggaaggaacgtaaagtcaccccctctaagtattccagccttatttatttcgatagcagtgccacttataatctggatgaggagaaccgcttccgcacacttaagtggctgatttcccccgtcaagatcgtcagtcgaccaaccattaggcagggacacggagagaaccgccagcgggagatcgagattaggttcgaccagctgcaccgggagtattgtctatcgccccgcaatcagcctagacgaatgtgtttacccgactcttgggcaatgaacatgtacagaggggggcccgcaagccccggcggattgcagggcttagagacgagacggctctccctgccatcctctaaagcaaaggctaagagtctgagcgaggcatttgaaaacctcgggaagagaagtctggaagccggacgatgcttgcccaaatccgatagtagttcctccctgcctaagacgaatcccacacacagcgccaccaggccccagcaaacctcggacttgcatgtgcagggcaatagctccggaatattccgaaaaagcgtgtctccatccaagaccctgtcggtccctgacaaggaggtcccaggacacgggagaaacaggtatgacgagattaaggaggaatttgataaactgcaccagaaatactgcttaaagtcccccggtcagatgaccgtgccactgtgcataggggtgagtaccgacaaggcctctatggaagtacgataccaaaccgaaggatttctggggaaattgaaccccgacccacactttcagggctttcagaagttgccaagctctcccctgggttgccggaaatctctcctgggaagcacagcaattgaggctccctcctctacctgtgtggcccgcgccatcaccagagacggaacgagagaccaccaattcccagcgaagcgcccccgtctgtctgagccccaaggcagcggtcgacaaggcaattctctcggagcaagcgacggcgttgataacacagtacgccctggggatcaggggtccagttcccagcccaatagtgaggagaggggggaaaatactagctatcggatggaggaaaaatctgacttcatgttggagaagctcgagacgaaatccgtatag

SEQ ID NO: 120064 - DNA, 2181 bp, Artificial Sequence
  Description of Artificial Sequence: Synthetic coding sequence
atggaggataggctgcatatggacaatggcctggtcccacaaaaaatcgtatcagtccacctccaggactcaacactgaaggaagttaaagatcaggtgagtaacaagcaggctcaaattctggaacctaagcccgagccaagccttgagatcaagccagagcaggacggcatggagcacgtgggcagagacgatcctaaagccctaggggaggagccaaagcaacgacggggcagtgcatcgggatctgaaccagcaggtgatagcgaccgtggaggggggccagtagaacactaccaccttcacctgagtagctgtcacgagtgcttggagctcgagaattcaaccattgaaagtgtgaaattcgcctctgccgagaacattcctgatttaccctacgactactcatcatcccttgagtccgtcgccgacgagacatctccggaacgtgagggtagacgcgtgaatctaaccgggaaggcccccaatattctgctgtatgtgggcagcgattcccaggaggcacttggaaggttccatgaggttcggtctgtcctagccgactgcgtggacattgacagttacatcttgtatcacctccttgaggactctgcactacgcgacccttggaccgacaactgcctgttgctagtgattgccactcgagagtccataccagaggacctgtatcaaaaattcatggcctatctgtctcaggggggtaaggtcctgggcctatcatccagcttcacttttgggggcttccaggttactagcaaaggtgctttacacaagacagtgcaaaatcttgtgttcagcaaagcagaccagagcgaagtcaaattgtccgtgttaagtagtggctgcagataccaagagggtccggtgcgtctgagcccgggtaggcttcaaggacacttagaaaacgaagacaaggatcgtatgatcgtccatgtgccttttggaacaagagggggggaggccgtgctatgccaggtgcacctagaactccctccatcttccaatatcgtacagacgcccgaagactttaacctcttaaagagctcaaactttcgtcggtatgaggtgctgcgtgagatccttaccacgttgggtctcagctgtgatatgaaacaggtccctgcccttacacccctctacctcctcagcgctgctgaggaaattagggatcctctgatgcagtggttagggaaacacgttgactccgaaggcgaaatcaagtctggccaactctctttgcggtttgttagcagttacgttagcgaggtagaaatcaccccttcttgcatacccgtagtcaccaacatggaggctttcagctcagaacatttcaacttggaaatctacagacagaacctgcaaaccaaacagcttggcaaagtgattctctttgcagaagtgacacccacaactatgcggctgctcgacggcctgatgtttcagacgccgcaagagatgggcctaatcgtcattgctgctcgtcaaacggaggggaaaggccggggaggcaatgtgtggctgtctccggtggggtgtgctctgtctacgctgctcatatccataccccttcgctctcagctaggtcagagaatcccattcgtgcaacacctcatgagcgtggcggtagtcgaggctgtcagatccattcctgagtaccaggatatcaatttacgcgtcaagtggcccaacgacatatattatagtgacctgatgaagataggtggcgtactggttaattctacactgatgggcgaaaccttttacatcctgatcggctgcggcttcaacgttactaacagcaaccctactatttgcatcaacgatttaatcactgaatataacaagcaacacaaggccgagctgaagcctctcagagccgactacctcattgcgcgcgttgtcacagttttggagaaacttattaaggagttccaagacaagggacctaattctgttttacctctttactaccggtactgggtccacagcggtcaacaggtgcaccttggctcggctgaagggcccaaggtgtctattgtgggactagatgactctggcttcctgcaggtacatcaggagggaggggaagtggtgacagtgcaccctgacggcaacagtttcgatatgctgcgcaatctgatccttccaaagcgccgctag

SEQ ID NO: 120065 - DNA, 2181 bp, Artificial Sequence
  Description of Artificial Sequence: Synthetic coding sequence
atggaggatcgactgcatatggacaacggattggtgccgcagaaaatagtgtctgtgcatcttcaagacagtacactcaaggaggtcaaagaccaggtcagcaacaagcaagcccagattctggagccaaaacctgagccgtctctggagattaagcccgagcaagacgggatggaacatgtgggcagagacgatcccaaggcactcggggaagaaccaaagcagcggcgcggctcagcttcagggagtgaacccgcgggtgacagcgatcgaggtggcggccccgtagaacattaccatctgcatctctccagttgtcatgaatgcttggagttggaaaattctacaatcgagagcgtgaaatttgctagtgctgaaaatataccagatctaccatatgattattcttctagcttagaatcggtggctgacgagacttcacctgagcgtgaaggcaggagggtgaacctgaccgggaaggcgccaaatattttgctgtacgtgggatctgattcacaggaagctctggggagattccacgaggtgcggtccgtcctcgctgactgtgtcgatatagacagctacattctttatcacctgttagaagacagtgccctgcgggatccctggacggataactgtctcctgctagtgatcgccacacgagagtccatccctgaagatctctaccagaagttcatggcttacctgtcacagggaggaaaagtacttggcctgtcttcatcattcacgttcggtggcttccaggtgacctccaaaggcgctctccacaaaacagtgcagaacctggtgttctcaaaggctgatcaaagtgaagtgaaattgtccgtgttaagtagcggttgccgctaccaggaagggcccgtgcgcctatcacccgggaggcttcagggccatctggagaacgaggacaaagaccggatgattgtacatgtcccgtttggtactcgaggcggggaggcagtcctgtgtcaggtccacctggagctgcctccatcgtctaatatcgtccagacccctgaggatttcaatctcctgaagagctcaaatttccgccggtatgaagtgcttagagagatcttaactacattaggcctttcatgcgacatgaaacaggtcccggccttaacaccgctgtatctcctgtctgcggccgaggagatccgagatcccctaatgcagtggcttggaaagcatgtggattccgaaggtgaaataaagtctggtcaactgagtctccgtttcgtctccagctacgtgtccgaagtcgaaattacccccagctgtatacctgtcgtgactaatatggaggctttctcttcagaacacttcaatttagaaatctatcgccagaacctgcaaactaagcagctcggcaaggtcatactgtttgcggaagtcacacctactacgatgagacttttagacgggctgatgttccaaactccgcaagagatgggacttattgtgattgccgcacggcagacagaaggaaagggccgcggtggcaacgtctggttaagccccgtcggatgtgccctgtcaaccttgcttatctccatcccgctacggtctcagctcgggcagaggattcctttcgtgcagcaccttatgtccgttgcagtggtggaagcggtgcgttctatcccagagtaccaggacataaacctgagagtaaaatggcctaatgacatttattactctgacttgatgaagatcggaggcgtgctggtaaattccacactcatgggagaaactttttatattctgatcggctgtgggttcaacgtaactaattccaacccaactatctgcatcaatgacctgatcaccgagtacaacaagcagcataaggcagagctaaagccactccgggctgactacctgatcgctcgcgtggtaaccgtgctggaaaaacttatcaaggaattccaggacaaaggacctaacagtgttctgcccctctactaccgctattgggtgcacagtggtcagcaggtgcacctgggttctgctgaagggccgaaggtttccatagtgggcctggatgattcaggctttttgcaggttcaccaagaaggtggcgaggtagtcacagtgcatcctgacggtaactcctttgacatgctgcgcaacctgatcttgccaaagaggaggtag

SEQ ID NO: 120066 - DNA, 264 bp, Artificial Sequence
  Description of Artificial Sequence: Synthetic coding sequence
atggaggatcggctgcacatggacaacggcctcgtgccccagaagattgtttcggttcatttgcaagactcaacgcttaaggaggtgaaggaccaggtgtccaataaacaggcccagatcttagagccgaagcccgagccttctttagaaattaagccagagcaagacggaatggagcatgtggggcgcgatgatcctaaggctcttggcgaggagcctaagcagaggaggggtagcgcgtccgggtctgagcccgccggttag

SEQ ID NO: 120067 - DNA, 234 bp, Artificial Sequence
  Description of Artificial Sequence: Synthetic coding sequence
atggaggatcgtttacatatggataatggcttggttccacaaaaaatcgtgagcgtccacctccaggatagtacactcaaggaagtgaaggaccaagtgagcaacaaacaggcacagattctggaaccgaagcccgagccttctctcgagatcaaaccagagcaagacggaatggagcatgtgggtagggatgacccgaaggcactgggcgaggagcccaaacaaaggagatag

SEQ ID NO: 120068 - DNA, 279 bp, Artificial Sequence
  Description of Artificial Sequence: Synthetic coding sequence
atggaggataggctgcatatggataacggcctagtacctcagaagattgtatccgtgcatctgcaggacagcactctcaaggaggttaaggatcaggtctcaaataaacaggcccagattcttgagcccaagccagaacctagcctcgagattaagcctgagcaggatggtatggaacatgtgggcagggacgatccaaaagccctgggcgaagaaccaaagcaacgtcgggggtctgcttcaggatccgagcctgccggcgattctgatcgcggctag

SEQ ID NO: 120069 - DNA, 807 bp, Artificial Sequence
  Description of Artificial Sequence: Synthetic coding sequence
atgggcctgtcaccctcagctcccgccgtagccgtgcaggcatcaaacgcatccgccagtccccctagcggatgccctatgcatgagggaaaaatgaagggatgccctgttaatactgaaccctccggcccgacttgtgaaaagaaaacatattccgtccctgcccaccaagagagagcttacgaatacgtggaatgcccaattcgtggcaccgcagcagaaaataaggaaaatcttgacccaagcaatctcatgcctcccccaaatcagacacccgctcccgatcaacccttcgccttgtctaccgtgcgggaggaaagctctattccccgcgccgactccgaaaaaaagtgggtctacccatctgagcagatgttctggaacgctatgctgaagaagggctggaagtggaaagacgaggatatctcccagaaagacatgtacaacatcattcggatccacaatcaaaataacgaacaggcatggaaggagattttgaagtgggaggctctccacgcagcagaatgtccttgcggcccgtctcttatcagatttggtggtaaagctaaagaatattcgccacgcgcacgtattagaagttggatggggtatgagttacccttcgatcgacacgattggattattaaccgatgcggcacagaggtgagatacgtgatcgattactacgacggcggcgaagtgaacaaggattaccaatttaccatcctggacgtcaggccggccctggatagtctttctgcagtgtgggaccggatgaaggtggcttggtggcggtggaccagctag

SEQ ID NO: 120070 - DNA, 807 bp, Artificial Sequence
  Description of Artificial Sequence: Synthetic coding sequence
atgggactgtctccctctgcacccgcggttgcagtgcaagcctccaacgcgtccgccagcccacccagtggttgtccaatgcacgaaggcaagatgaaaggatgcccagtaaacacagagccttctggacctacatgcgagaagaagacctactcagtgccggcccaccaggaacgtgcctacgagtacgtggaatgtcctatcaggggcacggcagcggagaataaggagaatttggatccatccaacttgatgcccccccctaatcagacacccgctcctgatcagccctttgcactctccacggtgagggaagagtcaagcattccaagggccgattctgagaagaaatgggtttacccatcggagcagatgttttggaacgccatgcttaaaaagggctggaagtggaaggacgaggacatcagtcagaaggacatgtacaatattattcgaatccataatcaaaacaatgaacaggcctggaaggagatcctgaaatgggaggctcttcacgccgcagagtgtccatgtggcccgagcctgatacgcttcggcggcaaggctaaggagtactctccaagggctcggattcgtagctggatgggctacgagctccccttcgaccgccacgattggatcattaacaggtgcggcacggaagtgcggtacgtgattgactactatgacggaggagaggtcaataaggactatcagtttaccatcctggatgtgaggcctgcactggactccctgtcagccgtgtgggaccgaatgaaggtggcctggtggaggtggacctcttag

SEQ ID NO: 120071 - DNA, 807 bp, Artificial Sequence
  Description of Artificial Sequence: Synthetic coding sequence
atgggactctctccctctgcgccagctgtcgccgtgcaggcaagcaacgcttccgcctcgcccccaagcggttgtcccatgcatgaggggaagatgaaggggtgccctgttaatacagaaccttctggcccgacctgtgagaaaaagacctactcagtgccagctcatcaggaacgggcctacgagtatgttgagtgcccgatacgagggacagcagctgagaacaaggaaaatcttgatccatccaaccttatgccccctccgaaccagacgcccgcccctgaccagcctttcgcactgtccaccgtccgggaggaatcaagcatcccacgggcagatagcgaaaaaaaatgggtgtacccctcagaacagatgttctggaatgcaatgctcaagaaaggctggaaatggaaggacgaggacatctcccaaaaagatatgtataacattatccgaatacacaaccagaataatgaacaggcttggaaagagattctgaaatgggaggcattacacgccgctgagtgcccttgtgggccttctctgattcgattcggcggaaaggctaaggagtactcacccagagctcggattaggagctggatgggctacgagttaccatttgatagacatgattggattataaataggtgcggtaccgaggtacgctatgtaattgattactatgacggcggggaagttaacaaagactaccagttcaccatcctagacgtgcggcccgctttggacagcctgtccgctgtttgggaccgtatgaaggtggcttggtggcgatggacaagttag

SEQ ID NO: 120072 - DNA, 1008 bp, Artificial Sequence
  Description of Artificial Sequence: Synthetic coding sequence
atggataatgcacggatgaactcgtttctggaatatccaatcctctcttctggcgacagcggaacttgctctgcacgggcgtatccatcagatcacaggattactacatttcagtcttgtgccgtaagcgcaaactcttgcggtggggacgatcggtttctcgtgggcagaggcgtccagatcggatccccgcatcaccaccaccatcatcatcacagacatcctcagccggcaacatatcagacttccggcaacctcggtgtgtcctactcccatagcagttgtgggccatcctacgggagccagaatttttctgccccttacagtccatacgctctgaatcaagaagctgatgtgtcaggagggtacccacagtgtgcgcccgctgtgtactctggtaacctctcctctcccatggtccaacaccaccatcatcaccaaggatatgcaggcggggctgttggctctccacagtacatacaccactcttacggacaagagcaccaaagcttggccctagcgacttacaacaactcactgtcgccgctacatgctagtcaccaggaagcctgccggtctccggcctccgagaccagcagccctgcacagacatttgactggatgaaagttaagcgaaatccacccaagaccggcaaagtgggagagtatggttatctgggccagccaaatgctgtccggaccaatttcacaaccaaacagttgaccgagctggaaaaggagttccacttcaataaatatctaacccgggcacgccgggtggagatcgccgcctctctccagcttaacgaaacacaggtcaaaatctggttccagaaccgacgaatgaaacagaagaaacgcgaaaaggaagggctgttgcccatcagccctgcaacaccaccgggaaacgatgaaaaggctgaagaaagctctgaaaagagctcatcctccccctgtgtgccgagcccagggtcatctaccagcgatacgcttactacaagccactag

SEQ ID NO: 120073 - DNA, 414 bp, Artificial Sequence
  Description of Artificial Sequence: Synthetic coding sequence
atggataatgctaggatgaactcttttctagagtatccgatactcagttcgggcgactctggcacatgtagcgctagggcctatccttcagatcatcgcatcacaactttccagtcctgcgcagtgtcagcaaattcatgtgggggggatgataggttcctggtgggacgcggagtacagatcggaagcccccaccatcatcatcaccatcatcaccgccacccgcaaccggcgacctatcagacctcgggcaacctgggagtttcctactcccactcaagttgtgggccctcctacgggtcccagaacttttccgccccatacagcccctacgccctgaaccaggaggccgatccacccaggtcattgtctctaccacgcattggggatatattctcatccgcagacttctag

SEQ ID NO: 120074 - DNA, 1233 bp, Artificial Sequence
  Description of Artificial Sequence: Synthetic coding sequence
atgagtgctcggaaaggctacctgctccctagtcctaactatcccactacaatgtcatgtagcgagtcccctgcggctaactctttccttgtagattctctgattagcagcggacggggggaagctggtggggggggtggcggggcaggaggcggtggtggcggtggatattatgcacacggaggcgtatatctcccaccggcagccgacctcccttatggtttacaatcatgcggactatttcccactctcggaggcaaacggaatgaggccgcttcacctggcagcggcggtggcggtgggggcctggggcccggtgcccatggctatggtccaagtccaatagatctgtggcttgacgccccaaggagttgtcggatggagccacccgacgggccacctccacccccgcaacaacaaccacccccaccccctcagcccccacaacccgctcctcaggccactagttgctccttcgcccagaacatcaaggaagaatcatcctattgtttgtatgactcggccgataagtgcccaaaggtttcagccacagctgccgagttagcaccatttcctcggggtccaccacctgatggctgtgcgctaggcacatctagtggtgtgcccgtgcccggatatttccgactctctcaagcgtatggaaccgctaaaggctatggatccgggggagggggcgcgcagcaattgggagctgggcccttccccgctcaacctcctggccgtggtttcgacctcccacctgcccttgcttccggcagtgctgacgctgctcgcaaggagcgagcacttgactcccccccccctccaactttagcctgcggtagcggtggaggtagccagggggacgaggaggctcatgccagctctagcgcggctgaggaactctcccctgccccatccgagtcttccaaggccagccccgaaaaggattccctgggcaacagtaagggggagaacgcagccaactggctaacggcaaagtcgggcaggaaaaagcggtgtccttacacaaagcaccagactcttgagctggagaaagagtttctgtttaacatgtacttgaccagagagagacgactcgagatttccagatctgtacacctgacagatcggcaggtgaagatctggttccaaaatcgccgtatgaaactcaagaaaatgaatagggaaaatcgcattagagagctgaccgcaaattttaacttcagctag

SEQ ID NO: 120075 - DNA, 609 bp, Artificial Sequence
  Description of Artificial Sequence: Synthetic coding sequence
atgtcgtgcagcgagagcccggccgctaatagctttctggtggactcccttattagctctgggcggggggaagcaggagggggaggcggtggagcagggggggggggcgggggagggtactacgcacatggaggggtttacctgcctccagccgcagatctgccgtacggtctgcagtcatgcggccttttccccactctcggtggcaaacggaatgaggcggccagtcctggaagcggcgggggtggaggaggcctcgggccgggtgctcacggctacggacctagcccgatagatctgtggctggatgccccacgatcatgtagacgacgcgccgcaacgagaggttggcccgtgcctagggctgctcccggagcaagatttaggagcccagccagggccagcttaagacttgggcgctgtggccccgagggggcatcgccaaggttcgccgcggccccacacgccgggctccggcaacgccgtggcctagcaggcagaaggggcggcgccagagtcgtgttgggaagagggggggccttgcctggcccatttagagagcaacagagccttgccggagagggtttcccaggccagtttcagcgatag

SEQ ID NO: 120076 - DNA, 285 bp, Artificial Sequence
  Description of Artificial Sequence: Synthetic coding sequence
atgtgccaggggaatagcaaaggcgaaaatgcggccaactggctgaccgccaaatcagggcgtaagaagcgttgcccctacacaaagcatcagacactggagctcgagaaggagtttttgtttaatatgtacttaacgcgcgagcgccgtctcgagatctcaagaagcgtgcatctgactgacagacaggtcaaaatctggttccaaaaccgaaggatgaaactgaaaaagatgaaccgtgagaataggatcagggagctgaccgccaatttcaactttagttag

SEQ ID NO: 120077 - DNA, 942 bp, Artificial Sequence
  Description of Artificial Sequence: Synthetic coding sequence
atggacttcgacgaacgcggaccttgttcttccaatatgtaccttccatcctgcacctactatgtgtctggacccgatttttccagcctgccatcatttcttccccagaccccaagtagtcgccctatgacctatagctactcaagcaatctcccccaagtgcaaccagtgcgggaggttacttttagggaatatgccatcgagcccgccaccaagtggcatcctcgggggaatttagcgcactgttattccgcggaagagctggtgcatagggattgtcttcaagccccaagcgctgcgggtgttccaggtgatgttttagcaaagagcagcgcaaatgtgtaccaccatccaaccccagcagtgtcttctaacttctacagcacagtcgggagaaacggtgtgctgcctcaggcttttgaccagtttttcgaaacagcctatggtactccagaaaatttggcgtcctcagactatcctggggacaaatcagccgagaagggccctcctgccgccactgctacatcagcagcagccgctgccgctgcaaccggggccccggccacctcatccagcgactcaggaggcggggggggctgtagagaaacagcagctgctgccgaagaaaaggagcggcggcggagacccgagagcagttcatcacctgaatcttcatcaggtcacactgaggacaaggccggaggttcaagcgggcagaggactcggaagaaacgctgcccttacacgaagtatcagattcgagaactggagcgggaattctttttctcagtatatatcaataaggaaaagagactgcagctgagcaggatgcttaaccttacagatagacaagtgaagatttggttccagaatcggaggatgaaggagaaaaagatcaaccgggaccggctacagtattactcagccaatccactgctgtag

SEQ ID NO: 120078 - DNA, 918 bp, Artificial Sequence
  Description of Artificial Sequence: Synthetic coding sequence
atggctcgtgaagattctgtgaagtgcttgcggtgccttttatacgccctcaacttactcttttggctgatgtccattagtgttctggctgttagcgcatggatgagggactatctgaataatgtcctgaccttgacagctgaaacaagggtagaggaagcagtgatactgacttattttccagtggtgcatccagtgatgattgcagtttgttgtttcctgatcattgtgggcatgctgggttattgcggaaccgtgaaaaggaacttgttattgctcgcctggtacttcggttctctgttagtcatcttttgcgtcgagctggcatgtggggtgtggacatacgagcaggagctcatggttccagtacaatggtctgatatggtgactctgaaggcgcgcatgaccaactatggcctgcctaggtatcgatggctgacacatgcttggaattttttccagagagagttcaagtgctgtggggtcgtgtacttcaccgactggctcgagatgacagagatggactggcctcctgactcatgctgcgtgcgggaattccctggatgttctaagcaagctcatcaggaagacctctcagatctttatcaagaaggttgtgggaagaagatgtacagcttcctgcgcggcacgaagcagctgcaggtgcttcggtttctaggcattagcattggagtgacgcaaattctggctatgatcctcaccattacactcctctgggccttatactacgaccgcagagagcctggcactgaccagatgatgtctctcaagaatgataacagtcagcacctgtcatgcccctctgtcgaacttctgaaaccttctctgtcaagaatcttcgaacatacctctatggccaattcctttaacactcattttgagatggaggaactgtag

SEQ ID NO: 120079 - DNA, 489 bp, Artificial Sequence
  Description of Artificial Sequence: Synthetic coding sequence
atgggactggagacggaaaaggctgatgttcagctatttatggacgacgattcttactctcatcactcgggattagaatatgcagatcccgagaaattcgccgattcagaccaggaccgggatccacataggctcaacagtcatctaaagctgggatttgaagacgtgatcgccgaacccgtgacaactcactctttcgacaaagtgtggatctgttcgcatgcactctttgagattagtaagtacgtgatgtataagtttctgactgtgtttttagccatacccttggcattcattgccggaattctattcgcaaccctctcatgcctgcatatatggatcctaatgccattcgtcaagacatgccttatggtgttgccatctgtgcagactatttggaaatccgtcactgatgtaataatagctcccttgtgcacatccgtggggcgatgcttctcttccgtgtcacttcagttgagccaggactag

SEQ ID NO: 120080 - DNA, 963 bp, Artificial Sequence
  Description of Artificial Sequence: Synthetic coding sequence
atgaccatgtcttcatttttaatcaatagcaactatatcgaacccaaatttccacctttcgaggaatatgcacaacacagcggtagcggcggggccgatgggggccccggagggggtccgggctaccagcaaccccccgccccacccactcagcacctgcctctgcagcaaccacagcttccgcacgccggtggtggacgggagcctaccgcttcctactacgccccccgcaccgctcgggaacctgcataccccgccgccgctctctatcctgcccatggagctgccgatacggcctatccctacggatacaggggcggagcctcgcctgggcggcccccccaaccggagcaacccccagcccaggccaaaggccccgcccatggcttgcacgcctcacatgtgctccagccacagcttccacctccgctccaaccacgcgccgttccacccgccgctcctcgacggtgcgaagccgcacccgctacaccaggagttccggctggggggtctgcacccgcatgtcccctattactcgctgataagtcacctctagggttgaagggtaaagaacctgttgtttatccatggatgaagaagattcacgtatctgccgtcaaccctagttacaatggcggcgagcctaaacgtagtagaactgcttacaccaggcagcaggtgctcgaacttgaaaaagagttccattttaacagatatcttacgcggcgtcgtcgcatcgagatagcacacaccctgtgcttatctgagcgacaagtgaaaatttggtttcagaacaggcggatgaaatggaagaaagaccataagctacccaataccaagatgagaagcagcaactccgccagtgcttccgctggcccacctgggaaagcccagacacagtcccctcatctgcaccctcacccccatccctcgacatcaacacctgtgccctcttctatctag

SEQ ID NO: 120081 - DNA, 963 bp, Artificial Sequence
  Description of Artificial Sequence: Synthetic coding sequence
atgactatgtcttcattcctcatcaattccaattacatagagccgaagtttcccccattcgaagagtatgcccagcactcgggcagtggaggtgctgacggagggccaggtggcgggccagggtaccagcaaccacctgcaccaccaacgcagcacctgcccctccagcagccacagttacctcatgcaggtggcggtcgcgaacctacagctagctactacgcgccaaggactgctcgcgagccagcctatcccgccgcagcactctaccccgcccacggcgcagctgatactgcttacccctatggatatcgtggaggagcttcaccaggaagacctcctcagcccgagcaacctccggcacaagccaagggtcccgctcacggcctgcacgcttctcatgttctgcagccccaattacccccacctctgcaacctcgcgcggtgccaccagccgccccccggcggtgcgaggctgcacccgctactcccggggtgccagccggggggtccgctccagcatgccccctgttgctggcagataagtcacccctggggctgaaggggaaagagcccgtggtgtacccttggatgaagaagattcacgtgagcgccgttaacccttcatacaacgggggggagcctaaaagatcccgcacagcgtatacgcggcagcaggtgctagaactggagaaagaattccactttaaccgctatttgaccaggaggaggcgcatcgaaatcgcccacacactgtgcctgagcgagaggcaggtgaagatctggttccagaaccggcgcatgaaatggaagaaggaccataagttacccaacaccaagatgcggtctagtaatagcgcttctgccagtgccgggccacctgggaaagcccagacacagtcccctcacctccaccctcatcctcatccaagtacatctacccctgtgccaagctccatctag

SEQ ID NO: 120082 - DNA, 1140 bp, Artificial Sequence
  Description of Artificial Sequence: Synthetic coding sequence
atgcttaagcgttgcggaagacgcttgctcttagccctggccggagctctcttggcatgtctcctggtcctcactgccgatcctccacctccgcctctgcccgccgagcgggggcgaagggcattacggagcctggccggcccggcaggtgccgcccctgccccggggctgggagcagctgccgccgcacccggggctctggtgagagatgtgcattccctgtccgaatacttctcactgctcacacgcgcccgacgcgatgcaggcccacctccaggggcggccccacgcccagctgatgggcatccacgacccctggctgaacctctggcaccacgcgacgtctttatcgccgtcaagacaacaaaaaagttccaccgtgcccggcttgacctcctgctggaaacatggattagcaggcacaaagaaatgacgtttattttcaccgacggcgaggacgaggcactcgcgagacatacaggcaacgtagtgataacaaactgctctgcggcccacagcaggcaggctctgtcatgcaagatggcggtcgaatatgataggtttatcgagtccgggagaaaatggttttgtcatgtcgatgatgacaattatgtcaatctgcgcgcactgcttcgactcctggcgtcataccctcacacacgggacgtgtacgtgggaaagccttcgctggatcggcctatccaagcgatggagagagtgagcgagaacaaggtcagacctgtgcacttttggtttgcaacagggggcgccggattctgcatttcccgggggctggcactcaaaatgtccccttgggccagcgggggccactttatgaacactgccgagaggatccgattaccagatgattgcactatcgggtacattgtcgaggccctgcttggagtcccactaatcaggagcggactgtttcacagccatctagagaacctgcagcaagtgcctacctcagaattgcacgaacaggtgaccctgtcatatggtatgtttgagaacaaacgcaacgcagtgcatgttaaaggccctttctcagtggaggccgacccctccaggtttcggtccatccattgccacctctatcctgacaccccttggtgccctcggaccgccattttttag

SEQ ID NO: 120083 - DNA, 813 bp, Artificial Sequence
  Description of Artificial Sequence: Synthetic coding sequence
atgtcttcctatttcgtaaacagcttttgtggtcgctatcctaatggccctgactatcaactgcacaactacggggaccacagttctgtcagcgaacagtttcgtgattcggctagtatgcacagcggaaggtacggatatggatataatggaatggatctatcagttggtcggtcgggcagtggtcacttcggatcgggggagagggctcgatcctatgctgccagcgctagcgccgccccggccgagccccgatattcgcagccagcaacctccacccactccccacagccagaccctctaccttgttccgctgtcgcacccagtcccggaagcgattcacaccacgggggcaagaattccctgtctaactcatccggggccagtgcagacgccggcagtactcacatttcatcccgggaaggggtaggcacagcctccggagccgaggaggacgctcccgcctcttctgagcaagcatcagcgcagagcgagccatctcctgcccccccagctcaaccccagatttacccatggatgcgtaagctgcacattagccacgataatattggaggacccgagggaaagagggctcgcactgcttacacaaggtaccagaccttagaactggagaaggagtttcacttcaatagatacctgactaggcggagaagaatagagattgctcatgccttatgtctgtcagaaagacagatcaaaatctggtttcaaaaccggagaatgaagtggaaaaaggataataagttaaagagcatgagcatggcagccgctgggggggcttttcgtccctag

SEQ ID NO: 120084 - DNA, 693 bp, Artificial Sequence
  Description of Artificial Sequence: Synthetic coding sequence
atgtcttcaagctattacgtgaatgcacttttctcaaagtataccgccggagcaagtttgtttcagaatgccgaacctacctcttgcagcttcgcgcctaactcccagaggtcaggctacggcgctggtgccggtgcattcgcttctacagtcccaggcctgtataacgtgaacagccccttataccaaagcccttttgcctccggatacggtctgggggcagacgcctatggtaacctaccttgtgcttcatatgaccagaatatacccggactctgctctgatctggcaaagggggcctgcgacaaaacagacgaaggcgcccttcatggggcggctgaggcaaacttccggatttatccgtggatgcggtcaagtggcccagatcgcaaacggggcagacaaacctatactcgctaccagactctggaacttgaaaaagaatttcatttcaatcgttatcttacccgccgtcgaaggatcgagatcgctcatgctctttgcctgactgaacgccaaatcaagatctggtttcagaatagacgcatgaagtggaagaaagagcataaggatgagggacccactgcagcagctgctccagaaggggccgtcccaagtgccgctgccacagccgcagccgataaggcggatgaggaagatgacgacgaggaggaagaagacgaggaagagtag

SEQ ID NO: 120085 - DNA, 93 bp, Artificial Sequence
  Description of Artificial Sequence: Synthetic coding sequence
atgtccagctcctattacgtgaacgctctttttagcaagtatacggccggtgcgagtctctttcaaaacgctgagccaacctcatgcagctag

SEQ ID NO: 120086 - DNA, 792 bp, Artificial Sequence
  Description of Artificial Sequence: Synthetic coding sequence
caccactgggggggtaattattacgtagactcttttctgctgggcgccgatgcagcagatgaattatcagtgggcatgcgacgagggccctggccgcctagacaggccgccacgctggccgagcatcccgatttttctccttgctcctttcaatccaaggccaccgtgtttggcgcaagctggaatcccgtgcaccgagccccgaccctctaccctgtctaccaccatcatcaccatcatccctacgtacatccgcaggcccccgtcgccgccgctgcgccagacggccgatacatgcgatcttggctcgagccaacccctggcgctcttagtttcgcggggctacccagcagccggccatatggcattaagcctgaacccctgtccgcacggcgcggagactgtcctaccctggatacccatacactgagcctcaccgactatgcctgtggctccccacccgtggaccgtgaaaaacagccgtccgaaggggcgttcagcgaaaataatgccgaaaacgaaagcggaggcgacaagccacccattgaccccaacaaccccgccgccaattggctccatgctcggtccactagaaagaaaaggtgcccctataccaagcatcagacgctggagctcgagaaagagttcttattcaacatgtacctgacgcgagataggcgttacgaagtggcacgactgctcaatctaaccgagcggcaagtcaaaatttggttccagaaccgccgtatgaagatgaagaaaattaataaggaccgcgcgaaggacgaatag

SEQ ID NO: 120087 - DNA, 819 bp, Artificial Sequence
  Description of Artificial Sequence: Synthetic coding sequence
atggcgacaacaggagcgctgggtaactattatgtcgatagcttcttattaggagctgacgccgcagacgaactgagtgtcggtagatatgctcccggcactttggggcagcccccacgacaagccgccaccctggctgagcatccagatttttctccctgctcctttcagagtaaggccactgtttttggtgcatcgtggaaccccgtgcacgctgcgggtgccaatgccgttcctgctgcagtctatcaccaccaccaccaccacccctacgtgcacccccaggctcccgtagcggcagccgcgcccgacgggagatatatgcgctcgtggctggagcctacccctggagcactgagtttcgcgggattgccctcttcacgcccttacggcataaagccggaaccactctcggcacgccggggagattgtcctacacttgacacccacaccctgagtcttaccgactatgcatgtggctctcctccagtggacagagaaaagcaacccagtgagggcgccttttcagagaacaacgccgagaacgaatctggcggtgacaagcctccaattgaccccaacaaccctgctgccaactggctgcatgctcggagcacacgcaaaaaacggtgtccttacaccaaacatcagactctagagttagaaaaggagttcttgtttaatatgtacctgacccgtgataggaggtatgaagtggcccgccttctcaacctgactgagagacaagttaagatatggttccagaatcgccggatgaaaatgaagaagattaataaggacagggctaaggacgagtag

SEQ ID NO: 120088 - DNA, 591 bp, Artificial Sequence
  Description of Artificial Sequence: Synthetic coding sequence
atggcaggattctccccttggagacggagacaacgtagaagaagacggcgccgaagggcacgccagtcaagagccgcaccagaacttgtgggagacttggggtcctttctcctgctgggcagcacgtttctatctactgctcggcactgcttcattacgtcagtcgagatcgtatcccgatatctgtgtgcacggggttccggtcgtgctggccatcacggtcccggacgcgctagacccgctgttgcaacatccgccttccccgcgcaggaacctcgcgtgtttctcagatcagctctacctgccgggagactgagcccctccaccactcatttacacctggttaccgctgataaccccgccgcgaattggctccacgctcgctctactagaaaaaaaagatgcccttacactaagcaccagactttggagttggaaaaagaattcctgtttaacatgtacctgacaagagacaggcggtatgaagtagccaggctcttgaacttaaccgagcggcaggtgaaaatatggtttcagaatagaagaatgaagatgaagaagatcaacaaagatcgggctaaggacgagtag

SEQ ID NO: 120089 - DNA, 906 bp, Artificial Sequence
  Description of Artificial Sequence: Synthetic coding sequence
atggactacaacagaatgaactccttcctggaatatccgctgtgcaatagaggcccgtccgcatacagtgctcactccgccccgacgagtttccccccaagcagtgcacaggcagtagacagctatgcctctgaaggcaggtacggaggaggactgtcaagcccagccttccaacagaacagtgggtacccagcccagcaaccaccaagtaccctgggcgtccctttccctagctccgcgccatcaggatatgctccagctgcctgctccccctcgtacgggccctcccagtactaccccctcggacagagcgagggggacggcggctactttcaccccagcagctacggagcacaactgggtggcctgagtgacggatacggtgcaggcggtgccggccccggaccttatccccctcaacaccccccatacggtaatgaacaaaccgcatccttcgcccctgcttacgcggatttgctgtccgaagataaggagactccatgcccctccgaaccaaatacacccactgcacgcacttttgactggatgaaagtgaagaggaacccgcccaagaccgctaaggtgagcgagccgggcctagggagtccctccgggctcaggaccaatttcacaactcgccagttaaccgaactggaaaaggagttccacttcaataaatacctttcacgcgctcggcgggtggagatcgcggcaactcttgagctgaacgagacacaggtgaaaatatggtttcagaacagaaggatgaagcaaaaaaagcgcgaaagagaagaaggaagggttccacctgctccccccggctgtcccaaagaagctgccggggatgctagtgaccagtctacctgtacgagccccgaagcaagccctagttctgtcacttcatag

SEQ ID NO: 120090 - DNA, 855 bp, Artificial Sequence
  Description of Artificial Sequence: Synthetic coding sequence
atggaaccaggaaattatgccacacttgatggagccaaggacatcgaggggctgctaggagcaggtggaggccggaatctcgtggcccacagcccactaacctcccaccccgcagctcctaccctgatgcctgccgtgaattacgccccactcgacctccccggatcggctgagcccccaaagcagtgccacccctgtccgggagtgccacaggggacttcccctgctcccgtgccctacggctacttcggcggaggctactactcatgtcgagtctccagatccagcctgaaaccgtgcgctcaggctgccacattggctgcctaccctgctgaaacccccactgccggcgaggaatatccttcccgacctaccgaatttgcattttacccaggttacccaggcacgtatcagccgatggcttcatatcttgacgtgagtgtggtgcagacactcggtgcccccggggagccaaggcatgacagtctacttccagttgattcttaccaatcatgggccctcgccggcggctggaattcacaaatgtgctgccaaggggagcagaatccaccagggcccttctggaaagccgcctttgcagactcgagtggccaacaccctccagacgcctgtgcgtttcggaggggccgaaagaaacgcattccgtattctaagggccagctacgggaactagagcgagagtacgctgcaaacaaatttattaccaaagacaaacgtaggaagatttctgcagctacatctctgagcgaacgccagatcaccatttggttccagaaccggcgcgtgaaagagaaaaaggtcctggcaaaggtgaaaaacagcgcaaccccctag

SEQ ID NO: 120091 - DNA, 531 bp, Artificial Sequence
  Description of Artificial Sequence: Synthetic coding sequence
cctagatgtcctcccgggccaagggtgccactagacgaacgggaggagatacgccaagaaactcaacccatcagacatgtgagtttcagtggcagactgaggaggtcaggcggcgttggcagccctgccgatggtctgggacgcaggctcgtcgcagctggacaggcagcccatgggcttcaccagcacgctgcagcaggcaccggtgaatttcactttaacaaatacttatgtcgaccaagaagggttgagatagcggctcttcttgatctcaccgaacggcaggtcaaagtgtggttccagaataggagaatgaagcacaaaagacaaacgcaacacagagaacctccagacggtgaacctgcgtgccctggggccctggaagacatatgcgatcccgctgaggaaccagcagcttctccggggggccctcttgccgggggggtggggagtcttttatcacctgcaggcggcggagccggaggtcttaagcgcggaccccccgccttctcaagaagcctgcgcgggtag

SEQ ID NO: 120092 - DNA, 1071 bp, Artificial Sequence
  Description of Artificial Sequence: Synthetic coding sequence
atgaatttcgagttcgagagagagattgggtttatcaattcccagccaagcttagccgaatgcctgactagctttcccgcagtccttgagactttccagacaagttcgatcaaagaatcaactttgatcccccccccccctccatttgaacaaacctttcctagcctgcagcctggcgcatccacactgcaaagacccagaagtcagaagcgggctgaggatgggcccgcgctaccacctccgccccctcctccattgcctgcagctccccctgctccagagtttccttggatgaaggaaaaaaagagcgctaaaaaacccagtcagtccgccacttctccaagtcccgccgcctcagcagtgcccgcgagtggtgtcggaagtccggccgacggcctgggcctgcccgaagccggcgggggcggtgcaaggcgccttagaaccgcctatactaatacccagctgttggagctggagaaggaatttcatttcaacaaatatctgtgtcgtccgcgtagagttgagatagccgcacttctggacctgactgagagacaagtcaaagtgtggtttcaaaatcgccgtatgaaacataagcgccaaactcagcaccgggagccacccgacggcgagccggcttgccccggcgcactggaggatatttgtgaccccgctgaggagcccgccgccagtcccggcgggccttccgcgagtcgagccgcctgggaagcttgctgccatccaccagaggtcgtcccgggcgccttgagcgcagacccacggcccttggccgtcagactcgaaggtgcaggggccagtagcccaggctgtgctcttcgtggcgcaggcggtctggagccaggccccctccctgaggatgtgttttccggccggcaggatagcccttttcttcccgacttaaatttctttgccgccgactcgtgccttcagctatccgggggtctgtctccaagcctgcagggctcccttgactctcctgtgccatttagcgaggaggaactcgatttttttactagcactttgtgcgccatcgatttgcaatttccgtag

SEQ ID NO: 120093 - DNA, 1296 bp, Artificial Sequence
  Description of Artificial Sequence: Synthetic coding sequence
atgcagaaagcaacatactatgataacgccgccgcagccctgtttggcgggtacagctcctaccctggctcgaatggattcggattcgatgtgccgccccaaccccccttccaggcggccacccacctggagggagattatcaacgttccgcctgtagtcttcagtccctggggaatgctgcaccgcatgcaaaatcaaaagaactcaacggatcttgtatgagacccggcttggcaccggagcctctatctgccccccctgggagcccaccaccaagcgctgcacctactagtgcgactagtaacagctccaacgggggcgggccgagtaagagcgggccacctaagtgcggacccggcaccaactcaaccttgactaagcagatcttcccttggatgaaggagagcaggcaaacctctaagctgaaaaacaacagtcccggtactgctgagggatgcgggggaggtgggggtggaggaggcggagggggctccgggggctccgggggaggcggaggcgggggaggaggcggagacaagagtcctccgggaagcgccgccagtaagagagccagaactgcttacacatcggcccagcttgtggagctcgagaaagaatttcacttcaatcgttatctctgcagacctcgccgtgttgagatggccaatttgttgaatctgtcagaaagacagatcaagatctggtttcagaatcgacggatgaagtacaaaaaagaccaaaaagccaaaggcctggctagttcctctggcggcccctcacctgccggctcaccaccacagccaatgcagtcaaccgccggatttatgaacgccctgcactccatgacaccttcctacgagagccccagccccccagcatttggaaaggcacaccagaacgcctacgcattaccttctaattaccagccgccactgaagggatgcggtgcgcctcaaaagtacccaccaacccccgcccctgagtacgaaccacacgtcctgcaggcgaacggcggtgcctacggcacccctaccatgcaaggcagtccagtctacgtgggcgggggggggtatgccgaccctctgccgcctcccgcagggccctccttatacgggctgaatcacttgtcccatcacccctccggcaatctggattataatggggccccccctatggcaccctctcagcaccatgggccttgcgagccgcacccgacgtatactgatttaagtagtcatcacgccccgccccctcaggggcgcatccaggaggcccctaaacttacacatctgtag

SEQ ID NO: 120094 - DNA, 900 bp, Artificial Sequence
  Description of Artificial Sequence: Synthetic coding sequence
atgaaagaaagtcggcagaccagtaaactgaagaacaatagccccggtactgccgaggggtgcggaggcgggggtgggggtggggggggaggtggttccgggggctccggaggcggaggcgggggaggtgggggtggcgataaatctccacctggatctgccgcgagcaagagagcccggaccgcttacacttctgcccaactggtagagctggagaaggagtttcattttaatcgctacctctgtaggccccggcgagtcgagatggccaatctgctgaacctgtccgaacggcagatcaagatctggttccagaataggagaatgaagtacaagaaggatcagaaggccaaggggctggctagcagcagcggaggtccttctccggctggcagccccccacagcctatgcagtccaccgccggctttatgaatgctttgcatagtatgaccccttcttatgaatctccatcgccgccggcgtttggcaaggctcaccaaaacgcctatgctctcccatccaattaccagcctccactcaagggatgtggagccccccagaagtatcccccaactcctgccccagagtacgaacctcacgttctacaggccaatgggggcgcctacggcacccctaccatgcaggggtcccctgtgtacgtggggggaggaggctatgcagacccacttccgccgcccgccggcccttctctgtacggccttaatcacttgagtcaccacccaagtggcaacctggattacaatggagcacccccaatggcaccctcccagcaccacggtccctgtgaaccccaccccacctataccgatctttcctctcaccatgcgcctcccccccagggcagaatacaggaggccccaaagctaacacatctatag

SEQ ID NO: 120095 - DNA, 1296 bp, Artificial Sequence
  Description of Artificial Sequence: Synthetic coding sequence
atgcagaaggcgacatattatgacaacgcggctgccgccctgttcgggggttattcctcttatcccggttctaacggttttggattcgatgttcctccacaaccgcctttccaggccgccactcacctcgagggggactaccagcgaagcgcctgctcactccagtcccttggaaacgcagcccctcacgctaagtcaaaagaactgaacggcagctgcatgagaccaggtctcgcacccgagccactgtcagcccctcctggaagtccacccccctctgcagctcccacatctgctacgtcaaattcctccaatggcgggggcccaagtaagtctggacctcccaagtgcggaccaggcaccaacagtactttgaccaaacaaattttcccatggatgaaggagtcgcgccaaacttcaaaacttaaaaataattcccctgggaccgccgaaggctgcggtggcggcggtggcgggggaggcgggggggggtccggaggctccggaggtgggggagggggcggcggcggcggagataagtcacctccaggatcagccgcttcaaagcgggcgagaaccgcttacacatccgctcagttggtggaactggaaaaagaattccattttaaccgatatctctgcagaccccgcagggtggagatggccaacctgctaaacttgagtgaacggcagatcaaaatctggttccagaataggaggatgaaatataagaaggaccagaaagcaaagggcctcgccagcagttctggtggacccagcccagccggctctccgcctcaaccaatgcagagtaccgctgggtttatgaacgcactccatagtatgactccatcttacgagtctccatctccaccagcctttggtaaagctcaccagaacgcctatgccctccctagtaactaccagccgcctctaaaaggttgcggagcacctcagaagtatccgccaaccccggccccagaatatgaaccccacgttctgcaggcaaatggaggcgcgtatggcacccccacaatgcaggggtcccccgtatacgtggggggtggtggatatgctgatccactgcccccgcccgcaggaccatccctttatggtctcaatcacctgagccatcatccaagtgggaacttagactacaatggcgctcccccaatggccccatcacagcatcacggcccttgcgagcctcatcccacctacactgatttgagctcccatcacgcacccccccctcaggggcgcatccaggaggccccgaagctcacccatctgtag

SEQ ID NO: 120096 - DNA, 1077 bp, Artificial Sequence
  Description of Artificial Sequence: Synthetic coding sequence
atgagacccggcctcgcaccggagccactgtccgcaccaccaggatctccccccccttccgctgcgcctactagtgctacttccaatagtagcaatgggggaggaccatcgaagtcgggtcctccaaaatgtggacccggcacgaactccactctcaccaagcagatcttcccttggatgaaggaatcgcgccagacatccaaactaaaaaacaatagcccaggtacagccgagggatgcggagggggtggggggggcggtgggggggggggatctggcggatcaggaggcggaggaggagggggcggaggaggggataaaagtcccccagggtccgctgcgtccaaacgagctcgtaccgcctataccagtgcacagttggtcgagctggaaaaagagtttcactttaacagatacctgtgcagacccagacgagtggaaatggccaacctgcttaacttgagcgagcggcagattaagatatggttccagaatcggagaatgaagtacaagaaggaccagaaggccaagggtttggcatctagctccggaggcccatctcccgctgggagtcctcctcagcctatgcagagtacagcgggatttatgaacgcgctgcactcgatgaccccttcctacgagagtcccagtccacctgcattcggcaaggcccaccagaatgcttacgcattaccaagcaattaccagccacctttaaagggatgtggcgctccacagaagtatccgccaacaccagcccctgagtacgaacctcacgttctgcaagctaatgggggcgcctatggaactcctacaatgcagggcagccccgtttacgttggagggggtggctatgcagaccccctgcctccccctgctggaccctctctgtatggcctgaatcatctgagtcaccacccctctggaaacttggactataacggagcacctccaatggcccccagccagcaccacgggccatgcgaaccccaccctacctacacagatctctcgagtcatcatgctccccccccacaggggcggattcaggaagcgccaaaactgactcatctgtag

SEQ ID NO: 120097 - DNA, 1296 bp, Artificial Sequence
  Description of Artificial Sequence: Synthetic coding sequence
atgcagaaagcgacctactatgataatgccgccgctgccctattcggcggctacagttcatacccaggttctaacgggtttggattcgacgtgccgccccagccaccatttcaggcagcaacccacctggagggcgactatcaacgctcagcttgttcgctccaaagcctggggaatgcggcaccccatgccaaaagcaaggagctgaacggaagctgtatgcgcccggggctggcaccagagcctctgagtgcccctccaggatctccgcctccctccgctgctccgacctctgccacatccaactctagtaatggcggcggtccctctaagagtggcccgcccaaatgcggacctggcaccaacagtacccttacaaagcagatcttcccatggatgaaagagagccgccagactagcaagttgaaaaataatagtcctggcacggctgagggatgcggtggcggcggcggcggtggaggtggcggtggctccggcggtagcggcggaggcggcggcggaggaggagggggagacaagtcccctcctggtagcgccgcatcaaagcgggctcgtacagcctacacaagcgcccagttggtggaacttgagaaagagtttcattttaatcggtacttatgcaggcccagacgtgtcgagatggcaaatctgttgaatctgagtgaacgccagattaagatctggtttcagaaccgtcgtatgaagtacaaaaaggaccagaaggccaagggtctggcttccagctctggaggcccatcacccgctggatcccccccccaaccgatgcagagcacggccgggtttatgaacgccctgcacagcatgacgccctcctatgaaagcccctcccctcctgccttcggtaaggcgcatcaaaacgcctatgccttgccgagtaactatcagccccctctgaaaggttgcggagccccacaaaagtacccgcccacacccgcgcctgagtatgaacctcatgtcctccaggccaatggtggagcctacggaacaccaaccatgcagggctcaccagtgtacgtgggtggagggggctatgccgaccctttacccccgcccgccgggccgtccctgtatggactgaaccacctgagccaccacccatccggaaaccttgattacaacggtgcgcctccaatggcaccatctcaacaccatggaccttgtgagcctcatccgacatacacagacctctccagccatcacgctccccctccccagggccggattcaggaggcgccaaagttaacccacctttag

SEQ ID NO: 120098 - DNA, 900 bp, Artificial Sequence
  Description of Artificial Sequence: Synthetic coding sequence
atgaaagagagtcggcagacctccaaactcaaaaataattcccctggcacggctgagggttgcggtggcggtggtgggggcggaggaggaggcggatccgggggctccggaggtggcggaggaggcgggggcggtggtgataagtctccgcctggcagcgcagcaagtaagagagcccgcacggcctacactagcgcccagctggtcgaacttgagaaagaattccactttaaccggtatttgtgtcgtccaaggcgagtcgaaatggctaacctgctcaatctgagcgagcgacagattaaaatatggtttcagaatagaagaatgaaatataagaaagatcagaaggccaagggactggcctctagcagtggaggaccctccccggcaggctctccgccccagccaatgcaatctaccgccggctttatgaacgcgctgcacagcatgactcccagctatgagtccccctcaccaccggccttcgggaaagctcaccaaaacgcttatgctctgccatccaactaccagccgccactgaagggttgcggggcccctcagaaatacccccctacccctgcccctgagtatgaaccgcatgtcctacaagccaacggtggagcctatgggacaccgacaatgcagggctctccagtctacgtcggtggaggaggctacgcagatccattaccaccccctgcaggaccctccctgtatggtttgaatcacctgtcccaccatcccagcggtaatctggattacaatggggctccccccatggccccttcccagcatcatggcccctgcgaaccacacccaacctacactgatctgtccagccatcacgcaccccccccacaagggcgaatacaagaagccccaaaactgacgcatttgtag

SEQ ID NO: 120099 - DNA, 1077 bp, Artificial Sequence
  Description of Artificial Sequence: Synthetic coding sequence
atgcgacccggactggctcccgaaccgctgtccgccccccccgggtcgccaccaccatccgctgcccctacatccgcaacaagcaacagctcgaatgggggcggcccttccaagtccggccctccaaagtgtggccctgggaccaatagtaccctgactaagcaaatttttccatggatgaaagaaagcaggcagacctcaaaactaaaaaacaacagtcctggcacggcagaagggtgtggtggggggggaggcggaggagggggcggaggcagcggcggatctggaggcggcgggggaggtggaggaggaggtgacaaaagcccacctggctctgctgcaagtaagagggcaagaactgcctacacgagcgcgcaacttgttgagcttgagaaggaattccactttaaccggtatctctgtaggccacgtcgggttgaaatggctaatctgctgaacttgagcgagcggcagatcaagatctggtttcagaaccgtaggatgaagtataagaaagatcagaaagccaagggactggcatcgagctcaggggggccatcaccagccgggtcccctccacaaccaatgcaatctaccgcaggattcatgaatgcgctgcatagcatgacgccatcgtatgagtcaccgtcacccccagcctttggaaaagctcaccagaacgcctatgcactgccgagtaattatcagccacctttgaagggctgcggggcccctcaaaagtacccaccaacacccgccccagaatacgagccacacgtactccaagcaaacggcggcgcttatggaaccccaactatgcaaggcagcccagtgtacgttggaggcgggggctatgccgaccccctccccccaccggccggtcccagtctgtatggcttgaaccatctgtcccaccacccgagtggcaatctggactacaatggagctccaccaatggccccctcacaacaccacggcccctgcgagccacatccaacctacacggacctctcaagtcaccatgcacccccaccgcagggaaggatccaagaagcacccaagcttacccatttgtag

SEQ ID NO: 120100 - DNA, 1296 bp, Artificial Sequence
  Description of Artificial Sequence: Synthetic coding sequence
atgcaaaaagccacatactatgataacgccgccgcagctctttttggcgggtattccagctacccaggtagcaacgggtttgggtttgacgtacctccgcaaccccccttccaggctgcaacccacctggaaggggattatcagcggtctgcttgctcccttcaatcactcgggaacgccgctccacatgctaaaagtaaagagctgaatggctcttgtatgcgcccaggtcttgctcctgaaccgttatccgcccctccgggaagtccacccccctctgcagcccctacctctgcgacctctaactcttctaatggaggcggaccaagcaagagtggacccccaaaatgtgggcctggtacaaacagtactctgacgaaacagatcttcccatggatgaaagaaagtagacagacaagtaaactgaagaacaactcccccggaacagccgaaggctgtgggggcggggggggtggaggcggcgggggcgggagcgggggctcaggcggagggggcggggggggtggggggggagataagtctcctccggggagcgcggccagcaaaagggctcgtacggcttacacctcagcgcagttggttgagctcgagaaggagttccatttcaatagatatttatgccgaccaagacgggtggaaatggcgaacctgcttaacctttctgagcggcagatcaaaatctggtttcaaaaccgtcgcatgaagtataaaaaggaccagaaagctaaaggcctggcttcgagctcaggaggaccctctcctgctggttctccacctcaacccatgcagagtactgccgggttcatgaatgcgctgcattccatgacaccctcttacgagagcccttcacctcctgcgttcgggaaggctcatcaaaacgcgtacgcactcccatcaaattaccagcctcctctgaaagggtgcggtgccccccaaaaatacccaccaacccccgcgcccgaatacgagccacatgtgctgcaggccaacggaggagcctatggcacaccaactatgcagggctcacccgtctatgtgggcggcgggggctatgcagaccctctgcccccacccgcaggcccctctctctatgggctgaaccacctctctcaccacccctccggcaacctagactataatggcgcacccccaatggccccaagccagcatcatgggccttgtgagccccatccgacatataccgacctgtccagccatcacgctcctccaccccagggtaggatccaggaggccccgaagctgacccacctctag

SEQ ID NO: 120101 - DNA, 756 bp, Artificial Sequence
  Description of Artificial Sequence: Synthetic coding sequence
atggctatgtctagttttctcattaacagtaattacgtcgatccgaagtttccgccttgcgaggaatactcccagtctgactacctgccctctgaccactcaccgggctattacgctggcggccagagaagagaatcgagctttcagccagaggccggttttggccgacgggcggcatgcactgtgcaaagatacgctgcttgcagagatcccggcccccccccccctccacctccacctccccctccccctcctcctccaggcctgtccccgagagcacctgcgccaccccctgcaggcgcactgctcccggagcctggacagcgctgtgaggccgtaagtagcagcccaccaccgccaccctgcgctcagaatcctctccatcctagcccaagtcacagcgcctgcaaggagcccgtggtttacccttggatgagaaaggtccatgtttccaccgtcaatccgaattacgccggcggcgagcccaagcggtccagaacagcgtatactagacagcaggtcttggagctagagaaagaattccactataaccgttaccttacccgcaggcggcgcgttgagatcgcccacgcactttgccttagcgaaaggcagattaagatctggttccagaacagaaggatgaagtggaaaaaagatcataagttacctaacacaaagatacgcagcggaggcgccgccgggagtgcaggagggccgccgggcaggcccaatggcggtccccgggccctatag

SEQ ID NO: 120102 - DNA, 810 bp, Artificial Sequence
  Description of Artificial Sequence: Synthetic coding sequence
atgtcatcgtattttgtgaattccttcagcgggagataccccaatggccccgattatcagctccttaactacggatctggttctagtctgtccggaagttatagggacccagcagcaatgcatacaggttcctacggttataactacaacgggatggacctttctgtgaatcggagcagtgcttccagctcccatttcggcgctgtaggggagtcgtcgcgggcattccctgcacctgcccaggagcctcgcttccgtcaggctgctagctcttgtagtcttagctcccctgaatcgctgccctgtaccaacggggattcgcacggggcgaaaccatcagcgtcttctccttccgaccaggcgactagtgccagttctagcgctaatttcactgaaatcgacgaggcctctgcatcatcggagcctgaagaggccgcttctcaattatctagcccttccctagcccgcgctcaacctgagcccatggccacgtccaccgctgccccggagggtcagactcctcagatattcccttggatgcgaaagctccacattagccacgatatgacaggccccgatggtaagcgggcccggacggcctacactaggtaccagacactggaactggagaaagagtttcacttcaatagatatctgacccgtaggaggaggattgagattgcacacgccctgtgcctctcggaaaggcagattaagatttggtttcaaaacaggaggatgaaatggaaaaaagataataagcttaagtccatgagtctggcgactgctggcagtgcttttcagccatag

SEQ ID NO: 120103 - DNA, 1179 bp, Artificial Sequence
  Description of Artificial Sequence: Synthetic coding sequence
atggccgcgctccgccagccccaggttgcagagctgctggcggaggctcgacgggcctttagggaggaattcggggccgaacccgagcttgcggtctccgcccctggaagagtgaacctcatcggtgagcacaccgattataaccagggccttgtcctgcccatggccctcgaattgatgacagtgttggttggatcgcccaggaaggatggcctggtgagtttactgacaacctccgagggtgcagatgagcctcagaggctgcagtttccgctcccaacagcacagaggagcttggagccaggtactccccgatgggctaactacgtaaagggtgtcattcagtattaccccgccgcccccctccctggattctctgccgtagttgtgagttccgtgcccctgggtgggggactgtccagttcggcttctctcgaagttgctacttacacttttctccagcagctgtgtccagattctggcactatcgcagcgagggcccaggtgtgccagcaggctgagcatagttttgccggaatgccttgtgggatcatggatcaatttattagcctgatgggacagaaaggtcacgccctgcttatcgactgccggtccctggaaaccagtctcgttccactgtccgatcctaaattggctgtgctgatcacaaatagtaacgtccgtcatagtttggcgtctagcgagtaccccgtccggagacgacaatgtgaagaggtggcaagagctctgggcaaagagtctcttagggaggtgcagctggaggagttggaggctgccagagatctagtgtccaaggagggcttccgcagggcccgtcacgtggttggtgagataagaaggaccgcccaggccgccgccgcgctgagacgcggagactatcgcgcatttggcagactgatggtcgaaagccacagaagtctgcgcgacgactacgaggtcagctgtcccgagctggatcagctggtcgaggcagccctggctgtgcctggtgtttacggatcaaggatgacagggggcggattcggaggttgcactgtcacgcttctggaagcatccgccgcccctcacgccatgcggcatatccaggagcactatggcggtaccgctacattctatctctctcaggcagcagacggcgcaaaagtgctctgtttatag

SEQ ID NO: 120104 - DNA, 675 bp, Artificial Sequence
  Description of Artificial Sequence: Synthetic coding sequence
atgtcgtcttactttgtgaactcaacatttcccgtgacacttgctagcggccaggaaagtttcctcggacagctgcctctatatagttcggggtacgccgaccccctgaggcactaccccgctccctatgggccaggaccaggacaggacaagggcttcgccactagcagctattacccaccggctggggggggatatgggcgcgccgcaccttgcgattacggacctgcaccggcgttctatcgggagaaggaatcagcctgtgctttaagtggtgctgacgagcagccaccctttcaccccgagcctcgcaagtccgactgcgcccaggacaagtctgtattcggggagactgaagaacaaaagtgctccaccccagtgtacccctggatgcagagaatgaactcatgtaattcttcgagctttggaccaagcggtcgacgggggcgtcaaacttatacccgataccaaaccctggaactagagaaagaattccattacaaccgttacctgactagacgcaggaggatcgaaattgcacatgcactatgtctcacagagaggcaaatcaaaatctggtttcagaaccgaagaatgaagtggaaaaaggaatcgaaacttttgagtgcaagtcagctgagcgctgaagaagaggaggagaagcaggctgagtag

SEQ ID NO: 120105 - DNA, 654 bp, Artificial Sequence
  Description of Artificial Sequence: Synthetic coding sequence
atgtcctctttatactatgccaatacgctattcagcaagtaccccgcgtcttcttcagtttttgcgactggggcctttccagaacagacctcatgtgcattcgcgtccaatcctcagcgtcctgggtatggcgctggtagcggggccagttttgcagcaagcatgcaggggttatacccaggcggagggggtatggcgggccagtctgccgccggcgtctacgcagccggctatggccttgaaccatcctccttcaacatgcactgcgcaccttttgaacagaatctgtctggggtatgccctggggattccgctaaggcggccggagcaaaggagcagcgcgacagcgatctggctgccgaatccaatttcaggatctacccgtggatgaggtcatcaggaactgacagaaagcgcgggcgccagacctacacaagataccagaccctagagctggagaaagaattccactacaatcgatacttaacacgcagaagaaggattgagatcgctcacacactatgcctcacagagaggcaaatcaaaatttggttccagaaccgaaggatgaagtggaagaaagagaataagacagcggggcccgggacaacgggtcaggatagggctgaggccgaggaggaggaggaggaatag

SEQ ID NO: 120106 - DNA, 87 bp, Artificial Sequence
  Description of Artificial Sequence: Synthetic coding sequence
atgaagtggaaaaaggagaacaaaacagccggcccggggaccaccggccaagatagggcagaggctgaggaagaggaagaggagtag

SEQ ID NO: 120107 - DNA, 732 bp, Artificial Sequence
  Description of Artificial Sequence: Synthetic coding sequence
atgtcatcgtacttcgttaactcccttttctccaaatacaagaccggagaaagccttcggccgaattactacgattgtgggttcgcccaggatctcgggggaaggcccacggttgtgtatggaccctcctccggtggatctttccaacatccaagtcagatccaggaattttatcacggccccagttctctgagtaccgcaccttatcagcagaacccgtgtgccgtggcatgccatggagatccggggaacttttatggatatgatcctcttcaacggcagtccctgttcggagcccaggatcccgatcttgtccaatatgcagattgcaagttggccgctgctagcggcctgggggaggaggccgagggtagcgagcagtccccctctccaacccagctgttcccttggatgcggccgcaggctgcagccggtcggcgcagaggtagacagacctactcgaggtatcagactctggagctcgagaaagagttcctgttcaacccttatctgacacgaaagagacggatcgaggtctctcatgcactggggttgacagaaaggcaggtgaagatatggtttcagaacagacgcatgaaatggaagaaggagaacaataaggacaagtttcctagcagcaaatgcgagcaggaggaactggagaaacagaaactcgagagggcaccggaggccgccgacgagggcgacgctcaaaaaggtgataaaaagtag

SEQ ID NO: 120108 - DNA, 753 bp, Artificial Sequence
  Description of Artificial Sequence: Synthetic coding sequence
atgagcatctcagggacactgagttcttactacgtcgacagcataatcagtcatgagtctgaggacgccccccctgccaaatttccatctggccagtacgcgagctctcggcaacctggccatgccgagcatctcgaattcccttcctgtagctttcagcctaaggccccagtgttcggagcatcatgggccccactgtccccacacgcctctggtagtttgccctccgtctaccatccttatatccagcctcaaggcgtgccccctgccgagagccgctacctgcgtacatggttagagcctgcccccagaggagaggctgcaccggggcagggacaggccgccgtgaaggccgaaccgctgttgggcgcccccggggagcttctgaaacagggcactccagagtattcacttgaaactagtgcaggcagggaggccgtgctgtcaaaccaaagacctgggtacggagacaacaagatctgcgaaggatctgaagataaggagagacctgaccagaccaacccctcagcaaactggctgcacgcccgctcaagtcgtaagaaaagatgcccttacaccaagtatcagactctggagctggaaaaggagttcctgtttaatatgtacctgacacgcgatcgcaggcacgaagtcgcccgtctactaaatctctccgagcggcaggttaaaatttggtttcaaaaccggcggatgaaaatgaagaagatgaacaaagagcaaggcaaagaatag

SEQ ID NO: 120109 - DNA, 387 bp, Artificial Sequence
  Description of Artificial Sequence: Synthetic coding sequence
atgtctatttccggcactctgtctagctattacgtcgacagcataatatcccacgagtccgaggatgcccccccggctaagttcccgtctgggcagtacgcctctagtcggcaaccaggtcacgccgagcatctcgagttcccatcttgtagcttccagcctaaggcgcccgtgtttggtgcatcctgggcgcccctgagtcctcatgccagtggctccctcccttctgtctatcacccgtatatccagcctcagggagttcctccagctgagtcaagatacctgcggacatggctggagccggcgccccgcggaggggcagctcaaacaggccacgcccgagttcaatttggtaatttcggcggacaggggggccgcgcagtatag

SEQ ID NO: 120110 - DNA, 1029 bp, Artificial Sequence
  Description of Artificial Sequence: Synthetic coding sequence
atgacctgtccccgtaatgttacccccaacagttacgccgaaccactggccgcccccggcggcggtgaacgttatagccgcagcgccgggatgtacatgcagtcggggtcagactttaactgtggcgttatgcgcggctgcggtctcgccccatccttgagtaaacgggatgagggatctagtccctctctcgctctcaacacctaccccagctatctgtcccagctggactcctggggggatccgaaggccgcatataggctggaacaaccggtagggcgccctttgtctagttgctcatatccccccagtgtaaaggaggaaaatgtgtgttgcatgtacagtgccgagaagcgcgctaagtccggccccgaggccgctctgtactcccacccactccctgaaagctgcctgggcgaacacgaggttccagtaccctcttattatcgggcttcaccttcatatagtgctctcgacaagacacctcattgctctggcgcgaacgatttcgaagccccatttgaacagcgtgcctccttgaatcctcgggcggagcacttggaatccccccaactcgggggcaaggttagtttccccgaaactcccaagagcgacagccagaccccttccccaaatgaaataaaaaccgagcaatctctggccgggcccaagggcagcccatccgagagcgaaaaagagagagctaaggccgccgattccagtcccgacacaagcgacaatgaagctaaggaagaaatcaaagcagaaaacactacagggaactggctgacagccaaaagcgggagaaagaaacgttgcccatataccaaacaccaaaccctggagctagagaaggaattcctgtttaacatgtatttgacacgggagcgcaggctggagatctctaagacaatcaacctgacagacagacaggttaagatctggttccagaatcgacgcatgaagttgaagaagatgaaccgggaaaacagaatcagagaactgacttcaaacttcaactttacatag

SEQ ID NO: 120111 - DNA, 915 bp, Artificial Sequence
  Description of Artificial Sequence: Synthetic coding sequence
atgttcaactcggtgaatcttggtaatttctgctcaccgtctcgcaaggaacgaggtgcagattttggggaaagggggagctgcgcaagtaacttgtacttgcccagttgcacgtactatatgcctgagttctccacagtaagctcatttctcccccaagccccttctaggcaaatatcctatccgtattccgcccaggtccctcctgtgagagaggtgtcctacggactggaacctagcggcaaatggcatcaccgcaactcttactcttcttgttatgccgccgccgacgaactgatgcaccgggaatgcctgccaccctccactgtcacagagatcttaatgaagaacgaaggtagctacggtggacatcaccatcccagcgcccctcatgccactccagccggtttttactccagtgtgaataagaacagtgtgcttccacaggcgtttgaccgtttttttgacaatgcatactgcggagggggcgacccacccgcagaacccccctgctccgggaaaggggaggccaaaggtgagcctgaagcgccacccgccagcggcttggcgtcaagagccgaggccggcgctgaggccgaagcagaggaggagaacaccaatccgtcttcgtcagggtccgcacacagcgtcgccaaagagccagccaagggtgcagcgcccaacgctccccggactcgaaagaaacggtgtccctatagcaagttccagatcagagagttggaacgtgaattttttttcaacgtctatatcaacaaggagaaacgattgcagctgtcacgcatgttgaacctgactgaccggcaggtgaaaatatggttccaaaacagaagaatgaaggaaaaaaagttatctcgagaccggcttcaatatttctcgggaaacccactcttgtag

SEQ ID NO: 120112 - DNA, 849 bp, Artificial Sequence
  Description of Artificial Sequence: Synthetic coding sequence
atgggcgagcataacctacttaatccgggcttcgtggggccattggtcaacatacatacgggcgacactttctacttccctaactttcgcgcttccggcgcacaattacccgggctgccatctctgtcctacccccgcagagacaacgtctgttcactgagctggccgtccgccgagccttgtaacggatatccacagccgtatttggggtctccggtgagcctgaaccctccctttggccggacctgcgagctcgctagggttgaggacgggaaggggtattatagagaaccatgcgcggaggggggtggcggagggcttaagcgcgaagaaagaggacgtgatcccggcgccggaccgggagctgctctgttacccctggagccaagtgggcctccagctttggggttcaagtacgactatgctgcaggggggggaggaggcgacggtgggggtggagccggtcctccgcatgatccacccagctgccagtctctggagtccgacagcagcagtagcttgctgaacgagggcaacaaaggcgccggcgctggcgatcccggctctttggtgagtccgcttaatccaggtgggggccttagtgcatctggagctccttggtaccccattaattctagatctcgaaaaaagagaaagccatattctaagcttcagctcgccgaactggaaggagaattcttagtcaatgagttcatcacacggcagcgtagacgggaactgtctgaccggctgaacctgtcagatcagcaggtgaagatttggttccagaaccggcgcatgaaaaagaagaggctccttctacgggagcaggccctctcgtttttttag

SEQ ID NO: 120113 - DNA, 993 bp, Artificial Sequence
  Description of Artificial Sequence: Synthetic coding sequence
atgacaactagtcttttgctgcacccacgctggcccgaatcccttatgtatgtatacgaagatagtgctgcggagagcgggatcgggggaggtgggggggggggaggcgggggaaccggaggtgccggagggggctgttctggggctagcccaggaaaagcgccatcgatggacggcctggggtcgtcctgtccagcctctcattgtcgggacctccttccccacccagtcctcgggagacccccggcaccactcggggccccccagggcgctgtttatacagatattcctgcacccgaagccgcacggcaatgcgcccctccacctgcacctcctacttcctcttcagccaccctcggatacgggtacccgttcggaggttcctattatgggtgcagactgtcgcataacgtgaatctgcagcagaagccatgcgcttaccaccccggcgataaatatcctgaaccctccggcgcattgcctggagatgatctgtcaagccgcgctaaggaattcgccttctacccttctttcgcatcatcctatcaggctatgccaggctatctggatgtgagtgtggtccccggcatttccggccatcccgagcccagacacgacgccctgattcccgtggaaggttaccaacattgggccctgtccaacggatgggattcacaggtatattgttccaaagaacagagtcagagcgcccatctttggaagagtcctttcccagacgtcgtgcctctccaaccagaggtttcatcctatcgcaggggtcgcaaaaaacgcgtaccatacacgaaggtccagctgaaggaactcgagaaagagtatgctgcttcgaagtttattactaaggaaaagaggaggagaatatcagcaactactaacctaagtgagcgacaggtgaccatttggttccagaacagacgggtcaaggaaaagaaggttgtaagtaagagcaaagcgccacacctacattctacttag

SEQ ID NO: 120114 - DNA, 795 bp, Artificial Sequence
  Description of Artificial Sequence: Synthetic coding sequence
atgattatgtcgtcttacttgatggatagcaactacatagaccccaaattcccaccctgtgaggaatacagtcaaaacagctatatccccgaacactcccctgaatactacggccggacccgagaatccggatttcagcaccaccaccaggaactgtaccccccaccccctccgcgtccctcctatccggaacgccagtatagctgcacctctctgcaggggccaggtaacagtcgagggcacggcccggctcaggccggtcaccaccatcctgagaaatctcagtccctgtgcgaacccgcacccctaagtggagcgtcagcatctccatctccagcccctccagcgtgttcacagcctgcccctgaccatccaagctcagccgcctccaagcagcccattgtgtatccctggatgaagaagattcatgtgtccaccgtgaatcctaattacaacggcggtgaacctaaacggagtagaaccgcttataccaggcaacaggtgctggaactcgagaaagaattccactataatcgctacttgacacggagacggaggattgagattgcccacagtttgtgcctgtccgaacggcagataaaaatctggtttcaaaacagaagaatgaagtggaagaaagatcaccggctccctaataccaaggtgcgctcagcaccaccagctggcgcagcgcccagcactctgtcagcagcaacacccggcacctctgaggaccatagccaatccgcaacccctcccgagcaacaacgagccgaagatattacgcggctgtag

SEQ ID NO: 120115 - DNA, 795 bp, Artificial Sequence
  Description of Artificial Sequence: Synthetic coding sequence
atgatcatgtcttcctacctcatggatagtaactatatagacccgaagtttccaccttgtgaggaatatagccagaacagctatattccggaacacagccctgaatactatggtaggaccagggaatcaggcttccaacatcaccaccaggaactttaccctccccccccccctaggccttcttaccccgaacgacaatacagttgcacatctctccagggtcctggcaactcacgtgggcacggacccgcgcaagccggccaccaccacccagagaagagccagtctctatgtgagcccgccccattatcaggtgcatctgcaagcccctcccccgccccccctgcctgcagccagcctgcacctgaccatccttcatctgcagcaagcaaacagcccatagtctatccctggatgaaaaagattcacgtgagcacagtcaaccctaactacaatggtggggaacctaagcggagtagaacagcctacacaaggcagcaggtgctggagttagagaaggaatttcattataatagatacttaaccaggagaagaaggatcgagatcgcccactctttgtgcctgagcgaaagacagattaaaatctggtttcagaataggagaatgaagtggaagaaggaccaccggctgcccaatactaaagtgcggagcgcccctcccgccggcgcggctcctagtactctctctgccgccacgcccggcacatccgaggaccatagccagtcggccacaccaccagagcagcagcgagcagaagacataaccaggctatag

SEQ ID NO: 120116 - DNA, 669 bp, Artificial Sequence
  Description of Artificial Sequence: Synthetic coding sequence
atgagttcttatgtcgcgaatagtttctacaagcagtctcctaacattccagcgtataacatgcagacttgcggcaattacgggagtgctagcgaggttcaggcaagcaggtactgttatggtggattagatctatcaattacctttcccccccctgcgccctcaaattcattacacggcgtagacatggccgcaaatccgcgtgcgcacccagaccgtccggcctgcagcgctgcagcggcacctgggcacgctcccgggcgtgatgaagccgcacccttaaaccccggcatgtattcccagaaagctgcccggcctgcactggaagagagggccaagagctccggggaaatcaaagaggaacaagcccaaaccggtcaacccgctgggctgtcgcagccgccagcacctccacagatctatccatggatgactaagctccacatgtcgcacgagaccgatgggaagcggtctagaaccagttacactcggtaccagactcttgagctggagaaagaattccatttcaaccgatatctcactagacgccgccgcatagagatcgcaaacaatctgtgcttgaacgagcgccagataaagatctggtttcagaaccggcgcatgaaatggaagaaagactccaagatgaaaagtaaggaggccctatag

SEQ ID NO: 120117 - DNA, 708 bp, Artificial Sequence
  Description of Artificial Sequence: Synthetic coding sequence
atgaacagctatttcaccaatccctcactttcttgccatctggcagggggacaagatgtgctgcctaatgtcgcccttaattctactgcctacgatcccgtaaggcatttcagcacctatggggccgcggtggcacagaatcgaatctactccacacctttttactctccacaggagaacgttgtgttcagtagctctagaggaccttacgattatggaagcaactctttttaccaggaaaaagacatgctgtcgaattgtagacagaataccctcggccacaatacacaaacttctattgcacaagattttagtagcgaacaagggaggaccgccccacaagatcagaaggcttccattcagatatatccttggatgcagagaatgaactcgcacagcggggtgggctacggtgccgatcggcggcggggtaggcagatttactctagataccagacgctcgaacttgagaaggagttccactttaatcgttatctgactcggagacgccggatagaaatagctaacgcactgtgtctgactgaacggcagattaaaatttggttccaaaatcgtagaatgaagtggaagaaagagtcaaatctaacgtctacgctgagcggagggggtggtggggccactgctgacagtttagggggcaaagaagaaaagcgggaggagactgaagaagagaagcagaaagagtag

SEQ ID NO: 120118 - DNA, 462 bp, Artificial Sequence
  Description of Artificial Sequence: Synthetic coding sequence
atgctgtctaactgtaggcagaataccctgggccataacacccagactagtatagcgcaggattttagtagcgagcagggacgcacagctcctcaggaccagaaggcttcaattcagatttacccatggatgcagcggatgaacagccactccggtgttgggtacggggccgatcggcgtcggggaaggcaaatttacagtcgataccagactctcgagctggagaaggaattccatttcaataggtatctgaccagaaggagacggatagaaatagccaatgccctgtgtcttaccgaacgacaaattaagatatggttccaaaatagaaggatgaaatggaaaaaagaatctaatctgaccagcaccctgtccggagggggggggggagccacagccgattcactcggcggcaaagaagagaagagagaggagaccgaagaggaaaagcagaaggagtag

SEQ ID NO: 120119 - DNA, 159 bp, Artificial Sequence
  Description of Artificial Sequence: Synthetic coding sequence
atgctgtccaattgcagacagaacaccttaggacataacacccagacctccattgcacaggatttcagttctgaacagggacggaccgctccacaggaccagaaggcctccatccagatatatccctggatgcagcggatgaactcccactcgggatag

SEQ ID NO: 120120 - DNA, 216 bp, Artificial Sequence
  Description of Artificial Sequence: Synthetic coding sequence
atgctgtccaactgccggcagaatactctaggtcacaatacgcagactagtatcgcacaggattttagcagcgagcagggccggaccgcgccccaggaccagaaagcgtcgatccagatctacccctggatgcagcgtatgaactcacacagcgtctgcttcgtcccggggtccctcggtgtcgggtatggcgcggataggaggagaggacggtag

SEQ ID NO: 120121 - DNA, 729 bp, Artificial Sequence
  Description of Artificial Sequence: Synthetic coding sequence
atgtcttcgtacttcgtaaaccccttatttagtaagtacaaagctggagagtccctggaaccagcttattacgactgtcggttccctcagtcagtgggacgctcccatgctctggtgtacggccctgggggtagcgctccgggtttccagcatgcatcacatcatgtccaggattttttccatcacggtacatcaggcatttctaattccggctatcagcagaatccatgttctctgagttgccacggcgacgccagcaagttctacggctacgaagcactgcctcggcagagcttatacggtgcgcagcaggaggcctccgttgttcagtatcccgattgcaagagcagcgccaacacgaactcctccgaggggcaagggcatctgaaccagaattcatcacctagcctgatgttcccctggatgcggccccatgctcccgggcggcggagcgggaggcagacttatagtcgctaccagacactggagcttgaaaaggagtttctcttcaacccatatcttacccggaagcggcggatcgaagtttctcacgcactgggcctgactgaaagacaggttaagatctggttccagaaccggcgcatgaagtggaagaaggaaaataataaagacaaacttcccggagctagggacgaagagaaggtggaggaagaaggaaacgaggaagaagaaaaggaggaggaggagaaagaggaaaacaaagactag

SEQ ID NO: 120122 - DNA, 783 bp, Artificial Sequence
  Description of Artificial Sequence: Synthetic coding sequence
atgtccgccactggaccaatcagcaactattatgttgactccctgatttctcacgataacgaagacctcttagcttcccgcttccccgcgacgggggctcatcctgcagctgccagaccaagtgggctggtgcccgattgcagcgactttccaagctgttccttcgcacctaagcctgctgtgttcagcactagttgggcacctgtaccaagccagtcaagcgtggtttatcacccttacggtcctcagcctcacctaggcgctgacactcgctacatgcgcacttggctcgaaccactttcaggtgcagtgagtttccctagctttccggcagggggccgacactatgcgcttaaacccgacgcgtaccccggtaggagagctgactgtgggcctggggagggcagaagttatcctgactatatgtacggctcacctggtgaactgcgggacagggctcctcagaccctgccctcaccagaagccgatgcgctcgctggcagcaagcataaggaagagaaggcggacctcgacccatctaacccagtggcaaactggattcatgctaggagcacgaggaagaaaagatgcccctacaccaaatatcagactctcgaactagagaaggaattcttatttaacatgtacctgaccagagacagaaggtacgaggtggcgcgggtcttgaaccttacagaacgccaggtaaagatatggttccaaaataggcggatgaagatgaagaagatgaataaggaaaagacggataaagagcaaagttag

SEQ ID NO: 120123 - DNA, 783 bp, Artificial Sequence
  Description of Artificial Sequence: Synthetic coding sequence
atgagcgccacgggccctattagcaattactacgtcgactccttgatcagccatgacaacgaggatctgctggcttccagatttccagcgaccggggctcaccccgccgcggccagaccaagcggtctcgtgcctgactgctcggacttcccctcctgtagcttcgcgcccaaaccagctgtcttctcgacttcttgggcgccagttccctcccagtcttcagtggtgtatcacccctacggtccacagccccacctcggagctgacacacggtacatgcgcacttggctagaacctctgtcaggagcagtctcctttccctcatttccggcgggcggaagacattatgccctgaaaccagatgcataccctggcaggagagccgactgcgggcccggagaagggaggtcgtaccctgactatatgtacggctcacctggcgaactccgcgacagggcaccacagaccctgccttcccctgaggcagacgcactggccggctctaaacacaaggaggagaaagctgatctggacccctccaacccagtcgcaaactggatccacgcccgttccactagaaagaaacgctgtccgtatacgaagtaccaaacactggagcttgagaaggagtttctctttaacatgtacctgacgcgtgacagaaggtacgaggtcgcccgggtgctgaaccttactgagaggcaggtgaagatctggttccagaacaggaggatgaagatgaagaagatgaataaggaaaagaccgacaaggagcaaagttag

SEQ ID NO: 120124 - DNA, 987 bp, Artificial Sequence
  Description of Artificial Sequence: Synthetic coding sequence
atgtccagttacctcgagtacgttagttgttcctcaagtgggggggtaggaggtgatgtcctctccctagctccgaagttctgcagaagtgatgcacgaccagtggccctgcaacctgcgttccccttgggtaatggagatggggccttcgtcagctgcttacctttggccgctgccagaccttcaccctcacctcctgccgcccccgcccgaccttccgtccccccacctgccgcccctcaatacgcccaatgcacactcgagggagcttatgagcccggcgccgcaccagcagcagcagccggtggcgcagattatggcttcctgggtagcggtcctgcctacgactttcctggagtgcttggcagggcagccgatgatggtggaagtcacgttcattacgctacgagtgccgttttcagcggtggtggttctttcttgctgtcaggccaggttgactacgccgcttttggggagcccggcccatttccagcttgcctgaaagcctcggccgatggacatcctggtgcgtttcaaaccgcttcccccgctcccgggacctaccccaagtcggtcagccccgcatcagggctgcccgccgctttttccacctttgaatggatgaaggtgaaaagaaacgcaagcaagaagggaaagttggccgagtatggagcagcttctccctcgtcagccattcgcactaatttcagcaccaaacaattgactgagctggagaaggagttccactttaacaaatatctcaccagagctcgacgcattgaaatagcgaactgtttacacctaaatgacactcaggtgaagatttggtttcagaaccgtcgcatgaagcagaagaaaagggagcgggagggactgttagcaaccgctatcccagtggctccgttgcagttgcccctgtcgggaaccacccctaccaaatttattaagaatcctggatcgccctctcagtcccaggaaccctcatag

SEQ ID NO: 120125 - DNA, 630 bp, Artificial Sequence
  Description of Artificial Sequence: Synthetic coding sequence
ctcgagcgtgcagccagagtcgagagagccggtggggcagcacagacagccgctgtcctcttgagcctctgccctgcaccgtactccggacccggattgaggccccacctggcctttgcccccggtcgcccacgggcagcagtgagaactgcttcagggcgcgcgcccgtgcgcgctgtccatccagggggcggcctccgaacctggtgtcgcacatgccgcgggagctggggaagaggcctgaggctcccgggggtcagagccggtgtgaggctacctggcagggctggggccggcggaccattccctgcctgcttgaaggcctccgctgacggacatccgggggcattccagactgcctctccagcacctggtacgtatcccaagtcagtgtctcctgcttcaggcctgccagcggcgttctccacatttgaatggatgaaagttaaacggaatgcctccaagaaagacagcggattggggttcgtagaagagacccgcagtcgggccaatagcatggaaagtgctagctctaccgattccgagaatgtgccaggaatcgagaagataagcggaagaagcagcccctggaactttagttggcagacccgccgggtgtgggggcggtag

SEQ ID NO: 120126 - DNA, 1023 bp, Artificial Sequence
  Description of Artificial Sequence: Synthetic coding sequence
atgagtttcccaaattcatcgccggcagcaaacaccttcttagtggactcactgatttccgcatgtaggtcagactctttttacagctccagtgccagcatgtatatgcccccaccctctgctgatatggggacttatgggatgcagacttgcggccttctcccttctcttgcaaaaagggaggtaaaccatcagaacatgggaatgaatgttcacccatatatccctcaggttgatagttggactgaccctaaccgctcatgtcgaatcgaacagccagtgacacaacaggtacctacatgttcctttactactaatattaaagaggagtcaaactgttgtatgtacagcgataaaagaaacaagctaatctctgctgaggtcccctcgtaccagcgtctggtccccgagtcctgtcccgtggagaaccccgaggtgcctgtgcccggctactttcgactgtcacagacctatgccactggtaaaactcaagagtataacaactctccagaggggagctccaccgtgatgctccagcttaaccctaggggcgccgccaaaccacaactgtctgcagcccaattacagatggagaagaaaatgaacgagccagtctcgggccaggagcccactaaggtgtcccaggttgagtcacctgaggcaaaagggggactacccgaggaaaggagctgcctggcagaggtatctgtgtcctcacccgaggtgcaggagaaagaaagcaaggaggaaataaagagcgacacgcccaccagcaactggctaactgctaaatccggacgcaaaaaacgttgcccctacaccaaacatcagacgctcgaactggagaaagagtttctctttaatatgtacttaactcgagagagaaggttggagatatctaaaagtgtgaacctgactgatagacaggtcaagatctggtttcagaaccgacggatgaaattgaagaagatgagccgtgagaacaggatccgggaactgacagctaacttgaccttctcctag

SEQ ID NO: 120127 - DNA, 1017 bp, Artificial Sequence
  Description of Artificial Sequence: Synthetic coding sequence
atgaatgattttgacgaatgcggccagagcgccgcatccatgtacctgcccggctgtgcttactacgtcgcgccatccgatttcgctagcaaaccaagcttcttgagtcaaccgtcaagttgccagatgacgttcccgtactcctccaatttagcccctcacgtgcagcctgtgcgggaagttgccttccgagactatgggttggaaagagcgaaatggccatatagaggtggcggcgggggaggctctgctggcggaggcagtagcggagggggccccgggggtggaggcgggggagctggcgggtatgcaccttattatgccgcagccgccgccgccgccgcagccgccgccgctgctgaggaagccgcaatgcagcgggagttgctgccacccgccggccggagacctgacgttctttttaaagcgcccgagcctgtatgtgcagcccccggcccaccccatggccccgccggggcagcgagcaatttttacagcgctgtcggcaggaatggcatccttcctcaggggttcgaccagttctatgaagcggctccaggacccccttttgcaggacctcagccccctccgcctccggcccccccccagccggaaggggccgccgataaaggggatcccaggacaggagcaggaggcggcggggggtcgccctgtacaaaggccactccgggcagtgagccgaagggcgccgcagaggggtccggcggcgatggggagggcccccctggcgaagccggggccgagaagtctagtagcgctgttgccccacagcggtccagaaagaagcgatgtccttataccaaataccagattcgggagttagagcgcgagttttttttcaatgtgtacatcaataaggagaagcggctgcagttgagccgaatgctgaatctgacggatcgtcaggtgaagatctggttccagaatcgcagaatgaaggaaaagaaattgaatagagacagactccaatatttcaccggcaaccccctgttttag

SEQ ID NO: 120128 - DNA, 480 bp, Artificial Sequence
  Description of Artificial Sequence: Synthetic coding sequence
atgtacctaccaggttgtgcatactatgtggccccttccgattttgcttccaagccatccttcctgtcccagccgtcaagctgccagatgactttcccgtactcttcgaacctggcgcctgggggtggctccccatgcactaaagctaccccaggaagcgaacctaagggagctgccgaaggctccggaggcgatggcgagggccctcctggggaggcgggggcggaaaaaagtagctctgcggtagcaccacagaggtctcggaagaagcggtgcccttatacaaaatatcagattcgcgagctcgagcgtgagttctttttcaatgtttatattaacaaggagaaacgtctgcaacttagcagaatgctcaacctgaccgacaggcaggtgaaaatatggttccagaatcggcggatgaaagagaagaaattgaacagagatagactacagtacttcaccggcaatccactcttttag

SEQ ID NO: 120129 - DNA, 813 bp, Artificial Sequence
  Description of Artificial Sequence: Synthetic coding sequence
atgtgcgagcggtcgttgtatcgggctggttacgtgggatccctgctgaaccttcagtcccctgacagcttctacttttccaacttaaggccaaatggcggacagcttgccgcgctgccccctatatcgtacccccgcggagctcttccatgggctgccacccccgcttcctgcgcaccagcccagcctgccggagccaccgctttcggcggattttcgcaaccttacctagccgggtctgggcccctggggcttcagccgccaacagctaaggacggtccggaagaacaggcaaagttctacgcccccgaagctgccgctggacctgaagagcgcggccgcacacgccctagcttcgcccccgagagttcactcgcccccgcagtggctgccctgaaggccgctaaatacgactacgccggcgtgggcagagcaactcctgggtctacaaccctgctccagggggctccatgcgctcccgggttcaaggacgacacaaaagggcctcttaatctgaatatgaccgtgcaagctgccggggtggcctcctgcctgcgaccttccttgccagacggactaccttggggcgcggcaccaggccgagctcggaagaaacgtaagccttacaccaagcaacagatcgccgagctggaaaatgagttcctggtcaacgagttcatcaaccggcagaaaaggaaggaactcagtaatagactgaacctctctgaccagcaagtgaagatttggtttcagaacaggcggatgaaaaagaaacgtgtagtgctacgggagcaggctctcgccctgtactag

SEQ ID NO: 120130 - DNA, 1299 bp, Artificial Sequence
  Description of Artificial Sequence: Synthetic coding sequence
atgctttttgaacaggggcagcaggctctggagctgccagaatgcacaatgcaaaaggctgcatactacgagaaccccggactgtttggagggtatggctactccaaaaccactgacacctatggctatagcactccgcaccaaccttaccctcctcctgccgccgcctcgtctctagacaccgattacccgggaagcgcctgttctattcagtcatctgcccctctgcgggcgcccgctcacaagggtgccgagctgaatggctcatgcatgagaccaggcaccggaaattctcaggggggcggtggcgggtcacagccgccaggactgaactctgagcagcaaccgccccagccgccgcctccacctcctacactgccacccagcagtcctaccaatccaggaggtggcgtgcccgccaaaaaacctaaaggcgggcccaacgccagtagttcctcagccactatatctaaacagatctttccctggatgaaggagtccaggcagaacagcaaacaaaagaattcttgtgccacagctggggaaagttgcgaggacaagtcacccccgggtccagcatccaaaagagtacgcacggcgtatacatccgcacagctagtggaactggaaaaggaattccacttcaatcgttacctctgcagacctcgtagagtagaaatggctaacctcctgaaccttaccgaacggcaaattaagatctggtttcaaaaccgaaggatgaagtacaagaaagaccagaaagcaaagggaatactgcacagcccagctagtcagagtccggaaagatccccacccttgggaggtgcagccggccacgtggcctattcaggtcagttgccccctgtccccggcctggcttacgacgcaccatcgcctccggcgtttgctaagtcacagcccaacatgtatggcttggctgcctacaccgcaccactgtccagttgcctacctcagcaaaaacgatatgcagcaccggagtttgaaccacacccaatggctagcaacggcggtggctttgcatctgccaatctgcagggaagtccggtttacgtgggtgggaattttgtggaatctatggccccggcaagcggacctgtgttcaacttgggccacttatcccatccatcctctgcatctgttgactacagctgtgctgctcaaattccgggcaaccaccatcacggaccctgtgatccccaccccacctatacagatctgtctgcgcaccactcttcccagggcaggctacccgaagcacctaagctgacccatctgtag

SEQ ID NO: 120131 - DNA, 1299 bp, Artificial Sequence
  Description of Artificial Sequence: Synthetic coding sequence
atgcttttcgaacagggacagcaagccctggagttgcccgaatgtaccatgcagaaggccgcctattacgaaaatcccggcttattcgggggctatggttactccaaaacaaccgacacatatggctacagtacacctcatcagccgtaccctcccccagctgctgcatcttctctcgatacagattatcccggcagcgcctgtagcatccagtcttcagcaccactgcgcgctcccgctcacaagggagccgaactgaacggaagttgtatgcgcccaggcactgggaactcccaaggcggcggtggtggatctcagccacctggactgaactcggaacagcaaccaccccagcctccacctcccccaccaaccctccccccaagttctccaaccaaccctggagggggcgttcccgcgaaaaaaccaaaaggcgggcccaacgctagcagctctagtgccacaatatcgaagcagatctttccatggatgaaggaaagtagacagaattcaaagcagaagaatagctgcgcgaccgccggtgagtcttgtgaggacaaatcaccgccagggcccgctagcaagcgcgtgcggacagcatatacgagcgctcagctggttgagctggagaaggagtttcacttcaaccgctatctctgtaggcctcggcgcgtagaaatggccaatctcctgaatctgacagagcggcagatcaagatatggttccaaaataggagaatgaagtacaagaaagatcagaaagccaagggaattctgcattcccccgcatcccagtcccctgagaggagcccgcctttagggggggctgccgggcatgtggcatactccggacagcttcctccagtgcccggtctggcctatgatgcccctagtcctcccgcatttgccaagagtcaacccaatatgtatggcttagctgcttacaccgccccattgagctcttgtttaccccagcagaaacgatacgcggcgcccgagttcgaaccccacccaatggctagcaatggggggggcttcgcatcagcaaacctgcaggggtctccagtctacgtgggaggaaactttgtcgagtcaatggctcctgcctctggcccagtatttaatctgggccatctcagccatccgtcctccgcttccgtggattattcatgtgccgctcaaattccaggaaaccatcaccatggtccttgtgatccccatccaacttatacagacctgtctgcacaccattccagtcaaggcaggctccccgaggctcctaagctcacccatctgtag

SEQ ID NO: 120132 - DNA, 303 bp, Artificial Sequence
  Description of Artificial Sequence: Synthetic coding sequence
atgctcttcgagcagggacaacaagctctggaactgcccgaatgcaccatgcagaaggctgcctactatgagaacccagggttgtttggaggatacgggtattcaaagactaccgatacttacggatacagcactccccaccagccttacccgcctcctgccgctgcgtcctccctcgataccgactatcctgggagcgcttgtagcatacagagttccgccccactgagagccccagctcataaaggcgcagaactgaatggttcttgcatgcgcccaggcaccggcaactcgcagggatag

SEQ ID NO: 120133 - DNA, 1299 bp, Artificial Sequence
  Description of Artificial Sequence: Synthetic coding sequence
atgctgttcgaacagggccagcaggccttagagctgcccgaatgtactatgcagaaggccgcttactacgaaaatccgggcttgttcggtgggtacggctactctaagactacggatacctacggatatagcacaccccaccaaccttatccccctccagctgcggcaagtagccttgacaccgactatcccggctccgcctgcagcatccagtccagcgcccccctcagagctcccgcccacaaaggggctgagttgaatggtagctgtatgcggcccggcaccggcaactcacagggaggcgggggcggttcgcagccccctggactcaacagcgaacagcagccacctcagccccctccaccacccccaacccttccaccctcctcccctactaatcccggcgggggcgtgcctgccaaaaagccgaaaggaggccccaacgcttcttcctcctctgctacaatctccaagcaaatttttccctggatgaaggaaagcagacaaaactcgaaacagaagaatagctgcgccacagcaggggaatcatgcgaggataaaagcccaccaggacctgctagtaagagggtgcgcacagcctacacctccgctcagcttgtagagctcgaaaaggaattccatttcaatcgctacctctgtagaccacggcgcgtcgaaatggctaacctgctgaatcttacagagcggcaaattaagatctggtttcagaaccgaagaatgaaatataaaaaagaccaaaaggccaaagggatcctgcattccccagcctcacagtcacccgagcgcagcccccctctgggaggggctgcgggacatgtggcatattcaggccaattaccgcccgttcccggtctcgcttacgatgccccttcaccccccgcttttgcaaaatctcagcctaatatgtacggtctcgccgcatacacagcaccgctctcttcttgcctgccccaacagaagaggtatgctgcaccagaattcgagccccatcccatggcctccaatggcggagggtttgcttccgcaaatttacagggctcgccagtctacgtgggaggcaactttgtggagtctatggcccccgctagcggtccggtcttcaacctcggacacctgagccatccttccagcgcctctgtagactactcctgcgctgcgcagataccggggaatcaccaccacggcccttgcgacccccacccaacatacacggacctgagcgctcaccatagctctcaagggaggctgcccgaagctccaaaacttacacatctttag

SEQ ID NO: 120134 - DNA, 768 bp, Artificial Sequence
  Description of Artificial Sequence: Synthetic coding sequence
atggttatgtcatcttacatggttaatagcaagtacgtggaccccaagttcccaccctgtgaggaatatctccagggcgggtatctgggggagcagggagctgactactacggcggcggagcccaaggcgctgacttccagcctccagggctgtacccaaggcccgattttggcgaacagcctttcggaggctcaggacctggcccaggttcagccctgcccgcccgcgggcacggccaggagcccgggggccccgggggtcactacgccgcccctggcgaaccatgtcctgccccaccagccccgccgcccgcgcccctgcctggtgccagagcttattctcagtcagacccaaagcagccaccatccggcaccgcccttaagcaaccagccgttgtttatccctggatgaaaaaggtccacgtgaacagtgtcaaccccaactacacgggaggagaaccaaaaaggtccagaactgcttacactcgtcaacaggtgttggagcttgagaaggagttccattttaatcgttacttaacccggcggaggaggattgagatagcacatacgctgtgcctatcagaacggcagatcaagatatggttccagaaccgcagaatgaaatggaaaaaagatcacaagctcccaaacactaaaggacgatctagctcatccagcagttcaagctcctgcagctcaagcgtggcgccctcacagcatctccaaccaatggcaaaggaccaccatacagatctgacgactctctag

SEQ ID NO: 120135 - DNA, 873 bp, Artificial Sequence
  Description of Artificial Sequence: Synthetic coding sequence
atgagttcatactttgtgaaccccctttactccaaatataaggctgccgccgctgctgcagccgctgctggagaagctataaatccgacctattacgattgccattttgctccagaggtgggtggtaggcacgctgctgccgctgctgctctccagctgtatgggaacagtgccgccggcttcccacacgcccccccacaggcacacgcccatccccatcctagccctcccccaagtggcacaggctgtggggggagagagggtcgaggccaggaatacttccaccccggaggcggcagtccggcagccgcgtatcaagctgccccgcctcctcccccacatcccccacccccacccccaccccctccctgcgggggcattgcctgtcacggtgaacctgcaaagttttacggatacgacaacttacaacgccaaccgatcttcacgacgcagcaggaagcggaactcgtccagtaccctgactgcaaatcttcctccggcaatataggcgaagacccggatcaccttaatcaatccagtagcccatcacaaatgttcccttggatgcgcccacaggccgcgcccggacgccggcggggccggcagacatactccaggtttcaaacccttgagctggagaaggaattcctcttcaatccctacctcacccggaaacgaagaatcgaggtatctcacgccttagctctcacggaaaggcaggtcaagatatggttccagaaccgaagaatgaaatggaaaaaggaaaacaacaaagacaagttccccgtaagccgccaagaagtcaaggatggcgagacgaaaaaggaagctcaggagctcgaggaggacagggcagaaggcctgaccaactag

SEQ ID NO: 120136 - DNA, 870 bp, Artificial Sequence
  Description of Artificial Sequence: Synthetic coding sequence
atgtcttcttacttcgtgaaccctttgtatagcaagtataaggccgccgccgcggcagccgccgccgctggtgaagccatcaatcccacatactacgactgccactttgcccctgaggtcggcggaagacatgctgcagccgccgccgcccttcagctctatggtaattccgccgccgggttcccacacgcacctcctcaggcacacgcgcacccccacccatctcctcccccctcaggcaccggctgcggagggcgagagggacgaggccaagagtatttccaccccgggggtggatctccagccgccgcctatcaggctgctcctccgccgcccccccatcctcccccacctcctccaccgcccccttgtgggggaatcgcttgtcatggtgagccagcaaagttctacgggtacgacaacctgcaacgccaacccatattcacaacgcagcaggaggccgagctcgtgcagtatcccgattgtaaatcctcctctggaaacatcggcgaggatcctgaccacttaaaccagagctcttccccctcacagatgttcccgtggatgaggccccaggcgccgggccggagaaggggccgacagacctactctcggtttcagacattagagctggaaaaggagtttctgtttaatccgtacctaactcggaagcgcagaattgaagtatcccatgcactagccctgaccgagcgccaagttaagatttggttccagaatagaagaatgaaatggaagaaggagaataataaagacaaatttccggttagccgccaagaggtcaaggacggcgaaactaagaaggaagcccaggagctcgaagaggacagagctgagggactgaccaactag

SEQ ID NO: 120137 - DNA, 870 bp, Artificial Sequence
  Description of Artificial Sequence: Synthetic coding sequence
atgagctcctattttgttaaccccctgtacagcaaatacaaggcagctgccgccgctgcagccgcagccggcgaggccattaatcctacctattacgactgtcattttgcccctgaagttggcggcagacacgctgccgctgcagccgccctccagctgtacggtaattctgcggcgggcttcccgcatgcacctccacaggctcacgcccatccccatccaagcccccctccttctggaacagggtgtgggggccgcgaagggcgggggcaggagtactttcatccaggtggcggcagccctgccgccgcataccaggcagctcccccaccccccccccatcctccaccaccacccccccccccgccatgtggtggaatcgcctgccacggggagcctgcgaagttttatggatatgacaacctgcagcgccagcctatctttaccacccaacaggaagccgagctggtgcaatatcccgattgtaagtcttcctccggtaacattggtgaagatcccgaccacctgaaccaatctagcagccctagtcagatgttcccctggatgagaccacaggctcccgggaggcgacgtggtcgccagacctactccagattccagactttagagcttgaaaaagagttcctgttcaacccatacctcacaagaaagcgccgtatcgaagtgagccatgccttggccttaaccgaaaggcaggtcaaaatttggtttcagaacaggcgcatgaaatggaagaaggagaacaataaagataagttccccgtgtcaagacaggaagtaaaggatggtgaaacaaaaaaagaggctcaagagcttgaggaggaccgcgctgagggtttgaccaattag

SEQ ID NO: 120138 - DNA, 321 bp, Artificial Sequence
  Description of Artificial Sequence: Synthetic coding sequence
atgtttccctggatgcggccgcaggcggctcccgggcgacgtcgcggtcgtcagacctacagccgctttcagaccctcgaactggagaaggagttcttgtttaacccatatctgaccagaaagaggcgcatcgaagtctcccatgctctcgcgctgaccgagcggcaagtcaagatatggtttcagaaccgtcggatgaaatggaagaaggaaaataacaaggataagttcccagtgtctcggcaggaggtaaaagacggggagactaagaaggaggcccaagagttggaagaggaccgggcagaaggattaaccaactag

SEQ ID NO: 120139 - DNA, 1059 bp, Artificial Sequence
  Description of Artificial Sequence: Synthetic coding sequence
atgttggggggatccgcaggccgtttaaaaatgagttcttctgggaccctttcaaattactacgtggactcactgattggacatgagggtgatgaggtattcgccgccaggtttgggcctcccggtccaggcgcccaggggcgacccgcgggcgtggccgacggacctgccgctacagcagccgaatttgcttcctgtagtttcgctcccaggtctgctgttttctcggcaagttggagcgcagtccctagtcaaccgcccgccgctgccgccatgtccggcttgtatcacccatatgtgccaccaccacctctagccgcatccgcttcagagccaggtcggtacgtacgatcttggatggaaccactgcccggattccccgggggggccggcgggggggggggcggcggcggcgggggacccgggcgagggccaagcccagggccaagcggacctgcaaacgggcgtcattacggcatcaaacccgaaacaagggccgcccctgcacccgctacagccgccagcactaccagctcgtcctccacctccctgtcaagttcttccaagagaacagagtgttctgtcgcccgcgagtcacaaggaagctccgggcctgagttttcttgtaattcttttctgcaggagaaggcagcggcagcgaccggcggaactggtcctggcgcaggcatcggagccgctacaggcacaggcggcagttcagagccctcggcttgcagcgaccaccccatccctggctgctccctgaaagaagaagaaaagcagcactctcagccacagcagcagcagcttgaccccaataatcctgctgctaattggatccatgcgaggtccactcgtaagaagcgatgtccatacaccaaatatcagacactcgaattggagaaagagtttctgttcaatatgtatttaaccagggatagaagatatgaggtggcaagaatactgaatctgacagaaaggcaggttaaaatctggttccagaaccggagaatgaagatgaagaagatgtctaaggagaaatgcccaaagggtgactag

SEQ ID NO: 120140 - DNA, 2757 bp, Artificial Sequence
  Description of Artificial Sequence: Synthetic coding sequence
cttcagcccgtgtatgaatctatggcctcccacgtgcaggtattctctccccataccctgcagtctagtgctttctgttccgtaaaaaagctgaaaatcgaaccctcctccaattgggacatgactgggtatggcagccatagcaaggtgtattcccaaagcaaaaatattccactgtctcagccagccactacaactgttagtacctccctgcctgtgccaaacccttcgttgccctacgaacagaccatcgtcttccctggctcaacagggcatatcgtggttacatccgccagctctacctccgtgacgggacaagtgcttggagggccacataacctgatgcggcgctctacagtgtccctcttagacacctaccaaaaatgcggcctcaaacgcaaatcggaggagatcgaaaacacatcgtctgtacagatcatcgaggaacaccctccaatgattcagaataacgccagcggcgccaccgtggccaccgccacgactagcaccgcaacatcaaaaaactccgggtctaacagcgaaggggattatcagctggtccagcacgaagtgctatgcagcatgacgaatacctatgaggtgctcgagttcctggggcggggtacatttggacaggtggtgaaatgttggaagcgagggacaaatgaaattgtggcaataaaaattcttaagaaccacccaagctatgcccgacagggccagatcgaagtgtcaattttggcccgcttgagtaccgaatctgctgacgactataactttgtcagggcctacgaatgcttccagcacaagaatcacacttgtctggtctttgagatgcttgagcagaacttgtacgacttcttgaagcagaacaagttcagccctctgcccttaaagtacatcaggcccgttttgcagcaggttgcaactgctttgatgaagctgaaaagcctggggctcattcatgctgacctgaaacccgaaaatatcatgttagtcgacccctcccgtcagccttacagggtgaaggtgattgatttcggatccgccagccatgtttctaaggctgtgtgcagcacatatctgcagagcagatactaccgcgctccggagataatcctgggcctgccattctgtgaggcaattgatatgtggtcactgggctgcgtcatagccgagctctttctcggctggcccctgtatcctggggcctcagagtacgatcaaattcgctatatctcgcagacacaaggcctgccagcagaatacttacttagcgcaggaaccaagacgacccggttctttaaccgagataccgacagcccttaccctctgtggaggctcaagactccggacgaccacgaggctgaaactggaatcaagagtaaggaggctaggaaatatatctttaactgtctggacgatatggcccaagtgaacatgactaccgatctggagggttctgacatgttggtggaaaaagctgacaggcgggagtttattgacctactgaaaaagatgctgaccatcgacgccgataagaggatcactccaattgaaacattgaatcatccctttgtgaccatgacccacctcctagacttcccccacagcacgcacgtaaaatcttgcttccagaacatggaaatctgtaagcggagagttaacatgtatgacaccgtgaatcagtcaaagacaccctttataacgcatgtggcaccgagcaccagtacaaacctgactatgaccttcaacaaccaactgactacagtgcacaatcaggcaccaagctcaacctccgctactatttccctggccaacccagaggtgtccattctgaactacccaagcacactgtaccaacccagcgccgcttctatggctgccgtggcccagagatcaatgcctctgcagacgggcactgcccagatatgcgccaggccggatccatttcagcaggcgctgatcgtgtgtccacctggattccagggccttcaggcctctccctctaagcacgccggatatagcgtgaggatggaaaatgccgtgcccattgtcactcaggcaccaggcgcacaaccattgcagatacaacctggcctcctggctcagcaagcatggccttctggaacgcagcagatcctcctgccccctgcttggcaacagctgacgggcgtcgccactcacacaagtgtgcaacacgccaccgtgatccccgagactatggccgggacccagcagttagcagattggcgaaacacacatgcgcacggttcccattacaatcctatcatgcagcagcctgctttactgacaggccatgtgacgctgccagccgctcagcccttgaatgtgggggtggctcacgtaatgagacagcaacctacctccactactagctctaggaaatcaaaacagcaccagtcaagccagaggaagaacgtgatctcctgcgtgaccgtgcacgactcaccttacagcgattcctcttcgaatacaagcccttatagcgtgcagcagagggccggccataataacgccaatgctttcgataccaaaggaagcctggaaaaccactgtaccggcaaccctaggactatcatcgtgcctcctctgaagacacaggcttcggaggtgctggtagaatgcgattctttggttcccggcaacctgggacctggccagggccgcaatctcagcctcgagagcgggttccccgcattcctgctgctggaaatgctcctttacggatcctag

SEQ ID NO: 120141 - DNA, 3597 bp, Artificial Sequence
  Description of Artificial Sequence: Synthetic coding sequence
atggctcccgtttacgagggcatggctagtcacgttcaggtatttagcccacataccctgcagtctagcgctttctgctctgttaaaaagctgaaaatcgagccctcctccaactgggacatgaccggctacgggtcccacagcaaggtctattctcagagcaaaaacattcccttgagccaaccggctacaactaccgtctcaacatctctgccagtccccaatcctagccttccctacgagcagaccatcgtgtttccagggagtacagggcatattgtcgtcacttccgccagcagcaccagcgttacaggtcaggtactgggcggccctcacaacctgatgaggcggtccacagttagcttgctggatacctatcagaaatgcggactgaagcgtaagagcgaggagatcgaaaatacctctagcgtccagatcattgaggaacatccaccaatgatccagaataatgccagcggagcgaccgtcgctactgctaccacgtccaccgccacctcaaagaacagtggtagcaatagcgaaggcgactatcagcttgtccaacatgaagtgctatgttccatgacaaacacatatgaggtgcttgagttcctggggaggggcacttttggccaagtcgtcaagtgttggaaaagaggaaccaacgaaattgtggccataaagattctcaagaaccatcccagctacgcccggcagggccagatcgaggtatccatattggcacgcctgtcaaccgagtccgctgacgattacaattttgtccgggcttacgaatgctttcaacataagaatcatacttgtttagtgttcgagatgttagagcagaacctgtacgattttctcaagcagaacaagtttagccccctgccacttaaatacattcggcccgttctgcagcaagtagctaccgccttgatgaagttaaagtcacttggccttatccacgctgacctgaagccagagaatataatgcttgtggaccctagtaggcagccatacagggtcaaggtcattgacttcggatctgcttcacacgtgagtaaggctgtatgctcaacttatctgcagagtaggtactatagagcaccggaaatcatcctaggcctcccattttgcgaggcaattgacatgtggtccctgggttgcgtgatcgccgagttgtttctgggttggcccttgtaccccggcgctagtgaatacgaccagataaggtacatttcgcagacacagggacttccagcagaataccttttgagcgctgggactaaaaccaccagattcttcaatagagatacagactccccgtacccactgtggcgcttgaagacacctgatgatcatgaggctgaaactgggatcaagtcaaaagaagcacgtaaatacatatttaattgtctggacgatatggcccaggtaaatatgactactgatcttgagggtagtgacatgctggtggaaaaagccgacagacgggaatttatagatctattgaagaagatgctgactattgacgccgacaagaggataacccccattgaaactctcaaccacccgtttgtgaccatgactcacttactcgacttcccccattccacacacgtcaaatcttgtttccagaacatggagatttgtaagcgccgcgtgaatatgtacgacactgttaaccagtcaaaaactcctttcattacccatgtggctcctagtacctcaaccaacttgaccatgactttcaacaaccaactgaccaccgtgcacaatcaggctccttcaagcacgagcgccaccattagtcttgccaacccagaggtctcgatactgaactacccctctaccctatatcagccttccgctgcctcgatggctgctgtcgcccagcgctccatgccactgcagactggcacagctcagatttgcgcccgccccgatccttttcagcaggctctgattgtctgtcctcctggttttcagggactccaggcgtcaccatcaaagcacgcagggtattctgtcaggatggagaacgctgtgccgattgtgacccaggcacccggggcgcagccattgcaaatccagccaggcctgctcgctcagcaggcttggccctctggcacccagcaaatccttctgccccccgcatggcagcaacttacgggggtggccacccacactagtgtccagcacgctactgtcatcccagagactatggctggcacccagcagctggctgactggcgaaacactcacgcacatggcagccactacaatccaattatgcagcagcctgcacttctgaccggccacgtcactctgccagccgcccagccattgaatgtgggcgtggcccacgtcatgcgtcagcagccaacttctactacctcttctcgtaagagcaagcagcatcagtcatcagtgcgcaatgtctctacttgtgaagtgtctagctctcaggcgattagttcacctcagcggtcaaagcgcgtgaaggagaataccccacctcggtgtgccatggtacactcctcaccagcttgcagcacatctgtcacatgtggatggggggacgtcgcgtcctcgactacacgagaacggcagcgccagaccatcgtcatccctgacactccaagcccaacggtgagtgtgataactataagttctgataccgatgaggaagaagaacagaaacacgccccgacttcaactgtcagcaagcagcgcaaaaacgttatctcctgcgttactgtgcacgatagtccttactccgattccagttcgaatacgagtccttactccgtccagcagcgcgcagggcacaataatgcaaacgcatttgacactaaaggctcactggaaaatcactgtaccggcaatcctcggactatcatagtccccccactcaaaacccaagcttccgaggtcctggttgaatgcgatagcctggtcccggtaaatacttcacaccactcttcctcgtataagagcaagtccagttctaacgttacaagtaccagcggccacagttcaggctcctcctccggcgcaattacatatagacaacagcgccccgggcctcactttcagcagcagcagccgctgaacctttcccaggcccagcagcatatcaccacagataggactgggtcgcaccgacgtcagcaggcatatatcacacctactatggctcaggcaccttatagctttccacataatagcccatcccacgggacagtgcatccacacttggctgctgcagccgctgccgcacacctgccgacccagcctcacttgtacacctacactgcccctgcggcactgggctctacaggcactgtggcgcacttagtagctagtcaggggagtgcccggcacacagttcaacacacagcctaccctgcctctattgtccaccaggtgcccgtaagtatgggtcctagggtactgccctctcccacgatccatcctagccagtaccctgcgcagttcgctcaccaaacttatatttcagcttcacccgcatccacagtgtatactggataccctctctctcctgcgaaggtgaaccagtacccatatatttag

SEQ ID NO: 120142 - DNA, 3516 bp, Artificial Sequence
  Description of Artificial Sequence: Synthetic coding sequence
atggcccccgtctatgaaggcatggcttctcacgtccaagtattttccccacatacgctgcagagttccgccttctgttcagtcaagaaattgaagattgaaccctccagtaattgggatatgacagggtatggttcacactcaaaggtatactctcagtccaagaatattcccttaagtcagcctgctaccactaccgtgtctacttcattgcctgttcccaatcccagcctgccttacgaacaaactatcgtattccctggatccaccggccatatcgtagtgacgtctgcgagctccacatctgtgactggacaagttctgggcggacctcacaatctgatgagacgctctacggtctcccttctggacacataccagaaatgcggattaaaacggaaatctgaggaaatcgaaaacactagctctgtccagattatagaagaacacccaccaatgatacagaacaacgccagtggcgcgacagtggctacagctaccacatcaactgctacttccaaaaactcgggatccaattctgagggggattatcaactggtgcagcatgaagtgttgtgttccatgacaaatacctacgaagtgctggaattccttggcagagggaccttcggtcaggttgtaaagtgctggaaacgagggacgaatgagatcgtagcaatcaagatccttaagaaccacccatcttacgcccggcaaggtcagatcgaggtctctatccttgcacgactctcgactgagtctgctgatgactataattttgtcagagcttacgaatgttttcagcataaaaatcatacctgcctcgtgttcgaaatgctggagcagaacctgtacgactttctgaagcagaacaagttcagtccgctaccgcttaaatatattcgccccgtgctccagcaggtcgccaccgcactgatgaaactgaagtccctcggtctaatccatgctgacctcaagcctgagaacatcatgctcgttgatcccagcagacagccctaccgggtgaaagtaatcgacttcggatctgcgtctcacgtatcaaaggctgtgtgctccacctaccttcaaagcaggtactatcgagcacctgagattatcttgggtttaccgttctgcgaagctattgacatgtggagcctggggtgcgtcatcgctgagctcttcttaggatggccactttaccccggtgcctccgagtacgaccagatacgctatatctcacagacacagggcctgccagcagagtatctcctctccgctggaacaaaaactacacggtttttcaaccgagacactgacagcccctacccactatggagactgaaaactcccgacgaccacgaggcagagaccggcattaagagtaaagaggcccggaagtatatctttaactgcctagacgacatggcacaagtcaacatgaccaccgacctggaagggagcgacatgctggttgagaaagcagataggagagaatttatcgatctgctgaaaaagatgctgaccatcgatgccgacaagcgcattacaccaattgagaccctgaaccatccattcgtgaccatgacacatttgctagacttcccgcatagcacacacgttaagtcctgtttccagaacatggaaatctgcaaacggcgtgttaacatgtacgatactgtcaaccagagcaagaccccttttattacacacgtcgccccttccaccagcacaaacttgaccatgacctttaacaaccagctgaccacagtccataatcagcccagcgccgcctcgatggctgcggtcgctcagaggagcatgcccctccaaacaggaacagcgcagatctgcgctcgtcctgacccatttcagcaggcactaattgtgtgccccccaggatttcagggactccaggcatccccatctaagcacgccggatactccgttagaatggagaacgcggtcccgattgtaactcaggctcccggggctcagcccctgcagatacaaccgggcttactggcacagcaggcgtggcctagtggcacccagcagatcttgctcccccccgcttggcagcagctgacaggagtggccacccacaccagtgtacagcatgccacagtgattcctgaaaccatggctggaacacagcagctggccgactggcgcaacacccacgcccacggcagccactacaacccgataatgcagcaaccagcccttctgaccggacacgtaacacttcccgcggcccagcctctgaatgtaggtgttgctcacgtgatgcgccagcagccgacttcgacaactagttctagaaaatccaaacagcatcagagctccgtacgaaacgtgtctacctgtgaagtcagctcgagtcaggcaatcagtagtcctcagcgttccaagcgcgtgaaagaaaatacgccacctcggtgcgccatggtccatagttcccctgcctgctccacatcagtaacctgcggctggggtgacgtggcttcaagcaccacccgcgagagacaaaggcaaacgatagtgatcccagacaccccctctcctacagttagtgtcattacaattagcagtgacacggatgaagaggaggagcagaagcacgcccccacaagcactgtgtccaagcagcgaaagaacgtgatctcctgtgtaacagtccacgatagtccttattccgattctagctccaatacctccccatatagcgttcagcagcgagccggacacaacaacgctaacgcctttgacacaaaggggtccctggaaaatcattgtacaggaaaccctcgaacaatcatagttccacccctgaaaacgcaggcttccgaagtcctggtggagtgcgatagtttagtgccagtaaataccagccaccacagtagcagctacaagagcaagtcatcatcaaatgtgacatccacatccggtcacagctcagggagcagctccggcgctattacctataggcaacaaagacctggcccacactttcagcagcagcagccactcaacctgtctcaggctcagcagcatatcactacggacagaacaggatcccataggcggcaacaagcttatatcacaccaacaatggctcaggccccctacagtttcccacacaactctccatctcacggaacagttcatcctcatctggcggccgccgctgcagctgcacacctgcctacccaaccgcatctgtatacttatactgccccagcagcattaggttcaactgggaccgtggcgcatctcgtggcgtcccaagggtctgcgcgccatacagtccagcacaccgcctaccccgctagcattgtccaccaagtccccgtgtctatggggccaagggttctaccttcgccaaccatccatccatcacagtatcctgcccaattcgcccaccagacatacatttccgcttctcccgccagcacagtgtatacaggatatcctctgagccccgccaaggtgaaccagtatccatacatctag

SEQ ID NO: 120143 - DNA, 3648 bp, Artificial Sequence
  Description of Artificial Sequence: Synthetic coding sequence
atggcgtcgcaagtgctggtatatccaccctacgtttatcagactcagtcctcagctttctgcagtgttaaaaaactcaaggttgagcccagtagttgcgtgttccaagaacgaaactacccacgcacgtacgtgaacggccgaaacttcggtaatagtcacccccccactaaggggtctgcttttcaaactaaaatccctttcaacagaccacggggccacaatttctcccttcaaaccagcgcggtcgtgctgaagaacacagcaggcgcaaccaaggtcatcgcagcacaggctcagcaggctcacgtgcaggcacctcaaattggcgcctggcgaaaccggttgcatttcctggagggccctcagcggtgtggcctgaaacgaaagtccgaagagctggataaccattcctctgccatgcaaattgtggacgagctatctatccttcctgccatgctacaaacaaacatgggcaacccggtgactgtagtcaccgccaccacagggtcgaaacagaactgcactaccggcgaaggtgattaccagctggttcagcacgaagtgttgtgctctatgaagaatacgtatgaggtcctcgattttcttgggaggggcacattcggacaagtggtgaagtgctggaaacgaggaactaacgagatcgtggcaattaaaattcttaagaaccacccgtcatatgcccgccagggccaaatcgaggtgtcaatcctggcccgactgtcaaccgagaacgccgacgaatacaattttgtgagagcatatgagtgcttccaacatagaaatcacacttgtttagtcttcgaaatgctggaacagaatctttacgacttcctcaaacagaacaagttctcacctctcccacttaaggtgatccgccccatcctgcagcaggttgcaaccgcgctgaagaagctgaagtcattagggctgatacacgccgatctcaagcctgagaacattatgctggtagaccccgttaggcaaccctaccgggtgaaagttatcgacttcggctcagctagtcatgtttcaaagaccgtttgtagcacatatttgcagagccgatactatagggcccctgagatcatcctcgggctccctttctgtgaagccatcgacatgtggtcgctgggatgtgtcatcgcagagctgtttctggggtggccactctacccaggtgccttagaatatgatcagatacgctacatatcacagacccagggcctacccggtgagcagctgctgaatgtgggaacaaagtcaactagattcttctgcaaagagaccgacatgtcccacagtggctggagactgaaaactctggaggagcatgaggccgagaccggtatgaagtctaaggaggctagaaaatacatatttaatagcctggacgatgtggctcatgttaatactgttatggaccttgagggcagcgacctccttgccgagaaggcagaccgtagagagtttgtctccctgttaaagaaaatgctgttgatagacgctgacctgcgtattacacctgctgagacactcaaccatcctttcgttaatatgaaacacctgctggattttccccactccaaccacgttaaatcttgtttccacatcatggacatctgcaagtctcacttgaattcctgtgacacaaacaaccacaataaaactagcttgctccgtcctgtagcgagctcttccactgccaccctgacagccaacttcactaaaataggcacattgcgaagtcaggccctgaccactagcgctcattctgtcgttcaccacggtattccccttcaggccgggaccgctcaattcggctgcggggatgcattccagcagacgctcataatttgcccccccgctatacagggtatacccgcgactcacggaaagcccaccagctactccattcgagtggacaatacagttccacttgtgactcaggcccctgccgtgcagcccctgcaaatcagacctggtgttttatcccaaacgtggtctggccgtacccagcagatgcttgtgccagcctggcagcaagttactcctctggcccctgccactacaacgctgacgtctgagagcgttgcgggctctcataggctgggtgactggggaaagatgataagctgttccaaccactacaatagcgttatgcctcagcctctcctgactaatcagattacattatcagcgccccagcctgtatccgtaggaatagcacatgtggtttggccacagccagccacaaccaaaaagaacaagcaatgccaaaatagaggaatcttggtaaagttgatggaatgggagcccgggcgggaggagattaatgcattttcctggagcaactccctgcaaaataccaacattccacactccgccttcattagccccaagatcattaacggaaaggatgtggaggaagtttcctgtatagagacacaggacaaccagaatagcgagggagaagcacgtaattgctgcgagacatccatcaggcaagattctgactcctcggtgtccgataagcaaaggcaaactatcatcatcgctgactcccccagcccagctgtgtcagtgattaccatcagttccgacaccgacgaagaagagaccagtcaaagacatagcctgcgggagtgtaaaggctctctggattgcgaagcctgccagagtaccctgaatatcgacagaatgtgctctctgagcagccccgactctacgctctctactagttcaagcggtcagagctctccctcaccttgtaaacggcctaattctatgtctgacgaggagcaagagtcaagctgcgatactgtagatggcagccctacctcagactcatctggacacgatagcccttttgccgagagcacattcgtggaggacacgcatgaaaatacagaactggtttcttctgccgacacggaaactaagcccgcagtttgttctgtcgtcgtgccccccgtggagctagagaatggtctgaatgccgatgaacacatggccaacaccgactcaatatgccaacctttgattaagggccgttcagcccccgggaggctgaatcagcccagtgctgtgggtacacggcaacagaaactcaccagtgcgttccagcaacagcacctgaacttttcgcaggtgcagcattttggatcaggtcaccaggagtggaatggcaattttggccaccgccgacagcaggcatacattcctacaagtgttacctctaatccttttacgttgtcccatggatccccaaaccatacagctgtgcacgcacatctggcgggaaacacccacttgggaggccaacctaccctgctcccttatccctctagcgccacattgagttccgccgcgccagtcgcacacctgctcgccagtccttgtacctcccggcccatgttgcagcacccaacctataacatttcccacccatctggaatagtccaccaggtccccgtgggtctcaacccgcgcttgcttccctctcccaccatccaccaaacccaatacaagcccatcttcccaccacattcttacatcgccgcctcgccggcgtacacagggttccccctatcacctacaaagctgtcacagtatccctacatgtag

SEQ ID NO: 120144 - DNA, 3585 bp, Artificial Sequence
  Description of Artificial Sequence: Synthetic coding sequence
atggcgtcccaagtgctagtgtacccgccttacgtctaccaaacgcagtcctcagctttctgttcggtcaaaaaattgaaagtggagcccagttcgtgcgtctttcaggagcggaattacccccgcacttatgtaaacggacgcaactttgggaactctcatcctcctactaagggaagtgctttccagactaagataccattcaatcggccacggggccataactttagcttgcagactagcgcagtggtccttaagaataccgccggtgccacaaaggtcatcgctgcgcaggctcagcaggcccacgttcaggcacctcagatcggcgcttggagaaacaggttgcatttcttagaggggccgcagcggtgtggcctaaaacgcaaatccgaggagctggacaatcatagttccgcaatgcagattgtcgatgagctcagtatactccccgctatgctgcaaaccaacatgggaaatcccgtcacggtggttaccgccaccacaggcagcaagcaaaattgtactactggggagggcgactaccagcttgtgcagcacgaggttctgtgttctatgaagaatacctatgaggtgcttgactttctcgggagaggcaccttcggtcaggttgtgaaatgctggaaacgagggaccaatgaaattgtggccataaagatcctcaaaaaccatccatcttacgcgagacaggggcagatcgaggtatccatcctggcaagattatccacggagaacgcagatgaatataatttcgtacgggcttatgaatgcttccagcaccgaaaccacacatgcctggtgttcgaaatgctggagcaaaatctttacgatttccttaagcagaataagttttcaccactgccactcaaagtgatcagaccgatactccagcaagtggccactgcactgaagaagctgaaatctttagggctgatacacgctgacttgaaacctgaaaacatcatgctggtggaccctgtgcgacagccttacagggttaaggttattgacttcgggagtgcatcccatgtatcaaagaccgtgtgttccacctacctgcaatcccggtattacagagcccctgaaatcatcctaggccttcctttttgtgaagccatagacatgtggtctctgggctgtgtcattgcagagttgtttcttgggtggcccctgtaccctggggctctcgaatatgaccagattaggtatatctcccagacgcaggggcttccaggagagcaactgttgaacgtagggaccaaaagtacccgattcttttgcaaagaaaccgatatgagtcactccggatggagactcaagaccctagaagagcacgaggctgaaacaggtatgaaatccaaggaggcccgaaaatacatatttaattcactcgacgatgtcgcccacgtaaatactgtgatggaccttgaggggagcgatctgttggccgaaaaagcggacaggagagagtttgtgtcactcttgaaaaaaatgctgttaatcgatgctgatctgcgaatcacacccgcagagacactgaaccaccccttcgtaaacatgaaacacctactggattttccgcacagcaaccatgtaaagtcatgttttcacattatggacatttgcaagagccatctgaactcatgcgatactaacaaccataacaagacaagcctattgaggcccgttgctagttcatccactgccacattgaccgcaaactttacaaagatcggtactttgaggtcccaagccttgacaacatctgcacattctgtggtccaccacgggatcccactgcaggctgggacggcgcagttcggctgtggtgacgctttccaacagaccctaattatttgtcctcccgctattcaaggaattcccgcgacacatggaaagccaacttcatattccatcagggtggacaatactgtgcctctggtgactcaggcccccgctgtgcagcctctgcagatacgtcctggcgtattgtcacagacatggagtggacgtacgcaacagatgctggttcccgcctggcagcaggtgacgcccctggcccccgccactacgactctaaccagtgagtccgtcgcgggctctcacaggcttggcgactggggcaagatgatttcgtgctccaatcactataactccgtcatgccacagcctttgctcaccaatcagatcacactcagtgcccctcagccggtctctgtgggcattgcccacgtggtttggccacagccagctacaaccaaaaagaacaagcagtgtcagaatcgctcaaatagcctacaaaacactaatatcccacatagcgccttcatcagcccaaagattatcaacggaaaggatgttgaggaagtctcatgtatcgagacgcaggataaccagaactcagagggcgaggcccgcaactgctgcgaaacatctattagacaggattctgattcttctgtttcagacaagcagcgacagaccatcatcattgcagactccccctccccagctgtttcggttataaccattagctccgatacagacgaggaagagacgagtcaacggcacagcctgagggaatgtaagggcagcctggattgcgaagcctgtcaaagcactctgaatattgaccgcatgtgtagcctctcgagccccgactcaaccctctcaacttcatcgtctggccaatccagcccatcaccatgcaaacggcctaattcaatgagtgacgaagagcaggagagttcatgtgacacggtggacggatcccctacatccgactctagcggacacgattccccttttgccgaatctaccttcgtggaggatactcatgagaacacagagctagtatcctctgctgatacagaaactaaaccggctgtgtgctcggttgttgtgcctccggtggagctcgagaacggactgaatgcagatgaacacatggccaataccgactccatttgccagccactgatcaaggggaggagtgctcccgggcggttgaatcagccttccgctgtaggaacccgacagcagaaactgacgagcgcatttcagcagcagcacctcaacttctcccaggtgcagcatttcgggagcggccaccaagagtggaatggtaacttcgggcaccgaagacagcaggcttatatccctacgtccgtgacgtccaatccgttcaccttgtctcatggctccccaaatcatactgcggtacatgctcacctagccgggaatactcacctaggaggccaaccaacacttctgccttatccctcaagtgcaacattatcaagcgctgctcccgtggcccacctgttggccagtccctgcacaagccggccaatgctgcaacaccctacatacaacataagccatccaagcggaattgtgcaccaggtgcctgtgggcctgaatccgcggctgttgccgtcccctaccattcatcagacgcagtataaacccatctttcctcctcatagctacatcgctgcgagccccgcgtataccggattccccctctctccaacaaaactctcgcaatatccttatatgtag

SEQ ID NO: 120145 - DNA, 3585 bp, Artificial Sequence
  Description of Artificial Sequence: Synthetic coding sequence
atggcgagtcaggtgttagtgtatccgccctacgtgtatcaaacacagtctagcgcattctgttcagtgaagaagttgaaagtggagccaagcagctgcgtctttcaggagcgtaattaccctagaacttacgtaaacgggcggaattttggcaacagccacccccctacgaagggctccgcatttcagaccaaaatcccattcaacagaccccgcggccataacttttctttacagacctcggctgtggtgctcaaaaacaccgccggtgctactaaagtgattgcggcacaagcacaacaggcacacgtgcaagcccctcaaattggggcctggaggaacaggcttcatttcctggaaggcccgcagagatgcggtctgaaaaggaagtcagaggagctggacaaccacagttccgctatgcagatcgttgacgagctatccatacttcctgccatgctccagacaaacatgggaaacccagttaccgtggtgacagcaacaacagggtccaaacagaactgcaccacgggtgagggggattatcagctggtccaacatgaggtcttatgcagcatgaagaacacatatgaagttttagattttctcggacgcggtacattcggccaggttgtgaagtgttggaagcgcggaaccaatgaaatagttgctattaagattctgaagaaccaccccagttacgcccgacagggtcaaatcgaagtctccattctggctcggctgtcgacagagaatgccgacgaatataatttcgtgagagcgtatgaatgtttccagcatagaaaccacacctgtcttgtcttcgaaatgctggaacaaaacttgtacgactttctcaagcagaataagttcagccctttacctctgaaggtgattcgccccattctgcaacaggtggccaccgctcttaagaaattgaagtcactgggcctcattcacgccgacttaaagcccgagaacattatgctggtcgaccccgtccgacagccttatcgtgttaaagtcatcgacttcgggagtgcaagccacgtgtccaaaactgtctgctccacatacctccagtccagatattaccgcgccccagagattatcttggggctgcccttctgcgaggcaatcgacatgtggagtttgggctgtgtgatcgccgaactttttcttggctggcctctatatccaggcgcgttagaatacgaccagatacgttacatttcacaaacgcaggggctgcccggcgagcagctgctgaatgttggcacgaaaagcacccggttcttttgcaaagaaaccgacatgagccacagcggatggaggctgaaaactctggaagaacacgaagcggaaactgggatgaagtccaaggaagccagaaagtacattttcaacagcctcgacgacgtggcccacgttaataccgtgatggacctggagggttccgatctgctggcagaaaaggctgatcggcgcgaatttgttagtctgcttaagaagatgctgctgattgatgcagaccttaggatcacccctgctgagacattaaaccacccctttgtcaacatgaaacaccttctggattttccccatagcaaccatgtgaaaagttgctttcacataatggacatctgtaaaagtcacctgaatagttgcgataccaataaccacaataagacctcgttactgaggccagtggctagctcctcaactgccactttgactgcgaacttcaccaagatcggtactctacggtcccaggcgttaacgaccagcgcacatagcgtggtgcaccacggaatccccctacaggcaggaaccgcacagttcggctgtggtgatgccttccagcaaactctgatcatttgtcctcccgctattcaaggcataccggcaactcatggcaagccgacatcttactcaattagagttgacaatactgtgccactggttactcaagccccggctgtccagcctttgcaaatcagaccaggagtactgtcccaaacttggtcgggccggacccagcagatgttagttcctgcatggcaacaggtcacgcccctggcccctgcgacaactaccttgacaagtgaatcagtagccggctcacacaggctgggagactggggcaaaatgatctcttgcagcaaccattacaattccgtgatgccacaacctctcttaaccaatcagatcactctaagcgccccccagcctgtctcggtgggcatagcccacgtagtgtggcctcagcctgcaacaacaaaaaaaaacaaacaatgccagaaccgcagcaactcactgcagaatacaaacatcccacattccgctttcattagtcctaagattattaacggcaaggatgtggaggaagttagctgcattgaaacccaggacaatcagaatagtgagggagaggcgagaaattgttgtgaaacctctattcgccaggacagcgattccagtgttagtgataagcagcgccagactatcataatcgcagactcgccatctcctgccgtgtctgttatcacgatctcctctgatactgacgaggaagagacttcacagcggcactctttaagggagtgtaaaggcagtctcgactgtgaggcatgtcagtcaacactgaatatagacaggatgtgttctctgagcagtcctgactctactcttagcaccagttctagcgggcagtcctctccctcaccctgtaagagacccaatagtatgagcgacgaggagcaggagtctagctgcgacacagtggatggtagtccaacttctgattcttccggccatgactccccttttgcggagtcaactttcgtggaagatacacacgagaatacagagctggtgagcagcgctgatactgagaccaaaccagctgtgtgcagcgtcgtcgtgccccctgtggagctcgagaacggcctcaatgccgatgagcacatggcgaacaccgatagcatctgtcagccccttataaagggacgttcagcccctggccgtctgaaccaaccctcggccgtggggactaggcagcagaagctgacctctgcattccagcaacagcatttgaacttttcccaggttcagcactttggatccggccatcaggaatggaacggtaacttcggtcaccgccgtcagcaggcttatatccctacaagtgtgacttccaatcccttcaccctgtctcatgggtctcctaatcatactgccgtgcacgcccacctggctggtaatacacacttgggagggcagcccactttgcttccgtatccctcctccgccacacttagcagtgcagctcccgtcgctcatctgctggccagcccatgtacttcgaggcccatgttacagcatccgacctacaatataagtcatccctccggaatcgtgcatcaagtgccagtcgggctgaacccacgtctgctgcctagccctacgatccaccagacccagtacaagcctatcttccctcctcatagctatatcgctgcatctcccgcctataccggtttccccctaagtccaacaaagctaagccagtacccatacatgtag

SEQ ID NO: 120146 - DNA, 3585 bp, Artificial Sequence
  Description of Artificial Sequence: Synthetic coding sequence
atggctagccaggtgctagtctaccccccttatgtgtaccaaacccagagctctgccttctgtagtgtcaagaagctgaaagttgaaccatcttcctgcgtcttccaggagagaaactacccgcggacctacgtgaacggcaggaatttcggtaactcccatccccctaccaaaggatccgcctttcagactaagatccccttcaatcgtccacgcggccacaacttctctctccaaactagcgccgttgtcctgaagaatactgcaggcgccacgaaggtgatcgctgcacaggcccagcaggcccatgtgcaggcccctcagatcggagcttggagaaatcggctccactttttggaagggccacaacgctgcgggctgaagagaaaatcagaagagttagataatcattcaagcgctatgcagattgtcgatgagctgtccattttgccagccatgctccagaccaatatgggcaaccctgtgactgtcgttaccgcaacaaccggcagtaaacagaactgcaccaccggggaaggtgattaccagctggtccagcacgaggtactttgttccatgaaaaatacttacgaagtgctggacttcctcggacggggcactttcggtcaggtggtaaagtgctggaagaggggtacgaatgagatcgttgcaataaagatcttgaaaaatcacccctcctacgcccgacagggacaaatcgaagtctcaatactggctaggctgtccacggagaatgctgatgagtataattttgtgcgagcgtatgaatgctttcagcatcgcaatcacacctgcctggtgttcgagatgctggaacagaatctgtatgactttttgaagcagaataagttttctccactaccattgaaggtaataaggccgatactgcagcaggtcgccacagccctgaaaaagctgaaatctctcgggctgatccatgcagatctgaaacctgagaatatcatgctcgtggaccctgtcagacagccttatcgagtgaaagtgatagattttggcagtgctagccacgtttcaaaaacagtgtgctcaacttacttgcaaagtagatattaccgggctccagaaatcatcctgggtctgcctttctgtgaagccatcgatatgtggtccctcgggtgcgtaatcgcggagttgtttttaggctggccattgtatccaggcgcattggagtacgatcagattagatacatttctcaaacgcaggggttacccggcgaacagctcctgaatgtggggacgaaatctactaggtttttttgcaaagagactgatatgtcacattccggctggcggttgaaaactctggaagaacacgaagccgagaccggaatgaagagcaaggaagcacgaaaatacattttcaactcactcgatgacgtggctcacgtgaacactgtaatggacttagaaggctcggacctcctcgccgagaaggcagatcggcgtgagtttgtgtccttgctcaagaaaatgctgctgatcgacgcagacctacgcattacccctgcagaaaccctcaaccaccccttcgtaaatatgaaacaccttcttgacttcccccactcaaaccacgtcaagagttgctttcatataatggacatatgcaaatctcacctgaattcctgtgacacaaacaaccataataagacatcgctgttgagaccggtggcaagctcgtctaccgcgaccctcacggctaactttaccaaaatcgggacccttcggagccaagcactcaccactagcgctcactctgtcgtacaccacggtatccccctccaggcgggtacggcccaattcggctgcggagatgccttccagcagacacttatcatttgcccacccgcaatccaagggattcctgctactcacggaaagcctacatcgtacagcatcagggtagataataccgtaccattggtgactcaggctcctgccgtgcagcccctccagatccgcccgggcgtgttaagccaaacctggagcggaagaacccaacagatgctggtccctgcatggcaacaggtgacaccattggctcccgctaccaccacccttaccagcgagtcggtggctggctcccaccgtttgggcgactgggggaagatgataagctgtagtaaccactacaattctgtaatgccccagccgctgttaaccaatcagatcactttgagcgctccgcagcccgtttcagtgggtattgcacatgtcgtgtggccccagccagcgactacaaagaagaacaaacaatgtcaaaacaggagtaatagcttacagaacaccaacattccccactccgccttcattagcccaaagattatcaatgggaaggacgtggaagaagttagctgtattgaaacacaagataatcagaactcggaaggggaagctcggaactgttgtgaaaccagcatccgccaagactccgatagttctgtatccgacaaacagagacaaacaatcattatcgccgactcgccatctcctgccgtgtctgttataacgattagctccgatactgatgaggaagaaacgtcacagagacactccctgcgcgagtgcaagggtagcttagactgcgaagcatgccagtctactctgaatattgatagaatgtgcagtctcagtagcccagattcaacattatccacttcgtcatccggacagtcctcaccctcaccctgcaagcgacctaactccatgtcagacgaagaacaagagtccagctgcgatacggtagacgggagtcccacctcggattcatctggccacgattcaccattcgctgagagtacgttcgtggaggatactcacgagaataccgaactcgtgtcaagtgctgacacagagactaagcccgctgtctgctccgtggtggtgcctcctgtggagttagagaacgggctgaacgccgacgagcacatggcaaacacggacagcatttgtcagcctttgattaagggtcggagcgccccgggaaggctcaaccaaccttccgcagtgggtacacggcaacagaagctgacatccgcattccaacaacagcacctgaatttcagtcaagtgcagcatttcggcagcggacaccaggagtggaacggcaactttggtcaccggcggcaacaagcatatattcccacgtccgtcacatcgaacccgtttacactctcccacgggtcccccaaccataccgccgtacacgctcatctcgccggcaacactcatctgggggggcagcccactttgctcccctatccctcctctgcaacattgtcttccgctgctccagtggcccacttactcgcctccccctgcacatctcgtcccatgttgcagcatccaacatataacatatcccaccccagcggcatcgtacatcaggtgcctgtgggacttaacccacgcctgttgcccagccctacaatccaccagacacagtacaagcccatattcccccctcattcatatattgccgcttccccggcatacacagggtttccactgtctcccacaaaattgagtcagtacccatacatgtag

SEQ ID NO: 120147 - DNA, 231 bp, Artificial Sequence
  Description of Artificial Sequence: Synthetic coding sequence
atggcaagtcaggttctcgtgtaccccccttatgtatatcagacacagagtagtgcattctgcagcgtcaagaaactgaaggtcgagcctagctcttgcgtgttccaggagcggaattaccctagaacatacgtcaacgggagaaattttggcaacagccatcctccaacaaaaggttctgcttttcaaacaaagatccctttcaataggccgcgcggccataacttttag

SEQ ID NO: 120148 - DNA, 1851 bp, Artificial Sequence
  Description of Artificial Sequence: Synthetic coding sequence
atgagcacaatccagtctgagacggactgctacgatataatagaggtcctgggaaaaggtaccttcggagaggttgccaaaggatggcgtagatcaaccggagagatggttgcaatcaagatcctcaaaaacgacgcttaccgaaaccgaattatcaaaaatgagctaaagctgctgcattgtatgagaggcctcgatccagaagaagcacatgttatacgttttctggagttctttcatgacgcactaaagttctacttagttttcgaactgctcgaacagaacttattcgagttccaaaaagaaaataactttgccccactgcccgcccggcacatccgaaccgttacattgcaagtgctgacagctctggctagactgaaggagctggccattatacacgcagaccttaaaccagagaacatcatgcttgtcgatcagactaggtgtcctttccgcgtgaaggtgatcgactttggtagtgcttctattttctccgaggttagatacgtgaaagaaccttacatccagtctagattttaccgggcccctgagattctgctcggcttgcccttttgtgaaaaagtcgatgtctggtctctcggctgcgtgatggcagagttgcaccttggatggcctctgtatcctggcaataatgaatatgaccaggtgaggtatatatgcgagacccagggcctgcctaaacctcacctgctgcacgcagcgtgtaaggcacaccacttcttcaagcgtaacccacatccagacgcagcgaacccatggcagctgaaatcatctgccgactatctggctgaaactaaagtaagaccgctcgaacggaggaaatatatgctaaaatctctggaccagattgagacagttaatgggggaagcgtggcttcgcgtctaacattcccggatagggaagccctggccgagcacgcagatttgaaatccatggtcgagctaattaagcggatgctcacttgggagagtcacgagcggatctcccctagcgcagcattgcggcacccctttgtgtcaatgcagcaactaagaagcgcacacgagacaacacactactaccagctaagcctgcggtcctaccggctcagcttacaggttgaaggtaagcccccgaccccggtggtggctgcagaagatggcaccccctattattgccttgccgaggagaaagaagccgccggcatggggtctgtggccggctcctcacctttcttcagagaggagaaggcgccgggaatgcagagggcaatagaccagcttgacgacttaagtcttcaggaagccgggcacggtctctggggcgagacatgcacgaatgccgtctcagacatgatggtcccactgaaggcagccatcaccggacaccatgttcccgattctgggccagaacccatcttagcattctactcaagccgactcgccggacgacataaagccaggaaacccccagcagggtccaagtcggatagcaatttctctaatctgattcgcctgagtcaggttagccccgaagatgatcgaccttgccggggatcaagttgggaggagggggagcacttgggagcctcagccgaacccctggcgatcctgcagagggacgaggatggcccgaacatagacaatatgactatggaggctgagagacccgaccctgagctgtttgatcccagcagttgccctggcgagtggctatccgagccggactgcacactcgaatcagttcgcggtccaagagcccaaggcctgcccccacggcggagtcaccagcacggaccaccaaggggagcgacttcttttcttcagcacgtcactgggcaccactag

SEQ ID NO: 120149 - DNA, 1746 bp, Artificial Sequence
  Description of Artificial Sequence: Synthetic coding sequence
atggtggctatcaagattctcaaaaatgacgcataccgtaatagaattattaaaaatgagttgaaattgctccactgcatgcggggattggacccagaagaagctcatgtgatcagatttcttgaattcttccacgacgccctgaaattctacctcgtgtttgagttgctcgagcaaaatttatttgagttccagaaagagaataattttgcacctctaccagccagacacattaggacagtaacgctgcaggtactgactgcattagccagactgaaggagctcgccattattcatgccgatctaaaacctgaaaacatcatgctggtcgaccagacccgttgtccatttcgggtgaaggtgattgacttcggctctgcttccatctttagcgaggttcgctacgttaaagagccctatattcagtcaagattctaccgcgctcctgagattctgttaggacttcccttctgtgagaaggtcgatgtctggtcactgggttgtgtgatggcagagctgcatctcggatggccactgtatcctggaaacaacgaatacgaccaagtacgctatatctgtgaaactcagggcctgcccaagcctcatttacttcacgcggcgtgtaaggcccatcatttttttaaacgcaatccccatccagacgccgccaatccttggcaacttaagtcttccgctgattacttagcggagaccaaggtgcggcctctcgaaaggcggaagtacatgctcaagagcctggaccagatcgaaacagtaaacggcggctcagtagctagtaggcttactttccctgaccgggaggcactggccgagcacgcagacttaaagtccatggtggaactgattaaacggatgctgacctgggagagtcacgaacgcatctcaccaagcgccgcgctacgtcaccccttcgtctcgatgcagcagctgcggagcgctcacgagactacccattattaccagctctccctgcggtcctataggctgagtttgcaggtagaagggaagcccccaactccagtggtggccgccgaggatgggacaccctactactgtctggcggaggaaaaagaagctgctgggatgggaagtgtggccgggtccagcccgtttttcagagaagaaaaggcaccaggcatgcagcgggcgatcgaccagttggacgacctgtccctgcaggaagctggccacggtttgtggggggaaacctgtactaacgctgtgtctgacatgatggtgccactgaaagccgctattactggacaccatgttcctgactctggccccgaacctatcctggcattctattcgtctcgtttggctggacgtcataaagcccgcaagccaccggccgggtcgaaatctgactcaaatttcagcaatctgataaggctctcccaggtttctcccgaggacgaccgcccatgtagaggcagtagctgggaagagggggagcatctcggagcatctgccgaaccgttggccatcctacagagagatgaagatggcccaaatatcgacaatatgacaatggaggcggaacgaccagatccagagctgtttgacccatcctcttgccccggagaatggctcagcgagcccgattgcaccctggagtctgtacgcggacctcgggcgcagggactgccccccagaaggagccatcagcatggaccgccaagaggggcaactagcttcctgcagcatgtgaccggccaccactag

SEQ ID NO: 120150 - DNA, 675 bp, Artificial Sequence
  Description of Artificial Sequence: Synthetic coding sequence
atgggcgaacagcccattttcagcacgcgcgcgcatgtatttcagatcgaccctaatacgaaaaaaaactgggttcctacgtccaagcacgctgtgacagtctcgtacttttacgacagtacccgtaatgtgtataggattatttccctggatggctcgaaggctatcatcaattcaactattacccctaatatgaccttcaccaagactagccaaaaatttggccagtgggcagacagtcgcgcaaacaccgtgtacggtctcggcttcagctctgagcaccatctgtcaaaggttaccgaactagaatgcgtgtcttcacaggcaaacgctgtccacacccataagactgagctcaaccagaccatccaggagctggaagaaaccctgaagctgaaagaggaagaaattgagaggctcaagcaggagatcgataatgccagggagctccaggagcaaagggactctttgacccaaaaactgcaagaagtggagatccgaaacaaggacctcgaggggcagctgtcagatctcgagcagcggcttgagaagtcacagaacgaacaggaggcgttcaggaataacctcaagaccctcctggagatcctggatggcaaaatcttcgagctcacagaattgcgcgacaatctggctaaactgctggagtgctcgtag

SEQ ID NO: 120151 - DNA, 1065 bp, Artificial Sequence
  Description of Artificial Sequence: Synthetic coding sequence
atgggggaacaaccaatctttagtacccgggcgcatgtatttcagatcgatccgaacacaaagaaaaattgggtcccgacttccaaacacgccgtaacggtttcttacttttacgactcaacacgcaatgtttaccggattataagcttggatggaagcaaggccatcattaattcgacgataaccccgaatatgacgttcaccaagacatcccagaaattcggacagtgggccgattcccgggctaacactgtttacggcttagggtttagctccgaacaccatctgtcaaagttcgccgagaaattccaggaatttaaagaggccgcaagattagccaaggagaaatcgcaagaaaaaatggagctgacaagcaccccttcccaggaaagtgctgggggggacctgcagtcacccttgacgccagaaagcatcaacgggaccgatgacgagcgcacccctgatgtaacccaaaatagtgaaccaagagccgagccaactcaaaacgctctcccctttagccacagctccgccataagtaagcactgggaggccgaacttgccactctcaagggaaataacgctaaactgactgcagccctgttggagagcactgctaatgttaaacagtggaagcagcagctggccgcctaccaggaggaggcggaaagacttcacaagcgggttacagagttggaatgcgtgagcagccaggctaatgcagtacacactcataaaaccgagctcaaccagacgatccaggagctggaagagactctcaaactaaaagaggaagaaatcgaacgtctgaaacaggagattgacaatgcccgagaattgcaggaacaacgcgattccttgacccagaaactgcaggaggtggagattaggaataaagacctggagggacaactctctgacttggagcagcgtctcgagaaatcccaaaacgaacaggaggctttccggaataacttgaagacactccttgagatcttagacggaaaaatctttgaacttaccgagttaagggacaatttggccaaactcctagagtgtagttag

SEQ ID NO: 120152 - DNA, 534 bp, Artificial Sequence
  Description of Artificial Sequence: Synthetic coding sequence
atgggcgaacagccgatctttagcactagggcccatgtattccagattgacccaaacaccaagaaaaattgggtgcccacctccaagcacgccgtaacggtctcctacttctacgattccacaagaaatgtgtaccggatcatctcactcgacggctctaaagcaatcatcaattcaactattaccccaaacatgacattcacaaagaccagccagaagttcggccagtgggccgacagtcgagctaacaccgtgtacgggcttggcttctcttcagagcatcatttgtcgaagtttgcagagaagtttcaggagtttaaagaggctgcacgtttagcaaaagagaagtcccaagaaaagatggagctcacgagtaccccatctcaagaatcggcagggggagatctgcagagtccactcacaccagaatcaatcaatggtactgatgacgaaagaacgcccgatgttactcagaacagtgagcctagggctgagcctacccaaaatgccctgccattctctcatcgtaaatag

SEQ ID NO: 120153 - DNA, 543 bp, Artificial Sequence
  Description of Artificial Sequence: Synthetic coding sequence
atgggctccgctatttctaaacactgggaagccgagctggcaaccttgaaaggcaacaacgcaaagctgacagctgctttgctcgagtcaacggccaatgttaaacagtggaaacagcaacttgctgcataccaagaagaggccgagcgtctccataaaagggtgaccgaacttgagtgtgtctcttcacaggccaatgccgtccatacacacaagactgaactgaaccagaccatccaggagttagaagagaccctgaagctcaaggaagaggagatcgagcgcctgaagcaagagattgataacgcacgcgaactacaggagcagcgagacagcttgactcagaagctgcaagaagtggaaatacgcaacaaggacctcgagggtcaattatctgacctggagcagaggttggagaagtcgcagaacgaacaggaagctttcaggaataacctcaagactctgctcgagatactcgatggaaagattttcgagttaaccgaactgagggataatctggctaagctgctggaatgcagctag

SEQ ID NO: 120154 - DNA, 1065 bp, Artificial Sequence
  Description of Artificial Sequence: Synthetic coding sequence
atgggggaacagcccatatttaccacacgcgctcatgtcttccagatcgaccccaataccaagaagaattggatgcccgcatctaagcaggcagttactgtgagttatttttatgatgtcactcgaaattcttatagaatcatttccgtcgatggggccaaggtcatcattaactccactattaccccaaatatgacatttacaaaaacaagtcagaagttcggccagtgggcagactcccgcgcgaatactgtatttggactgggcttctcttcggagcagcagctgacaaagtttgcagaaaagtttcaagaagttaaggaggcggcgaaaatcgcaaaagataagacacaagaaaagattgaaaccagcagcaatcactcacaggaaagcggacgagagactccttctagcactcaagcctcttcggtcaatggaactgacgatgaaaaagctagccacgcgggccccgccaatacacatctgaagtctgagaatgacaagctcaagatcgcactgacacagtcagccgccaacgtgaaaaagtgggaaattgagttgcagaccttgcgtgagagcaatgccaggctcacaactgctctacaggaatctgcggccagtgtggagcaatggaagcgacagttttcaatctgccgggacgaaaacgaccggctccgtaataaaatcgatgaactggaggaacaatgttctgaaataaatcgtgagaaagaaaaaaatacacaattgaagcggcgaatcgaggagctggaagcggagctgagggaaaaggaaaccgagttaaaagacttgaggaaacagagcgagattattccacagctgatgtctgaatgcgagtacgtgagcgaaaaactggaagcggctgaaagggataatcagaacctcgaagacaaggtgaggtctttgaagaccgacatagaagagtcaaaatatcgccagcgacacctgaaagttgagctaaaatccttcttggaagtcctcgatggcaagatagacgatctgcacgattttaggagagggctgtctaagctggggactgacaattag

SEQ ID NO: 120155 - DNA, 867 bp, Artificial Sequence
  Description of Artificial Sequence: Synthetic coding sequence
atgggcgagcagcccatttttacaactcgggcacacgtttttcaaatcgaccccaatactaaaaagaactggatgcctgccagtaaacaggcagtcacagtctcctatttctacgatgtaacacgcaatagctatagaattattagcgtagatggagccaaggttatcatcaattcgactattaccccaaacatgacttttacaaagacttcccagaaattcgggcagtgggccgattcacgtgcaaatacggtgttcggcctgggcttcagctctgagcagcaactgacgaagtttgcggaaaagttccaggaagtcaaggaggccgcaaagatagcaaaagataagacccaggaaaaaattgaaactagctccaaccacagccaggcatcctcggttaacggtaccgacgacgaaaaggcgtcccacgccggcccggccaacacgcacttgaagtcggagaatgacaaactaaagatcgctttgacccagtctgcagccaacgttaagaatgagattaacagagaaaaggaaaagaacacacagcttaaaagaagaattgaagagctagaagctgaattacgggagaaagaaaccgagctcaaagatctgcgaaagcaatcggaaatcatccctcagcttatgtctgaatgtgagtacgtgtcagagaaactagaggcagctgaacgggacaaccaaaaccttgaggataaggtgcggtcccttaaaaccgacattgaagaaagcaagtatcgccagaggcacctcaaagtggagctcaagtcatttcttgaggttctggacggaaagatcgacgacctacatgactttaggaggggactcagtaaactgggcaccgacaactag

SEQ ID NO: 120156 - DNA, 900 bp, Artificial Sequence
  Description of Artificial Sequence: Synthetic coding sequence
atgggagaacagccgattttcacgactcgggcgcatgtgtttcagattgaccccaacaccaaaaagaactggatgcccgccagtaagcaggctgtaaccgtgagctatttctatgatgtgactcgcaatagttatcggatcatctccgtagacggagccaaggttattattaacagcacaattacccccaacatgacttttacaaagaccagccagaagtttggacagtgggccgattcgcgcgccaacaccgtctttggcctggggttttcctcagaacaacagctcaccaaattcgccgaaaagtttcaagaagtaaaggaggccgccaaaatcgccaaagacaaaacacaggagaagattgaaacctcttcaaaccacagccaagagtccgggcgggagacacccagcagtacccaggcgagcagcgtcaatggaaccgacgatgagaaggccagtcatgcaggaccagccaatacgcacctgaagtcagagaatgacaagctgaagattgctcttacgcagtcagcagccaatgtgaagaacgagattaatcgagagaaagagaaaaacacacagctcaagcgacgcatcgaggaactcgaggctgaactccgggagaaggaaacagagttaaaggatctccgcaagcaatccgagattattccccagttgatgagcgagtgtgagtatgtgagcgaaaaactggaggccgccgagcgtgataaccaaaatctcgaggataaagtccggtctcttaaaacagacatcgaagagtccaagtaccgccagcggcacctgaaggtggagctgaagagtttcctcgaggtgctggacggcaagattgatgatttgcatgattttcgcagggggttgtcaaaattgggaaccgataactag

SEQ ID NO: 120157 - DNA, 1032 bp, Artificial Sequence
  Description of Artificial Sequence: Synthetic coding sequence
atgggggagcagcctattttcaccacgcgcgcacatgtctttcagattgaccctaatacgaagaagaactggatgcctgcctctaaacaggctgttaccgttagttatttttatgacgttactcggaacagctataggatcatttctgttgacggagccaaggtcatcataaattctacaataacaccaaatatgacctttacaaaaacctctcaaaagttcggccagtgggccgattctcgggctaatacagttttcggcttaggattcagtagcgagcagcagctcactaagtttgcagaaaaattccaagaggtaaaggaagccgccaaaattgccaaagataagacccaggagaagattgaaacctcgtcgaaccactcccaggcgagcagtgttaacggcactgacgatgaaaaggcctcccatgctggccccgccaatacccacctgaaaagtgagaatgacaagctgaaaattgcattaacccaatccgctgccaacgtcaagaaatgggagatcgagttacagactctgcgcgaatccaatgctcggcttaccaccgccctgcaggagagcgccgcctccgtggaacagtggaaacggcagttcagcatctgcagggacgagaacgaccgactaagaaataaaatagatgaactggaagaacagtgtagcgaaatcaaccgcgagaaggagaagaatacacagcttaagaggaggattgaggaactggaagccgaactccgggagaaagaaacagagctgaaggacctaagaaagcagtcagagatcatccctcagctgatgagcgagtgtgagtacgtgagtgagaagctggaggcggctgaacgagataatcagaatctcgaagacaaggtccgatctctaaagacagatattgaagagagtaagtataggcagcgtcatcttaaagtggaactgaagagcttccttgaagtattggacggcaagatcgacgacctgcacgatttccgccgaggcctctctaaattgggaactgataactag

SEQ ID NO: 120158 - DNA, 15 bp, Artificial Sequence
  Description of Artificial Sequence: Synthetic coding sequence
tgaaccgacaactag

SEQ ID NO: 120159 - DNA, 4176 bp, Artificial Sequence
  Description of Artificial Sequence: Synthetic coding sequence
atggccgttgagggcagtactatcacttcccggataaagaatttactgcgatcgccttccatcaagctacggagatccaaggcggggaaccgccgggaagacctgtctagcaaggtcaccctggagaaggtactgggaatcactgtttctgggggtcgtggccttgcatgtgatccccggtctgggttagtcgcatatcctgctggctgcgtggtggtgctcttcaatccgcgcaagcacaaacagcatcacatcctaaactcatcgcggaaaactattacagcactggccttttctccagacgggaaatatctggtcaccggtgaaagtgggcacatgcccgcagtgagggtctgggacgtggccgaacactctcaggtcgcggagctgcaggagcataagtacggcgtcgcatgcgtagcgttctcacctagcgcaaagtatatcgttagcgtaggttaccagcacgacatgatcgtgaacgtctgggcatggaaaaaaaatattgtggttgcaagcaacaaggtttctagtagagtgacagctgtgtcattctccgaggactgttcttacttcgtgacggctggcaaccgccatattaagttctggtaccttgacgactcaaagaccagtaaggtcaatgccacggtaccactactgggccgcagcggcttgctaggcgaactgaggaataatctctttacagacgtggcatgcggtagaggtaaaaaagcagactccacattttgcataacatcttcgggactcctgtgcgaattctctgaccgacggttgctagacaaatgggtggagctacgcgtgtatcctgaggtgaaggactccaaccaggcctgcctgcccccctcctctttcattacctgtagctccgacaacaccatccgcctctggaatactgaaagctctggcgtgcatggctccaccctgcaccggaatattctttcttcagatctgataaagatcatctacgttgacggcaacacccaagccctcctcgatactgagctgcccggaggggacaaagctgacgcaagtctgctcgaccccagagttggcataaggagtgtttgtgtgagtccaaatggccagcatctggcctcaggtgacagaatgggcaccttgcgcgtccacgaacttcagtcactgagtgaaatgctgaaagtagaagctcatgactccgagatcttatgcttagaatattctaagcccgatacaggtctgaaactcctcgcctccgctagccgcgacagactgatccatgtgctggatgcagggagagaatactcactgcagcagacactggatgagcacagctccagcattacagccgtgaaattcgccgcgtcagatggtcaggttcgcatgatcagctgtggtgcagacaagagtatttacttcagaacagcccaaaagagtggcgacggtgttcagtttacccgcactcatcacgtagttaggaagacaacactctacgacatggacgtagagccatcttggaagtatactgcgatcggctgccaggatcgaaatattcgaattttcaacatcagctcagggaagcagaaaaaattattcaaaggcagtcagggcgaagatgggaccttgattaaggtccagactgatcctagtgggatctacattgctacaagttgtagcgacaagaacctgtcgatctttgacttttcctcgggagagtgtgtggcaactatgttcgggcattctgaaatcgtaactggtatgaaattcagtaatgattgcaaacatctgattagcgtgtcaggcgattcatgcatctttgtgtggcgcctgtcttctgaaatgacgattagtatgcgtcagagactggctgagctcagacagagacagaggggagggaagcaacagggtcctagctcaccccagagagcttctggacccaatcgtcatcaagccccttcaatgctgtcacctgggcccgctttatcttccgactcagacaaggaaggggaagacgagggtaccgaagaggagcttcccgccctgccggttcttgccaaaagtactaaaaaagctttggcttcagttccctctcccgccctccctcggagtctgtcgcactgggagatgtcacgcgcacaggaaagcgtggggttccttgaccccgctcctgccgcgaatcccggccctcggaggagaggccgatgggtgcagcccggtgtagagctgagcgtccggagtatgctggatctgagacaactggagactctagcaccctcgctccaggatccctctcaggactcccttgcaattattccctctgggccaagaaagcatggacaggaggccctggaaacttcactaacatcacagaatgagaagccccctcgcccacaagcctctcagccttgtagctaccctcacattatccggctcctgagccaggaagaaggggttttcgcacaggatctcgagcctgcgcccatcgaggacggcattgtttatccagagccctctgataatccgaccatggacacctccgaattccaggtgcaagcccccgccaggggtaccctgggtcgtgtgtacccaggatctaggagctcagagaaacattcaccggacagcgcctgcagtgtggattatagttctagctgtctgagttcgcccgaacatcccactgaggattctgagtctaccgagccactgtctgtggatgggatcagttccgacctggaggagccagcagagggagatgaagaggaagaagaagaggaaggtggcatggggccttatggcttacaagagggctcgccacagacccccgatcaggagcagtttctgaaacagcacttcgagacgcttgcaagcggcgctgccccgggagctcccgtccaggtcccagagcgatccgagtcgcggtcaatttctagtagattcttattgcaggtacagactcgcccccttcgagagccatcccctagttcttcttcgctcgccctgatgtcgcggccagcgcaggtcccccaggcctctggtgagcagcctcgcggcaatggggcaaacccccccggggcaccacctgaagtggagcctagctccggcaacccctctccccaacaggctgcatcagtcctgctgccccggtgcaggctgaaccctgacagcagttgggcgccgaagagagtagccacagccagcccctttagtggtctgcagaaggcccagtcagtgcatagcctggtgcctcaagaaaggcacgaggctagtctgcaggcaccaagccccggggccctcctgagccgtgaaatcgaggcccaggatgggctgggtagtctgccacccgcagatggacgcccttcacggcctcactcataccagaatcccaccacctcgtccatggccaaaattagtcgctccattagtgtgggcgaaaacctgggacttgtcgctgaaccacaggcacacgcgcccatccgtgtgtcccccttgtctaaattagctcttccatccagagcccacctagtgctagatattcctaaacctctgcccgatagaccaacactggctgctttctctccggtaacaaagggccgtgctcccggcgaggcggaaaagcccggattcccggtcggcctggggaaggcccacagtaccactgagcgctgggcttgtcttggggagggcactacccccaagccaaggactgaatgccaggcccatcctggtccgagttctccttgtgcccagcaactgcctgtgagctctctgtttcagggccccgagaacctgcagcctccacctccagaaaaaacccctaatcctatggagtgcaccaagcccggcgcggccctttctcaagactctgaacctgccgtgtcccttgaacaatgcgaacagctggtagctgagctcagaggctctgtgcgccaggcggtgagattgtatcattctgtagccggctgtaaaatgccaagcgctgagcaaagccgaatcgctcaacttttgcgggacaccttttcatcagttcggcaggaactggaggccgtggcaggagccgtactgtccagccctggtagcagtcccggcgccgttggcgctgagcagacccaggccctgttggaacagtatagcgagttgttgctgcgcgcggtcgagcggcgtatggaaagaaagttatag

SEQ ID NO: 120160 - DNA, 1077 bp, Artificial Sequence
  Description of Artificial Sequence: Synthetic coding sequence
atgtctaccgctagggaacaaccaattttttcgacccgcgcacacgtgtttcaaatcgacccagccaccaagcgaaactggatccccgctggcaagcacgcactgactgtgagctatttctacgacgcaacacgtaatgtgtacaggattatctcaatcggaggggccaaggcaattattaattccactgtcacccccaacatgaccttcaccaagaccagccagaaattcgggcagtgggctgatagcagagctaacaccgtctatggactcggattcgcatcagaacaacatctcacccagttcgcagagaagttccaggaagttaaggaggccgccaggttagcaagagaaaagtcccaggacggcggagaactgacttcacccgcattgggtctggcctcgcatcaggtgcccccatctcctctggtgtcagcgaacggcccaggggaagagaaactcttccgctctcagtcggcggatgcaccaggtccaacagagagggagcgtctgaagaagatgctgagtgagggcagcgtgggagaagtacagtgggaggccgaattctttgccctgcaggattcaaacaacaagctggccggcgccctgagagaggcaaatgccgctgctgcgcaatggcgacagcaattagaggctcagagggctgaggctgagcggctgagacagcgagtcgcggaacttgaagcacaggccgcatccgaggtgacccccacgggtgaaaaagagggattgggccagggacagtctcttgagcagctggaggccctcgtccagactaaggatcaagagatccagaccctgaagtcccagacggggggccccagagaagcacttgaggccgccgaacgcgaggaaacccagcaaaaagtgcaaacgcggaatgctgagcttgaacaccagctccgcgcgatggagcggtcccttgaggaggcaagggccgaaagagagagagcccgtgctgaggttgggagagccgcccagctgctggacgtgagtttattcgagctatctgaattgcgagaagggcttgccagattggctgaggccgctccatag

SEQ ID NO: 120161 - DNA, 438 bp, Artificial Sequence
  Description of Artificial Sequence: Synthetic coding sequence
atgtctactgctcgagagcagccgatatttagcacccgcgcccacgtgttccaaattgatccggcaaccaagagaaactggatacccgctggcaagcacgctctgaccgtgtcttatttttacgacgccactaggaacgtgtaccgaattatctctattggtggggccaaggcaataataaactccactgtcacaccaaacatgacgtttaccaaaactagtcagaaattcgggcagtgggccgattccagggctaatacggtttatggattggggttcgcatcagagcagcacctaacacaattcgcagagaaattccaagaagtcaaagaagctgccaggctggctcgggaaaagtcacaggacggctggggcggcccacaatctgccctggttgtcggctcatttggcgctgtctttgagctcctgattgtttag

SEQ ID NO: 120162 - DNA, 1086 bp, Artificial Sequence
  Description of Artificial Sequence: Synthetic coding sequence
atgtccacagcacgtgaacagcccatctttagtactcgcgcacatgtttttcagattgaccccgcgaccaagcgcaattggattcctgccggcaagcacgcactgactgtcagctatttctacgacgctacccgcaatgtctatcgtatcattagcattggtggcgccaaggcgataatcaatagtactgtgacccccaacatgacttttactaagactagccagaagtttggccagtgggccgatagcagagctaacaccgtatatggcctgggatttgcctccgagcaacacctgacccagtttgcagagaagtttcaggaagtaaaggaggcggctagactggcacgcgaaaaatctcaagatggcggcgagctgactagccctgccctgggactggcttcccatcaggtccctccaagtccactcgtgagtgccaacggcccgggcgaggagaaactcttcaggagtcagtcagccgatgcccccggaccgacagagcgggaacgcctcaagaagatgctgtccgaggggagtgtaggtgaggtccaatgggaggctgaattctttgcactccaggacagtaataataagcttgctggcgcactgcgggaagctaatgctgctgccgcccagtggcgccaacaactggaggctcaaagggccgaggcggagcgactccggcagagggttgcagagctggaagcccaagccgcatctgaagtgacgcctacaggcgagaaagagggacttggacagggccagtccttggaacagctcgaagctttagttcagaccaaggaccaggagatacaaacactgaagtcccaaactggcgggccgcgcgaagcactggaggcagcagaacgggaggagactcagcagaaggtccaggatctggagactagaaacgcagagctcgagcaccagcttcgcgctatggagcggagcttggaggaagcgcgtgccgaacgcgagcgggcccgggctgaggtcgggcgagcggcccaattgctcgatgtctctctgttcgagctcagcgagttaagagaaggtctggctagattggctgaggcagctccttag

SEQ ID NO: 120163 - DNA, 1077 bp, Artificial Sequence
  Description of Artificial Sequence: Synthetic coding sequence
atgagcacagctcgcgagcagccaatcttctccacccgggctcatgtctttcaaattgatccagctaccaagcgaaactggattcctgctggcaagcacgccctgacagtgtcatacttctacgatgcaactcgaaacgtgtaccgcatcatttcaattggtggagccaaagcgataatcaattctactgtgactcccaacatgaccttcaccaagacgagccagaaatttggccagtgggcggattcccgcgcaaacactgtgtatgggttgggttttgcttctgaacagcacctcacccagtttgcagagaaattccaagaggtcaaggaagctgccagacttgctagagaaaaaagtcaggatgggggcgaactgacttccccagcactgggccttgcctcccaccaggtcccccctagtccactcgtgtcagcaaacggcccaggcgaggaaaaactgtttcgctcacagtccgcagatgcccccgggcctaccgagagagagaggcttaagaagatgcttagcgaaggaagcgtgggagaagttcagtgggaggccgaattcttcgcactgcaggattctaacaataaactcgctggggccctccgcgaagccaatgctgccgctgcacagtggcgccagcagctggaggcacagcgagccgaggctgagcggctaagacagagggtcgctgaactggaggctcaagccgcgtccgaggtcacgccgaccggcgaaaaggaaggcctgggccagggccagtctctggaacagctggaagcactggtacagacaaaagatcaggaaatacagaccctgaagagccagaccggcggacctagagaggccctggaggccgcagagagggaagagacccagcagaaggttcaaacacggaatgccgaattggagcaccagttgcgggcaatggagcgctcgctcgaagaggcacgagcagagcgggaacgggcaagggctgaggtggggcgcgccgcgcagctgctagacgtgtccctatttgagctgtccgagctccgtgaagggctggctcgactagcagaggctgctccatag

SEQ ID NO: 120164 - DNA, 1086 bp, Artificial Sequence
  Description of Artificial Sequence: Synthetic coding sequence
atgagcaccgcccgtgaacagcctattttcagcacaagagctcacgtgtttcagattgaccccgcaactaagaggaattggatccccgcaggaaaacatgcgttaactgtgagctatttctacgatgccactcggaacgtgtaccgaatcatctcaattgggggcgctaaagcgatcattaatagtaccgtgacaccaaatatgacgttcaccaagacctcccaaaagtttggacaatgggccgatagtcgggcaaacaccgtttacggtctgggcttcgcaagcgagcagcatctgacccaatttgctgaaaaattccaggaggtaaaggaggcagcacggttggcacgcgagaaaagtcaagacggaggggagctgacatcccccgccctcggattggccagtcatcaggtccccccctccccactggtgagtgctaacggacccggcgaggaaaagctttttaggagccagtcagccgacgcacccgggccaaccgagcgagaacggttgaaaaaaatgcttagcgaagggagtgttggtgaagtgcagtgggaggcagagttctttgcactccaggattccaacaataagctggccggggcactaagggaggctaatgctgctgcagcccagtggaggcagcagctcgaggctcagagagccgaggcggagcggcttagacagcgggttgctgagctggaggcccaggccgctagcgaggtgacacctacaggagagaaagaaggacttggccaggggcagtcattggaacagctggaggccctggtacaaaccaaggaccaggagattcagactctgaaatcccaaacaggcggcccacgagaggcacttgaggccgcggagagggaggaaacacagcagaaagttcaagacctggagaccaggaacgcggaactcgaacaccagttgcgcgccatggaaagatcattagaggaggcgcgggccgaacgggagagggcacgcgccgaagtcggcagagcagcccagctgctggatgttagtctcttcgagctgtctgaacttagggaaggcctcgctaggctggcggaagctgcgccttag

SEQ ID NO: 120165 - DNA, 1086 bp, Artificial Sequence
  Description of Artificial Sequence: Synthetic coding sequence
atgtccacagccagagaacagcccatcttcagcactcgggctcatgttttccagatcgaccctgccaccaagaggaactggattcctgccggaaaacacgccctcactgtcagttatttttacgatgcgacacggaacgtgtaccggatcattagcatcggcggtgccaaagcgatcataaactctaccgtgacacctaacatgacattcacgaaaacctctcagaagtttggtcagtgggcggactctagggccaacacggtgtatgggctaggtttcgcgagcgaacaacatcttactcaattcgctgagaagtttcaggaggtgaaggaggctgcgaggttagctagggagaaatcccaggatgggggcgagcttacgtctccagctctcgggctcgcaagccaccaggtccctccctcaccgttggtgtccgctaacgggcctggtgaggaaaagctatttcggagtcaatccgcagatgcaccaggacccacggaaagagaaaggttgaagaagatgttgtcagaggggtcagtcggcgaggtccagtgggaagccgagttttttgctctacaggactccaataataagctggccggcgccctaagagaggccaatgccgccgctgctcaatggagacagcagctcgaagctcagcgcgccgaggcggaacggctgagacagcgggtcgccgaactagaagctcaggcagcctcagaagtgaccccgaccggggaaaaggaaggtctggggcaggggcaaagtctggagcagctggaagccctggtgcaaacaaaggatcaagagattcaaacgcttaagagccagaccggcggccctcgagaagcccttgaggcggcagaacgggaggagacgcagcagaaggttcaggaccttgaaacaagaaacgcagagctagaacatcaattgcgtgccatggaaaggagcctggaggaggcaagggccgagagggagcgggccagggctgaggtcgggcgggccgcccagctacttgacgtctccctttttgaactgagtgagctgcgagagggcctggccagactcgcagaagcagcgccatag

SEQ ID NO: 120166 - DNA, 978 bp, Artificial Sequence
  Description of Artificial Sequence: Synthetic coding sequence
atgtctactgcacgggagcagccgatctttagcacccgtgcacatgtgtttcaaattgaccccgctacaaaacgcaattggattcctgcaggaaaacacgcgctgaccgtgtcttacttttatgacgcaacccggaacgtatacagaatcatttcaatcggcggagctaaagccatcatcaacagcactgtgacgcccaacatgaccttcacaaagaccagccagaagtttgggcagtgggccgactccagagcgaacacagtttacgggcttggattcgcaagcgagcaacatctaactcaagttcccccaagtcctctggtgtcagctaacgggcccggtgaagaaaaattgtttagatcccagtctgctgatgccccgggacctacggagcgagaacgtcttaagaagatgcttagtgaggggagtgttggggaagttcaatgggaagctgaattctttgcactccaggattcaaacaataaactggccggggctctgcgagaagccaacgccgccgcggctcagtggcgccaacagctggaagctcagcgagccgaagcagaaaggctgaggcagcgcgtcgccgagctggaagcccaagccgctagcgaagtgacccccaccggtgagaaagagggattagggcaggggcagtcactcgagcagcttgaggctcttgttcagactaaagaccaggaaatccagaccctgaagtctcaaacgggcggaccgagggaggcactcgaggcggcagagcgtgaggaaacacagcaaaaggtccaggatctggagacaaggaatgccgagcttgagcatcaattgcgagcaatggagcgatcccttgaagaggctagggctgagcgggagagggctcgtgccgaggtgggacgcgcggcccagctgcttgatgttagcttgttcgaactatcagagctacgcgagggcttggctagacttgccgaagccgccccttag

SEQ ID NO: 120167 - DNA, 1176 bp, Artificial Sequence
  Description of Artificial Sequence: Synthetic coding sequence
atggaatcagaaaccgagcctgaaccagtgaccctgttagtcaaatctccaaaccagaggcacagagacctggaactttctggtgatcgaggatggagcgtgggtcatcttaaggcacacctgtcaagggtttatcctgaaagaccccgtccagaggatcagaggttgatctactctggcaagctgttgctcgatcaccagtgccttagagatctgctcccaaagcaggaaaagcggcacgtcctgcatttggtatgtaacgtgaagtcaccttccaagatgccagagatcaacgcaaaggtggccgagtctaccgaagaacccgccggatccaacagaggacaatatcccgaagatagctcttccgacgggctgcggcagagagaagtgctcagaaacctctctagtccaggatgggaaaatatatcacgccctgaagccgcccaacaggcttttcagggactgggccctggtttctcagggtacactccttatggctggctgcagcttagctggtttcagcagatttatgctcggcagtattacatgcagtacctggctgcaactgctgcctcaggcgccttcgtaccgcccccaagcgcccaggaaattcctgtggtgtctgccccagcaccggcacctattcacaatcagtttccggctgaaaaccaacccgccaaccagaacgcagctcctcaggtcgttgtcaatccgggcgccaatcaaaacctgcgcatgaacgcacaggggggtcccattgttgaggaggacgatgaaataaaccgcgactggctggattggacttattccgcagccacattttcagttttcctgagcatactctacttctactcgtcactgtccagatttctgatggtgatgggagctacagtggtcatgtatttgcaccatgtgggctggttcccctttcgcccgcgtcctgtgcagaatttccctaacgacgggccgcctcctgatgtggttaaccaggaccccaacaacaacctgcaggagggcaccgacccagagacagaagacccaaaccacctcccaccggacagggatgttcttgatggtgaacagacttcaccgtcctttatgtccactgcatggctggtatttaagaccttttttgcctcgctcctgccggagggccctcctgcaattgccaattag

SEQ ID NO: 120168 - DNA, 699 bp, Artificial Sequence
  Description of Artificial Sequence: Synthetic coding sequence
atggagagcgagactgagcccgagccagttacactgttggtgaagtctcccaaccagcgtcacagggacctggagctgagcggagatcgcggatggtctgtcggccatctcaaggcccatttgtcccgggtatacccagaacgtccccgcccagaggaccaaagactgatttatagcggtaagttgcttttggaccatcagtgtctgcgagatctgctgccaaaagaaaagaggcacgtgttgcatcttgtttgcaatgtgaagtctccgagcaaaatgccagaaatcaacgctaaggtggccgaatcaaccgaagaacccgctggatctaaccgcggtcagtacccggaggatagcagtagtgacggactcagacaaagagaggtgcttcgcaatctgtccagcccgggctgggaaaacataagccgccatcatgttgggtggttccctttcaggccgaggcccgtgcagaattttcccaacgacggtcccccccctgacgtggtgaatcaggacccaaataataatctccaggaagggactgatcccgagacagaagaccccaaccacctcccaccggatagggacgttctcgatggcgagcagacctcacccagcttcatgtccaccgcctggctagtcttcaaaacgttctttgcatcactgcttccagagggcccaccagccatcgccaattag

SEQ ID NO: 120169 - DNA, 1101 bp, Artificial Sequence
  Description of Artificial Sequence: Synthetic coding sequence
atggagtctgaaacagagccagagccagttacactgttggttaaatccccgaatcagcgacaccgtgacctggagctttctggcgaccgcggctggagcgtaggacacttgaaagctcatctgtcccgagtgtatcccgagaggccccgacccgaggaccaaagactgatttatagtggcaaactgctcctggaccatcaatgtctccgtgacctgctgccaaaggtcgccgagtccacagaagaacccgcaggatcgaacaggggacagtatcccgaagacagttcctcagacggtctgagacagcgggaggtcttacgcaacttgtctagtcccggttgggagaatatctcaagacccgaagccgctcagcaggcttttcagggcctcggcccaggattttccggctacaccccctacggctggctacagctatcgtggttccaacaaatttacgccagacaatattacatgcagtacttggccgcaacagcagcgtcaggggcattcgtgccgccgccctctgcccaggagatccccgttgtaagtgctcctgcgccagctccaatccacaatcaatttcctgccgagaaccagcctgcaaatcaaaatgctgcaccccaagtggtcgtgaaccctggagcgaatcagaacctgcgaatgaacgctcaggggggaccgattgtcgaagaggatgacgaaattaaccgagactggctggattggacctactctgcagccacattcagcgttttcctatcgatcttatacttttactcttccctgtctagatttctgatggtgatgggtgccaccgtagtgatgtaccttcaccacgtaggttggttccccttccggcctcgcccagtgcagaattttcccaacgatggcccacctcccgatgtggtcaaccaagaccctaacaataacctgcaggaaggtaccgaccccgaaactgaggaccctaatcatctgccaccagaccgcgacgtgctggacggagagcagacgtcccctagcttcatgtccacagcctggctggtcttcaagaccttcttcgctagccttttgccagaggggccacctgccattgctaattag

SEQ ID NO: 120170 - DNA, 1173 bp, Artificial Sequence
  Description of Artificial Sequence: Synthetic coding sequence
atggaatcagaaacagaaccagagcccgtgaccctccttgtgaagtcacctaatcaacggcaccgcgacttggaactgtctggcgacagagggtggtctgtaggacatctgaaagctcatctgtcaagagtttacccagaacggccaaggcctgaggatcagcgactgatttactccggaaagctgctgcttgaccatcagtgtctacgagacttactgccaaaagagaagaggcacgtgctccatctcgtgtgcaacgttaagtctccgtctaagatgcccgagattaacgcaaaagtcgcagagtcgaccgaagagccagctggctccaacagggggcagtatcctgaggattcttctagcgacggactcagacagcgagaggtgcttcgtaatctgtctagccccggctgggagaacatctctaggccagaagcagctcaacaggccttccaggggttagggcccggattctctggctacacgccctacgggtggctgcagctctcctggttccagcagatttacgcccgacagtattacatgcaatatctggcagccactgcagcttccggtgcatttgtgcccccaccatccgcccaggagatcccagtggtatctgcccccgctcccgcgcccatccacaaccagttccccgcagagaaccagcccgccaatcaaaatgccgccccgcaggtggttgtgaatccaggtgcaaatcagaatcttcgcatgaatgcccagggcggccccatagtcgaggaagatgatgaaatcaatagagactggttggattggacctactccgcagccactttctccgtgttcctgagtatactgtacttttactcgagcctgagtagattcctaatggtgatgggcgctacggtggtcatgtatttgcaccatgtcggatggttcccctttaggccgcgacctgtgcaaaactttccaaatgatggccctccccccgacgtggtcaaccaggaccctaataataatctgcaagagggtaccgatccagagaccgaagatcccaaccacttacctccagaccgtgacgtgctggacggggagcagacaagtcctagctttatgtccacagcctggcttgtgttcaagactttctttgctagcctcctcccagaagggccgccagctatcgctaactag

SEQ ID NO: 120171 - DNA, 1338 bp, Artificial Sequence
  Description of Artificial Sequence: Synthetic coding sequence
atggctgaactgaaatatatatctggcttcggcaatgagtgtagctctgaggacccccgatgtcccggtagtttacctgagggtcagaacaaccctcaggtgtgcccatacaacctgtacgccgaacagctttctggcagtgccttcacatgtccacgctcaaccaataaaagatcctggctgtaccgcatcctgcccagcgtatcacataaaccttttgaaagcatcgatgagggccaggtaactcacaattgggatgaggtggacccagatcctaatcagctcaggtggaaaccttttgaaattcctaaggcgtcccagaagaaagtcgacttcgtgtctggactacacactctgtgcggtgctggcgacatcaagtctaacaacggtctggcgatacacatttttctttgcaatacttctatggagaatcgctgcttctacaacagtgatggggattttctgatcgtgccccagaaggggaatctgctcatatacaccgaatttggcaagatgctggttcaacctaacgagatatgtgtgatacagaggggcatgcggttctccatagacgtctttgaggagacccgtgggtatatcctggaagtatacggtgtccatttcgaacttcctgatcttgggccaattggggccaatggcttggccaaccctcgtgactttctcatcccaatcgcctggtatgaggacaggcaggtcccagggggctacactgtgataaataaatatcaggggaagctgttcgcagccaaacaagatgtgtctcccttcaacgtggtggcctggcatggtaactatacgccttacaagtacaacctgaagaactttatggtgatcaactccgtggcatttgatcatgcagaccctagcatcttcaccgtgctgaccgccaagtccgtacgcccgggggtcgccatagcagacttcgtgatcttcccacccagatggggcgtcgctgacaaaacctttcgccctccttattatcaccgcaactgcatgagcgagttcatgggcttaatccggggacactacgaggctaagcagggtggatttctcccgggaggtggctcacttcactccaccatgactccccacgggcctgacgcagattgcttcgagaaggccagtaaggtcaagcttgcacctgaacggattgcggatggcactatggcttttatgttcgaaagcagcctgagtctggcggtcaccaaatgggggctcaaggcatcgagatgcctcgacgagaactaccacaagtgctgggagcctttgaaaagccatttcacacctaatagcaggaaccccgcagaacccaattag

SEQ ID NO: 120172 - DNA, 2187 bp, Artificial Sequence
  Description of Artificial Sequence: Synthetic coding sequence
atggaagaaacacagccccctcctcaacccaagttgcccttgtgcgactctctgatgatatggctgcagacattcaatactgcatctccatgccaggatgttaaacaattaacttccggcgtggccatggcgcaggtcctgcaccagattgacgccgcatggtttaacgagagttggttgtcacgcatcaaggaagacgtgggggacaactggcgaatcaaggcttcaaacgtaaagaaagtcctgcaagggattatgtcctactaccacgagtttctggggcaacaaatctccgaagcacttattcccgatctgaaccagatcacagagtgctcagaccccgttgaactgggcaggctcctacagttaattctggggtgtgctattaattgtgagaaaaagcaggaacatatccagaacataatgaccttagaagagagcgtccagcacgtggttatgaccgcaattcaggaactgatgagcaaggagatcctcagttctccacccaacgacgctgtcggcgagctggaacaacagttaaagcgcgcactcgaggaactgcaggaagcactcgcagagaaagaggagctacgccaacgatgtgaggagttagacatgcaagtgacaactttgcaggacgagaagaactccttggtcagcgagaatgagatgatgaacgagaagctcgaccaacttgacgggtcgtttgacgatcctaataccgtcgtggctaaaaagtacttccacgcgcagctgcagctggagcaactgcaagaggagaatttccgtttggaggcagctaaggacgattatcgggtccactgcgaggagctggagaagcagctgatagaattccagcaccggaatgatgaactgacgtccttggctgaggagacccgggcgttaaaagacgaaattgacgtattaagggcaacatctgacaaagccaataagctggagtctacagtggagatttataggcaaaaacttcaggacctaaacgacctgaggaagcaggtgaaaactctgcaggagactaacatgatgtacatgcataacacggtgtccctagaggaggaactcaagaaggccaatgccgcccgtactcagttggaaacttataaaagacaggtgcaggatctgcatgtgaagctgagttctgaaagcaaacgggcagataccctggcattcgaaatgaaaaggctagaggagaagcacgaggcactgctgaaagaaaaagaacgcctgattgaacagagggatactctcaaagaaacaaatgaggagctgcgatgctcacaggtacagcaagatcacttgaaccagactgacgcatcagcgaccaaaagttatgagaacttggcagctgaaatcatgcccgtcgaatatagagaggtgtttattaggctgcagcatgagaacaagatgctccgcctgcaacaggagggttcagagaacgaacggatcgaggaactccaagaacagctggagcaaaagcatagaaagatgaacgaactggaaaccgaacagcggctcagcaaggagcgcatccgggagcttcagcaacagattgaagacttacagaaatcccttcaggaacagggctctaagagtgagggggaatcttcaagtaagctgaagcagaagctggaggcccatatggaaaagctgactgaagtgcacgaagaactgcagaagaagcaagagttaattgaggacctgcagcccgacatcaaccagaacgtacagaaaatcaacgaactcgaggcggcattacagaaaaaagacgaggatatgaaagcgatggaggagaggtataagatgtaccttgagaaggcacgaaatgtaattaagaccctcgatccgaaactgaacccagccagcgctgagattatgttattgagaaagcagctcgcagaaaaagagcgcaggatcgagatcctggagagtgagtgcaaagtagctaaatttagagactacgaggagaaactgatcgtgtctgcctggtacaataagtcacttgccttccaaaagctggggatggagagcaggctcgtgtccggcgggggagcctgctcagacacgggggcgtgtacgcccgctaggagcttcttggcgcaacagagacacattacgaacactcggcgcaatctgtccgtgaaggtacctgccaccacatctgattag

SEQ ID NO: 120173 - DNA, 2061 bp, Artificial Sequence
  Description of Artificial Sequence: Synthetic coding sequence
atggcccaggtgttacatcaaattgacgccgcttggtttaacgagtcatggcttagcaggatcaaggaggatgtcggggataactggcggataaaggcatccaacgttaaaaaggttctccaaggaatcatgtcctactatcatgaatttttgggtcagcagattagcgaagccctgatacccgatctgaaccaaattaccgagtgcagcgatcctgtggaactagggaggcttctgcaactcattctcggctgtgccatcaattgcgaaaagaaacaggagcacatccaaaacatcatgacactggaggagagcgttcagcatgtggtgatgaccgctattcaggaactgatgagtaaagagatcctctcttctcctccaaacgatgcggtcggcgagctggaacagcaacttaagagagccctggaggagttgcaagaagccctcgccgagaaagaggagctgagacaaagatgtgaagaactggatatgcaggtaactactctgcaggatgaaaagaacagtctggtgtctgaaaatgagatgatgaacgagaagctggatcagctggatggctctttcgatgaccctaacaccgtggttgccaaaaaatacttccatgcccagttgcaactggagcagctgcaggaagaaaatttccgcctcgaggctgccaaagatgattaccgtgtgcactgcgaggaactggaaaaacaactgatcgagttccagcacaggaatgatgagttaacttccctcgcggaagagacacgcgcattgaaggacgaaattgacgttttaagagcaaccagcgacaaggcaaataaactggagtccactgttgagatatataggcagaaattgcaggacttaaacgatctgagaaaacaggtaaagaccctacaagagactaacatgatgtatatgcacaatacagtctctctcgaggaagagttaaagaaggctaacgccgcccgcacccagctcgagacttacaagagacaggtccaagacttgcacgttaaattatcttcggaaagcaaaagggctgacaccctcgcatttgaaatgaagcggctggaggagaagcacgaagccttgctgaaggaaaaagaacgattgatcgaacagagagatacactcaaagaaactaacgaagagctcagatgcagtcaggtgcagcaggatcatttgaaccagaccgacgcgtctgctacgaaaagctacgaaaatttagctgccgaaatcatgcccgtcgagtaccgcgaggtgtttattcgtctgcagcacgagaacaagatgctccggttacagcaggaggggagcgagaatgagcgcatagaagaacttcaagaacagctggagcagaagcacaggaaaatgaatgagctcgagacggaacaaagactctccaaagagagaatccgggagttgcaacagcaaatagaagatctgcagaagtcactgcaagagcagggttcaaagtcagagggcgagagcagttccaaactgaagcagaagctggaagcccatatggaaaagctgaccgaggtacacgaagaactacagaaaaaacaggagttgattgaggacctgcagccagatattaaccagaatgtccagaagatcaatgaactcgaggcagctctgcaaaagaaggatgaagatatgaaggctatggaggaacgctataagatgtatctggagaaagcaagaaatgtcataaagacattggacccaaaactcaacccagcatcagcagagatcatgctgttacgcaagcagctggccgagaaagagaggcgtatcgaaatcctcgagagcgaatgtaaggtagctaaattcagagattatgaggaaaagctgatagtgtcggcatggtacaataagtcactggcctttcaaaaattggggatggaatcacgattggtgtctggaggcggcgcttgttctgatacgggagcctgtacaccggcacgctccttcctggctcagcaacggcatattactaacaccaggcggaacttgagcgtcaaagtacctgccactaccagtgactag

SEQ ID NO: 120174 - DNA, 414 bp, Artificial Sequence
  Description of Artificial Sequence: Synthetic coding sequence
atggaagagacccagccgccaccccagcccaaactgccactgtgtgactcgttgatgatttggctgcagacctttaataccgctagcccctgtcaggatgtgaaacagttaacatcaggggtggctatggcccaagtcttgcaccagatcgatgctgcttggttcaacgagagctggctgtctcggatcaaggaagatgtcggagataattggcgaattaaagcatcgaacgttaagaaagtgctgcaaggaattatgagttattaccacgagttcctcggacagcaaatcagtgaggcattaattcctgacctcaatcaaattacggaatgttctgaccccgtggaattgggcagattgcttcagcttatcctgggctgcgcgataaattgcgagaaaaagcaggagcattag

SEQ ID NO: 120175 - DNA, 2154 bp, Artificial Sequence
  Description of Artificial Sequence: Synthetic coding sequence
atgtccgttgataaggccgaactctgcgggagcctcctcacttggctgcagacgtttcatgtcccctcaccgtgcgcaagcccacaggatctaagcagcggtctagcagtggcgtatgtgctgaatcagattgatccaagttggtttaacgaggcttggcttcagggaatttccgaggatcctggccccaactggaagttgaaagttagcaacttaaaaatggtgctccggtccctcgttgagtactcacaggacgttttagcccacccagtgagcgaggagcatttgcccgatgtcagcttgatcggggaatttagcgaccccgctgaactaggtaaattgcttcagttggtcttgggctgtgcaatatcttgtgaaaagaagcaggaccacatccagagaataatgactctcgaggaatccgttcagcacgtggtgatggaggcaatccaggagctaatgacaaaagatacacccgactccctgtcccctgagacctatggcaacttcgactcccagagccgcaggtactacttcctgtccgaggaggccgaggaaggcgacgagctccagcagaggtgcctagaccttgagagacaactcatgttgctgtctgaggaaaaacagtccctagcacaagaaaatgccggattacgtgaacggatggggcggcctgaaggtgagggaacccccgggttaactgccaagaagctgttgcttctccagtcccagctcgagcagttgcaggaggagaattttcggttagagagcggcagagaggatgagaggctgaggtgcgccgagttggaaagagaagtagctgaactccaacaccgtaaccaggctctcaccagcttagctcaagaggcccaggccctcaaggacgagatggacgagctccgccagagtagcgagcgcgcggggcagctggaggccacactaaccagctgccgcagacggcttggcgagctccgcgagctgagaaggcaggtgcgccagctagaggaacgaaatgctggacacgctgaaagaaccaggcaattggaggacgagcttagaagggccggtagtctgcgggctcaactagaagctcaaaggcgccaggtacaggaactgcaaggccagcggcaggaggaagcaatgaaggcggagaagtggctctttgagtgccgcaacctcgaagagaagtatgagagcgttaccaaggagaaggaaagacttcttgctgaaagagactcgctgagagaagctaacgaagagctgaggtgtgcccagctgcagcctcgtggcctgacccaggccgatcctagcctggacccgacctccactcctgtcgataacctggccgccgagatcctaccagcagaattgcgggaaaccctcctacggctccagctggaaaataagcgattgtgtagacaagaagcagccgaccgcgagcgtcaggaggaactgcaaaggcacctggaggatgcaaacagagcaagacacggactcgagacccagcaccgcctgaaccagcagcagctcagtgaactgcgcgcgcaggtcgaggatctccagaaggccctgcaggagcaagggggaaaaaccgaagatagtatactgctgaaacggaaactcgaggagcacctgcagaaactccacgaggccgacctggaattgcagagaaagcgcgaatacatcgaggaattagaacccccaacggattcctctaccgcccggcggattgaggagctccagcataacctgcaaaaaaaagatgccgatcttagagcaatggaggaacgctaccgtagatacgttgacaaagcacgcatggttatgcaaactatggaacctaagcagaggcctgccgccggtgctcctccggaactgcattcactccgcacacaactgagagagcgtgacgtgcggattcgccacctggaaatggacttcgagaaaagcagatcccaacgggagcaagaagaaaagttactgataagcgcgtggtacaatatgggcatggcattgcagcagcgagcaggcgaagagcgcgccccggctcacgcccaaagtttccttgcccagcaacgcctcgctaccaatagcagaaggggccccctagggagactcgccagcctcaacctccgccccactgataagcactag

SEQ ID NO: 120176 - DNA, 2160 bp, Artificial Sequence
  Description of Artificial Sequence: Synthetic coding sequence
atgtcagtcgacaaggccgaactctgtggctctttgttgacctggcttcagactttccacgtcccaagcccttgtgctagtccacaagatctcagttcgggcttagctgtggcctatgtcttgaaccagatcgatccctcatggtttaacgaagcatggttgcagggcatttccgaagacccggggcccaactggaagctcaaggtctcgaacctgaagatggtgctccgaagtttggtcgaatattcacaggatgtactggcccatcccgtcagcgaggagcacttaccggacgtaagcctcatcggcgaattcagcgaccctgcagaactaggcaaacttttgcaactggtcctggggtgcgccattagttgcgaaaagaaacaggatcacatacagaggatcatgactctcgaagaatccgtgcaacacgtcgtgatggaggcgatccaagagctcatgacaaaagacacacctgatagtctttcacccgaaacgtacgggaatttcgattcgcagtcccggagatactacttcttgtccgaagaggccgaggaaggcgatgagctacagcaaagatgcttagatctagaaagacagctgatgctattgagtgaggaaaaacagtcactcgcacaggaaaatgccggacttagggaaagaatgggacggcctgagggggaggggaccccaggcctcacagccaaaaaattactccttctgcaatctcaactcgagcaactgcaagaggaaaacttccgtctggagtccggtagagaagacgagcgcctgcgatgtgccgagctggagcgggaggtggcagaactgcagcaccgtaaccaggcgttgaccagtcttgctcaggaagcccaagcattgaaggatgaaatggacgagcttaggcaatcctcggaacgcgctgggcagctcgaggcgaccctgacctcttgtcgacgaaggcttggtgagttgcgggagcttcggcggcaggtcagacagttggaggagagaaacgccggccacgccgagagaacacgacagttggaggacgaattaagaagggcaggatctctcagagctcagctggaggcacagaggaggcaagtccaggagttgcagggtcagcgtcaggaagaagccatgaaagccgagaaatggctgttcgaatgcaggaacctggaggagaagtacgagtctgtcaccaaggagaaggaacggctattagcagaacgtgactcactgcgagaggccaacgaagagttacggtgcgcgcagctccaaccgcgcggacttacacaggccgatccaagccttgatcctacgagcactccagttgacaatttagcggcagaaatcctgcccgcagagctgcgtgaaactctcctccgccttcagttagagaataagcggctctgccgccaagaagccgctgatcgggaacgtcaggaggagctgcaacgacacttagaagacgcaaaccgtgcacgccacggcctcgaaacccagcaccgtctcaaccagcagcaactctccgagttgagagcccaggtagaggatcttcagaaagccctgcaagagcagggcggcaagaccgaagatgctatttcaatcctcctcaagcgcaagttggaagagcatctgcagaaacttcacgaagccgacctggaactccagagaaaacgggagtatattgaagagcttgaaccccccaccgatagcagcacagctcgtagaattgaagaattacagcacaatctccagaaaaaagacgcagatctgcgagcgatggaggagcgctaccgacggtacgtcgataaggcccgcatggtcatgcagactatggagccaaaacagaggccagctgcgggcgccccgccagaactccacagcctacgtactcagctgcgcgagcgggatgtaaggatccggcatctggagatggattttgagaaaagtcggagtcaaagggaacaagaggaaaagctgcttattagcgcctggtataacatgggcatggctcttcagcagcgtgctggggaggaacgcgcaccagcccacgcacaatctttcctggcccagcagcggttagccacaaattccaggagaggcccactggggcgtctggcctctcttaatctgcgtcccaccgacaagcactag

SEQ ID NO: 120177 - DNA, 2157 bp, Artificial Sequence
  Description of Artificial Sequence: Synthetic coding sequence
atgttctcagtcgaatccctggagcgcgcggagctatgtgagtcactactgacctggattcagactttcaatgtggacgccccgtgccagaccgtggaggatttaacaaatggggtcgtcatggcgcaagttctccaaaaaattgacccagcatacttcgatgagaactggctaaatcgcattaagaccgaagtgggggacaattggcgcctgaagatatctaatttaaaaaagattcttaagggtatcctggattataaccacgaaatcctgggccaacagatcaatgattttacgctcccggacgtcaatttaataggcgagcactctgacgctgctgaactgggccggatgctgcagctcatcttaggatgcgcggtgaactgtgaacagaaacaggaatacattcaagccatcatgatgatggaggagtccgtccaacacgtagtgatgaccgccatccaggagctcatgtctaaggagtccccagtgagcgccggtaatgatgcttatgtagacctggatagacagctcaagaagacaactgaggagctgaatgaagcactttccgctaaggaagagatcgctcagaggtgccatgagcttgatatgcaggtagctgctctgcaggaagagaaatccagtctgctagcagagaatcaggtcttgatggaaaggttgaatcagagcgactctatagaggatcctaactcccccgcaggacgaaggcacctgcagctacagacacagctggagcaattgcaggaagagacctttcgactggaggccgccaaagatgactaccgtatccgatgcgaggagctagagaaagagatctccgagctccgacagcagaacgacgagctcaccacattggccgacgaggcacagagcttgaaggatgagattgatgtgctgagacacagcagtgataaagtcagtaagctggagggacaagtggagagttacaagaagaagctggaagacctgggcgacctgagaagacaggttaaattgttagaggaaaaaaatacgatgtacatgcagaacacagtctcactggaagaagagctgcggaaggcgaacgctgctcgtagccagctggagacgtacaagcggcaggtggtcgaactgcagaatcgcctgagcgaggagagtaagaaggccgataagcttgattttgaatataagcgcctaaaagaaaaagttgacagtttacagaaggaaaaagatcgtctgcgaaccgaaagggacagcttaaaggaaacgatagaggagctcagatgcgtccaggcccaggaaggacagctgacaacacagggcctcatgccccttgggtcccaagagtccagcgacagtttggccgcagaaatagtaactccagagatccgggagaagttaattagacttcagcatgagaacaagatgctaaagctcaatcaggagggttctgacaatgagaagattgccttgctgcaaagcctgctggacgatgctaatcttcggaagaacgaactggagaccgaaaatcgcctggtgaaccaacggctgctcgaggttcagagccaggtggaggaactacagaaatctctgcaggatcagggatctaaggccgaagattctgtcttactgaagaagaagttagaagaacacctagagaagttgcacgaagctaacaatgagttacaaaagaagagagccatcattgaggacctcgagcccagatttaataattcatcacttaaaatcgaagaacttcaggaagcactgcggaagaaggaggaggagatgaagcagatggaggaaaggtacaagaaatacctggaaaaagccaaaagcgtgataaggaccctggacccaaaacagaaccagggcgccgccccagagattcaggctctgaagaaccagctccaagaaagggaccggttattccatagcctcgaaaaggagtacgaaaaaactaaaagccaacgggagatggaggagaaatacattgtctctgcctggtacaacatgggaatgacactgcacaaaaaagccgcagaagacagattggcctccactggtagcggacaatccttccttgctagacagcggcaggccacttcttctcggaggtcatatcctgggcacgtgcagccagccaccgcgcggtag

SEQ ID NO: 120178 - DNA, 222 bp, Artificial Sequence
  Description of Artificial Sequence: Synthetic coding sequence
atgtccgctgagactgctagtggccctaccgaagatcaggtggaaatacttgaatacaatttcaacaaggtagataagcaccccgacagcaccaccctgtgcctgattgccgcagaagctggtctatccgaggaagagactcagaagtggtttaaacagcgtctggcgaagtggcggagaagcgagggccttccttctgagtgtaggtccgtgacagactag

SEQ ID NO: 120179 - DNA, 222 bp, Artificial Sequence
  Description of Artificial Sequence: Synthetic coding sequence
atgagcgctgagactgcttcgggtccaacagaggatcaggtcgagatcctggaatacaacttcaataaggttgataaacatccagattccactaccttatgcctcatagcagctgaagccggactgtctgaagaagagactcagaagtggtttaagcaacggttggcaaagtggaggaggtccgaaggtctgccatctgagtgcagatcagttaccgattag

SEQ ID NO: 120180 - DNA, 222 bp, Artificial Sequence
  Description of Artificial Sequence: Synthetic coding sequence
atgagcgccgaaactgcaagcggaccaacagaagaccaagttgagatattggagtataatttcaataaggtggacaaacatcctgacagcacaaccctatgcttgatcgctgctgaagcaggtttgtcggaggaggaaacgcaaaagtggttcaagcagcgcttggctaaatggcgtagaagcgagggcctgccatccgagtgcagaagcgtcaccgactag

SEQ ID NO: 120181 - DNA, 285 bp, Artificial Sequence
  Description of Artificial Sequence: Synthetic coding sequence
atgagcgcagagacagcttcgggcccgacggaagaccaggttgagattctggagtacaacttcaataaggtggataagcacccagactctaccaccctgtgtctcatcgcggccgaggctggcctttctgaagaggagacacaaggatccgacttgatcagtagatctaagatctggcaccctgagtcatcacctcagagggaaggctacccgcacgattctctgccatgcctggccttcgactatttcagtctcctcccaccacaatgcaaggagatggtgtag

SEQ ID NO: 120182 - DNA, 276 bp, Artificial Sequence
  Description of Artificial Sequence: Synthetic coding sequence
atgctgatcttcctgggctgctacaggcggagactggaggaacgggccggcacaatgagtgctgagactgcatcaggtcccactgaagaccaagtggagatcctggagtataactttaacaaggtggacaaacatccagattcaacgactctctgcctgatagctgccgaagctggcctgtcagaggaggagacgcagaagtggtttaagcagcgtctggctaaatggagaagaagtgaaggcctgccaagtgagtgtcgctctgttaccgattag

SEQ ID NO: 120183 - DNA, 222 bp, Artificial Sequence
  Description of Artificial Sequence: Synthetic coding sequence
atgtctgccgaaacggcatccggtcctacagaagatcaagtggaaatacttgagtataactttaacaaggtggataaacacccggactccacaactctatgtctaattgctgcagaagccgggctttccgaggaggagacccagaaatggttcaagcagcggttggcaaagtggcggcggagcgaggggttgccgtcagaatgtaggtccgtgaccgactag

SEQ ID NO: 120184 - DNA, 285 bp, Artificial Sequence
  Description of Artificial Sequence: Synthetic coding sequence
atgtcagccgagacagctagcggcccgactgaggatcaggtggagatcctcgaatataatttcaacaaggtggacaagcacccggattcaactacgctgtgtctgattgctgctgaggccggactgagcgaggaggagacgcaaggtagcgaccttatcagccggtccaagatctggcaccccgagtccagtccacagcgggagggctacccgcacgacagcttgccctgcctcgctttcgactatttctccctcctgccacctcagtgcaaagaaatggtctag

SEQ ID NO: 120185 - DNA, 222 bp, Artificial Sequence
  Description of Artificial Sequence: Synthetic coding sequence
atgtctgcagagactgcatctggtcctactgaggaccaagtcgagattctcgagtacaactttaataaggtagataagcatccagattcgaccacactctgcctaatcgccgctgaggcagggctgagtgaggaagaaactcagaaatggttcaaacagcgcttggccaagtggcggagaagcgagggcctcccttcagagtgccgatcggttacagattag

SEQ ID NO: 120186 - DNA, 276 bp, Artificial Sequence
  Description of Artificial Sequence: Synthetic coding sequence
atgttaatttttctggggtgttacaggagaagactcgaagagagggctggtacaatgagcgccgagaccgcttccggacctacagaggatcaagtcgagattctggagtataacttcaataaagtcgacaaacaccccgattctaccactttatgcctaattgcagctgaagctggactcagtgaagaagagacccaaaaatggtttaaacaaaggctggctaagtggcggagaagcgagggactcccgagcgaatgtaggtcagtaactgattag

SEQ ID NO: 120187 - DNA, 285 bp, Artificial Sequence
  Description of Artificial Sequence: Synthetic coding sequence
atgagcgcagaaaccgctagcggtccaacagaggaccaggttgagatcctggagtacaacttcaataaagtggacaaacatcctgacagcactacgctttgtctaatcgccgctgaagcgggactttccgaggaagaaacgcagggaagtgacctgatcagcaggagcaagatctggcacccagaatccagcccacagcgcgaaggatatcctcatgatagtctcccgtgtctcgcatttgactattttagtctgctcccgccacagtgtaaagagatggtgtag

SEQ ID NO: 120188 - DNA, 222 bp, Artificial Sequence
  Description of Artificial Sequence: Synthetic coding sequence
atgtcggccgagacggcatctggtcctacagaagatcaggtggagatactggagtacaactttaacaaggtggataagcatcctgattctaccaccttgtgcctgattgctgcagaggcaggtttaagcgaggaggaaacacagaagtggttcaagcagagacttgccaagtggcgtaggtccgaaggactcccgagtgaatgtaggagcgtgaccgattag

SEQ ID NO: 120189 - DNA, 222 bp, Artificial Sequence
  Description of Artificial Sequence: Synthetic coding sequence
atgagcgctgagactgcaagcgggcctacagaggaccaggtggagattctggaatacaacttcaacaaggtggataagcatcctgactccactaccctgtgtctgatcgctgccgaagctgggctatccgaagaggaaacccagaagtggtttaagcagaggttggcgaagtggagaagatctgagggcctgcccagtgagtgccgctcagtcacagactag

SEQ ID NO: 120190 - DNA, 339 bp, Artificial Sequence
  Description of Artificial Sequence: Synthetic coding sequence
atgctgatctttttgggatgttaccggcgcaggctcgaggagcgtgccgggaccatgagcgctgagactgccagcggtccaaccgaggaccaggtcgaaattttggagtataacttcaacaaagtggataagcaccctgattcgacgactctgtgtctgatcgcggcagaggcaggtctgtccgaggaagagactcagggttccgacctgatatccaggagcaaaatatggcaccccgaatcatctccacagcgtgagggatatcctcacgatagcctgccctgtctggctttcgactatttctcgctgctgcctcctcagtgtaaagaaatggtgtag

SEQ ID NO: 120191 - DNA, 222 bp, Artificial Sequence
  Description of Artificial Sequence: Synthetic coding sequence
atgtccgccgaaactgcctccggacccacagaagatcaggtcgagattctggagtacaactttaataaggtggacaagcaccccgattcgacaactctgtgcctgatagctgccgaggcaggcctctcggaggaggagacccagaagtggtttaaacaacgtctagcaaaatggcggagaagcgagggcctaccatctgagtgcaggtccgtcactgactag

SEQ ID NO: 120192 - DNA, 222 bp, Artificial Sequence
  Description of Artificial Sequence: Synthetic coding sequence
atgtctgcggagactgcgagtgggccaacagaggaccaagttgaaattctcgagtacaacttcaataaagtagacaaacatcccgactctactaccctgtgcctcattgccgctgaggccggcctgagcgaagaagagacgcagaagtggtttaaacagagactggccaaatggcggaggtctgaaggactacccagcgagtgtcggagcgtgaccgactag

SEQ ID NO: 120193 - DNA, 222 bp, Artificial Sequence
  Description of Artificial Sequence: Synthetic coding sequence
atgtccgctgaaaccgcaagcggacctaccgaagaccaagtcgaaattcttgagtacaacttcaacaaggtggacaaacatcctgactcaactacactgtgccttatcgcagcagaggcagggctgtccgaggaagagacacagaagtggtttaagcagcggcttgctaaatggcggcgttccgagggcttgccctcagaatgtcgtagcgtaaccgattag

SEQ ID NO: 120194 - DNA, 144 bp, Artificial Sequence
  Description of Artificial Sequence: Synthetic coding sequence
atgtcggccgaaacagcatccggtccaacagaggatcaagtcgaaatcctggagtacaacttcaacaaagtcgataagcatcccgacagtacaacactttgtctgattgccgctgaggctggtctgtcagaggaggagacctag

SEQ ID NO: 120195 - DNA, 1164 bp, Artificial Sequence
  Description of Artificial Sequence: Synthetic coding sequence
atggctacggctcaactgcagcgcacccctatgtccgctctggtgttccctaacaagatctcaacagagcaccagtccctggttcttgtgaaacggctcctggccgtgtccgtgtcctgcataacctatttgcgcggaatattccctgagtgtgcgtacggtacccggtaccttgatgacctttgtgtcaagatactgagagaggacaaaaattgtcccgggtcaactcagttggttaaatggatgcttgggtgttacgacgcgctgcagaagaaatatgtatatacgaatcctgaagatccacaaacaattagcgaatgctatcagtttaaattcaaatacactaacaacggcccacttatggatttcatttccaagaaccagagcaatgagtcttcaatgttgtccactgacaccaagaaggcaagcatactgctgatacgaaaaatctacatacttatgcagaacttgggccctctccctaatgatgtatgtcttactatgaaactcttctattacgacgaggttactcctccagactaccagccaccgggcttcaaagacggagattgtgaaggtgtgattttcgagggcgaaccaatgtatctcaatgtcggagaggtgtcaaccccttttcacatcttcaaggttaaagttacaaccgaacgcgaaagaatggagaacatcgattccacaatcctctctcctaaacagattaagacacctttccagaagatcctgcgcgacaaggatgttgaggatgaacaggagcactatacatccgacgacctggatattgagaccaaaatggaggagcaggaaaaaaaccctgcgtcttcagagctggaagagccatccctcgtatgcgaagaagacgaaattatgcggtctaaagaaagtcccgatctatctatatcacactctcaggtggagcaacttgtgaacaagactagcgagctggacatgagcgagagcaagacccgctccggaaaagttttccagaacaagatggccaacgggaatcagccagtcaaatcatcaaaggaaaaccgaaaaaggagtcaacacgaatcaggccggatagttctgcatcacttcgacagctcgtcacaagagtccgtgccaaaacggcgaaaattcagtgagccaaaggaacacatttag

SEQ ID NO: 120196 - DNA, 1185 bp, Artificial Sequence
  Description of Artificial Sequence: Synthetic coding sequence
atggcaaccgcccaattacagaggaccccaatgtcagccttagtatttcccaataagatcagcaccgagcatcaaagtctggttcttgtgaagagactgcttgcggtctcggtttcttgcatcacctatttgcgtggcatttttcccgagtgcgcctacggtaccaggtatctggatgatctgtgcgtaaaaatcctgagagaagacaagaactgcccaggctccacccagctagtcaagtggatgctcggatgctacgatgcgctccaaaagaaatatctccggatggtggtcctggccgtttataccaacccagaggatccccagacgattagcgaatgttaccaattcaaatttaagtacactaacaacggccccctgatggattttatctccaagaaccaaagcaatgagtcttccatgctgtcgactgatacaaagaaagccagtattctgctaattaggaagatttatattctcatgcagaatttgggccccctgcctaacgacgtctgtctgaccatgaagttgttctattacgacgaggtcacgcctccggattatcagccaccgggcttcaaggacggcgactgtgagggagtaatatttgagggagagcccatgtaccttaacgttggcgaggtttctaccccattccatatattcaaagtgaaggttaccactgagagggagaggatggagaacattgattctactattctgtctcctaagcaaatcaagacaccattccagaaaattctgagagacaaggatgtggaagatgaacaggagcactacactagtgatgatctggacatcgagaccaaaatggaagaacaggaaaagaatccagccagctccgagcttgaggaacccagtctggtgtgcgaagaggacgagatcatgcgcagtaaggaaagtcctgacctgtccatctcacactcccaggtcgagcagctggtgaacaagacgtccgaactggatatgagcgaatcaaaaacgcgtagtggcaaagtgtttcagaacaagatggccaacgggaatcaacctgtaaagtcctcaaaggaaaacagaaagcgctcccaacacgagagcgggcgtatcgtcttacaccactttgactcgtcatcacaagaaagcgtccccaaaagaaggaagttctctgaacccaaggagcacatctag

SEQ ID NO: 120197 - DNA, 573 bp, Artificial Sequence
  Description of Artificial Sequence: Synthetic coding sequence
atgaggctctggaacaagattagccggtggatgctgggctgttatgatgcactccagaaaaaatatctccgcatggttgtgttggctgtttacaccaatcccgaagatccgcaaacaatatctgagtgctaccagtttaaatttaaatataccaacaacggaccattaatggacttcatttccaagaatcagagtaacgaatcaagcatgctctcaacagatacgaaaaaagcaagcattctgctgatacgcaagatatacattttgatgcagaatctgggccctctgcctaacgacgtttgtctgactatgaaactgttttattacgacgaggtaacaccgccggactaccagcccccaggatttaaggatggagattgtgaaggcgttatattcgaaggggagccaatgtatctgaatgtgggagaggtatccactccgtttcatatcttcaaggtcaaggtgaccacggaacgcgagaggatggaaaacatcgactccactattcttagcccaaagcagattaagactccattccaaaaaattctgcgcgataaggatgtagaagattag

SEQ ID NO: 120198 - DNA, 972 bp, Artificial Sequence
  Description of Artificial Sequence: Synthetic coding sequence
atgcggttgtggaataaaattagccgatggatgctgggctgctatgatgccctgcagaagaaatatctcaagatcatggagctcacagtgtacacgaacccggaagatccccagactatatcggaatgttaccaattcaagttcaagtataccaataacggacctctgatggatttcatttctaaaaaccagtcaaatgagtcttccatgttgtccacagacactaaaaaggccagcattctgctgatcagaaagatctacattctgatgcagaacctggggcccctgcccaacgatgtttgtctcaccatgaagctgttctattacgatgaagtcacacctcccgattaccaaccgcctggattcaaagatggcgattgcgaaggggtgatattcgaaggagagcccatgtacttaaacgtgggggaagtgtcaacaccgtttcacatttttaaggtaaaagtcaccacagagagggagagaatggagaatatcgattctacaatcttgtctccaaaacagataaagacgcccttccaaaagattctgcgcgataaggacgttgaggatgagcaggagcactacactagcgacgacctggatatcgaaacaaagatggaggaacaggagaaaaaccccgcctcatcagaacttgaggagcccagcctggtatgtgaggaggacgaaataatgcggtctaaagaaagtccagacctgagcatctcccatagccaggttgagcagttagtcaacaaaacctctgaattggacatgtccgaaagtaaaactagaagtggtaaggtgttccagaacaaaatggcaaatggcaatcagcccgtcaaatcctccaaagagaatagaaagcgatcccagcatgagtcaggcaggatcgtcctgcatcattttgattcatcttcccaggagagcgtccccaaacggagaaagtttagcgagcctaaggagcacatctag

SEQ ID NO: 120199 - DNA, 1185 bp, Artificial Sequence
  Description of Artificial Sequence: Synthetic coding sequence
atggcgaccgcccaactccagcgcaccccaatgagcgcccttgtgtttcccaacaaaatttcgacagaacaccaaagcctggtgttggtaaagaggctcctggctgtttccgtgtcctgcataacatacctgaggggtatttttccggagtgcgcctatggcactcggtacctggacgacctgtgtgtgaagattctcagagaagacaaaaattgcccaggatcgactcagctggttaaatggatgctggggtgttacgatgctctccagaaaaagtatctgaagatcatggaactgacggtatatacgaatccagaagatccacagaccatatcagagtgctatcagttcaaattcaagtacacaaataacggccctctgatggattttatctccaaaaatcagtctaacgagtcttcgatgctgagtacggataccaagaaggcgtctatccttctgatccggaagatatatattctgatgcagaatttaggcccacttcctaatgatgtttgtctcacgatgaagctgttttattacgacgaggtcactcccccagattaccagcctccggggttcaaggacggtgactgcgaaggcgtgatttttgaaggagaacccatgtatctcaatgttggcgaagtaagcactccattccacatttttaaggtgaaggtgacaaccgaacgagaacggatggagaacatagacagcacaattctgtcccccaaacagatcaaaaccccatttcagaagattctgcgggataaggacgttgaagacgagcaggaacactacacgagcgatgacctggacatcgaaacaaaaatggaagagcaagaaaaaaacccagctagcagtgagcttgaagagccttcgctggtgtgtgaggaggatgaaattatgcggtctaaagagtcacctgacctcagcatttctcactcccaggtggagcagctggtgaacaaaacatctgagcttgatatgtcagaaagcaagacccgtagcggcaaggtgttccagaacaaaatggccaacgggaaccaaccagtaaaaagctctaaggaaaatcgcaagcgaagccagcacgagagcgggcggattgtgctgcatcacttcgacagctcaagtcaagagtcagtgccgaagagacggaagttctcagagccaaaggagcacatctag

SEQ ID NO: 120200 - DNA, 945 bp, Artificial Sequence
  Description of Artificial Sequence: Synthetic coding sequence
atgcgtctatggaataagatctcccggtggatgttgggatgctatgacgctctccaaaaaaagtaccttcgcatggtagtgctggccacaatctcagagtgctatcagttcaagtttaagtacacgaacaacggcccattgatggattttattagtaagaaccagtccaatgagtcctccatgctatctaccgatacaaaaaaagcaagcatccttcttatccgaaagatttacatcctgatgcagaatctgggtccgctccctaatgatgtgtgtctcacaatgaagctcttttattatgacgaggttaccccccctgactaccagccaccaggatttaaagacggagattgcgagggggtgattttcgaaggggaaccgatgtatctgaacgtgggtgaagttagcaccccgttccacattttcaaggtgaaagtgacaacggaaagggagcgtatggaaaacattgattctacaatcctgtcccctaagcagattaaaacacctttccagaagatcctgagggataaagacgtcgaggacgagcaggaacattacacaagtgatgacctggacatcgagaccaaaatggaagagcaggagaagaatccagcaagttctgaacttgaggagccaagtctggtgtgtgaagaggacgaaatcatgaggtctaaggaatcgcccgatctgtcaatctcccactctcaggtggagcagctcgtcaacaagacctcagaactggacatgtctgagtccaaaacaaggtcaggtaaagtatttcagaataaaatggcaaatggcaatcaacccgtgaagagctctaaggagaaccggaagcgttctcagcatgaatctggacgcatcgtgttacaccacttcgactccagctcccaggaaagtgtgcctaagcggcgcaaattctctgaaccgaaggagcatatctag

SEQ ID NO: 120201 - DNA, 495 bp, Artificial Sequence
  Description of Artificial Sequence: Synthetic coding sequence
atgcgcctatggaataagattagtagatggatgctgggatgctacgacgccttacaaaagaagtatgtatatacaaatccagaggatcctcagacaatctctgagtgctatcagtttaagttcaagtatacgaacaacggccccctcatggatttcattagcaaaaatcagtccaatgagtcgagcatgctctccacggacactaaaaaggcaagcatacttctgattcgcaaaatttacattcttatgcagaatctaggtcccttaccgaatgacgtgtgcctgactatgaagctgttttattatgatgaagtgactcctccagattaccagccccctggtttcaaggacggcgactgcgagggcgtaatattcgaaggagagccaatgtatctgaatgtcggcgaggtgtcgacaccatttcacattttcaaagtaaaggtgacaactgaaagggagcgcatggagaatattgactctacaatacttagctag

SEQ ID NO: 120202 - DNA, 945 bp, Artificial Sequence
  Description of Artificial Sequence: Synthetic coding sequence
atgagactgtggaacaaaattagccgctggatgctcggatgctacgacgctttgcagaagaagtatttaagatatttcctttttaaaaccatctcagaatgttatcagtttaagtttaagtacaccaacaacggccccctaatggattttatcagcaaaaatcagagtaacgagtcaagtatgctttctactgataccaaaaaggcaagcattttgctgatcaggaaaatctacatcctgatgcagaacttggggccgctgccgaacgatgtttgcctgactatgaaactgttttactatgatgaggtcacgcccccggactaccagcctcccggattcaaagatggcgattgcgaaggggtaatttttgagggcgaacctatgtaccttaatgtaggggaggtgagcacaccttttcatatttttaaggttaaggttacgacggaaagggagcggatggagaacattgattctactatcctttctcccaagcagatcaaaacaccatttcagaagattctgcgcgacaaggacgtcgaggatgagcaagagcactacactagtgacgatttagacatagagaccaaaatggaagaacaggaaaaaaatccagcctcaagcgaacttgaagaaccttcactcgtatgcgaggaagatgagatcatgaggtccaaggagagccctgatctctccatcagccatagccaagtcgaacagcttgtcaacaagaccagcgagctggacatgtccgagagcaagacacgaagtggcaaggtttttcaaaacaagatggcaaatggcaaccagcctgtcaagtccagcaaggagaaccggaaacgtagtcagcacgagagcggacgcatcgtgctacatcactttgactcctccagccaagagtctgtcccaaagaggcggaaattctcagaacccaaggagcacatctag

SEQ ID NO: 120203 - DNA, 6108 bp, Artificial Sequence
  Description of Artificial Sequence: Synthetic coding sequence
atggcatccgccgtctccccagccaatcttccagctgtgttactccaaccaaggtggaagcgcgtcgtcggatggtctggacccgtccccagaccacggcatgggcatcgcgctgtggctatcaaagaactaatcgtggtgttcggcggagggaatgaaggaattgtcgacgagttgcacgtgtataataccgctacgaaccagtggttcattccagccgtgcgcggcgatattccacccggctgcgccgcttatggtttcgtctgtgacggaacacgcctactagtcttcggagggatggtggagtacgggaagtactccaacgatttgtacgagcttcaggcatctagatgggagtggaaacggttaaaagctaaaacgccaaaaaatggacctcctccatgccctagactcgggcattcgttctccctggttggcaataagtgctatttattcggaggccttgctaacgatagtgaagaccccaagaataacattcccaggtatctgaacgatctttatattctcgagcttcgcccgggtagcggcgtcgtggcatgggatattcccattacctacggcgttctgcctccaccacgcgagagtcacaccgctgttgtgtacactgagaaggacaataagaagtcaaaactggtcatctatggaggaatgagcggatgcaggctcggagacctctggaccttggatatcgacaccctgacatggaacaagcccagtctgtcaggagtcgcacccctgccacgatctctgcacagcgctacaaccattgggaataagatgtacgtgttcggcggatgggtacctttggtgatggatgacgtcaaagtggcaacccacgagaaggagtggaaatgtacaaacacgctggcctgtctgaatctggatacaatggcctgggaaacgattctgatggacacactagaggacaacatcccccgggcacgcgctggccactgcgcggtggcgataaacacgagactatacatttggagcgggcgcgacggctatcggaaagcctggaacaatcaggtgtgctgtaaagacctgtggtacctagagaccgaaaagccccccccccccgctcgggtccagttggtaagagcaaacacaaattccttggaggtcagttggggggccgtggcgaccgcagactcatacctcttgcagctgcagaagtacgatatccccgctactgccgcgacagctacctcccctactcctaatccagtgccatccgtgccagcgaaccctcccaagtctcctgctccggctgccgccgcaccagctgtgcagcccctgacccaggttggcattaccttgctccctcaagcagcccccgctcctcctaccacgaccactatccaggtcttacccactgtgccgggcagttctatttccgtgcccaccgcggctaggacccagggagtccccgccgtgttaaaggtgaccggaccacaggcaaccaccgggacacccttggtgacaatgcgccctgcatcccaagccggtaaagcacctgtaactgttacgagcttgcctgctggagtgaggatggtcgtgcctacccaaagtgcccaaggcactgtcattggctctagtccacaaatgagcggaatggcagcactagcagctgccgcagctgccacacaaaaaatacctccttcaagcgcacctactgtcctctctgttcccgcagggaccaccatcgtcaagactatggccgttacgccaggaactacaacattgcccgctacggttaaagtagcatctagcccagtcatggtgagtaatccagccaccagaatgctgaaaaccgcagctgctcaggtggggacaagtgtttcatcagccaccaacacctcaacacggccgattatcacagtccacaaatccggcaccgtcacagtggctcagcaagctcaggtcgtgaccacagtggtgggaggtgtgacaaaaacgattacattagtgaaaagccctatttccgtcccaggaggttctgctttgatttccaacctgggcaaggttatgtccgtcgtccagacaaagcctgtccagacatccgctgtaactggtcaagcttctaccggccccgttacacagatcattcagaccaaaggaccacttcccgcaggaaccattctgaaattggttactagtgcagacgggaagccaactactattatcacaacaacacaggcctctggcgcaggaaccaaacccacaattctggggatttcaagcgtctccccttctactactaaaccagggactactaccatcattaagaccatcccaatgtcggctattattacccaggccggagccacgggcgtgaccagtagcccaggaatcaagtctcctatcacaataattaccacaaaggttatgacatctggcacaggtgccccagccaagatcatcaccgccgtgcctaagatcgctacaggacacggccaacagggagtcactcaggtcgtgttaaaaggcgcccctgggcagccaggaacaatcctgaggactgtgcccatgggtggtgtccgcctggtcacccccgtgaccgtgagtgcagtcaaaccggcagtgacaaccctcgtggtaaagggaacgacgggcgtaacaaccctgggaaccgtaacagggacagtgtccacaagcctagctggcgccggaggtcactccacatctgcttcacttgccacacctatcaccacactgggaaccattgctaccctcagttcccaggtcatcaatcccacagcaataaccgtgtccgcggcgcagactacgctcacagcggctggagggttgactacgcccactatcaccatgcagcccgtttcccagccgactcaggtgaccctgatcactgcccccagtggggtggaggcccagccggtacatgaccttcccgttagcattcttgccagccccactactgaacaacccacagcaactgtgacaatcgctgacagcgggcagggggacgttcagccaggcaccgtgacactggtgtgctccaatcctccctgcgagacccatgagacaggaactacaaacacggcgaccaccacagtggtcgccaacttgggaggacatcctcagccaacgcaggtacagtttgtgtgcgatcgacaggaagcagcagcatcattggtgaccagtacggtgggacagcagaacggctcagtggtgcgagtctgctccaatccaccctgtgagactcatgagaccgggaccactaacacagcaacaactgctacgtcgaacatggcaggacagcacgggtgcagcaatcctccctgtgagacccatgagaccggtacgactaatactgcaaccaccgccatgagtagcgtgggagccaaccaccaacgagatgccagaagggcctgcgcagccggcacaccagcggttattaggataagtgttgctactggggcactcgaagccgctcaagggagtaaatcccagtgccagacacgtcagacaagtgctacatcaaccacgatgaccgttatggccacaggcgctccatgcagcgccggccctctgctgggaccctctatggctcgggagccgggaggcagaagcccggcctttgtccaactggctcccctctcctctaaggtgcgcctttctagcccatcaatcaaggatttgcccgccggacgacactcacatgctgttagcaccgcggccatgacacgttcttctgtaggggcgggtgagcctcgcatggcccccgtttgtgaaagtcttcaaggtggctctccttcgacgaccgtgactgttacagcccttgaggcattgctctgtccttctgcaactgtgacccaggtgtgtagcaaccccccatgcgaaacccatgaaacagggacgactaataccgccaccacatccaacgcagggagtgcacagcgggtgtgcagtaaccccccctgtgagacccacgaaacagggactactcataccgcgaccactgccacatccaacggggggaccggccagcccgaggggggacagcagccgcccgccggcagaccctgcgaaacccatcaaactacctccacaggtacaacaatgagcgtctccgtgggagcactcttgcccgacgctacctcgagccaccgaacggtcgaaagcggtctggaggttgctgcggctccctccgtcaccccccaggccggcactgctttactggctcctttccctacgcagcgcgtgtgtagcaatcccccttgcgaaacccacgaaaccggtactacccacacagcaaccacagtgacatctaatatgtcgagtaatcaggacccccctccagcagcttcagaccagggggaggtagaatctactcagggtgacagtgttaacattacctccagttctgccattacaacaactgtttctagcaccctgactagggcggtcaccacagtgacccaatctacaccggtgcctggcccctccgtgccaccaccagaagagctacaggtaagtcctgggcctcggcaacagctgcctcctcgccagttgcttcagagtgccagcactgctctgatgggagagtccgcagaggtcctctccgcttcacagacccctgagttaccggcagctgtcgatctgagttctaccggagagccatcatcggggcaggagagtgctgggagcgccgtcgtggctacggtcgtagttcagccaccacctccgacacagtctgaagtcgatcagctgtcccttcctcaggagctcatggccgaagctcaagcggggaccacaaccctgatggttacgggcctgaccccagaggagctcgctgtcacagcggcagcagaagcggccgcgcaagctgctgcaactgaggaagcccaggctttggccatccaggccgtgctgcaggccgcccaacaggccgtcatgggaacaggcgagcctatggacacctccgaagctgccgctaccgtgacacaggctgagctgggacacctctcagccgagggacaggaaggacaggccactaccatcccaatagtactgacccagcaagaactcgccgcactcgtccagcaacagcaattgcaagaggcccaggcgcagcagcaacaccatcacctccctaccgaggctctcgccccggcagatagcctcaacgatcccgccatcgaaagcaactgcctcaacgaactcgctggaactgtgcccagcaccgttgccctactgccatcaacagccacggagtccttggcgccctctaacacctttgtcgcacctcaacccgtggtcgtggcctcccctgctaaactacaagcagcagctacattgaccgaagtggccaacggcattgagagcttgggagtcaaaccagatctgccaccaccaccatccaaggctcccatgaaaaaggagaaccagtggtttgacgttggggtcattaagggcacaaacgtgatggttactcactacttcttaccccctgatgatgcggtcccttcagacgacgatctaggcactgttccagactacaaccaactgaagaaacaggaactccagccaggcactgcatataaattccgggtggctggcatcaatgcatgtggcaggggtcctttctctgaaatctcagcgttcaaaacttgtctgcccggcttcccaggcgctccctgtgctatcaagatttccaaatcgccagatggtgctcacctcacatgggaacccccatctgtgacaagcggaaaaatcattgagtactctgtgtacctggccattcagtcctcacaggccggcggagaattaaagtcttccaccccagctcaacttgcgtttatgcgagtatactgcgggcctagtccttcatgcctggttcaatcgagtagcttgagcaatgcacatattgactatacaaccaagcccgccatcattttccggattgccgcacggaatgagaaaggctatgggccagcaacacaggtgaggtggctccaggagacttccaaagattcaagcggaacaaaaccagccaataagagacctatgtcaagtccggaaatgaagagcgctcctaaaaaatccaaggccgatggacaatag

SEQ ID NO: 120204 - DNA, 5901 bp, Artificial Sequence
  Description of Artificial Sequence: Synthetic coding sequence
atggccagtgctgtgtccccggctaatttgcctgccgtgctcctgcaacccaggtggaagagagtcgttgggtggtctggcccagtccctaggccacggcacgggcaccgagctgtcgccataaaagagctgatcgtggtttttggaggaggcaatgagggaatagtggatgaactgcatgtgtacaacacagcaaccaaccagtggtttataccagcagtgcgaggcgatatccctcccggctgtgctgcctacgggttcgtatgtgatgggaccaggctgctcgttttcggcggcatggttgagtatgggaaatactccaacgacctgtacgaacttcaagctagcagatgggagtggaagaggctaaaggctaaaacaccaaaaaacgggcctcccccgtgtccccgactaggccattccttctcccttgtcggcaataagtgttatctcttcggtggcctcgccaacgattctgaggacccgaagaataacattcctaggtatctgaatgatctgtacatcctcgaactcaggcctggatccggcgtggtggcctgggatatcccaattacatacggcgttctgcctcctcccagggaaagtcacacagctgtggtgtacacggaaaaagacaataagaagtctaagctggtcatctacggaggcatgagcggctgccgcctgggagacctgtggaccttggatatcgatacccttacttggaataagccgtcccttagcggcgtggcaccgttaccaaggagcctgcattcagccaccacaatcgggaataagatgtacgtttttggcggatgggtacccctggttatggatgacgtcaaagtggctacacacgaaaaagaatggaaatgcacaaataccttggcttgtcttaatttggacaccatggcatgggagaccatcctcatggacaccttggaagataacattccaagagcccgagccgggcattgtgcagtggcaatcaacaccagactgtatatttggtcaggtcgagacgggtataggaaggcgtggaataaccaagtatgttgtaaggatttatggtacctagagactgaaaaacctcccccacctgcacgggtccagcttgtgcgtgcgaataccaactctcttgaggcggcccctgcacctccaacgaccactacaattcaagtattgccgactgttccgggctcgtcaatctccgtgccaaccgccgccaggacccagggcgtgcccgcagtcctcaaggtgaccggccctcaggccacaactgggacaccattggtgacgatgcggcccgctagccaagctggaaaagctcccgtcacagtcaccagcttgcccgcaggcgtccgtatggttgtgccaacacagtccgctcagggtacagtaataggaagttctccccaaatgagcggtatggccgccctcgctgcggccgcagcagccacacagaagatccctccctccagtgcccctactgtgctcagcgtccccgctggaaccaccatcgtgaaaaccatggctgttacccctggcacaactacgttgcctgccacagtaaaggtcgctagttcaccggttatggtgagcaacccagccacaaggatgctgaagaccgctgccgctcaagtgggaacaagcgtctcaagtgccacaaataccagtacccgccccattattaccgtgcacaagtccggaaccgtgaccgtggcccagcaagctcaagtcgtgacaaccgtggtcggcggcgtcaccaaaaccatcacgctggtgaaatcccctatcagcgttccaggaggttctgcactcatctctaacctggggaaagtaatgtcagtggtgcagactaaaccagtgcagacctctgctgtgaccggccaggccagcacagggcccgtcacacaaatcatacagaccaaaggcccattgcccgccggcacaatcctgaagttagtgacttccgctgatggcaagcctacaactatcattactacaacgcaagcctcgggtgctggcacaaagcctacgattctcggcatttctagcgtgtcaccctcaacaactaagcccggaaccaccactattattaaaactatcccaatgagcgccattattacccaggcaggagcaacaggcgtaaccagctcccccggcattaagtctcccatcaccatcattaccacgaaagttatgacctccggaacaggcgcccccgcgaaaattattaccgctgtacccaagatagcaacaggtcacggacagcaaggagtgacccaggtcgtgctgaaaggagctcccggacagcctgggactatacttagaacggtgcctatggggggagttcgccttgtaactcctgtcacggtcagcgcagttaaaccagccgtgacaaccctggtggtgaaagggaccacaggtgttacgaccctgggaaccgtcaccgggactgtctcaacctccttggcgggcgcaggggggcactccacatcagcttctcttgcgactcctattaccactctaggtactattgccactctgagttcgcaggtgattaacccaactgccatcacagtatcagccgcacagaccaccttgacagctgccgggggtctaaccacccccaccatcaccatgcaaccagtttctcagcctactcaagttacattaatcacagccccttcaggagtggaggcccaaccagttcacgacctccctgtgtcaatcctggcttctcctactaccgaacaacccaccgcaactgtgactattgctgattctggccagggcgatgtccagccaggcacagtgactctggtttgttcgaaccccccgtgcgaaacacacgagaccggcaccacaaatacagctactacgactgttgtggcaaaccttgggggacaccctcagcccactcaggtgcaatttgtttgtgatcgccaggaggcggccgcatcattagtgacctctaccgtaggccagcagaacgggagtgtggtgcgggtgtgcagtaatcctccctgcgaaacccacgagaccggcacaacaaataccgcaaccaccgccaccagcaacatggcaggccagcatgggtgctcaaacccaccctgcgaaacacacgagactggtactaccaatacagcgactacagcaatgagctccgtcggtgccaatcatcagcgggatgctcgaagggcttgcgccgccggaactcctgccgtgattcgaataagtgtggcaacaggtgctctggaggccgcacaaggctctaaatctcagtgccagacgcggcagactagtgcaacaagcacaactatgacagtgatggccactggtgccccgtgctctgcaggaccgctgctgggaccaagcatggctcgggaacctggtggtcgctcacccgcgttcgtgcagctcgcgccactgtcttctaaagtgcgtttatctagcccttctataaaggatctcccagcgggcaggcactcacatgctgtcagcactgccgccatgacaagatcatctgtgggcgcaggagagcctcggatggcccctgtctgcgagtcgctccagggaggtagcccttcaaccactgtgaccgtcactgcattagaagctctcctgtgcccatctgccaccgtgacacaagtctgtagcaatcctccctgtgaaacccacgaaactggtactactaacactgccactactagtaacgctgggtcagctcagagagtatgttctaaccccccatgcgagactcatgagacaggcactacacatacagccactactgccaccagcaacgggggcacaggacagcccgaaggaggccagcaaccccctgcaggccggccgtgtgagactcaccagaccacatcaaccggaacaacgatgagcgtgtctgtaggggctcttctgcccgatgctacttcctctcatcgtacagtggagagcggcctggaagtcgctgcggcgcccagcgttacacctcaggccgggacagccctactggcgcctttccctactcagagggtatgttcaaaccctccatgcgagactcatgagacaggtacgactcatacagccactacggtgaccagcaatatgagctccaatcaggatccccctcccgcagcatcagaccagggggaggtggagtcgactcaaggagattctgtcaatatcacatctagctccgcgattaccacaacagtgtctagtactctgacacgcgcggttactactgtgactcagtccacacccgtgcccggaccctccgtaccaccacccgaggagctgcaggtctcaccagggcccaggcagcagcttcctcctaggcagctactgcagtctgcttccacagccctgatgggtgagtcagccgaggtgctgtctgcatcccagaccccagagttacctgcagccgtagatctgtcatccaccggcgaaccttcatccggccaagaaagcgctggctccgccgtagttgccacagtggtggttcagccccccccgcctacgcagagcgaggtcgaccaactctctctcccgcaagaactaatggccgaagcccaggccggaacaaccaccctgatggtgaccggtctgacgcccgaagaactggcagtgaccgcagctgcggaggccgctgcccaggctgccgccacagaggaagcccaggccctcgcaatccaagccgtactgcaagccgcccagcaagcagtgatgggcaccggtgaaccaatggacacatctgaagctgcagccaccgtgacccaagccgagctgggtcatctcagtgctgagggacaggaggggcaagctacaactattcctattgtcttaacccaacaagaactggccgccttggtccagcaacaacaattgcaggaggcccaggcacaacagcaacaccaccatctgccaactgaagcactggctcctgcggatagtctcaatgatcccgccatcgagagcaattgtctgaacgagttggccggaacagttccttccaccgtggctctactgcctagcactgccactgaatcccttgctccttctaacaccttcgtagcgccccaaccagttgtggtggcatctccagctaagctgcaagcagcagccacccttacagaagttgccaacggcatcgagtctctgggagttaaaccagatctgccaccgccgcccagcaaagcccccatgaagaaggagaatcagtggttcgatgttggggttatcaaaggcaccaatgtcatggtcacccactactttttgccacctgatgatgccgtgccgtctgacgatgatttaggaactgtgcccgactacaaccagctaaagaaacaagaattacagccgggtactgcttataaatttcgtgtggccggcatcaacgcatgcgggagggggccatttagcgaaatctccgcgttcaaaacttgcctcccagggttcccgggggcaccatgtgctattaagattagcaagagcccagacggagcgcatcttacctgggagcccccctccgtaacatcagggaagataattgagtactctgtttatttggccattcagtctagccaggccgggggagagctaaaatcctctacgcccgcacagctggcctttatgcgtgtgtactgtggaccctcaccaagttgtctggtgcaatcatcctccctctcgaacgcccatattgactacactaccaagcctgcaatcatctttcgcatcgctgcccgtaacgaaaaaggatatgggccagccacccaggtccggtggttgcaagagacttctaaagattcttccggaactaagccagcaaacaagagacctatgagtagcccggagatgaagtctgctcctaaaaagtctaaagccgatggtcagtag

SEQ ID NO: 120205 - DNA, 6243 bp, Artificial Sequence
  Description of Artificial Sequence: Synthetic coding sequence
atggcctccgcagtctcgccagccaacctacccgctgttctgctgcagcctaggtggaaacgcgtggttgggtggtccggtcccgtccctaggccaaggcacggccaccgagcggtggcaatcaaggagctgatcgtggtgttcggcggaggcaacgaggggattgtagacgagttgcatgtgtataataccgccaccaaccaatggtttatcccagccgtcaggggcgacatccctcctggatgcgctgcatacggattcgtgtgtgatgggacaaggctcctggtgttcggcggaatggtggagtatggcaagtattcgaatgatttgtatgagctgcaggctagtaggtgggagtggaaacgacttaaggcaaaaacaccaaagaatggcccccctccatgtccccggcttgggcattccttcagtttggttgggaacaaatgctatctgtttggcggcctcgccaatgatagtgaagaccccaagaacaatataccccggtatcttaacgatttgtacatccttgaactgaggccggggagtggcgtggtggcctgggacatcccaattacatatggggtgctgccaccgcctagggagtcccacaccgctgtcgtatacactgaaaaggacaacaagaaatccaagctcgtgatctacgggggcatgagcggttgtaggcttggggacttgtggaccctcgacatcgatactcttacctggaacaaacctagcctgtctggcgtggcccccctgccgcggagcctccattcagctaccaccatcggcaacaagatgtacgtcttcgggggctgggttcctctcgttatggacgacgtgaaggtcgcgactcacgaaaaggagtggaaatgcacgaacacactggcatgtttgaatctggacacaatggcatgggaaactattttgatggacaccctggaggacaacatacctcgggctagagccggtcactgtgctgtcgccataaacaccagactatacatttggtccggacgagacggctaccggaaggcttggaataaccaggtgtgttgtaaagacctgtggtacctcgagacagaaaaacctccgcctcctgcccgtgtccaactcgtacgcgcaaatacaaacagtctggaagtgagctggggtgcagtggccactgccgattcctacttactacagttacagaagtatgatatcccagccaccgccgccactgctacatctccgacacccaaccccgtgccttcagtacccgctaaccccccgaagagtccggctcccgccgccgcagcgcccgcagtgcagccacttactcaggtgggtataacccttctgccacaagcagcccccgctcccccaacaaccaccacgatccaggtgctcccaacagtaccaggcagctccatttccgtgccgacagcggcaaggacgcagggtgtaccagcagttctgaaggtgactggtccgcaggcgaccacgggcactccgcttgtgactatgcgacctgccagccaggctggcaaagcacctgtaacagtgacgagcctccccgcaggggtccggatggtcgtaccaacacagagcgctcaaggcaccgtgatcgggagcagccctcaaatgtccggcatggccgcactggctgccgcagcagccgccacacaaaagatcccaccatctagtgctcccacggtgctgtcagttcctgccggtaccaccattgtgaagactatggcggtcacgcctgggacaaccacccttcccgcgaccgttaaggtagcaagcagcccggtcatggtctccaaccccgctactcgcatgctcaagaccgcagctgctcaagtagggacctcagtctcatccgcgaccaacacatcgaccagaccaatcatcaccgtgcacaaaagtggcacagtgacggtcgcccagcaggctcaagtcgtcaccactgttgtggggggagtcaccaagaccataaccttagtgaagagccctataagtgtgcccggcggttccgcgctgatcagtaatctcggcaaagtcatgtctgtggtgcaaaccaagcctgtccagacatccgccgtcacaggccaggcgagcactggcccagtgacacagatcattcagactaagggacctctcccagcagggacgatcctgaagttggtcacctctgcagacggcaagcctaccaccataatcacaacgactcaggcaagtggcgcaggcacgaagccaacgattctgggcatatcttccgtgtctcctagcacaacaaaacctggcaccacaactatcattaaaactatcccaatgtcagccattattacacaagcaggtgccaccggtgtgaccagtagtccgggcattaagagccctatcaccattattaccacaaaggtcatgacaagcggaaccggtgcacccgctaagatcataacagccgtgccaaaaatcgcaacggggcatggacagcagggagtaacgcaggtagtattgaaaggggccccaggtcaacccggtactatcctgaggactgtgcccatgggtggagtgcgactggtaacgcctgtgaccgtatccgccgtgaagccagctgtgacgacattggtggtcaaaggcaccactggagttacgacacttggtaccgttactggaacggtgtccacaagtctggctggtgccggcggtcattccacctccgcttcactcgcgaccccaatcactactcttggtaccatcgctactctcagctcccaagtaatcaaccctactgctataaccgtgtcagccgctcagactacattaaccgcagctggtgggcttaccacacctacaatcaccatgcaacctgttagccaacccactcaggttaccttgataactgcgccatcaggtgttgaggctcaacctgtccacgatctccccgtgtctatcctcgcttcccctactactgagcagccaaccgcaaccgtaacaatagctgacagcggtcaaggtgacgtgcagcccggaaccgtaacactggtgtgttccaaccccccatgcgagacacacgaaaccggcacaaccaacactgcaacaaccactgtcgtcgccaatctgggtggccatccccagcccactcaggttcagttcgtgtgtgacagacaagaagcggccgccagcttggtaacgagcactgtgggtcagcagaacgggagcgtggtgcgtgtctgtagtaatcccccatgcgagactcacgaaacagggaccactaacacagcgacgaccgctacctcgaacatggccggacagcatggttgctctaatccaccctgtgaaactcacgaaactggaactactaataccgctactacggcaatgtcatccgttggggccaaccaccagcgcgatgcacgccgggcttgcgcagctgggacccccgccgttattcggatatcagtcgctacaggcgccctagaggcagcccaggggtctaaaagccagtgtcagacccgtcagacttccgcaacatctacaacaatgactgtcatggccacaggggcaccttgctctgccggccccttgctgggtccctcaatggctagggaaccggggggtcgatcacctgctttcgtgcagctcgcccccctgagcagtaaagtcagactgtcctctccatcaattaaggatctcccagccgggagacacagccatgctgttagcaccgctgctatgaccaggagctctgttggggcaggagaaccccgcatggcccccgtctgtgagagcctgcagggcggaagcccatcgacaacagtgacagtgaccgccttggaagcactactgtgcccctcagccacggtaacccaggtatgctccaatcctccgtgcgagactcatgagacaggcaccaccaacacggctaccacctcgaacgcagggtctgctcagcgagtatgctctaacccaccctgtgagacacatgaaacagggactacgcacacagcaaccacagctacctctaatgggggtacaggccaacccgaaggcggccagcagccgcctgctggtaggccctgtgaaacacaccaaacaacatccaccggcacaaccatgtccgtttccgttggcgccctgctccctgacgccacaagctctcaccgcacagtggaatccggcttagaagtggcagcagccccctcagtgacaccacaggctggcaccgcactgttggcccccttccctactcaaagagtgtgctccaaccctccctgtgagacacacgagactggcactacacatactgccacgactgtcactagcaacatgtcctcaaatcaagacccgccacccgccgccagtgaccaaggcgaggtcgaatccacccagggggactctgtgaacataacctcgagttcggccattaccactaccgttagttctacgctcacacgtgctgtcactactgttacacaaagcaccccagtccccgggccaagtgtgcccaaaatttcatccatgacagagactgccccccgtgccctcaccactgaagtaccgattcctgcaaaaataacggtcaccatcgccaacactgagacaagcgacatgcctttctctgccgtcgacattctgcagcctcccgaggaattgcaagtgagccctggccctaggcagcagctgccacctcggcagttgctgcaaagcgcttctactgcccttatgggcgagtccgccgaagttttgtctgcctctcaaacacccgagctgcccgctgcagtggacttgtcgtcaaccggcgagccaagttctggacaggagagcgccgggagtgccgtagtggcaaccgtggtcgtgcagccaccgcctcctacccagagtgaggtggatcagctttcattgcctcaagagctgatggccgaggctcaagcagggacgactactttgatggtaaccggcctgactcccgaagaattagccgtgacagctgccgctgaggctgcagcacaggcggccgccacagaagaggctcaagctctggcaatccaggcagtgctgcaagcagcgcagcaggctgtcatggccggcaccggtgaaccaatggacactagtgaggccgccgccacagtaacgcaggcggaattgggccacctctctgccgagggacaggaaggccaggcgacaaccattcccattgtgctaacacaacaagaactagccgccctggtgcaacagcaacagctgcaagaggcacaggcccagcagcagcatcaccatctcccaacggaggctttagccccggccgacagcttaaacgaccccgcaatcgaaagtaactgcttgaacgaactggctgggacagtccctagcacagttgccctactgcccagcacagcaaccgaaagcctggcgccatctaatacattcgtcgcaccccaacccgtggtagtcgcttcccctgccaagttgcaagcggcggctactctcactgaagtggctaatggtatcgagtctttaggggtgaagcctgacctccccccccccccgtcaaaggcacctatgaagaaagagaatcagtggttcgatgtgggtgtaattaaggggacaaacgttatggtaacccactatttcctgccacctgacgacgcagtgccgtcagatgatgacttggggactgtgcccgactataatcagctgaagaagcaggaactgcagcccggcaccgcctataaattccgagtagccggcattaacgcctgcggacgggggcctttctccgagatctctgccttcaaaacatgcctaccagggttccccggcgcgccatgtgccattaagatctctaaatcacccgacggcgcccacctcacctgggaacctccaagtgttacctcaggcaagatcattgaatacagtgtgtaccttgccatccagagctctcaggccggtggtgagctgaaatcgtctaccccggcccaattggctttcatgagagtgtattgtgggccatccccaagctgtttagtgcagtcttcctcactaagtaatgcccatatcgactacaccacgaagccagccataatctttcgaattgccgctcgcaacgagaagggatacgggcctgctacgcaggtccgatggctgcaagagacatctaaagacagtagcggaacaaagcctgccaataaacggccaatgagctctcctgagatgaaaagcgcccctaagaaatcaaaagctgacggccagtag

SEQ ID NO: 120206 - DNA, 1305 bp, Artificial Sequence
  Description of Artificial Sequence: Synthetic coding sequence
atggactctgttgagaagggtgccgcgaccagcgtttcaaatcctcgcgggagaccttcgagaggtaggcctccgaagcttcagaggaattcaagaggcggccagggccggggggtggagaagcctccacatttggcggctttgatcttggctcgaggaggtagcaagggcatacccttgaagaacatcaagcatctggctggcgtcccactgatagggtgggtactccgggccgcgctagacagcggggcatttcagtccgtgtgggtgagtactgatcatgacgagattgaaaacgtggctaagcagttcggagcgcaagtgcatcgtcgctcatctgaagtgtccaaagactcctctacatccctggacgccattatcgagttccttaattatcacaatgaagtcgatatcgtaggcaatattcaggccacatcaccctgtctccaccctacggatttgcaaaaggtggcagaaatgatccgggaggagggctacgactccgtctttagtgtggtgcgcaggcaccagttcaggtggtcagagatccagaagggcgtgagggaagtaacagaaccactgaacctgaaccctgccaagcgaccccgtcgccaggactgggatggcgaactttatgagaacggaagcttttactttgccaagcgccacttgattgaaatgggatatttgcagggtggtaagatggcttattatgagatgagagctgaacactctgtcgacatcgacgtggacatcgactggcccattgccgagcaacgcgtgctgagatatggatacttcggaaaagaaaagctgaaagagatcaaactgctggtgtgtaacatcgatggctgcttgacaaacggccatatttatgtgtcgggagatcaaaaagagattatatcatatgacgtgaaagacgccatcggcatttcattactgaaaaaaagcggcatcgaggtaaggttgatctccgaaagggcctgcagcaaacagacactgagttcccttaaattggactgtaaaatggaagtgtccgtgagtgacaaactggctgtcgtcgacgagtggcggaaggaaatgggactgtgctggaaagaggtggcgtacctggggaacgaagtctcagatgaggagtgtctgaaaagagtgggcctgtcaggtgcacccgcggacgcctgcagcacagcgcagaaggccgttggatacatctgtaagtgcaacggagggcgaggagcaatccgcgagtttgccgagcatatctgcctgctcatggaaaaagtgaataattcttgccagaagtag

SEQ ID NO: 120207 - DNA, 507 bp, Artificial Sequence
  Description of Artificial Sequence: Synthetic coding sequence
atggcatttaatgattgcttctcactaaattacccaggtaacccctgccccggcgacctgattgaagtgtttaggcctggttatcagcattgggccctgtaccttggcgacgggtacgtgatcaacattgctccggtggacgggattcccgcctccttcacaagcgcaaaaagcgtgtttagtagcaaggctctcgtgaagatgcagctccttaaggacgtggtcggcaatgacacctaccgtattaataacaagtatgatgagacctatccaccactgcccgtggaagaaatcattaagagatctgaatttgtcattggccaggaagtcgcctacaacttgcttgtaaacaattgcgagcacttcgttacactgctgaggtacggcgaaggcgtgagcgagcaggctaaccgagccatctcaactgtcgaattcgtgactgcagcggtgggagtcttttcctttctcggactcttccctaagggacaaagagcgaagtattactag

SEQ ID NO: 120208 - DNA, 489 bp, Artificial Sequence
  Description of Artificial Sequence: Synthetic coding sequence
atggctttggcacgccctagacccagactgggggatctgatcgagatttctagattcgggtatgctcattgggccatatacgttggggatggttatgttgttcatcttgcacctgctagcgagattgcaggcgccggagccgctagcgtcctttcagctctgaccaataaggccatcgtgaaaaaagagttactgagcgtagtggctggtggtgacaactacagagtgaacaataaacacgacgatagatatacacctttacccagcaataaaattgtgaagcgagcagaagagcttgtgggacaggagcttccatactccctcacttccgacaattgtgagcatttcgtcaatcaccttcggtacggagtatctcgaagcgaccaagtgactggtgccgtaacaacagtcggcgtggctgcaggtctgctcgccgccgcatcactggtggggattttgttggcaaggtccaagcgcgaaaggcagtag

SEQ ID NO: 120209 - DNA, 1023 bp, Artificial Sequence
  Description of Artificial Sequence: Synthetic coding sequence
atgaaggaggaccaggtggtggccgaggagcctggcttccaagacgaagaagaatcactgtttcaggatatcgatctccttcagaaacatggcatcaacgtggcagatatcaaaaaactgaaaagcgtgggcatatgtacaataaagggaatacagatgaccacgcggagagcgctctgcaatgttaaggggctgtccgaagctaaggtggataagattaaggaggctgccaacaagctgatagaaccagggtttctgaccgcattcgagtatagcgaaaagaggaagatggtattccacattaccacgggttcacaggaattcgacaagctgctgggcggcggtatcgagagcatggctattactgaggcctttggcgagtttcgcacagggaagacccaactttctcatacgctgtgtgtaacagcccaactgcccggcgctggcggttaccccgggggcaagattattttcattgatacggagaatacatttagacccgatcgcctcagggatattgcggacagatttaacgtggatcacgatgctgtcctggacaatgtgctttatgcccgtgcctacacgagtgagcatcaaatggaacttctggattacgtggcggccaagttccacgaagaggccgggatcttcaagctgttgataattgattccatcatggctctgtttagagtcgattttagcggaagaggagaactcgccgagagacagcagaagttggcccagatgctgtcccgtttgcagaaaattagcgaggaatataatgttgccgtgttcgtcaccaatcagatgactgctgaccccggggctaccatgacatttcaagcagaccccaaaaagcctattggcggtcacatcctggcacacgcgtcaactaccaggatctcgcttaggaagggaagaggagagctgcgcatcgccaagatatatgactcccccgagatgccagagaatgaggctaccttcgctattaccgcgggtggaatcggggacgcgaaggaatag

SEQ ID NO: 120210 - DNA, 1080 bp, Artificial Sequence
  Description of Artificial Sequence: Synthetic coding sequence
atgagtgacgaaggcagtcgcggctctcgccttccactggccctgcccccagccagtcaaggctgcagctcaggcggtggaggaggcggatcaagtgccgggggctcaggcaactctaggccacccagaaacctccagggattgctgcagatggccataacagccggttctgaggaacccgacccgcccccagagcccatgagtgaagaacgccgccagtggctgcaggaagctatgtcggccgcattccgcggccagagggaggaagtggagcagatgaaatcttgccttagggtcctttcacagcccatgcctcccactgcaggtgaagcagaacaagcggcagatcagcaagagcgcgaaggggccctggagctgctggctgacctgtgcgaaaacatggataacgccgcagacttctgccaactgtctggaatgcatttgcttgtgggacgttatctggaggcgggcgccgcaggactcaggtggagggccgcccagctgatcggcacttgctcacagaacgtggctgctattcaggagcaagtactgggccttggcgccttgaggaagctgcttagactgcttgacagggatgcctgtgatacagtgcgcgtgaaagcactgttcgcaatctcatgcctcgtgcgagagcaggaagcagggctcttacagttcctgcggttggacggcttttccgttttgatgagagcaatgcaacagcaggtacagaagctaaaagtaaagtctgctttcctactccagaatctacttgttgggcatccagagcataagggtacactgtgctcaatgggcatggttcaacaacttgtggctctcgtgcggactgaacattcaccctttcacgaacacgtgcttggggctctctgtagtctggtcacggatttccctcagggcgtccgcgagtgccgcgagcccgaactggggcttgaagaactcctacggcacagatgccaactgctgcagcagcacgaggagtaccaggaggaacttgagttttgcgaaaaactgctacagacgtgcttctcttcccccgccgacgattcgatggatcgctag

SEQ ID NO: 120211 - DNA, 774 bp, Artificial Sequence
  Description of Artificial Sequence: Synthetic coding sequence
atgtctgacgagggtagtcgaggttctcgccttcctctggctctaccaccagcttcgcagggctgttcttccggcggagggggaggaggctcttccgcaggaggtagcggcaactctcgcccaccgagaaatttacaagggctcctgcagatggccatcactgcaggatctgaagaacccgacccccctccagagccaatgagtgaggaaaggcggcagtggcttcaggaggcaatgtctgctgcattcagagggcaaagagaggaggtcgaacaaatgaagagttgcctgagggtgctgtctcaacctatgcctcccactgcgggagaggctgaacaggccgctgaccagcaggaacgcgaaggcgcattggaactgcttgctgacttatgcgagaatatggacaacgccgctgacttttgccaactgtcaggtatgcacctgttggttggcaggtacttagaggctggagcagccgggctcagatggagggctgcgcagctcatcggaacctgtagtcagaacgtggccgctatccaggagcaggtgctggggttgggggctctgagaaagcttctccgcctcctcgaccgtgatgcctgcgacacgggcgtcagagagtgtcgagagccagaactcggtctcgaggaactactgcggcataggtgccaactcctccagcaacatgaagagtatcaggaagaactggaattctgtgaaaaactgcttcagacctgcttcagctcacctgccgatgattccatggacaggtag

SEQ ID NO: 120212 - DNA, 1080 bp, Artificial Sequence
  Description of Artificial Sequence: Synthetic coding sequence
atgtccgacgaggggagccgggggtctcggctgcccctggctttgcccccggcttctcaaggctgcagctcaggaggaggaggaggaggctcgtccgccggtggttctggcaacagcaggccgcccagaaacctgcagggcctgctccagatggccatcaccgcagggtctgaagaaccagacccccctcccgagcctatgagcgaagagcggcggcagtggctccaagaagctatgagtgcggcgtttcggggccaaagggaggaagtggagcaaatgaagagctgcttgcgggtgctgtcgcagccaatgccacccacggcaggagaagctgaacaggccgctgaccagcaagagagagaaggcgctctggagctgttggctgatctttgcgaaaacatggacaacgccgccgatttttgccaactgagcgggatgcacctcctggtggggcggtacctggaagccggagccgctggcttgcgttggcgcgccgcccagcttatcggcacttgctcccagaacgtggctgccatacaagagcaggttctgggtctgggcgcactgaggaagctgctgagactcctggatcgggatgcatgcgatacagtgcgtgtgaaagctctttttgctatatcctgtctggtacgggagcaagaggcaggcttgttgcaattcttgagactagatggattcagtgtgctgatgcgggccatgcagcaacaggttcagaagctaaaggtgaaatccgcattcttgttgcagaacttgctcgtaggtcatccggagcacaagggtaccctctgctccatgggaatggtccagcagctggtagcattagtgcgcactgaacactcaccctttcatgagcacgtgcttggggctctgtgctctctggtgactgactttcctcagggcgtccgagagtgcagagagcccgagctcggactcgaagagcttcttcgccaccggtgccaacttctgcagcaacatgaggaatatcaggaagaactggagttttgtgagaaactactgcagacctgcttctcaagtcccgctgatgatagcatggaccggtag

SEQ ID NO: 120213 - DNA, 1443 bp, Artificial Sequence
  Description of Artificial Sequence: Synthetic coding sequence
atgcagattccacgcgccgcattattaccactcctgctactcctacttgcggctcctgctagcgctcagctgtccagagcagggcggtctgctccactggccgccggatgccccgaccgatgcgagcccgccagatgtccgcctcagcccgagcattgtgagggggggagggcacgcgacgcatgtggatgttgcgaggtgtgcggtgcgccagagggtgccgcctgcggcttacaggagggcccttgcggcgaagggttacaatgcgtggttccattcggagtgcctgcctctgctaccgttcgcagacgtgcacaggcaggtctttgcgtttgtgccagttcagaaccagtatgtggaagcgacgctaatacctacgccaatttatgccagctgcgcgctgcaagccgtagatctgaacgactgcatcgacctcccgtgatcgttttgcagcgcggggcatgtggccaaggccaggaggacccgaactccttacgacataaatataacttcatcgccgacgtagtagagaaaattgccccagctgttgtccacatcgaactttttcgcaagctcccctttagcaaaagagaggtccccgtggcctctggcagcggattcatcgtctctgaggacggccttattgtcacaaacgcccacgtggttaccaacaagcaccgggtcaaggtggaactgaaaaacggtgctacctatgaggcaaagataaaggacgtggatgaaaaggcagatatcgctctcatcaagatcgatcatcagggcaagctgcccgtgcttctgctaggcagatcatccgagctgcgtccgggagagttcgtggtggccatcggatccccattttcccttcagaatactgtcaccaccggcatcgtctctacaactcagagagggggaaaggagttgggccttaggaactctgatatggactatatacagacagatgcgattataaactatggcaattccggcggccctctggtgaatctggacggagaggtaatcggtatcaacaccctcaaagttaccgctggaataagctttgccatcccctcagacaagatcaaaaagtttttgacagagagtcatgacagacaggccaaggggaaggccattacaaaaaagaagtatattggtattcgcatgatgtccctaactagttccaaggcaaaagaactgaaagacagacaccgggatttcccagatgtgatcagtggcgcctatattattgaggtgatccccgacacccccgcagaggcaggtgggctcaaggaaaatgatgtcataatctcaattaatggccagtccgtggtgagtgcaaacgatgtttctgacgtgatcaaaagagaatcaactctaaacatggtggtgagacgggggaacgaggacattatgatcacggtcattcccgaagagattgacccttag

SEQ ID NO: 120214 - DNA, 666 bp, Artificial Sequence
  Description of Artificial Sequence: Synthetic coding sequence
ggcaaactccccgtgctgctcctcggtagaagctctgaactgcgcccgggagagtttgtggtcgccattgggagccctttctctttgcagaacaccgtgactactggcatcgtgagcacgactcagcggggaggtaaggagctgggccttcgcaacagtgatatggactatatccaaaccgatgctatcattaactatggtaacagcggcgggccccttgtaaatctggatggggaagtgatcgggattaacaccctcaaagtgacggctggaatcagcttcgctatcccatctgataaaataaagaagtttctgacagaaagccatgatcgccaggctaaagggaaggccatcactaagaagaagtatatcggtatacgcatgatgtccctaacgagtagcaaggcaaaggaactcaaagaccggcaccgtgactttccggatgtcatcagtggcgcttacatcatagaggtgatcccagatacgcccgctgaagccggcgggctgaaagaaaacgatgtcatcattagtatcaatgggcagagcgtcgtctccgctaacgatgtgagtgacgtgatcaaaagagagtccacactgaatatggtggttaggcgcggcaatgaggatattatgatcaccgtcattccggaggagattgacccttag

SEQ ID NO: 120215 - DNA, 1344 bp, Artificial Sequence
  Description of Artificial Sequence: Synthetic coding sequence
atgggctgggccgccaggccacgggcacttgcacctgctgcaccagaggctctgcttcacagtccccgtagacgctcccctgccctcgccctgtctgcagccaccgctgcagcagcccgcggaccgggccgagttcgactattaaggggagtgcgcagggctcgtggtcggagagtaagacctgccggcggtcctgttcgccggggtgctgcagttcggggcgcccttcggggggcgtccctgggccatggcgctgcggctcgtgctggccggcctctgtgcgtgcgtcagcagctgagagcagcttcccggagaagcgagcgactgcaccgaccaccagtcattgtgcttcagaggggcgcctgcggtcagggtcaagaggacccaaattcattaagacataaatacaactttatagcagacgttgtcgagaagatagcacccgccgtggtccacatcgagttattccgcaagctgccgttcagtaagagggaagtgcccgtcgcatcaggtagtggcttcattgtgtccgaggatgggttgattgtgactaacgcacacgtcgttacaaacaaacatcgagtcaaggtggagctgaagaacggcgccacctacgaggcaaaaattaaagatgtggatgagaaggcggatatagcgctcatcaaaattgaccatcaggggaaactgccggtactgttgctgggcagaagcagtgaactgcggcccggcgagtttgtggtagccatcggctcacctttctctctgcaaaataccgtcacaaccggaatcgttagtaccacccagaggggtggaaaggagctgggccttcgaaactctgacatggactatatccagaccgacgccatcatcaattatggcaatagtggtggcccactggtgaacctggatggagaagtgatcggtattaacaccctcaaggtcaccgcgggcatctctttcgcaattccctccgataagatcaagaagttcctcacggaatcacatgatcgacaggccaaggggaaagcaatcacaaaaaaaaaatatatcggcatcaggatgatgagcttgacatcttccaaggcaaaggaattgaaagatagacaccgggacttccctgatgtaatttccggggcctacatcatcgaggtcattccagacacccctgctgaggctggaggcctgaaagaaaatgacgtcattattagtataaatggacagtccgtcgtcagtgccaacgatgtcagcgacgttatcaagcgcgaaagtacgctgaatatggtagtccgccgtgggaatgaagacattatgatcacggttatccccgaagagattgacccatag

SEQ ID NO: 120216 - DNA, 1377 bp, Artificial Sequence
  Description of Artificial Sequence: Synthetic coding sequence
atggccgctccacgcgcgggtagaggtgccggatggtcactgcgcgcttggcgcgccttgggcggaattagatggggaagacgcccgaggctgacccctgatttgagagccctcctgaccagcgggactagtgatccacgggcccgagttacatacggaactccgtctctgtgggcacggctttcagtgggcgttacagagcccagagcttgcctaacttctggcaccccggggccccgggcccagctcactgccgtcaccccagacacgcgcacccgtgaagcttctgaaaatagcgggacacgcagccgtgcttggcttgcggtggctctgggtgccggcggggcagtccttctcctactgtggggcggggggcggggtccccccgccgtgctggcggccgtgccaagtccaccccccgcatcacctaggagtcagtacaactttatcgccgacgtggtggagaaaacagccccagccgtggtatacatcgagatacttgataggcatccttttctgggccgtgaagttcccatcagcaatgggtctggattcgttgtagctgctgatggactgatcgtgactaacgcccatgtcgttgcggatagacgaagagtaagagtacgccttttgtcaggcgatacatatgaggccgtcgtgacagcggtcgacccagtggcggatatcgctactcttcgcattcaaaccaaggagcccctgccgacacttcccctgggacgatctgccgacgttaggcagggggaattcgtggtggccatggggtcccccttcgccttacagaacaccatcacaagcgggattgtgagttcggcacagcggccagctcgcgacctcgggctgccacaaacaaacgttgagtacatccagacagatgctgccatcgattttgggaatagtggtggcccacttgtgaacctggacggcgaagtgataggagtaaatacaatgaaggtcacagccggaatttccttcgcaatcccatccgacagactgagggagtttctacacagaggcgaaaaaaagaactctagcagcggaattagcggatcccagagacgctacataggggttatgatgctcaccctgtctccttcaatcctagcagaacttcaacttcgagagccgagtttcccagacgtgcagcatggtgtgctaatccacaaagtgatacttggttccccagctcatagggcaggattacggccaggggatgtcatactggccatcggagagcagatggtgcagaatgcagaggatgtgtatgaagccgtcagaacacagtcccagctggcagtccagattaggcgcggacgagagacgctgaccctgtacgtgacccccgaagtcacagagtag

SEQ ID NO: 120217 - DNA, 1086 bp, Artificial Sequence
  Description of Artificial Sequence: Synthetic coding sequence
atggctgctcccagggccggacggggggctggttggagcctgcgggcgtggagggcgctgggcgggattaggtgggggcggaggcctcggctaacacccgatctcagagccctactgactagcggaacgagcgatccgcgggcccgggttacctacggtaccccctctctgtgggcccggctgtctgttggcgtgaccgaacctagggcatgcctgacctccggtacaccaggccctcgcgctcagctgacagccgtgacccccgatactcgaacacgagaagcttcagagaattccggaacacgctcccgcgcctggttagctgtggcactgggcgctggtggcgccgtgcttctcctcctctgggggggcggacgcggtccacctgctgtgctggcggctgtcccctctccccctcctgctagcccccggtctcagtataacttcatcgcagacgtagtggagaaaactgcgcctgccgtggtgtacattgaaatactcgacagacatccgtttttgggcagagaagtacctatctctaatggaagtgggtttgttgtggccgccgacgggttgatcgtgactaatgcccatgtggtcgccgatcgtcggcgggtgagggtgaggcttcttagcggggatacatacgaggccgtggtgacagcggtggatccagtagctgacatcgcaaccctaagaattcagactaaattcgggaacagtggaggaccattggtaaacctggatggcgaggtgatcggtgtaaatactatgaaggtaacagctgggatatcattcgcaattccgtcggatagattaagagagttcctgcatcgaggtgaaaagaaaaatagtagctcaggtatctccggcagccagcgaagatatattggggtaatgatgctgacactctcccctcgagctggcttgaggcctggagacgttatactggctattggtgagcaaatggttcaaaacgccgaggacgtatacgaggcagtgaggacacagagtcagctagctgtgcagataaggcgaggacgcgaaacgctgacactctatgtcactccagaggtgaccgagtag

SEQ ID NO: 120218 - DNA, 1362 bp, Artificial Sequence
  Description of Artificial Sequence: Synthetic coding sequence
atgcaggctagagccctcctgttggccgcgctagctgctcttgccctggcacgggaacctccagcggctccatgcccagcccgatgtgacgtgagcaggtgtcccagcccgcgctgcccaggcgggtacgtgcctgatctctgtaattgctgtctcgtgtgcgcagcctctgagggagaaccctgtggcggacctctcgacagcccatgtggggagtcgctggagtgtgtgagaggtttatgtaggtgtaggtggagccacgccgtatgtggcaccgacgggcacacctatgccaatgtgtgcgccctgcaggcggccagtcggcgggcactgcagttatcggggacccccgtacgacaactgcagaaaggagcttgtcctcttggacttcaccaactctcctccccgcgctacaagtttaatttcatagctgatgtcgtcgaaaaaatagcacccgcggttgtccacatagaactgttcctcaggcaccctctgtttgggcggaatgtgcccttgtcttcaggatctggtttcattatgagcgaagcagggttgatcatcaccaatgcccacgttgtatcttcgaacagcgcggctcccgggaggcagcagctcaaagtacagttacagaatggggactcatatgaggctactataaaggacatagacaagaaaagcgatatcgcaacaataaagatccatcctaagaagaagttgccagtcttactcctgggtcactcggccgacctgcgccccggcgaatttgtcgtcgccatcgggtccccatttgcgcttcagaataccgtcacgaccggaattgtgtctacagcccagagggagggcagggaacttgggctcagggactcagatatggactacatccagaccgatgccattattaattacggcaactccgggggccctctcgtcaacctggacggtgaggtaatcggaataaataccctcaaagtgaccgccggcatctcattcgccatcccctctgaccggataacacgatttctgactgaattccaagacaagcagatcaaggactggaagaagagattcattggtataagaatgaggacgattaccccaagtctggtggacgaactcaaggcatcaaacccggacttcccggaggtttcctcgggtatttacgtgcaggaggtggctccaaactcccctagccaacgcggagggatccaggacggggacataattgtgaaggtgaatggtcggccgctggtcgattccagtgaactgcaggaggctgtgttgaccgagagtccattgctcttggaggtcaggcgggggaacgacgacttgctgttttctatagcccccgaggtggtgatgtag

SEQ ID NO: 120219 - DNA, 1431 bp, Artificial Sequence
  Description of Artificial Sequence: Synthetic coding sequence
atgataagacctcaacttaggacagccggtcttgggagatgcctcttgcccggcctgctgttgctgctggtgcccgtgttatgggccggcgcagagaagttgcacacccagccgagctgcccagccgtgtgccaacctacgcggtgtcctgctttacctacatgtgctcttgggaccacccccgtattcgacctttgtaggtgctgtcgtgtgtgcccggccgctgagcgggaagtgtgtgggggagctcagggtcagccttgcgctcctggcctgcagtgcctacagcccttgcgacctggcttccccagcacttgtggatgcccaacactcggcggcgccgtgtgcgggtctgatagacggacgtatccaagtatgtgcgctctccgcgcggagaatagggcagcccggcgcctgggcaaagtgccagccgttccagttcagtggggaaattgtggcgataccggcacacggtccgcgggacctctgcggcggaattacaactttattgccgctgtggtggagaaggtggcaccttcagtggtgcacgtgcagctttgggggcgattgctccacggctcacgtttggtgccagtgtacagcggatccggattcatagtgtcagaggatggcttgattatcacgaatgctcacgtagtccgaaatcagcaatggattgaggtcgtgctgcagaatggcgctagatatgaggccgttgtgaaagacatcgacctgaaattagacctggctgtcatcaaaatagaatcaaacgcagagttacccgttctgatgctggggcggtcttctgacctccgggcgggcgagttcgtggtggcgctcggttcccccttttcactgcagaacaccgccactgccggcattgtttctaccaaacagagaggaggtaaagagctgggaatgaaagacagtgatatggattacgtgcagattgatgcaaccatcaattacgggaattccggtggtcccctggtgaatctggatggggatgtgatcggtgtgaacagccttagagtaaccgacgggatctcatttgcgatccctagcgacagagtgcgccagttcctggctgagtaccacgagcaccaaatgaagggaaaggcgttttctaataagaagtaccttgggctgcaaatgttatcattaacagtgccactttccgaagaacttaaaatgcattaccctgactttccagacgtgtcctcaggagtgtatgtgtgcaaagttgtagagggaactgccgcccagagttccggacttagagaccacgacgtgattgtgaatataaatggaaaacctatcactactactacggatgtagttaaagctctggactctgactctctgtcaatggccgtgctgagaggaaaggataacctgctgctcaccgtcatacccgagactattaattag

SEQ ID NO: 120220 - DNA, 8157 bp, Artificial Sequence
  Description of Artificial Sequence: Synthetic coding sequence
atgccgagaactaagcagatacatccaaggaacctcagggacaagatcgaggaggcccagaaagagctcaacggagccgaggtgtctaagaaggagattctgcaggcaggagtgaaaggaacatctgaaagccttaaaggcgtaaaacggaaaaagatcgtcgctgaaaatcacttaaaaaagatcccaaaatcccccctgagaaatcccctgcaagccaaacacaagcaaaatacagaggagtcaagctttgcagttctgcattccgcctccgaaagccataaaaagcagaactatattcccgtaaagaacggaaaacagttcaccaaacaaaacggcgagacacctggcattattgccgaagcttctaagagcgaagaaagtgtgtccccaaaaaagcccctctttctgcagcagccatccgagcttcgccgatggcggagcgagggggccgaccccgctaagttctcagacctcgacgagcagtgtgattcttcatccctgagttcgaaaactcgtacagacaattccgaatgcatctctagccattgcgggactaccagtccctcctatactaatacagccttcgatgtgcttctcaaggcaatggagcccgagctgagcaccctgtctcagaaggggtctccatgcgccatcaagacagagaaactgagacccaacaagaccgctcgatccccccccaaacttaagaatagttcaatggacgcaccaaaccagacttcccaagaattagtggcagagtcacaaagcagctgtaccagctataccgtgcacatgagcgctgcacagaaaaatgagcagggcgctatgcagagcgcctctcatctttatcaccagcacgagcactttgttcctaagtccaaccagcacaatcaacaattgcctggctgctccggtttcacagggtcgctaaccaacctgcaaaatcaggaaaacgcgaaactggagcaggtctacaatatcgcagttaccagctctgtcggactcacatcgccctcctccagatcccaggtcactcctcaaaatcagcagatggatagcgcgtccccactgagcatttctccggccaattccacccagtcaccccccatgccaatctataactcaacccacgttgcatcagtagttaaccagagcgtcgaacagatgtgtaatctgctgttgaaggatcagaagcccaaaaagcagggtaaatacatttgtgagtattgcaatagagcatgcgctaagccctctgtattgttaaaacacattaggagtcacaccggagaaagaccctatccctgcgtcacttgtgggtttagctttaagacaaagtcaaacctgtacaaacataagaaatcacacgctcacacaattaaattggggctcgtactccagcccgatgctggcggtctttttctatctcatgagagcccgaaggccctgtccatacactcagatgtcgaagattcgggggaatccgaggaggagggagcaactgacgaaaggcagcatgatctgggggccatggaattacagccagtccatatcattaagcggatgagcaatgcagagacactgctgaagtcgtcctttacaccctcctctcctgaaaatgtgattggcgattttctgttgcaggatcggagcgctgaaagccaggcagttactgagctaccaaaggtggtggttcaccacgtgactgtttctccactgagaacagactcacccaaggccatggaccctaagccagaattaagcagcgcccagaagcagaaagacttgcaagttactaatgtccagcccctgtctgctaatatgagtcaggggggagtgtctaggctggaaactaatgagaactctcatcaaaaaggagatatgaatcctttggagggtaaacaagactcccatgtgggaactgtccatgcacagctgcaacgccaacaggctacagactattcccaggagcagcaagggaaactgttgtcgcctagatccctgggctcgactgatagtgggtacttctccagaagcgagtccgccgaccaaaccgtgtcgccgccgactccctttgccaggcgcctgccctcaacggagcaggattcaggccggagcaacggtcccagcgcagccctcgtgaccacttctactcccagtgccctgccaaccggggagaaagctctgctgctgccaggtcagatgcggcctcccctcgctacaaaaaccctagaggaaaggatttctaagctcatatccgacaatgaagccttggttgatgataagcaacttgattccgtgaagcctcgacgcacaagtctatcaagaaggggttccatagacagccccaaatcatacattttcaaggactcgtttcagtttgatctcaagccagtggggcgccgcacctcgagttcttccgacatacctaagtctccgttcacaccgacagaaaaaagtaagcaggtatttttgctttcggtgccttcactggattgcctgccaatcactagatctaactctatgccaactacgggatactccgccgtgccggcgaatataatccctcccccgcaccccctgcgaggatctcagagctttgatgacaaaataggcactttctacgacgatgtgttcgtatccggaccgaacgcccctgtgccgcagagtggccaccccagaactctggtgaggcaggcagctatagaggactcaagcgccaacgagtcccatgtgcttggcacaggtcagagtctggatgaaagtcatcaaggatgccacgcagctggagaagctatgtctgtgcgcagcaaggccctggcccaggggccacacatagaaaaaaagaagtctcaccagggtagggggacgatgttcgagtgtgagacttgcaggaaccgctaccggaagttagagaatttcgagaatcataagaagttctactgttccgagttgcatgggcccaaaacaaaggtggccatgcgggagcccgaacatagccctgtgcctggagggctacaaccacaaatcctgcactatcgcgtcgccggcagttcgggtatatgggagcagaccccccagatccgcaagaggaggaaaatgaaaagcgtaggcgacgacgaggaactgcagcaaaatgaatccggcaccagtcctaagagctctgaagggctccagttccagaacgctcttggatgtaacccaagcctccctaaacacaacgtcacaataagatctgaccagcaacataagaacatccagcttcaaaattctcatatacacctggtggcccgaggcccggaacagactatggatcccaagctctcaactattatggagcagcagattagctctgcagcacaggataagatcgaactccagcgccacggaaccgggatcagtgtgattcagcacactaactcactatcacggccaaatagtttcgataagcccgaaccttttgaacgggcatcacccgttagctttcaggagctaaacagaaccggaaaatccggttccttgaaggtgataggtatctctcaggaagaatcccatccatcgcgcgatggatcccatccccaccaactggcgctgtcggatgccctgagaggagaactgcaggaaagctcacgaaaatcgcccagcgagagacacgtattagggcaaccaagccggcttgttaggcagcataatattcaggtgcctgagatattagtaacagaagaacctgaccgcgatcttgaggcccaatgccatgaccaggagaaatctgaaaaattttcatggccacagcgttcagagactttatctaagcttccaaccgagaagctgcccccaaaaaagaagcgactgagattggccgagatcgaacactccagtacagagagttcctttgattccactctgtcccgcagccttagtagggagagcagtttgtcccatacgtcaagcttttctgccagcctagatatagaggatgtttccaagactgaagcatcccccaaaatagacttccttaataaggccgaattcctaatgatcccggccggactcaacactttaaacgttccagggtgccaccgagagatgcgacgaaccgcttccgagcagataaattgtacccagacaagtatggaggtcagtgatttacgctctaaaagcttcgactgcggatccatcactcctccccaaacaacacctctgaccgagctgcaacctccttctagtccttctagggttggagtgacaggccatgtcccactgttagaaaggaggcgtgggccgctggtgcgtcagataagtcttaacatagcgcctgactcacacctgtcgcctgtgcacccaacttcattccaaaacactgccctgccaagcgttaatgctgtgccatatcagggcccacagctcacctccacttcccttgcagaattttcggcgaacaccttgcattctcagacccaggtgaaagatctgcaggcagagacatcgaacagttccagcacgaatgtctttcccgtgcagcaactgtgcgacattaatttgctgaaccagatccacgcgcccccgtcacaccagtcaactcagctctcactgcaggtgtctacgcagggctcaaagcctgataagaatagcgtgctttcgggatcaagtaagagcgaagactgttttgcaccgaaataccagttgcattgtcaggtcttcacatcggggcccagctgcagtagtaatccagtgcactctttgccaaatcaggtaatctccgatccagttggaaccgatcactgtgtaaccagtgctacattgcccacaaagctcatcgacagtatgtcaaatagtcatccattactgccccctgaactgaggccccttggtagccaggtccaaaaggtgcctagctcttttatgttgcctatcagattacagagttcagtgcccgcctactgcttcgcaacgctgacttccctcccccagatccttgtgactcaggacctccctaaccagccaatctgtcagactaatcacagcgtcgtgccgattagtgaggaacaaaattcagtgccgacattgcagaagggccaccagaatgccctccctaatcctgaaaaggagttcttgtgtgagaacgtgttctcagagatgagtcagaactcctcactctctgagtcactgccaattactcagaaaatcagcgtgggccgcctgtctccacaacaggaatcatcagctagcagtaagcgaatgctgtctcccgccaattccctcgatatcgcaatggagaagcaccagaaaagagcgaaggacgaaaacggtgctgtctgcgccacggatgtgcgtccactggaggccctgagtagcagggttaatgaagcaagtaaacagaaaaaacctatacttgtcagacaggtgtgtaccaccgagcctctcgacggcgtcatgcttgagaaggatgtattctcgcagcccgaaatatccaatgaggcagtgaacctcacaaatgtcttaccagcggacaattcaagcacaggttgttctaaattcgtggtgatcgaacccatttcagagctgcaggaattcgaaaacatcaagagcagtaccagcctcacactcacagtcagaagctccccagctccaagtgagaacacgcacatcagccctcttaagtgtacagataataaccaggagcgcaagagccccggggtgaagaaccaaggtgataaagttaatattcaggagcagagtcaacaacccgttaccagcctcagcctgttcaacatcaaagacacacaacagctcgccttccccagcctgaaaactacaacaaacttcacatggtgctaccttttgcgccaaaaaagcctgcacctgcctcagaaagaccaaaaaacgagtgcctatactgactggaccgtgagcgcatccaaccctaatcccctgggcctacctacgaaggttgctctggcgctgctgaacagcaagcagaacactggaaaatcgctgtactgccaggcaataactacccactctaagtccgatctcctggtgtattctagcaagtggaagagttcattaagcaagcgtgcactgggtaaccagaaaagtacagttgtggagtttagcaataaggacgcctccgagatcaactccgagcaagataaagaaaatagcctgattaagtctgaaccacgccggatcaagattttcgacgggggttataagtccaatgaagagtatgtgtatgtccgcggtagggggcgagggaagtatatctgcgaggagtgcggtattcgatgtaagaaacctagcatgctcaaaaagcatatacggactcatactgatgtccgcccatatcactgtacatattgcaatttttctttcaagactaaggggaatctgaccaaacacatgaaaagtaaggctcactctaaaaagtgcgttgacctgggggtttctgtcggtctcatagatgagcaggataccgaggagtcggacgagaagcagcggttctcctacgagaggagtggctacgacctagaggagtccgacggaccagatgaggacgataacgagaacgaagacgacgacgaggatagtcaagctgagagcgtgctttctgctaccccctccgtgaccgccagtcctcaacatcttccatctagaagctccctgcaggaccccgtgtccaccgacgaggatgtccgcatcactgactgtttttctggcgttcatacagatcctatggatgtcctgccccgggctctgttgaccaggatgacagtgctttcaaccgcccagtctgactacaacagaaaaacactgagtcccggaaaggctagacaaagagcagcccgggatgagaatgacacgatccccagcgttgataccagcagatctccctgtcaccaaatgagtgttgactatccggaatctgaagagatcctaagaagttccatggctggcaaagccgttgccattacacagtcaccgtcgtcagtgcggctgccacccgcagccgctgagcatagccctcaaactgccgctggcatgcccagtgtcgcctcacctcacccagacccccaggaacagaagcagcagatcacgttacaaccaactccaggtctcccgagcccccacacgcatctgttttcacacctgccgctgcacagccaacaacagtcacgaacaccatacaatatggttcccgtcggcggtattcacgtggtgccagctggcctgacgtatagcacctttgtacctcttcaggctggacctgttcagttaacaatccccgccgtctccgtggtgcaccgtactctgggcacgcatcgcaacactgtgactgaagttagcggaacaacaaatcccgccggggtcgcggaactgagctcagtcgtaccctgcatccctatcgggcaaatcagagtgccagggctccagaacctctccacccccgggttacagtcactaccaagcttgtcaatggagaccgtgaatatcgttggactggccaacaccaacatggcgccgcaggttcacccacccggattggcactgaatgccgtcggactacaggtcctcacagccaacccgtcttcacagagttctcctgcccctcaagcacatataccgggtctccagattcttaacatcgccctcccaacattgatcccctccgtgtctcaggtggctgttgacgctcagggcgcccccgagatgcccgcaagtcagtctaaggcatgcgagacccagccgaaacagactagcgtggcttccgctaaccaggtgagtaggacggagagcccccagggcctccccaccgtgcagagggaaaatgccaagaaggtgctgaacccccctgcccctgcaggggatcacgcccgtctggacgggctgtccaaaatggatacagagaaggctgcgtcagcaaaccacgtcaagcctaaacccgagctgactagcatacagggacagcccgctagcacttcccaaccgttactgaaggcacacagtgaggtcttcacgaaacccagcggtcagcagacactaagcccagatcggcaggttccgcgccctaccgctctgcctcgtaggcagcctaccgtccacttttcagatgtatcctccgatgacgacgaggatcgtttagtaatcgcgacgtag

SEQ ID NO: 120221 - DNA, 387 bp, Artificial Sequence
  Description of Artificial Sequence: Synthetic coding sequence
atgccacgcaccaagcaaatccacccaaggaatctgagagacaaaattgaggaagcacagaaggagctgaatggtgccgaagtctccaagaaggaaatactgcaggcgggagttaaaggaacctcagaatccttgaagggggttaaacgcaagaaaatcgttgccgaaaatcatttgaaaaagattcccaagtcccctctccgcaatcctctgcaggcgaagcacaagcagaacacggaagaaagcagcttcgctgtcctccactccgcttccgagtcccataagaaacagaactacattcctgtgaaaaatggcaagcaattcacaaagcagaacggggagacccctgggatcattgccgaagctagcaaatctgaagagtcttag

SEQ ID NO: 120222 - DNA, 429 bp, Artificial Sequence
  Description of Artificial Sequence: Synthetic coding sequence
atgccccgcaccaagcaaattcacccacgcaacctgcgcgataagattgaagaggcccaaaaggaattgaacggcgccgaagtgtccaaaaaagaaatcctccaagccggggtgaaagggacgagcgagtcattaaagggggtcaaacgtaaaaaaattgtagccgaaaaccatctgaagaaaattcccaagagcccgcttcggaaccccctgcaagcaaaacataaacagaacaccgaggagagtagctttgccgtcctgcactcagcaagtgaaagccataagaagcagaactatatccccgttaagaacggcaagcagtttacaaagcagaacggcgagacacccggcattattgctgaggcttccaaatccgaggaaagtgtgagccccaagaagccactgtttttgcagcagccgtccgaatag

SEQ ID NO: 120223 - DNA, 363 bp, Artificial Sequence
  Description of Artificial Sequence: Synthetic coding sequence
atgcccaggaccaagcagattcatccccgcaacttgcgggataagatcgaggaggcacaaaaagaacttaatggcgccgaggtaagcaaaaaagagattctccaggcaggtgtgaagggcacaagtgagtctctcaaaggcgtcaaaagaaaaaagatagtggcagagaaccatctcaagaaaatacccaagtcccccctccgcaatcctcttcaggccaagcacaagcagaacactgaggagtcatcattcgccgtgttgcacagcgcaagcgaatcccacaaaaagcagaactacatccccgttaagaatggtaaacagtttaccaagcagaacggggaaacccccgggatcatcgcatag

SEQ ID NO: 120224 - DNA, 1752 bp, Artificial Sequence
  Description of Artificial Sequence: Synthetic coding sequence
atgctgaaaaaacacattcgcacacacaccgacgtgcggccctaccactgcacttattgcaattttagcttcaagacgaaggatgagaaacagcgcttcagttacgaaaggtcggggtacgatctagaagagtccgacggccccgacgaggatgacaatgagaatgaggacgacgatgaggattctcaggctgagagtgtgcttagcgccaccccatccgtaacagcttctccccaacatctaccttcgaggtcctccctgcaggaccccgtttctacagatgaagacgtgagaataaccgactgcttttctggagtgcacactgacccgatggacgttttgcccagggcactcctcaccagaatgacggtgctgagcaccgctcagagtgactacaataggaagacactttcacctggcaaagcccgccagcgagctgctagggatgagaatgataccatcccgtcagtcgatacttcccgatctccctgccaccaaatgagcgttgattaccctgagagcgaagagatccttagatccagcatggctggcaaggctgtcgcaatcacacagtctccttcctctgtccgcctccctccagcagccgctgaacattccccgcagaccgcggctgggatgccttctgtggccagtccgcaccccgacccgcaggagcagaaacagcaaattacccttcaacctacaccaggcttgccttccccgcatacacacttgtttagccatttgccactgcactcccagcaacagtctcgtaccccatacaacatggtgcccgtcggggggatccacgtggtgcccgcagggttgacttactccactttcgtgcccttgcaggctggccctgtacagttgaccattccagctgtcagcgtggtgcaccgcacactcggcacacatcggaacaccgtgaccgaagtatcgggcaccacaaacccagcaggcgtagccgagctatcgtcggtggtgccttgtattccgattggccagataagagtccctggtctgcaaaacttatctacacctgggctccagagcctaccctccctgtccatggagaccgtgaacatagtcggactggctaacacaaacatggcaccacaggtgcacccacccgggctcgcgctcaatgcagtcggacttcaggtcttgacagccaatccctcttcccagtcatcgcctgccccgcaggcccacattccaggacttcaaatcttgaacatcgccctgcccaccctcatcccttccgtctctcaggtcgccgtagacgctcaaggggccccggagatgcccgccagccagtccaaggcgtgcgaaactcagcccaaacaaacttctgtggcctccgccaatcaagtcagccgcaccgaatcgccgcaggggctccctactgtgcagcgggaaaacgcaaagaaagtgctgaatccaccagctcctgccggagatcatgcacggctggacggcctctctaaaatggacacggagaaggctgcctccgcaaatcacgtgaagcctaagccagagctgacctcaatccaaggccagcctgcttctacaagccagcctctgctcaaggctcacagcgaggtgttcaccaaaccatctgggcaacagactttgtcacctgatagacaggtgccccggcccaccgctctgccgcggcgccaacccacagtccactttagcgatgtgagttctgacgacgatgaggatagactcgtaattgctacatag

SEQ ID NO: 120225 - DNA, 2103 bp, Artificial Sequence
  Description of Artificial Sequence: Synthetic coding sequence
ggtgacaaatttagcttccagagggccctcggaaaccaaaagagcaccgtggtggagttttcgaataaggacgcttctgagattaactctgaacaggataaagaaaactccttgatcaagagcgagccgcgcagaattaagatctttgatgggggatataaatcgaacgaagagtatgtgtatgtcagaggtagagggcgcggcaagtacatctgtgaagaatgcggaatccgctgcaaaaaaccttcaatgctcaaaaaacacatcaggacacacacagatgttaggccgtatcattgcacgtactgcaacttctctttcaagaccaaaggaaatctcactaaacatatgaaatccaaagcccactccaagaaatgcgtcgacttgggcgtatcggttggcctcattgacgagcaggacacggaggaatccgatgaaaaacaaaggttctcctacgaacgctctgggtatgatctggaggagagtgatggaccggatgaggacgacaatgaaaacgaggacgacgacgaggattctcaggcggagtcagtcctttcagcaaccccctccgtgacagcgtctcctcaacacctaccctctagaagtagcctgcaggatcccgtgtctactgatgaagacgtgcgtatcacggattgcttctcaggcgtccacactgatcctatggacgtcctccctcgagcgctcctcactagaatgaccgtcctgtccacagcccagtccgactacaataggaaaacattgtccccggggaaggcccgtcaaagggctgcgagagacgaaaatgacacgattcccagtgttgacacgtcccgtagcccatgccatcagatgagtgtcgactaccctgaaagcgaagagatcctaagatccagtatggccggcaaagccgtagccataacccagagcccctcaagcgtgcgtttgccacccgccgctgctgagcactcacctcaaactgcggctggcatgcccagcgtggcctcccctcacccggaccctcaggagcagaaacagcagataacacttcagccaacaccgggattaccctcaccacacactcacctgttcagccacctaccactgcacagtcaacaacagagccggaccccatacaatatggttcctgtgggtggcatacacgtcgttccagcagggctcacatatagcacgtttgtccctctccaagccgggcctgtacagctgacaatccccgccgtgagcgtcgtgcaccgaaccttaggcacccaccggaacacagtcacagaagtcagcgggaccactaacccggcaggtgtagccgagctgagcagtgttgttccctgcatccctatcggacagattcgggtaccagggctgcagaacctgtccaccccagggctgcagagtcttccctctctcagtatggagacggtcaacatcgtggggttggcaaacacgaatatggcccctcaggttcatccccctggtctggcgctgaatgcagtgggcttacaggtgttgacagcgaacccatcttcgcagagcagccccgccccacaggctcacattccggggctccaaatcctaaatattgcgcttccaacactgattcccagcgtaagtcaggtggccgtagatgctcagggcgctccggaaatgccggccagccagagtaaagcctgcgagacacagcccaaacaaactagtgtggcctctgccaaccaggtgtctaggaccgagtcaccccaagggctcccaacagttcaacgcgagaatgccaaaaaagtcctgaatcctcccgcacctgctggtgatcacgcccgcttagacggactgtccaaaatggataccgagaaagcggcctccgcgaaccacgtcaaaccaaaaccagaactgacctccattcagggccagcccgcttcaactagccagccattgctaaaggctcattccgaagtctttaccaaacctagcgggcagcagacgctgtcaccagaccgccaggtacctagacctactgctctaccccggcgccaacctacagtccacttcagcgatgtgagcagcgacgatgatgaggatcgattggtgatcgccacctag

SEQ ID NO: 120226 - DNA, 7341 bp, Artificial Sequence
  Description of Artificial Sequence: Synthetic coding sequence
atggatacaggcgacaccgccctgggccagaaggcaacaagccgtagcggagagacagacaaagcctctgggcggtggcggcaggagcagtcagccgttataaagatgtccacctttggcagtcatgagggtcaaaggcagcctcagattgagccggagcagattggcaatactgcctcagcacagttgttcgggtcgggaaaactggcctctccctctgaagtcgtccagcaggttgccgagaaacagtacccaccgcaccgaccctcaccttattcctgtcagcacagcctctctttccctcaacactctctgccgcagggcgttatgcacagcaccaaaccacaccaatcgctggaggggccaccctggctgtttcccggtccattgccgtctgtcgcttcagaagacctgttcccttttcctatccatggacattccggcggataccccaggaaaaagatttcctccctgaaccccgcatatagtcagtattcccagaagtcgattgagcaagcggaagaggctcacaagaaggagcacaaacccaagaaaccaggcaagtatatttgcccatactgctctagggcatgtgctaagccaagcgtcctgaagaaacatatccgctcccacactggcgagcgtccttacccctgcatcccctgtggttttagcttcaagacaaagtcaaatctctacaaacatcgaaagtcccacgcacacgctattaaagccgggctggtgcctttcaccgaatccgcggtatctaagctcgatctggaggcgggctttattgatgtagaggccgaaatccatagcgacggggagcagagtaccgataccgacgaggagagttcactgtttgccgaggccagtgacaagatgtcaccaggtccacccatcccactcgatattgccagtcgaggggggtatcatggaagcctggaagaaagcctcggaggtccaatgaaagtgcctattttaatcatccccaagtctggcatccccctccccaatgaatcctcccagtatattggtcctgatatgctgcctaatcctagcctgaacactaaggccgacgactctcacacagtgaaacagaagctggccctgaggctaagtgagaaaaagggtcaagatagcgagccttcattgaacctgctgtctccccatagtaaaggaagcactgacagcggatatttctcccgaagtgagtcggcggaacaacagatttcacctcccaataccaatgcaaagagctacgaggagattatctttggcaagtattgtcgactgagtcctcgcaatgcactgtcagtgacaacaacgtcacaggagagggcagcaatgggacggaagggcatcatggaacctctgccgcacgtgaacacgagacttgacgtgaaaatgtttgaggaccctgtgtctcagcttattcccagcaagggggacgtggatccatctcagacatcgatgctgaagtcaaccaaattcaattctgaatcaaggcagccccaaatcataccgagcagcattcgcaatgaaggaaagttgtatccagccaattttcagggtagtaatcccgtattgttggaagctcctgtcgattcctcacccctcatcaggtctaattccgtgccaaccagcagtgccactaacctgacgattccaccctctcttcgtggttcacatagctttgatgagcgcatgacaggttcagatgatgtgttctacccggggaccgtgggcattcccccccagaggatgttaaggcgacaggcggcctttgagcttccgtcagtccaagaagggcatgttgaagtggagcaccatgggcgcatgctgaaggggatcagttcatcatctctgaaagaaaagaagttgtcccccggggatagagttgggtatgattacgacgtatgccgtaaaccttacaaaaagtgggaagacagtgagacccctaagcagaattaccgggacatcagttgcctgagctccctgaagcatggcggagagtatttcatggatccagtcgtgccacttcagggggtcccatctatgttcggtacaacatgcgagaaccgcaaacggagaaaggaaaaaagcgtcggtgacgaagaggatacaccaatgatctgttccagcattgtgagcacccccgtgggaatcatggcctcagattatgaccctaaattacagatgcaggaaggcgtcagaagcggattcgccatggctggacacgagaacctgtctcatgggcatacagaacgcttcgacccctgcaggccacaactgcaacccgggtctccttctttagtttcagaagagtcccctagcgccatcgacagcgataaaatgagcgacctgggaggccgaaaacctcctggtaatgttatctccgttatacagcacaccaactctctgagtagacccaacagctttgagcggtctgagtctgcggagttagtggcttgcactcaggacaaggcaccttccccatctgagacctgcgactctgagataagcgaggcgcccgtctcacccgagtgggcgcctcctggggacggcgcagaatcgggcgggaagccctcgcctagccagcaggttcaacaacagtcttaccacacccagccccgactggttcgacagcataatattcaggtgccagaaattcgggtgacagaggagcctgataagcccgagaaagaaaaggaggcccaatctaaggagcctgaaaagcccgtcgaagagttccagtggccccagcgctccgagaccttatcgcagcttccggcagagaaactgcccccaaagaagaagcgcctgcgcttggccgacatggagcattcttctggcgaatcaagttttgaaagtaccggtaccgggttgtctagaagtccgtcccaagagagcaacttgagccattcaagtagcttttccatgagctttgaacgggaggaaacttcaaagctctccgcacttcccaaacaggatgagtttggtaaacatagcgagttcctgaccgtgccagccgggtcttattcactcagtgtccctgggcaccaccaccaaaaggagatgagacgatgctcctcagaacagatgccttgtccgcacccagcagaggtccccgaagttcgctccaagtcatttgactacggaaacctctctcacgcgccagttagtggtgcggccgccagtacagtgagcccttcaagggaaagaaagaagtgtttccttgtacggcaggccagctttagcgggtctccagagatcagccagggggaagtcggcatggaccagtcggtgaagcaagaacaactagagcacttgcacgccggcctgcgcagtggatggcaccacggcccaccagcagtattgcccccactgcagcaggaggatccaggcaaacaggtcgctggcccttgcccgcctctgtcaagcggccccctgcatctggctcagcctcagatcatgcacatggactctcaggaaagtctcaggaacccactgatccaacctaccagctatatgacgtcaaagcacctgcctgagcaaccacatctgtttccccaccaggaaacaatccccttttcccctatccaaaatgccctttttcaattccagtatcccacagtctgtatggttcacctgccggcccaacagccaccctggtggcaggcacactttcctcacccttttgcccaacaccctcagaagtcttacggcaagccctcatttcagacagagatccactcatcctaccccttagagcacgtggcagagcataccggcaagaaaccggccgagtacgcccacaccaaagagcagacctacccatgttacagcggagcctccggtttacacccaaaaaatctgctgccgaagttcccttcggatcaatcctctaaatccacagagactccatctgaacaggtgcttcaagaggatttcgcctccgccaacgccgggagtctgcaatccctgccaggaaccgtggtgccagttcggatccaaacacatgtccccagctatggatcggttatgtatacatccatatcccaaatcttaggccagaactcacccgcaatagtcatttgcaaagtagatgaaaacatgacacagagaaccctggtgacaaatgcagcaatgcaagggatcggctttaacatcgcccaggtcctaggccagcacgcaggacttgaaaaatatccaatctggaaagcccctcagactctgccactaggcttggagagctctatccctctgtgtctccctagtacttctgattcagttgcgaccctgggcgggagtaagaggatgctgagccctgcctcttcgctggagcttttcatggaaactaagcagcaaaaacgggtgaaggaagagaagatgtatggccagatcgtggaagagcttagcgcggtagagctgaccaactccgatatcaagaaggatctgtcaagacctcagaaacctcagctcgtccgccagggctgcgcatcagagcccaaggatggactccagtcggggtcttcttccttcagctccttgtcaccctcctctagtcaggactacccttccgtgtcccccagcagcagagagccatttctcccgtctaaggagatgttatcagggtctcgtgctcccctcccaggacagaagagcagtggtccaagtgagtccaaagagtcttccgatgagctagacattgatgaaaccgctagcgacatgagcatgtccccgcaaagcagcagtctgccagcaggcgacggccagctagaagaagaaggcaagggtcacaaaagacctgtaggcatgctggtgaggatggcaagcgcccctagcggtaacgtggccgactctaccctcttgctaactgacatggccgactttcagcagattttgcagtttcccagtctgagaacgacaaccactgtgagctggtgtttcctcaactataccaaacccaactacgttcaacaggctacgttcaagagctctgtgtacgcgtcttggtgcatcagttcatgcaaccctaatcccagcggcctcaacacaaaaacaacactggcactcctgaggagtaaacagaagattaccgccgagatttatactctggccgccatgcaccgaccaggaaccgggaaacttacgtcgtcttctgcctggaagcagttcacacagatgaagcccgatgctagctttctttttgggtcaaagctggagcgaaagctggttggcaacattttaaaggagcgaggtaagggcgacatccacggggataaggacataggctccaagcagaccgagccgattcgtatcaaaatattcgagggcggctataagtctaacgaagactacgtttacgtgagaggaagagggagagggaaatacatttgtgaggagtgtggcattcgctgcaagaagccaagtatgctgaaaaaacatattaggacccacaccgatgttcgaccatacgtctgtaagctgtgcaattttgcatttaagacaaaaggaaatctgaccaaacacatgaagtcaaaggcccacatgaaaaaatgccttgagcttggcgtgtcaatgacttcggtggatgacaccgagaccgaagaggcagagaatctcgaggacctgcataaggctgccgagaagcactccatgagttcgatctctaccgaccaccagttttctgatgctgaggaaagtgacggcgaggatggcgatgataatgatgatgacgacgaagatgaggacgacttcgacgatcagggcgacctcacaccaaaaacgaggtccaggagcacttctcctcaacctcctcgcttctcttctcttccagtcaatgtcggcgccgtgccgcatggcgtcccctccgacagttcgctgggacatagctcacttattagctacctcgtaactcttcccagcattagagtgacgcaactgatgaccccatcagactcttgcgaggatacacagatgactgagtaccagaggctgtttcagtcaaagtctactgacagtgagccggacaaggatcgactcgacatccccagttgcatggatgaagaatgcatgctaccctcagaacccagctctagtcctcgggacttcagtccaagttcacatcatagtagcccagggtacgattcaagtccctgccgtgataatagcccgaagagatatctgattcctaaaggtgacttgagccccagaagacatctcagccctagaagggatttatctcccatgagacatctgagcccccgaaaagaggccgccctacggcgggagatgtctcaaagggacgtgtcccccaggaggcatctttccccacgtcgacccgtgagtccggggaaagacataaccgctcgcagggacctttcacctaggcgcgagaggcgatatatgactaccatccgcgcaccttcaccaaggcgggcactctatcacaacccaccactgtcaatgggacaatacttgcaagcggagcctatcgtgttgggtccacccaacctgcgccgtggtctgcctcaggttccctatttcagcctgtacggcgatcaggaaggggcctacgagcatccggggtcctctctgtttccagaggggccaaacgattacgtttttagccacctccctcttcactcgcagcaacaggtgagagctccaatcccaatggtccccgtgggcggcatccaaatggtgcactctatgcctcccgccttatctagccttcatccttcacccactctgccactgccaatggaaggattcgaggagaaaaagggggcgtcaggggagtcattctcaaaggatccttatgtcttaagcaaacagcacgagaagaggggacctcacgcactgcagagcagtgggccaccatcaacgccttcttctcccagactactgatgaaacaaagcactagcgaagactcacttaacgccactgagcgagagcaggaggaaaatattcagacatgcaccaaggctatcgccagcctgcggatcgcaaccgaagaggcagctctcctgggcccagatcaaccagcaagggtacaggagccccatcaaaatcccttagggtctgcccacgtgtcgatacggcacttttctcgccccgagcctggacagccttgcacatccgcaactcatcccgacctccacgacggcgagaaggacaactttggtacctcacaaacacccctggcacactctaccttttattccaagtcatgcgtggatgataagcagctcgatttccatagttcaaaggaactgagctcaagcaccgaggaatcaaaagatcctagttcagagaagtctcagctccactag

SEQ ID NO: 120227 - DNA, 7341 bp, Artificial Sequence
  Description of Artificial Sequence: Synthetic coding sequence
atggatactggcgacaccgctctaggccaaaaggcgacctcacgcagcggcgaaacagacaaggcttctggtagatggcggcaggagcagtctgctgtgataaaaatgtctaccttcggtagtcatgagggccagagacagccacagatcgagccggaacagatcggtaacacagcaagtgcccagctgttcgggagcggcaaattggccagtccatcggaagttgtgcagcaggtggcagagaagcagtatcctccccatcggccctccccttactcgtgccaacattctttgtcatttccacaacacagcctcccccaaggtgtgatgcactccacaaaaccacatcaaagcttggaagggccgccctggttattccccggcccactgccatctgtggccagtgaggatctttttccttttcctattcacggtcacagtggcggctatcctagaaagaaaatctctagcctaaacccagcctactcccaatacagccagaaatcaattgaacaggcggaagaggcccacaaaaaggaacacaagccaaagaaacccggcaagtatatctgtccttactgttccagagcctgcgcaaagcccagtgtcctaaagaagcacattcggagtcacacgggtgagcgaccatacccttgcatcccttgcggattttcgttcaaaaccaagtctaatctatacaagcaccgcaagagtcatgcacacgctattaaggccggcctcgtgccattcacagaatctgctgtgtccaaactggatctagaagcgggctttatagatgttgaagcggaaattcactccgatggggagcagtccacagatacagacgaggaaagttccttgttcgccgaagctagcgataagatgagtccgggacctcctatcccactggatatcgcatcaagggggggataccacggctcgctcgaagagagcctcggcggcccgatgaaggtcccgatcctcatcatcccaaaatcaggtattccactcccaaatgagagcagccagtacattggcccagatatgttgccgaatccctcattaaacactaaggccgatgatagccatacagtgaagcagaagcttgcccttagactcagcgaaaaaaaaggtcaagacagcgagcccagtctgaatcttctgtctcctcacagtaaaggctccaccgattcagggtatttttcccgatccgagagcgcagaacagcagatctctcccccaaacaccaacgctaagtcatatgaggaaatcattttcggaaagtattgtcggctttctccaaggaacgccctttcggtgacaactacctcccaagagcgtgccgctatgggacgcaaaggaattatggaacccctcccacacgtaaatacacgcctggatgttaaaatgtttgaggaccccgtaagccagttgataccgtctaaaggggatgtggaccctagccaaacttctatgcttaagtccactaagtttaattcagaatcccggcagccccagataatcccatctagtattagaaacgaaggaaaactgtacccagctaattttcaaggaagtaatcctgtgctgctagaagcccccgttgattcatcccccctaatacggagcaattcggttcccacttcctccgctacaaatctgacaattccccccagcctcagagggtcccattccttcgacgagcgtatgacaggatcggacgatgtcttctaccctggaactgtgggaattccgcctcagagaatgctccggcgtcaggcggcgttcgaactgccttccgtacaggaaggccacgtggaggtggaacaccacggtcggatgctcaagggaatttcatcttcgagccttaaggagaaaaaacttagtcctggagatcgcgtgggatatgactatgatgtgtgccgcaaaccttataagaagtgggaggattccgaaacaccgaagcagaactatagggatatctcttgcctgtcgagcctaaaacatgggggcgaatactttatggatccagtggtgcccctccaaggagtgccatcaatgtttgggactacttgtgaaaatcgcaaaaggcgcaaggaaaagtcagttggagatgaggaggatacaccaatgatttgcagctctattgtgtctacacccgtcggaataatggcttcagactatgatccgaagctgcagatgcaggagggtgtgcgcagcgggttcgccatggctggtcacgagaacctttctcacgggcacacggaacgattcgacccatgcaggccccaacttcaaccggggtccccttccctcgtaagtgaagaaagcccgtccgcgattgattccgacaaaatgagcgaccttggtgggcgcaagccaccaggaaacgtcatcagtgtgattcagcacacaaattccttgtctaggccaaactccttcgagcgctctgagtctgcggaactggttgcctgcacccaagataaggctccaagtccgtctgaaacctgcgactccgagatctccgaggccccggtgtctcctgaatgggctccacctggggacggggctgagtctggaggcaagcccagtcccagtcagcaagtccagcagcaaagctatcacacgcagccccgactcgttagacagcataacattcaggtccccgagattagggtgaccgaagagccagacaagccagaaaaggaaaaagaagcccagagcaaggagcccgaaaaacctgtagaggaattccagtggcctcagaggtctgaaactctgtctcaactccctgcagaaaaactgcctccgaagaagaaaaggttgcgcctggcagacatggaacacagctccggagagtcatcctttgaatctacaggcacaggcctgagtaggtccccctctcaagaaagcaacttgtctcattcatcgtccttctcaatgtcattcgagagagaggagacctctaagctgtctgctctgccaaaacaggacgagtttgggaaacattccgagtttttaacggttccggcgggctcctacagcctgagtgtgcctgggcaccaccaccaaaaagagatgcggaggtgttcaagcgagcagatgccatgcccacacccagctgaggttcccgaggtccggtctaagtcatttgactatggcaatctgtcacatgcccctgtgagcggcgcagccgcctccacagtcagcccatccagagagcgcaagaagtgtttcctggtgcggcaggccagcttttctggcagccctgagattagtcagggagaggtcggcatggaccagtccgttaagcaagagcagctggagcatctccatgccggcctaagaagcggctggcaccacggacctccagccgtcctgccgcctcttcagcaggaggaccccgggaaacaggtggcaggaccttgccctcctctcagctccgggcccttgcacctggcccagccacaaattatgcatatggacagtcaggagtcgttgcggaatcccctgattcagccaactagctatatgaccagtaagcatcttcccgaacagccccacctgtttccgcatcaggagaccatacctttctctcccattcagaatgcactgtttcagttccagtatcccactgtgtgcatggtccacctgcctgcccaacaacctccatggtggcaggctcactttccccatccttttgcacagcacccccagaagtcttacgggaagccaagctttcaaactgagatccacagcagttacccattggagcacgtggcagagcatactgggaaaaagcctgcagaatatgctcatactaaggaacagacgtacccatgttattccggggccagcgggctacacccaaagaatctgcttcctaagtttccctctgatcagtctagcaaaagtaccgagacaccctccgagcaggtactgcaggaagatttcgcctcggctaacgcgggctcattgcagtccttgcctgggactgtggtgcctgtgaggattcaaactcacgtgccctcttatgggtccgtgatgtacaccagcatcagccaaatactgggccagaatagtcccgctatcgtgatctgtaaagtagacgaaaatatgacccagcgaaccctggtgactaatgccgccatgcagggcataggcttcaatattgctcaggtgctggggcaacacgccggtttggagaagtaccctatttggaaggccccacagaccttgcccctgggcctggagtccagcattcccctgtgcttgccttctaccagcgactccgtggccacactggggggttctaaacgcatgctgtctcctgcctcgagtttggaactgttcatggagaccaaacagcagaaacgcgttaaagaagagaagatgtatgggcagatcgtggaagagctgtcagccgtggagttgaccaactcagatatcaagaaggatctctcgcggccacaaaagcctcagctggtcaggcaaggctgcgcctcggagcctaaagacggtctccaatcaggctcatccagctttagctcccttagtccctcctcctcacaagactatccctcagtgtcaccttcttcacgtgagccatttctcccgagcaaggagatgctgagtgggagccgagcccccctacccggacagaagagttccggcccaagcgagtcaaaggagtcaagcgatgagttggacatcgatgaaaccgcttctgatatgtcaatgtcaccgcagagtagctctctgccagccggagacggacagctggaggaggagggtaagggacacaaacggcccgttggaatgcttgtgagaatggccagtgctccgtcagggaatgtggccgattcaacattgcttttaaccgatatggcggatttccagcagatcttgcaattcccaagccttcggaccacgacaactgtcagctggtgctttctcaactacactaagccaaattacgttcagcaggctacattcaaatcctctgtgtacgcttcctggtgcatctcatcatgcaaccctaatccttctggattgaataccaaaacaactttggctcttcttcggtccaagcaaaagatcactgcagagatttacactctggccgcaatgcatcggcctggcacgggtaaactgactagttccagcgcctggaaacaattcacacaaatgaagcccgacgcaagttttctgttcggaagtaagctcgagagaaagctagtcggcaacattctcaaggagaggggcaagggtgacatacacggggataaagatatcggcagcaagcagacagagccaatccggatcaaaatttttgagggcgggtacaaatccaacgaagattatgtttacgtgagaggaagaggcaggggtaaatatatatgcgaagaatgcgggatccgctgcaaaaagccatccatgctgaagaaacacattcggactcacacagatgtccgcccttacgtttgtaagctgtgtaactttgcattcaaaactaaaggtaacttaacaaagcacatgaaatcgaaggcccatatgaagaaatgcttagagcttggcgtttcaatgacaagcgttgatgacacagagacagaggaagccgagaatcttgaggaccttcacaaggctgcagagaaacacagcatgagcagcatctctacggaccatcagttttctgatgctgaggaatccgatggagaggacggcgatgacaatgacgacgacgacgaagatgaggacgactttgatgatcagggggatctgactcctaagacacgttctcgcagcactagcccccagccacccaggttctctagcttgcctgtcaatgttggcgcggtcccccatggcgtgccctccgattcgagtcttgggcatagttcgctcatctcctacctcgtgactttgccaagcatcagggtcacacagcttatgaccccctccgattcttgtgaggatactcagatgaccgagtaccagcgactgttccagtccaagagtaccgactccgagcctgacaaagatagactagacatcccttcatgtatggacgaagagtgtatgctgccttcagagccctcttcctcaccccgggatttctcacccagcagtcaccattcaagccccgggtatgacagttccccatgccgtgataatagcccgaagaggtaccttatcccgaagggagatctgtcacctagaagacacctaagcccccgccgggacttgtccccaatgcggcatttgtcccccagaaaagaggccgccctcagaagggagatgagccagcgggatgtgagtccccgccggcacctctcaccgaggcgccctgtttctcccggaaaggatattactgccagaagagatcttagtccaaggcgggaacggaggtatatgaccaccattagggcaccatcacccaggagagccttatatcataaccctcctctatccatgggccagtacctgcaagcagagcctatcgtcctcgggcctcctaatctgcgaagagggctcccacaggtgccatacttctcactgtatggcgaccaggagggcgcctatgaacaccctgggagctccctttttcccgaggggcccaacgactacgtgttttcccatctgccattgcactcacagcagcaggtacgcgccccaatacctatggttccagtgggcggaattcagatggtgcacagcatgcctcccgcccttagctctctgcatcctagccctaccttgcccctccccatggaagggtttgaagaaaagaagggggccagcggagaatcctttagtaaagacccctatgttctaagcaaacagcacgagaagcgaggtcctcacgccttgcaatccagcgggcctcccagtactcccagctctccacgactgctgatgaaacagagtaccagtgaggactccctgaatgctacagaaagggagcaagaagagaatatccagacctgtactaaagcaatagccagcctgaggattgcgaccgaggaggccgccctcctgggccccgatcagccagcccgcgtccaggaaccccaccaaaaccctctaggtagtgctcacgtatctataagacacttttctagacccgagccagggcagccctgtacttccgccacacacccagacctgcatgatggcgagaaggacaacttcggcacatctcagacacccctggctcatagcaccttctattctaaatcctgcgtcgatgacaagcagctggattttcacagctctaaagaactgagcagctcaacagaggagtctaaggatccctcatcggaaaaaagccagttgcattag

SEQ ID NO: 120228 - DNA, 7341 bp, Artificial Sequence
  Description of Artificial Sequence: Synthetic coding sequence
atggacacgggggacacagccctgggacagaaggctacttctcgctcaggagagacagataaagcctccggacgctggcgccaggaacaatccgccgtgattaaaatgtcaacttttggatcccatgagggtcagcgccaaccccagattgagcccgaacagatagggaacacggcatcagctcagctctttggatcgggtaagctagcatcccctagtgaggtggtacagcaggtggccgaaaagcagtaccctccccaccgcccgtccccttacagttgccagcactcattgtcatttccccaacacagcctgccacaaggcgtgatgcatagtacaaagccccatcagtccctggaggggcccccctggctgtttcccgggcctctgccaagtgtagcttccgaggatctcttccccttccctatccatggtcactctggaggatatccccgaaagaaaatttcctccctaaaccctgcatactcccaatatagccagaaatcaatcgagcaagccgaagaggcccacaagaaagagcacaaaccaaaaaaaccggggaagtacatttgtccttactgcagcagggcctgtgccaagccttcagttcttaaaaagcatatcaggtctcacacgggcgagcgcccctatccctgtattccatgcggattctcctttaagaccaaatctaatctgtacaagcaccgcaaatctcatgcccatgcgatcaaagcaggactcgtccccttcactgaatctgccgtgtccaagttagatttagaggccggattcatcgacgtagaggccgagattcactctgacggcgagcaaagcaccgataccgacgaggaatcctcgttgtttgcggaagcaagcgataagatgtcacccgggcctcccatacccttggatattgcgagccggggagggtaccacggctctctcgaggagtcactggggggccccatgaaggtgccaattttgattattcccaaatctgggatccctctccccaatgagagtagtcagtacatcggacccgacatgctgcctaatccttctctcaatacaaaggcagacgatagtcatacagtgaagcaaaaactggccttgaggttgtctgaaaagaaaggacaggatagcgagcctagccttaatctgctgtcaccccattccaaaggcagcacagactcaggatatttctccagatctgaatcagctgaacaacagatcagtccaccgaacacaaacgccaagtcttacgaagagattatcttcggaaaatattgtcgcctttctcctagaaatgctctctccgttactactacttctcaggaaagagctgcgatgggccgcaaaggcatcatggagcctcttcctcacgtgaacacaaggctggacgtgaaaatgttcgaggaccccgtctctcaactgatcccctcaaaaggcgatgtcgaccccagccagacttccatgctcaaaagcaccaagtttaattctgaaagccggcagccacagattatcccttcttcgatacgtaatgaagggaagctgtacccagcaaattttcagggatctaatcccgtgctgctggaggccccagtggattcatcacccctgatccgcagtaattctgtcccaactagcagcgcaactaaccttaccatccctccaagcctgcggggcagccattcattcgatgagaggatgaccggaagtgatgacgtgttctatcccggaacagtcgggatcccccctcaacgcatgttgaggaggcaggctgccttcgagctgccttccgttcaggaagggcacgtcgaggtcgagcaccatgggaggatgttgaaaggtatcagcagtagttccctcaaggaaaagaagctctcacctggagatcgagtgggatacgactatgacgtgtgccgaaagccgtacaagaaatgggaggactcagagacccctaaacagaattatcgtgacatctcttgcctgtcttcactgaaacatggcggtgagtacttcatggaccctgtggtgccattgcagggggtgccatctatgttcggtaccacctgcgagaatagaaaaaggcggaaggagaagtctgtgggcgacgaagaggacacacctatgatctgctctagtattgtgtctactccagtgggtatcatggcctctgactatgatcctaagctccaaatgcaagaaggggttagatctgggtttgccatggcaggccacgaaaatctgagccatggtcacaccgagcgctttgacccttgtaggccgcagctgcagcccggctccccatcgctagtatcagaagaaagtccttcagccatcgacagcgacaaaatgtctgatctgggtgggcggaagccgccagggaacgtgatatctgtgattcaacacaccaatagcctctctagaccaaattcttttgaacgctctgagtcagccgagctggtggcctgcacacaggacaaagctccgtcgccctcagagacctgcgactccgaaatcagtgaagccccagtctctcctgagtgggctccacccggggacggggcagaatcaggtggaaagccaagcccgtctcagcaggttcagcaacagtcctatcacacacaaccgcggttggtgcgccagcacaacatccaggtacccgaaatcagggtgactgaggaacctgataagccagagaaagagaaggaagcccagtcaaaggagcccgaaaaacccgttgaagaattccagtggccgcaaagatcagaaaccttgtcccaactccctgcagagaaattaccacccaagaagaaaagactccgccttgcagacatggagcactcttccggggaatcatctttcgaatctacaggaacgggactaagtaggagccccagtcaggaatccaatctgtcccattcttcaagcttctctatgagcttcgagcgagaggagacctccaagctcagcgccttgcccaaacaggatgagttcggcaagcactccgagttcctgacagttccagctggatcttattctctgtctgttcctgggcaccatcaccagaaggaaatgagacgctgtagctccgagcagatgccatgtccccatccagccgaggtcccagaggttcgctccaaaagtttcgactacggtaatttgagccatgctcctgtcagtggcgccgccgcatctaccgtctctccttctcgtgaaagaaagaaatgctttctggttcggcaggctagctttagcggttctcccgagatctctcagggcgaggtcggtatggatcagagcgttaagcaagagcagctcgagcacctgcacgcaggtctacgctcggggtggcaccatggcccacccgctgtactcccccccctgcagcaggaagatcctggaaagcaagtcgccggcccttgccctcctctgagcagcggtccactccacctggcgcaaccacaaatcatgcacatggattctcaggaaagtctgcgcaatccactgatccagccaacttcctatatgacctcaaagcacctccctgaacaaccccatctcttcccacatcaggaaacaattccattctcccccattcagaatgcactgttccagttccaatacccaacagtgtgtatggtgcacctcccagcacaacaaccaccttggtggcaggcccactttcctcacccttttgcccagcacccccagaagtcctacggaaagccctccttccagacggaaatccacagttcgtaccctttggagcatgtcgctgagcatactggaaagaaacccgctgaatacgcccacaccaaagagcagacatacccgtgttatagtggagcttccggcctgcatcctaagaatcttctaccgaaatttccctcagatcaatcttccaagagtacagagactccgtccgagcaggtactgcaggaagactttgcttctgctaacgcgggctcccttcagtccctgcctggaaccgtggtacctgttcgaatccagacgcatgttccgtcctatggaagcgtgatgtatacatctattagccagatcttggggcagaattccccagccatcgttatttgtaaagtggatgagaatatgacccaacggaccctcgttaccaatgctgcgatgcagggtatcgggtttaacatcgcacaagtgctgggtcagcacgctggcctggagaaataccctatctggaaggccccacagaccctgcctcttggactcgaatcctccattccactgtgcctgccctccacttccgatagtgtcgccacgttgggagggtcgaagcggatgctttcccccgcatctagccttgaactgttcatggagacgaagcaacagaagcgggttaaggaggagaagatgtacggtcagattgttgaggaactgagcgccgtcgagctgacaaactccgacataaagaaagatctcagtaggccacagaagccccaactcgttcgacagggttgcgccagtgagcctaaagatggccttcagtctgggtcaagtagcttcagctcattgtcaccctccagtagccaggattacccttcagtgtctcctagttctagagagccctttttgcctagcaaagaaatgcttagcgggtcaagagccccattgcctggccagaaatccagcggccctagtgaaagtaaggagtcctccgacgagctggacatcgatgagaccgcttctgatatgtctatgagtccccagtcgtcatccctccccgccggcgacggacagctggaagaggagggaaaaggacataagcgcccagtcggaatgctggttcggatggctagtgcaccaagtggtaatgtcgctgactccacactcctgcttaccgatatggccgatttccaacaaattcttcagtttccatctctgcgcactacaacaactgtgagctggtgcttcctgaactatacgaaacccaattatgtccagcaggcgacatttaaatcttcagtgtatgcgagttggtgtatcagctcctgtaatcccaatcctagcggtttgaacacaaagacaacgctcgcgctgctccgcagcaagcagaaaatcaccgcagagatctacactctcgcggccatgcaccggcctggtactggtaagctaacatcgtcgtccgcatggaagcagttcacccagatgaagcccgatgccagtttcctgttcggttctaagctcgaaagaaaattagtgggcaatatcctgaaggaacgcggcaaaggagacatacatggtgataaggatatcggaagtaagcagacagagcctattagaattaagatttttgaaggaggctataaatccaacgaagactacgtttacgtccggggccgcgggagggggaaatacatttgcgaagagtgtggaatcagatgtaagaagccaagcatgctgaagaaacatattagaacacacacagatgtgcgcccatatgtttgcaaactttgcaatttcgcattcaagacgaagggaaatctaaccaaacacatgaaatcaaaggcgcatatgaaaaagtgccttgagctaggggtatccatgactagtgtcgatgacactgagaccgaggaagcagagaatctcgaggatctgcataaggccgcggagaaacacagcatgtcgtcaatcagcacagatcatcagttctctgatgccgaggaatctgatggtgaggatggagacgataatgacgatgatgacgaagatgaagacgacttcgatgaccaaggagacctcactcccaagacccgtagtaggagtaccagtccacaaccccccagattctccagcctgccagtcaacgtgggcgctgtccctcacggtgtaccctcggactcttcgctgggtcacagctccctcatatcttatctggtcacacttccctctatcagggttactcaactgatgacaccttccgactcctgcgaggatacacagatgaccgaatatcagcgcctattccaatccaagagcacagactcagaacccgataaggacagactggatataccctcctgtatggatgaagaatgtatgttgccctcagaaccgtcctccagcccacgagacttttccccttcaagccaccactcctcaccgggctatgatagtagtccctgccgagataactcccctaagaggtatttgatcccaaaaggtgacctctctcctcgtaggcacttaagcccaaggagagacttgtccccaatgcgccatctttcgccgcgaaaagaggccgctctgaggagggagatgagtcagcgcgacgtgtcccctcgccgacatttgagccccaggcgacctgtcagcccaggaaaagacatcacagccagaagggatctgtccccgagacgggaacgtcgatacatgaccaccattagagccccaagcccaagaagagcactctatcataatccacccctctctatggggcaataccttcaggcagagcctatcgtcttaggccctccaaatttgaggcgcggactgccccaagtgccctacttctccctgtacggggaccaggagggcgcttacgagcaccccggctccagcctgtttcctgaaggcccaaacgactacgtgtttagtcacctccctttacacagtcagcagcaggttcgggctcccatcccaatggtccctgttggtggcatccaaatggtccactcaatgccaccagcgttgagctcattgcacccctctccgacactgcctctgcccatggagggcttcgaggagaagaaaggtgcttcaggagagagctttagcaaggacccctacgtgctcagcaaacaacatgagaagagaggaccccacgcacttcagtccagtgggccgcccagcacaccctcgtctccacgtttgcttatgaaacaaagtacaagcgaggactctctaaatgccactgagcgtgagcaggaggagaatattcaaacttgcactaaggccatcgccagcctacgaatcgctacagaggaggccgccttgctcggacccgaccagcccgcccgagtccaggagccgcatcagaaccctctgggctccgcacatgtcagtattcgccacttcagtaggccggagcccggccagccatgtacctccgccactcatcccgacctgcacgatggtgagaaagataactttggtaccagccagacacccctggctcacagcaccttttattccaagtcctgcgtggacgacaagcaactggacttccattcctcgaaagagctgtcttcaagtaccgaggagagcaaagacccatccagcgaaaagagtcagctgcactag

SEQ ID NO: 120229 - DNA, 7221 bp, Artificial Sequence
  Description of Artificial Sequence: Synthetic coding sequence
atggatcccgaacagtccgtaaaaggcaccaagaaggcggagggaagtccgcggaagagactgaccaagggggaagcaatccaaacctccgtgtcttcatctgtcccgtatccaggctcaggcaccgctgcaacacaagagagcccagcgcaagaattattggctccccagccttttcccggcccttctagcgtgcttagagaaggttcccaggagaagacaggccagcaacaaaagccccccaagcgtcctccaatcgaggcgtcagtacatatctcacagctcccacagcatcctcttacgcctgcttttatgtcaccagggaagccagagcacctactggaaggcagtacatggcagttggttgatcccatgcgtccaggcccatcagggtcatttgtggctcccggcctccacccccagtctcagctcttaccctctcatgcgtcgatcatccccccagaagacttgccaggcgtccctaaagtgtttgtgcctagacctagccaggtctccctcaaacctaccgaggaagctcataagaaggagagaaaacctcagaagcctgggaaatatatttgtcagtattgtagtcgcccgtgcgccaaaccctcagttctgcagaagcacattagatcacatacaggcgagaggccctatccctgtggaccatgcggcttctcattcaaaaccaaaagcaatttgtataaacatcgtaagtcccatgcgcacaggatcaaagcgggtttagcttccgggatgggcggtgagatgtatcctcacggcttggaaatggaacgaattccaggtgaagagtttgaagaaccaacggaaggggagagcactgattcagaagaggaaacatccgccacatccgggcatcccgccgagctttcacctcggcccaagcagccgctgttatcaagtggcctctatagcagcgggagccactcgagcagccatgagagatgttccttgagtcagtcatcgacggcacagtcattagaagatcctccaccttttgtggaaccttctagcgaacatcccctaagccataaacctgaagacacccataccattaagcaaaagttggctctccggcttagcgagcgtaaaaaggtcatagacgaacaggctttcctgtcccctgggtcgaagggttccacagaatccggctatttttcccgtagcgagtccgctgaacaacaggtgagtccgcctaatacaaatgcaaaatcatacgccgagatcatcttcggcaaatgtggtcggattggccagagaacggccatgctgacagctaccagtacccaacccctgctccctcttagtacagaggacaaaccgtctctggtaccactttctgtgcccagaactcaagtcatcgaacatattaccaagctcatcacaatcaatgaggctgtcgttgatacgtccgagatagattctgtgaagccgagacgatcgagtctcagccgtcgctcctccatggagagccccaagagctccctgtatcgggagcccctgtccagccattccgagaaaactaagcctgagcagtcactgctgtcgcttcaacaccccccttcaacagctcctcccgtgccactcctgcgcagtcactccatgccatctgcagcctgtaccattagtactccacatcacccttttaggggatcctacagttttgatgaccacatcaccgactctgaggctttgtcccattctagtcacgtcttcacttcacatccaaggatgttgaaacggcagccagctattgaactcccactgggaggtgagtactcctctgaagaaccaggcccaagttcaaaggataccgctagcaagccatccgatgaggtggaacctaaggaatcggaactaacaaagaagaccaagaaagggctgaagaccaagggtgtcatctatgaatgtaatatctgtggtgctaggtacaagaagcgtgacaattatgaagcccacaaaaagtattattgttcagagctgcaaatcgcgaaacccatctcggccgggacccacaccagtccagaggccgagaaatcacagattgagcacgagccctggagccagatgatgcattacaagctgggaactaccctagagttgacccccttgagaaagcgtaggaaggagaagtcacttggtgacgaagaagagccgccagccttcgagtctactaagtcacagtttggtagtcccggccctagcgacgccgccaggaacttgccactggagagcaccaaatcacccgctgaacccagcaagtccgttccaagcctcgaaggcccgaccggcttccagccaaggaccccaaagcccggcagtggctccgaaagcggtaaggagcggagaaccacaagtaaagaaatcagcgttatccagcatacttctagcttcgagaagagcgattcacttgagcagccatcgggcctcgaaggagaggacaaacctctcgcccagtttccatctccccctcctgctccgcatgggaggtcagcgcatagccttcagcccaaactcgtacgccagcccaacattcaggtgcctgaaatcctggtgacagaagagcccgatagacccgacacagagcctgagccaccacccaaagaaccagaaaagacagaagaatttcagtggccacagcgctctcagacattagctcaactccccgctgaaaagcttccccccaagaagaaacggctacgtttggcagagatggctcagagcagcggggaatccagttttgagtccagcgttcccctctccaggtcgccgagccaagaatcgaatgtgtccctgagcggttcatccagatcagcttccttcgagcgcgatgaccacggcaaagcagaggccccgtctccctcgtcagacatgaggccgaaacccctcggcacccatatgctcaccgtaccaagccatcatccacatgctcgagagatgaggcggtctgctagcgagcaatcccccaatgtcagccattcagcccatatgaccgagacacgtagtaagtcttttgattacggtagcctttccttgacaggcccctctgcccctgcacccgtggctccacctgctagggtggcgccacctgaacgccggaagtgttttctcgtgcgacaggcttctctatctcgtccgcccgagagtgaactcgaggtggctccaaagggacgtcaggagagcgaagaacctcagccttcttctagtaagccgtcagccaagagttccttgtctcagatcagctctgcagcaacctctcacggcggtccacctgggggcaaaggtcccggccaagacaggcctccgctcgggcctaccgttccttataccgaggctttacaggtcttccatcacccggtggcacagactcccctccacgagaagccctatctcccccccccagtcagcctgttttcctttcagcacttagtgcagcatgagccggggcaatcacctgagttcttctcaacccaggctatgagcagtctgctcagttcgccttattctatgccaccgttacccccatccctttttcaggcacccccactgcccttgcagcctaccgtactacaccccggccaattacaccttcctcaactcatgccccatcccgcgaatatcccctttcgccagccaccatccttcctgcccatgccataccctacttcttccgccttgagctccggtttttttctgcccctgcagagtcagtttgccctccagctcccaggagatgtggaaagccaccttccccagataaaaacgagcctggcaccactggctacaggctccgctggcctcagccccagcaccgagtattcgtcagacatccgtctcccgccggttgcccctccggcctctagctcagcgcctactagcgccccccctcttgctctgccagcatgtcccgataccatggtgtcccttgtggtccccgtcagagtgcagacgaacatgccctcctacggctctgcaatgtatacaacccttagtcaaatcctggtgactcagagccagggaagcagcgctaccgtggccctccccaaatttgaagagcccccgagcaagggaacaaccgtgtgtggcgctgacgtccacgaagtggggccaggtcctagcggcctgagcgaggagcagtcccgagctttccccactccctacctccgcgttcctgtcacgctgccagaacggaaaggcacctctctcagttcggagtccatcctatctttggaggggtcctctagcactgctggtggatctaagagagtcctctcaccggctggatccttagagctgacaatggaaactcaacagcagaagagggtgaaggaagaggaggccagcaaggcagacgaaaagttggagcttgtcaagccctgttccgtcgtgttgacctcaactgaagacggaaaacggcctgagaagagccatctgggcaaccagggccagggacggcgcgagctggagatgttgagtagcctgagtagcgacccatccgatacaaaggagattccccctctcccccatcctgctctctctcacggcaccgcccctggctccgaggcattaaaggagtacccccagccaagtggcaagccacaccggcgggggttgactccactgagcgttaagaaggaggactccaaggagcagccagatctccctagcctggcccctccgtccagtctgcctcttagtgagactagttccaggcccgccaaatctcaggaaggcacagactctaagaaggtacttcagtttccaagtctccacaccaccaccaatgtttcctggtgttacctgaactatattaagcccaaccatatccagcatgccgaccgcaggtcctccgtctatgctggctggtgtatttctctctacaatccaaatcttcctggcgtgtccacaaaggccgctctaagtctgcttcgctccaagcagaaagtgtctaaagagacctatacaatggccacagctccacaccccgaagcaggacgactggtgccatcatctagtcggaagccacggatgaccgaggtgcatcttccgtccttggtttcacctgagggccagaaagacttggcccgggtggaaaaggaggaagagaggcgaggagaaccagaagaagatgctcctgccagccagagaggcgaacctgccaggatcaagatttttgaaggaggttacaaatctaacgaggagtatgtgtatgttagggggcgggggaggggcaaatacgtctgcgaagaatgtgggatccgctgcaagaagcccagcatgctgaagaagcatatcagaacgcacactgatgtcagaccttatgtatgtaagcactgccacttcgccttcaaaacaaagggtaatctcaccaaacacatgaaaagcaaagctcattctaagaaatgccaagagaccggtgtgctcgaggagctggaagcggaggaggggacctcagacgacctttttcaggattccgaaggcagagaaggcagcgaggcagtggaggagcaccagttctctgatcttgaggacagcgacagcgactccgatttggatgaggatgaggacgaagacgaggaggagtcccaggatgagctgagtagaccctccagcgaggccccacctcccggcccgccacatgccttgagggcagactccagtccgatcctgggacctcaacctcctgacgccccggcctccgggacagaagcaactcggggcagctctgtcagtgaggccgaacgtctgaccgccagctcatgtagcatgagctcgcaatccatgcctggcctaccctggctgggccctgcaccattaggctcagttgaaaaggatacaggctcagcgctgtcctacaagcccgtcagcccacgtcggccatggtccccaagcaaggaggccggtagcagaccacctctggcacggaagcacagcctcactaagaacgactccagtccacagaggtgctcaccagcacgagaacctcaggcttcagcgccaagcccacccgggttgcacgtggaccctggtaggggaatgggagctctgccatgcggcagtcccaggctgcagttaagtcccttaacgctttgcccgttaggcagagagctggcgcctagggctcatgtgttatccaagttggaggggactacagaccctggactgcccaggtattcccctaccaggagatggtctccgggtcaagcggagagcccccctcgttccgctccgcccggtaaatgggcgcttgcgggtccaggttcaccaagcgccggagagcatggaccaggcctggggctggacccccgggtgttgttcccccccgctccgctcccccataaactactcagccggagccccgagacttgcgccagcccttggcaaaaagccgagtctaggagtccttcttgttcccccgggcccgcccaccccttgtctagcaggccattttctgccctgcatgactttcacggacacatcctcgccaggaccgaggaaaacatcttttctcacttgccactgcattcgcaacacctgacccgcgccccttgtccattgattcccataggcggaatccagatggttcaggctagaccgggcgcccacccgacactgctgccaggacccacagcagcttgggtaagtggtttcagcgggggaggaagcgatctgaccggggcccgcgaagcgcaagagcggggcaggtggtcccctaccgaatcttcttcagcttctgtgtctccagttgctaaagtatccaagttcacgctgtctagcgagcttgagggaggggattatcctaaagagcgggagaggacagggggagggcctgggcgccccccggattggaccccccacggtaccggagctcccgccgagcccaccccaacacatagtccctgcacaccaccagataccttacctcggccaccccagggtcgcagagcagcacagtcttggagccccagactcgagagtcctcgtgcccccacaaatccggagcccagtgccacaccaccgctggatcgttcgtccagtgttggctgcctggccgaagcctccgctcgctttcctgctaggacacgcaatctgagcggggagccccggacccgccaagatagcccaaagccaagcggctccggagaacctcgggcacaccctcaccagcctgaggaccgggtgccaccaaatgcctag

SEQ ID NO: 120230 - DNA, 7221 bp, Artificial Sequence
  Description of Artificial Sequence: Synthetic coding sequence
atggatcctgaacagtcagtcaagggtactaagaaggctgaagggtcaccccggaagagattgaccaaaggtgaggccatccaaactagcgttagcagcagcgtgccttaccctgggtctgggacagcagcgactcaggaaagccctgcgcaagagcttctagcccctcagcctttccctgggccgtcctccgtgctccgggaggggtcccaagagaagacagggcaacagcagaaacctcccaaacggcccccaatcgaagctagcgtgcatatcagtcaacttcctcagcacccattgaccccagccttcatgtcacccggaaagcctgagcatctgctggaaggcagcacttggcagttagtggatcctatgcgcccagggccttccggctcgttcgtggctcctggcctgcacccccagtcccaactgctgccttcacacgctagcatcatccctccagaagacttgcccggggttcccaaggtgtttgtgccccgcccttcccaggtgtcactaaagcccacggaagaggcccacaaaaaagagcggaagccacagaagccgggcaaatatatatgccagtattgttcccggccctgcgccaagccaagtgttttgcaaaagcacatcaggagccacacaggggaacgcccctatccgtgtggcccctgtggcttttcctttaaaaccaagtctaacctctataagcatagaaaaagtcacgcgcaccgcatcaaagcaggccttgcttctgggatggggggtgaaatgtaccctcatggattggaaatggaaaggatccccggggaagagtttgaggagcctacagagggggaatcaacagattccgaagaggagacttctgctacctccggtcacccggcagaactgagcccccggcccaagcagccacttttgagctcaggtttatattctagtggcagccactcaagtagccatgagcgctgctccttaagccagtcaagtactgcccagagtctggaagaccccccccccttcgtcgaaccatctagcgagcaccccctgtcccataaacctgaggatactcacaccattaaacagaaattggccctgcgactctctgagagaaaaaaagtgatcgacgagcaggcatttctctcgccaggctcgaaaggaagcacagagtccgggtatttctctcgctcggaatctgctgagcagcaagtgagccccccaaacacgaacgcgaaatcttatgccgagatcattttcggcaagtgcggtcgcatcggccagagaaccgcgatgctgacagcgacctctacgcagcccctcctgccactgtcaacagaggacaaaccctctttagttcccctatcagtacctcgaactcaagttatcgagcacatcaccaagttaataacaatcaacgaagccgtagtggatacatccgagatcgatagtgtgaagcctagacgatccagcctgtctcggcggtccagtatggagtcccccaagtctagtctctatagagagcccctgtcgagccactccgagaaaactaagccagagcagagtctgctgagcttgcagcaccccccttctacagccccgcctgtgcctctcctgcgatctcactccatgccctccgcagcttgcacaatctcgactccacaccatccctttaggggctcttacagttttgacgaccacattactgatagcgaggctttgtcgcatagtagccatgtcttcacaagtcatcccagaatgttgaaaaggcagcctgctattgagcttccactggggggcgaatattcctctgaggaaccaggaccctcatctaaggataccgccagcaagccctccgatgaggtggagcccaaagagagcgagctgacaaaaaagacgaaaaaagggctcaagaccaaaggcgtgatttatgaatgcaacatctgtggagcaaggtacaaaaagcgcgacaactacgaggctcataagaagtattactgctccgagcttcagatcgccaaacctatctcagcagggacacacacatctcccgaagcagagaaatctcagatcgagcacgagccatggtctcaaatgatgcattacaaattaggaaccacactagagcttacccccctccggaagagacgcaaggaaaaatcgctcggggatgaggaagagcccccagcctttgagtccactaagtcccaattcgggagccccggtccttctgatgccgctcgcaacctgccacttgaaagcacaaagtccccagctgagccaagcaagtccgtcccaagcttggagggaccaacaggctttcagcctagaacgcctaaacctgggtcaggcagtgagtccggcaaagaaaggcggaccacttccaaagagatcagtgtgattcagcataccagctcattcgaaaaaagcgactcactggaacagccatccggcctggaaggggaagacaagcccctcgcccagttcccttcaccaccccctgcccctcatggccgttctgctcatagcctccagccgaaactcgttagacagcccaacatccaggtccccgaaattttagtgactgaggagcccgataggcccgacactgagccagagcccccacccaaggagccagaaaagaccgaagaattccagtggccccaacgatcccagacgctagcccaattgcctgccgaaaagcttcctccaaaaaagaagcgtctgaggctggctgagatggcgcagtcttctggagagtcttcgttcgaatccagcgtgccactgagtcggtcaccaagtcaggaatccaacgtgtcccttagcggcagtagccgaagcgcaagttttgagagagatgatcacggaaaggccgaggccccatctccttcttcagacatgcgccccaaaccactgggcactcacatgctaactgtaccaagtcaccatcctcatgccagggagatgcgccggtccgcctcagaacagtccccaaacgtgagccactccgcgcacatgacagaaacccggtctaaatccttcgattacggctctctgtccctgacagggccatctgccccagctcccgttgcgccaccagctagggtggcgcctcccgagagacgcaagtgctttttagtgcgtcaggccagtctgagcaggcccccagagtctgagctcgaggtggcccccaagggacgccaagagtcggaagagccacaaccttcctcatcaaagcctagcgccaaaagctcacttagtcagatcagctccgccgctactagccacggaggaccgccaggagggaaggggccaggtcaggaccgtccaccactgggccccacagtgccctatacagaagcactgcaggtttttcaccacccagttgcacagacacctctgcacgagaagccctacttgcccccacccgtgtccctcttcagttttcagcatctcgtccaacacgagcctggccaatctccggaattctttagcacacaggccatgagctcgctgctttccagcccgtatagcatgccaccattgcctccgagtctttttcaagccccgcctctgcccttgcagcccacggtgctacacccagggcagcttcatctgccacagttgatgccacacccagccaatattccatttagacagcctccctcttttttgcccatgccctatcccacaagctccgcattgagcagcgggttcttcctgccactgcaatcgcaattcgctcttcagctccctggcgacgtcgaaagccatctccctcagattaagacatccctcgccccattggcaactggcagcgccggcctgtccccctcaactgaatatagcagtgacattcgactcccccctgttgctccgccggcatcatcgtccgcccctacctccgcacctcccctggccctacctgcttgcccagacactatggtcagtctggtggttcctgtccgagtacagaccaatatgcccagttacggttccgctatgtataccaccctttcccagattttggtgacgcagtctcagggcagctctgccactgtggcattgcccaaatttgaagagcctcccagcaaaggaactaccgtgtgcggcgccgatgtgcacgaggtgggacctgggcccagcggtctctcagaggaacagtcacgagcatttccgacaccttacctacgtgttcctgtgacattgccagaacgtaaggggacaagcctctcctcagagagtattctgagtctggaaggctcctcaagtaccgccggaggaagcaagagggtgctcagtcccgccggctcactggagctcacaatggaaacccagcagcagaaacgtgtgaaggaggaagaggcatctaaggcagatgaaaaactggaactggtgaaaccttgtagtgtcgtgctcacctctactgaggacgggaaacgacccgagaaatcacacctgggcaatcaaggccagggacgcagggagctagaaatgttatcctcactgtcgagcgacccatcggataccaaggaaattcccccgcttccacacccagccctttcccatggcactgctccagggagcgaggctcttaaagagtatcctcagccgagcgggaaaccccacaggcgcggtcttactccactctctgtgaagaaagaagactctaaggagcaacctgatttaccttcgctggccccaccctcctcactgccgttgtctgaaacatcttcgcgacccgccaagtcccaggagggtacagacagcaagaaagtgctgcagttcccttcattacacaccaccacaaatgtgagttggtgttatttaaattacattaaacccaaccatatccaacatgcagaccgaaggagcagcgtgtatgcaggttggtgtatttcactgtataatcccaatctgccgggagtgagcaccaaggctgccctcagcctgctgagatcaaaacagaaggtgtctaaggagacctataccatggccactgctccccacccagaggccggtcgattggttcccagctcatcaaggaagccgcgaatgacagaagtccacctgcccagccttgtgagcccagaaggacagaaagacctcgccagggtcgagaaagaggaggagagaagaggggagccagaagaagacgctccagccagccagagaggagagccagcccgaattaaaatcttcgaggggggctacaagtcaaacgaagaatacgtgtacgttaggggccgcgggagagggaagtacgtgtgcgaagagtgcggtatcagatgtaaaaagcccagcatgttgaaaaaacacattaggactcacaccgacgtccgcccatatgtgtgcaagcactgccatttcgccttcaaaaccaaaggcaatctgaccaagcatatgaaatccaaagcacattcaaaaaagtgccaggaaaccggggtcctggaagagctggaggccgaagagggtacatcagacgatttgtttcaggattcagaaggccgcgaaggctccgaagcagtcgaggagcatcagttctcggacctcgaggactcggattcggacagtgaccttgacgaggatgaagatgaggatgaggaagagtctcaggatgaactatcccgcccatctagcgaggcccccccccctggaccaccgcacgcccttcgtgccgattccagtcccatattggggccacaacctccggatgcccccgccagcggaactgaggccacaaggggatccagcgtgtccgaggcagagcgcttaactgcgtcttcttgcagcatgagcagccagtccatgccagggctcccctggttaggaccggcgcctctgggtagtgtagagaaagataccggctctgctctgagttacaagccagtttccccacgccggccttggagtcctagtaaggaggccgggtccagaccaccactagcccgaaagcactccttgaccaaaaacgacagttccccacagcggtgttcccctgctagggaacctcaggcttctgccccttctccccctggtctgcatgtcgacccaggaagaggtatgggtgcgctcccttgcggatctcctaggttacagctctcgccattaactttatgtcctctcggccgagaactggcgcctcgagctcacgtgcttagcaagctggagggcaccactgatccaggcctcccccgctattccccgacgcggcggtggtcacccggacaggctgagagtccaccacgatccgcaccgcctgggaaatgggccctcgccggacccgggtccccatctgctggtgaacacggaccaggcctcggactggatccaagagtgctgttccctcctgctcccctccctcacaaactgctgtcacggagccctgaaacttgcgcatccccttggcaaaaagccgagtcccggtctccatcctgcagccccggacccgcacaccctctgagcagtcgcccattctctgccctgcatgatttccacggccatatcctggcgcggacagaggaaaatatttttagccaccttcctctgcattcacagcatctgacacgtgccccatgcccgcttattcccattggaggcatacagatggtacaagcccggccaggcgcccacccaactctgctgcctgggccaactgcagcatgggtgagcggatttagcggaggaggctcagatcttacaggcgcccgcgaagcccaggagaggggacgatggtcacccaccgagagtagttccgcctcagtatccccagtagcaaaggtgtcaaaatttactctgtctagcgagctggagggcggagactacccaaaagagcgggaacggacaggaggtggaccaggacgccctcccgactggactccccatgggactggagcgcccgcagaacctacccccactcatagcccatgcacacccccagacactctgccaaggccaccccaaggccgccgggcagctcaaagctggagtccccggttggagtcccctagagctccaaccaacccagaaccatcagctactcctcctttagataggagctctagcgtgggctgtctggcagaggcctctgctcggtttcccgccaggaccagaaatctgtcgggggaacctcgtactaggcaagacagccccaagcccagcggaagcggcgaacccagggcccatccccaccagcccgaagaccgagtcccacctaatgcttag

SEQ ID NO: 120231 - DNA, 7218 bp, Artificial Sequence
  Description of Artificial Sequence: Synthetic coding sequence
atggatcctgagcagtctgtcaagggaactaagaaagccgagggatcgccacgaaaaaggcttacgaagggggaagccatacagacatcagtgtccagctcagtcccgtacccaggcagcggcacagcagccactcaggaaagccccgctcaggagctgttagctcctcagccatttcctggaccttcctccgtgcttcgtgaaggctcacaagagaagaccggacagcagcagaaaccacctaaacgaccccccattgaagccagtgtgcacatcagccagttaccccagcatccactgaccccggcctttatgtctccaggcaagccagagcacttgctcgaggggtcgacttggcagctcgtcgatccgatgagaccaggaccatcgggcagcttcgttgcccctggattacaccctcagtcacagttattaccgtcccatgcatctattatcccgccagaggatctccctggcgtgcctaaagtttttgttccccgaccctcgcaggtctccctgaagcccactgaagaggcccacaaaaaggagcgcaaaccacagaaacctggtaagtacatatgtcaatactgcagtcgaccctgtgcgaagcctagcgttctacagaaacacatcaggtcccatacaggggagaggccttatccgtgcggcccttgtgggttctcatttaagacaaagagcaatctgtataaacacagaaaaagtcacgcacaccgtataaaggccggcctggcaagcggtatggggggcgagatgtatccgcacggattggagatggagagaatccccggtgaagagtttgaagagcctaccgaaggagagagcacagattcagaggaagaaacaagcgcgacctctggccaccccgcagagctctccccgcggccaaagcagcccctattatcttccgggctgtactcatccggtagtcactccagtagtcacgaaagatgttcactgtctcagagtagtacagcccagtcactggaggacccacctccattcgtcgagccctcatcggagcacccactgtcacacaagcccgaggatacacataccatcaagcagaagctggccttgcgtctgtcagagagaaagaaggtaatcgacgaacaagcgtttctgtcgcctgggagcaaagggtcaaccgaatcagggtatttctctcggtcagagtccgcagaacagcaggtctcaccccctaatacaaacgcaaagagttatgccgaaattattttcggaaaatgtggtaggatcgggcagcggactgctatgcttacagcaaccagtacgcaaccactcctgccattgagcacagaggataagccctcacttgttcccctttctgtgcctagaacccaagtcatagagcatattacaaagctcatcacgatcaatgaggctgtcgtggatacttctgagatcgatagtgtgaaacccaggagatcctccttgagcagaaggtcctccatggaatcccctaagtcctccctttatcgagaaccactcagtagtcattccgagaagacaaagcccgaacaaagcctgttaagcctgcagcacccaccttcgaccgcaccccccgtaccgctcttgcgatctcattccatgccctccgctgcctgtacaataagtacaccccaccacccctttcgcggttcttattcctttgatgaccacatcacggattccgaggccctgagtcattctagccacgttttcacttcccacccacgaatgctgaagaggcaacctgccatagaactccccctcggaggagagtactcatcagaagagccgggaccgagtagtaaggacaccgcctctaagccctcagatgaagtagagccaaaagagtccgagttgacaaagaaaactaaaaaaggcctaaaaaccaaaggtgtgatatatgagtgcaacatctgcggtgccaggtacaagaagcgcgataactatgaggctcataagaagtactattgctccgaattacaaattgcgaaacccatctcggcaggcacacacaccagtcctgaagccgaaaaatctcaaattgaacatgagccctggtcccagatgatgcactataagttaggtaccactctggagttgaccccgctcaggaagaggcgaaaagagaaatccctaggggacgaagaggagcctcctgcatttgagagcacgaagtcccagttcgggagtccaggcccctctgatgcagccagaaatctgcctttagaatcaaccaaaagccctgcagagcctagcaagagtgtgccgtctctagaggggccaactggtttccaaccacggacccccaaacccggtagcggttccgaatctggcaaagaacgcaggactactagcaaggagatcagcgttattcaacatactagcagctttgaaaagagtgattccctggagcagccctccggactggagggggaagataaaccattggcccaattcccatctcctcctccagccccccacggtcggagcgcacatagccttcaacctaaactggttcgccagcctaacattcaagtacccgagattcttgtgacagaagagcctgaccgcccggacacagaacctgagccccccccaaaagagccagaaaagacagaagagttccagtggccacagcgctcacagacacttgctcagctcccggcagaaaagttaccccccaagaaaaagagactgaggctggccgaaatggcacagtccagtggcgaatcaagttttgagagttctgtgccactgtcaagaagcccctcacaggagtccaacgtgtctctgagtgggagctccagaagtgccagttttgaacgagatgatcacggaaaggcggaagcgccctcccccagctcggacatgcgacctaaacccctggggacacatatgttaacagtcccttctcaccaccctcacgctagggagatgcggaggtccgcttcagaacaatccccaaatgtgtcccacagcgcccatatgaccgaaactagatccaaaagttttgattatggcagcctttctctcactggtccatccgcccctgctccggtggccccgcccgctagagtcgctccccctgaacgccgcaagtgctttcttgtgcggcaggcatccttgagtcgtccccctgagtcagagctggaggtagcccccaagggacgtcaagaaagtgaagaacctcaaccaagctcatccaagccttctgccaagtcgtccctgtcgcagatctcaagtgccgccactagccatgggggaccacctggaggtaaaggacccgggcaggatcgccccccactcggacctacagtgccatacacagaggccctgcaagtgttccatcatcccgtggcccagacacctcttcacgagaaaccttatctgcctccaccggtctcactgttctcttttcagcatctggtgcagcatgaaccaggccagtcaccagagtttttctctacacaggccatgtccagcttgttatcttccccatatagcatgcctcctctgcccccctcgctcttccaggccccccctctccccctccagcccaccgttttgcaccctggccaactgcacctgcctcagttaatgccccaccctgctaatattccatttcggcaaccacccagcttcctacctatgccttatcccactagctccgccctgagttctggcttctttctcccccttcagagccagtttgcactgcagttacccggtgacgtagagtctcatttgccacaaatcaaaacatccttggccccactagcaaccgggagtgctggattgtcaccaagcactgagtattcaagtgacattagattgcctccggtggcacctccagcttccagttctgcccctactagtgccccaccccttgccctccccgcctgccccgacaccatggtctctctggtggtccccgttagagtacagaccaacatgccttcttacggatcagctatgtatactacactttcccagattctggtgacccaaagccaggggtccagtgccactgtggctcttcccaaattcgaagagcccccgagcaaagggacgacagtgtgcggggctgatgttcacgaggttgggcccggcccgagtggcctcagtgaagagcagagcagagcctttccaaccccctacctccgggttcctgtgacactcccagaacgcaaaggcacgtcgcttagctcggagagtattctgtctttggaaggctccagctccactgctggcggaagtaaaagagtactaagtccggcagggagtctggaactgacaatggaaactcagcaacaaaagcgcgtcaaggaagaggaagccagtaaggcagatgagaaactggagctggtcaaaccatgttctgtcgtgctcacatcaacagaggacgggaagcgcccagagaagtcccacctggggaaccagggccaaggtcggagggagttggagatgttatctagcctgtctagtgatccatccgacactaaggagatacctcccttgccccaccccgccctgtcccacgggactgcaccggggtcggaggccctgaaggaatatcctcagcctagtggtaagccccacagaaggggactaactcctcttagcgttaaaaaagaggatagcaaggagcagccagacctaccttcactcgccccaccttcctctctgccgctgagcgaaactagtagtcgaccagctaagagtcaggagggtaccgatagcaaaaaagtcctccagtttcccagtttacacacaacaactaacgtgagctggtgttatctgaattatataaagccgaaccatatccagcatgctgaccgcagaagtagtgtgtatgccggatggtgcatctcactttacaaccctaatctgccaggagtgagcactaaggcggcgctctcactcctgcgaagcaagcagaaggtgtccaaagagacatataccatggccaccgcccctcacccagaagcagggaggctggtaccctcctccagtcgcaaaccacgcatgaccgaggtccacctgcccagccttgtgtctccggaggggcagaaagacctggcccgcgttgagaaagaggaggagcgcaggggggaacccgaagaggacgcccccgcttcccagagaggtgagcctgcccgcatcaagatattcgagggtgggtacaagtctaacgaggagtacgtttacgtgcgcggacgagggagggggaagtacgtatgcgaagaatgtggaatccgctgcaaaaagcccagcatgctaaaaaagcatatccggacgcatactgacgtgagaccatatgtatgcaaacattgccacttcgcattcaagactaagggaaatctgacgaagcacatgaaaagtaaggcacatagtaaaaaatgtcaggagaccggagtgctcgaagaactggaggctgaggagggcaccagcgatgacctgtttcaggactccgaaggccgcgaaggcagcgaggccgtagaagagcatcaatttagtgatttagaagacagcgactcagactctgacctagatgaggacgaggacgaggacgaagaggagagtcaggatgaactcagcagacccagttccgaggctccaccgcccggaccgccacatgctctcagggcggactcttctcccattctcgggcctcagccaccggatgcccccgctagtggaacagaagcaactaggggaagctcagttagtgaggcagaaagactcaccgcatcctcctgcagtatgagcagccagagcatgccaggtctgccctggctaggtccggcccccctcggcagtgttgagaaggacacgggttctgcacttagctataagccagtcagccctagaagaccttggtcaccaagcaaagaagccggatctcgacccccgctcgcccgtaaacactccctcacaaaaaatgactcttctccacaaaggtgtagcccagctagagaacctcaggccagcgcgccgagtccccctggtcttcatgtggatcccggtaggggaatgggggcccttccttgcgggtctccaagactccaattaagtcctctgaccctgtgtcccctcgggcgggaactcgcgcctcgggctcatgttctttctaaactggaaggtactactgatcccggcctgccaagatattcaccaacacggcggtggtcccccggacaggcagagtccccccctaggtccgcccccccaggaaaatgggcgctcgctgggcccgggtcaccttctgcgggtgagcacggtccgggtctgggtctagacccaagggtgctctttccacccgctcccctccctcataaactgctgtctcgttctccggaaacttgcgcatctccttggaaggcagagtctcgatcccctagctgctctcccggacccgcccacccactgtccagtcggcccttctctgccctgcacgacttccacgggcatatcctggctcgaaccgaagagaatatttttagccacctccccctgcacagccagcacctgacccgcgctccatgccctttgatacccatcggggggatccagatggtacaggcccggccaggagcccatcccactcttctgcccggtcccacggccgcatgggtgtccggtttcagtggcgggggatccgatttaacgggcgcgcgggaggcacaggaacgcggaaggtggagtccaactgagtcttcttcagccagcgtctcgcctgtggcgaaggtttccaagttcacactgtcttccgagttggagggcggtgactacccaaaggaacgggagaggacgggcggaggaccagggcggcctccagattggacaccgcatggtaccggcgcgcccgccgagcctacccctactcactctccatgcactcccccagatactttacctcgccctcctcagggccgccgtgccgcccagtcctggtcacctaggctggaaagcccacgtgcaccaacaaatccagagccttccgctactccccccctagaccgttccagctcagttgggtgcttagccgaggcctcggctcgattccccgctaggacccgcaacctgtccggagaaccacggacgcggcaggattcccccaagccctcaggctccggcgagcccagggcccacccgcaccagcccgaagatagagtgccccccaatgcctag

SEQ ID NO: 120232 - DNA, 7218 bp, Artificial Sequence
  Description of Artificial Sequence: Synthetic coding sequence
atggacccagagcagtcagtgaaaggtacaaagaaggccgaaggcagtcccaggaaaaggcttactaaaggggaggctatacagacctcggtctcaagtagcgtgccttaccccgggagcggcacagccgctactcaggagagccccgcccaggagctgcttgctccccagccctttccaggcccctcttctgtgctaagagaaggtagccaggagaagacgggacaacagcaaaagccccccaaaaggccacccatcgaggcgtccgtgcatatctcacagctccctcagcaccccctgactcccgcattcatgagtcccggtaaacccgagcacttattggagggaagcacgtggcagctggttgaccctatgaggccgggcccttccgggtcctttgttgcccctggtttacatccccagagtcaactgctcccttcacacgcatccatcattccaccggaggacttgccaggcgttcctaaggtgttcgttccccgccccagtcaggttagtctgaaacctacagaagaggcgcataagaaagaacgaaagcctcagaaaccagggaaatacatctgtcagtattgttccaggccatgtgccaagcctagcgtgttgcagaaacatattcgctcccatacaggcgagcgtccatacccatgtggaccttgcggcttcagcttcaagaccaagtccaacctatataaacaccgcaagagtcacgcccacaggattaaggctggtcttgcctccggcatgggcggagagatgtatccccatggattagagatggaacgaattccaggcgaggagttcgaagagccaacagagggagagagcacggactccgaggaggaaacttctgcaaccagcggtcacccagcggagctatctccccgaccaaaacaacctctcctcagctccggcctctattccagcggcagccactcttcatcgcatgagcggtgttcactcagtcaatcgtccactgcccagagcctggaagacccccccccctttgttgaaccgtccagcgaacacccactgtctcataagccggaggatacccatactattaaacagaagctggccctgcggctgagtgagcgcaagaaggtcattgatgaacaggcttttctctctcccgggtctaagggctccaccgagtccggttatttttcgaggtcagagagcgctgagcagcaggtgtcaccacccaacacaaacgccaagtcatacgccgagatcatcttcggaaagtgcgggaggatcggacagcggaccgcgatgcttacagccacttccacacagcccctgctacctctctcgaccgaggataaacctagcctggtgccgctgtccgtgccacggacgcaagtgattgagcatattaccaagcttatcactatcaatgaggcggtagttgacacgtctgaaattgatagcgtgaaaccacggcgatctagcctgagtaggcgatctagcatggagtcaccaaaatccagcctgtatcgcgagcccctgtctagtcatagtgaaaagaccaagccggagcagagcttgctgagcctccagcatcctccgtccacggcgcccccagtccccttgctcaggagccatagcatgccctccgccgcttgcacgataagtactcctcaccacccgttcagagggagctattccttcgatgaccatatcactgattccgaagcgttgtctcacagtagccacgtgttcacttcccatcctaggatgctcaaaagacagcctgcaattgaacttcctcttggaggtgaatacagttccgaggagcccgggccttcaagcaaggatacagcttccaaaccctcagacgaggtcgaaccaaaggaaagcgagttaacaaagaagactaaaaaaggtctgaagaccaaaggcgtgatttacgagtgtaacatttgtggggcgaggtacaaaaagagagataattacgaggctcacaaaaaatactactgctctgaattacagattgcaaagcccattagtgcaggtacccatacatcacccgaggccgagaagagtcagatagagcatgaaccttggtctcagatgatgcactacaagctcggaactactttagagctgaccccgctccggaagaggagaaaagagaaatctctaggcgacgaagaagagcctccagctttcgagtcaacaaagtcccaatttggatcccccggcccaagcgatgccgcccggaacctgccacttgaatctaccaagagccccgctgagccatctaagagtgtcccatcactggaggggccgacaggatttcagccgcgaaccccaaagcctggatccggctccgagtcaggaaaggagcggaggacaacttccaaagagatcagcgtgatacaacataccagttcgttcgaaaaatcagactccttagagcagccgtcagggctggaaggggaagataagccccttgcacagttcccaagtccgccccccgcgccacatggccgcagcgctcactccctgcagcccaagctggtgaggcagccaaacattcaggtgcccgagatcctggtaaccgaggagccagacaggccagacacggagcctgaaccaccccctaaggaacctgagaaaacggaggagttccagtggccccaacgaagccaaacgctggcccagcttcctgcagagaagctgccgcctaaaaagaaaagactgcgtctcgcggagatggctcagtcaagcggtgaatcttcctttgagtcaagcgtgcctctctcccgaagcccgtcccaggaatcaaatgtgtcgctttcaggctcatcccggtcagccagtttcgagcgggatgaccatgggaaggctgaagccccttccccttcatccgacatgcggcccaagccactcggcactcacatgttaacggtgccctcccatcaccctcacgcacgtgaaatgaggcggtctgcttctgagcagagccccaacgtatcacactcagcccacatgaccgaaacccggagcaagtccttcgactatggatctctgtctctgaccgggccctctgcgccagcacccgtggcccctcccgcccgcgtcgcaccccccgaacggagaaagtgtttcttagtccgacaggccagcctgtccaggccccccgagagtgagcttgaggttgctccaaagggtcggcaggaatccgaagagccgcagcctagcagctccaagccgtccgcaaagagcagcttaagccagatcagtagcgccgccaccagtcacggagggcccccaggcggcaagggccctggccaggatagaccaccactgggcccgaccgttccctataccgaggccctgcaggttttccaccaccctgtcgcacaaactccgcttcacgagaaaccctacctgcctcctcccgtgtctctgttctcctttcagcacttggtgcagcatgaacctggacaatcaccagaattcttcagcacccaagcaatgagctcactgctaagctctccttactctatgccccctctgcctccctccctgttccaggccccacctttaccattgcagccaaccgttctacaccccgggcagctgcatctgcctcagctgatgcctcaccctgccaatatccccttcaggcagccaccttctttccttccaatgccttaccccacgtccagcgccctgagctcaggcttcttcctgcctttgcaatcgcaattcgcattgcagctgccaggggacgtcgagtctcaccttccacagatcaagacatcattagctccattagcaactggttcggcagggctttcacctagcacagagtattcttccgacattcgactgccccctgtggcaccccctgccagctcatccgctcctacttcagcaccaccacttgctttacccgcttgccccgacacgatggtgtcactggttgttcccgtgagagtgcagacaaacatgccatcctacggtagcgccatgtatactaccctctcccagattctagtcacacaatctcagggatcctcggccacagtggctcttcctaaatttgaggagcccccttcaaagggaacgacggtctgtggagctgacgtgcacgaggtgggacctgggcccagcgggctatctgaagaacaaagcagggctttccccaccccttacctaagagtgcccgtcaccctgcctgaaagaaagggcacttcactctcatctgagtcaatcctgtccttggaaggctccagctctacagccggtggttctaagagggtattatcacctgcgggctcactggagctgacgatggagacgcagcagcagaaacgggttaaggaggaggaggccagcaaggccgacgagaaactagaactcgtcaagccttgctcagtggtgctgaccagcaccgaagacggcaagagacctgagaagtctcacctgggaaaccaaggccagggcagaagagagttggagatgctaagttccctttcctccgatcccagtgacactaaagagattcctcccctccctcatcctgccctttctcatggaaccgctccaggcagcgaagcgctgaaggagtacccacagccttcaggaaagcctcatagacggggtctaacacccctttcagttaaaaaagaggacagcaaagaacagccagacctgcctagcctggccccgccttcgtccctgccactgagtgaaacatcaagccgccctgccaagtctcaggaagggacagatagcaagaaggttctccagtttcctagcctgcacactacaaccaatgtgtcatggtgttacctgaactacatcaagccaaatcacatccagcatgctgatcggagatcaagcgtttacgccggctggtgtattagcctctataaccctaatctacctggtgtgagtacaaaagcggccctgagcctgttgcggtcaaaacaaaaggtgtctaaagagacgtacaccatggcaaccgcacctcaccctgaggctggacggcttgtgcctagttccagtcgcaaacccaggatgaccgaggtacacttgccctcgttggttagccccgaaggacagaaggacctggcccgcgtcgaaaaggaagaggaacgcaggggcgagccagaggaggacgcccccgccagccaaagaggagagcctgctaggatcaaaatttttgaggggggttacaagtctaatgaggaatatgtgtacgtgcgcgggaggggccgtgggaaatacgtctgtgaggaatgcggtattaggtgtaagaagccttctatgctcaagaagcatatcaggacccacactgacgtccggccttacgtttgtaagcattgccactttgcattcaaaaccaaggggaacctgaccaagcacatgaagagcaaagcgcacagcaagaaatgtcaggagacgggagtgctggaggagctggaagccgaagaaggtaccagcgacgatctttttcaggactccgaggggagagaagggtccgaagctgtggaggagcaccaattcagcgatttggaagattccgattcagactctgatctggatgaggacgaagacgaggatgaggaggaaagtcaggatgagctgagtaggccgtccagcgaagctcccccaccggggccacctcacgcattacgcgctgactcctcacctattctgggtccccagccaccagatgctcccgcgtctggcaccgaggccacacgcggaagctcagtgtctgaagcagaaaggctgactgcctcctcatgtagtatgagcagtcaatccatgcccgggcttccatggctggggccagctcccctcgggagcgtagagaaagacaccgggtcggccctgtcatacaagccagtttcccctcggcgaccgtggagcccatcaaaggaggccggtagtcgcccgccactggccagaaaacattccctgactaagaatgatagctcaccccagagatgctcacccgccagggaaccacaggcctccgctcccagccctcccggtttgcacgtcgacccaggccgcggaatgggcgcgctgccatgtggtagtccacgccttcagctgagtccactgacgttatgccctctggggcgggagctggccccccgagcacacgtcctctctaaactggagggcacaacagaccccggcttgccccgctactcgccaactcgacggtggtctccaggccaagccgaatcgcccccgagaagcgcccccccagggaaatgggcacttgctggaccaggcagtccttctgctggggagcacggcccaggactggggttggacccgagggtgctgttcccccccgcccccttaccacacaagctcctgtcaagaagtcctgagacctgcgcatccccctggaaggccgagtctcggtcgccatcttgctcccctgggccagcacatcctctctccagtcgtcccttttccgctctgcacgattttcacggacacatcctggccaggactgaggagaatatcttcagtcacctccccctgcactctcagcacctcacaagggccccctgtcctctgatccccatcggtggtattcagatggtgcaggctagacctggagctcatcccacactgcttcccggtcccacagctgcctgggtttctggcttttccggggggggctctgatcttactggagccagggaggctcaagaacgaggacggtggagcccaacagagtcgagtagcgcatcagttagcccagtggctaaggtgtctaaatttacactgtcctctgaactcgaaggcggcgattaccctaaagaacgggagcgcactggcggtggcccaggtcggcctccagactggacaccccatggcacaggcgcccccgcagaacctacgcctacccactccccttgcacccctcctgacacattgccgcgacctcctcaaggacgtcgcgcagctcagtcatggagccctaggctcgagtcaccccgcgcaccgacaaaccctgagccatcggctactcccccgctcgataggtcttcaagcgtgggctgccttgcagaagcctccgcgcggtttcctgccaggaccaggaatctgtccggcgagcctcgaactcgacaggactctccaaaacccagtggatccggcgagccaagggctcatcctcaccagcccgaagatcgcgtgccacctaacgcctag

SEQ ID NO: 120233 - DNA, 9429 bp, Artificial Sequence
  Description of Artificial Sequence: Synthetic coding sequence
atggctaccttggagaagctgatgaaggcttttgaatccttaaagagtttccagcagcaacagcagcagcaacagcagcagcagcagcagcagcagcaacagcagcagcagcaaccaccgcctccacctcccccccccccgcccccccagctgcctcagccacctccacaagcccaaccgttactgcctcagccacaacctcccccacccccgcctccacccccaccaggccccgcggtggccgaggagccgttgcataggccaaaaaaggagttgtccgccacaaagaaggatcgggtgaaccactgcctgactatttgtgaaaacattgtggcccagtccgtccgcaacagccccgaattccaaaagctgcttggcatcgccatggaactgttcttgctgtgttcagacgacgccgagtccgatgtgcggatggtcgctgacgaatgtctgaataaggttatcaaggcgcttatggactcaaatctgcctagacttcagctggagctttacaaagaaattaaaaagaatggtgcccctagaagtctgcgggcggctctatggaggttcgctgagctggcacacctcgttaggcctcagaaatgtagaccctatctggtcaatctgttgccatgcctcaccaggacaagcaagagacccgaagaaagtgttcaggagacactagcggcggcagttcccaaaattatggccagcttcggaaattttgcgaatgacaacgagatcaaggtgctgttgaaggctttcattgcaaatctcaaaagcagttctccaacaattcggagaacggcagctgggtctgcggtgtcaatttgccagcacagccggagaacccagtacttttattcctggctcctgaatgttctcttgggactgctcgtacccgtggaggatgaacactccactttgctgatcctcggggtactgctcactctccgctacttggtgccattgttgcagcagcaggtgaaggatacctcactaaaaggaagctttggggtgactcggaaggaaatggaagtgagcccctcagctgaacagctggtgcaagtatatgaactgactttacatcatacgcagcatcaagaccataatgttgtgacaggggctctagagctcttacagcaactgtttcgcaccccgcctccagagctactgcagacactcacagccgtagggggaatcggacaactgactgcagcaaaggaggaaagcggtggcaggtctaggtctggatctatcgtggagctgattgctggaggaggttcttcctgcagccctgtcctgtctcgaaagcagaaaggtaaggtgctgctaggagaggaggaggccttggaagacgactctgagtctaggagcgatgtgtcgagctccgcactcaccgcatctgtgaaggatgagataagtggagagcttgccgcctcgtcaggggtatcaacccctgggtccgcaggccacgacattatcacagaacagcccagaagtcagcacacattgcaggccgactctgttgaccttgcttcatgcgacttgacatccagtgctactgacggagatgaagaagatatcctgtcacacagctcctctcaggtgtctgctgtcccatccgaccctgccatggatctgaatgacggcacacaggcctcctcgcccattagcgattcatctcagacgaccactgaagggcctgactccgccgtcacccctagcgattcctccgagatcgtcctcgatgggacggataaccagtatctgggactgcagatcggtcagccacaggacgaggatgaggaggcaactggcattctacccgatgaagccagcgaggctttccggaattcctcaatggcactccaacaggcccatctcctgaagaacatgtctcattgccgtcagcccagcgatagtagcgtagacaaatttgtcctgagagacgaagcaactgaacccggcgatcaggaaaataagccctgtcggattaaaggagacattggccagagtacagatgacgactccgctcctcttgtccactgtgtgaggcttctgtccgccagtttcctgttaacagggggaaagaatgtcctggttcctgacagagatgtaagggtcagcgtaaaagcactggcattatcttgcgtgggcgcagccgtcgcactacaccctgaatcatttttctcgaaactttacaaggtgcctctggacaccactgaatatcccgaggagcagtatgtttctgacattctcaattatatcgatcacggagacccacaggtcagaggtgcaacggcaatcctgtgcggcaccctcatctgctcaattctttcacggtctcgatttcacgtaggtgattggatgggaaccattagaacgctgactggcaacacattttctcttgcggactgtatccccttactcaggaaaacgctgaaggatgagtcatcagtcacctgtaagttggcctgcacggcagtcagaaactgtgtgatgtccctgtgctcgagtagctactccgaattgggtctgcagttaataatagacgtgctcaccttgagaaatagcagctactggcttgtgaggaccgaacttctggaaaccctggctgagattgatttcagactagtttcctttctggaagctaaggccgaaaacctccatagaggcgcccatcattatacgggactgctgaagctccaggagcgggttctgaataatgtggttattcacctgttaggagacgaagaccctcgcgtgcgccatgtcgccgccgcaagtttaattagactagtgcccaagcttttctataagtgtgaccagggccaggctgatcccgtggttgccgtggccagagatcagtcaagcgtgtacctgaagctactcatgcacgaaacgcaacccccctcgcatttctctgtttcaaccataactaggatttaccgcggctacaacttgctgcccagcatcaccgacgtcaccatggagaacaatctaagtagagtgattgcggctgtgagccacgagctcatcacctcaacaacaagagcactgacctttggttgttgtgaagcgctctgtcttctgtccaccgccttcccagtttgtatttggtctttggggtggcactgtggagttccccccttatccgcatcagacgaatctcgtaagtcctgtactgttgggatggctacaatgatactgacactgctatcatctgcgtggttcccccttgatctgtctgcccaccaggacgccttaattttggcagggaatctcctcgcagcatccgccccaaaaagtctgcggagtagctgggccagtgaggaagaagccaatcctgccgctactaagcaggaagaagtctggcccgccctaggggatagggctcttgtccctatggtggagcaactgttttctcatctactcaaggttataaatatctgcgcacatgtgctggacgacgttgccccaggcccagccattaaggctgccttaccttcattgacaaatcctccatcactttcacccatacgtcgtaaggggaaagaaaaggaacctggcgaacaggctagcgtacctctgtcccctaagaaaggctccgaggcgtccgcagcttcacggcagtctgatacgagtgggccggtcactacttccaaatcttcctccctcgggagcttttaccaccttccctcctatttgaagctgcatgacgtgctgaaagccacacatgcaaactataaagtgactctcgatcttcagaatagtacagagaagtttggtggtttcctgcggtcagctctcgatgtgctatcccagattctggagctcgccacattacaggacattggaaagtgcgttgaggaaattctgggctatctcaagtcgtgctttagcagggagccaatgatggccacagtgtgcgtacagcaactgctcaaaacattattcggtactaatctggcctcacagtttgacggtttgagctccaaccctagcaaatcacagggacgggcccagagactaggcagtagttctgtcagaccgggcctgtaccattattgcttcatggcaccttacacccactttacgcaggctctggccgatgcttcactgaggaatatggtgcaagccgaacaggagaatgacacgagtggctggttcgacgtgctacaaaaggtgagtacccagctaaagaccaacctgacctctgtgaccaagaaccgcgcagacaaaaacgctatacacaaccacatccgactgttcgaacccctggtgatcaaggctctgaaacagtataccaccactacttgtgtccagctccagaagcaggtgctggatctgttagctcaactggtacagctgcgtgtgaattattgtctcctggacagcgatcaggtctttatcggctttgtacttaaacagttcgaatatatagaggtggggcaattccgcgagagcgaagccattatccccaacatttttttctttctggtcctgctctcctacgaacgctatcactccaagcagataatcgggatccctaaaatcatccagctgtgcgatggaattatggcatcagggcggaaggcagtgactcacgctattccagctctgcagccgatcgtccacgacttgttcgtccttaggggcaccaacaaggctgatgccgggaaggaacttgaaacgcagaaagaggtggtggtgagtatgcttctaaggctcattcaataccaccaggttctggaaatgttcattctggttttacaacaatgccacaaggaaaacgaggataagtggaaacgcctcagtaggcagattgccgacataatacttccaatgctcgctaaacagcaaatgcacatcgacagccacgaggccttgggagtgcttaacaccctgttcgagattctggcaccctcctcactgagaccagttgatatgcttctgagaagcatgttcgtgacccctaacactatggcatccgtttccacagtacagttgtggataagcggaatactggctattttgcgcgtactgattagtcagtccaccgaggatatcgttctgtcccgcatccaggaactaagcttcagcccctatctgatctcttgcacagttattaacaggctgagagatggggatagtacttccaccctggaggagcactctgagggtaagcagattaagaaccttcccgaggagactttctctaggttccttctccaactggtggggattcttctggaggatatcgtcactaagcagctcaaagtagaaatgagtgaacagcagcatacattctactgccaggagctgggaactcttctgatgtgtctcatacatatcttcaagagcggcatgtttagaagaataaccgccgcagccactcgcctctttcgctcagatggatgtggcggatcattctacactctagatagcctgaacctgcgcgcccgatccatgattacaacccatcctgccttagttctcttatggtgccaaattctgcttctggtcaatcatactgactatcggtggtgggcggaagtgcagcagaccccgaagcggcacagcctctcgagcacaaaattgctatcacctcagatgtccggcgaggaggaggattcagaccttgcagcaaaactgggcatgtgtaaccgtgaaatcgtcagaaggggggccctgattttgttttgtgattatgtttgccagaacttacatgattctgagcacttaacctggttgatagtgaaccacatccaggacctcatcagcctctcgcacgagcctcccgttcaggattttatctcagctgttcaccggaattcagctgccagtggcttgtttatccaggccatccaaagtagatgtgagaaccttagcactcctaccatgctcaaaaaaacactgcagtgcttagaagggattcatctgagtcagtcaggcgcggtgcttacattgtatgtggatagacttctgtgcacgccctttagggtactggccaggatggttgacattcttgcttgccggagggtagagatgctgttggctgctaatctccagtcatccatggctcaattaccgatggaggaactcaatcgtatacaggaatacctccagagctctggattagcccagcggcaccaacggctgtattccctgctggatcggttcaggctcagtactatgcaggattcgttgtcaccatcaccgccagtcagcagtcacccgctggacggcgatggccacgtgtcgttagagaccgtgtctcccgacaaggattggtacgtccatctagtgaaatctcagtgttggacaaggagcgacagtgcacttttagagggcgcagaactagttaaccgcataccggccgaggacatgaacgccttcatgatgaattcggaattcaatttgtccctgcttgctccatgcctgtctttgggcatgtccgaaatcagcggaggccagaagagtgccctgttcgaggcggctcgggaggtgacactggcccgcgtatcaggtactgtgcagcagcttcccgccgttcaccacgtcttccagcccgaactgcccgcagagcctgccgcttattggtctaagctgaacgacctgtttggcgatgccgctctctatcaatcgctgcccaccttagcccgcgccctggcacaatacttggtggtggtgtccaaactaccaagccaccttcacttgccaccggagaaagaaaaggatatcgttaagtttgtcgttgcaactctagaggcgctgagctggcacctcatacacgaacaaatccccctctcccttgatctgcaagctgggttggattgttgttgtctggcactccagctacctgggttatggtctgtagtgtctagcacagaatttgtcacgcacgcttgctctctgatatactgtgtacatttcattctggaagccgtcgccgtgcaaccgggcgagcagcttctgagccccgagaggcgcacgaatacacccaaggctatctctgaggaggaggaggaagtggaccccaatacgcaaaacccgaaatacatcaccgcagcctgcgagatggttgcagaaatggttgagtctctccagagcgtactcgcgctggggcacaagaggaatagcggagtcccagccttccttaccccgcttctcaggaatatcattatatcacttgccagactgccccttgtaaacagctacacacgcgttcccccactggtttggaagttggggtggtccccaaagcccggaggggactttggtacagccttccctgaaattcctgtagaattcctgcaggagaaagaggttttcaaggagttcatttaccgcattaatactctgggatggacgagtaggactcagttcgaagaaacgtgggccactttgctgggcgtgctagtgacccaaccccttgtgatggagcaggaagagagtcccccggaagaggacacagaaagaacgcaaataaacgtcctggccgttcaggctattacgtcactcgtccttagcgcaatgaccgtgcccgtcgccggaaaccctgccgtgagctgcttagaacagcagccacgaaataaacctttaaaggcactcgacacgagatttgggcgcaagctctctatcatcagagggattgttgaacaggagatccaggctatggtaagtaagagagaaaatatcgccactcaccatctataccaggcatgggacccagtgcccagcctgagtcccgccaccacaggggcgcttattagccacgagaaactactgctgcagattaatccagaacgtgaactcggatctatgtcttacaagttaggacaggtgtctattcactctgtttggctcgggaactcgattacaccactgcgggaagaggagtgggatgaagaagaggaagaggaggctgatgcccccgctccctcaagcccacccacttccccggtcaattctcgtaaacacagagctggtgtcgatatccactcttgcagccagttccttctggagctctacagcaggtggatcttaccctcttcctctgcccggagaactcctgctatactgatcagcgaggtggtgcggtctcttttagttgtctccgacctgttcaccgagaggaatcagtttgagttgatgtatgttaccctgaccgagttgcgccgggtccatccaagcgaggatgagatcctcgctcagtacttggtgccagctacctgcaaggcagcggcggtgcttggcatggataaggccgttgctgagcccgtatctcggctactcgaatccacgttaagatccagtcacttaccttctcgtgtgggggcattgcatggagtgctgtacgtgcttgaatgtgatctgttggacgacaccgcaaagcaactcattccggttatttctgattacctcctgtcaaacctgaaaggcattgcacactgtgtcaacattcatagtcagcagcatgtgctggtaatgtgtgccacagccttttacttaatcgaaaactaccctctggacgttggacccgagtttagcgcttctatcattcagatgtgtggcgtgatgctcagcggctccgaggaatctactcccagtatcatctaccattgtgctctaaggggtctcgagcggctgcttctttcagagcagctctcacggctcgacgcggagtcactcgtgaagctctcagtcgatagggttaacgtccacagcccgcatcgtgctatggccgctctgggcctgatgctgacctgcatgtatactggtaaagaaaaagtgtcccctggacggaccagcgatccgaatcccgctgcaccagactccgagtcagtgatcgtggccatggagagagtgagtgtcctctttgatcggatccgtaaaggcttcccttgtgaggcacgcgtggtggcccgcatattaccacaatttctggacgattttttcccccctcaggatatcatgaacaaggtcatcggggagttcttgagtaatcaacagccctacccccagtttatggcaacggtagtgtacaaagtcttccagacacttcactccaccgggcagtcaagcatggtcagggactgggtgatgctgagtctgtcaaacttcactcagcgggcaccagtggccatggctacatggtctctcagctgtttctttgtatcagcatcaaccagcccctgggtggctgccattctccctcacgtgatttcaaggatgggcaaacttgaacaagtggacgttaacctgttttgtctggtggctactgatttttatcggcaccagatagaggaagagctggatcggcgtgctttccagtcagttcttgaggtcgtcgccgcgccaggatcaccgtaccacaggttgctcacatgcttgcgtaacgtgcataaagtaaccacgtgttag

SEQ ID NO: 120234 - DNA, 3114 bp, Artificial Sequence
  Description of Artificial Sequence: Synthetic coding sequence
atggaccgcatggcgagcagtatgaagcaggtccccaaccctctccccaaggtcctaagccggcgcggagtgggggccgggctcgaggccgccgagcgggaatcatttgaaagaacccaaaccgttagcataaataaagccattaatacacaggaagtggcagtcaaagagaagcacgcccggacatgtatcctagggacgcatcatgaaaaaggggctcagacattttggtcggtcgtcaatagactgcctttgtcatcgaacgctgtgctgtgctggaagttctgccacgtgttccataagctactgcgtgacggccatccaaacgttctgaaggactctctgcgttataggaacgagttgagcgacatgtcgcgtatgtggggccatttgtccgaagggtatggccagctgtgcagcatatacctgaaacttctgaggacaaaaatggagtaccacacaaagaatcctaggttccctgggaatctacagatgtcggacagacaactggacgaagccggcgagagcgacgtgaacaacttttttcagctaactgtggagatgtttgactatctggaatgcgagcttaatctctttcagacggtcttcaattcactcgatatgagcagaagcgtgtctgtgaccgcagccgggcagtgccgtctcgcaccgctcattcaggtgattcttgactgcagtcacctatacgactacactgtcaaactgcttttcaagcttcatagctgcctgccagccgataccctgcaggggcatagagatcgtttcatggagcagtttacaaagttaaaggatttgttttaccgttcttccaatttacagtactttaagcgccttatccagataccccaactgcctgagaacccaccaaacttcctgcgtgcaagtgcgctgagtgaacatatctcaccggtggtcgtgattccggctgaggcctcttctcctgattccgaacccgtgctagaaaaagacgacctgatggacatggacgctagtcagcagaatctgttcgataataagtttgacgatattttcggttcctctttttcaagtgatccattcaatttcaattctcagaacggcgtcaacaaagacgagaaagatcacctgatcgaacggctttacagagaaatctccggcttaaaggcgcagcttgaaaacatgaagaccgagtcccaacgggtggtgctgcagctgaaagggcacgtgtccgagcttgaggcagatttagctgagcagcagcacctgagacaacaggcagctgatgactgcgagttcttgagggccgagctggacgagcttcgacgtcagcgcgaggatacagagaaggctcagaggtcactttccgagatcgaaagaaaagctcaagctaacgagcagcggtactccaagctgaaagaaaaatacagcgaactagtccagaatcatgcagacctgctgagaaaaaacgccgaagtgactaaacaggtttccatggcgcggcaagcgcaggtcgacctcgagcgtgagaaaaaggagctggaggacagtctcgagaggatctctgaccaggggcagcgaaagacacaggaacagctcgaggttctcgaaagccttaagcaggagttggctacatcccagcgagagctccaggtgttgcagggaagtctggagacatcagctcagagcgaagcgaactgggctgccgaatttgccgagctggaaaaagaaagggattccttagttagcggagccgctcaccgggaggaagagctttctgcccttcgtaaagagctgcaagatacacagctcaagttagcgagcaccgaagaaagcatgtgccagctagctaaagaccagaggaaaatgctcctggttggctcccggaaggccgccgagcaagtgatccaagacgccttaaaccagctggaagagccaccacttataagctgtgctggatcagccgaccacctactctctactgtaactagtattagctcctgtatagaacagcttgaaaaatcctggagccagtatctggcatgtccagaagatattagcggtttgctgcactcaattacgttgctggctcatctgacctccgacgcgatagcccacggagctactacctgtctacgtgcccctccagagcccgccgacagcctgaccgaggcgtgcaagcagtatggtcgggagaccctggcctatctcgccagcctggaagaggagggctcccttgagaatgccgattccaccgccatgcggaactgtctgtctaaaattaaggccatcggggaggagctcttgcctcgagggctggacataaagcaggaagagctgggtgacttggtggacaaagaaatggccgccacatcggccgcaattgaaaccgccacagctcgcatcgaggaaatgctgtccaagtcccgagccggtgataccggtgttaaactcgaggtgaacgagagaatccttggctgctgcacgtccctcatgcaggctatccaagtcttgattgtcgcttccaaagatctccaaagagagatcgtagaatccggccgtggcaccgcttctcccaaggaattctatgccaaaaatagccggtggaccgaggggttgatttctgcttccaaagcggtgggctggggggccactgtcatggtggacgctgccgacttggtagtgcaaggaaggggaaaattcgaggaattgatggtctgcagccacgagattgctgccagcacagcccagcttgtggccgccagcaaagtgaaagcagataaagattcccctaacttggctcaactccagcaggcctcccggggcgtgaaccaagccacagcaggcgtcgtagcctccaccattagcggaaaatcccagattgaggagaccgacaacatggatttctctagtatgacattgacacagattaaaaggcaggagatggatagtcaagtccgggttttggagctcgaaaacgagcttcagaaagaaaggcaaaagctgggcgaactgagaaaaaaacactatgagttggcgggtgtggctgagggatgggaagaagggacagaggcaagtccaccaacgctgcaggaggtagtgaccgaaaaggagtag

SEQ ID NO: 120235 - DNA, 2961 bp, Artificial Sequence
  Description of Artificial Sequence: Synthetic coding sequence
atggataggatggcctcatctatgaagcaggtccctaatcccctgcctaaagtgttgtcccggcggggtgtgggggctggacttgaagccgccgaacgcgagagcttcgagaggacacaaaccgtttcaatcaacaaagccatcaatacacaagaggttgcggtgaaagagaagcacgctcgcacctgcatcctgggaacccaccatgagaaaggcgcccaaactttttggagcgtagtcaacaggctgccacttagctctaatgccgttctgtgttggaagttttgtcatgtcttccataagttgctcagagacggtcatccaaacgtactgaaagatagtctgagataccgtaatgagcttagtgatatgtctaggatgtggggacacctatccgaaggatacggccagctctgtagcatttatctcaagttgcttcgcacgaagatggagtatcatacaaaaaacccaagatttcctggtaacttacaaatgagtgatcgccagctggatgaagcaggggagagcgacgtcaacaatttcttccaacttacagttgagatgttcgattacctcgaatgcgagttaaacttattccagacagtctttaatagcctcgacatgtctagaagtgtgtccgtcactgctgccgggcagtgtcggttggccccactgattcaggtgatactggattgctctcacctctatgactacactgttaaattactattcaaattgcacagctgtttaccggcggacacactccagggtcacagagacagatttatggagcagtttacgaaactgaaggatttgttttaccgctctagcaatttgcagtacttcaagcggctaatccagatcccacaattaccagagaacccccccaattttcttagagcctcggccctcagcgagcacatttctccagtcgtcgtgattccagccgaggcttcaagccctgacagcgaacctgtgttggagaaggatgatctgatggacatggacgcctctcagcagaacctctttgataataagtttgacgacatcttcgggtcttctttttcctcagaccccttcaactttaatagccagaacggtgtaaacaaggacgaaaaggatcatttaattgagagactctatcgtgagatttcaggtctgaaggcacagctggaaaacatgaaaactgagagccagcgcgtagtgttacaactgaaagggcatgtgtcagaactggaggccgacctagccgagcagcagcatcttcgccagcaggctgcagacgactgtgagttcctgcgcgccgagctggacgaattgcggcgccagcgagaagatactgaaaaggctcagaggtctctctctgagatagagcgcaaagcacaggccaacgagcagcgttattctaaactgaaagagaaatatagtgaattagtgcagaatcatgctgacctcctcagaaagaacgctgaggtaacgaagcaggtgtccatggctagacaggcacaggtggaccttgaacgggaaaagaaggagttggaagacagtctcgaacggattagcgaccaagggcagcgcaagacgcaggaacaactcgaagttctagaatcactcaagcaggagctggctacatctcagagggaactacaggtgctgcaaggttccctggagacctccgcacagagtgaagcgaactgggctgccgaattcgccgagctggagaaagaacgggatagtctcgtaagcggagcagctcaccgagaagaggaactgtccgcccttagaaaagaactgcaggacacccaattgaagctagcttctactgaggagagcatgtgtcagttggcgaaggatcaaaggaagatgctccttgtaggaagcaggaaagctgcggagcaagttattcaagacgcactcaatcagctggaagaacccccactaatttcctgcgccgggtctgcagaccaccttctgtccacagtgacatctatatcttcatgcattgagcagctcgaaaagtcctggagccaatatctcgcctgccctgaagacatttccggactgctgcatagcattacgcttcttgcccatctgacctcagatgctattgctcacggcgccacgacttgcctgcgcgccccgcctgagcctgctgattctctcacagaagcatgcaagcagtatgggcgtgaaaccttagcatatcttgctagtcttgaggaggaaggaagtttggagaatgccgattccaccgctatgcgcaactgtctgtcaaagatcaaggctatcggtgaggaactactgccgcgggggcttgacatcaaacaggaagagttgggtgacctggtcgataaggaaatggctgcgaccagcgccgccattgagacagcgacggcccgtatagaaggcaccgctagccccaaggaattctacgctaagaacagcagatggacagaggggctcatctctgcctctaaagccgtgggttggggcgctactgtcatggtagacgctgccgacctggtggtacaaggtcgaggcaagttcgaggaactgatggtgtgttcccacgaaatcgccgcttctaccgctcagcttgtagccgcttctaaagtgaaggccgataaggatagcccaaaccttgctcagctgcagcaagcatcccgcggcgtaaaccaggccactgctggcgttgtggcctcgacaatttccgggaagtcacagatagaggaaacagacaacatggatttctcgtccatgacactgacccagatcaagcgacaagaaatggactcgcaagtgagagtactggaactagaaaacgaactgcagaaagaacgccagaaattaggcgaattgcgaaagaaacattacgagcttgccggcgtggccgaaggctgggaagaggggactgaggcctcccctccaacactgcaggaggtggttaccgagaaagagtag

SEQ ID NO: 120236 - DNA, 3207 bp, Artificial Sequence
  Description of Artificial Sequence: Synthetic coding sequence
atgaattccatcaagaacgtgcccgcacgtgtcttgagtcgacgcccaggccattccctggaggcggagagagagcagttcgacaagacccaggccatctctattagtaaggccattaatacccaagaggcccctgtgaaagaaaagcatgcaaggcgcataatcttaggcacccaccacgaaaagggtgccttcaccttttggagttatgcaatcggactgcccctacccagcagttctatcttgtcatggaaattttgccacgtcctgcataaagtgctgagagacggtcatcctaacgtactgcacgactgccagaggtatcggtctaacatcagggagattggagacctgtggggtcatctccacgacaggtacggccagctggtgaatgtgtacaccaaactcctgctaaccaagatttcttttcacctcaaacacccacagttcccagccggcctggaggtgacagacgaagtgctcgagaaagcagccggaaccgatgtgaacaacatttttcagttaacggtagagatgtttgactacatggattgtgagttgaagctgtccgagagtgtttttaggcaactaaataccgccatcgctgtgtcacagatgagctctggccagtgtcggctcgcacctctaatccaggtgattcaagactgctcacacctttatcattataccgtgaagctgttattcaagttacacagctgcctgcctgcagataccctgcaggggcacagggacaggttccacgagcagtttcactcccttaggaatttcttcagacgggcctcagatatgctgtatttcaaaaggcttatccagataccccggctgccagagggtcccccgaacttcctccgggcctcagccttggctgaacatattaagcctgtagtggtgatccccgaggaggctcctgaggatgaggaacccgagaacctcatcgagatctccaccggaccacctgccggtgagcccgtagtcgtagctgatctattcgaccagacattcggacctcccaatggctccgtgaaggatgacagagacctgcagatcgagtccttgaagcgagaggtcgagatgttgcggtccgagctggagaaaatcaaactcgaggcccaacggtacattgcccagttgaagtcccaggttaatgcacttgaaggggagctggaggagcagcggaagcaaaagcaaaaggccctggtggacaacgaacagttgcgccatgaactggcgcagctgagggcagcccagctggaaggggagaggtcccagggcctccgggaggaggcggaacgaaaggccagtgctacagaagcccggtacaacaaactgaaggagaagcatagcgagctcgtgcacgtgcacgccgagctccttcggaaaaacgctgataccgccaagcaactaaccgttacccagcagtctcaggaggaggtggcacgcgtcaaggaacaactcgctttccaagtcgaacaggtgaaaagagaatcagaactaaagctggaagagaagtctgaccagctggaaaagcttaagcgcgagcttgaggcaaaagccggtgagctggctcgggcacaagaggcactgtctcacacagagcagagcaaatctgagctgtccagcaggctggacaccctatccgccgagaaggatgcactcagcggcgccgtacgccagcgcgaggcagacctgctcgctgcccagagcctggttcgcgagaccgaggccgctttgtccagagagcagcaacggagctctcaggagcagggcgaactacaggggcgccttgcggagcgcgaaagccaggaacagggacttcggcaaagacttcttgatgagcagttcgcagtgctgcgcggcgcagccgcagaggccgcgggaattctgcaggatgccgtgtctaaacttgacgaccctcttcatctgaggtgtaccagctcccccgattatttggtgagtagagctcaggaagcattggacgctgtcagcaccctggaggagggccacgcccagtacttgacttctctggccgacgcctctgcgttagtggcagcgcttacaaggttcagccatttggcagccgacacaatcattaacggtggcgctacttctcatctcgcccccactgaccctgccgacagactgatcgacacctgtcgggagtgcggcgcaagagctctggaactgatggggcagctccaagaccaacaagccctgcgtcacatgcaggcatcactggtgagaactccattgcaaggaattctgcaattgggtcaggaactcaagcccaaatccctcgatgtgcgccaggaagaactgggagcggttgtggacaaagaaatggccgccaccagtgcagcaatagaggatgccgtgcggcgaatcgaagatatgatgaaccaagctcgtcacgccagctccggagttaagctggaagtcaacgagagaatattaaactcttgtactgaccttatgaaggccatccgactactcgtgaccacgtccacgtctctgcagaaggaaattgtggaaagtggcagaggagccgccacgcaacaagaattctacgcgaagaattcaaggtggacagaagggctcataagtgcaagcaaggccgtcggctggggagctactcagcttgttgaggctgccgacaaggtggtactccatactggaaagtacgaggagctgatcgtctgttctcacgaaattgcggcatcaaccgctcaactggttgctgcttctaaagtgaaagccaataagcattctccacacctcagcaggttacaggagtgttcacgcaccgttaacgagcgcgcagctaatgtggtggcttccaccaagagtggccaagagcagatagaagacagagacacaatggatttttcagggctatccctgatcaagctgaagaagcaagagatggagacacaagtcagggtgctcgagctggaaaagaccctcgaggcagagcgtatgcgattaggcgagctgaggaagcagcactatgtgctggctggggcttcaggatctccaggcgaagaggtggcaattcgtccttcaaccgctcccagaagcgttaccaccaagaagccacctttagctcagaagcctagtgtggccccccgacaggaccatcagttagataaaaaggatgggatctacccggcccagctagttaactattag

SEQ ID NO: 120237 - DNA, 753 bp, Artificial Sequence
  Description of Artificial Sequence: Synthetic coding sequence
atggcacacgtgggcaccagtagggttgggtccgttctgtcaatgtcactaagcatccacctcctcgtgcccaccatgaccaaaggcgagactggcaagccagggcaccatgaagccccaaggacacttcaggctttcccttggacatgggctcgcgcatctcccggtgttagcgtggatatgagtgccggactaccacaatcactgctgtgctggcccggcgcaccactgctgcctacgccaccactgcccagtgcgacatatgtgggacatagcttgggtctgccgcgagcaggctcaagcgtcggcccatggttctccggtcgctgggtgggtggagcactcgtgcagtggcccctgggcggagggggcccgggatctgtggcagccggcctcggaggcccactcgtcagatggctgctgggtggcggagcactggtaaggtggccgctgggaggaggcgggccagggtctgtagcagccgggtgggggggcccatggttcgggggaaggtgggttggagggcccccaggatccgttgcagcgggatgggggggacctgtcagatggccactcggtggagggggccccggttctgtcgcgactggatggggcggtccatggtttggaggccgttgggtgggaggcccccctggaagcgtggctgccgggtgcggaggagcccttgtgcagtggccattgggtggaggaagcttacatagtatcccctcattccccagagcgtggcggtag

SEQ ID NO: 120238 - DNA, 2016 bp, Artificial Sequence
  Description of Artificial Sequence: Synthetic coding sequence
atgcgcccaaagcggttgggaagatgctgcgcaggttctcgtttaggccccggggacccagccgccctgacatgtgcccccagccccagcgcatccccagcacctgagccaagtgcccagccacaggcacgaggcaccgggcagagagtggggtcacgagccacctcgggctcacagttcttatcagaggcccgcaccggcgcccgacccgcctcagaagcgggggccaaagcaggagctaggaggccatcggccttctcggcaattcaaggcgacgtgagatctatgcctgataatagcgatgcaccatggacacgtttcgtgtttcagggcccatttggctcacgtgcaaccgggcgtggcacaggcaaagcagcaggcatttggaagaccccagccgcttatgtggggagacgtcccggagtctcagggccagagagagcggcatttatcagggagctggaagaggcactgtgccctaacttaccacctcccgtgaaaaagatcactcaggaggacgtcaaggtaatgctgtaccttctcgaagagctgctgccccccgtgtgggaatccgtaacttacggaatggtactacaaagggagcgggatttgaatactgccgcccgtattggacagtcactggttaagcagaatagcgtcctgatggaggagaatagtaaattggaagccctcttggggtcagcaaaagaggagatcctctatctgagacaccaggtcaatttgagggatgagctgcttcagctgtattccgactcagatgaggaggatgaggatgaagaggaagaagaagaggaaaaggaagccgaagaggaacaggaagaggaagaagctgaggaagatttgcagtgtgcccatccttgtgacgccccaaagctaataagtcaggaggcactgcttcatcaacaccactgtccccagttagaggccctccaggagaagctacggctcctggaagaggaaaatcaccaactcagagaggaagcaagccagctggacacactagaggacgaggagcagatgctaatcttagagtgtgtggaacaatttagtgaggctagtcagcaaatggctgagttatctgaggtgctggtcctgagattggaaaactatgagcggcagcagcaagaagtcgcccgactgcaagcccaggtgctaaagcttcagcagagatgtagaatgtacggagctgaaaccgaaaaactccagaaacagttggcctcagagaaggaaatccaaatgcagcttcaggaggagagtgtatgggtcgggtctcagctacaggatctgagagagaagtatatggattgtgggggcatgttaatagagatgcaagaagaagtcaagaccctgcgccagcagccaccagtaagcacaggatcagcaacgcactacccatacagcgtgcccctcgagacattgcctggcttccaggagactctggccgaggaactgcggacaagcctaaggcgcatgatttcagacccagtgtattttatggagaggaattatgagatgccacgtggagacactagttcccttaggtatgacttcaggtactctgaagacagagagcaagtgcggggctttgaagctgaagaagggctgatgctcgcggctgatattatgcggggcgaagattttacaccagcagaagagttcgtgccccaagaagagctgggagccgctaaaaaggtgcctgcagaggaaggagttatggaagaggcagaactggtaagcgaggaaacagaagggtgggaggaggtcgaattggagctggatgaagcaacacggatgaatgtggttacttccgcgctggaggcgtccggactgggacctagtcatctggatatgaattatgttttgcagcagctcgccaattggcaagacgcccactaccgacgtcagttgcggtggaagatgctgcagaagggcgaatgcccccatggtgctctgcctgctgccagcagaacatcctgcaggtccagttgtcggtag

SEQ ID NO: 120239 - DNA, 1809 bp, Artificial Sequence
  Description of Artificial Sequence: Synthetic coding sequence
atgcgccctaagagactggggagatgctgtgccggttcccgccttggtcctggagatcccgcggcactgacctgcgcccccagcccttcagctagccccgccccggagccatctgcgcaacctcaggccaggggaacaggacagagggtgggatcacgtgcaacctcgggatctcagttcctatccgaggccagaaccggagccagacctgcaagtgaagccggcgccaaagccggagctaggcgcccctccgcttttagcgccatacagggcgacgttcgttcgatgccagataactccgatgctccctggacccgattcgtctttcagggaccttttggaagcagagctactggtcgtggcaccgggaaggccgccgggatctggaagacaccggccgcttatgtaggcagacgtcctggggtgagtggccccgagagggctgctttcatacgcgagctagaggaagcactgtgtcctaacttgcccccccccgttaaaaagattacgcaggaggatgtgaaggttatgctctacctgctggaggaggtgtgcaccgctttcttgattcagctcctaccccctgtctgggagtccgtcacatatgggatggtactgcagagggaacgggacttgaacactgccgcccggattggccagagcctggtcaagcagaacagtgtactcatggaagagaatagcaaactggaagcactcttagggtccgccaaagaggagatcctgtacctccgccaccaggttaacttgagggatgaactcctgcaactgtactcagatagcgacgaagaggatgaggatgaggaagaagaggaggaggaaaaagaggcagaggaggagcaggaagaagaggaggccgaggaggatctccaatgcgcacacccctgcgatgcccccaagctgatcagtcaagaggccctgctacatcagcatcactgtccacagctggaggcccttcaggaaaagcttcgcttgctggaggaggagaatcaccagctccgggaagaagcatcccagcttgacacactggaagacgaggagcagatgcttattctggagtgcgtggagcagttctcagaagcatcccaacagatggccgaactgagcgaagtactggttttaagacttgaaaattatgagcggcagcagcaagaggtggctagattacaggctcaggtgttaaaactgcagcagcgctgccgtatggaaacgctcccaggatttcaggagaccctggcagaagagctccgaaccagcctgagaagaatgatcagtgatcccgtctatttcatggaaagaaactatgagatgcctaggggggatactagtagcttgaggtacgatttccggtattccgaagaccgcgagcaggtgcggggttttgaagctgaggagggtttgatgctggcagctgatattatgcgtggtgaggacttcacaccagccgaggagtttgtacctcaggaggaactcggtgcagctaagaaggtgcctgcagaagagggagtcatggaagaagcagagcttgtaagtgaggagaccgaggggtgggaagaagtagaattggagctggatgaggcaactcggatgaatgtggtcacctctgccctggaggcgagtggcttgggtccttctcacctggacatgaactacgttcttcaacagctggctaattggcaagacgctcactatcggcgccagctgcgctggaagatgctgcagaagggtgaatgtcctcatggcgccctaccggcggcaagtcgcacctcatgccgcagctcttgcagatag

SEQ ID NO: 120240 - DNA, 1860 bp, Artificial Sequence
  Description of Artificial Sequence: Synthetic coding sequence
atgcgtccaaaacgactgggtagatgctgcgctgggtcccggctgggacctggcgaccctgccgccttgacatgtgcgccgtcaccatcagcttcaccagcccctgaaccatctgcccagccccaagcgcgcggcaccggccaaagagtggggtccagagcaaccagtggctcccaattcttgtcggaggctagaacaggcgcccgccccgcctctgaggcaggtgccaaggcaggagctagacggccatctgccttcagcgctatccagggggatgtgagatcaatgccagataactccgacgcaccctggactcgctttgtgttccaggggcccttcgggtctcgcgctacaggacgggggaccgggaaggctgctggtatctggaagactcctgccgcgtatgtcgggagaagacctggtgtgagcgggcccgaacgtgccgcattcattagagagctagaagaagccttatgcccaaatctcccaccgcccgtcaagaagatcacacaagaggatgttaaagtgatgctctatttgctggaagagctgttgccgcccgtgtgggaatccgttacatatggcatggtgctacaaagagaaagggacctcaacacagccgcacgcatcggccagtccctggtcaagcagaactcagttctgatggaggaaaatagcaagctggaagctctgctaggatctgccaaagaggaaattctgtacttaagacaccaggtgaatctgagagatgaattgctgcagctctactccgactctgatgaagaagatgaggacgaagaagaggaagaagaagaaaaggaagcagaggaggaacaagaagaggaggaggctgaggaggatctgcagtgcgcccacccatgcgatgctcccaaattaatctctcaggaggctctgctgcatcagcatcattgccctcagctggaagccctacaggagaaactccgtctgctggaagaagaaaaccatcagctacgggaagaggcttcacagctggacaccctggaagacgaggagcaaatgctgatactggagtgcgtggagcagttctctgaagcctctcagcagatggctgagcttagcgaggtgctggttctgcgtttggagaattacgaaagacagcagcaagaggtggccagattacaggcacaggtgctaaagctgcagcagcggtgtcgaatgtacggggccgaaacagagaagctgcagaaacagttagcctcagagaaggaaatccagatgcagctacaggaggaggaaaccctgcccggttttcaggagacactggccgaggagcttcggacgtcactccggaggatgatcagcgaccccgtttacttcatggaaagaaactacgaaatgcccaggggcgacacaagttccttgaggtatgatttcaggtattcggaagacagagaacaggtgagggggtttgaagccgaggagggcctgatgctggccgccgatattatgcgaggggaagatttcacacccgccgaggagtttgtgcctcaggaggagctcggagcagctaagaaagtgcctgccgaagaaggtgttatggaggaggccgagctcgtatccgaagagaccgagggatgggaagaggtggaactggaacttgacgaagccactaggatgaacgtggtaactagcgcgctggaggcatcaggcctaggtccttctcatctggacatgaactacgtgttacaacaattggccaattggcaggatgctcattaccgacgtcagctgcgatggaagatgcttcagaagggtgaatgtccccacggcgccctaccggcagcgtcccgaacttcttgtagaagctcctgcaggtag

SEQ ID NO: 120241 - DNA, 1785 bp, Artificial Sequence
  Description of Artificial Sequence: Synthetic coding sequence
atgcgccctaaacgtctcggaaggtgctgcgctggaagtcgactcggcccgggcgacccggccgccttaacatgtgccccatccccatccgcatcccccgccccggagccctccgctcagccccaagcccgggggactgggcaacgagttgggtcccgagcgacctcaggctcccagttcctgagtgaagcccgcaccggggctagacccgcgtcagaagcgggagccaaggccggcgctcggcggccctcggcattctcagcaatccaaggcgacgtgcggagcatgcccgacaacagtgatgccccctggactagattcgtgttccagggccccttcggaagccgagcaacaggcaggggcacgggaaaagctgcggggatctggaagaccccagctgcttacgtcggacgacgcccaggggtctccggcccagaacgggccgcgttcattcgggagctcgaagaggccctgtgtccaaacctacccccccctgttaaaaagattactcaggaggatgtgaaagtaatgctctacttgctcgaggaactgctgccacctgtctgggagtctgtcacatacggcatggtgctacagcgcgagagagacctcaataccgcggctaggatcgggcagagcctggtgaagcaaaatagcgtgttgatggaggaaaactccaagctcgaggctttactcggcagcgcaaaggaagagatcctgtaccttagacatcaggtgaacctgcgcgacgagctcttgcagctttacagcgattctgatgaggaggacgaggatgaggaagaggaggaagaggagaaggaagcagaggaggagcaagaagaagaggaggcggaagaggacttacagtgcgctcatccgtgcgatgctccaaagctgataagtcaagaggcattactgcaccagcaccactgtccacagctggaggccctgcaagagaaacttaggctgcttgaggaggagaaccaccaactgcgggaagaggcaagccagctggatactctggaagatgaggagcagatgctcattctagagtgtgtcgagcagttctcagaggcaagtcagcagatggctgagctctccgaagtgctggtgttacgacttgaaaactacgaacggcagcagcaggaagtcgcccgtttgcaggctcaggtgttgaagcttcagcagaggtgccggatggaaacgctgccaggctttcaagaaaccctcgcggaggagctgaggacctccctccgcagaatgatttccgatccagtctatttcatggaaaggaattatgaaatgccccggggggatactagctccctgcggtatgacttcaggtactcggaggatagagaacaagtgagggggtttgaagccgaagagggattgatgctagctgctgacatcatgaggggcgaggactttacacctgcagaggagttcgtccctcaagaagagctgggggctgcaaagaaggtgccagcagaggaaggcgtcatggaagaagctgagctggtgtccgaagaaaccgaagggtgggaggaggtagaacttgaactggatgaggccaccagaatgaatgttgtcacatcagcactggaggccagcggactggggccctcccacttggatatgaattacgtcttacaacaactggcgaactggcaggatgcgcattaccgtcgccagttgcgttggaagatgctgcagaagggcgagtgtcctcacggagccctgccagccgcgagccgaacatcctgtcggtcctcatgccggtag

SEQ ID NO: 120242 - DNA, 837 bp, Artificial Sequence
  Description of Artificial Sequence: Synthetic coding sequence
atgaaatttcgcgctaaaataaccggtaaggggtgcttggaactttttattcacgtgagcggaacagttgctcgcctggccaaggtttgtgtgctgagagtgcgacccgactccctatgctttggacctgcaggctctggggggctgcacgaggccaggctctggtgcgaagtcaggcagggagcttttcagcaatttcggatggaaggcgtctcagaagatctcgatgagatccacttggagttgactgccgagcacctcagccgcgctgcaagatcggcagctggggccagctctctcaaactccaactcactcacaagcgaagaccttctttgaccgtggctgtagagcttgtcagttcactgggaagggcccgctccgtggtgcacgatttgcctgtgcgggttctgccacgacgagtttggcgtgattgtctacctccttctctgagagcttccgacgcatcaatcaggctgcctaggtggcggactctgcgcagcatcgtagagagaatggccaatgtcggatctcatgtgcttgtggaagccaatctgtccggccgtatgaccctgtcaattgaaaccgaggtggtgagcattcagtcatatttcaagaatctaggaaatcctcctcagtccgctgtgggggtcccagagaatcgggatctcgagtcaatggtccaagtgcgagtggacaacaggaagcttctgcagttccttgaaggacaacaaattcacccaaccaccgcgctgtgtaatatctgggataacacactgctccagctggtgctggtccaggaggatgtaagcctgcagtattttattccggcgttgtag

SEQ ID NO: 120243 - DNA, 1065 bp, Artificial Sequence
  Description of Artificial Sequence: Synthetic coding sequence
atgaaatctctgctgctgctggtgctcatcagtatttgctgggccgatcatctttccgataattacaccctggaccatgaccgcgcaatccacatccaggccgagaacggacctcacctccttgtagaggcagaacaggcgaaggtgttttcacaccgcggcggtaatgtgacattgccgtgtaaattttaccgtgaccctactgcctttggtagtggaatacataagatccgcataaaatggaccaagctaacatcggactatctgaaggaggtggatgtctttgtctctatgggatatcacaagaagacctacggggggtatcaaggcagagtcttcttaaagggtggctcagatagcgacgcctctctggtgattacggacttaactctagaggactatggcagatacaagtgcgaggtaattgaaggtttggaggacgacaccgtggtagtggccctggatctacagggagtggtattcccatactttccaaggctcggcaggtacaatctcaattttcatgaggctcagcaagcttgtctcgaccaggacgcagtgatcgcgagctttgatcagctatatgacgcgtggcgtggtggtctggattggtgtaatgccggatggctcagtgatgggagcgtgcaataccccattaccaaacctagagagccctgcggcggtcaaaacacggtgccaggggtgagaaactacggcttttgggacaaggacaaaagtagatacgatgtcttttgttttacatctaatttcaacgggagattctattacctgattcaccccaccaagctaacctacgacgaagctgttcaggcctgcctcaacgacggggcacagatcgcaaaggtggggcagatctttgcagcctggaagatactagggtacgatcgttgtgatgcgggctggctcgccgatgggtcagtgagatatcccatcagccggcctaggagacgatgttctccaactgaggccgcagtgcggttcgttgggttcccagataagaagcataagctgtatggagtgtactgctttagagcttacaactag

SEQ ID NO: 120244 - DNA, 549 bp, Artificial Sequence
  Description of Artificial Sequence: Synthetic coding sequence
atgaagagccttttactactcgttctgattagcatctgctgggccgatcatctgtccgataattacacactggatcatgatcgggcgatccacattcaagagaatggtccccatctgctggtagaggccgagcaggctaaggtattctcacacaggggaggcaacgtgacactgccctgtaaattttatcgggatcctaccgcatttggtagtggtattcataaaattaggatcaagtggacgaagctgacatccgattacctgaaagaggtggacgtctttgtgtccatggggtatcacaaaaagacctatggcggttaccagggtcgggtgttcctcaaggggggatccgatagtgacgccagcctggtgattaccgacctgaccctggaagactatggccggtataaatgtgaagtgatcgagggactggaggatgatactgtggtggtggctctggatctgcagggcgtggtgttcccttacttccctagactgggaaggtacaacctcaacttccacgaagcacagcaggcctgtctagattag

SEQ ID NO: 120245 - DNA, 477 bp, Artificial Sequence
  Description of Artificial Sequence: Synthetic coding sequence
atgaagtccttgctgctgctagtattgatctccatctgttgggccgaccatctctccgacaattatactcttgaccacgaccgcgcaatccatatccaggctgagaatggaccacatttgctcgtcgaggccgagcaggccaaagtgttttcgcaccgtggtggcaacgttaccctgccttgcaagttttatcgcgacccaaccgcatttggctccggaatacataaaataaggatcaaatggactaaactgacttccgactatttgaaagaggtcgatgtgttcgtttccatgggctatcacaaaaagacgtatggagggtatcagggacgggttttcctgaaagggggctccgacagcgacgcttctctcgtgattacagatctgacattggaagattatggtaggtacaagtgcgaagtgatcgaaggattagaggatgacactgtggtggtcgctctggacttgcagggctag

SEQ ID NO: 120246 - DNA, 600 bp, Artificial Sequence
  Description of Artificial Sequence: Synthetic coding sequence
atgaaaagtctgctcttactggtactgatcagtatttgctgggctgatcacttgtctgacaactacaccctggaccatgatcgggcaattcacatccaggcggaaaacgggcctcatctgctggtggaggctgagcaggcgaaggtgttctcacaccgcgggggcaatgtgactcttccctgcaagttctatcgggacccaaccgcttttggcagcggcatccacaagatcaggattaaatggacgaagctgacttctgattacctgaaggaagtggacgtgttcgtgagcatgggttatcataagaagacatatggcgggtaccaggggcgtgtctttcttaaaggaggatccgattcagatgcttcactggtaatcaccgacctaacactagaggattacggtaggtataagtgcgaggttattgaggggctagaagatgacactgtggtggtcgccttagacctccagggggttgttttcccgtattttccaagactgggacggtacaatctgaactttcatgaagcccagcaggcgtgccttgatcaagatgccgtgatcgctagttttgatcagctttatgatgcctggcgatag

SEQ ID NO: 120247 - DNA, 777 bp, Artificial Sequence
  Description of Artificial Sequence: Synthetic coding sequence
atgaaatctctgttattattggttctcatatcaatatgctgggctgatcacctgtctgacaactatacactggatcacgaccgcgcaattcacattcaggcagagaacggcccacatcttctagtagaggctgaacaggctaaggtcttttcccaccgtggaggcaatgtaactttaccctgcaagttttatcgggaccccacggctttcggttctggtattcataagatcagaatcaaatggactaaattgactagtgattatctcaaagaagtagatgtgtttgtgtcaatggggtatcataaaaagacatatggcgggtaccaggggcgggtcttcctcaaaggtgggtctgactctgacgcctccctggttattaccgacctaaccttggaggactatggcaggtacaaatgtgaggtgatcgaaggcctggaagatgataccgtggtggtggccctggacctgcagggtgtggtctttccctattttcccaggctgggaagatacaacctaaactttcacgaggcccaacaggcctgcttggaccaagatgccgtgatcgccagcttcgaccagctgtacgacgcatggcgcggaggattggattggtgtaatgcagggtggctgagtgatggctcagtgcagtacccgatcacaaagccccgagagccctgtgggggccagaacacggtaccaggagtgaggaactacggattttgggataaagacaaaagccggtatgatgtgttctgctttacgagtaattttaactag

SEQ ID NO: 120248 - DNA, 462 bp, Artificial Sequence
  Description of Artificial Sequence: Synthetic coding sequence
atgaaatcactgttgctgctggtcctcatctccatctgttgggctgaccatctatcagacaattatacactggatcatgacagagctatacacattcaggcagaaaacggtccccacctccttgtggaggcagaacaggcaaaggtgttctcacaccggggcgggaacgtgacactgccgtgtaagttttatagggaccccaccgcattcggttctggcatccataagatcagaattaagtggaccaaactaaccagcgactatttgaaggaggttgacgttttcgtgtctatgggctaccataagaagacgtacggaggctaccaggggagagtgtttttaaagggaggctctgatagcgacgccagcctcgtgattacagatctcactctggaggattatgggaggtacaagtgcgaggtgatagaggggctggaagatgacacagtcgtggtcgcctag

SEQ ID NO: 120249 - DNA, 1683 bp, Artificial Sequence
  Description of Artificial Sequence: Synthetic coding sequence
atgtttgcccggatgtccgatctgcatgtgcttctcctgatggccttggttggaaaaaccgcttgtggcttctccctgatgtccttgctggagagcttggatccggactggacccccgatcagtatgattacagctatgaggattacaaccaggaagagaatactagtagcaccctgactcatgccgagaatcccgattggtactacactgaggaccaggcagatccttgtcaacccaatccttgcgaacatggcggagactgcctggtacacggttcaaccttcacctgtagttgcctggctccttttagcggtaataagtgtcagaaagtccagaacacttgtaaggataacccttgtggcaggggtcaatgtctgattacccaatcaccaccttattacaggtgcgtatgtaaacatccatacaccggtccgtcctgctcgcaggtagtccccgtgtgccggccaaacccttgccagaacggggctacctgcagccgccacaaaaggcgaagtaaatttacctgcgcgtgccccgaccaatttaagggcaaattttgcgagatcggatcagatgactgttatgtgggtgatggctatagttacaggggcaagatgaatcggactgtaaatcagcacgcatgcctgtactggaactcacacctcctgttgcaggagaattacaatatgttcatggaggacgcggagactcacggcataggggagcacaatttttgccgaaatccagacgccgatgagaaaccctggtgctttattaaggtaacgaacgataaggtaaagtgggaatattgtgatgtcagcgcctgcagcgctcaggacgtcgcctaccctgaagaatcccccacggagcccagtaccaaacttcccggattcgattcttgcggaaagacagagatcgcagagaggaagattaagcgtatttacggcggttttaaatcaactgccggtaagcatccttggcaggcttctttgcaaagctcattgcctcttaccatctcaatgccacagggccacttttgcggtggcgccctgatccacccttgctgggtgcttaccgccgcacactgtactgacatcaagacacggcacctcaaggttgtacttggcgatcaggatttgaaaaaggaggagttccacgagcagtctttcagagtggagaaaatcttcaaatacagccattataatgaaagggacgaaattccacacaatgatattgctctcctgaagctcaagcctgtggacggccattgcgccttagaaagtaaatacgttaagactgtgtgtctccccgatggcagcttcccctccggcagcgaatgccacatatccggctggggtgtcacggagaccggtaaaggttcgagacaattgctcgacgccaaggtaaagttaatagccaataccctttgcaattcacggcagctgtacgatcacatgattgatgattccatgatatgtgcaggcaacctgcaaaaacctgggcaagatacctgtcagggagactcaggcggcccgctgacttgtgagaaggatggcacttactacgtgtatgggattgtcagttggggtttagaatgtggaaaaaggcccggggtctatactcaggtcactaaattcctaaactggatcaaggcgaccatcaaatctgagtcagggttttag

SEQ ID NO: 120250 - DNA, 534 bp, Artificial Sequence
  Description of Artificial Sequence: Synthetic coding sequence
atggaggaaaatttcatctgtagtaggaagacgatggcactctcgtcaacttggattctgtcccccaaaaaaacaggtccactgacgtctatgataactgccaccaggatcatcatccgaaaacgaacccctgttgcccatcttcctactttgaggatccttacgggcacaactttacgaaccaagctgattcatgccagcccgacaccagtcaataccgtagggactgcttctagcatgggcgctcccagccatgctgcagcttggctactgagccttgggataagtgtgcggaagtgcaagatccgcgcccgcacaacgcacgtcgcaggcgctaatgtgtcacttcccagggttctgcccacaacggccgtaagtgtgaatactctaacacaggtgcccgcggccccaaagtggttcctctacgccgggcaaactccagcaaggatgggacttcccgctcccggtatttcgggtgacccaagttcgcctgtacctgtcccaacatcttcccgcggcaacagcgttaagtag

SEQ ID NO: 120251 - DNA, 843 bp, Artificial Sequence
  Description of Artificial Sequence: Synthetic coding sequence
atgtttgcgcggatgtccgacctgcatgtcctgctcctgatggctctggtcgggaaaaccgcatgtgggttcagcctgatgagtctgcttgagtcgctcgacccagactggacgccagaccagtatgactatagttatgaggattataatcaagaggagaacactagcagcacactcactcatgccgaaaacccggactggtactatacagaagaccaggctgatccgtgccagccaaacccctgcgagcatggcggcgactgcctggtgcatggctccaccttcacatgctcatgcctggcgccattttctggaaataagtgtcagaaagtacagaacacgtgtaaagacaatccctgcggacgggggcagtgtctgattacccagtccccaccgtattacaggtgtgtgtgcaaacatccatataccggcccatcatgttctcaggttgtgccggtctgcaggcctaatccctgccaaaatggtgcaacatgtagtcggcataaaagaagaagtaagtttacttgtgcatgtcctgatcagtttaagggcaagttttgcgagatagggagcgacgactgctatgttggcgatggctactcttaccgcggtaaaatgaatcgaacggtgaaccagcatgcttgcctttactggaactcacatttactgttacaggagaactataatatgtttatggaggacgctgagacacatgggattggggagcataacttctgccgtaaccccgatgccgatgaaaagccgtggtgtttcattaaggttaccaatgacaaggtcaagtgggaatactgcgacgttagtgcatgctctgcccaggcctag

SEQ ID NO: 120252 - DNA, 1605 bp, Artificial Sequence
  Description of Artificial Sequence: Synthetic coding sequence
atgagccttctcgaaagtctggatcctgattggacaccggatcagtatgactattcatacgaggactataaccaggaggagaacacaagcagcaccttgactcatgctgagaacccagattggtactacacggaggaccaagccgacccatgccagcctaacccctgtgagcatggaggcgattgcttggtgcacggatcaacgtttacttgtagttgccttgcaccattttccggcaacaagtgccagaaggtgcagaatacctgtaaggataatccatgtggtaggggtcagtgccttattacacagagtcccccctactatcggtgcgtgtgtaaacatccatacacgggcccttcctgtagccaggttgtcccagtttgtaggcccaatccctgccagaacggcgcaacctgcagccggcataaacgtcgcagtaagtttacctgtgcatgccctgatcagtttaaaggcaaattctgcgaaatcggcagcgatgactgctacgtgggggatggctatagttaccggggaaaaatgaaccgcaccgtgaaccagcatgcctgcctttattggaactctcacctcctccttcaggagaattataatatgttcatggaggacgcggagacccacggaattggagagcacaacttttgccggaaccctgatgccgacgaaaagccttggtgttttataaaggttactaacgataaggtcaaatgggaatactgcgatgtcagcgcatgttctgcgcaggacgtcgcctatcccgaagagtcacccaccgagccctcaacaaagcttcccggtttcgactcctgcgggaagaccgagatagcggagcgcaagatcaaacgcatttacggcggcttcaagtcaaccgctggaaaacacccttggcaggctagcctgcagtcaagcctgcccctcacaatctctatgccgcagggacatttctgcggtggagccctgatccatccctgctgggtgcttacagctgctcactgcactgatattaaaacccgccacctcaaggttgtgctgggagatcaggacctcaagaaggaggaatttcacgagcagagtttcagggtcgaaaaaattttcaagtattctcactataatgaacgggatgagatcccccacaacgatatcgcattactcaagctaaagcccgtggacggacactgcgctctagagtctaagtatgttaaaacagtgtgtttgcctgacgggagcttcccgtctgggtccgaatgtcacatcagcggatggggcgttactgaaactggaaaaggtagccgtcagttgttggatgcaaaggtgaagctgatcgctaacaccttatgtaattcacgtcagctgtatgaccatatgattgatgattccatgatctgcgccggtaacctccaaaagcctgggcaggatacatgccagggtgacagtggggggcctttgacatgtgagaaagacgggacttactacgtatacggcatcgtgtcctggggacttgagtgtggtaagagacccggcgtgtatacacaggtgaccaagtttctgaattggatcaaggcgactattaaatctgaaagcggattttag

SEQ ID NO: 120253 - DNA, 1656 bp, Artificial Sequence
  Description of Artificial Sequence: Synthetic coding sequence
atgttgcccctgttgctgttacccctcctatggggtgggtctttacaggagaagcctgtctacgaacttcaggtgcagaagtccgtgacagtgcaggaagggctgtgcgtgctagttccatgctccttctcttacccctggcgaagctggtatagttcaccacctctctatgtctactggttccgtgacggggagatcccttactacgccgaggtggtagcaactaacaatccagaccgccgggtcaaacccgagacacaaggccgcttccgcctgctgggggacgttcagaagaagaattgtagcctctctattggggatgcccgcatggaagatactgggagttatttctttcgggttgagcgggggagggacgtgaagtattcataccaacagaataagcttaacctggaggtaactgccctgattgagaagcccgatatacacttcctggaaccactcgaaagtgggaggccaaccaggctcagttgctcccttccaggctcttgtgaggccggaccgcccctaacgttcagctggaccggaaatgcattgtcccccctagatcccgagacgactcgctccagtgagcttacactcaccccacggcctgaggaccacggaacgaatcttacatgccagatgaaaagacagggcgctcaggtgacaaccgagcgtaccgtgcaattaaatgtctcttacgccccgcagaccatcacaatttttagaaatggtatcgcactcgagattctccagaacaccagctacctgcctgtgttggagggccaggcattacgtctgctgtgcgatgccccttctaacccgcccgcccatttatcttggtttcagggctctcctgcccttaatgcaacgccaatatcaaacacaggcattctcgagctccgacgggtgcgctccgctgaggaaggggggttcacatgccgcgcccagcaccctctgggattccttcagatcttcctcaatttatcggtgtattccctgcctcagctgctgggtccctcttgttcatgggaggctgaggggctgcactgtagatgtagtttccgcgcccgcccggctcctagcctgtgctggcgtcttgaagaaaaaccgctggaaggcaattccagtcagggctcgttcaaggtaaactcctcctccgccgggccttgggccaattctagtctgattcttcacggcggcttgagcagcgatctgaaagtgagttgcaaagcttggaatatctacggctcacagagtgggtccgttttattattacagggccgaagcaaccttggaaccggcgtggtccctgcggctctcgggggcgctggggtcatggctctgctgtgtatttgtttgtgtctaatattcttcctgatcgtcaaagcgcggcgaaagcaggcggccggtcgaccagagaagatggacgacgaagatcctataatggggacgatcacttctgggtcaagaaagaagccctggccggatagtcctggagaccaagcttctccccccggagatgcgcctccactggaggaacagaaggaactccactacgcaagcttaagctttagtgagatgaaatccagagagcccaaggaccaggaggcacccagtacaacggaatactccgagatcaagacatcaaagtag

SEQ ID NO: 120254 - DNA, 558 bp, Artificial Sequence
  Description of Artificial Sequence: Synthetic coding sequence
atgttcagggaagtgttcgcagacgaagacccagccacgtatgtttgggatggcaattatcaccagccatgggaacccgctgctgctggtgcggtgggggcaggcgcctatagagaggtagaagccgaggaccctgggcgcttggccgttgaggcgttggtaagaactagacggtgtgtctgcgtagctcaacgctgggggggcaaaagagaggttatgtatactgcttttaaggcgctcggggatagcgtcgactatgtgcagttttgccgagtgtgtgactccgatactcggttggatcctatggcactgctcgagcttgtccgtgtgctggacgaagaccctagagtcggcgcggtgggcggtgatgtccggattctcaatcctctagactcgtgggtctcctttctgagctcactcaggtattgggtggccttcaacgtagagagagcttgccagagctactttcattgcgtgagctgcatatcaggaccattggggaccccccccggtcctgcagccacacagcggaggcccagaccaagctgcggcgggtag

SEQ ID NO: 120255 - DNA, 645 bp, Artificial Sequence
  Description of Artificial Sequence: Synthetic coding sequence
atgtttcgtgaagtgttcgcagacgaggaccccgccacttatgtctgggatggcaattatcaccaaccttgggagcctgcagctgctggcgccgtgggggccggtgcctacagggaagtggaagccgaggacccaggcaggttagccgtcgaagccctggtccgtactagacggtgtgtctgtgtggcacagagatggggcgggaagcgcgaggttatgtacacggccttcaaagctctgggcgactcagtggattatgtccaggtgtgtgacagcgatacaagactggatcccatggctctgctcgaactcgtccgggtattggatgaagatcccagagtaggcgcggtaggaggcgatgtgaggattctgaacccacttgactcatgggtgagctttcttagttccttgcggtattgggttgctttcaacgtggagcgggcttgccagagttattttcattgcgtgtcatgcatatccggcccactcgaatcctgcccgggcccccgggaacacgccatgatgccttcctttctggcccccgtacaggtgcatcttcaggtcccactgctgctgcgcgacgcattagtgttacctgcagtggccgagcctgccgacactctggtgcaagtagtacttccctag

SEQ ID NO: 120256 - DNA, 1734 bp, Artificial Sequence
  Description of Artificial Sequence: Synthetic coding sequence
atgcgtcaggatgccccaaaacccacgccagcagcctgccgttgttctggcctggctcggagagtgctcactatcgcatttgctctcttaatattgggccttatgacttgggcctacgcagctggggtgcctttagcctctgataggtacggtctgttggcatttggcctgtatggcgccttcctcagcgcccacctggtggctcagtcattattcgcttatctggagcaccggagagtcgccgcagctgcgaggggtcctctcgacgccgccactgctcgctccgtcgccctgacgatatccgcttaccaagaggacccagcgtatctgagacaatgtctggcttccgcgcgagccctgctctaccctcgagcaagacttcgcgtgctaatggtggtggacggaaacagagctgaagacttgtatatggtcgatatgtttcgggaagtgttcgctgatgaggatcccgcaacctacgtgtgggatgggaattatcaccagccatgggagccagcagcggccggtgccgttggcgccggggcatacagagaagtggaagcggaggatcctggccgattggctgtcgaagccttggtgcggacccgacggtgcgtgtgcgtggcacaaaggtggggcggcaaacgagaagtgatgtacaccgcttttaaggctctcggagactccgtggactacgtccaggtgtgcgatagcgacacgagattggatcctatggccctgctggaactcgtgcgggtcttggacgaggacccacgagtgggggccgtggggggggatgttagaattctaaatcctcttgattcatgggtgtcattcctgagctcactccggtactgggtggcgttcaatgtggaaagagcttgccagagctactttcactgcgtaagctgcatctccggtcctctcggcttgtaccgtaataatttactgcagcagttccttgaagcctggtataatcaaaaattcctgggaacccactgcactttcggggacgacagacacttgaccaatcggatgctctccatgggttatgcaaccaagtacaccagtagatcccgctgctactccgaaaccccttctagctttctgcggtggttgagccagcagacaagatggtctaagtcctattttagggagtggctgtacaatgccctatggtggcatagacatcatgcctggatgacatatgaggccgttgtttcggggttatttcctttttttgtcgccgccactgtgctccgtctgttctatgccggcagaccatgggcactcctgtgggttctgttgtgcgtgcaaggagttgctctggccaaagcagcattcgccgcgtggctccgcggctgtctgaggatggtcctattgtcattgtatgcacccctatatatgtgcggacttttgcctgccaagtttttagctctagtgacaatgaatcaaagcggttgggggacttccggtcgtcgtaagctggcggctaactacgtgccccttctgcccctggccctctgggccctcctccttctcggtgggctggtacgctctgtggcccacgaagcacgcgctgactggtctggaccatctagagctgctgaggcctatcatttagcagccggagctggagcttatgtggggtattgggtcgcgatgttaaccctgtattgggtcggagtcagacgtttatgccggcggaggaccggaggctatagggtgcaagtttag

SEQ ID NO: 120257 - DNA, 1659 bp, Artificial Sequence
  Description of Artificial Sequence: Synthetic coding sequence
atgcactgcgagagattcctgtgcatcctaaggatcatcggtacaacactcttcggggtgtcgctgcttctcggcataacagctgcttacatcgtcggctatcagttcatccagactgacaactattatttctcctttggactctacggcgctttcctggctagccacttgattattcagagcctgtttgcttttctcgagcatcggaaaatgaagaaatctcttgaaacacctatcaagctgaacaagacagttgccttgtgtattgcagcttatcaggaggatcccgactacctccgaaaatgcctccagagtgttaaaagacttacctaccctggtataaaggtcgtcatggtcatagatgggaactctgaagacgatctctatatgatggatattttcagcgaagtcatggggcgtgataagtccgctacctatatttggaagaacaacttccacgagaagggccccggggagaccgacgagagtcataaggagtcttcccagcatgtcactcagttggtgctgagtaacaaatcgatatgcatcatgcagaaatggggaggcaaacgagaggtaatgtacacagctttcagagccctagggaggagtgtcgattacgtgcaagtctgcgactcagacacaatgctcgatcccgcctcaagcgtagagatggttaaggtcttagaggaggacccaatggttggcggcgtaggaggggacgtgcaaatcctgaataaatatgactcctggatcagtttcctttcttcagtcaggtactggatggcatttaacatcgagcgagcctgtcagagctattttggatgtgtccagtgcatctctggcccactcggtatgtaccgcaactccctgctccatgagttcgttgaggattggtataatcaggaatttatgggaaatcagtgctctttcggagacgacagacatctgacaaaccgcgtcctcagccttggctacgcgactaaatacacagcaagaagcaaatgcctgacagaaacccccattgaataccttcggtggctcaaccagcagactcgatggtctaagagctactttcgcgaatggctctataatgccatgtggttccacaaacaccatctgtggatgacatacgaggcaattattacaggtttcttccccttttttctgatcgccaccgtgatccaactcttttacagggggaagatctggaatatactgcttttcctgctcaccgtccaactggttggcctgatcaaatcaagttttgcatcatgtctgcgtggcaacatagttatggtgtttatgtctttgtattctgtcctctatatgtcttctttgcttccagccaagatgtttgcgattgccaccataaacaaggcgggttggggcacctctggccgaaaaactattgtagtcaattttatcggcctcatcccagtctcggtgtggtttactattcttcttggcggcgtaatttttacgatatataaggaatccaaaagaccgttcagcgagtctaagcagactgtactgatcgttgggactttattgtacgcctgctactgggttatgctgctgaccctttatgtggtgttgataaataaatgcggacgcaggaagaaaggacagcagtatgacatggtcctggatgtgtag

SEQ ID NO: 120258 - DNA, 951 bp, Artificial Sequence
  Description of Artificial Sequence: Synthetic coding sequence
atgcactgtgagaggttcctttgtatcctgcggatcatcgggacaaccctctttggcgtctcactgttgcttggcattaccgccgcctatattgtcggctaccagtttatccaaaccgacaactactatttctcatttgggctttacggtgcttttctagccagccacctgatcatccagtcattgtttgcttttctagagcatcgtaaaatgaagaagagtctggaaactcccattaaacttaacaaaacagttgcactgtgtatagccgcatatcaggaggatccagattatctgcgcaaatgcctccagtcagtgaagaggctcacttatccggggattaaggtcgtgatggtgatagacggcaactctgaggacgacctttatatgatggacatttttagtgaagtgatgggccgggataaaagtgcgacttatatttggaagaataatttccacgagaaggggccaggagagactgacgagtctcacaaagagtcgtctcaacatgtgactcagcttgttttgtcaaacaagtcgatttgtattatgcaaaagtggggaggtaagagagaggtgatgtataccgccttccgggcgctgggccggagcgtggattacgtccaggtgtgcgacagtgacactatgttagatcccgcgtctagcgtagagatggtgaaggtgctcgaggaagaccccatggtggggggggtgggaggcgatgtgcagattctcaacaaatacgattcatggatctcattcctttcctctgtgagatattggatggcattcaatattgaaagggcttgccagtcctacttcggctgcgttcagtgcatatccgggcccttgggcatgtatagaaactcgctcctacacgtccttactttcgcagtcacccataatactttggtgcctctgggtgctgtgcagtactgtggaattcgttag

SEQ ID NO: 120259 - DNA, 1389 bp, Artificial Sequence
  Description of Artificial Sequence: Synthetic coding sequence
atggcacaagtgagtataaataacgactacagcgaatgggatctgtcaacagatgctggcgagcgcgccaggttgctgcaatctccctgcgtagacaccgcacctaagagcgagtgggaagcctcgcctgggggcttagatcgtgggacaactagcacactaggggcaatttttattgtggtgaacgcatgccttggagccgggctcctcaatttccctgcggcgttttctaccgcagggggagtggctgccggtatagccctccagatggggatgctcgtgtttatcatctctgggctagtaattttagcctattgcagtcaggcatctaatgagagaacatatcaggaagtggtctgggccgtttgtggtaaactaacaggcgtgctctgcgaggtagccatcgccgtgtataccttcggcacctgtatcgcctttttgatcattattggcgaccagcaggataaaatcatcgcagtaatggccaaagagcccgagggggccagtggaccctggtataccgatcgaaagtttacaatctctctgacagcctttttattcatactgccactctccattcccagggagatcggattccagaaatacgcttccttcctcagtgtcgttggcacctggtatgtgactgcgattgttatcatcaagtatatttggccagacaaggagatgacacccggaaacatcctgactcgccccgccagttggatggctgtgttcaacgccatgccgaccatctgctttgggttccagtgccacgtgagttccgtaccagtcttcaatagcatgcaacagccagaggtgaagacgtggggaggggtcgtaaccgcggccatggtgatcgccctcgctgtatatatgggaaccggcatatgtggatttctgacatttggtgccgccgtggatcctgacgtcctgctgtcttacccatctgaagacatggcagtcgcggtggcacgggcctttatcattctgtccgttttgacctcctatcctatcctgcacttctgtggtagggccgttgtggagggactgtggctgaggtaccagggcgtgcctgttgaggaagacgtgggcagagagaggagacggagggttttgcagaccctggtttggttcctccttacacttctgctcgcactatttattcctgacattggaaaggttatatcagtgataggaggtctcgccgcttgtttcattttcgtttttcctgggctctgcctcattcaggcgaaattaagcgaaatggaagaggtgaagcctgcgagttggtgggtgctcgtcagttatggcgtccttctggtgactctgggcgcattcattttcggccagactaccgcaaacgctatattcgtggacctgttggcctag

SEQ ID NO: 120260 - DNA, 1662 bp, Artificial Sequence
  Description of Artificial Sequence: Synthetic coding sequence
atgcctgtccagctgaccacagccctccgcgtggttggaacctccctcttcgccctggcagtactcggaggcatcctagcagcatatgtgaccggctaccagttcatacataccgaaaagcattatctgtccttcggcctctatggagccatcttgggtctgcatctccttatccagagccttttcgccttccttgaacatcgtcgtatgcgaagagccgggcaagccctgaagctcccctcgccacggcgcgggtctgtagcactatgtatcgcggcgtatcaagaagatcctgactatctccgaaagtgtctgcggagcgctcagcgaatatcatttcccgaccttaaagttgtcatggtggtggacggcaacagacaagaggacgcctacatgttggatatcttccacgaagttctcggtggtaccgagcaggccggattcttcgtttggcggtcgaacttccatgaggccggcgagggcgaaaccgaggcctcacttcaggagggaatggatagagttcgggatgttgtgcgggcttccaccttcagctgcattatgcagaagtggggggggaagcgagaggtcatgtacacggcttttaaagccctgggagacagcgtcgattacatacaggtctgcgatagcgacacagtccttgaccctgcgtgtactatagagatgttgcgggttttagaggaggacccccaggtgggtggagtcggcggggacgtgcagattttgaataagtatgattcctggatatcatttctcagctcagttaggtactggatggcgttcaacgttgagcgggcctgccaatcctattttggctgtgtccagtgcattagtggaccattaggcatgtatcgaaatagtctgcttcagcagtttctagaagattggtatcatcagaagtttcttggcagcaagtgctcatttggtgatgatagacacctgacaaatcgcgtgctgtccctgggctacaggactaagtacacagcccgctctaagtgcctgacagaaacacctacaaaatatttaaggtggctgaaccagcagacccgatggtctaaaagctactttagagaatggttgtacaactctttgtggtttcacaagcatcatttgtggatgacgtacgaatccgttgtcactggtttttttccttttttcctcatcgcaactgtaattcagctgttttatagaggaagaatctggaatatactcctgtttcttctgacagtgcagctcgtgggaataattaaagcaacttacgcctgcttcttacggggtaatgctgaaatgatattcatgtctctttacagcttgttatacatgtccagtttgctgcctgcgaagatttttgcaattgctacgattaacaaaagcggatggggcactagcgggaggaaaaccattgttgtgaacttcattggcctgatcccggtatctatctgggtagccgtcctcctcgggggcctggcctacacagcgtactgccaggatctcttttccgaaaccgagctagccttccttgtaagtggggccatcctctatggatgctactgggtcgcgcttttgatgttgtatcttgcaattatcgcacgcagatgcggaaaaaagccagaacagtatagtctggcgtttgctgaagtctag

SEQ ID NO: 120261 - DNA, 1308 bp, Artificial Sequence
  Description of Artificial Sequence: Synthetic coding sequence
atggcagctcatctgctgcctatttgtgctctcttccttacgttgcttgatatggcccagggttttcggggccccttattgccaaaccggccttttacaacagtgtggaacgccaatacacagtggtgcctggaacgccacggggtggacgtcgacgtatctgtctttgatgtggtggctaacccaggccaaacattcaggggacccgacatgaccatcttttattcttcacaactcggcacttacccctactatactcccaccggcgaaccagttttcgggggtctgcctcaaaatgccagtctaatagcccatcttgctcggacctttcaggatatcctcgccgccatcccagccccagacttctctggcctcgccgtgatcgactgggaagcatggagaccgaggtgggccttcaattgggatacgaaagacatctaccgacaacggagtagggcgcttgtacaagcacagcaccccgactggcccgccccccaagtggaggctgtggcccaggaccaatttcagggtgccgctcgtgcgtggatggctgggactttacagctcggtcgtgccctgaggcccagagggttgtggggcttttatgggttcccagattgctacaactacgactttctctcgccaaactacaccggccagtgtccgtcagggatcagagcccagaacgaccagttaggatggctctggggccagtcccgggccttgtacccgagtatttatatgcctgccgtcctcgagggcactggtaaatctcagatgtacgttcagcacagggtggccgaggcctttagagttgccgtggccgcaggcgatccaaacctccccgtccttccctatgtgcaaattttctatgataccacaaaccattttctgcctctggacgagctagaacactccctcggagagtctgcggcacaaggcgctgctggggttgtactatgggtttcatgggagaacacccgcactaaagaatcttgtcaggctataaaggagtacatggacaccacactcggcccgttcattttaaatgtgacctccggggctctcctgtgttcacaggcactctgtagtgggcacggccgatgtgtgcgccggacatcgcatcccaaggctctgttgcttttgaatcccgcttcgttttcgatccagctcactccggggggcggtccactgtctctaagaggcgccctctcattagaggatcaggcccaaatggccgtggaattcaagtgtaggtgctatccaggctggcaagctccctggtgcgaacggaaaagcatgtggtag

SEQ ID NO: 120262 - DNA, 1308 bp, Artificial Sequence
  Description of Artificial Sequence: Synthetic coding sequence
atggcggcacacctgctgccaatttgcgctctctttttgaccttgctggacatggctcagggctttcgcgggccacttctccctaacaggcctttcactacagtatggaatgctaatacccagtggtgccttgaacggcacggggttgatgtagatgttagcgtctttgacgtggtggctaacccagggcagacgttccgcggcccagatatgacgatattctattcttcccagctcggaacctatccatattacacccccactggcgagccggtgttcggtggcctgccccagaacgcttccttaatagcacacctggcccggactttccaggatattctagccgcaatccccgctcccgacttttcaggtctggcagtcatcgactgggaggcttggcgccccagatgggccttcaattgggacacgaaggatatctatagacaacgcagtagagctctggttcaagcccagcaccctgactggccagctccccaggtagaggccgtggcccaagatcagttccagggtgccgcacgcgcctggatggctggcacattgcaacttggccgcgcccttcggcctcgtggattatggggtttttatggattccctgattgttacaattacgattttctcagcccaaattacaccggccagtgtccgtccggtattcgcgcccagaacgatcagcttggatggctgtggggccagtcaagggcgctttaccctagcatatatatgcctgccgtcttagaaggcaccggtaagagccagatgtacgtgcagcacagagtggccgaggcattccgcgtggccgtagccgcaggcgatcccaacctgcctgtgctgccatatgtgcagatcttctacgacactactaaccattttcttccgctagacgagctggaacacagtcttggtgagtctgccgcgcagggtgccgctggcgtggtgctgtgggtgtcctgggaaaacacaaggaccaaggagtcatgccaggctattaaagaatacatggacacgacacttggtccttttattctcaatgtgacctctggagccctcttatgctcccaagccttatgctctggccacggacgctgcgtgcgtaggacttcgcatcccaaggcactccttctgctgaacccagcgagcttttccatccagctgacaccgggcggcggcccactctctctgcgcggagcgttgtccctggaggaccaagcccagatggccgtagagttcaaatgtcgctgctatcccgggtggcaggcaccttggtgcgaacgaaagagcatgtggtag

SEQ ID NO: 120263 - DNA, 1218 bp, Artificial Sequence
  Description of Artificial Sequence: Synthetic coding sequence
atggcggcccacctcctcccaatatgtgccctgtttttgaccctactcgacatggcacagggctttagggggccactgctgccaaataggccgtttactacagtatggaacgccaatactcagtggtgtctggagcgccatggcgttgacgtggatgttagcgtgttcgacgtggtagctaaccccggccagaccttcaggggtcccgatatgacaatattctatagttcccagctcggcacctacccttactatacgcctaccggtgagcccgtctttggcggccttccccagaacgccagtttaatcgcgcacttagcccggacgttccaggacatcttggcagcaatccccgcaccggacttcagcggtctggcagttattgactgggaggcctggcgcccacgctgggctttcaattgggacacgaaggacatataccggcagcgatctcgagcactggttcaagcccagcaccctgactggccggccccacaggtggaagccgtggcccaggaccaatttcagggagccgcccgcgcgtggatggccggcactctgcagcttgggagggccctccggccgaggggcttgtggggcttttacggctttcctgactgttacaactatgactttctatctccaaactacacaggacagtgcccgagtggaattcgcgcccaaaatgaccagctgggatggctctgggggcagagccgagccctttatcccagcatctacatgcctgcggtcctggaggggaccggaaagagccaaatgtatgtccagcaccgtgtagcggaagcttttagggtcgccgtggctgcgggcgacccaaaccttccagttcttccatatgtacagatcttctacgatactaccaaccacttccttccactggagtcatgtcaggctataaaggagtatatggacactacacttggccccttcatcttgaacgtgaccagcggagcactcctgtgctcacaggctttgtgctccggacacgggagatgtgtccgcaggacctcccatcccaaagccctattactgctgaacccagcgtccttttccatccagctgacacccggcggcggaccactcagcctcaggggggccctgtccttggaggatcaggcacagatggctgtcgagtttaaatgtagatgctaccccgggtggcaggccccttggtgcgaacgtaagagcatgtggtag

SEQ ID NO: 120264 - DNA, 1308 bp, Artificial Sequence
  Description of Artificial Sequence: Synthetic coding sequence
atggccgcccatctgcttccaatatgtgcactcttcctgaccctgctagacatggcacagggattcaggggtcccctcttaccaaataggcctttcactacagtttggaatgccaatactcagtggtgtctagaacgacacggagtagatgtcgatgtgagcgtgttcgacgtcgtggctaatcccgggcagactttccgaggccccgatatgacaattttttactcctcacagttgggtacatatccatattacaccccaacaggtgagcccgtcttcggaggtctcccccaaaacgcgtcccttatcgctcatctggcacgcactttccaagacattctagcggccattcccgccccagacttcagcgggctggccgttattgattgggaagcatggcgacccaggtgggcgttcaattgggataccaaagacatttacaggcagagatcccgcgctctggtccaggctcagcacccagactggccagcgccacaggttgaggcagtggcacaagaccagtttcagggagctgcgcgggcctggatggctggtacgctgcagttaggacgggccttgaggcctaggggcctatggggtttctatggatttccagactgctacaattacgactttttgagcccaaattacactggccagtgtccatctgggattagagctcagaatgatcaactcgggtggctttggggccagtcccgcgccctgtacccctctatttatatgcctgccgtcctggaagggacaggcaagagtcaaatgtacgttcagcatagagtcgcagaggccttccgcgtggccgtagctgctggcgaccctaacctgccagtgctgccctatgtgcagatcttttatgacacaactaatcacttcctccctttagatgagcttgaacactcccttggcgagagtgccgctcagggagccgctggagtcgtgctgtgggtaagttgggaaaacactcggacgaaagaatcttgtcaggcaatcaaggaatatatggataccactttggggccgttcattttgaacgtgacctcgggagctttgctttgtagccaggctttgtgtagcggccatggaaggtgcgttcgcaggacttcccatcctaaggccctgctgctgctgaaccccgcttccttcagcattcagctaacacctggcgggggtccactgagtctgaggggagctctttcccttgaggatcaggcccaaatggctgtcgagttcaagtgtcgctgttaccccggatggcaggccccatggtgcgagaggaagtcgatgtggtag

SEQ ID NO: 120265 - DNA, 312 bp, Artificial Sequence
  Description of Artificial Sequence: Synthetic coding sequence
atggctgcccatctactgcccatctgtgccttgtttctgactctgctggatatggcccagggctttcgaggccctctgctgcctaaccggcctttcactactgtctggaacgctaatacacagtggtgccttgagaggcatggagtcgatgtcgacgtcagcgtattcgatgtggtggccaatcccgggcagacgtttcggggacccgatatgaccattttctatagctcccaactcggcacctacccctactacactccaactggggagcctgttttcgggggactcccccagaacgccagtctcatctag

SEQ ID NO: 120266 - DNA, 531 bp, Artificial Sequence
  Description of Artificial Sequence: Synthetic coding sequence
atgtatgtccaacaccgcgtggccgaagcttttagagttgctgttgctgccggagatcctaacctgccagtgcttccatacgttcaaatcttctatgatactactaaccacttccttccacttgacgagctggagcattcgttgggcgagtctgctgctcagggtgcagcaggcgtggtgctatgggtttcctgggagaatactcggaccaaagagtcctgtcaggccatcaaggaatacatggacactacccttggcccttttatccttaatgttacgtcaggggctctgttgtgctcccaggcactgtgttccggacacggaaggtgtgtgcgacgcacatcacatccaaaggccttgttgctgcttaatcctgcatccttcagtatccagttgaccccaggcggaggtcccctgagcctcaggggggccctgtctctggaggaccaggcgcaaatggcagtcgaatttaaatgtagatgctatccaggatggcaagccccgtggtgcgagcgcaagtcaatgtggtag

SEQ ID NO: 120267 - DNA, 210 bp, Artificial Sequence
  Description of Artificial Sequence: Synthetic coding sequence
atggctgcccacctgcttccaatctgtgccctctttctgactcttctggacatggcccagggcttccgggggcccctgctccccaatcgcccatttacaaccgtctggaatgccaatactcaatggtgccttgagagacatggggtggatgttgacgtttctgtcttcgatgtggtagctaatccggggcaaactttccgaggaccctag

SEQ ID NO: 120268 - DNA, 762 bp, Artificial Sequence
  Description of Artificial Sequence: Synthetic coding sequence
atggccggcactttgcagctgggtagggccttacggcctcgcggcctctggggattctatggattcccggactgttataattatgacttcttaagccctaactacaccggtcaatgcccctcagggataagagctcagaatgaccagctaggatggctttgggggcagtctcgggctctttacccgagtatctatatgcccgccgtgttagaaggcactggcaagtcccagatgtacgtacagcacagggtggccgaggccttcagagtagcagttgctgctggcgacccgaaccttcccgttctgccctacgtgcagatcttctatgacaccaccaatcactttctgccacttgacgagcttgagcacagcctgggtgagtccgctgcccagggggccgcgggggttgttctctgggtgtcctgggagaatacacgcactaaggaaagctgtcaggccattaaagaatatatggataccactttgggcccattcatccttaacgtgaccagcggcgccctgctttgcagtcaggccctgtgctctggacatggtcgatgtgtcagaagaactagtcaccccaaagcccttttgctgctgaatccggcttccttctccatccagctgacgcctgggggtggccctttaagcctgcgcggcgcattgagtcttgaagatcaagcccagatggccgtcgagttcaaatgccggtgttaccctggctggcaggcaccctggtgtgaacgaaagagcatgtggtag

SEQ ID NO: 120269 - DNA, 1422 bp, Artificial Sequence
  Description of Artificial Sequence: Synthetic coding sequence
atgcgggccgggcctggaccaaccgttacgctggccttggtgttggccgtttcatgggcaatggaactgaagccaaccgcacctccgattttcaccggacgaccctttgtggtggcatgggacgtccccacccaggactgtgggccgcggctgaaagtacccctcgacctgaacgcatttgatgttcaggcttcacctaacgaggggttcgtaaaccaaaatatcaccattttctatagagaccgactgggactttatccgaggttcgacagtgccggtagatctgttcatggtggagtaccgcagaatgtttcactctgggcccataggaaaatgctgcagaaacgcgtggaacattatattaggactcaagaaagtgccggcctggcagtcattgattgggaagattggagaccagtttgggttagaaattggcaggataaagatgtgtatcggcgcctctcacgccaattggtggccagtcggcaccctgactggccacccgataggattgtgaagcaagcacagtacgaatttgagtttgccgcacaacagtttatgctcgaaaccctcagatacgtgaaggccgttaggccgcgacacttgtggggattctacctgttccccgattgttataatcatgattatgtgcaaaattgggagagttataccggcaggtgtccagacgtcgaagtcgcacgtaacgatcaactcgcatggctctgggcagaatccaccgccctatttccttccgtttaccttgatgaaaccctggcaagttctaggcacggaagaaattttgtcagttttcgggtgcaggaggcgttaagggtcgcccggactcaccacgccaaccatgcactgcccgtgtacgtttttacccgcccgacctacagcagacggctgacgggactctccgaaatggacctgatcagcactattggggaaagtgctgccttgggagctgctggcgtcattctctggggagacgcaggatataccacctcaacagagacctgccagtatctgaaagactatctgacccgccttctggtgccttatgtggtgaacgtcagctgggcgacacagtattgctcaagggcccagtgccatggtcacggtagatgtgttcgacgcaacccatctgctagtacttttctgcatctatccacaaactctttccgtctggtccctgggcacgctcctggtgaacctcagctgcgcccagttggagaactgagttgggcagacatagaccacctccagacccacttccggtgccagtgctatctcggctggagtggcgagcaatgccagtgggaccataggcaggctgccgggggcgcctccgaggcatgggctgggtcccatctgaccagtttactggccttggccgcactggcctttacatggacgttgtag

SEQ ID NO: 120270 - DNA, 1422 bp, Artificial Sequence
  Description of Artificial Sequence: Synthetic coding sequence
atgcgagccggacccggcccaacagtgacactcgctctggtgttggccgttagttgggcaatggaactaaagcctacagcgccgcccatatttacagggcgcccttttgttgtggcctgggacgtacctacccaggattgcggaccacgattgaaggtgccattggaccttaatgcgttcgatgtccaggccagccctaacgagggtttcgtcaatcagaatattacaatcttttatcgtgatagactgggtttgtacccccgattcgactccgcagggcgaagtgtccatggaggggtaccacaaaacgtcagcctgtgggcgcataggaaaatgctgcaaaaaagggtcgagcactacattaggactcaggaaagcgccgggctggcggtgatcgactgggaagactggaggccagtctgggttaggaattggcaggacaaggatgtgtatagacgtctgtcacggcaactggtggcttctaggcatcctgattggcctcccgatcgtatcgtgaaacaggctcagtatgagttcgaattcgctgcccagcaattcatgctggagactctccgctacgtcaaggctgtccggcctaggcacttgtgggggttctatctcttccctgattgttacaatcacgactatgtgcaaaactgggagagctatactggccgctgtcccgacgtggaggtggcccgcaacgaccaattagcatggctgtgggcggagagcactgcactctttccatcagtctacctggatgaaacactggccagtagtcgccatggaagaaactttgtttccttccgggtccaagaggcactcagggttgctcggacccatcacgctaaccatgcgctgcctgtgtacgtgttcacccggcccacctacagtcgccgcttgaccgggctctccgagatggatctcatctcgaccatcggcgagtctgccgcgctcggagctgctggggtgatactgtggggagacgccgggtatactactagtaccgagacctgccagtatctgaaggattacctcactcgcctcctcgtgccctacgttgtaaatgtgagttgggcaacccaatattgctcaagggcacagtgccatggtcacggacgatgcgttcgccgtaacccttctgcaagtacattcctccatctatccactaacagcttccggttggttcccggccacgcaccaggggaaccgcagctgcgacccgtaggggaacttagctgggctgatatcgatcatctacagacacatttcagatgccagtgttacctggggtggagcggtgagcagtgtcagtgggaccataggcaagccgctgggggcgcatcggaggcctgggcgggtagtcatctgacctcactgcttgctctggctgcgttagcttttacctggacgttatag

SEQ ID NO: 120271 - DNA, 147 bp, Artificial Sequence
  Description of Artificial Sequence: Synthetic coding sequence
atgagagctggccctggtcctactgtcacccttgccctggttttagcggtctcttgggcgatggaactgaaaccaactgcacccccaatctttactggtcgaccctttgtggtggcttgggatgttcccactcaggattgcggttag

SEQ ID NO: 120272 - DNA, 354 bp, Artificial Sequence
  Description of Artificial Sequence: Synthetic coding sequence
atgcgagctggtcccgggcccaccgtgacgttggccctcgtccttgcagtaagctgggccatggaattaaaacccacagcccctcccatctttacagggaggccattcgtggtagcgtgggatgttcctacccaggactgcggacccagactcaaggtgccgctagacctcaacgcctttgatgtgcaggccagtcccaatgagggcttcgttaatcagaacattaccatcttttatcgtgaccgacttggcctttatccccggttcgactctgcagggaggtccgttcacggaggagtccctcaaaatgtttcgctgtgggcccaccgaaaaatgctccagaagcgcgtctag

SEQ ID NO: 120273 - DNA, 246 bp, Artificial Sequence
  Description of Artificial Sequence: Synthetic coding sequence
atgcgcgctggccctgggcctacggttactttagcgcttgttctggccgtcagttgggcgatggaactgaaacctaccgctccccctatctttacaggtcgaccatttgtggtggcttgggacgtgcctacacaagactgcggtcctagactgaaagtgcccctggatctgaatgcgttcgacgtgcaagcaagccccaatgagggcttcgtgaatcagaatattactattttctatagggactag

SEQ ID NO: 120274 - DNA, 231 bp, Artificial Sequence
  Description of Artificial Sequence: Synthetic coding sequence
atgcgtgccggcccgggccccacagtgacactggccctggtcttggcggtgtcgtgggctatggaactgaaacccacagcccccccaattttcaccgggagacccttcgtggtggcctgggatgtgccaactcaggattgcggtccccggctgaaagtccctctggatctgaacgcttttgacgtgcaagcatcacccaacgagggctttgtaaatcaaaacataacctag

SEQ ID NO: 120275 - DNA, 1422 bp, Artificial Sequence
  Description of Artificial Sequence: Synthetic coding sequence
atgcgtgccgggcccggccctactgtgactctcgcattagtcctagcagtgagctgggcaatggagctgaaaccgacagccccccctattttcacgggccgccccttcgttgtggcctgggacgttccaactcaagactgcggacctcgactcaaagtgccgctggacctcaacgccttcgacgttcaggcatcccctaacgagggttttgttaatcagaacatcactatcttttatcgcgaccggttaggcctgtatccgcgtttcgattccgccggcagaagtgtccatgggggagtgcctcagaacgtcagcctatgggcccatagaaaaatgctgcagaagcgcgttgagcattatatacggactcaggagagtgccggactggctgtgatcgactgggaagactggagacccgtttgggtccgcaattggcaggacaaggatgtctatcggagattgtcacggcagctggtcgccagccgacaccccgattggccaccagatagaatcgtcaagcaggcccagtatgagttcgagttcgctgcccaacaattcatgttagaaaccctaaggtatgtgaaggcggtgcgcccccggcacctatggggattttacttgttcccagactgttacaaccatgactatgtgcagaactgggagtcctacaccggacgctgtcccgatgtggaggtggctagaaatgatcagctggcgtggctttgggccgagtccaccgctctcttccccagtgtctacttagatgagactttggcatcctcacggcatggacgcaactttgtgtccttccgcgtgcaggaggccctacgggtagcccggacacaccacgcaaaccacgcgctccccgtctacgtgttcactaggcctacatacagtcgccgcctgacagggctgtctgagatggacctgatatccacaatcggagaaagcgcagctttaggagcggcaggtgtcattttgtggggagacgcaggctacaccacctcaaccgaaacttgtcagtacctgaaggattacctgacacgcttactggtgccttacgtcgtcaatgtgagctgggctacccaatactgctctcgggcccaatgccacggtcacgggcgctgcgtacggcgcaacccctctgcgtccactttcctgcacttgtccactaattccttccggttagtaccgggccatgcgccaggtgagccacagctgcggccagtgggggagttatcctgggctgatatagaccatctccaaacacacttcagatgccagtgctacctgggctggtcaggtgagcagtgtcaatgggatcaccgccaagccgccggcggtgcatcggaggcctgggccgggagtcatttaacctcactgctggctctggctgccctggcgtttacttggacactctag

SEQ ID NO: 120276 - DNA, 1422 bp, Artificial Sequence
  Description of Artificial Sequence: Synthetic coding sequence
atgcgagcaggacctggcccaacagtaactcttgcactagtgctagccgtatcatgggctatggaactaaaacctaccgctcccccaattttcacaggacgccccttcgtggtggcgtgggacgtccccacccaggattgtggaccgcgcttgaaagtgccattagaccttaatgcattcgacgtgcaggcaagtcccaacgaaggctttgtgaaccagaacatcacgattttttatagagataggctgggcctttacccaagatttgacagcgcaggtcggtccgtccatggaggggtgccacaaaatgtgtctctttgggcccaccggaaaatgttacagaagcgtgtagagcactatatccgaacacaagagtctgctggcctggcagtgattgattgggaagactggagacctgtctgggtgaggaactggcaggataaagacgtgtatcgaaggctgtcccgccagctggtggcgtcgcgacacccggactggccacctgatcgcatagtgaagcaggcccaatatgagtttgagttcgctgcccagcagtttatgttggaaacccttcggtatgtaaaggccgtgaggccccggcatttgtggggcttctacttgttccccgattgctacaaccacgactacgtgcagaattgggaatcatacacaggaagatgcccagatgttgaggtcgcaaggaatgaccagttggcttggctctgggcagagagtaccgctttgttccccagtgtgtacctagatgagaccttagccagctcgcgccacggccgcaactttgtctccttccgagtacaggaagctctcagggtggcaaggactcaccacgctaatcacgccctacccgtgtatgtgttcaccaggccaacttatagtagaaggttgactgggctaagcgaaatggatctcatttctacaattggggagtccgccgcactgggagctgcgggtgtgattctgtggggggatgcaggatataccacctcgacagaaacgtgtcagtacctgaaggactacctgactagacttctggtgccatatgtggttaatgtgtcttgggcaacccagtattgctctagagctcagtgtcacggacacggcagatgtgtaaggaggaaccctagcgcctcgaccttcctgcatctgtcaaccaactcttttcgcctcgtaccaggacacgccccgggggaacctcaactgaggcctgtaggcgaattgtcctgggcagacatcgaccacctgcagacgcatttccggtgccaatgttacctaggctggagtggtgagcaatgccagtgggaccatagacaggccgccggcggcgcatctgaggcttgggcaggaagtcaccttactagtttgctggccttagctgccttggcatttacttggaccctgtag

SEQ ID NO: 120277 - DNA, 366 bp, Artificial Sequence
  Description of Artificial Sequence: Synthetic coding sequence
atgagagcagggccggggccaaccgtaaccttagcattagtgctagccgtgagttgggccatggaactgaaacctacggcaccacccatcttcactgggcgaccgttcgttgtggcctgggatgtgccaacacaggactgcgggccacgactgaaggtccctttagatctgaacgcatttgacgtccaggcatcacccaacgagggatttgtcaatcagaatatcaccatattttacagagaccggctcggactgtacccacgtttcgattccgctggccgttccgtgcatgggggggtccctcagaatgtgtctctgtgggcccacaggaaaatgcttcagaagcgggtcgaacattacatttag

SEQ ID NO: 120278 - DNA, 1254 bp, Artificial Sequence
  Description of Artificial Sequence: Synthetic coding sequence
atgactacccagctgggcccggctctggtactgggagtggctctgtgtctcgggtgcgggcaaccactgcctcaggtgcctgagaggccgttcagtgttctgtggaacgttccgtcagcacactgtgaggccaggtttggggtccatctgcccctgaacgcgctcgggatcattgccaatcgtggccagcattttcatggtcaaaacatgaccatcttctacaaaaatcagcttggcctgtatccctacttcggcccaagggggacggcccataatggcgggattcctcaggcattgccactggatagacatttggcactcgcggcataccagattcatcactctttacgccctggtttcgctggtcctgcggtactagattgggaggaatggtgccccctttgggctggtaattggggaaggcgacgggcctaccaggccgctagttgggcctgggctcagcaagtttttccagatctcgacccccaagaacagctgtataaggcctacacaggttttgagcaggccgcccgtgcgctgatggaggacaccctaagagtggcccaggcgctgcgccctcacgggctgtggggcttttatcactaccctgcgtgcggtaacgggtggcactccatggccagcaattatacaggccgctgtcacgctgcaacgttggcccgaaacacacagctacactggctctgggcggcctcaagtgcactgttcccctcaatctatttgcctcccagactgccacccgcccaccatcaggccttcgtgagacatcgactcgaggaggccttccgggtcgcactcgtgggacaccggcacccccttcctgttctggcttatgttcggctcacccaccgtcgctccgggaggttcctctcgcaggacgacctggtgcagtccattggtgtctctgccgctctgggtgctgcaggtgttgtgttatggggggatctgagtctgtcatcaagcgaagaagaatgttggcacctccacgactacctggtagatactttggggccgtacgttatcaacgtgacccgcgctgccatggcctgctctcaccagaggtgtcatggccacggccgctgcgctcggagagatcctggtcaaatggaggcctttctgcacctttggcccgacggctcactgggagactggaaatcattctcttgccactgctactggggatgggcagggcccacttgccaggagcctagaccaggcccaaaagaggcggtatag

SEQ ID NO: 120279 - DNA, 1164 bp, Artificial Sequence
  Description of Artificial Sequence: Synthetic coding sequence
atgactacacagttaggacccgcgctggtgttgggcgtagcgttatgtctgggttgcggacagccgctgccgcaggtgcccgaacgtcccttctctgtactttggaacgtaccgagcgctcactgtgaagccaggtttggcgtccacctgccattgaatgccctcgggattattgccaatcgcgggcaacacttccatgggcagaacatgacaatcttttacaagaaccagctgggcctgtacccctacttcggacctaggggaactgcacacaatggaggcattccgcaggcactccctctcgacagacacctggcactggctgcataccagattcatcactcgctgcggcctggatttgccggaccggccgtccttgactgggaagaatggtgtcctctttgggctggtaactggggccgcaggcgggcttatcaggcggcatcatgggcctgggcgcagcaggtcttcccggacctggacccacaggagcagctgtataaggcatacaccgggttcgaacaagccgccagagcgctgatggaagatacactgagagtggcacaggccttgaggcctcacggcctgtggggattctaccactatcctgcatgcggtaatgggtggcacagcatggccagcaactataccggccgatgtcacgctgcaacactggcacggaacacacagttgcattggctgtgggccgctagttcagcactgttcccgtccatctacttaccccctcgactgcctcccgcacaccatcaggccttcgtgaggcatcgcctggaggaggcatttagagtggcactggtaggacaccgtcacccgctgccagttctggcatacgttcgactgacacaccggagatcagggcgctttcttagccaagaggagtgctggcacctccatgactatctggtagacacactgggcccatatgttatcaatgtcaccagggctgccatggcctgcagccatcagcggtgtcacggtcatggtcgctgcgctcggcgggaccccggtcagatggaggccttcctgcacctatggcctgatgggtctcttggcgattggaagtcatttagctgtcactgttattgggggtgggctggtccaacgtgtcaggagcccagaccggggccgaaagaggctgtctag

SEQ ID NO: 120280 - DNA, 507 bp, Artificial Sequence
  Description of Artificial Sequence: Synthetic coding sequence
atgcttccccctgctcaccaccaggccttcgtacgtcataggttggaggaagccttccgggttgcactggtgggtcatcggcacccactccccgtgctcgcatacgtacgcctgactcaccgccgcagtggcagattccttagccaggatgatttggtacaatccattggcgtctcagccgcgctcggggccgccggcgttgtcctgtggggggacctgagtctgagctcaagtgaggaagagtgttggcacttacatgactacttggtggacaccctggggccttacgtcattaacgtgacgagagccgctatggcatgctcacatcagagatgtcatggccatggaagatgcgcccggagagatccagggcagatggaggcctttctgcatctgtggcctgatggatccctgggcgattggaaatccttctcgtgccattgttactggggatgggcaggtccgacatgtcaggaacccaggcctgggcccaaagaggccgtgtag

SEQ ID NO: 120281 - DNA, 483 bp, Artificial Sequence
  Description of Artificial Sequence: Synthetic coding sequence
atgactacccagttgggccctgctcttgtgctaggggtagctttgtgtttaggctgcggtcaaccgctgcctcaggttccggaaaggcccttctccgtgctgtggaacgttccaagcgcacactgcgaagctagattcggcgtccatttgccgctaaacgccctcggcatcatcgcaaaccgtggacagcattttcacggccagaacatgactatcttttataaaaaccagcttggattgtatccttactttggcccccggggaaccgctcacaacggaggtatccctcaagccttgcctctagatagacatttagcactagctgcataccaaattcatcactcgctccgccccggattcgccggccccgctgtcctggactgggaagagtggtgccctttatgggctgggaactggggcagacggcgagcttaccaggcggcatcttgggcctgggcacagcaagtatttccggacttgtag

SEQ ID NO: 120282 - DNA, 1164 bp, Artificial Sequence
  Description of Artificial Sequence: Synthetic coding sequence
atgactactcagctcggaccagccctggtgttgggggtggctctgtgcctgggctgtgggcagccgctccctcaggttcccgaacggccgttttctgttctttggaacgtgccttccgcccactgtgaagccaggttcggagtgcatcttcctttgaatgccttagggatcatcgcaaacagggggcagcattttcatggccagaatatgactattttctataagaaccagctcggactgtacccttatttcggccctcgcgggacggctcacaatggtggcattccacaggccttgccactagatagacacctggctctggcagcctaccagattcaccacagcctgcgccccgggttcgctgggcccgccgtgctcgattgggaggaatggtgcccactttgggcgggaaattggggtaggaggcgggcctatcaagctgcgagctgggcctgggcccaacaggtctttccagatcttgatccacaggagcagctgtataaagcgtataccggctttgaacaggccgcacgagccttaatggaagatactctgagagttgcccaggcattacggccacatggcctctgggggttctatcattatccagcatgcggaaacggctggcactccatggcctccaattacactggcaggtgtcatgccgccactctcgcaaggaacacccaactacactggctgtgggctgcctcaagcgcgttgtttcctagtatatacctccccccacgactgcccccagcacatcaccaggccttcgtgagacaccgcttggaggaggcattcagggtggccctggtcgggcaccgccatcctttgcccgtgctggcctatgtcagactgacacacaggcgcagcggccgtttcctatcccaagaggaatgctggcatctgcacgactacttagtggacactctgggaccctacgtcattaacgtgactagagccgccatggcgtgttcacatcagcgctgccatggccacggccgctgtgcacgccgcgatcctggacagatggaggccttcctacatttatggcccgatggatccttgggggactggaagtccttttcttgccactgctactgggggtgggcaggccctacctgccaggagcctcggccaggaccaaaagaggcagtgtag

SEQ ID NO: 120283 - DNA, 417 bp, Artificial Sequence
  Description of Artificial Sequence: Synthetic coding sequence
atgctacctcctgcccaccaccaggcgttcgtgaggcaccggcttgaagaagcctttcgtgtggccctcgtagggcatcggcatccattgcctgttctggcctacgtaagactgacccatcggcggagcggccgattcctctcacaggaggaatgttggcacttgcatgactatctcgttgatacccttgggccgtatgtcatcaacgtcacccgcgctgcaatggcttgttctcatcagagatgtcacgggcacggcagatgtgccaggcgagatccaggacagatggaggccttcctacatctgtggcctgacggcagccttggggattggaagagcttttcgtgtcattgttactggggatgggccggccccacatgccaggagcctcgtcccgggcctaaggaagccgtctag

SEQ ID NO: 120284 - DNA, 1518 bp, Artificial Sequence
  Description of Artificial Sequence: Synthetic coding sequence
atgagtagtgtacaacaacagccgccccccccccggcgcgtgacaaatgtgggtagtttactgcttacaccccaggagaacgagtcactgttcacctttttggggaagaaatgcgttacaatgagctcagcagtagtgcagctctatgccgccgatcgtaactgtatgtggagcaagaagtgtagcggagtggcctgtctggttaaagataatccccaacgaagctactttctgagaattttcgatataaaggatggaaaactgttgtgggaacaggagctgtataacaactttgtctataacagtcccaggggttactttcatacctttgcgggcgatacttgtcaggtggctcttaattttgcgaatgaagaagaagcgaagaagttccggaaggcagtgactgaccttctcggcagacgtcaacggaagagcgagaagcgaagggatcccccaaatggccccaatttgccgatggcaacagtggatataaaaaaccccgaaattacaacgaatcgattctacggcccacaggtaaacaatatatcacacacaaaggaaaagaaaaaaggaaaagccaaaaagaagcggctcactaaggcagacatcggaacccctagcaatttccagcacattggccatgtcgggtgggaccccaatacaggttttgatctgaacaatcttgacccggagctgaaaaatttatttgatatgtgtggcattagcgaagctcagctcaaggaccgagagacatcgaaagtgatctacgatttcatcgaaaagaccggcggggttgaagctgtgaaaaacgaactccggaggcaggccccccctcccccgcccccctcccgagggggtccccctcctccgccacctcccccacacaactcaggccctccaccacccccggccagaggtcggggagcgcccccaccacctccctctagggctccaacagccgcccctcctcctccaccaccctctcggccctcggtcgctgtgcctccgcctccaccaaatcgcatgtatccgcccccccctcccgctttgccctctagtgcaccaagcgggcctccacctccaccaccgtccgtactgggcgtggggccagttgccccccctccaccaccccctccgcctcccccaccaggaccacctcctccaccaggtctcccctcagacggtgatcaccaagtgcctaccacggccgggaacaaggctgctttgctggaccagatccgggagggagctcaactcaaaaaagtcgagcagaacagtaggcccgtctcttgctccgggcgagacgccctgctggatcagattagacaagggatccagttgaagtccgtggcagatggccaggagtccacccctccaacaccagcaccaacatcaggaattgtcggtgctctaatggaagtaatgcagaagagatcgaaggccatccactcatctgatgaagatgaagacgaggacgatgaagaagatttcgaggacgacgatgaatgggaagactag

SEQ ID NO: 120285 - DNA, 1446 bp, Artificial Sequence
  Description of Artificial Sequence: Synthetic coding sequence
atgaaagtgctgtcggaggggcagctaaaactgtgtgtggtgcagcctgtgcacctcacatcctggctgctgatcttttttatcctcaaatcaataagctgtttgaaacctgcgaggctccctatctatcaacggaaaccatttatagctgcatggaacgctccaactgaccagtgccttatcaaatacaacctcagactgaacttgaaaatgtttccagttatcggttctcccttggcgaaagcgcggggtcagaatgttaccatcttttatgtcaaccggctaggatactacccttggtataccagtcaaggtgtgcctattaatgggggcctgccccagaatatctcactacaggtgcacctggaaaaggcggatcaggacatcaattattacattccagcggaagacttttctggtctggccgttattgattgggagtattggcgtcctcagtgggccaggaactggaatagtaaggatgtgtaccgacagaagtcacgcaagcttatctctgatatggggaagaatgtttctgcaactgacatagagtacttagcaaaggtgacattcgaggagagtgccaaagccttcatgaaggaaacaattaaactgggtattaagagtaggcctaagggactgtggggatattacctgtatcccgattgccataactataatgtttacgccccaaactactcggggtcctgtcctgaagacgaggtcctaagaaacaacgagctgtcttggctctggaattcttcggccgcattataccccagcataggggtatggaaatcactgggggattcggagaacatcctacgtttctccaagttccgagtccatgagagtatgcgcatatccacaatgaccagtcacgattatgccttgcctgtgttcgtgtataccagactgggatatagagatgaacctttgttctttctctccaaacaggatcttgttagcaccatcggcgagtcggccgccctgggtgcggcggggatcgtgatctggggagatatgaacctgaccgcgtctaaagctaattgtaccaaagtgaagcaatttgtgtcatctgacctcggctcttatattgctaacgtcactagagctgccgaggtgtgctcccttcacctgtgtcgcaacaacggtagatgtatacggaaaatgtggaatgcccctagttacctgcatctgaatccagcctcataccacatcgaagccagcgaggacggagagtttaccgtcaagggaaaggcatctgacaccgacctggccgtgatggcagacacattttcttgtcactgttatcagggatacgaaggcgccgattgtagagagatcaagaccgcggatggttgtagtggggtgagcccatctccggggagtctgatgactctttgtctgttgctgcttgcgagttaccgcagcatccagctgtag

SEQ ID NO: 120286 - DNA, 138 bp, Artificial Sequence
  Description of Artificial Sequence: Synthetic coding sequence
atgaaagtactcagcgaggggcaactgaaattgtgtgtggttcagcccgtgcacctgactagctggctgctgatattttttatcctcaaatccatctcctgccttaagcccgcccgactgccaatttatcagcggtag

SEQ ID NO: 120287 - DNA, 192 bp, Artificial Sequence
  Description of Artificial Sequence: Synthetic coding sequence
atgaaggtgttaagtgagggtcagctgaagctttgtgttgtacagcccgtgcatttaactagttggctcttaatcttcttcatccttaagtcaatcagttgtctgaaaccagcccgcctccccatctaccaaaggaagccattcatcgctgcttggaatgctcctaccgaccagtgtctgataaagtattag

SEQ ID NO: 120288 - DNA, 15366 bp, Artificial Sequence
  Description of Artificial Sequence: Synthetic coding sequence
atgaccagtaggagactggaagaatccatgggcgcggtacagatgggcctggttaacatgttcaaggggttccagtctaaggttctacctcctctttcgcccaaggtggtgaccgaggaggaggtgaatcgtatgctgactccatccgaattcctaaaggagatgtccctcaccaccgagcagaggttggccaagaccagactgatgtgccgaccacaaatcatcgaattactcgatatgggggaaaccactcaccagaaattctcaggaatcgatctggaccaggccctgttccaacctttccccagcgagatcattttccaaaactacacaccatgtgaggtgtatgaggtcccccttatcctgcggaacaacgataaaattccccgccttgtgaaggttgtcgaagagtcaagcccgtatttcaaagtgatcagccccaaagacataggacataaagtcgctccgggcgttcccagcatctttaggattctgtttaccccagaagagaacaaggactacgcacatacactgacatgcgtcaccgagagggaaaagttcattgtgccaatcaaagctcgtggagctagggcaatcctcgatttcccagacaagctgaactttagtacatgtcctgtcaagtatagtactcaaaagattctcctggtccgcaatattggaaataagaacgcagtgttccacattaaaacttgtagaccgttctccattgagcccgccatcggcactctaaacgttggagagtccatgcagctggaagtcgagttcgagccccaaagcgtgggcgatcatagcggtcgcctgattgtgtgttatgacaccggggaaaaggtgttcgtgagcctgtatggcgcagccattgacatgaacatccgactcgataagaattccctcacaattgagaagacctatatcagcctggcaaaccagagaacaatcacaatccacaatagatcgaacatcattgcacattttctgtggaaagtgtttgcaactcaacaagaagaagaccgggagaagtacagggcctgcgatgacctcatcaaagaagaaaaggatgagacagatgagttttttgaggaatgcatcaccgacccgctgcttagagaacacctgtcagtgctgtcacgcacattcgctaaccagaggaggttagttcagggtgattcgaagctgttttttaataacgtctttactgtggagcccttggaaggcgacgtctggccaaattcatcagcagagatcaccgtgtatttcaatccactggaagccaagctctaccagcagacaatctattgtgacatactgggcagagaaatacgcctgcccctcagaattaaaggcgaaggaatggggcctaaaatccacttcaacttcgaactgctggacatcggaaaggtctttaccggctcggctcactgttacgaggcaatactgtataacaaaggatcaatcgacgccctgtttaacatgacgcctccaacctccgcacttggggcatgttttgtgttctctcctaaggagggaattatagagcctagcggagtacaagctatacagatctccttctcctctactatcctcggaaacttcgaagaggaattcctcgtgaatgtgaacggctcccctgagcctgtgaaactcacaatccgcggatgtgtgatagggcctacttttcattttaatgttccagctctgcatttcggtgatgtttcattcggatttccccacaccctaatctgctccctcaataatacctcactgatcccaatgacttataaactgaggatccctggcgacgggctggggcacaagtctatcagctattgcgaacaacatgtagactacaagcggccaagttggacgaaagaggaaatttcttccatgaaacccaaagaattcacaatttctcctgactgcgggaccattaggccacagggctttgcggcaatacgagtgacactgtgctcaaacaccgtccagaaatacgagctcgccctggtcgtggacgtcgaaggcataggggaagaggtattagctcttctgatcactgctcggtgtgttgtccctgcgctccatctggtgaatacagaggtggattttgggcattgctttttaaagtacccgtatgaaaaaactttgcagttggccaatcaagacgacctccccggattctatgaagtgcagccacaggtgtgtgaggaggtcccaacggtgctctttagctctccaactccaagtggtgtaatctccccatccagtaccattcatatccctctggttctggagacccaggtaaccggcgaacatcgcagcaccgtgtacatctcaatctttggctctcaggacccgccgcttgtgtgtcacttgaagtctgccggcgagggccccgttatctacgtgcaccctaatcaagtagacttcggcaatatatatgtgctgaaggactcaagccgcatactcaacctgtgtaaccagtctttcatcccagcgtttttccaggcacatatggcgcacaagaaaagtctgtggacaatagagcccaatgaggggatggtccctccagagacagatgtgcaactcgctctgaccgctaacttgaatgatacccttactttcaaagattgtgtgattctggatattgagaacagcagtacctatcgaatccctgtgcaggcttctggaaccggctccacaatcgtgtccgataaaccttttgccccggagttgaatctaggcgcacactttagcctagatacgcattactaccattttaagctaattaacaaagggcgtcgcatccagcagctgttctggatgaatgacagtttccggccccaggcaaaactgagtaaaaagggaagagtaaaaaaggggcacgcgcatgtgcaaccgcagccaagcggcagccaagagcctcgcgacccacagagccctgtttttcacctacatcctgctagtatggaactttaccctggccaggcgatcgacgtgattcttgagggatatagcgccactccacgtatcgtgaaagaaaagttagtttgccatgccatcatcggagcacaaaagggtaaatccctcgtcatggctgtgaacatcacgtgcgagttcgtggctcccctgatccagctgagcacaaagcagctgatctaccgactagagaagaagcccaattccatcctgaaacctgactaccaaccactcgccataaagaatatcagtaccctgcctgtcaacctgttgctgagtactagcggaccattttttatttgcgaaacggacaaatcccttcttcctgctactcctgagccaattaagctggagatcgacgaagagaagaatctgcttatcaaatttgaccctagttatcgaaacgacttaaacaactgggttgctgaggagatcttggctattaagtacgtggagcatccccagatagactccctggacctccgtggggaggtccactaccccaatttgtctttcgaaactaaagagttagatttcgggtgtatcctgaacgacactgagttgatcagatacgttacaataacaaactgttcacccctggtggttaagttccgctggttctttctagtgaatgacgaggagaaccaaatacgatttgttactctgcctaagaagccttatagtgcccccgtgtcccagatggaatctattccagccaccagtgaggccgcaagcccccctgctatcctcgtgaccgttgagtcccccgagatggacttaaacgattttgtcaagactgtgctggtggatgaggacgcaaggcctgaggagaaggagctgagaaaaaccaaggccagttcagtcatatccgatgagataaagatatcatctactgaaatcgagagaatctatagttcccaatcccaggtggaggaccaggagtctcttcagacctgcgaacagaatgagatgctgtctattggaatcgaagaggtgtttgatatcttgcccctattcggcgtcctgcaacctcatagctcccatcagatctcctttaccttctacgggcatgcaaacatcatcgctcaggccaaagctctgtgcgaagtggaggaaggtccgacatatgaaatcacactgaaaggtgaggcttcattggtgaactactctttcgatacgaaggacattcactacggtcttcaactgttcgaccacgtcactgagagggaaataaccctgactaatatgggaaaggtggggttcgaatttaaagtgctaaccgaccaccagagtagtcctgacaaccttcttcctggtgtgcctctgatcttgccggtgtcggggttcatttcttcacatcaggagcaagtactgaaggtctattatctacccggcgtccctgaggtatttaaaaggagctttcagattcagatagcccacctggatcccgagaacattaccttgagtggcgaggggatcttcccacagatttgtttggaccttcctcggaatctgactgcaaatgagaaatacgagatgttcttgaatcaggcacgtaagaatacagacaaggaatacaataagtgtgaaatgttggatcactttgatatcataacagaggaagtaccggaagacgagcccgccgaagtatccgcccatctgcagatggaagtagaacggctaatagtgcaatcctacgttctcgagcaccagaagactacaacacccgacccaatggacgatccgtgttttagccatcgctctcgacgaaagttggcaaaaattcagttacctgaatacattctggacttcgggtatattatcttgggagaagtgcgtacacatatcatcaagataatcaacacaagccacttccctgtgagcttccacgcagataaacgtgtcctccacgagaccgggtttagcacagaactcgaccgtgtaaaaaacctgccccattgcgaaaccgagatcttcgaggttaggtttgaccctcagggcgcgaacttgcctgttggctccaaggaagtgatcctcccgataaaagtggtgggaggtccaacagtgcacatctgcttgcaggctaaggttaccatacctactatgacactgtctagaggcaaggtcgactttgccaccatacagtgcggccaatgtttggtggaaacgattcagttgtctaatcacctgcaagtaccctgcgagtggttcgtacagagccagaaacctgtagacaagctggaaaaacacatgcctaaatatctcaggcagaagctgcgcgcggaacttaaacctaaaacacgcatctttgaaattcagccgatttctggggtcctggatcccggggaaaagtcgaatgtgcaagtaaaatttatgcccaaggaggaaaagttttactctcagacgctagtgtttcagatagctcagtctgcccagaagctgactctccttgccagaggccagggactcgaaccccgacttgaattctcaccttccgtgctggacctgggacccctgttactatgcgcccctggagacgaagctgaggtgatcgtaaaaaatccgtgcaacttccccattgagttctacagtcttgagttcgaccagcagtaccttatcgaggagaagatactaagaaaactcaagggttacgattcatataatacactattgcttccgcctaggaaccctggcgagaagctgccgcctgagctttacgaatatttcaaggaaattaaaaaaagtaaggaggagcaaatgagggccaagtatctcgagaatcttgcccaggaaaacgaagaggaggatattacgagtagcgatcaggggacctccaactcaaccaagaggacctctttgagcaggggcatcagtgtcacaagcaatcttgaggagtggcatgccctgctggtcgagagcaaaacttacctggaggaagaagaagacgaagagtcactggaaaagattatcttccagactgataagctacagtcgattgacagtcattcaatggaggaggtgggggaagttgagaacaatccggtatctaaagcaatcgcgcgacacctgggaatcgacatcagcgcggaaggtcgtctggccaaaaataggaaggggatcgcaatcattatacacgggacgcctttaagtggcaagtccgccaatgcagtaagcgttgccaagtactacaacgccgcttgtctcagcattgactccattgtgctagaggcggtggcgaatagcaacaacattccaggtattagggcccgtgaactatgtataagggctgctattgagcagtcggtgaaggaaggggaggaggccgcccaagaagctgcggttggccagaatgtgatcggccagggccggctgagtacagataccctgggcaaattagcaagcgaaatgacactggtggccccggaaatcaagccgggaaagagcgttcgaggctccgtggtgataactaagtcaaaggccgattcccacgggagtggaagccagaagcagcatcacagtcaccagtccgagacccctcagatcagctcttcacctcttccccccggacctatccatagatggctgtccgtctcgccgagtgtagggggcgagactgggttgatgagctgcgttctgcctgacgagctgttggttcaaatcttggctgagcgcatccagttgtccgattgctataggggagttgttttcgacggccttgacacccttttcgcccagaacgccgctgccgcattgctgtgcctcctgaaggccattggtagccgtgagcacatatacatcctcaatatggcacaggattacgctgcaatgaaagcccaggaaaaggctaagaaagagcaggaagagcgaaagcataagggggccttggagaaggaaaaggagcgtctacagaatatggatgaggaagagtatgacgcgctgactgaggaagagaaactgacttttgatagaggcattcagcaggctctccgggaacgcaagaagcgggaacaggaacgcctggccaaagaaatgcaggaaaaaaagctgcagcaggaacttgagcggcagaaggaagaagacgagttgaaacgcagggtgaaaaagggaaaacaggggccaatcaaggaggagccgccaatgaagaaatcccaggccgctaataaacaagtacccccactcactaaggtggatgtgaagatggaaaccatcgagcgcaaaatttccgtgagagaacagacaatgagcgaaaaagaggagcttaacaagaaaaagaggaatatgggcgatgtatctatgcatggactccctcttgtccaggaccaggaggacagcgaaggagacaacagcaaagaccccgataaacaactcgcccccaaattcaagacatatgagttgacactgaaggacgtgcagaacatcctgatgtactgggatcgcaaacagggggtgcaacttccacctgccggcatggaggaagccccacacgagcccgacgatcaacggcaagtccccctcggcggccggcgggggcgaaaagacagggagagagagcgactggaaaaggagagaactgaaaaagaacgtttagaaagagaaaaagccgagagagagcgcttagagaagctgagggctctggaagaaagaagcgattgggaaggagagggcgaggaggatcatgagggtaagaaagagaaagaccttggcgtcccgttcctggatattcagaccccggattttgaaggactttcttggaagcaggccttagagtctgataaactgcccaagggcgagcaaatcctggacattctgggcctgggcgcctcaggcccccctatccctccacctgccctgtttagcatcgtctcctatcctgttaaacggccaccccttactatgaccgatgacttggagcattttgtgtttgtaatccctccgagtgaagacatctcactcgatgaaaagaaggagatggaaatagaatctgattttttggcaacaaccaacacgactaaagcccaagaggagcagacctcctcctcaaaaggcggcaaacaaaagatgaaggaaaagatagatcaagtattcgagatccaaaaagacaagcggcacatggctctgaaccgcaaggttctttctggcgaacccgccggaactatctcacagctgtcagacactgacctggacaacttcaatggtcagcattcgcaggagaaattcactcggctaaaccacttccggtggatcgtgccagccaatggagaagtgaccctgcaggttcattttagctccgatgagttcggcaacttcgaccaaacattcaacttcgagatcttagggacatgttgccaataccagctttattgcagaggaatttgtacatatccatatatatgtcaggaccctaaggtagtgtttcctcagcggaagatggatatgaaaacaaacgaggttatatttaaaaagtatgtgatgtcgacagagacatactacttcgggcctctcctttgtggtaagtcccgtgacaagtacaaaagctccctcttccccggcaacatggagactctgacaatcctgaacaccagcttaatggtggtggaagccagtttttacttccagaatgacgtgaaggccaatacctatttcctggaaccgaataccatggtcctcaaaccaaatgagaagcagattcttaatgtttgggcctacccaacatctgttggcgtgtttgaagacagtattgtttgttgcatcaacgataaccccgaacctgcaatattccagctttcctgtcaagggatccgaccggagttagagttggaacctagacaacttcactttgataggctcctcttgcacagacaagagtcaagggtagttctgctccggaacgtcactctacttcccgtggcctggagaataacgtccctggagcatctgggcgatgattttacagtgagcctgatgcaaggcacaatcccccctgaggccgaatacggtctccatctatacttccagccaacgaagccagttaatattaagaaggccatcaggctcgaagtcctggacgctgaaaaccttctgggcgtggtgcagatagaaaacatcatggtctttgccgaagcctatgacatcgccttggatataacattccctaaaggcgcggaaggtgggcttgattttggcattgttcgcgttactgaggaggccaagcaacccctgcaattaaagaatcgtggcaaatacgagattgccttctcctttagtgtcgacagtgtgggcattagcactccaaacatcaattccatgatttctgtccagcccaagaaaggcagcctgacgccgacagaaaagccaactaatgtgcaagtcttctttcacgccaagaaggaggtcaaaatcgaacatcagcccgtgctgagatgccaaatcatcgagcccaatatttctgaaggcggggaaataatagcgtccatcccaattaagttttctgcgaacgccgtctactcgaagtacaacattacacctagctccgtaatcaatttcggcgctctaatttgtggtaccaggaagtcaaccacatttaccattgaaaaccaaggagtgactgattttaagtttgcactttataaactgaccggcgagagtccaatccaccaaaagaaggctgccagtcatgtgcggcacgccaggtcgagagagtctgagagtttttacaagaccggctcatctcgggccgcaaaattttcagacaccatccagaaagaggtgaccacaaccggccaggcgcgtttcgcccatggaatgtttacagtttaccccggtttcggaagtatccctagtgggggacagcaggtgataaacgtggactgcgttgcagacgccatgggtaagtgtgaagaatttattgccattgatatctctggccgcgatcctgctgtacatccagcaggcattctttataccctgttggcagaggcctgcctccctgcctttgtcaccgaaaataatgcattgatcttcgaagaacaccaaatttgtacatctgctaatctgcaccatattctccagacaatcgaatctgggggtctgttcgtggaagacgagaataagtttattttctgtaatgtcctcgtcggcagacaggctaaagcgcgcttcaaaatatctaatgttgggaagatcacttgtgatgtgaacatcgtagttcggccaatctcaaataaaccatttgctcgaattgtggacatatttgaggtcgagccctcaaagatgtgcatcgctagccactcccacgcctttgctactgtatccttcactcctcaaatcatgcaaaattatcagtgtatattcgaggcaaccttagacggcttgccttcaaccctcgccaaatcccgcgggctggtcttcgatattgccggcgagggaaatctcccgagggtgactgtggtcagaccagtcctccacaaccagtatgggaaccctctgctgctctttaagagactgctgctgggtcattcggaaaaactgccattgattcttaagaacaatggggtgctccctgcccaactgcacgttgatctccaagatgagctgggtgtgttcagcctaaaggggagaccgacaactgcttatatatacatcaccgaagagaataaaccgcatgtgaaagcaaaaaaagctcatacagcctcccttgtggtgagtcctggggatactgccgagtttgatgttgtgtttcacagccagaaggttggccgcatgcgcggtataatccatctgtctgtgataaataaccagtacgaggaaacgagcattcatatggtcggcgaaggttacgaggatgacataactttggacaacatacacggcctcgtggcaccaacctctcaggaggatattagcattagtgaatttaccgaaattatcgaagataacgacatggaggatctggtggccgctgctctcgtggatcacattcaattcggcgactgtcacattggtcacagttataatgctagcttcaccgtgaccaatcattctcaggttaaccttattcgctttgagtggcctgtttctgcaacaatcgcattctctcctcaaatgggacacctgcatccaggctgtgcaaaggatattgtcgttacgatgaagtccgatgtacctatcaatttgaagaacatgcgtatccgctgcaaactgagcagaataatgtttcagctgccagcggaccaagttcccgattgggacgatcgtatgcatacagtcaaatgggtggacgtacccaggaacatgcccgggacctttacaaccaaacgcaaggtcatcgaaacggatcccgaacctgcacactcagttttggaggaaaattaccaagagctgcaacttcagatatctgctaacgtcgatttcgcttcatatcactgtcaggctcgggatgtgcggttcaaggaaacgctcgtataccagaccagagtcttcgaatttgatgtgatcaacagcgggcgggtacaactcgagttttcatgggtctccgaagacactagcaaggcagtgtcttttgccaagcctgaccaccagggctcggctcagaaggaccagttatcacaggggacaatgcacacagggagcacactcgacagcacgatggaccactgggctgaaggttctccacagcctttctccgtcgaacccagttccggaattgtcccggtgggtaaaatccagaagttcaaagtcaagttcagcccactcgatatcggggacttcgagagcaacctcttttgtcagatccctaaccttccacccggggaacaaggtcccgtgttggtagcaaagggcaggagtacccttccgatctgccacttcgacctgaaggactcggattacattagcggacaccagcggaaccccgagctgcgggggtccagcgggggtgcactggaccccaacacccgggtgattgagttcactacagtggggatcggagggaaaaacctaagaacattcacaatcctcaatccaactaactcaacatattctttctgctggatctccgaggagattgaatccctgcagaaccctgcagcatttacctgtctcacagaaaaaggcttcatccatccggagaagaaggcggaaatagtgttccagttcacgccctttcacctgggcattactgaatcctcctggacctttctgataccagagcacaatataactgttccgtttctcctggtcggtaaaacgactgagcctttgatctctctcaacaaaagtcatctgaatttttccagtttgctgatcggaagggaggctcgggaaacggtgcagatcatcaacaaggaagagcaggggttcgatttcagtttccaggataatagcagatacagcgaaggcttctccaactctcttctggtgtgcccgatggaagggtggatccctccccttagtcgttttcctatagacatctttttcaccccaaaacaggagggtgatgtgaacttcaatctgatttgtaatgtggaaaagaaggtacatccagtaactttaaacgtaaaggctgagggctacaccatgaacgtggagataaagtgcaaagatcgtacaggatccatcactttattgacccccaatcagaccaatattatcaatttctatgaggtggaactcaacgagtgcgtgcagtgtgaatttaactttattaacacgggcaagtttacctttagttttcaggcccagctgtgcgggtcgaagactctccttcagtaccttgaattctctcccatcgattccactgtggacgtcggacagagcgtacatgcaacattgtccttccagccactcaagaaatgtgttctgactgacttggaattaattatcaagatttcgcacggccctacctttatgtgcaacatctctggttgcgctgtatctcctgctatacattttagtttcacttcttataattttggcacctgttttatttaccaggccggaatgcccccgtacaaacagaccctcgtaatcacaaacaaggaggaaacccccatgagcattgattgtctgtacacaaacaccacccacctcgaggttaatagcagagtagatgtcgtgaagccggggaatacactggaaatccctattaccttttatccacgggaaagcattaattatcaggagctgatcccttttgagataaatggtctgtcacagcaaacagtggaaattaagggaaagggaaccaaaatgaagatacttgtcctcgacccggcaaataggatagtgaagctgggcgccgttctaccagggcaagtggtgaagaggactgtctcaatcatgaacaactccttggcccagctcacctttaaccagtcgatcctatttaccattccggagttacaggaacccaaagtgctgacccttgcaccattccacaatataaccctaaaacctaaggaagtttgtaagctcgaagttatttttgccccaaaaaagcgggtcccccccttcagcgaggaagtgttcatggaatgcatgggtctgctgagaccactgtttttgctatcaggatgctgtcaagccttggagatttcccttgaccaggagcacattccattcggcccagtcgtgtaccagactcaggccactagacgtatcttgatgatgaacaccggggacgttggtgctcgatttaaatgggatatcaaaaagtttgagcctcacttctccatttcgccggaggaggggtacatcacctcgggcatggaagtgtcctttgaagtgacttatcaccccacagaagtcggcaaagagtccttatgtaaaaacattctctgttatatccagggagggtctcctctttcactaacgttgtctggggtctgcgtcgggcctccagcagtcaaagaagtggtgaacttcacatgccaggtccgcagcaagcacacccagactatccttttatccaacagaaccaaccagacatggaacctgcacccaattttcgagggtgaacattgggagggtcccgagttcattactctggaggctcaccaacagaataagccttatgaaataacctaccggcctcggacgatgaatctggagaataggaagcaccagggaaccctgttttttcctctgccggatgggaccgggtggttgtacgcattgcatgggactagcgagctgccgaaagcggtggctaatatctatcgagaagtgccgtgtaaaacaccctacaccgagctcctgccgatcacaaattggctcaacaaaccccagcgctttcgcgtcatcgtggagatccttaagccagagaagcctgacttgtccataactatgaaggggctggattacatcgacgttctgagcggtagtaagaaggattacaaactcaatttcttcagtcacaaagaaggcacatacgccgccaaagtaatcttcaggaatgaggtgaccaacgagttcttgtactacaatgtcagctttcgcgtgattccctccggaatcataaagaccattgagatggtgacccccgtgagacaggtggcttccgcctcaattaagctggaaaacccgctcccctattcagttacgttctcgactgagtgcagaatgccggatatcgctctcccgagtcagtttgttgttcccgcgaactccgaaggcacattttctttcgagtttcagccgctgaaggctggcgaaaccttcggccggcttacattgcacaacaccgatttaggttactatcagtacgaactgtacctgaaggcgacaccagctctgccagaaaagccagttcattttcaaacggtcctagggtcctcccaaataatcctggttaagtttataaactatactcgccagagaacagaatactattgtcgtacagactgcacagattttcacgctgagaaactcatcaatgctgctcccgggggccagggtgggacggaagcctctgtggaggttttgtttgaacccagccacctcggagagaccaaggggatacttattctgtccagtttggccggtggtgagtacattattccactctttggaatggcgttaccgccgaaacctcaggggcccttttccatacgggccggatactctatcatcattccctttaagaacgtcttttaccacatggtgaccttcagcatcattgtcgacaatcccgccttcacaatcagagccggcgagtccgtgcggcctaagaagatcaataatattactgtcagctttgagggcaatcctagcgggtccaaaacgccgatcaccaccaagctgacggtgagttgccccccaggagagggaagtgaaactggtgtcaaatgggtatattacctgaaagggatcaccctgtag

SEQ ID NO: 120289 - DNA, 2853 bp, Artificial Sequence
  Description of Artificial Sequence: Synthetic coding sequence
atggaatcagccggagggttcaaattgggtatggagcctctcagcgggggcggcgtctgcgaaaaaaagaagttactgaagatgacaagtcgccgcttagaagagagcatgggggcggtgcagatgggcctcgtcaacatgtttaaaggtttccaaagcaaggttttgccccccctgagccccaaggtggtcacagaggaggaagtgaatagaatgttaaccccatcagaattccttaaagaaatgtccctcacgacggagcaacggctagccaagaccaggctcatgtgccggccccagattatcgagttgcttgatatgggcgagaccacccaccagaagttcagcgggatcgaccttgaccaagcattattccagcccttccctagtgaaattatcttccagaactataccccgtgtgaggtttacgaggttcctttgattttacgaaacaacgacaagatccctagattggttaaggtggtcgaagagagtagcccatactttaaagtcatcagtccgaaggatataggccataaggtagctcctggagtgccgtctatttttcgcattttatttacaccggaagaaaacaaggattacgcacatactttgacatgtgtcactgaacgtgaaaagttcatcgtccctattaaggcaaggggggcgagagcgattctcgactttcccgataaattgaatttttccacctgtcctgtaaagtacagtacccagaaaatccttctggttcggaacatcggtaataagaacgcagtttttcacattaagacatgtcgaccattcagcatagaaccagccattggcaccttgaatgtcggcgaatccatgcaactcgaagtagagttcgaacctcagtctgtaggagaccatagcgggcgtctgatagtgtgttacgacacgggcgagaaggtgtttgtgagcctgtacggtgccgccatcgatatgaacattagattggataaaaattccctgacgattgaaaaaacgtatatcagtctggccaatcagaggacaatcacgatccacaatagatccaacatcatcgcccattttctatggaaagtctttgctacccaacaagaggaagatagggagaaataccgggcctgtgacgacctgatcaaagaggagaaggacgaaacagacgagttcttcgaagagtgcataacagatcccctgttgcgcgagcatctgagcgttctatcaagaaccttcgctaatcagcgcagactcgtacaaggagattcaaagctgttctttaacaacgtgttcacggtcgagccactcgagggagatgtgtggccaaactctagcgctgagatcacggtgtacttcaacccgctcgaagcgaagctctaccagcagacgatttattgtgacattcttggaagagaaattaggctccccctaaggattaaaggcgaggggatgggccctaagatacatttcaattttgaactgctggatattggaaaagtctttacggggtctgcacactgttacgaagccatcctgtacaacaagggctcaatcgatgcgctgtttaacatgacaccaccaacatctgctctgggagcatgcttcgtgttctctccaaaggaaggcattatcgaaccttccggagtccaagccatccaaataagtttctcatctactatcttaggaaacttcgaagaagagtttcttgttaacgtcaacggtagccccgaaccagtcaagctgaccattcggggatgcgtgatcggccctacctttcactttaacgtgcctgcactgcatttcggagacgtttcatttggcttcccacacacactcatctgttctctcaataacactagcctcatcccgatgacctacaaactgcgtattcctggcgacggactgggacacaaatccattagctattgtgagcagcacgtggattacaaacgcccgagttggacaaaggaagagatatcatctatgaaacctaaagagtttaccatctccccagactgtggcactatcagaccccaaggattcgccgctatcagggttacactgtgtagcaacaccgtgcagaagtatgaacttgcactcgtggtggatgtagaaggaattggggaagaagtgctggccctgctcatcacagctaggtgcgtcgtccccgctttacacttggtgaataccgaggtagatttcgggcattgctttctgaaatatccttacgagaagactctgcagctcgccaatcaggatgaccttccaggattctacgaggtgcagccccaagtgtgcgaggaggtgcccactgtgctcttctcatcaccaactcccagcggcgtgatctccccctcgtccaccatccatattccacttgtcctggagacacaggtgactggcgaacaccgcagcaccgtctacatttccatctttggctctcaagaccctcccttagtgtgccatcttaagtctgcgggagagggcccagtgatttacgtgcatcctaaccaagtggacttcggaaatatctatgtgctcaaggacagttctagaatcctcaacctttgcaaccaatccttcatccctgccttctttcaggcacacatggcacacaagaagagtctttggacaatcgagcctaacgaaggtatggtgccacctgagacagacgtccagcttgccttaactgccaacctgaacgatacactgacatttaaggattgcgtcatcttggatatagaaaacagctcaacgtataggattcccgtccaagcctctggcactggctcaactatcgtgtccgataagccttttgcccccgaactcaacctgggggcacacttcagatag

SEQ ID NO: 120290 - DNA, 2823 bp, Artificial Sequence
  Description of Artificial Sequence: Synthetic coding sequence
atggagtccgccggaggttttaagctaggcgagaagaagaagttgctgaagatgacatcacgaaggctggaagaatccatgggggcggtacagatgggattggtgaatatgttcaagggtttccagtcgaaggtgcttccccctctgagccccaaggtagttactgaagaggaggtgaaccgcatgctgaccccctccgagtttctgaaggaaatgagcctgacaactgagcagagactggcaaagacccgcctgatgtgccggccacagattatcgaactgctcgatatgggcgaaaccactcaccaaaaattcagcggcatagatttggaccaggcactgtttcagcccttcccctccgaaatcatatttcagaactataccccctgtgaggtgtacgaggtgccgcttatactaaggaacaatgataaaattccacgcttagtgaaagtcgtcgaggagagttcaccatatttcaaagtcatcagccccaaggacatcgggcacaaagtagctcccggagtgccgagcatattcagaatcctttttactcccgaggagaacaaagattacgcccacaccttaacttgcgtgactgaaagagaaaagttcatagtgcctattaaggctaggggcgcccgcgccatactcgattttccagacaaactgaacttcagcacctgccccgttaaatacagcacccagaagatcctattggtccgaaatatcggcaataaaaacgccgtattccacatcaaaacctgccgtcccttctcaatcgagcccgctatcggtacattaaatgtcggcgagagtatgcagctcgaggtcgagttcgagcctcagagcgtcggcgatcactccggacggctcattgtctgctatgacaccggcgaaaaggtgtttgtgtcgctctatggggcggccattgacatgaacatcaggttggacaagaattccctcacaattgagaagacctacatttcactggctaaccagcgcacgattacaatccataatcgctctaatattatagcccactttctttggaaggtatttgccacccaacaggaggaagacagagagaagtacagggcctgcgatgacttgataaaggaggagaaagatgaaaccgatgagttttttgaagaatgtatcactgatccacttctcagagagcacttgagcgtcctctcccgtacattcgcaaaccaacgaaggctggttcagggagactctaagttattttttaataacgtcttcaccgtggaacccctggagggagacgtttggcctaactcctccgctgagatcactgtgtattttaaccccctggaagcaaagctctatcagcagacgatttactgtgacatcctcggccgtgaaatccgccttcctctccgcattaagggggaaggtatggggcccaaaatccacttcaacttcgagctcctggacattggtaaggtgttcacgggatctgcccactgttacgaagccatactgtacaataagggcagcatagacgcactgtttaacatgaccccccccacaagcgcactcggagcatgcttcgttttttcgcctaaggaagggatcatagagccctcgggagtgcaggcgattcagattagtttctcttcaactattctgggaaacttcgaagaggagttcctcgtgaatgtcaacggctcccctgagcccgtcaagcttaccattcgcgggtgtgtgattggtccgacctttcacttcaacgtgcccgctctgcattttggagatgttagcttcggtttccctcacaccctgatttgctcacttaataatacaagcctgattcccatgacttataagcttcggatcccgggagatgggcttggtcataagtcaatcagctactgtgaacagcacgtggactacaagaggccctcatggactaaagaagaaataagcagcatgaagccaaaagagttcactatatcccccgattgtggcacaatccgtcctcagggatttgccgctatcagggttaccctatgtagcaacaccgtgcaaaagtacgagctggctttggttgtggacgtcgaaggcatcggcgaggaggtgttggcactgttgatcacggcgaggtgtgtcgttccagctctacacttggtgaacacggaagtagattttggccactgttttctgaaatacccttacgaaaaaactctacagttagccaatcaggacgatttgcccgggttctacgaagtgcagccccaagtgtgcgaagaggtgcccaccgtgcttttcagtagccctaccccctccggagtcatctcaccttcctccacaattcacatccccctcgtcttggagacccaggtgaccggcgagcacaggtccacagtgtatatatcaatctttggatcccaagatccacctttagtttgtcacttgaagtcagccggggaggggcctgttatttatgtgcacccaaaccaggtggacttcgggaacatatatgtgttgaaggactcatcccggatcctgaacctctgtaaccagtccttcatccccgctttttttcaggcacatatggcccataaaaagtctctttggacaatcgaacctaatgaaggaatggtgccgcctgagacagatgtgcaactggccttgaccgcaaacctgaacgataccctgactttcaaagactgtgttatcctcgatattgagaactcttcaacctatcggatccccgtccaggcaagcggaacaggatctacaatagtgagcgataagcccttcgctccagaactgaatcttggcgcccacttcaggtag

SEQ ID NO: 120291 - DNA, 15363 bp, Artificial Sequence
  Description of Artificial Sequence: Synthetic coding sequence
atgacatctcgaagactggaggaatccatgggggctgtacagatgggattggtgaacatgtttaaggggttccagtctaaagttctccctccacttagtcctaaggtcgttacagaggaagaggtgaacaggatgctcacgccctcagaattcttaaaagaaatgtctcttactaccgagcaaaggctcgctaagaccaggcttatgtgcaggccacagatcatcgaactgctggatatgggcgagaccacacaccagaagttttcgggaattgacctggatcaggcattattccaacctttcccgagcgaaatcatcttccagaactatactccctgcgaggtttatgaggtgccactcattcttcggaataacgacaaaattccacggctggttaaggttgtggaagagagttccccctactttaaagtgatcagtcctaaggacataggtcataaggtcgcccccggggtgcctagcatttttaggatcctgtttaccccggaggagaacaaagactatgcacatactctcacgtgcgtaaccgagcgagaaaagtttatcgttcctatcaaggcaaggggggcccgggccatcctggatttccccgacaagctgaacttctcaacttgccctgtcaaatacagtacccaaaagatcctgttggttagaaatataggaaataaaaatgcagtatttcacatcaaaacttgccggcctttctccatcgagccagcaattggcaccctcaacgtgggggaatccatgcagttagaagtggagttcgagcctcaaagcgtgggagaccactcaggacggctgatcgtatgctatgacacaggggagaaagtcttcgtgtcattatatggagccgccatagacatgaacattcgtctggacaaaaattccttgaccatcgagaagacttacataagtcttgccaaccagaggacaattacaatccataatagatcaaatataatcgctcatttcctatggaaagtgttcgctacccagcaggaagaggaccgtgagaaatatagggcctgtgacgaccttatcaaggaggagaaggacgagacggacgagttctttgaagagtgtattactgatcctctcctgcgcgagcacctcagcgttctcagtcgcacatttgctaaccagcgtcgcttggttcagggtgatagtaagctgttctttaataatgtttttacagttgagcctctcgagggcgacgtgtggccaaattcgtctgccgagatcaccgtatacttcaaccccctggaggcaaagctgtaccaacagacaatttactgcgacatactgggacgagagataaggctgccactcagaatcaaaggggaaggaatgggtccaaagattcattttaacttcgagctgctggacatcgggaaagtcttcaccggatctgcgcattgttacgaggccattctctacaataaggggtcaattgacgccctcttcaatatgactccgcccacttcagcgctcggcgcctgttttgtgtttagccctaaggagggcatcatcgaacccagtggcgtgcaggctattcagatttctttttctagtactatcctgggtaactttgaggaggaattccttgtcaacgttaacggtagccctgagccggttaaactcactatccgcggatgcgtaatagggccaacctttcatttcaacgtgcctgcactccacttcggcgatgtgtcatttggatttccacatacattgatttgtagcttgaacaacacgtcattgatcccaatgacgtataagctcagaatcccaggagacgggctggggcacaagtcaatatcttattgtgagcagcatgtggattacaagcgcccttcttggaccaaagaggagattagttctatgaagcccaaggagtttactatcagccccgattgcgggactatacgcccacagggctttgctgccattcgcgtgacactctgttccaacactgtgcaaaagtacgagctggccctcgtggttgatgttgagggaatcggcgaagaggtcctcgctctcttaattactgcacggtgtgtggttcctgcgctccacttagtgaacaccgaggtcgatttcggtcattgcttcttgaaatacccgtacgaaaaaacactgcaactggccaatcaggatgacctccctggcttctacgaggtccagccccaggtctgtgaagaagtgcctactgtgcttttttcttcccctactccttctggggtgatctcgccttcatctacaatccatatacccttggtcctggagacacaggtgacgggggaacaccgctcaactgtatatatttcaatttttggttctcaggaccccccattagtgtgccacctgaaaagtgctggagaaggcccggtgatctatgtacatccaaaccaggttgactttgggaacatctacgtccttaaagattcgagcagaatattaaatctgtgcaatcagtcttttatacctgcgttcttccaggcccacatggcacataagaaaagcctctggacaatcgaacccaatgaggggatggtaccaccagagaccgacgtgcagctggccctcacagctaatcttaacgataccttgactttcaaagactgcgtgatcctggacatagagaattcctcaacctaccgtatacctgtacaggcctcggggaccggcagtacaatcgtgtcagacaaaccattcgcccctgaactcaacctcggcgctcacttttccctcgacacccattactaccatttcaaactaatcaataaggggcggaggatacaacaattattctggatgaatgactccttcagacctcaagctaagctgagcaaaaagggacgcgttaagaaaggccatgcacacgtgcagccccagcccagcgggtcccaggaacctcgggacccgcaaagtcccgtatttcatctgcatccagcctctatggaattgtatccagggcaagcgatagatgtgattctagaaggctattctgccacgccccgaatagtgaaggagaagctcgtgtgccacgccattatcggggctcagaaaggcaaatccctggtcatggctgtcaatattacatgtgagttcgttgctccgctcattcagctgagcaccaaacagctcatttaccgcctcgaaaaaaagccaaactctatcctgaagccagattatcagcctctcgcaattaagaatattagtacattaccagttaacctgctgctatctacatccggaccattcttcatctgcgagactgacaagtctttgctacctgcaacccctgagccaatcaagctggaaatcgacgaggagaagaacctattaatcaagtttgaccctagctatcgcaatgatctgaacaattgggtcgccgaggagattctggccatcaaatatgtcgaacaccctcagatcgactcactcgatctgaggggcgaggtccactatcccaatttgagcttcgagactaaagagctcgactttggatgtattcttaacgatacagagttaatacggtacgttactattaccaactgttcacctttagtcgtaaaatttcgatggtttttcctcgtaaacgatgaagagaatcagatcagattcgttactctgccaaaaaaaccatactccgccccagtatctcagatggaatccattcctgccacaagcgaagccgcctcgccgcccgccatactggtcaccgttgaatcacctgaaatggaccttaacgactttgtaaaaactgttctcgtggatgaggacgccagaccggaggagaaagaactaagaaagacaaaagcatcctccgtgatatccgatgtacggtgcccgtttcacggagaggaaagaatctatagctcgcaatcccaggtagaggaccaagaatcgctgcagacctgcgagcagaatgaaatgctcagcatcggcattgaagaggtttttgacatattgccactcttcggcgtgcttcaaccccactcctcacaccagatttcttttactttctatggccatgcaaacattattgcccaggcaaaggccctgtgcgaggtggaggaaggcccgacctacgagattaccctcaaaggtgaagcgtcccttgtcaactattccttcgataccaaagacatccattacggtctgcagttgttcgatcacgttaccgaaagagaaattaccttgaccaacatggggaaggtcggttttgagtttaaggtattgacagatcatcaatcctctccggacaatttattgcccggtgtccctcttatccttcctgtgagcggctttataagttcacatcaggagcaggtacttaaagtgtactatctgccaggcgtacccgaagtatttaagaggagtttccaaatccagatcgcccatcttgacccggagaatatcactctatccggcgagggaatctttccccagatctgcctggacctgccacgaaacttgaccgccaatgagaaatacgagatgtttttaaatcaggcccgcaagaacaccgacaaagagtacaacaagtgcgaaatgttagatcacttcgatattatcaccgaggaggtgcctgaagatgaacccgctgaagtgtctgctcacctgcaaatggaagttgaaaggttgatcgtgcagtcttatgttctcgagcaccaaaaaactacaactccagaccccatggacgatccgtgtttcagtcatcgctcacggcggaaacttgcaaagattcaactccctgagtatattttggattttgggtatatcatactgggggaggttcggacccacataattaagatcattaatacaagccatttccccgtttctttccacgctgacaagcgggtgctgcacgaaaccggattctctacggaacttgacagggtgaaaaacttaccacactgcgaaactgaaatatttgaggtgagatttgacccccagggtgcaaatctgcctgtagggtccaaagaggtcatcctgcctatcaaggtagttggcggaccaacagtgcatatttgcttgcaggccaaggtgactatccctactatgacattaagtagaggtaaagtagactttgctacaattcagtgcggccagtgcctcgtggaaactattcaactttccaatcacctccaggtcccctgcgagtggttcgtccagagccagaagcccgtggataaactagagaaacacatgcccaagtaccttcgtcaaaaactgagagcggagctaaagcccaagacccgcatttttgagattcagccgatttccggagtgttagatcccggagaaaaaagcaatgtacaagtgaaattcatgccgaaagaagagaagttttattcccagacccttgttttccagatcgctcagtcagcacagaaattgacactcctcgcccggggacaaggcctcgaaccacggctcgagttttcaccgagcgtactggatcttgggcccctcctgctgtgcgcgccgggagacgaggccgaggtcatcgttaagaacccctgcaatttccccatcgagttctactcccttgagttcgatcaacagtatctgattgaagagaaaatcctaagaaaacttaaaggatacgactcatataacaccctcctgctaccaccgcgcaacccaggcgaaaagctccctccagaattgtacgaatactttaaggaaattaagaagagtaaagaagagcagatgcgagcaaaatatctggaaaatctggcacaggagaacgaagaggaggatattactagcagcgaccagggcacaagcaatagcaccaaaaggacctcactcagcagaggaatctccgtgacaagcaatctcgaagagtggcacgccctcctggttgagtcaaaaacctacttggaggaagaggaggacgaggagtctctcgaaaaaatcatttttcagactgataagctgcagagtatagattcccactctatggaagaagttggcgaggtggagaataatcctgtatctaaagcaattgccaggcacctgggaattgatattagcgctgaaggccgcttagcgaaaaaccgcaagggcatcgccatcattatccacggtaccccactgtccgggaaaagtgcgaatgccgtgtcggttgcaaagtattacaatgcggcatgcttgtccattgacagcatcgtgctggaagcagtcgctaatagtaataatatccccggaataagagcgcgcgaactctgcattcgggcagccattgagcaatcagtcaaggagggcgaagaggctgcccaagaagcagccgtgggccaaaatgtcatcgggcagggacgcctctccaccgacacactgggcaaacttgccagcgagatgacattggttgctcccgagattaagcctggcaagtcagtacgcggatctgtggtcatcactaagagtaaggccgacagccatggaagcggtagtcagaaacagcaccactcgcatcagtccgaaacccctcagataagctcttcgcccctgccgccagggccaatccatagatggctcagtgtttctcctagcgtgggaggtgagacaggcctgatgagctgcgtgctccctgacgaactcctcgtccagattcttgcggagcggatccagctcagtgattgctacagaggcgtcgtatttgacgggctggacactctgttcgctcagaatgccgccgccgccctgctttgtcttctcaaggctattggatccagggagcacatctatattttaaacatggcacaggattacgcagcaatgaaggcccaagaaaaagcaaaaaaggaacaggaggaaagaaaacataaaggagcattagagaaagagaaggaacggcttcaaaacatggatgaggaggagtacgatgccctgactgaggaagagaaacttacgttcgatagaggaattcaacaggccctccgtgagcgcaagaaacgcgagcaggaaagattggcgaaggagatgcaggaaaaaaaactacaacaggagctggaacggcagaaagaagaggatgagttaaaaaggcgtgttaaaaaaggcaagcaaggacccattaaagaagagccccccatgaaaaagtcccaggcggctaataagcaagtacctcccctcactaaggtagacgtgaagatggaaacaatcgagcgcaagatctcagtgcgggagcaaaccatgtccgagaaggaggaacttaacaagaaaaagagaaacatgggagacgtttccatgcatggattaccgttggttcaggatcaagaggatagcgaaggcgacaatagcaaagacccagacaaacagctcgctcctaagttcaagacttatgaactgactttgaaggacgtacaaaacattctcatgtattgggataggaaacaaggggtgcagttacctcccgctggcatggaggaggcacctcacgagcctgacgaccagcgtcaggtgcctttaggcgggcgccgcggccgaaaagaccgagaacgcgaacggctggagaaagagagaaccgagaaagaaagactcgaaagggaaaaggccgaaagagaacggctggagaagctccgcgctctggaagaacggtccgactgggagggtgagggtgaggaggaccatgagggaaagaaagagaaagaccttggagtgccgtttcttgatatacaaactccagactttgaaggtctgtcctggaaacaggctctggagtcagacaagctgcccaagggcgagcagatcctagacattctaggcctgggagctagcggtccgccaatccctcccccagcgctgttctcaattgtgtcctacccggtgaaacggccacccttaactatgaccgatgatctcgaacactttgtcttcgtgatcccaccctctgaggacatctctctcgacgagaaaaaagagatggagatagagagtgacttcttggccactactaacacaaccaaggctcaggaagagcaaacctcttctagtaaaggaggtaaacaaaagatgaaggagaagatagaccaggtgtttgagatacagaaagataagcggcatatggccctcaaccgtaaggtgttgtcaggggaacccgcaggaaccatttcacagctctccgataccgacctggacaacttcaacggtcagcatagccaggagaagttcacccgcctgaaccacttcagatggatcgtccctgcgaatggagaagtgacccttcaggtccatttcagctcggatgaattcggaaactttgaccagacattcaatttcgaaattttgggcacgtgttgtcaataccagctgtactgccgcggaatctgcacatacccctacatctgccaggaccctaaggttgtgtttcctcaacgtaagatggacatgaagactaacgaagtgatattcaagaaatacgtgatgagcactgaaacttactattttggcccattgctgtgtggcaagtccagggacaaatacaaaagttctttgttcccgggtaacatggagacgttaaccattctgaacacctcgcttatggtggtcgaggccagcttctacttccaaaatgacgtcaaggcaaatacctatttcttggagccgaacaccatggtcttgaaaccaaacgagaagcaaatcctcaacgtttgggcctatcccacatctgtaggcgtgttcgaagactctattgtttgttgtattaatgataatcccgaacctgcgattttccaactgtcctgccagggaatcaggccagagctggagttagagcctcgtcagttgcacttcgatcgactgctgctccatcggcaggagagcagagttgttctgctgcggaatgtgacactgctccctgttgcctggcgtatcacttctctggaacacctgggggatgacttcacagtcagcctaatgcagggtactattcctcctgaagccgagtacggcttgcacctttacttccaaccgacgaagcctgtgaatatcaaaaaggccatcagattggaggtactagatgcagagaacctgttgggtgtggtgcagatcgagaatatcatggttttcgccgaggcctacgacatcgcacttgacatcaccttcccaaaaggagccgaaggggggctcgatttcgggatcgtccgcgtcactgaggaagccaaacagcccctgcaattaaaaaacagaggtaagtacgagatcgccttcagttttagtgtagactcagtgggaatctctacgccaaacataaattcaatgatatccgtccagcccaaaaagggctccctaacgccaactgagaagcctacaaacgtgcaggttttctttcacgcgaagaaggaagtgaagatcgagcaccagcccgtcctgaggtgtcagattattgaacctaacataagcgagggcggtgaaattatcgcctccatcccaattaaatttagcgcgaacgcagtatacagcaaatacaacatcaccccctcatctgtgattaacttcggcgctcttatctgcggtacccggaaaagtactacttttaccattgagaatcaaggagtgacagactttaagttcgctctgtataagctgacgggggaaagtccaattcaccagaagaaagcagccagtcatgtgagacatgccagaagccgcgagtcagagagtttctacaaaaccggcagttccagagccgcaaaattctccgacaccatccagaaggaggtaacaaccaccggtcaggcccggttcgcacatggcatgttcacagtgtaccccggtttcggcagtatcccatcaggcggtcaacaggtgataaacgttgattgtgtggcagacgcaatgggtaagtgcgaggagtttatcgcaattgatatctccggaagggaccctgccgtacatcccgctggcattctctacacacttctggccgaagcttgcctgcctgcatttgtcacagagaacaacgctcttatctttgaagagcatcaaatttgtaccagcgccaatctgcaccacatcttgcagacaatcgaatcaggaggtctattcgtggaggacgaaaacaaatttattttttgtaatgtgctggtgggccggcaggctaaagctcgatttaagatcagcaacgtagggaaaatcacttgcgacgtgaatattgttgtacgcccaatctcaaataagccctttgcacgtatcgtggatatctttgaggtggaaccttcaaaaatgtgtattgccagccactcacacgcgtttgccaccgtgtccttcacacctcaaattatgcagaactatcagtgcatatttgaagcaactctggacgggcttcctagtactctggcgaagtccagagggttggtgttcgatattgcgggagaaggcaatctgcctcgggtcaccgtcgtgagacccgtgctgcataaccaatatgggaaccccctgctcctttttaagcgactgttactcggccactcggagaagctaccactgatcctgaaaaacaacggcgtcctgccagctcagttgcacgtagatcttcaggacgagctaggtgtcttttccctgaagggccggcccacaacggcgtacatctacattacagaggagaacaagccacacgtcaaagccaaaaaagctcacacagcttctctggtggtgtctcctggagacactgctgagtttgacgtggtcttccattcacaaaaggtaggccggatgaggggcatcattcatctgtccgtgatcaacaaccagtacgaggagacatccatccatatggttggcgagggctacgaagacgacatcacacttgataacatacacggtctggtcgctcccacaagccaggaggatatatcaatatcggagttcacagaaatcattgaagacaatgatatggaagatctcgtagccgccgcactggtcgatcacatacagttcggagactgccatatcggacactcttacaacgctagtttcacagtgactaaccactctcaagtcaacctgattcgctttgaatggcccgtgtctgctacgatcgccttctcgccccagatggggcatctccatcccggttgcgccaaagatattgttgtaacgatgaaaagcgacgtccctattaatctgaagaatatgaggattagatgcaaattgtctcggatcatgttccaactgccagccgaccaggtcccagattgggatgatagaatgcacaccgtaaaatgggtcgacgtccctcggaacatgcccgggacatttacaaccaaaaggaaagttatcgaaactgaccctgagcctgcccatagtgtgctcgaagagaactatcaggagctgcaactgcagatttcagccaacgtagatttcgcgagttatcactgtcaagctcgggatgtgcgctttaaggagaccctggtatatcagacacgggtgttcgagttcgatgtgattaatagtggtagagtgcagctagagttctcttgggttagcgaggacaccagtaaagctgtctcatttgctaagccagatcaccagggatcagcccagaaggatcaactgtcccagggcaccatgcacacaggctccaccctggactccactatggaccactgggcagagggcagcccacagcccttcagtgtggaaccatcaagcggcattgtgcctgtcgggaaaattcaaaaatttaaagtcaagttcagcccccttgacatcggggacttcgagagcaacctgttctgtcagatacctaacctgccacctggggagcagggccccgtgctggtagctaagggtaggtccactctcccaatctgtcattttgacctgaaggactcagactacatctccgggcatcagcggaatcccgaactacgtggctcatcaggcggagcgctggaccccaacacccgcgtgatagagttcactacagtgggtataggcggtaagaacttgagaacatttaccattttgaaccccactaattcaacttacagcttttgctggatcagcgaggaaattgaaagcctgcagaaccctgctgcttttacatgtctgaccgagaagggattcattcatcccgagaagaaagccgagattgtgtttcaattcactcccttccaccttggaattactgagtcttcgtggaccttcttgattcccgaacataatattactgttccgtttcttcttgtggggaagactacggagcctctcatttctttaaacaaatcacacctaaacttctcatcactgttaatcggaagagaggctcgggagacggtacagataatcaacaaagaggagcagggtttcgacttttccttccaagataacagtcgctattccgagggattctcaaatagtctactggtctgtccaatggaagggtggatcccccccctctccaggttcccaattgatatatttttcacgccaaaacaggaaggggatgttaatttcaacctcatttgtaatgtcgagaaaaaggtccaccccgtgaccctcaatgtcaaggccgagggatacacgatgaacgtagagataaaatgcaaagatcgaacgggttctatcacacttctcacgccaaaccagacaaatattatcaatttttacgaggtggaacttaatgagtgtgttcaatgcgagttcaacttcatcaatactgggaaatttacatttagcttccaagcccagctttgcggctccaaaacactactacagtatctggagttttcccctattgattcaaccgtggacgtcgggcagtcggtgcacgctactctgagttttcagccactgaaaaaatgtgtcctgacagatctcgagctaattattaaaatcagccacggaccaacctttatgtgtaatatatccgggtgtgcagtgtctccagctattcacttttccttcaccagttacaattttggaacctgtttcatttaccaggcaggcatgcctccttataagcaaactctggtaataacaaataaagaggagactcctatgtcaatcgactgcctgtataccaacacaacgcatctcgaagtgaattctcgggttgacgtagtcaaaccggggaacaccctcgaaattcccatcaccttctacccgagagagagcattaattatcaagaattgatacccttcgaaatcaacggcctctcacagcaaacagtagagataaaggggaagggtacgaagatgaagatcctggtgctcgatcctgctaaccgcatcgtgaagctcggagctgtgcttcccgggcaggtcgtgaagaggactgtatccattatgaacaactccctggcccagcttacctttaatcagtcaattcttttcaccattcctgaacttcaggaaccaaaagtgttaacacttgcgccattccacaatataacgctaaagccaaaggaggtctgcaagctcgaagtgatcttcgctccgaagaaaagggtgccccctttcagcgaggaagttttcatggaatgcatgggcctattacggcctctgtttttgctgagtggctgttgccaggccttggaaataagcctggatcaggagcatatcccgtttggaccggtcgtctaccagacacaggccactagacggatccttatgatgaataccggtgacgtgggcgccaggttcaagtgggacattaaaaaatttgagccgcatttctcaatttctcccgaggagggatatattacatcgggaatggaggtgtcgtttgaggtcacctatcatcctaccgaggttggcaaagagtccctgtgcaagaatattctttgctacattcaaggaggttcgccactctctctgacccttagcggtgtttgtgtgggcccaccggctgtcaaagaagttgtcaactttacatgccaggtgcgtagcaagcacacacagacgatactgctaagcaatcgcaccaatcagacttggaatcttcaccccatatttgagggagagcattgggagggcccagagtttattaccctggaggcccatcaacagaacaagccgtacgagattacatacagacctcggactatgaatctggagaaccgaaagcaccagggcaccctattttttccattgccagacggcacgggctggctgtacgcccttcacgggacgtctgaattgcctaaggctgtggcaaatatatatagggaggtcccctgcaaaactccgtatacagaactcctgcccataactaactggttgaacaagccacaacggttccgagtgattgtggagatccttaagccggaaaaaccggacctgtccattaccatgaaggggttagactacatcgatgttctgagtgggtcaaaaaaggattacaaactgaattttttctcccacaaggagggaacatacgccgccaaggttatctttcgtaatgaagttactaatgaatttctttactacaacgtgtcatttcgagtcatcccttctgggattattaagactatcgagatggtgactcctgtcaggcaagtagcaagtgcatctatcaaactcgaaaatcctcttccctattctgtaacgttttcaacggaatgtaggatgcccgacatcgcattgccaagtcagttcgttgtcccagcaaactccgagggcactttctccttcgagttccagcctctcaaagcgggcgaaaccttcggtcggttgacgctgcacaacactgatctcggctattaccagtacgagctctacctcaaagccaccccagccctgccagagaagccagttcatttccagacagttttgggcagcagccaaatcatcctggttaagtttattaattatacccggcagcggaccgaatattactgtcgaacagactgcaccgactttcatgctgagaagctgattaacgccgcccccggcggtcaggggggtactgaggcctctgtcgaagttctgttcgaaccaagccaccttggagagacaaaggggattctgatactgagcagcctcgctggcggcgagtatatcatcccactgtttggcatggctctgccacccaagccccaaggaccgttctccatccgggcagggtacagcatcatcattccatttaagaacgtgttttaccacatggtgacgttcagtattatcgtagataaccctgcttttacaattcgcgccggcgaatcagttcggccaaaaaagatcaacaatatcacagtgtcttttgagggtaatccgagtgggtcgaagacccctatcaccacaaaactgaccgtgtcatgtcccccaggcgagggatctgagactggggttaaatgggtatactacctgaaaggaataactctctag

SEQ ID NO: 120292 - DNA, 3054 bp, Artificial Sequence
  Description of Artificial Sequence: Synthetic coding sequence
atgaccagccgcagactagaagagtccatgggagcagtccagatgggtctcgtgaacatgttcaaggggtttcagtcaaaggtcctgccccctctgtctcctaaagtggtcaccgaggaagaagtgaatagaatgctgacacctagcgaatttctgaaggagatgtctctgacgaccgaacaaagattagccaagactcgccttatgtgcaggcctcagataatcgagctgctggacatgggcgaaaccacccatcaaaagttctccgggattgacctggatcaggccctgttccagccatttccatctgaaatcatattccagaattacacaccatgtgaagtctatgaggtgcctcttatcctgaggaacaacgataaaatccctcggctggtcaaggtggtggaggagtcgagtccctatttcaaagtaattagcccaaaagacataggtcataaggtcgcccctggcgttccatcaatctttcgtattctttttaccccagaagaaaacaaagactacgcccacacgttgacttgcgtcaccgaacgagaaaaatttatcgtgcccattaaagcccggggagcaagggcaatcctggactttccggacaagcttaatttctctacatgcccagtaaagtatagcacacaaaaaatcttattagtcagaaatattggcaataaaaacgcagtattccatattaaaacttgccgtcctttttcaatagagcctgccattggaaccttaaacgtgggggagtctatgcaattagaggtcgaattcgagccacagtccgtgggcgaccacagcggaagactcattgtgtgttacgacactggagagaaagtgttcgttagcctgtatggtgcagctattgatatgaacattcgactggacaagaactcacttacaatagagaagacatacattagtctggctaaccagcgcacaattactattcacaataggtcgaacatcattgcacattttctgtggaaggtctttgccactcagcaggaggaggatagggagaagtacagagcttgcgatgatttaataaaggaggaaaaagatgagaccgacgagttcttcgaagaatgtattacagacccccttctgagagagcacttatctgtgctgagccgtacctttgctaaccagcggaggctggtccagggagacagtaagctcttcttcaataatgtgttcacagtggagcccttggagggcgacgtatggccaaactcctctgctgaaatcaccgtttacttcaatcccttggaagcaaaactgtatcagcagacgatctattgtgacatcctgggcagggagattcgactgcctctccgcattaagggtgaggggatgggccccaaaatccactttaatttcgagcttttagatattggaaaggtcttcacaggctcagcccactgctacgaggccattctttataataagggcagcatcgatgctttattcaacatgacaccaccgacaagtgccctcggcgcttgtttcgtgttcagccccaaggagggtattattgagccctctggcgttcaagcaattcagattagcttcagcagtaccatcctgggtaatttcgaagaggaatttctggtgaatgtgaacggctcacctgagccagtaaagctgaccattaggggatgcgtcatcggaccgacattccattttaatgtaccggccttacatttcggggacgtgtcctttgggtttcctcacacgctcatttgtagcctgaacaatacttccttgataccgatgacttataagctccgaatacccggagacggcctgggccacaagtcgatcagttactgtgaacagcacgtggactataaacgccccagttggacgaaagaggagatttccagcatgaagcctaaagaatttacgattagcccagattgcggaactatcaggccgcagggattcgcggccatccgcgtcactctatgttccaataccgtccaaaaatacgagctcgcattggttgtagacgttgagggcatcggtgaagaggtcctcgcactcctgatcaccgcccgctgtgtcgtgccagcccttcatcttgtcaatacggaagttgacttcggtcattgcttcctgaagtacccttatgagaagacacttcagctggccaaccaggacgacctgcccggattctacgaggtacaaccccaggtctgcgaagaggtgcctactgttctcttcagttcccccaccccatcgggggtgattagtccgagtagcaccattcacattcccctcgtgctcgaaacgcaggtgactggggagcacaggtcgacagtttatataagcatcttcggaagccaggaccctcctttggtgtgtcatctcaagtccgccggtgaaggtcctgttatctatgtgcatcccaaccaggtcgactttgggaatatttatgtgctcaaggattctagtagaattctaaatctctgtaatcaaagtttcattcctgcattttttcaggctcatatggctcataaaaagtccctgtggactatagaaccaaatgaaggcatggtgccacccgagacggatgtccagttagctttgaccgctaatctgaatgacacgctgaccttcaaagactgtgtaatattggatatcgagaacagctctacgtaccgcatccctgtgcaggcaagcgggactggaagtactatcgtcagcgacaagcccttcgcaccagagttgaacctcggggcacattttagccttgatacccattattatcactttaagctgataaataaaggccggaggatccagcagctgttttggatgaacgacagctttcgacctcaagcaaaattgtctaagaaaggacgtgtgaagaagggacacgcccatgtgcagccacagccatccggttcacaggagccaagagaccctcagtcccccgtatttcacttgcatcctgcatccatggaattgtacccgggccaggccattgatgtgattctggaaggttattccgcgaccccccgcgtgaggggctag

SEQ ID NO: 120293 - DNA, 2223 bp, Artificial Sequence
  Description of Artificial Sequence: Synthetic coding sequence
atgactagtagaaggctggaagagagcatgggtgccgtccagatgggcctggttaatatgtttaaggggtttcagtctaaagttctgcccccgctctctcccaaagtcgtgaccgaggaagaggtgaacagaatgctgacaccgagcgagttccttaaagaaatgagcctaactacagagcagagactggcaaaaaccagactcatgtgcaggccacagataattgagctcctggatatgggggagaccacgcaccagaagttctccggcattgacctggatcaggccttgttccaaccatttccgtctgagatcatattccagaactacacaccctgcgaggtctatgaggtgccgttgatacttcggaacaacgataaaataccaagactggtcaaagtagtcgaagaatctagtccctattttaaggtgatcagtcctaaagacataggacacaaagtggcaccaggtgtgccgagtatcttccggatcctctttacccctgaagagaacaaagattacgctcacaccctaacatgcgtaacagagcgtgagaaattcattgttcctatcaaagcgagaggtgcgcgggccattctcgattttcctgacaagctgaattttagcacatgcccagttaagtactccacacaaaaaatcttgctcgtgcgcaatattggcaacaaaaatgccgttttccatattaaaacctgccgcccctttagtattgagcctgccatcggcaccttaaacgttggagagagtatgcagctcgaagtggagttcgagccgcaatctgtgggcgaccattccggacggctaatcgtatgttacgacacaggagagaaagtgttcgtgagcctgtacggtgccgccatagacatgaatataaggctggacaagaactctttgactatcgaaaaaacctacatctctctggcaaaccagcgcacaattaccatccataatcggagtaatataatcgcacatttcctatggaaggtcttcgcaacacaacaggaggaggacagagagaagtacagagcctgcgatgacctgattaaagaggagaaggacgaaaccgacgaattttttgaagaatgcattacggaccctttgctgagagaacatttgtctgtcctgtccagaactttcgcaaatcagcggcgcctggtacagggagattcaaaattgtttttcaacaacgttttcactgtagagccccttgagggagatgtgtggcccaatagctctgctgaaatcaccgtttacttcaatcctctggaggcaaaactgtatcagcaaacaatctattgtgacattctgggtcgcgaaatacggctaccactaagaatcaaaggtgaaggcatgggtccgaaaatccattttaacttcgagttactggatatcgggaaagtattcactggtagcgcccactgttacgaggccattctttacaacaagggctctattgacgccctgtttaacatgaccccacctacatcagcactgggggcttgtttcgtgttctcacccaaggaggggatcatcgaacccagcggcgtgcaagctatccagatcagcttctcatcaacaatcctggggaacttcgaagaagaattcctcgtcaacgtcaacggttcgcccgaacctgtgaagctcactatcaggggctgtgtcatcggcccaacattccattttaacgtcccggcactgcattttggagatgtgtccttcgcgactcaggaactcagggaccctcaggtgctgatcccattccagcggttcccacataccttgatatgttctctgaacaataccagtctgatacctatgacatacaaactccgcattccaggcgatggcctggggcacaaatccatttcctattgtgagcagcacgttgactacaaacgaccgtcctggacgaaggaagagatctcatctatgaaacctaaagagttcacgatttcaccagactgtggcaccattagaccacagggatttgccgctatacgcgtaactctgtgtagcaacactgttcagaagtacgagttggctctagtggttgatgtggaggggattggtgaggaagtgttggcacttctgatcactgccagtgcccccgaactgtgtaatcggaaagtaatgctgagcgttctgcagtggaagattcatcgtgctaaacgatccctgccacgcgataccgtcgctgtgacatag

SEQ ID NO: 120294 - DNA, 3645 bp, Artificial Sequence
  Description of Artificial Sequence: Synthetic coding sequence
atgactagtaggaggctcgaggaaagcatgggcgccgttcagatggggctggtgaacatgttcaaagggttccaatctaaagttctcccccccctgagtcccaaggttgttacagaggaggaagtgaacaggatgctaactccttccgaattcctgaaagaaatgtccctcaccaccgaacagcgactggcgaagactagattgatgtgtcggccccaaattatagaactgctggacatgggagaaaccacgcatcagaagttctctggaattgacctggatcaggccctgttccagccattccctagcgaaataatcttccagaattacacaccttgtgaggtctatgaggtcccactgatactgcgtaacaatgataagatcccacgactcgtaaaggttgtggaagaaagctcgccttacttcaaagtgatctctcccaaagacatcgggcataaagtggcacctggcgtccccagcatatttcgaattctgtttaccccggaggagaacaaggactacgcgcacacactcacttgtgtcactgaaagagaaaaatttattgtacctatcaaagcaagaggcgccagggccattctcgattttcccgataagctgaacttttccacttgtcctgtcaaatactctacccagaaaattctgctggtcagaaatattggaaacaagaacgccgtctttcatattaagacgtgccgcccgttctctatcgagcccgccatcgggactttgaacgtgggagaatcaatgcagttggaagtggagttcgaacctcagtcagtaggagatcactccggccggctgatagtgtgttacgacactggagaaaaggtattcgtctctctgtacggagctgcaatcgacatgaacattcggttggataagaactctctgacgatcgaaaagacttatatatctctggcaaatcagcggacaatcaccatccataacagaagtaacataattgcccactttctgtggaaggttttcgctactcagcaggaagaggatcgggagaagtatcgggcctgtgacgacctgatcaaagaggagaaagacgagaccgatgagtttttcgaggaatgcataacagatccattgttgcgggaacacctttcagtgctgtcacggacctttgctaatcagcggaggctggtgcaaggcgattctaagctcttctttaataatgtgtttaccgtagagccgcttgaaggcgacgtgtggcccaattcctctgctgagatcacagtgtacttcaacccactggaagcaaagttgtatcagcagacaatatactgtgacattctaggaagagagatcagactgccgcttaggatcaaaggtgaaggaatgggccctaaaattcacttcaacttcgagctgctcgacataggcaaagtcttcaccggatctgctcactgctacgaggctatcctgtacaataaaggtagcatcgatgcgctgttcaacatgactcctccaacttcggcacttggcgcatgtttcgtgttctcgccaaaggaagggattatcgagcctagcggagttcaagctatacagatctcctttagttccacaattctgggcaatttcgaggaagagtttctggtaaacgtgaatggctcccctgaaccagtgaagctcacaatccggggctgtgtcattggtcccaccttccattttaatgtgccagccttgcacttcggcgatgtcagtttcgggtttcctcacacgctgatatgttccctgaataacacttcccttatcccaatgacatataaactgagaatccccggggatggactcggacacaaatctatctcttattgtgaacagcacgtagactataaacggcctagctggactaaggaagaaatctcgagcatgaagcctaaagagtttactatcagtcctgattgtggcaccattcggccccaagggttcgccgccatacgtgttaccctctgtagcaataccgtgcagaagtatgaacttgctctggtggtggacgtcgagggcataggggaggaggtcctggccctactgataacggctagatgtgtcgtcccggccctccaccttgtaaatacagaggtcgatttcgggcactgtttcctcaaatacccgtacgagaaaactttgcagttggcaaatcaggatgacctcccaggattttatgaagtgcaaccacaggtgtgcgaggaggttccaactgtgctattttcttcgccaacaccttcaggagtgatttctcccagcagcacaattcacatccctctggtgcttgaaacgcaggtcaccggcgagcatagatcaactgtctacatttccattttcggttctcaagatcctcctttggtatgtcatctgaaatcagctggtgaggggcccgttatttatgtccatccaaaccaggtggatttcgggaacatctatgtcctgaaagactcatctcgtatcctcaacctgtgcaaccagtcattcatcccagccttcttccaggcccacatggcccacaagaagagtctgtggacaatagagcctaatgaagggatggttccccctgagaccgatgtgcagctggcgcttacagcgaacctgaatgacaccctaacattcaaagactgcgttatactagacattgaaaattcttctacgtaccgcatccctgtgcaagcttcaggtacaggctccaccatcgtgagtgataagcctttcgctccagagctcaacttgggcgctcatttcagtctggacacgcactactatcattttaaactcataaacaaggggaggcggattcagcagcttttttggatgaacgattcctttcgcccccaggcaaagctgtcgaagaaggggcgggtgaagaagggtcacgctcatgtgcaaccccagccatccggttcacaggagccccgtgacccccagtctccagtgtttcatctacacccagccagtatggagctttacccagggcaagcaattgacgtcatcctcgaggggtatagtgccacacctagaaaacccaatagcattctcaaaccggactatcagcccctggccattaaaaacatttcgaccctgccagtgaacctgctgctgtcgacaagcggcccattcttcatctgtgagacggacaaatcactgttgccagccactcctgagcccataaagctggaaattgatgaagagaaaaacctgcttatcaaatttgatccctcctatcgtaacgaccttaataattgggtagcagaggagatccttgccataaaatatgtggagcacccccaaatcgattctctagatctccgcggggaagtccactaccctaacctgtccttcgagacgaaggagcttgacttcggctgtattttgaatgacaccgaactcattagatacgtcacgattacaaactgttccccccttgttgttaagtttagatggtttttcttggtgaacgatgaagaaaatcagatccgattcgtcacactacccaagaagccctactcagcaccagtttcgcagatggagtccattcctgccacatccgaggccgcctcccccccagcaattttggtaaccgtcgaaagccctgagatggacctgaacgattttgttaagtag

SEQ ID NO: 120295 - DNA, 3054 bp, Artificial Sequence
  Description of Artificial Sequence: Synthetic coding sequence
atgactagccggagactggaggaatccatgggggccgttcagatgggcctcgtaaatatgttcaaaggcttccagagcaaggtactgcctcccctctctcctaaagtcgtaaccgaggaggaagtgaatcgcatgctcacaccgtcagaattcctgaaggaaatgtccctgacaactgaacagagactggctaaaaccagacttatgtgtcgcccacaaatcattgaattgctggatatgggggaaacgacccaccagaagtttagcggcatcgacctcgatcaggcattgttccagccatttccttccgagattattttccagaactatacgccctgcgaggtgtatgaggtccctctgatacttaggaataatgataagattccgcgcctggttaaagtcgtcgaggaatcttctccttatttcaaagttatttcccccaaggacatcggacataaagtggcccccggggtgccaagcatcttccgaatactgtttacgcccgaagagaacaaggattacgcccatactctgacctgcgtgacagagagggagaagtttattgtgcccatcaaagctcgcggggccagggctatcctggatttcccggataagctgaatttttcaacctgccctgtgaagtatagtacccagaagatcctgctggtcagaaatataggaaataagaacgcagtttttcatatcaaaacatgccgacccttttccatcgaacccgccataggaaccctgaacgtaggcgagtcaatgcagctggaagtcgaatttgaacctcagtccgtgggagaccactccggccgcctcatcgtgtgctacgatacaggagagaaagtgttcgtgtctttatatggcgcagccatcgatatgaacatacggctcgacaagaactcgctcacaatcgagaaaacatacatctcgcttgccaaccagagaacgatcacaatccataacaggagcaatattatcgctcacttcctgtggaaggtatttgccacgcagcaggaggaagaccgggaaaagtaccgggcttgtgacgacctcatcaaagaggagaaggatgagacagacgaattttttgaagaatgcattaccgatccccttctgcgtgagcacctaagcgttttatcacgtacctttgccaaccagcggaggctagttcagggggactccaaactatttttcaacaacgtctttaccgtggagcccctggaaggagacgtgtggcctaactcatctgccgagatcactgtttacttcaatcctcttgaggccaagctctatcaacaaacaatatactgcgacatcctcggaagagagattcgcctgcctctgcgtatcaaaggggagggtatgggacctaaaatacacttcaactttgagctcctggacataggcaaagtttttacgggctcagcccattgctatgaggctatcttatataacaaaggttctattgacgccttattcaacatgactccccccacctccgcgttgggcgcatgcttcgtgtttagccctaaagaaggtatcatcgagccgtctggcgttcaagccatccagatctcgttctcctccacaatcctaggcaactttgaggaagagttcctcgtgaacgtgaacggatccccagagccggtgaaattgaccatcagaggatgcgttattgggccaactttccatttcaacgtgccggcactgcattttggcgacgtgtcctttgggtttcctcacaccttaatatgttctttaaacaatacaagcctgatccctatgacatataaactccggattccaggcgacggcttgggccacaaatcaatctcgtactgcgagcagcacgtggattacaaacgcccctcatggactaaagaagagataagtagcatgaaacctaaagagttcactatcagcccagactgcggaactatacgtccacagggtttcgctgctatcagggtcactttatgctctaacacagtacagaagtatgagctcgccttagtggtggatgttgagggcattggagaggaggtgttggcccttctgattaccgccagatgtgtggtgccagcactgcacttggtcaacacggaagtcgacttcgggcactgcttcctgaaatacccctacgaaaaaacactgcagctcgccaatcaagacgacctgcctgggttttatgaggtacagcctcaggtctgtgaggaagtgcccacggtgctcttctccagtcccactccgtctggcgtgatttcacccagctcaaccatccacattcccttagtgttagagacccaggtaactggcgaacataggtctactgtgtacatttctatattcgggtcacaagatcctcctctggtgtgtcacctgaaatcagccggggaaggacctgtgatctatgtgcaccctaatcaggtcgactttgggaacatctatgtcctgaaggacagctcacgtatcctcaacttatgcaaccaatcgttcattcctgcctttttccaggcccatatggcacacaaaaagagcctgtggaccatcgaacccaatgaggggatggttccaccagaaacagatgtccagctagccctgacagccaatctcaacgatacactgactttcaaagattgcgtgatacttgacatcgagaactcctctacctatcgcatccctgtacaagcctctggaactggctctaccatagtgtctgacaagccttttgcccctgagcttaacctaggcgcgcacttttctttagatacacactactatcactttaagcttattaacaagggccgacggattcaacagctcttctggatgaatgattctttcaggccccaggcaaagttgagcaagaagggacgcgttaagaagggccacgcacacgtacagcctcagccatcggggagccaggaaccccgggatccacagtcccccgtttttcacctccaccccgccagcatggaattgtacccaggacaggccatcgacgtgatcttagagggatattccgctactccacgcgttaggggctag

SEQ ID NO: 120296 - DNA, 822 bp, Artificial Sequence
  Description of Artificial Sequence: Synthetic coding sequence
atggccacctgggacgaaaaagccgttacccgacgcgcaaaggtggcacccgccgagcgcatgagtaagttcttacggcacttcactgtggtgggcgatgactaccacgcctggaatattaattataaaaaatgggagaatgaggaggaggaagaggaggaggagcagccccccccaacccccgtgagcggggaggaggggagagctgccgcccctgatgtcgcaccggctcccgggccggcacctagggctccgttagattttaggggaatgctgcgaaaactgttcagctctcaccgtttccaggtgattatcatttgtctggtggtgttggatgctttactcgtccttgcagaactcattctagatctgaagattatccagcccgacaagaataattatgccgccatggtcttccactacatgtccatcacaatcctggtcttcttcatgatggagattatcttcaaactattcgtgttcaggctcgaattctttcatcataaattcgaaatactcgatgctgtggtggttgttgtgagttttatcctagacatcgtgctcttgttccaagaacaccagtttgaggcgctgggcctcctgattttgctcagactatggcgcgtggcccgtatcatcaatggtataataatatccgtcaagactcggagtgagagacagctgttgcgtttaaagcagatgaatgtacaattggctgccaagattcagcacttggagtttagctgctccgagaaggagcaagaaatagaacgccttaataagctgcttaggcaacatggcctcctgggggaggtgaactag

SEQ ID NO: 120297 - DNA, 822 bp, Artificial Sequence
  Description of Artificial Sequence: Synthetic coding sequence
atggctacttgggacgaaaaagcagtgacccgtcgtgctaaagtagctccagccgaacggatgagcaaattcctgagacatttcaccgtggtgggggatgactaccacgcgtggaatatcaattacaaaaagtgggaaaatgaagaagaggaggaggaggaggagcagccaccacccactcccgtgagcggagaagaaggccgtgctgccgcccccgacgtcgcccccgccccggggcctgccccgagagccccgctggacttccgcggcatgctgcgaaagctgtttagctctcatcggttccaggttattattatctgtctggtggtgctggatgccctcctcgttttggcagagctaatactcgacctgaagataatccaaccagacaaaaataattatgccgcgatggtattccattatatgagtatcacaatccttgtgttcttcatgatggaaataatttttaagctgttcgttttccggctcgaattcttccatcataagtttgaaatcctcgacgcagtcgtggtggtcgtgtcatttatcctggacatcgtgctcctctttcaggaacaccagttcgaagcactgggtttgctaatcctgctgaggctttggcgggtggcccgtatcattaacggcattattatttcggtgaagacgcgtagtgaaaggcaattactgcgattgaagcaaatgaacgttcagctcgccgccaagattcagcacctcgaattttcgtgctctgagaaggagcaggagatcgaaagattaaataaactcctgcggcagcacgggttgctcggagaggttaactag

SEQ ID NO: 120298 - DNA, 237 bp, Artificial Sequence
  Description of Artificial Sequence: Synthetic coding sequence
atggctacttgggatgagaaagccgttacccgccgggcaaaggtggccccagccgaacgcatgagtaagtttctgaggcattttacggtcgtcggggatgattaccatgcgtggaatattaattacaagaagtgggaaaatgaggaggaagaagaagaggaggaacagccgccacctacacccgtgagcggcgaagagggtagggcagctgctcccgacgtagcacccgccccctag

SEQ ID NO: 120299 - DNA, 900 bp, Artificial Sequence
  Description of Artificial Sequence: Synthetic coding sequence
atggaagagctgttgccagatggtcagatctgggcgaacatggatccagaggagagaatgcttgctgccgccactgcctttactcacatctgcgccggacagggcgaaggagatgtgaggagggaggcacagtcaattcagtacgacccttactccaaggccagtgtggctcctggtaagagacctgctctgcctgtgcagcttcagtacccccatgtggaaagcaatgtgcctagtgagactgtgtccgaagcatcccagagactccgtaagccagtcatgaaaaggaaggtgttgcggagaaagccagacggcgaagttttggtgacggacgaaagtatcatcagcgaatcagaaagcggaactgaaaacgatcaggatctttgggacctgaggcagcgtctcatgaacgttcagttccaggaggacaaggaatcctccttcgatgtgtcccagaagttcaatctgccacacgagtaccaggggatcagccaggaccagttgatctgcagtctccagcgtgagggtatgggctccccggcatacgagcaggacctgatagtggcttccagacccaagagctttattctccctaaactggatcagctgtcccgcaatcgcggtaaaaccgatcgtgttgcccgatacttcgaatataaacgagattgggatagcatcagactacctggagaggaccatcggaaggagttgcggtggggggtccgtgaacagatgctttgtagagccgagcctcagtccaagcctcaacacatatacgtgccaaacaattacctggttcccactgaaaagaagaggagcgccttaagatggggggtaagatgcgatcttgccaacggggtgattccaaggaagctgccttttccattaagccccagttag

SEQ ID NO: 120300 - DNA, 900 bp, Artificial Sequence
  Description of Artificial Sequence: Synthetic coding sequence
atggaagagttgctgcccgatggccaaatctgggccaatatggaccctgaggaacgaatgcttgccgcagccacagcctttacacacatttgcgctggacaaggagagggggacgtccggcgggaagcgcagagtatccagtatgacccctacagtaaagcttctgtggctcctggtaagaggcctgcactccctgtccagctacagtatccacatgtggaaagcaacgttcccagtgagactgtcagtgaggcatcccagcgtctgcgcaaacccgtcatgaagagaaaggtactgcggaggaagcctgacggagaggttctcgtgaccgacgagagcattatatctgaatctgagagcgggaccgaaaacgaccaggacctttgggacctgagacagcggctgatgaatgtgcagttccaagaggataaggagagctccttcgacgtaagccagaagttcaatctgccacatgagtatcagggcataagccaggaccagttgatttgttctttgcaacgggaaggtatgggtagccccgcatacgaacaggacttgatcgtagcgtcccgccccaaaagttttattctgccgaagctggatcagctaagtcgcaaccgggggaagacggatagggtggctcgttatttcgagtataagcgagactgggatagcattaggctgcccggtgaggaccacagaaaggagctgaggtggggtgtcagggagcagatgctgtgccgtgccgagccacagagcaagccacagcacatctatgtgccaaacaattacctggttccaacagagaaaaaaaggagcgcccttaggtggggagtgcggtgcgatctcgctaacggggtgatcccaagaaagctgcccttcccactgtctccctcatag

SEQ ID NO: 120301 - DNA, 900 bp, Artificial Sequence
  Description of Artificial Sequence: Synthetic coding sequence
atggaggaactactgcctgatgggcaaatctgggccaatatggaccccgaagagcggatgcttgctgctgccacggcctttacacatatttgtgcaggccagggggagggagacgtgcgtcgcgaggcacaatccattcagtacgatccgtatagtaaagcctctgtcgcacccggtaaacgccccgccctacccgtgcagctgcagtatccccacgtagagtctaatgtcccctccgagaccgtttctgaagcttctcagaggctgcgcaaaccagtgatgaaacgaaaagtgctgaggcgaaaacccgatggggaggtgcttgtgactgacgagagcattatttcggagtcagagtcaggtaccgagaacgaccaagatttatgggatctcagacagcggcttatgaatgtgcagttccaagaggataaagagtcctcatttgatgtgtctcagaagttcaacctgccccatgagtatcagggcatcagtcaagaccagctaatctgtagccttcagagagaggggatgggatcacccgcctacgagcaggacctcattgtggcctcccgaccgaagtcgtttattctgcctaagctcgaccaactgagtcggaaccgcggcaaaaccgatagggtggcccgctacttcgagtacaagcgggactgggatagcatccgcttacctggagaggatcatcgcaaggagctcagatggggtgtccgggaacagatgttgtgccgcgctgagccgcaatcaaaaccccagcacatttatgtacccaacaactatctggtgccaacagagaaaaagaggagtgccttgcggtggggggtccgatgcgatctcgccaacggcgtcatccctcgaaagctacctttccccctcagtccttcttag

SEQ ID NO: 120302 - DNA, 1113 bp, Artificial Sequence
  Description of Artificial Sequence: Synthetic coding sequence
atgctccctagactgatttgtatcaacgactatgagcagcatgcaaagtctgtgctccctaaatcgatttacgactactacagaagcggggcaaacgacgaagagaccctcgcagacaatatcgcggcattcagccgctggaagctgtacccaaggatgctcagaaacgtggccgaaacagacctgagtacctcagtcctggggcaaagagtgagtatgcccatatgtgtgggcgccacggctatgcaaaggatggcccacgtcgacggcgaacttgcgacagtcagagcctgtcagtcattaggaactggtatgatgttgtcatcatgggctacctcatctatcgaagaggtggccgaggccggccctgaggccctgcggtggctccaactttacatctataaagatagagaggtcactaagaaactggtccggcaggccgagaagatggggtacaaggccattttcgtcactgtagatactccctatttggggaaccgcctggatgatgtgagaaataggttcaagctgcccccacagctgcgcatgaagaacttcgagacttcaacgttatccttttcacctgaggaaaacttcggcgatgattcgggtctggcagcctatgttgcaaaggcaatcgaccccagtatctcgtgggaggacattaaatggctccgccgactgaccagcctgccaatcgtggccaaagggatcctgcgcggggacgatgcacgagaagcagtgaagcatgggctcaatgggattctagtatccaaccacggagctcgacaactggacggagtgcctgcgacaattgacgtactgcctgagatagtggaggcagtggaagggaaagtggaggtgttcctcgacggcggagtgcgcaagggcacggatgtactcaaagccctcgccctcggggcaaaggctgtttttgtggggcgtcccatcgtgtggggactggcattccaaggagagaaaggggtccaggatgtgctggagatcctgaaggaggagtttaggctcgcaatggccctgtccgggtgccagaacgttaaggtaatcgataaaaccttggtcaggaagaatcccctggcagtcagcaaaatatag

SEQ ID NO: 120303 - DNA, 1056 bp, Artificial Sequence
  Description of Artificial Sequence: Synthetic coding sequence
atgtccctggtgtgtctgacggacttccaggcccatgccagagaacagcttagcaagtcaaccagagacttcatcgaggggggggcagatgattcaatcacccgcgacgacaacatcgccgcatttaaaaggatacgcctcaggcccagatacctgcgggatgtatcggaagtggacacgaggactactatccagggcgaagagatctctgcccctatctgcattgcccctactgggttccattgtcttgtgtggcctgacggcgagatgagcaccgcccgtgccgcccaggccgccggtatttgttacatcacctccacctttgcttcttgtagtctcgaggacattgtgatcgctgcgcccgagggacttagatggttccagttgtacgtccatccagatctgcaactgaataaacaactcatccaaagagtcgaaagtcttgggttcaaagcactcgtaatcacgttggatacgcccgtgtgtgggaaccgtcggcatgacattaggaatcagctgaggcggaatctgacacttacagatctgcagtcccccaagaaggggaatgcaattccctattttcagatgactcctatctccacatcactgtgctggaatgacttgtcttggttccagtccataaccaggttacccatcatccttaaaggcattctgaccaaagaggatgccgagctggcggttaagcacaatgtgcagggaatcattgtaagcaaccatggtggccggcagctggacgaggtactcgcgtcaatcgatgctctcaccgaagtcgtggccgctgtcaagggcaagattgaggtatatttggacggaggtgttaggactggtaacgatgtgctgaaagctttagcacttggggccaagtgcatctttttggggaggcctattttatggggtcttgcttgtaaaggcgagcacggcgtcaaggaagttcttaatatactgactaatgaattccacactagcatggccttgacagggtgtaggtctgttgctgaaatcaacaggaatctcgtgcagttttcaagattgtag

SEQ ID NO: 120304 - DNA, 1095 bp, Artificial Sequence
  Description of Artificial Sequence: Synthetic coding sequence
atggaggataaaatgtggagtgagtgtgaaggcccggagatgagcttggtttgcctgactgatttccaggcccacgcccgagaacagttgtccaagtctacgcgggattttatcgagggaggcgccgacgactccataacccgcgacgacaacattgctgcctttaagcgtatacggctgaggccgcggtatcttcgtgacgtgtcagaggttgacaccaggacgacaatacaaggagaagagatctccgccccgatctgcatcgctccaacgggcttccactgtctggtctggcccgacggtgagatgagcactgcgagagctgctcaggccgccggtatatgttatatcacatctacttttgcctcatgctctctagaagatatcgtcatagcggctcccgagggactgaggtggtttcagctttacgtgcatcctgacctccagctcaacaagcagctcatccaaagggtggagtcacttgggtttaaggccctcgtcattacactcgatacacctgtctgcggaaacaggaggcacgatattcgcaaccaactcaggcgcaacctgactttaaccgacctacagagccccaaaaagggtaacgccatcccctactttcagatgacccctattagcacctcgctgtgttggaacgacctgagttggtttcagagtatcactagacttcccatcatcttgaaggggatcttaaccaaagaagacgctgaactggctgtgaaacataatgtccaagggatcattgtttcaaaccacggcgggcgccagctggatgaggttctcgcctctatcgatgcgctcactgaggtggtggccgccgtgaagggaaaaatagaagtgtacctggacgggggagtgcgcactggcaatgatgtgctgaaggctctggccctcggtgcaaagtgcatcttcctgggaaggcccatcctctgggggctggcgtgcaaaggagaacatggcgtcaaggaagtcctgaatatccttaccaacgaattccacacatcgatggctctcactggttgtagaagtgtggcagagattaatagaaatctggtccagttttctagactctag

SEQ ID NO: 120305 - DNA, 561 bp, Artificial Sequence
  Description of Artificial Sequence: Synthetic coding sequence
atgtccttagtgtgcttgaccgacttccaggctcacgcacgggagcagctgagcaagagcacccgcgatttcatcgaggggggagcagacgactcaattacccgggatgacaacatcgccgcgttcaagcggatcagactgcgacctagatacttgcgggacgtaagtgaggtcgacactaggacaaccatccagggcgaggaaattagcgccccaatttgcatagcacccactgggttccattgtttggtttggcccgacggcgagatgtctacagccagggcacccgagggcctccgatggttccagctgtatgtacaccccgatctccaactcaacaaacaactgatccaacgcgtggagtctttgggatttaaggccctggtgatcacactggatacacctgtgtgcggtaaccggcgccacgacatcaggaaccagctacgcagaaacctaacattaactgatctccagtcacccaagaagggcaatgcaatcccatatttccagatgactcccatctccaccagtctctgctggaacgatttgtcctggttttag

SEQ ID NO: 120306 - DNA, 2292 bp, Artificial Sequence
  Description of Artificial Sequence: Synthetic coding sequence
atggtggcttgcagggcgataggcatcctgagccgattcagcgcctttagaattttacgctcccggggatatatctgtcgaaatttcaccggaagttccgcgctcctcacacggacacacatcaactacggtgtcaaaggagatgtggccgtggtacgcatcaacagccccaatagcaaagtcaacacactgtccaaagagttgcacagcgagttcagcgaagttatgaacgagatctgggcaagcgaccagataaggtcagctgtcctcatttcttccaaacctgggtgtttcatcgccggtgccgatattaatatgctggccgcttgcaaaaccttacaggaagtaacccagctgagtcaagaggctcagcggattgtcgaaaaactggaaaaatctactaaacccatcgtcgcagcaatcaatggcagctgtctgggaggcggtctagaggtcgctattagctgtcagtatcgaatcgcaacaaaagatcgcaaaactgtgctcggaacccctgaggtgttgctgggcgccctgccgggtgcaggagggacccagcggctgccaaaaatggttggggttccggccgccctggatatgatgctaacggggagaagcattcgcgcggatagagctaaaaagatgggactcgtggaccaacttgtggagccccttggccctggcttaaaacctccggaagagaggactattgagtatctcgaggaagttgcaattacattcgccaagggattggccgataagaaaatatcaccaaagagggacaagggactagtggagaaactcaccgcctatgcaatgactattccattcgtgaggcagcaagtttataagaaagttgaggaaaaagtgcgcaagcagactaaaggattatatcccgcccctctgaagatcattgacgtagtgaagactggaatagaacaaggatcagatgccggctacctgtgtgagtcacagaagttcggagagctggtcatgaccaaggaatccaaggccttgatgggactgtatcacggacaggtgttatgtaaaaagaacaaattcggcgcccctcagaaggacgtcaagcacttggctattctgggagccgggctaatgggggctgggatagctcaggtcagtgtggacaaagggctgaagacaatcctcaaagatgcaacattgacagccctcgacagaggtcagcagcaggtgtttaaagggcttaatgataaggtgaaaaaaaaggcacttactagctttgaaagagactctattttctcaaatttgacgggacagctagattatcaagggttcgaaaaggccgacatggtgatcgaggccgtgtttgaggacttgtcactgaagcatagagtcctcaaagaggtggaagctgtgattccagatcactgtatcttcgcctctaacacaagtgccctacccatttccgaaatcgccgcagtcagcaagagaccagaaaaggtaatcgggatgcattattttagtcctgtggataagatgcagctgctggagattattactaccgaaaagactagcaaggacactagtgcttccgccgtggccgtgggactgaaacaggggaaggtgataatcgtcgtgaaggacggtcccgggttctacactactagatgtcttgcacctatgatgagcgaggtcattagaattttgcaggagggtgtggaccctaagaaactcgacagcctgaccactagtttcggatttccggttggcgccgctaccctcgtggatgaggtcggagtggacgttgctaagcacgtagctgaagaccttggaaaggttttcggagagaggttcggaggcggaaaccccgaacttctgactcagatggtgagcaagggatttctggggcggaaatctgggaaaggcttctacatataccaggaaggtgtgaagaggaaagaccttaactcagacatggacagcatcctggcgtctcttaaactacctcctaagtccgaggtgtcctctgatgaggatatccagttccgcctggtaacccgcttcgtaaacgaagccgtgatgtgcctgcaggaagggatcctcgcaacccccgcggaaggtgacattggggcagtgttcggcctcggtttccccccatgtctcggaggcccctttaggtttgtcgacttatacggtgctcaaaagatagtagaccgactaaagaagtatgaggccgcctatggaaagcagttcaccccctgccagttactcgcggaccacgccaatagtcctaacaaaaagttttatcagtag

SEQ ID NO: 120307 - DNA, 783 bp, Artificial Sequence
  Description of Artificial Sequence: Synthetic coding sequence
atggaaagtaaaggtatgtggcaattgtttgagctgaccctgccgatccaatcaatgcttgccgcctgcaaaaccctccaggaagttacgcagctctctcaagaggcgcagaggattgttgagaaactcgagaaatccactaagcccattgtggccgcaattaacgggagttgtctgggcggcgggctggaagttgccatctcctgtcagtatagaattgctaccaaggaccgaaaaaccgtgttggggacacccgaggttcttctgggcgctcttccaggagcagggggaacacaaagactgcctaagatggtaggcgtaccagccgctctcgacatgatgctgaccggacgttccatccgggctgaccgggctaaaaaaatgggactcgtggaccagctggttgaacccctaggacctgggctgaagcctcctgaggaacgtacaatcgaataccttgaagaagtcgccataacgtttgccaagggcttggccgataaaaagatttccccaaaacgggataaagggctggtggagaagctaacggcttacgccatgaccattccatttgtaaggcagcaagtctataagaaagtggaggagaaagtccgaaagcagacaaagggcttatatccagctcctctgaaaatcatagatgtcgtgaagacgggcatagagcagggatcagacgccggctacctctgtgaatctcaagtcaatttattccccttcaacgtgctcctgtccgtaaaaggcaagctcaaaattcagtctagtgtgtag

SEQ ID NO: 120308 - DNA, 1425 bp, Artificial Sequence
  Description of Artificial Sequence: Synthetic coding sequence
atgacgattctaacctatccattcaaaaacttgccaaccgcatccaagtgggctctgcgtttttcgataaggccactgtcatgttctagccaattaagagctgctccggccgtccagacaaaaacgaagaaaactctcgccaagcccaacattcgtaatgtggtcgtagtggatggagtcaggaccccattcctgctgtctggaacctcctacaaggacctcatgccacacgacttggcccgcgctgcactgactgggttactgcaccggaccagcgtgcctaaggaggtggttgattacattatcttcgggacagtcatccaggaagttaagacctccaacgtggcaagggaagccgcactgggggccggtttctccgacaagacaccggcccacactgttacaatggcatgtatatccgcgaaccaggccatgactacgggagtgggcttaattgccagtggccagtgtgacgtcatagttgccgggggggtggaacttatgagcgacgttccaatccgccatagtagaaagatgcgaaagctgatgttggacctgaacaaggccaaatcaatgggacagcggctttccctaatttctaagtttcggtttaacttcctcgccccagagctcccagcagtgtctgaattctcaacgtctgaaacgatgggtcactccgcagatagactggccgctgctttcgcagtgtcaaggttagaacaggacgagtatgctttaagaagtcattctcttgccaagaaagcccaggacgagggcctgttgagcgacgttgtgccgtttaaggttccgggaaaagatactgtgactaaggacaacggcatcaggccatcttctttagagcagatggccaaactgaagccggcctttataaagccatatggtacagtgacagcggccaattcatctttcttgactgatggagcttcagccatgttaataatggccgaagagaaagcgctcgctatggggtataagcctaaggcatatttacgcgattttatgtatgtgagccaagatcccaaagaccagttattgctaggccccacctacgcaactcccaaagttctggagaaggccggactgacaatgaacgacattgatgcctttgaattccatgaggccttctccggacagattctggcgaatttcaaggccatggatagcgattggttcgctgaaaactatatgggaaggaagaccaaggtggggctgcctccactggagaaatttaataattggggtggctcactgtcattgggccacccatttggtgccactgggtgtagactcgtgatggccgcagcgaatcgactgaggaaggagggcggccagtacggactggttgccgcttgtgctgctggcggccagggccacgccatgattgtggaagcatacccaaagtag

SEQ ID NO: 120309 - DNA, 258 bp, Artificial Sequence
  Description of Artificial Sequence: Synthetic coding sequence
atgaccatactcacctacccttttaaaaacttgcctaccgcttccaaatgggcattgaggttttcgatcaggccactctcctgctcctcccagttgcgagctgcacccgctgttcagacgaagaccaaaaagacgctcgccaaaccgaatataagaaacgttgtggtggtggacggcgttcgcactccgtttttacttagcggaacttcctataaggatctcatgcctcacgatctggcgagagcagccttaacttag

SEQ ID NO: 120310 - DNA, 531 bp, Artificial Sequence
  Description of Artificial Sequence: Synthetic coding sequence
atgacaatcttgacatacccgttcaaaaacctgcctaccgcatcaaagtgggccttaagattttccattcgccctctgtcctgctcgagccagctccgtgcagctcccgcggtgcagacaaaaactaaaaaaacacttgcgaaaccgaacatcaggaacgtggtagtagtggatggcgtgagaacccctttcctgttatcaggaactagctataaggatttgatgccgcacgaccttgcgcgggccgctctgactggtcttttacaccgtaccagtgtgccaaaggaggtcgtggattatattatcttcggaacagtgatccaggaagttaaaacctcaaacgtcgcccgggaggcggctctcggggcagggttcagcgataagactcccgcgcacacggtcaccatggcgtgcatttctgccaatcaggctatgactactggcgtggggctgattgccagtggccagtgcgacgtcatcgttgctgggggggtcgaactgatgagtgacgttccaatccgacacagttag

SEQ ID NO: 120311 - DNA, 453 bp, Artificial Sequence
  Description of Artificial Sequence: Synthetic coding sequence
atgacaatcttaacgtacccattcaagaaccttcccactgcctctaagtgggccctgaggttctcaatccgtcctctttcctgcagctctcagctccgcgctgccccggccgtgcaaaccaaaacaaagaagactctggccaaaccaaacatcaggaatgtggtagtggttgatggcgtgcgcactcctttcctcttaagtgggacctcctataaggacctcatgccgcacgatctggcaagagcggccttgactggacttttgcacaggacctccgtccccaaggaggttgtggactacatcatcttcggcactgtcatccaggaggtgaagacctccaatgttgcccgtgaagctgcgcttggtgcaggcttctccgacaagacccccgcacacacagtgaccatggcctgcatttcagccaatcaggctatgaccaccggggtgggttag

SEQ ID NO: 120312 - DNA, 1380 bp, Artificial Sequence
  Description of Artificial Sequence: Synthetic coding sequence
atgactatcctcacataccctttcaagaacctgcccacagcctccaagtgggctctaaggttcagcattagacctctatcatgcagctcgcagctgcgagcagctccagcggttcagacgaaaactaagaaaactctggccaaaccaaatattcgaaacgtggtagtggtcgatggagtgaggactcctttcttactctctggcacaagcggcctattacaccgtacaagcgtgccaaaggaggtggtagattatatcattttcggtaccgttatccaggaagttaagacctccaatgtagcaagagaagctgccctcggggcaggattctctgacaaaacacctgcacacacagtgacgatggcctgtatttctgcaaatcaggccatgacaactggcgtcggattaatagccagcggccaatgcgacgtgatagtcgccggaggcgtggagttgatgtcagacgtgccaattaggcacagccgaaaaatgaggaagctgatgctagatctcaacaaggccaagtccatgggacagcggctgtccttgatatctaagttccgtttcaattttttggcgcccgagctgccggcggtgtctgagttttctacttctgagactatgggtcacagtgcggatcggctggcagcagcattcgccgtgtctaggcttgagcaggacgagtacgcgcttcgatcacattctttagccaagaaggcacaggatgaggggctgttatcagacgtggtccccttcaaagtcccagggaaagatacagtgacgaaggataatgggatcagaccatcttcccttgaacaaatggctaaactgaagccagcatttataaaaccgtatgggaccgtgactgcagccaactcgagtttcctcacggacggagcctctgctatgctgatcatggctgaggaaaaagccttagccatgggttacaaacccaaggcctatttgagagatttcatgtacgtaagccaggatccaaaggaccagcttttgctcggcccaacttatgccacacctaaagtgcttgaaaaggctggattgacaatgaatgacatagacgcctttgaatttcatgaggcatttagcggccaaatcctggcaaatttcaaagctatggatagcgactggtttgccgaaaattacatgggacgaaagactaaagtgggtctcccccccttggaaaaatttaataattggggcggcagcctaagcctaggccacccattcggcgctactgggtgtaggttggttatggctgcggccaatcgacttcgcaaagagggaggtcagtacggtcttgtggctgcttgcgcggccgggggccaggggcacgctatgattgtggaggcttaccctaaatag

SEQ ID NO: 120313 - DNA, 1359 bp, Artificial Sequence
  Description of Artificial Sequence: Synthetic coding sequence
atgactttggtcagcggctggttactctacggatggatcatagcagttcagacaaagaccaagaagacactagccaagccaaacatccgcaacgttgtcgtggttgacggggttcgaacccctttccttctcagtggaacatcttacaaagacctaatgccgcacgatttggcccgtgctgcgttgacaggcctgctgcataggaccagcgtgcctaaagaggtggtggattatattatatttggaacagtcatccaggaggtgaagacatccaacgtggctagagaagccgccctgggagcagggttctctgataagacgccagcccacaccgtgacaatggcttgtatctctgcgaatcaggccatgacaacaggggtgggattgatagcgagcggacagtgcgatgtgatagttgccggaggagttgagctgatgtccgatgtccccattcgacactctagaaaaatgaggaagctgatgctggatttaaataaggccaaatccatgggacagaggctatccctgatttccaaatttaggtttaacttcttagctccagagctgcccgcggtgagtgagttcagcacctctgagactatgggtcactccgcagaccgcttagccgcagcatttgccgtctcacgactggaacaggacgagtatgcactccgttcccatagcctcgccaagaaggctcaggatgagggcctgctatctgatgtggtccccttcaaggttccagggaaggatactgtgacaaaggataacggtatccgcccctcctccctggaacaaatggctaaactgaaacctgcttttatcaaaccttatggaaccgtgaccgccgccaattccagctttttgactgacggggcctctgccatgttaatcatggcggaagaaaaggcattggcaatgggctataagcccaaggcgtatctgcgcgacttcatgtatgtgtctcaggacccgaaggaccagctcctgctcggcccgacatatgccaccccaaaagtactggaaaaggctgggctgactatgaacgatattgatgcatttgagttccacgaagctttttctggccaaattctggctaactttaaagcaatggatagcgattggttcgctgaaaattacatggggaggaaaacgaaggtgggactccctccgttggaaaagtttaataattggggaggcagcttgtcccttgggcatccgttcggtgctacggggtgccgccttgtgatggccgcagctaaccggctgaggaaggagggcggtcagtacggcctggtggcagcctgcgccgctgggggccaaggccatgccatgatcgtggaagcatacccaaagtag

SEQ ID NO: 120314 - DNA, 783 bp, Artificial Sequence
  Description of Artificial Sequence: Synthetic coding sequence
atgaaggtggaagtgttgccagctctaaccgacaactacatgtatctggttattgatgacgagaccaaagaagccgccattgtggaccctgtgcagccccaaaaagtggtcgatgctgcgcgcaagcatggggtgaaactgacaaccgtgctgaccacacaccatcactgggaccacgctggcggtaatgaaaagctcgtgaagctcgagagtgggctgaaagtttacggcggcgacgatagaatcggcgccctcacccacaaaatcactcacctgagcaccctacaggtgggttccttgaatgttaaatgtttagcaacaccatgccacactagcggtcatatttgctactttgtcagtaagcctggcggcagcgaacctcctgcagtgtttaccggagatactttatttgttgccggttgtggcaagttttatgagggtactgccgacgaaatgtgcaaggcattgcttgaagtactggggaggcttccgccggatactcgggtgtactgcggacacgagtatactatcaacaacctgaagtttgcaagacacgtggaacctggcaatgccgccattcgcgaaaagctagcctgggccaaggaaaagtatagcataggcgagcctacagtcccctcaactttggctgaagagttcacctacaacccgtttatgcgggttagggaaaaaacagtacagcaacatgccggcgaaacggacccagtcactacgatgcgggcggtgcgtcgcgaaaaggatcagttcaagatgcctcgggattag

SEQ ID NO: 120315 - DNA, 927 bp, Artificial Sequence
  Description of Artificial Sequence: Synthetic coding sequence
atggtggtgggccgggggttactgggcagacgctctcttgccgcgctgggtgctgcatgcgcgcggcgcggcttagggccggccctgcttggtgtgttttgccataccgatctgcgcaagaacctaacagtggacgagggcacgatgaaggtggaggtcttgcctgctcttacagataattatatgtatctggtcatcgatgacgaaaccaaggaagcagccattgttgacccagttcagccacagaaggtcgttgatgccgcccgtaagcatggcgtgaagctcaccaccgtgttgactacccatcaccactgggaccacgccggcgggaacgaaaagctggtgaaactcgagagtggcctcaaagtatacgggggggacgaccgcatcggggcgctgacccacaaaataactcatttgtcaacactgcaggtggggtcgttaaatgtcaaatgcctcgccaccccatgccacactagcggccacatctgctattttgtgtctaagcctggaggtagcgaaccaccagccgtgttcacaggcgacacactgttcgtggccgggtgcggcaagttctatgagggtacagctgacgagatgtgtaaggccttgctggaagtgctcggccggctccctccagacaccagggtgtattgcggacacgagtacactatcaacaacctgaaatttgcacgacatgtggaaccaggcaatgcggctattcgggaaaagttggcttgggccaaagagaagtattctataggcgagcccaccgtgccatccaccttggcagaggagtttacatacaacccttttatgcgggtcagagagaagaccgtgcagcagcacgcaggcgaaacggacccggtgacgactatgagggcggtgcgacgggagaaagatcaatttaagatgcctagagactag

SEQ ID NO: 120316 - DNA, 711 bp, Artificial Sequence
  Description of Artificial Sequence: Synthetic coding sequence
atggtagtgggaaggggacttctgggccgccgttctttagcagccctgggggcagcttgcgcccggagagggctcgggcccgctctgctaggagtcttctgccataccgatctgagaaaaaatctgacagtcgacgaggggaccatgaaagtggaggttctgccagctctcaccgataactatatgtacttggtcattgatgatgagaccaaagaggccgcaattgtcgatcctgttcaaccccagaaagtggtggacgctgcaagaaagcacggagtgaaactcaccactgtgctaacaactcaccatcattgggaccacgctggagggaacgaaaaattagtaaaactcgagagcggattgaaggtctacgggggtgatgacaggattggagcgttaacccacaagataacacatctgtcaaccctccaagtcacgccatgcctttggctcgccgcaggctcatctatgaaggggctcaggatgaggtgtgtcaaactttgctggaggtcttgggccggcagtccccgaacacaagaatccacagtggcgacctctaccccatccactacctcttccctccacgctacatggtccccagcgatgcctcctagcgggaggtcttggccaggacccagacggtccaccgctagcggcagcccacagtgccatccaccgtggcaacgtagcttaccgaccaccccaagttag

SEQ ID NO: 120317 - DNA, 1128 bp, Artificial Sequence
  Description of Artificial Sequence: Synthetic coding sequence
atggccatgacgggatggagctgtctcgttacaggtgcagggggctttctcggacagaggattattagactccttgtgaaggaaaaagagcttaaggagatacgtgtgttagacaaggcttttggccccgagctgagggaagagtttagtaaattgcagaacaagaccaaattaaccgtgttagagggcgacatcctggatgaaccctttttgaaacgggcctgtcaagatgtatccgtgattattcatacagcgtgcataatagatgtctttggggtgacccatcgggagtccattatgaacgtgaatgtgaagggaacccagctgctgctcgaggcatgtgtgcaggccagtgtgcctgtattcatttacacttctagtatagaagttgccggacctaattcctataaggagatcatccaaaatgggcacgaggaagagcctctagagaatacatggcccgcgccatatccacactcaaagaagcttgccgagaaggctgtcctggccgccaatgggtggaacctgaagaatggcggaacattgtacacttgcgccctgaggcccatgtacatatacggggagggtagtagatttctgagcgcatcaattaacgaagccttaaacaataatggaatactcagctccgtggggaaattcagcactgtcaatcctgtgtatgtggggaatgtggcatgggcacacatccttgctctgcgggccctacaggaccctaaaaaggctccctctatcagaggacagttttattacatttcagacgatacccctcaccaatcctacgataacctcaattataccctgtccaaagagtttggacttcggctggacagtcgctggtcctttcccctcagcttgatgtactggattggattcctgctggagatcgtctcgtttctgctgagaccaatttatacttatcggcctccctttaatcgtcatatcgttaccctgagtaacagcgtgtttacgttcagctacaagaaagctcagcgggatttggcctacaagcctctctacagttgggaagaagctaagcaaaagaccgtggaatgggtcggttcactggtggaccgccacaaagagacactgaaaagcaagacacagtag

SEQ ID NO: 120318 - DNA, 1122 bp, Artificial Sequence
  Description of Artificial Sequence: Synthetic coding sequence
atgactggttggtcttgtctcgttactggagctggcggcttcctgggacagcggattatcagactgctggtgaaagagaaagagctgaaggagattcgcgtccttgacaaggcattcgggccggagctgagagaagagttctctaaactgcagaataagacaaagctgactgtgttggaaggggatattctggacgagccatttctgaaaagagcttgtcaggatgtgagcgtcatcattcatactgcatgtataatcgatgtgtttggcgtaacgcatagggaatccattatgaacgtcaatgtcaaaggcactcagctcctactcgaagcctgcgttcaagcgagcgtgcctgtcttcatctatacgtcatcgatagaagtggctggccctaactcctataaggaaatcatccagaacggccatgaggaagagccattggaaaatacctggccagcgccctaccctcacagcaaaaaactggccgaaaaggccgttctggctgcaaatggatggaaccttaaaaatggaggcacattgtacacatgtgccctcagacccatgtacatttacggggagggctcccgtttcctctcagcaagcattaatgaagcactcaacaacaatgggattctgtcttctgtgggcaaattctctacggtcaaccccgtgtacgttggcaatgtggcctgggcacacatcctcgccctcagggctttgcaggacccgaagaaggcaccctctatacgggggcagttctactatatatctgatgatacacctcatcagtcttacgataacctcaactacacactcagcaaggaatttggcctccggctcgacagccggtggagctttcctctgagcctgatgtattggatcggcttccttttagagatcgtgtccttcctgcttcgtccgatctatacgtataggcccccatttaacaggcacatcgtgacgctgagcaatagcgtgttcacattctcttacaagaaggcccagagggatctagcatataagcccctctacagttgggaggaggctaaacagaagacagtcgagtgggtcggaagtctggtggaccggcacaaagagacactgaagtcgaagacacagtag

SEQ ID NO: 120319 - DNA, 1122 bp, Artificial Sequence
  Description of Artificial Sequence: Synthetic coding sequence
atgactggctggagctgcctggtgactggtgctggcgggtttctgggccagaggataataaggctcttggtgaaagagaaggagctgaaagagatccgcgtcctggacaaggcatttggtcccgagttacgggaagaatttagtaagctccagaacaagacgaagcttacagtgttggaaggtgacattcttgacgaacctttcctcaagcgcgcctgtcaagacgtcagcgttattatccatactgcctgcatcatcgacgtgttcggtgtcacccatcgcgagtcgataatgaacgtgaacgtgaaaggcacccagctgctactggaggcctgtgtgcaggcctcagtcccggtgtttatctacacatcctccatagaggtagcaggccctaactcatacaaggagattatccaaaacggacacgaggaagaaccgcttgagaatacctggccagccccctaccctcactcaaaaaagctcgcagagaaagccgtgttggctgcaaacggctggaatttgaaaaatggggggaccctctatacctgtgctctgagacctatgtacatttatggagagggctctagatttttgtctgctagcatcaacgaagccctgaacaataacggcatactgagctcggtgggcaaattttcaacggtcaaccccgtgtacgtggggaacgtggcctgggcgcacatcctagcactgagagccctccaggacccaaaaaaggccccctctattcggggtcagttttattacattagcgatgacactccccaccaatcatacgataatctcaactataccctttcaaaggagtttggcctgagactcgactcccgatggtcattccctctctcacttatgtactggatcggttttttgttagagattgtttcttttctgttgagacctatctacacctaccgcccaccgtttaaccggcacattgtgacactgtcaaattctgtgttcacattctcctacaaaaaagcacagagagaccttgcctataaacccctgtattcatgggaagaagctaagcagaagacggtagagtgggtaggcagcctggttgaccgccacaaggagactcttaaatcaaagacccagtag

SEQ ID NO: 120320 - DNA, 249 bp, Artificial Sequence
  Description of Artificial Sequence: Synthetic coding sequence
atgacagggtggtcttgtctagtgactggagccggcggttttctgggtcagagaattatccgactgcttgtcaaggagaaggagcttaaggaaatccgcgtgctcgataaggcctttgggcccgagctacgcgaggaattttcaaaactacagaataagacaaagctaacagtgcttgagggcgacattctggacgaaccattcctgaaacgcgcctgtcaggatgtttccgttatcatccatacgtag

SEQ ID NO: 120321 - DNA, 1119 bp, Artificial Sequence
  Description of Artificial Sequence: Synthetic coding sequence
atgggctggtcctgtctcgtcactggagcgggcggcctcctgggccagcgtattgtgcgcctactggtcgaagagaaggaactgaaggagattagggctctagacaaagccttcagaccagagctgcgcgaggaattctccaaattgcaaaatcgcacaaagctgaccgtccttgagggggatatactcgacgaaccattcctgaaaagggcctgtcaggacgtcagcgtggtgatacacaccgcttgtattatcgatgtattcggcgtcactcaccgtgagtcaatcatgaatgtcaacgtgaaaggcacgcagctgctgctggaggcctgcgtccaggctagcgtacccgttttcatctacaccagctctatcgaggtggctgggcctaatagctataaggagattatccagaacggtcacgaagaggaacccctggaaaacacctggcccacaccgtacccctactcgaagaagctagccgaaaaggctgtcctggccgctaacggatggaatcttaagaacggtgacaccctgtatacatgcgctctgcgcccaacctatatatacggagagggggggccatttctttctgcaagcatcaatgaagcactgaataacaatgggatcctgagtagtgttggcaaatttagtacagtgaatcctgtatacgttggaaatgtggcttgggcgcatattctggcactgagggcacttcgagatcccaagaaagccccaagcgtgcggggacaattctattatataagtgacgacacgccacatcagagctatgacaatctgaactatatcttgagtaaggagttcggtcttcgtttagattctcgttggtctttaccccttaccctgatgtattggatcggcttcctgttggaagtcgtaagcttcttgctgtcgccaatttacagttaccagccgcctttcaatagacataccgtgaccctatccaacagtgttttcacattttcctataagaaagcacagagagacttggcctacaaacccctctacagttgggaggaggccaaacagaagactgttgaatgggtgggctctctggtggaccggcacaaggagacactcaagagcaaaacacagtag

SEQ ID NO: 120322 - DNA, 588 bp, Artificial Sequence
  Description of Artificial Sequence: Synthetic coding sequence
atggggtggagctgtctcgttacaggtgcaggcggtctattaggacagaggattgttcgcttattagtggaggagaaggaactgaaagagattcgggctctcgataaggccttccgacctgaattgagagaggagttctcgaaacttcagaaccgcactaaactcaccgtgctggagggggacatcttagacgagccatttttgaaacgcgcttgccaggacgtgtccgtggtgatccacacagcatgtatcatcgatgtttttggagtaacgcaccgggagtcaattatgaatgtcaacgtcaaaggaacgcagttattgctggaagcctgcgttcaagccagtgttccagtttttatctacacctcaagcatagaggtagctggtcccaatagctataaggagatcatccaaaacggccatgaagaggaacccctagaaaatacttggccaaccccatacccctacagtaagaaattggctgagaaagctgtcttggcggctaatgggtggaatttgaaaaatggagatactctctatacttgcgccctacggcccacatacatctacggggagggaggcccttag

SEQ ID NO: 120323 - DNA, 1119 bp, Artificial Sequence
  Description of Artificial Sequence: Synthetic coding sequence
atgggatggtcttgccttgttaccggggccggcggcctgttagggcagaggattgtgcggctcctagtggaagagaaagagctaaaagaaatccgcgcactggataaggccttcaggcccgaattgcgagaggaattttctaagctacaaaatagaaccaagcttaccgtgttggaaggagatatcctggacgaaccattcctgaagagggcatgccaagacgtgtcagtagtgatccatacggcctgcatcattgatgtctttggagtgacgcatagggagtctatcatgaacgtcaatgttaaaggtacacagctgctcctcgaagcttgcgtgcaagcgtcagtgcctgtgttcatatatacctcatccattgaagtggccggtcccaactcttacaaagagatcatccagaacggccacgaggaagaacccttagagaatacctggccgaccccatacccttacagcaagaaactggctgagaaagcagtcctggccgcaaacgggtggaatctaaaaaacggggataccctttacacatgtgccctgcgtcctacgtatatctatggggaaggtggtccttttctatcagcctcaataaatgaagctcttaataacaatggcatcctgagcagcgtgggaaaattctctacggtaaatccagtgtatgtcggaaatgtggcatgggcccacatcctggccttgagggctttaagggacccaaagaaagcgccgagcgtgagggggcagttctactacatttctgatgatacccctcaccagtcctatgacaatctgaattatattctctctaaggaatttggtctcaggctggactcgagatggtcccttccactcacgcttatgtactggatcggattcctactggaggttgtgtcattcctgttgtctcccatctacagctaccagccacccttcaaccgccacaccgtgacactttccaatagcgttttcactttcagttacaagaaagctcagcgtgacctggcctataaacccctctattcctgggaggaagccaagcagaagaccgtcgaatgggttggatcattggtcgatcgccacaaggagactttgaaatctaaaacccaatag

SEQ ID NO: 120324 - DNA, 591 bp, Artificial Sequence
  Description of Artificial Sequence: Synthetic coding sequence
atggcagattcagcacaggctcaaaagttagtctacttggtgactggaggctgcggctttcttggcgagcacgttgtccggatgctcctgcagcgcgagcctaggctgggggagctgcgggtcttcgaccaacacctgggcccatggctggaagagctgaagactggacctgtcagagttaccgctattcagggtgacgtgacgcaagctcacgaggtagctgccgccgttgcgggagcccatgtcgtgatacatacagccggcctggtggacgtgttcgggcgggcctcaccaaagaccattcacgaagtgaatgtccagggaacacgtaacgtgatcgaggcgtgtgtgcagaccggcacacgctttctggtgtacacctcgagtatggaggtcgtcggaccaaataccaaagggcaccctttctacagagggaatgaggacactccatacgaggcagtgcaccgacatccatatccctgttcaaaagctttggctgagtggttagtgctagaagccaacgggagaaaggctatgttgcccggctgtacctgttggcaaccaggctcctggtctagtggccagccctag

SEQ ID NO: 120325 - DNA, 1110 bp, Artificial Sequence
  Description of Artificial Sequence: Synthetic coding sequence
atggcagattcggcacaggctcagaagctggtatacctcgtgaccggggggtgcggcttcctcggagaacacgtggtgaggatgctattgcagagagaaccacgacttggtgaactccgggtattcgaccagcacctcgggccctggttggaggaactgaagacagggcccgtgcgcgtgaccgccatacagggtgacgtgacacaggcccacgaggtagccgccgctgttgctggggctcatgtagtcatccacacagccggcctggtggacgtcttcgggcgagcaagccccaagacaattcatgaagtgaatgtccaaggcaccagaaatgttatcgaagcatgcgttcaaacgggcacgcgatttttagtatatacatcttccatggaagtagtgggaccaaatacaaagggacaccccttctacagagggaacgaagacacaccttatgaggcggtgcataggcacccttacccctgcagcaaagctctggctgaatggctggtgctggaagctaatggccgcaaagtgaggggaggcttgcctctggtcacctgtgcactgcgccctactggcatctatggcgagggccatcaaataatgcgggacttctaccgacaagggctacgtctgggtgggtggctctttcgcgctatccccgcttctgtcgagcacggaagggtgtatgtgggcaatgtcgcctggatgcacgtgttggccgcacgcgagctggaacagcgagctactctgatgggcggtcaggtgtacttttgttatgacggtagcccctaccggtcctacgaggacttcaacatggaatttctggggccatgtgggctgcggctcgtcggagctaggccattactgccttactggcttttagtgtttctggccgccctcaatgccctgttgcaatggttactgcggccactagttttgtacgcccctctgctcaacccttatacattagccgtggctaacactaccttcacggtgagcacggataaagctcagagacacttcgggtacgaacccctgttctcgtgggaggatagtcggactcgcaccatcctctgggtacaggccgccaccggatccgcccagtag

SEQ ID NO: 120326 - DNA, 591 bp, Artificial Sequence
  Description of Artificial Sequence: Synthetic coding sequence
atggccgacagcgcccaggctcagaaactggtctacctcgtcacaggtgggtgcgggtttctgggcgaacatgtcgtgagaatgctgctccaacgcgaaccgcgtttgggcgagcttcgcgtctttgaccaacatttgggtccctggctcgaggagctcaaaacaggtcccgtgcgggtcacagctatccagggggacgtgacacaggctcacgaggtcgccgctgcagtcgccggtgcacacgtggtgatccatactgcaggtctcgtagacgtgtttggcagagcttccccgaagacgattcacgaggttaatgtccaaggcactcgcaatgtgatagaagcatgcgtgcagacaggaacaaggttcctggtttacacctctagcatggaagtagtcgggccaaacaccaaagggcacccgttctatcgcgggaacgaagacactccctacgaggccgtccatcgacacccttatccttgttcaaaggctctggccgagtggctggtgctggaagccaatgggagaaaagctatgttgcctgggtgtacctgctggcagcccggatcatggtccagtgggcagccctag

SEQ ID NO: 120327 - DNA, 1086 bp, Artificial Sequence
  Description of Artificial Sequence: Synthetic coding sequence
atgagcggcaacggcaatgcagccgcgacggccgaagaaaactccccaaagatgcgcgtgatccgcgtggggacccgcaagagccaactggccagaatccagaccgactccgttgtagctacacttaaagcctcatatcctggcctgcagttcgaaatcatcgccatgtccaccaccggtgataaaatcctggacaccgcgctatccaagattggcgaaaaatcattgtttacgaaggaactggagcacgctctcgaaaagaatgaggtcgatttggtggtgcatagcctgaaagacctgcctaccgtgctgccaccaggttttaccattggcgcaatatgtaagcgcgagaaccctcacgacgccgtcgtgtttcatcccaagtttgtgggtaagacacttgagactctgcctgagaaaagtgtcgtggggactagcagcctgcgtcgcgcggcccaactgcagcgcaagtttccgcacttggaatttcgaagtatcagaggtaatctgaataccagactgcgcaaacttgatgaacagcaggagttctcagccattatcctggctactgccgggttgcagcggatgggctggcacaacagagtgggtcagattctgcatccggaagagtgcatgtatgcagttggacaaggggccctgggcgttgaggtcagagcaaaggaccaggatattctggatctggtcggagtacttcatgaccccgagactctgttgaggtgcatagcagaaagagcctttcttcgacatcttgagggtgggtgttccgtgcctgtggctgtgcataccgccatgaaggacgggcaactgtatctaacgggcggcgtctggagtctggacggatctgatagtattcaggagaccatgcaggccaccattcacgttcccgcccagcacgaggatggccccgaagatgacccccagctcgtgggtatcactgctcggaacattccccgtggcccgcagttggcagcccagaacctcggaatttccctggccaacctcctgctgagcaaaggcgccaaaaatatcttggacgtggctcggcagttaaacgacgctcattag

SEQ ID NO: 120328 - DNA, 1035 bp, Artificial Sequence
  Description of Artificial Sequence: Synthetic coding sequence
atgcgggttattagagttggcacccgcaagtcgcagcttgccaggattcaaaccgattctgtggtggctaccctcaaagctagttaccccggcctgcagtttgagattatagcaatgtcaacaacaggggacaagatcctggacaccgctctttctaagattggggaaaagtcattgtttacaaaggaactggagcatgccttagagaagaatgaggtggatctcgtagtccatagcctcaaagacctgcctactgtgctgcctcccggcttcaccatcggcgctatttgcaaacgcgaaaacccacacgatgcagtcgtgtttcaccccaagtttgtggggaagacactcgagacattaccagaaaaaagcgtagtaggaacatcaagccttcgaagagccgcacagctgcagcggaagtttccccatcttgagtttcggagtattcgtgggaatcttaataccagactgcggaagctggacgaacagcaagagttctcagccatcatacttgccactgccgggcttcagagaatgggatggcacaatagagtgggccagattctgcaccctgaagagtgtatgtacgcagtcggtcagggagcccttggcgtggaagtccgggccaaggaccaagatattctggacctggtcggcgttctgcacgacccagagactttactgagatgtatcgctgaacgcgcttttctgagacacttagagggcggctgcagcgttccggtggccgttcataccgccatgaaagacggacagctgtaccttactgggggcgtgtggagtttagacgggagcgattcaatccaggagaccatgcaagcaacaatccatgtgcccgctcagcacgaagacggacctgaggacgatcctcagctagtgggtattaccgcacgcaatatcccaagaggcccccagctggccgctcagaatctgggaatttcgctcgccaacttgttattgtccaaaggtgccaaaaacatcttggacgtcgctagacagctcaacgatgcccactag

SEQ ID NO: 120329 - DNA, 1035 bp, Artificial Sequence
  Description of Artificial Sequence: Synthetic coding sequence
atgcgtgtgatccgcgtcgggacgcgtaaatcacagttggcgcgcatacagaccgacagcgtggtggctacactgaaggctagttacccaggactccaatttgagattatcgccatgagtaccaccggagataaaatattggataccgccttgagcaagattggagaaaagagcctgttcactaaagaacttgagcacgctctggagaaaaatgaggtggatcttgtggttcattcgctcaaagaccttcccaccgtactgccgcctggatttacaattggagctatctgcaagcgcgaaaatccgcatgacgccgtggtttttcaccccaagttcgtaggtaaaaccctcgagacattaccagagaaatcagtggtgggaactagctcactgcggagagcagctcaactgcagcgaaagtttcctcacctcgaatttcgcagcatcagggggaatctgaacacacgcttgcgtaaactcgacgagcaacaggagttctccgcaatcattctggcaactgctgggctccaaaggatgggctggcacaacagggtgggacaaatattgcatcccgaggaatgcatgtatgcggttgggcagggagccctgggcgtggaggtgcgggctaaggaccaggacatattagatctggtaggagtcctccatgacccagagaccctcctgaggtgtattgcagaaagggcgtttctccgtcacctggagggaggatgcagcgtgcctgtggcggtgcacaccgcgatgaaagacggtcaactttacttaaccggcggggtgtggagcctggatggatctgatagtatccaggaaactatgcaagcaacgattcacgtcccggcgcaacatgaggatggacccgaagatgatccgcagcttgtgggcataacagcccgcaatatcccccgtggcccccagctggccgcccaaaatctgggcatcagcctcgcaaacttactgttgtctaaaggagccaagaatattctggacgtggctagacaactgaatgatgctcactag

SEQ ID NO: 120330 - DNA, 564 bp, Artificial Sequence
  Description of Artificial Sequence: Synthetic coding sequence
atgcgtgtgatcagagtgggcacaaggaagagccaactcgcccgcattcaaactgattccgtggtggcaaccctgaaagcatcttatcctggtctgcagtttgagatcattgcgatgtccactacaggcgacaagatcctggacacagccctttcgaaaatcggcgagaaatccctcttcaccaaggaactcgaacacgccctggaaaaaaacgaagttgacctggtggttcactccctgaaggaccttcccactgtgctcccgcccgggtttactattggcgcaatttgcaagagagagaaccctcatgacgcggttgtattccatcctaagtttgtgggtaagacactagagactttgccagagaaaagcgtggtaggaacaagctccttgcgccgcgctgcccagctgcaacgcaaatttccacatctggagtttcgaagcatccgcggtaatctcaacacacggctcagaaagctcgacgagcagcaggagttctctgctatcatcctggccacagctggactccagaggatgggctggcataatagggtgggccagtag

SEQ ID NO: 120331 - DNA, 1035 bp, Artificial Sequence
  Description of Artificial Sequence: Synthetic coding sequence
atgcgggtcatacgcgtcggaaccaggaaatctcaattggcccgaattcagaccgactctgttgttgctacactaaaggcgagttatcccgggctgcagttcgaaatcatcgccatgtcaactaccggcgataagattctggacactgcactgtccaagattggtgaaaagtcactgtttacaaaagagcttgaacacgcattggaaaaaaacgaagtggacctggtagttcactcactgaaggatctccctactgtgctaccgcccggtttcacaattggagccatttgcaagagggagaatccacacgacgccgtggtttttcaccctaagttcgttggcaagaccctggagacactgcctgaaaaatcagtggtgggaacctcgtctttgcgacgcgcggctcaactgcaacgaaaattcccccacctggaattccggagcatacgaggcaacctcaataccagactccgtaaactggacgagcagcaagaattctccgcgatcatcctcgcgacagctggcttacaacgtatggggtggcacaatagagtgggccaaatcctccaccccgaggagtgtatgtacgcagtgggccaaggggctctgggtgtggaggtacgagctaaggaccaggatattttggatctggtcggcgtgcttcacgatcccgaaaccctactccgctgcattgctgagagggctttccttaggcacctggaaggagggtgttccgttccagtggcagtgcacacagccatgaaggatggtcaattgtacctgactgggggagtgtggtcgttggacggatccgactcaatacaggagactatgcaggccactatccacgtgcccgcacagcatgaggacggtccagaggatgatcctcagttggtgggtatcacggcgcggaacatccctaggggccctcaactggccgctcagaacctggggatctctctggccaacctgctgttatccaagggggccaaaaatatcctcgacgtcgcccgtcagctgaatgacgctcattag

SEQ ID NO: 120332 - DNA, 564 bp, Artificial Sequence
  Description of Artificial Sequence: Synthetic coding sequence
atgcgcgtcattcgagtcggcacccgtaaatcccagttggcacggatccagacagacagcgtcgtggctactctcaaagctagctaccccgggctgcagtttgagatcatcgcaatgtccacaacaggagataaaatattggataccgcgttgtcgaagatcggcgaaaagtccttgtttacaaaggaactagaacatgcccttgagaaaaatgaggttgatctcgtggtgcatagcttgaaagacctgcctaccgtcctgccccccgggtttacaatcggtgctatttgtaaaagggaaaatccacacgatgctgtcgtttttcatcctaaatttgtgggcaaaacactggaaacattgccagagaaatcggtggtgggcacatctagccttagaagggccgctcagttacaaaggaaattcccccatctggaattccgatctattcgcggtaacctgaacacccgactgcgaaaattggatgaacagcaggagttcagcgctattatactggccacagcaggactccagcgcatgggatggcacaaccgggttgggcagtag

SEQ ID NO: 120333 - DNA, 915 bp, Artificial Sequence
  Description of Artificial Sequence: Synthetic coding sequence
atgagggtgatccgtgtcggcacccggaaaagccagctggcccgaattcaaaccgattctgtcgtcgcaacactcaaagctagttatcccggcctgcagttcgaaatcatcgctatgtcaacaaccggagataagatcttagatacagccctgagcaagattggtgagaagtctctattcaccaaggagttggaacatgcactcgagaagaacgaagttgacctagttgtgcactccctcaaagacctccccacagtgcttccccccgggtttaccataggcgcaatctgcaaaagggagaaccctcatgatgccgtggtgtttcatcctaaattcgtgggcaaaacactcgagaccttaccagaaaagtcagtcgtgggcaccagcagcctaagaagagcggcccaactacagcgcaagtttcctcacctggagttcagatctattcgggggaacttaaacacccgcctaagaaaactcgacgagcagcaggaatttagcgcgatcatcctggcaacagcaggattgcagagaatgggttggcacaatagggtcgggcagatcctgcatccagaggaatgcatgtacgctgttggacaggaagggggatgttcagtcccagtggccgtgcacactgcaatgaaggacggccagttgtacctgactggaggtgtgtggagtctggacgggtcagatagcatacaagagacaatgcaggcaacaatccatgttccagctcagcatgaggatggcccagaagacgatccccagcttgtgggcattactgccaggaatattcctcggggaccacagttggctgctcaaaacctgggtatcagcctggccaatctgcttctcagcaagggagccaagaacatcctggacgtggcccgacagctgaacgatgctcattag

SEQ ID NO: 120334 - DNA, 966 bp, Artificial Sequence
  Description of Artificial Sequence: Synthetic coding sequence
atgtctggaaacggcaatgccgccgccactgcagaggagaatagtcctaaaatgcgggtgatccgagtggggacccggaaatcacaactagcccgcattcagaccgatagcgtggttgcaacgctgaaggcctcataccccggcctccaattcgagataatcgcaatgagcacaaccggggataagatcctggacacagccctaagtaagataggagaaaagtctctgtttacaaaggaactagaacatgccctggagaagaatgaggtcgacctggtggtccactccctgaaagatctccccactgttctgcctcccggcttcacgattggcgccatctgcaagcgggagaatccacacgatgccgtcgtattccaccctaaattcgtagggaagactcttgaaaccctgcctgagaaatcggttgttggaacttcttccttgagaagagctgcccaattacaaagaaagttcccgcacttggagtttcggtcaatccgggggaacctaaacacgaggctccgaaagcttgacgaacagcaggagttttccgctattatactcgccacggcagggctgcagcgtatgggatggcacaatagggtcggacagatactgcaccctgaagagtgcatgtatgccgtcggccaggagggtggatgcagcgtgcctgttgccgtgcataccgccatgaaagacggccagctgtacctgactggaggagtgtggagtctggacggttctgattcaatacaggagaccatgcaggcgactatccacgttccggctcagcatgaagatgggccagaagatgacccacagttggtgggtattactgctcgcaatattcccagaggaccacagctagcggctcagaacctggggatttccttggccaatttgttactgagtaaaggtgccaagaatattctggacgtggctcgacagttgaacgacgctcactag

SEQ ID NO: 120335 - DNA, 879 bp, Artificial Sequence
  Description of Artificial Sequence: Synthetic coding sequence
atggcattcatgaaaaagtatctactccctattttagggctgtttatggcttactactattactccgccaacgaagaattcagaccagaaatgctgcagggaaaaaaggtgatcgtcaccggggctagcaagggaattgggagagaaatggcctaccatctggcaaagatgggtgcgcacgtcgttgtgaccgcacgcagcaaggagacccttcaaaaagtggtcagccattgcttggaactgggtgccgcaagtgcccactatatcgctggcacgatggaggacatgacattcgccgagcagttcgtcgcacaggccggaaaactcatgggcggacttgacatgctgatccttaaccatattacgaacactagccttaatctgttccacgatgacatccaccatgttcgaaaatctatggaggtgaatttcctttcttatgtagtgctgacggtcgcagcactgcccatgctaaagcagtccaacggtagcatcgtcgtggtctcctcccttgccggtaaggtggcatacccgatggtggcagcctatagcgcttccaagttcgccttggacggtttcttcagctccatccggaaggaatattccgtgtcaagagttaacgtctctattacattatgtgttctcggtctcattgacaccgagaccgcaatgaaagctgtgtcaggcattgtgcacatgcaggccgcccccaaggaggagtgcgcactggagataattaagggcggggccctgcgacaagaagaagtgtattacgactcatcgttatggacgaccttattgatacgtaatccctgcaggaagatacttgaattcctgtactcaacgtcttacaatatggatcgcttcataaataaatag

SEQ ID NO: 120336 - DNA, 879 bp, Artificial Sequence
  Description of Artificial Sequence: Synthetic coding sequence
atggcattcatgaagaaatacctgctgccaatcctcggcttgttcatggcgtattactattacagtgccaatgaagaatttcggcccgagatgcttcagggcaaaaaggttatagtgacgggagctagtaaaggcattggccgtgagatggcctaccatttagcaaaaatgggagcacatgtcgtggtgaccgcgcggagcaaagaaacgctgcagaaagttgtcagccactgtctagagctcggggcagcttctgcccactatatcgctgggacaatggaggatatgacttttgccgaacagtttgtcgcccaggctgggaagctgatgggtggcctggacatgctcatactaaaccacatcaccaatacgtctctcaatctgttccatgacgacatccaccatgtgaggaagtccatggaagttaattttctgtcttatgtcgtcttgactgtggcagccctgcccatgctcaaacagagtaacggaagcatcgtcgtcgtgtcgtcactcgctggcaaagttgcctaccccatggtggcagcatattctgcgtccaagttcgctctggacggcttcttttcttcaatccggaaggagtacagcgtttctagagtgaacgtgtctatcacactgtgtgtcctgggactgatcgacaccgagactgcaatgaaagccgtgtccggtattgtgcatatgcaagccgcccccaaagaagaatgcgctctggagataataaagggcggagcattaagacaggaagaggtgtattatgattcaagcttatggactaccctattaatcaggaatccttgccggaagatcctcgaattcctgtatagcaccagttataacatggatcgtttcatcaacaaatag

SEQ ID NO: 120337 - DNA, 879 bp, Artificial Sequence
  Description of Artificial Sequence: Synthetic coding sequence
atggcctttatgaaaaaatacctgctaccaatattggggctgtttatggcatattactattactctgcaaatgaagaatttcggccagaaatgctgcagggcaagaaagtcatcgtgaccggcgcaagcaaaggcatcggtagagagatggcctatcaccttgccaagatgggtgcacacgtggttgtgacagcaaggtccaaggaaactttgcagaaggtggtgtctcactgccttgagctcggcgccgcctccgcacactatattgccgggactatggaggacatgacttttgccgaacagttcgtagctcaagctgggaaactgatgggaggactcgatatgttgatcctgaaccacataactaacacctcactgaatctgtttcacgatgacattcaccatgtgagaaagagcatggaagtaaacttcctcagctacgtggtgttgacagtggccgccctgcccatgctcaagcagagcaatgggagtattgtggtagtaagctctctagctggcaaggttgcatatcccatggtagcagcctactcggcctctaaatttgccttagacggatttttctccagcatcagaaaagagtactcagtgtctcgtgttaacgtctccattaccctatgcgtacttggtcttatcgatacagagactgccatgaaggccgtgagcggcattgtgcatatgcaggccgcaccaaaggaagaatgtgccctggaaatcatcaaagggggcgcactaaggcaagaggaagtgtattatgattcctcgctctggaccaccttacttattcggaatccatgtcggaagattctggagttcctctacagcacctcatacaacatggatcgctttatcaacaagtag

SEQ ID NO: 120338 - DNA, 1218 bp, Artificial Sequence
  Description of Artificial Sequence: Synthetic coding sequence
atggaaagatggccctggccctctgggggcgcatggctgctcgtcgctgccagggccctcctccagcttttaaggtcagatctaagattgggacgccccctcctggccgcgctggcactgctggctgctctggactggctgtgtcaacgtcttttgccacctccagccgctctcgccgtactcgctgccgcgggctggatagcactgtcacgactcgcgagaccccaaaggctccctgtggccacccgtgcagtgctgattacgggctgtgattcgggcttcgggaaagagaccgccaagaaactcgacagtatggggttcacagtgctcgctactgtgctggagcttaatagcccgggcgcgatagaactgaggacttgttgctccccaagactgcgcttgctccagatggacctcactaaacccggagacatctctcgggtcctcgaatttaccaaagcacacaccacgagcacaggtctctggggcttggttaataacgccgggcataacgaggtggtggccgacgcagagctgtccccagtggccacttttcggagttgtatggaagtgaatttcttcggggccctcgagctgacgaaggggttgttaccactgctcagaagtagtcgtggccgcatcgtcaccgtgggatccccagcaggcgacatgccttatccttgtttaggggcgtacgggactagtaaggccgccgtggccttgctgatggataccttctcttgcgagttgctgccgtggggtgttaaggtcagcattatccaacctggctgtttcaaaactgagtctgtgcggaacgtcggacagtgggagaagaggaagcaactgctactcgccaatctcccgcaggagctgttacaggcatatggaaaagactacattgaacacctgcacggtcagtttctccactcccttagactagcaatgtccgatctgactcccgtagtcgacgctatcactgacgctctcctcgctgcgcgtccacgaagaaggtactaccccggccagggcctgggactgatgtattttatccactactacctgcctgagggtcttagacgccgcttcctgcaggctttctttattagtcattgtctgccaagggctttgcagcccggccaacccggaaccaccccaccgcaggacgccgcgcaggatccaaatcttagcccaggcccttcccctgctgtggcgcgttag

SEQ ID NO: 120339 - DNA, 2232 bp, Artificial Sequence
  Description of Artificial Sequence: Synthetic coding sequence
atggaggctgtggctgttgctgctgccgtcggtgtgttacttttggctggagccggtggagcagccggcgacgaggcaagggaagccgcggctgtgagggctctagtagctcggctgctagggcccgggcccgcagccgacttcagtgtctccgtcgagcgtgctttggccgctaagcccgggctggacacctactctctcggaggcggaggagcagctcgcgtgcgcgtccggggctcgactggggtagccgccgctgcagggttgcacaggtatctgcgcgatttttgtggatgccatgtagcttggagcggctcacagctccgactccctcggcccctgccagcagtgccaggtgagctgaccgaagcaacacctaatagatataggtactaccagaacgtatgcacacagtcttacagcttcgtctggtgggactgggcccgctgggaacgggaaattgattggatggcattgaacggtatcaacttggccttggcctggagcggccaggaagccatctggcagcgcgtctacctcgctctgggcttgacccaagccgagataaatgagttcttcaccggacctgcctttctggcttggggaaggatgggaaatttgcatacctgggatggtccacttcccccttcctggcatattaaacagctttacctacaacaccgggtgctggatcaaatgcggagcttcggtatgacgccggtattacccgctttcgccggccacgtacctgaggctgtaacacgagttttccctcaggtaaatgtgactaagatggggagctgggggcatttcaactgtagctacagctgtagcttccttttggcccctgaggatcccatttttccaattattgggtcactctttctgagagagctgattaaagagttcggtaccgaccatatatacggcgctgatactttcaatgaaatgcaacctcccagttcagagccttcctatctagccgctgcgaccacagcggtttacgaggctatgaccgcagtagataccgaggccgtctggctgctacagggatggttattccagcaccaaccgcagttttggggcccagcgcaaattcgcgcagtgctgggggcagttccccgtggcagactgctggtactggatctgttcgccgaatcacagccggtgtacacaagaacggccagctttcagggccagcccttcatctggtgcatgcttcacaacttcgggggcaaccacggtctgtttggagcactggaagccgtgaacggagggccagaggcggctagactctttcctaactcgacgatggtcgggaccggcatggcacctgagggcatatcgcagaatgaggtggtgtactccctcatggccgaactgggatggagaaaggaccccgtgcctgacctggctgcctgggtgactagctttgccgcgaggcggtatggcgtctctcaccctgacgctggagccgcttggaggttgctactaaggtccgtgtataattgcagcggcgaggcctgccggggccacaatcgaagccctcttgtgcgacgtccttcgttgcagatgaacacctctatctggtataacagatccgacgtattcgaggcctggaggcttctattgacctcagcgcctagtctggcgactagcccggcgtttcggtacgaccttttagatctgactagacaggccgtgcaagaacttgtctccctctattacgaagaggctcgttccgcttatttgtcaaaggaacttgctagtctactgcgagcaggtggcgttctggcttatgaactactgcccgcgctggacgaggtgctggcctctgattctagattcctattggggagctggctcgagcaggcccgggccgccgccgtctctgaggctgaggcagatttttatgaacagaattccagataccagttaaccctttgggggcccgaagggaatattctggattatgcaaacaaacagctggcaggcctagtggccaattattacacccctcgatggagactgttcctggaggccctcgtggactctgtggcacagggcattcccttccagcagcaccagtttgacaaaaatgttttccaacttgagcaggcattcgttctcagtaagcagaggtacccttcacagcctaggggcgacactgtggacctggcaaagaaaatttttctgaagtattaccccaggtgggtggctggaagctggtag

SEQ ID NO: 120340 - DNA, 450 bp, Artificial Sequence
  Description of Artificial Sequence: Synthetic coding sequence
atggcccgaacagtggtgcttatcaccggctgtagttctggaattggcctccatctggcagttaggcttgcctcagatccatctcagagttttaaggtctacgccactttaagagacttaaaaactcaaggacgtttatgggaggcggcacgtgcgttggcctgtcccccagggtcactggaaacattgcaacttgacgtgcgcgatagtaaaagtgtcgctgcagctagggagagggtgactgaaggcagagttgacgtccttgtgtgtaacgcggggttaggccttctgggaccacttgaagcgctgggggaagacgccgtagcctccgtcctggacgttaacgtcgtggggaccgtcagaatgcttcaggcctttttgcccgacatgaaacgcaggggtagcggaagggtgcttgtcaccggctctgtagggggccttatggcttag

SEQ ID NO: 120341 - DNA, 987 bp, Artificial Sequence
  Description of Artificial Sequence: Synthetic coding sequence
atggccagaaccgtagtactaataaccggatgctcctccggaatcgggctccacctggcagtacgtttagcctcggacccctcgcagagcttcaaggtgtacgcaaccttaagagatctgaagactcagggaagactctgggaagccgctcgtgcccttgcttgcccacctgggtccctagagacactacagctggacgtcagagactctaagagcgtggcagctgcacgcgaaagagttacggaaggccgagtagacgtgctcgtatgcaacgctggactgggtcttttaggtccgctggaggctctgggggaagatgccgtggccagtgtgctggacgtcaatgtggtcgggacggtccggatgctgcaggcgttcctgcctgacatgaagcgccgcggatcagggagggtgctggtgaccggtagcgtgggcgggttaatgggcctccctttcaatgacgtttattgcgcatctaagttcgcactggaagggttgtgcgaatcattggcagtgctccttttgccctttggcgtccacctttcccttattgaatgcgggcctgttcacaccgcatttatggaaaaagtgctcgggtcccccgaggaagtattagatagaacagacattcatacctttcataggttttaccagtacctggcacattctaagcaggtgttccgggaggcagcacagaaccctgaggaagtggcagaggtgtttttgaccgctcttcgagctccaaagccaacactccgttactttaccacagagaggttcctaccattacttcggatgcgcctggacgatccatccggcagcaattacgtgacagcaatgcatcgcgaagtgtttggcgatgtccccgcaaaggcagaggccggtgctgaggccggggggggggctgggcccggggccgaagatgaggctggccgcggcgccgtgggcgaccccgaacttggcgacccaccagctgcaccccagtag

SEQ ID NO: 120342 - DNA, 447 bp, Artificial Sequence
  Description of Artificial Sequence: Synthetic coding sequence
atggcatgtacagtggtgctgattactggctgctcctccggaattggcctgcacctggctattcatctcgccctcgacccctctcaatcttttaaagtgtacgccactctacgcgatcttaaaactcagggccgactatgggaggccgcccgggccctggcatgtcctcagggcagtctggaacgactgcagctggatgttcggaatagtagcagtttggccgccgcccgggaacgtgtgacggagggacgggtcgatgtgctagtttgtgataccggactgggacttctcggaccattgggagaggacgccgtggcatccgtactggatgtgaacgtggttggcaccgtccgcgtgttgcaagactttctgcccgatatgaaacgcccaggcagcggacgtgtgttagtgacggggtccatggggggattgatgggggaatggtag

SEQ ID NO: 120343 - DNA, 786 bp, Artificial Sequence
  Description of Artificial Sequence: Synthetic coding sequence
atggccgctgcctgccggagtgtgaaaggtcttgtcgcagtgattacaggaggtgccagtggcctggggttggcgacggccgaaagattggtcggtcaaggggcctctgcagtactcctggacttgcctaatagcggcggagaggcccaagccaaaaaactgggcaataactgtgtcttcgcccccgccgacgtcacctcagaaaaggacgtccaaactgctctggcactggccaaggggaagtttgggagggtggatgtggccgtgaactgtgccggcatcgccgtcgcctctaaaacctacaacctcaagaaaggtcaaacccacaccctggaagattttcagagagttctcgacgtgaacttgatggggaccttcaatgtgatccggctggtggctggcgaaatggggcaaaacgagccggaccagggaggccagcgtggtgttattatcaacacggccagtgtcgccgcattcgagggacaggtggggcaggccgcctacagcgccagcaagggcgggattgtcgggatgacgctgcctatcgccagagacctggcccccattggtattcgtgtgatgacaattgctccagggctgtttggcactcctttgctgactagcctacccgagaaggtgtgcaatttcctggcctcccaggtccctttccccagccgtctaggtgaccccgccgagtatgcccacctggtgcaggccataattgagaatccattcctcaatggggaggtcattaggctagacggcgccattcgaatgcagccctag

SEQ ID NO: 120344 - DNA, 510 bp, Artificial Sequence
  Description of Artificial Sequence: Synthetic coding sequence
atggcagctgcctgtcgctccgtgaaaggactggtggcggtcatcacaggaggagccagcggtttgggccttgctacagccgagcgattagtggggcagggcgccagcgccgtactcttggacctgcccaatagcgggggggaggcccaggccaagaaactgggaaacaattgtgtttttgccccagcggatgtgacatcagaaaaggatgttcagaccgccctggctcttgccaagggtaaattcggaagagtggacgtggctgtcaactgtgcgggaatcgcagtggcttctaaaacatacaacttgaagaaggggcaaacccacacactcgaagactttcagcgagtcctcgacgtgaatttgatggggacattcaacgtgattcggttagtggccggcgaaatgggccagaacgagcccgaccagggcggtcagcgcggagtgatcatcaacactgcttctgtggccgcttttgagggccaggtgtgtctcgctccccattgctag

SEQ ID NO: 120345 - DNA, 759 bp, Artificial Sequence
  Description of Artificial Sequence: Synthetic coding sequence
atggccgccgcctgcagatctgtgaaggggctggtcgccgtgatcactgggggggcaagtggcctaggcctcgcaaccgcagagaggctggtcggacagggggctagtgctgtgcttctggatttgccgaacagcggtggcgaggcccaggccaaaaagcttgggaataactgtgtcttcgctccagcagatgtcacatcggagaaggacgtgcagacagccctggccctagccaaaggcaaatttggtagggtggatgttgcagtgaattgtgccgggatagccgtggcgagcaagacctacaacctcaaaaaggggcagacgcacacactcgaagactttcaaagagttctggacgtgaatttaatgggaactttcaatgttatccggcttgtcgccggtgagatgggccagaacgaacccgaccaaggtggccagcgcggggtgataattaacaccgcttccgtggccgccttcgaaggccaggtcggccaagcagcttattcagcttcgaaaggggggatagttggcatgaccctgcccatagcacgcgacctggcacccattggactcttcgggactcccctcttgacctcgcttcccgagaaggtatgcaattttctggcctcacaggttccattccctagccgactgggcgaccctgctgagtacgcccacctggtgcaggctatcatcgaaaacccctttctgaatggggaagtcattagattagatggcgctatccgcatgcagccttag

SEQ ID NO: 120346 - DNA, 903 bp, Artificial Sequence
  Description of Artificial Sequence: Synthetic coding sequence
atgaaattcttacttgacatcctgctgcttctgcctttgctcatcgtatgttcacttgagtccttcgtgaagctttttattccgaagcgccgaaagtccgtgacaggtgagatagttcttattacaggggctgggcatggaataggccggctgacggcttacgagtttgccaagctgaaaagtaagctcgtgctctgggacattaataagcacggcttagaggagaccgctgcaaagtgcaaaggcctcggagccaaggtgcacaccttcgtggtcgactgtagtaacagggaggacatctacagctccgcgaagaaggtgaaggcggagatcggggacgtttcgatcctcgtaaataacgccggggtggtttacacttctgatctcttcgctacccaagacccccagatagagaagacattcgaagtaaacgtacttgcacatttttggacaactaaggcattcctgccagccatgaccaagaacaaccatgggcatatagtgactgtcgcaagcgcggccgggcacgtttcagtcccttttctgctggcctactgtagcagcaagtttgcagcagtgggattccacaagaccctgacagatgagctggctgcactacaaatcacaggcgtgaaaactacttgtctgtgtccgaattttgttaacaccggttttatcaagaatccgtccacttccctcggacccaccctggagccagaggaggtcgttaaccggttaatgcacggtattctgactgaacagaagatgattttcatcccttcatctattgccttcttgaccactctggagaggatcctgcctgagaggtttctcgcggtgttgaagcagaagatctcggtgaagtttgacgccgtgattggatacaaaatgaaggcccaatag

SEQ ID NO: 120347 - DNA, 795 bp, Artificial Sequence
  Description of Artificial Sequence: Synthetic coding sequence
atgaacatcatcttggagatattactcctgctgattacaatcatctacagttatctggagtccctggtgaaattcttcataccacagaggagaaagagtgtagctggggagatcgttctcattacaggcgctggacacggaatcggtcgtcagaccacgtacgagttcgcaaagcgccaaagcatccttgtgctctgggacataaacaaggtaaagaaagaagtcggcgatgttaccattgtcgtcaacaatgctgggaccgtttaccccgccgacctactgagcactaaggacgaagaaattaccaagacgtttgaagtcaatattctcggacatttttggatcacaaaggctctgctgccctcaatgatggagagaaaccacggtcacatagtgacggtggcctcagtttgtggccacgagggtatcccttatctgatcccatactgctcgagtaaatttgctgctgtgggctttcacaggggactgacttcagaactgcaggccctcggcaagaccggaattaaaacatcatgcctctgtccagtgttcgtgaacaccggttttacaaaaaatcccagcaccaggctctggccagtgctcgagacggatgaggtggtccgatctctgatagatggcatcctgacgaataaaaagatgatctttgtgcccagctacatcaacatttttctgaggttacagaaattcctgcccgagcgggcctcggcaatactcaatcggatgcagaacatacagttcgaggcagtggtaggacacaaaatcaaaatgaagtag

SEQ ID NO: 120348 - DNA, 903 bp, Artificial Sequence
  Description of Artificial Sequence: Synthetic coding sequence
atgaacatcattttggaaattcttctcctgttaatcactataatctacagttatctggaatccttggttaaattcttcatacctcagcgaagaaaatctgtcgcaggggagatcgtgctgataaccggggcaggccacggtattggccgtcaaaccacatatgagtttgccaagcgacagagtattcttgttctctgggacatcaataaacggggtgtggaagagactgccgctgagtgcaggaagctgggagttaccgctcatgcttatgtggttgactgcagtaatcgcgaagagatataccgcagtctcaaccaagtgaagaaggaggtgggcgacgttaccattgtggtcaacaacgccggaacagtgtaccctgcagaccttctgtctacaaaggacgaggaaatcacaaaaacatttgaagtgaacatactggggcacttctggattactaaggcactgctgccaagcatgatggagaggaatcatggccacattgttaccgtcgcaagcgtatgtggccacgaaggcattccttacctaataccttattgctcctccaaatttgccgcagtgggattccatcgtggcctcacttccgaactgcaggctctgggcaagaccggcatcaaaacatcctgcctgtgtcctgtgttcgtgaacactggctttaccaaaaatccctcaacacggctgtggcccgtactggagacggatgaagtggttcggtcactcattgacggaatactcacgaacaagaaaatgatctttgttccttcctacatcaacatttttttgagactccagaagtttctgccagagcgagccagcgccatcttaaatcgcatgcagaatatccagttcgaggcggtcgtgggacacaagattaagatgaagtag

SEQ ID NO: 120349 - DNA, 813 bp, Artificial Sequence
  Description of Artificial Sequence: Synthetic coding sequence
atggcgacgggaacccgatatgcgggaaaggtcgtcgtggttacagggggagggaggggaatcggagctgggatcgttcgcgcatttgtcaatagcggtgcaagagtggtgatctgcgataaagatgagagcggggggcgagctctggagcaggagttaccaggagccgtgtttatcctctgcgatgttacccaggaggacgacgtcaaaaccctagtctcagaaacaatcaggagatttggacgtctcgactgtgtggttaataatgccggccaccacccgcctccccaacgcccggaggagacgagcgcccagggattccggcagctccttgaactcaatcttctcggcacgtatactctgactaaactggcgttgccctatctgagaaaatcccagggaaatgtgatcaatattagtagtctagtgggggccataggacaagcccaagcggtcccttacgtggccaccaagggcgctgtgactgctatgactaaagctctggccttagacgaaagcccgtatggtgtacgggtaaattgcatcagccccggtaatatttggacacccctgtgggaagagttggccgcacttatgccagatccaagagcaaccatccgagaaggtatgctggcgcagccgctggggaggatgggacaaccagcggaagtgggagcggctgccgtgttcctggcctccgaagcaaacttttgcacgggaatagaactccttgtcactggcggtgccgagttaggatatggatgcaaagctagccgaagcaccccagtggacgccccggacatcccttcttag

SEQ ID NO: 120350 - DNA, 1164 bp, Artificial Sequence
  Description of Artificial Sequence: Synthetic coding sequence
atgtccacattcttttccgatacagcctggatttgtctcgcagtgcctactgtgctatgtgggaccgtattctgcaagtacaagaagtccagtggacagctttggagttggatggtttgcttggccggactctgtgcagtgtgtctgttgatcctgtcaccgttttggggcctaattctttttagcgtctcgtgcttcttgatgtatacctacctctcaggacaagagctcctcccggtggatcaaaaggcagtgttagttacaggaggcgactgcggactcggacatgcactgtgcaagtacctcgatgagcttggattcaccgtgtttgccggcgtattgaatgaaaatggtccgggggcagaagaactcaggagaacatgcagtcccagattgtccgtcctgcagatggacattacaaagcccgtccagatcaaagatgcatactcaaaagtggctgccatgctccaagatcgcggtctgtgggcagtgattaataacgccggcgtgctgggctttccgactgacggagagctgctcctgatgacagactacaagcagtgcatggcggtgaattttttcgggaccgtcgaggttactaagacgttcctgccgctactgcggaagagtaaaggtagactcgtaaatgtgtcatctatgggaggcggcgctcccatggaacgcctggcaagttacggctcgtccaaggcagccgtaacgatgttctcctctgtaatgcgactggaactgtccaagtggggaattaaggttgccagcattcagcccggcggttttcttacaaacattgccggaacatccgacaagtgggagaagcttgagaaagatatcttagaccatcttcccgccgaagtccaggaggactacggtcaggattacattctggcgcagcgaaacttcctgcttttgattaacagcctcgccagcaaggacttcagcccagtgttgagagatattcagcatgccattcttgcaaaatcaccgttcgcctactataccccagggaaaggggcatacctctggatatgtcttgcccactatctcccaataggaatctacgattattttgccaaacgccactttgggcaggataagcccatgccacgggctttgcgcatgccgaattataagaaaaaggctacgtag

SEQ ID NO: 120351 - DNA, 783 bp, Artificial Sequence
  Description of Artificial Sequence: Synthetic coding sequence
atgggagatgtcctggagcagttttttatccttacagggcttctggtctgcctggcgtgtttggctaagtgcgtacgatttagccggtgcgtgctgcttaattactggaaagtcctgcctaaatccttcctccgttccatggggcagtgggccgtgatcacaggggcaggggatgggataggcaaagcctacagtttcgagctagccaaacgtggcctcaatgtcgtgctgatttcgcggacccttgagaagctcgaggccatcgcgacagagatagagcggacaactgggaggtccgtcaaaataatccaggcagatttcactaaggatgacatttacgagcatataaaggagaaacttgctggcctggaaatcggtatacttgtcaataatgtgggaatgttgccaaacctgcttccctctcattttttaaatgcacccgacgaaatccagtcactcatccactgcaatatcacttcggtggtgaaaatgacacaactcatcttgaagcatatggagagtaggcaaaagggccttattctcaacatctcgagtgggatagcccttttcccatggcccctctacagtatgtacagcgcctcaaaagcttttgtctgtgcctttagcaaagctcttcaggaggagtacaaagcgaaggaggtgatcatccaggccggcttcttgtccctgatccctgcgtgggccttctattcgggtgcatttcagcgcctcctgttgactcactacgtggcctacttaaagctgaataccaaggtaagatag

SEQ ID NO: 120352 - DNA, 933 bp, Artificial Sequence
  Description of Artificial Sequence: Synthetic coding sequence
atgggtgacgtcctcgaacagttctttatacttaccggcctcctcgtgtgcttagcttgtttggccaaatgcgtccgtttctctaggtgcgtccttcttaactactggaaagtcctccctaagtccttcctacgatcaatgggccagtgggctgtcatcaccggcgccggcgatgggatcggcaaggcatacagctttgagttagccaagcgaggcctgaacgtggtcctgattagtcgtaccctcgaaaaattagaggccattgcaacagaaatcgaacgcacgacaggccggagcgttaagattatccaggctgactttacaaaggatgacatatatgagcacattaaggagaaactggcaggcttggagatcgggattttagtcaacaatgtcggcatgctccccaacctgcttccaagccacttcctaaacgctcctgacgagatccaaagcctcatacactgtaacataacctctgttgtgaagatgacccagctgatcttaaagcatatggaatctcgacagaaggggttgatcctgaatattagcagtggcatcgctttgttcccatggcccctatattccatgtatagcgcctccaaagcgttcgtttgcgccttttccaaggcactgcaggaggagtacaaggctaaggaggtgatcatccaggtgctgactccatatgctgtgtctactgctatgacaaagtaccttaacacaaacgttatcacaaaaactgctgacgaattcgtcaaggaaagcttgaactacgtcactatcggcggcgagacttgtggatgcctcgcccacgaaatcctggcgggtttcctgtcccttatccctgcttgggccttttacagcggggctttccagcgcctcttactgactcactacgtggcttatctcaaactgaacacgaaggtccgctag

SEQ ID NO: 120353 - DNA, 2211 bp, Artificial Sequence
  Description of Artificial Sequence: Synthetic coding sequence
atggggtcacctcttcggtttgatggacgagtcgttctagtgacaggtgccggtgccgggctgggtagggcgtatgcattagccttcgcagagaggggtgccctcgtggtggtaaacgacctggggggtgattttaagggtgtggggaagggatccttggcagctgataaagttgttgaagagattagacgacggggagggaaggcagttgctaattatgactccgtcgaggagggtgaaaaggtcgtgaaaactgctctggacgcctttggacgaatcgatgtggttgttaacaacgccgggattctccgtgatagatccttcgctagaatctccgatgaggattgggatatcatccatagagtacatttacggggttcattccaggttaccagggccgcatgggaacacatgaaaaaacaaaaatacggacggatcattatgacgtcctccgctagcggcatctatgggaatttcggacaagccaattattctgctgctaaactaggcttactcggcttggcgaactctctggcaattgaaggccggaagagcaacatccactgcaatacaatcgcacctaatgcaggatcaaggatgacccagactgtcatgcctgaagatttggtggaagctctcaagcctgagtatgtcgctcccctggtcctgtggctgtgtcatgagagctgtgaggagaacgggggcctgtttgaggtcggagcggggtggattggaaagctgcgctgggagcggaccttgggtgccatcgtcaggcagaagaatcatcctatgaccccggaagctgtgaaggcaaattggaagaaaatttgcgacttcgagaacgccagcaaaccacagagtatccaggaatctacagggtccattatcgaggttctttctaagatcgattccgagggaggcgtctccgcaaaccatacttcccgagcgacatcaactgctacttcaggctttgctggcgccatcggacaaaaactaccgccattctcgtacgcttataccgagctggaagctattatgtatgctcttggggtgggcgcatcaattaaagatcccaaagacttgaagtttatatatgagggatcctcggatttctcttgtctgcctactttcggagttatcatcggccagaaatctatgatgggcggtggcctggccgaaattcccgggctctcaatcaattttgccaaggttctgcacggcgaacagtatttagaactgtacaagcctcttccaagggcaggcaagttgaaatgtgaagctgtcgtggctgacgtgctggataaagggtctggagtggtgattattatggacgtctacagctattccgagaaggagctgatctgccataaccagtttagcctgttcctcgttgggagtgggggatttggcgggaaacgtacttctgataaagtgaaagttgcagtggccattcccaaccgtccgccggatgctgtccttaccgacactacatctcttaaccaggccgctctgtaccgattatccggtgattggaatcctttgcatatcgaccctaactttgcatctcttgccggcttcgataaacccattctgcacggtctatgtactttcggattcagtgctagaagagtgctgcaacagttcgctgacaatgatgtctcacgttttaaggcaatcaaagccagatttgcaaagcccgtgtatccaggacagaccctgcagaccgagatgtggaaagagggcaaccgcatccactttcaaactaaagtgcaagaaaccggcgacattgtcatatctaacgcctatgtggatctggctccaacttcaggcactagcgcgaaaacgccgagcgaaggaggcaagctacagagcacattcgtgtttgaggagattggcaggaggttaaaggacatcgggcccgaggttgtcaagaaggttaacgcagtatttgagtggcacattactaaagggggaaacataggtgccaaatggactattgatctgaaatcggggtccggaaaggtgtatcagggacccgcaaagggagccgcagatacgacgatcatcttgtcagacgaggatttcatggaagtggtgctcggcaaactcgaccctcaaaaggccttcttctcaggccgccttaaggctaggggcaacatcatgctgtctcagaagctccagatgatcctgaaggattacgctaagttgtag

SEQ ID NO: 120354 - DNA, 2286 bp, Artificial Sequence
  Description of Artificial Sequence: Synthetic coding sequence
atggtcatcctcgaagctccccatctcctgcgaaggaaagaaccagagacccccgggctgtcctcgaggatcggcccctctctatgtcccggattttgcaggaagcggtccgtctcctgctgttttcagaacctgtgcaataacccgatggaaaagataattagtcaatgtaggttctttgtgagcatgaacgaccttgggggggattttaagggggttggcaagggtagcctggcggcagacaaggtggtggaagagattcgccgcaggggaggcaaagcagtcgccaattacgactcggtcgaggaaggcgaaaaggtcgtcaaaaccgcattggacgctttcggccggatcgacgtcgtggtgaacaacgctggcatcctccgcgaccgcagtttcgcaagaataagcgacgaggattgggacataattcatagagtgcatttgagaggctcctttcaggtcacccgggccgcgtgggagcacatgaaaaagcagaaatatggtaggatcattatgacctcctctgcttccgggatttatggcaactttgggcaggctaactattctgccgctaagctgggactgctcgggctggctaactctttagccatagaagggaggaagtccaatatccactgcaatactatcgctcctaacgctggcagcaggatgactcagacagtgatgcccgaggatctggttgaggcactcaaaccagagtacgtcgccccccttgtgctgtggttgtgccacgagagctgcgaggaaaatggagggttgttcgaggtaggcgccgggtggatcggtaagctgcgctgggagagaaccctcggggctatcgtaagacagaagaaccatccaatgaccccggaggctgtaaaagccaactggaagaaaatctgtgactttgagaacgcctccaagccacagtccattcaggagagcaccgggagcattatcgaagtcttatccaagattgattccgaggggggagttagtgcaaatcatacttctagagccaccagcacagctacctccggcttcgccggggcaatcgggcagaagttgcctcctttcagctacgcctatacagagctggaggcaatcatgtacgctctgggagtgggcgccagtatcaaggatcctaaggacctcaaattcatctacgaagggtccagtgactttagctgtctgccaacgtttggcgtaataatcggacaaaagagtatgatggggggggggctcgcagaaattcctggcctctctatcaactttgctaaggtcttgcatggggagcaatatcttgaactgtacaagcctctccctcgcgcagggaaactgaaatgcgaggcggttgtggcggatgtgcttgataagggctcgggtgtggtgatcatcatggacgtgtacagttacagcgaaaaggagttgatttgtcataatcagttcagcctgtttcttgttggctccgggggcttcggaggtaagagaacctctgacaaggttaaagtggcagttgccatacctaacaggcccccagatgctgtgctgaccgacacaacttcccttaatcaagctgccctctatcgcctgagcggcgattggaatcccctgcacattgacccaaattttgcctccctggctggatttgataaacctatccttcacggactttgcacgttcggcttttcagcacggagggtgctccaacagtttgccgacaacgacgtcagtcgattcaaagctattaaggctagatttgcaaaacctgtttatcctggccagaccttgcagactgagatgtggaaggaaggtaatcggatccactttcagaccaaagtgcaggagacaggagatattgttatctctaatgcctacgttgacctcgctcctacaagtggtactagtgcgaagacacccagcgaaggggggaagctgcagagtacgttcgtcttcgaggaaattggcagaagactcaaagacattgggccagaggtggtgaagaaggtcaatgctgtgttcgaatggcacattaccaaaggggggaacataggggccaaatggactattgatctcaagtccgggagcgggaaggtgtatcaaggacctgccaagggcgcggcggacacaactattatactgagcgatgaagacttcatggaggtggtattaggaaaattggaccctcagaaggcattcttttcggggcggcttaaagcccgcggtaacatcatgctcagccagaaattacagatgattctgaaggattacgctaaactatag

SEQ ID NO: 120355 - DNA, 2139 bp, Artificial Sequence
  Description of Artificial Sequence: Synthetic coding sequence
atggaaaagattattagccagtgcaggttttttgttagcatgaatgacctgggtggtgatttcaaaggcgtcgggaaagggagcctggcagctgacaaggtcgttgaagaaatcaggagaaggggcggcaaagcagtagctaattatgactccgttgaggagggcgagaaggtcgtgaaaaccgctctggatgctttcggcaggatcgacgtggtagtgaataatgccggcatactgagagatagaagcttcgcacgcatcagtgacgaggactgggacattatacatcgtgtgcatttacgagggtcttttcaggtcaccagggcggcatgggagcacatgaagaagcagaagtatggaagaatcatcatgacctcgagcgcatcaggtatttacggcaacttcgggcaggcgaactactcagcggctaagctgggcttattaggattagcaaactcccttgcaatcgaggggagaaaatccaatattcactgcaacacaatcgcccctaatgcgggctcacgcatgactcagactgtgatgcctgaagacttagtggaagcgctgaaacctgaatacgttgctcccttggttttgtggctctgccatgagtcctgcgaagagaatgggggcctgttcgaagtgggagccgggtggattggaaaactgaggtgggagaggaccttgggggcaatagtgcggcagaagaatcatccgatgaccccggaggccgtgaaggctaattggaagaaaatatgtgattttgagaatgcttccaagccccagtcgatccaagagtctaccggctcgattattgaggtcctgagcaagatcgattcagagggaggagtgtcagccaaccacacaagcagagcgacctccactgctacctccgggtttgcgggtgctatcgggcagaagcttcctcccttctcctatgcctacacagagctcgaggctatcatgtacgctttgggagtgggtgcctcgattaaggatcctaaggatctcaaatttatctacgaggggtcttcggatttctcttgcctgcccaccttcggtgtgattattggacagaaaagcatgatggggggcgggctggccgaaatccctgggctaagtatcaactttgcaaaggttcttcacggcgagcagtaccttgaattatataagcctttgcctcgcgccgggaagttaaagtgtgaggccgtggtcgccgacgtactggacaaaggatccggggtcgtgatcataatggatgtgtatagctacagcgaaaaggagcttatctgccacaatcagttcagcctgttccttgtagggtccggaggttttggggggaagcgcacgagcgacaaagttaaagttgctgtggctatccctaaccgcccacctgatgccgttctcactgacacgacctcgcttaaccaggccgcgttatatcggctctccggcgactggaacccattgcacattgaccccaactttgctagcctggcaggattcgataagcccatcctccatggtctatgcacttttggttttagcgcacgccgggtcttacagcagtttgccgacaacgacgtgtcccgctttaaggccatcaaggctagattcgccaaaccggtgtacccaggtcagacactgcagactgagatgtggaaagaagggaaccggatccacttccagacgaaggtacaggaaacaggggacatagttatatctaacgcatacgtagacctggcccctaccagtggcaccagcgccaagactccatccgagggcggtaagctgcagagcacattcgtatttgaagagattgggcggagactcaaggacatcggcccagaggtggtgaagaaggtgaacgctgtgttcgagtggcatatcactaagggggggaacatcggggccaaatggactattgatctgaagtcgggtagtggtaaggtctaccagggacccgcaaaaggggctgcggacacaactataattctaagtgacgaagacttcatggaggtcgttctcggtaaattggatccccaaaaggcattcttttctggtcgactgaaggcccgggggaacattatgcttagtcaaaagctgcagatgattcttaaagattatgcaaaattgtag

SEQ ID NO: 120356 - DNA, 1800 bp, Artificial Sequence
  Description of Artificial Sequence: Synthetic coding sequence
atgaagaagcagaagtatgggcggatcataatgacttcctccgccagcggcatctatggcaatttcggtcaggctaattactctgctgcaaagcttggcctcctgggattagctaacagcctagcaatcgaggggaggaaatcgaatatacactgtaataccatagcccccaatgcaggatcacgaatgactcagacagtcatgccagaggacctggtggaagcgctgaagcctgagtatgttgctccattggtgctgtggctctgccatgagtcttgcgaagagaatggaggcctgttcgaggtgggtgccggatggatcggcaagctaaggtgggagaggacgctgggtgctattgtccgccagaagaaccaccccatgaccccggaggcggtgaaggccaactggaagaagatttgtgatttcgagaatgcctctaagccacaatccattcaggaatctacgggcagtatcatagaggtcctctccaagatcgattcagaaggaggagtgagtgctaatcatacgagccgggctacaagcacagctaccagcggatttgctggcgcgattggtcagaagctcccaccatttagctacgcctacacagagcttgaagccatcatgtacgccttgggtgtcggcgcatccattaaggacccaaaggacttgaagtttatctacgagggatcatccgatttttcatgcttacccacctttggagtgattatcggccagaagtcgatgatgggtggcggcttagccgaaatccctggcctgagcataaacttcgcaaaagtgctgcacggcgagcagtaccttgagctctataagcccctgccacgcgcggggaaattgaagtgcgaggcagtggtagcagacgttcttgataagggatctggcgtggtgatcatcatggatgtgtactcttattcggagaaggagctgatttgtcataatcagttctctctgtttctggtggggagtggggggtttggcggcaagcgaacgtccgacaaggtcaaggttgcagtggctattccgaataggcccccggatgccgtgctgaccgataccaccagtctgaatcaagcagcactgtatcggctgtctggagactggaacccgttgcacatcgacccaaacttcgcgagtttggccgggttcgacaagcccattttgcacgggttatgtacctttgggttttcagcaaggcgggtgttacagcaattcgccgataacgatgtgagccgatttaaagctattaaggccaggtttgccaagccagtctacccagggcagaccctccagaccgaaatgtggaaggagggtaaccggattcacttccaaaccaaagtccaggaaacaggcgacatcgtcatctccaacgcatacgtggacctggctcccactagtggcacctccgccaaaacacctagtgagggtgggaagttacaatcgacattcgtatttgaagagattggccggcgcctgaaggacatcggtcctgaggtcgttaagaaagtgaatgctgtattcgaatggcacatcactaagggcggcaacatcggcgcaaagtggactattgaccttaagtccggctccggtaaggtgtaccaggggccagccaagggggccgccgatacaaccattattctcagtgatgaggacttcatggaagtagtattaggaaaactcgacccccagaaagctttttttagcggccggcttaaggcccgcggaaatattatgctgtcccaaaaactccagatgatcctgaaggattacgccaagttgtag

SEQ ID NO: 120357 - DNA, 2157 bp, Artificial Sequence
  Description of Artificial Sequence: Synthetic coding sequence
atgggttccccactccggttcgatggcagggtcgtcctcgtcaccggcgccggtgcggttaacgatctggggggcgatttcaaaggcgtgggaaaggggagcttagctgctgataaggtggttgaggagatacgccggcgcggcggcaaggctgttgccaactatgacagcgtggaggagggagaaaaagtcgtcaagaccgcactcgacgcctttggcaggatcgatgttgttgtgaataacgccgggatcttgcgggatcggtctttcgcccggatctcagacgaggattgggatatcatccaccgagtgcatctgagagggtctttccaggtgacccgtgcagcctgggagcacatgaagaagcagaaatatggacgaattattatgacatcatccgccagcggaatatatgggaactttgggcaggccaattatagtgcggcgaagctggggttgctaggtcttgcaaatagtctggccattgaggggcggaagtccaatattcactgcaacaccatcgcccctaacgctggctcccgtatgacccagacagttatgccggaggacctggttgaagcactcaagccggagtacgtggcccctctggtgctctggctgtgtcatgagtcttgcgaggagaacgggggtctgtttgaagtaggcgcgggatggatcggcaagcttcgatgggagcggacgttgggagccatcgtgcgccagaaaaaccatccaatgacccctgaggctgttaaagccaattggaagaaaatctgtgattttgagaatgcatctaaaccacagagcattcaagaaagcactgggagcatcatagaggtgctgtcgaaaatcgatagcgagggcggtgtaagtgctaatcacacaagtcgtgccacttccaccgccacaagcggatttgctggggccattgggcaaaagcttcctccattttcttacgcttataccgagcttgaggctattatgtacgccctgggagtgggcgcgagcataaaagacccaaaagatctgaagttcatttatgaagggtcgtcagacttcagctgcctgcccacatttggtgtcataatcggtcaaaagagtatgatgggtggcgggctagctgagataccaggcctgtctataaactttgcgaaagtgcttcatggggagcaatatctggagctgtacaagcccctgccacgggcaggtaagcttaaatgcgaggctgtggtagcagatgtgcttgacaagggttccggcgtagtcattatcatggatgtatatagttacagtgagaaagaactcatttgtcacaaccagttttcactgtttctcgttggttccggcggctttggaggtaagaggaccagcgataaggtaaaggtcgcggtggctatcccaaatcgccctccagacgctgtcctgacagacaccacctccttgaaccaagctgccttgtatcggttgtcaggagactggaacccccttcacatagacccaaacttcgcatctttggcaggttttgacaagccaatcctgcatgggttatgtacatttggctttagtgcgagacgcgtcctgcagcagtttgccgacaacgacgtgtcaaggttcaaagccataaaagctcgatttgcaaaaccagtgtaccccgggcagaccctgcagacggagatgtggaaggagggaaaccgcatccacttccaaaccaaggtccaggaaaccggcgacattgtaatctccaacgcgtatgtggatctggctccgacctcgggtacttccgctaagaccccctctgagggaggaaagttgcagtccactttcgttttcgaggaaatcggcaggcgcctaaaggacattggccccgaagttgtaaaaaaggttaacgctgtctttgagtggcacattactaaggggggcaacattggtgccaagtggaccatcgaccttaaatctggttcagggaaggtctaccagggccctgccaaaggcgcagcagacacgaccatcatcctaagcgacgaagactttatggaggttgtacttgggaaactggacccccagaaggctttcttttctgggcgcctcaaagcccgcgggaacatcatgctatcacagaagcttcagatgatactgaaggactatgctaagctttag

SEQ ID NO: 120358 - DNA, 1026 bp, Artificial Sequence
  Description of Artificial Sequence: Synthetic coding sequence
atgcgaaaagtggtcctgattacgggcgcaagcagcggcataggtctggctctgtgcaagcggcttcttgctgaagacgatgaactgcatctttgcctagcgtgtcgcaatatgtcaaaggccgaggccgtttgtgcggccctgctggccagtcaccctactgccgaagtgactattgtgcaggtggacgttagtaatctgcaaagtgtgttccgcgcctcaaaggagctgaagcagcgcttccaacgacttgattgtatttacctcaatgccggcatcatgccgaacccacaactgaacatcaaggcactgttcttcggactgttttctcgcaaagtgatccacatgtttagtacagccgaaggtctgcttacacaaggagacaaaattactgccgacggcttgcaagaggtgttcgaaacgaacgtgttcggtcattttattcttatccgggagctggaaccactgttgtgccacagtgataatccttcccagctgatctggacttcatccaggagcgcacgaaagtcgaatttcagtttagaagactttcagcactccaagggaaaggagccttacagcagcagcaagtacgcaacagatctgttatctgtggctttaaacagaaactttaaccagcagggcctgtactccaatgttgcctgtccaggaacagcactcacaaatctgacctacggtatactgccaccctttatctggacactgctcatgcctgctatcctgctactccgcttctttgcaaatgcgttcaccctcacaccctataacgggacagaagctttagtctggctctttcatcagaaacctgagagccttaatcctctgattaaatacctgtctgccactactggtttcggccggaattacatcatgacccagaagatggatctggacgaagacactgcagaaaagttttatcagaagctcttagaactcgagaaacacataagagtcaccattcagaagaccgataaccaggccagactctcagggagctgtctttag

SEQ ID NO: 120359 - DNA, 336 bp, Artificial Sequence
  Description of Artificial Sequence: Synthetic coding sequence
atgagaaaagtggtgcttattactggcgcttcttcgggaattggccttgcgctgtgtaagcgcctgctcgcagaagatgacgaactccacttgtgtttggcttgccgcaacatgtctaaggccgaggccgtctgtgcagccttactcgcttcacatccaaccgcagaggttacaatcgtccaggttgacgtgagcaacctgcagagcgtgtttagagcctctaaggagcttaagcagcggtttcaaagactcgactgcatctacctcaatgctgggattatgccaaacccccagctgaatattaaggcccttttcttcggtctgttcagctcttag

SEQ ID NO: 120360 - DNA, 255 bp, Artificial Sequence
  Description of Artificial Sequence: Synthetic coding sequence
atgaggaaagtcgtcctgatcacaggggcaagtagtgggattggccttgctctctgtaaacgtcttctagctgaggacgatgagcttcacctgtgcttggcgtgtaggaacatgagcaaggctgaggcagtttgcgccgcacttcttgcatcgcatcctaccgctgaggttacaatcgtccaagtggacgtgtctaacctccagtcagttttcagagcaagcaaggaactcaaacagcggtatataagctgttag

SEQ ID NO: 120361 - DNA, 921 bp, Artificial Sequence
  Description of Artificial Sequence: Synthetic coding sequence
atgcgtaaagtggtcctgatcaccggcgcttcatcaggaatcggcttggcactgtgtaagagactacttgccgaggacgacgagctgcatttgtgcctcgcctgtcggaacatgtccaaggcggaagcggtgtgtgctgctctgctggcatcgcaccccacagcggaagtgacaatcgtgcaggtggatgttagtaatctccaatctgtgttccgtgctagcaaggagctgaagcagcggttccagaggctggactgcatctacctcaacgcgggcatcatgcctaatccccagctcaacattaaagctctgttcttcggactgtttagtaggaaggtcattcacatgttctcaacagcggaaggactgctcacccagggtgacaaaattactgctgatgggctccaggaggtgtttgagaccaacgtttttgggcactttatcctgatacgggaactggaacccctactgtgccattcagataatccctcccagctgatctggacatcttccagatcagcccgcaaatctaatttctccctcgaggatttccagcactcaaaggggaaagagccttacagttcttccaagtacgccacagatcttctatccgtcgccttaaaccgtaactttaaccagcaactgcggttttttgcaaacgcatttaccttgacaccctacaatgggacagaggccctggtgtggctctttcatcagaaacccgagtctctgaaccctctcattaagtacctctctgccaccacaggattcgggagaaattatatcatgacacagaagatggatctggatgaggatacggccgagaaattttaccagaagctcctcgagcttgagaaacatatccgggtaactatccaaaagactgataatcaagcacggctgtcaggctcctgtctttag

SEQ ID NO: 120362 - DNA, 360 bp, Artificial Sequence
  Description of Artificial Sequence: Synthetic coding sequence
gttgttattcgcgaactggagccattgctgtgccattccgataacccttctcagttgatctggacttcctcaagatctgctcgcaaatcaaacttttcactcgaagattttcagcactccaaagggaaggaaccgtacagctccagtaagtacgccactgatctactgtctgtggcactgaatagaaactttaaccagcagctgaggttcttcgccaacgctttcaccctcacaccatataatggtaccgaagccctggtgtggctatttcaccaaaagccagagtccctgaaccctctaatcaagtacctttcggccaccacggggttcggacgaaactacatcatgacgcaaaagtag

SEQ ID NO: 120363 - DNA, 966 bp, Artificial Sequence
  Description of Artificial Sequence: Synthetic coding sequence
atggaacggaaaaaccaaacggctattacggagtttatcattcttggcttctctaacttaaatgagtggcagtttttactgttcacgatctttttcctgacatacttttgcacccttggaggaaacattcttataatcctcaccactgtcacggaccctcacctacacacgcctatgtactactttctcggcaatctcgcgtttatagacatatgctacaccacatctaacgtcccccagatgatggtgcaccttctgtccaaaaagaagagcatttcctatgtggggtgcgttgtgcagctgtttgcctttgtattctttgtgggttcagaatgtcttctactcgctgctatggcctatgataggtatatcgcgatttgcaacccgcttagatacagcgttatcctgtcaaaggtgctctgtaatcagctggccgccagctgttgggctgccgggttccttaattcagtcgtccataccgtactcaccttctgcctcccgttctgtgggaataaccagatcaattatttcttttgcgacattccgcccctcctgatcctgtcttgcgggaacacctcggtcaacgagctggctctgctttcaactggggtttttatcggttggactcctttcctctgtatcgtcttgtcctacatctgcatcatctcaaccatcttgcggatacagagtagtgaggggaggcggaaggcgttctccacttgcgcctcccacctcgccatcgtgttcctattctacggctccgccatattcacctatgtccgtcctatctccacatactcactgaaaaaggacagacttgtgagcgttctgtactcggtggtgacgccaatgctgaaccctataatatacaccctgaggaataaggacatcaaggaggccgtaaagacgataggatctaaatggcagcctccaatatcgtctctggacagcaaactgacatactag

SEQ ID NO: 120364 - DNA, 786 bp, Artificial Sequence
  Description of Artificial Sequence: Synthetic coding sequence
atggcaagtcagctccagaatagacttagatccgccttggcactggtcaccggcgccggctcaggcataggcagggccgtgtcagtccgcctggcgggagagggcgccaccgtggcagcttgcgaccttgaccgcgccgcagctcaggagactgttaggcttctgggcggccctggttctaaggaaggtccgccacggggaaatcatgcggccttccaggccgatgtcagcgaggcgcgcgccgccagatgcctgctggagcaggtgcaggcctgcttcagtcgccctccttcagttgtggtgtcatgcgccgggatcactcaggacgaattcctgctgcacatgtcagaagatgattgggataaagtgatcgcagtgaatttgaaaggaacttttctggttactcaagctgccgcccaggccctagtctctaacgggtgtagaggttcgattatcaacatctctagtattgtcgggaaggtgggcaacgtcggacagacgaactatgccgcgagcaaagccggcgtcatagggctgactcagacggccgcccgggaactcggaaggcatggtattcgatgtaacagtgtgctgccagggttcatcgcaacccccatgactcagaaggtgccgcaaaaagtggtggacaaaatcactgagatgattcctatgggacatctgggcgaccctgaagacgtggcggatgttgtcgcttttttggcctcagaggacagcggttatataacaggtacctctgtagaagtgacagggggacttttcatgtag

SEQ ID NO: 120365 - DNA, 786 bp, Artificial Sequence
  Description of Artificial Sequence: Synthetic coding sequence
atggctagccagttgcaaaatcgcttgcggagtgcattagcccttgtaaccggggcagggtccgggattggccgtgcggtgtccgtgagattggccggagaaggtgcaactgtggccgcttgtgatctggatagagccgccgcccaggagaccgtgagactcctggggggtcctggcagcaaggagggaccaccccgggggaaccatgcggctttccaggcagatgtgtctgaggcccgagctgctcgatgtctactggagcaggtccaggcttgtttctccagaccaccctcagtcgttgtgtcttgcgctggcatcactcaagacgagtttctgctccacatgagcgaggacgattgggacaaagtcattgctgtcaatctcaaggggacattcctggtcacccaagccgctgcccaagcattggtgtctaacggctgcaggggctcaatcatcaacatatcaagtatagtgggaaaagtggggaatgtcgggcagacaaactacgccgcatctaaagcaggcgtcattggtctcacacagacagctgccagggagttaggcagacatggcatcagatgtaactccgtgcttcccggattcattgctactccaatgacacaaaaggtcccccaaaaggtggtcgataagattacggagatgataccaatgggtcatcttggggacccagaggacgtggctgatgtggtggcttttctcgctagtgaggactctggttacatcaccggcacctcggtggaggttactggtggtctctttatgtag

SEQ ID NO: 120366 - DNA, 786 bp, Artificial Sequence
  Description of Artificial Sequence: Synthetic coding sequence
atggcctcgcagctgcagaatcgacttcgttccgcacttgcccttgtgaccggcgccggcagtggaattggccgggctgtgagcgtccgcctggcaggggaaggagctacggtcgccgcctgtgacctggatcgcgcagccgcccaggagaccgtgaggctcctagggggtcccggatccaaagagggcccacccagaggtaatcatgccgcgttccaagccgacgtttctgaagctcgcgcagcacggtgtctgctagagcaagtgcaggcctgtttttcccgccctccatctgttgtggtgagctgtgccggtatcacacaggatgagttcctcctgcatatgtctgaagacgattgggataaggttatcgcggtcaatctgaaaggtaccttcctggtaacccaagcagcagcccaggctctggtgtccaacgggtgtcgcgggagcataatcaacattagttcaatcgtgggcaaggttggcaatgttggccagactaactatgcggccagcaaagccggagtcatcggtcttacccagacagctgctcgggagttgggccgccatggtatccgatgtaactccgtgctgcccggattcatcgccacaccaatgacccaaaaggtacctcagaaggttgttgataagataaccgagatgatccctatgggccacctaggcgaccccgaggacgtcgccgatgttgtggcctttctcgcttctgaagactcagggtatataaccgggacttctgtggaagtgactggaggactattcatgtag

SEQ ID NO: 120367 - DNA, 786 bp, Artificial Sequence
  Description of Artificial Sequence: Synthetic coding sequence
atggccagccagttacagaatcgactgcgaagcgccctggcactcgtcacaggcgccggatccggtattgggagggccgtgtccgtacgcttagccggggaaggcgccacagtggccgcgtgtgacttggaccgggccgccgcacaagagacagtgagactcctggggggccctggaagtaaggagggccccccaaggggcaaccacgctgcctttcaagcagacgtctcggaggcccgcgcggcgagatgcttgcttgaacaggttcaggcctgtttttcccgcccacccagcgtagtcgtgtcttgcgccggcattacccaggatgaatttctcctccacatgagtgaggacgactgggataaggttattgctgtgaacctgaaaggaactttcctggttacccaggccgcggctcaagcacttgtgtctaatggctgcagaggtagcattattaatatttcatcgatcgtggggaaggtgggaaacgtggggcaaactaattacgctgcatcaaaggctggagtcatcggcctgacccagaccgctgcccgggagctggggagacacgggatcaggtgcaacagcgtgctgccagggttcattgctactcccatgacccagaaggttcctcagaaggtcgtcgacaagattacggagatgatcccaatgggccacctgggcgatcccgaggacgttgccgacgtggtagcctttctggcctccgaggatagcggatacatcactggcacctctgtggaagttaccggtggactgttcatgtag

SEQ ID NO: 120368 - DNA, 786 bp, Artificial Sequence
  Description of Artificial Sequence: Synthetic coding sequence
atggccagccagctccagaatagactgaggagcgctctcgcgttggtcactggcgcaggcagcgggattgggagggccgtgagtgtccgccttgcaggtgaaggagcgaccgtcgctgcctgcgatctcgatcgggctgccgcgcaggaaaccgtgcggctcctgggaggccctggttccaaagaagggccgccccgtgggaatcatgccgcctttcaagctgacgtgtcagaggctcgcgcagctaggtgcttgctcgaacaggtgcaggcctgtttttctcggccaccttctgtagtcgtttcctgcgcaggcattacacaggacgagttccttctgcatatgtcagaggacgattgggataaggtaattgcagtcaacttaaaaggcacctttctggtgacccaggccgccgcgcaagcccttgtgagtaacggctgccgaggctcaattattaatatttcttccatcgtcggcaaggtcgggaatgtcgggcagactaactacgctgcttcaaaggcgggggtcattggcttaacccagacagcagcccgggagttaggaagacacggtattagatgcaattcggtgctacccggcttcatagccacaccaatgacccagaaggttccacagaaggtcgtggacaagatcactgagatgatcccaatgggtcacctgggggaccctgaggatgtcgcagatgtagtggcatttcttgcatccgaagactcagggtatattactgggacttccgtggaagttacaggaggcttgttcatgtag

SEQ ID NO: 120369 - DNA, 1848 bp, Artificial Sequence
  Description of Artificial Sequence: Synthetic coding sequence
atggtgtccggaccacttgccctgaggtggtgcgcttgggctggacgcggcgacatgggaccagatatggagctgccgtcgcactcaaagcaattgctgctgcagttgaatcagcaaaggacaaaaggtttcctgtgcgatgttattatcatggttgagaatagcatctttagggcacacaagaatgtgctggccgcatccagcatttactttaaatctttagtgttgcatgataacctgattaatctggataccgatatggtatcttctacagtgtttcagcagattctagatttcatctacactggcaaattgctccctagtgatcaacccgcggagccgaacttttctaccctgctgaccgccgcgtcatatctccagcttcccgaattggccgcactgtgtaggagaaagctgaagagagcgggcaaaccattcggcagcggtagggccggttccaccggtatgggccgtccacctaggagtcagcgtctctccaccgctagtgtgattcaggcgagataccaggggctggtggatgggcgcaaaggcgcccatgcaccccaggaactcccacaggccaaagggtccgacgatgagctatttttgggtggatccaaccaagactcagtgcaagggcttggtcgtgcagtctgccccgccggaggtgaggctggactgggagggtgctccagctcaaccaatggctcttccggaggctgtgagcaggagctcgggctcgacctgtctaaaaagtcgcccccactgcctccggccactcccgggccgcacctcactcctgatgatgcagctcagctgagtgattctcaacacggctctcctccagccgcttcagcccctcctgtcgctaatagcgcgtcttactcagaactcggtggcacccccgatgaaccgatggatttagaaggcgccgaggacaaccatctgtctctgctcgaagccccagggggccaaccacggaagagtttaaggcacagcacaagaaagaaggaatgggggaaaaaggagccagtggctggttcaccctttgagagacgggaagccggccctaaaggcccttgcccgggagaagagggtgagggcgtcggtgaccgagtaccgaatggtattctggctagcggtgccggcccatcagggccatatggcgaacccccgtacccgtgcaaggaggaggaagagaacggaaaggatgcctcagaagactcagctcaatctggttcagaaggcggctctgggcacgcctcagcgcactacatgtatagacaggaagggtacgagactgtgtcttatggagataacttatatgtgtgtattccatgcgcgaaaggcttcccatcaagtgaacagcttaacgctcatgtagaaacacacacggaggaagaactgttcattaaggaagagggtgcttacgagaccggatccggaggggcagaagaggaggctgaggacttgagcgcgccttctgcagcctatactgccgagccacgccctttcaagtgctcagtgtgtgaaaaaacttataaggaccctgcaaccctgcggcagcacgagaaaacgcattggctaaccaggccgtttccttgcaatatttgtggtaagatgtttactcagcgcggaacaatgacccgacacatgagatctcacctggggctgaaacccttcgcctgcgatgaatgtgggatgcggtttacccgtcaatacagattgaccgaacatatgcgagtccactctggagagaaaccctatgagtgtcagctctgtggaggtaagttcacccagcaacggaacttaatctcccacttgagaatgcatacaagccctagctag

SEQ ID NO: 120370 - DNA, 1848 bp, Artificial Sequence
  Description of Artificial Sequence: Synthetic coding sequence
atggtgagcggcccgcttgctctgcgatggtgcgcttgggcaggacggggagatatgggccctgatatggagctcccatctcattctaaacagctcctactgcagttgaatcagcagaggactaagggattcctgtgtgacgtgatcattatggtcgagaacagtatattccgggcccacaaaaacgtgttagctgcctcaagcatctacttcaagtccctcgtgttgcacgataatcttatcaatctggacacagatatggtgtcatccaccgtgttccagcagatactggacttcatctatacaggtaaactgctccctagcgatcagcccgcagagccaaattttagtacccttttaaccgcagcctcatacctccaactcccagaactggcagccctttgccgacgcaagctgaaacgcgccgggaaaccttttggatccggccgcgctggcagtaccggcatgggccgccccccacgaagtcaacggctctctacggcaagcgtcatccaggccaggtaccagggcctcgtcgatggccgaaaaggggcacacgcaccccaggaactgcctcaggccaaggggtcggacgacgagctgtttctcgggggctctaaccaggattccgtgcagggcctgggaagagctgtttgtcccgccggaggcgaagcaggcttgggggggtgcagctcctcgacaaacggaagtagcgggggttgtgaacaagagttgggcctggatctgtctaagaagtctccccccctccctccagcgacacctgggcctcacctgacccctgacgatgccgcgcaactgtccgatagtcagcacggcagtccccctgccgcttccgcgccacccgttgccaactctgcatcatatagcgagctcggggggacaccagacgaacccatggatttggagggagctgaggacaatcatctgtcactgctcgaagcgccaggtggccagcctcgtaagtctctacgccactcaacccggaagaaggaatggggcaaaaaggaacctgttgccggttctccgtttgagaggagggaggccggacctaaaggcccatgtccaggggaagagggagaaggtgtcggcgaccgggtgccgaacggtattctggctagcggagctgggccttccggaccatacggggagccaccctacccctgcaaagaggaagaagagaatggcaaggacgcctcagaggattccgcacagtctggaagtgagggcggctccgggcacgctagcgcacattacatgtaccggcaagaaggatacgaaaccgtatcctatggagacaacctgtatgtgtgtatcccgtgtgcaaaaggctttccaagttcagagcagctgaacgcacacgtggagactcataccgaagaggagttgttcatcaaagaggagggagcctatgagaccggtagtggaggcgcagaagaagaagcagaagacctctccgcaccgtcggctgcttatactgccgagccgcggcccttcaaatgcagcgtatgtgaaaagacatacaaggatccagccacactccggcagcatgagaaaactcactggctcacacgtccattcccctgtaacatttgcggcaaaatgttcacccagcggggcaccatgacaaggcatatgaggtcccacttgggactgaagccttttgcctgcgatgaatgcggcatgcggttcacgaggcagtatagactgacggaacatatgagagtgcactccggggagaagccttatgaatgccagctttgtgggggcaaattcactcagcaacgtaacctgataagtcatcttaggatgcacacatccccgtcctag

SEQ ID NO: 120371 - DNA, 1848 bp, Artificial Sequence
  Description of Artificial Sequence: Synthetic coding sequence
atggtgtccggacccctggctctccgctggtgtgcctgggccggaaggggagacatgggccccgacatggagcttccatcccactcgaagcaactcctgctccaattaaaccaacaaagaacaaaaggtttcttgtgcgacgtcattattatggtggaaaacagtatcttcagagcccataaaaacgtgctggccgcatccagtatctatttcaagagtctggttttgcatgataaccttatcaacttggatacggatatggtctcttcaactgtgttccagcagattcttgacttcatctatactggcaagttactgcctagcgatcagccagcagagcctaattttagcacattactgaccgcggcgtcatatttacagctccccgaattagcagctctctgtcgtcgcaaactgaaaagggccggcaagcctttcggaagtggtagggccgggagtaccggcatgggccggccgccccgcagccagagactcagcaccgcaagtgtgatccaagctagataccagggtttggtggacggtaggaagggggcacacgctcctcaggaactgccccaggcaaagggctccgatgatgagctcttcttgggcggttccaaccaggattctgtccaggggctaggccgggctgtgtgcccagcgggtggtgaagccggactcgggggctgtagcagttcaacaaatggcagctccggcgggtgcgaacaggaattgggtcttgatctttccaagaagagtccaccattaccgccagctacccccggacctcacctcacaccagatgatgccgctcagctttctgattctcaacacgggagccccccggcggcttctgctccccctgtcgcaaatagtgcaagttacagcgagttgggggggactcctgatgaacccatggacttggaaggtgcagaagataatcatttgtcccttctcgaggctcccgggggacagccccgaaagtccctgcgccactccacacggaagaaggaatggggaaagaaggaacctgtggccggtagtcccttcgagaggcgtgaggccggtcccaaaggaccttgtcccggcgaggaaggggagggggtgggcgatagagtccccaatggcattctagcatcaggcgcaggcccgagcgggccatatggcgaacctccatatccttgtaaggaagaagaagagaacggcaaagacgcatcagaggactccgcccagtcaggctcagagggaggctcaggtcacgcttctgcacactatatgtatagacaggaaggctatgagaccgtgtcttatggagacaatctgtacgtctgcatcccttgcgctaagggcttccccagtagcgagcagctcaacgcccacgtcgaaacccatacagaggaggagctcttcattaaagaagaaggggcatacgagacgggatccggaggagctgaagaagaggccgaagacctgagtgctccttctgccgcctacacagccgaaccccgcccctttaagtgctccgtctgtgaaaaaacatataaagaccccgccacactgcgccagcacgagaagacacactggctgacgaggccatttccatgcaatatttgtgggaaaatgttcacccagaggggcactatgacccgacatatgcgcagccatttgggacttaagccattcgcctgcgatgagtgtgggatgcgcttcacccgccagtatagacttacagaacatatgcgggtgcattctggtgaaaaaccttatgaatgccagctctgtggagggaagtttacacagcaaaggaatttgatctcccacctccgcatgcatacatctccctcttag

SEQ ID NO: 120372 - DNA, 2670 bp, Artificial Sequence
  Description of Artificial Sequence: Synthetic coding sequence
atggacgcccgcggcggtggaggacgcccgggcgaatcccccggcgctacccccgccccgggtccccctccaccacccccccccgctccccctcaacagcagcctcctcctcctcctccacccgctccccctcctggccctggccccgctcctccccagcaccctccccgagccgaagccctgcccccagaagctgctgatgaaggcggtcctcgcggcaggcttaggtctagagactcaagctgcgggcgacccgggacccctggggccgccagtaccgcaaaaggctcacctaatggggagtgtgggcggggtgagccacaatgctccccggcagggcctgaagggccagccagaggacctaaggtctctttctcatgccggggcgcagcatccggaccagcccccggcccagggccagcagaggaggctggctcagaggaggctggaccggccggggagcccaggggctcccaggcctctttcatgcagcgccaatttggcgctctgttacagcccggtgtcaacaagttctcacttcgaatgttcggaagccagaaagcagtagagagggagcaggaaagggtgaagtcagcaggcgcatggataattcacccttactctgatttccgcttctactgggattttactatgcttctgttcatggttggcaatctgattataatacctgtgggtataaccttcttcaaggacgaaacaacggcgccatggatcgttttcaatgtggtgtcagatacgttcttcttaatggatctcgtactgaactttcgcaccgggatcgttattgaagacaataccgagattatactcgaccccgagaaaataaagaagaagtacctaaggacatggtttgtggtcgatttcgtctctagcattccagtggactacatcttcctgattgtggagaaaggaatagattccgaggtctacaaaacagccagagccctacggatcgtacgattcactaagattctgtccctgctgagattattgcgactcagcaggctgatcaggtatatccaccagtgggaagagatctttcacatgacctatgatttggcgtctgcggtgatgcggatttgcaatctcatctctatgatgctccttctctgtcactgggatggatgcctacaattcctcgtgcccatgttacaagatttccctcgtaattgctgggtaagcatcaacggcatggtgaaccactcctggtctgagctgtactcttttgccctattcaaggctatgtcacatatgttatgtatcggatacggccgtcaggctccggagtcaatgactgatatctggctgaccatgctcagtatgattgtcggtgcaacatgctatgccatgttcattggtcatgctacggcgctaattcaatctctggacagcagtagaaggcagtaccaagaaaaatataagcaggtggaacagtatatgtccttccataagctgccagccgatttcagacagaaaattcatgactattatgagcaccggtaccaagggaagatgtttgacgaggactcaatcctgggcgaactcaacggtcccctgagagaagagattgtcaatttcaattgcagaaagcttgtggcctccatgcccttgtttgcaaatgctgatccaaacttcgtgacagccatgctgactaagctgaagttcgaagtttttcagcctggcgactacatcatacgggagggtacaataggcaagaaaatgtacttcatacaacacggtgtggtctccgtcctaactaaaggtaataaagaaatgaagctgtctgatgggagctactttggtgaaatatgtcttctgactagaggtcggcggactgcctcagttcgggcagatacctattgcaggctgtactctctctcagtcgacaactttaacgaagtgctggaggagtaccccatgatgaggagagcgttcgagactgtggccattgataggttggacaggatcgggaaaaagaacagcatcctcttgcataaggttcagcatgacctgaacagtggagtctttaataatcaggagaacgccatcatccaggagatcgtgaagtacgatcgggagatggtgcagcaggcagagctgggccaacgtgtgggattgttcccacctcctcctccccctcctcaggtgacttctgctattgccaccctgcagcaagctgccgccatgtccttctgtccacaggtcgctcgccctcttgttggcccacttgctctgggctctcctcgattagttcgaagacctcccccaggccctgctcctgccgccgctagtccagggccccctccacccgccagcccccccggcgcgcccgcttcccccagggctccacgcacatcaccctacggcggcctcccggctgcacctttagccggacccgcactacccgctcgcagactgagccgggctagtcgacctttaagcgcctcacaacccagcttaccgcacggagcacctggtcccgctgcatcgacccggcctgcatcatcatcaacccctcgattagggcccaccccggccgcaagggcggccgccccttcccctgacaggcgtgattcggcgtctcctggcgcagctggcggcctggaccctcaagacagcgcacgctctcgcctttcaagcaatttatag

SEQ ID NO: 120373 - DNA, 2325 bp, Artificial Sequence
  Description of Artificial Sequence: Synthetic coding sequence
atggaagccgaacaacgcccggccgccggcgccagcgagggtgcgactcctggtctcgaggccgttccacctgttgcacctccaccagccacagccgctagcggccctatcccaaagtccggaccggaacccaagcgacgccatctggggaccctgttacaacctacagtgaataaattcagcctgcgggtctttggttcccataaggcagtcgagatagaacaagagcgagtcaaatcagcgggagcctggattatccacccctatagcgactttcgcttttattgggacctgatcatgctgctactaatggtgggcaatctgatcgtactgccagtgggaattaccttttttaaggaagagaattcccctccgtggattgtgttcaacgtgctgtccgataccttcttcctgctggacctggtgctgaactttcgcaccggtatcgtggtggaggaaggcgctgagatactgcttgctccccgcgccatccgaacccgctacctcagaacttggtttttggttgatttgataagcagcatcccggttgattacatcttccttgtggtggagctggagcctcgtttggatgcggaggtctataaaactgcacgcgccctgcggattgtaagatttaccaaaattctgagtctcttgagactgctgcggctatccagacttattagatacatccatcaatgggaggagatcttccatatgacctatgacttggccagtgccgtcgtgcgcatctttaaccttataggaatgatgctcttgctgtgtcactgggacgggtgcttgcagtttcttgtaccgatgctgcaagatttcccaccagattgctgggtgagtatcaatcacatggtcaaccactcctggggacggcagtatagccatgcgctgtttaaggccatgtcacatatgctatgtatcggatacggacagcaagcaccagtgggcatgcccgacgtatggctgactatgctgtctatgattgtcggagccacatgttacgcgatgttcatcggccatgccaccgccctcatccaaagcctggatagttcacggcgccagtaccaggaaaagtataagcaggttgagcagtatatgagcttccacaaactgcccgccgatacccggcagcggatccacgagtactacgaacatcgctaccaggggaagatgtttgacgaagagagtatcctgggagagctgagcgagcccctaagagaggaaattattaatttcacttgccggggcctggtcgctcacatgccattgtttgcccacgctgaccctagttttgtgacagccgttctgactaagctgagattcgaagtcttccagcctggcgatctggtggttcgcgaggggtccgttggacggaaaatgtattttattcaacatggcctgttgtcagttctcgcgcggggagcccgcgataccaggctcaccgatgggagttacttcggtgaaatctgtctgctgaccaggggtagacgtacagcttccgtgcgggcggacacctattgtcgcctgtactcgctttctgtcgatcacttcaacgcggtgctcgaagaattcccgatgatgcgacgggcctttgagaccgtagcgatggaccggcttcttcgcatcggcaagaagaatagcatactccagagaaaaagatcagagccttctcctggcagcagtgggggcattatggagcagcacctggtgcagcatgacagggatatggccaggggggttaggggaagggccccgagtaccggggctcagctgtctggtaagccagtcctgtgggaacccttggtgcatgccccactgcaggccgctgcagtgacctccaacgtcgccatagcgttaactcatcagcgaggccccctgccactttccccagattcgcctgcaaccctcctagcaagaagcgcttggcggagcgcaggatcacctgcatccccactagtgcctgtgcgtgccggcccatgggcttccacgagcagattacctgcccctcctgctaggacattacatgcctcactgagcagggcaggaagaagtcaagttagcctgctgggcccgcctcccggagggggcggcaggagactcgggcctcgcggccgccctttaagtgcctcccagccttccttaccccagcgagctactggggatggctctcccggtagaaagggttcaggcagcgagcggcttccgcctagcggactgctcgcaaaaccccctcgaaccgcccaacctcctaggccccctgtaccagaaccagccacccctcggggcctccaactcagcgccaatatgtag

SEQ ID NO: 120374 - DNA, 3612 bp, Artificial Sequence
  Description of Artificial Sequence: Synthetic coding sequence
atggataagctgcccccctcaatgaggaaacgactctacagccttccccagcaagtaggagcgaaggcctggatcatggacgaagaagaggacgccgaagaagagggcgcaggcggtaggcaggatccttccaggcggtccattcgccttcgacctctgccgagtccctctccaagcgcagctgccggagggacagaaagcaggtcttcagcccttggagctgcagactcggaaggtccagctcggggggccgggaaatctagcacgaacggggattgtaggaggttcagaggcagcctggcatccctcggctcccgcggaggcggttcaggcgggacgggcagtggaagctcccatggtcacctgcacgattcagccgaggaacgtcgcctgatagccgagggcgacgcctctccgggagaggatcgaacccctcctggtctcgctgctgagccagagaggcccggagcatccgctcagccggctgcctcacccccaccaccccagcagcctccccagccagccagtgccagttgtgagcagccgtcagtcgacacagccatcaaggtcgaagggggggcagcagctggtgatcaaatcctgcctgaagctgaagtccgactgggacaagcgggcttcatgcagagacaattcggggccatgctacaacctggagtcaacaagttcagcctccgcatgtttgggagccaaaaagccgtggagcgggagcaggaaagggtcaagtctgcagggttctggatcattcatccatactctgactttcggttctattgggatctgacaatgctgctgttaatggttggtaaccttattatcatacccgtgggcatcacgttcttcaaagacgaaaatacaaccccctggatcgtatttaacgtagttagcgatacgttcttcctgatcgatttagttctgaatttcagaacaggaatcgtggtggaggacaataccgagattattctggatccacagagaatcaagatgaagtatctgaaatcttggttcatggtcgatttcatcagctccatacctgtggattacatcttccttatagtcgagacacgcattgattcggaagtctacaaaactgcaagggctctgcgaatcgtgcgattcactaagattctttcgcttctccggctgctccgtttgtcacgcttgatccggtatattcatcagtgggaagaaatatttcacatgacatacgatttggcctctgctgtggtgaggatagtgaatttgatcggcatgatgctgctactgtgtcattgggatgggtgcttacagttcctcgttccaatgctccaggatttccccgacgattgctgggtctccataaataacatggtgaacaatagctggggtaaacagtattcctacgctctcttcaaggccatgagccatatgctatgcatcggctatggccggcaggccccagtgggaatgagcgacgtgtggctgactatgctgtctatgattgtgggagcaacatgctacgctatgtttattggtcacgcaacagccttgatacagagtttggactcttcccgcagacagtatcaggagaagtacaagcaagtagaacagtacatgagcttccacaaactcccacccgatacacgccaacgaatccatgactactatgaacacagataccagggaaagatgtttgacgaagagtctatcctcggagaactatcggagcctcttcgggaggagatcattaattttaattgcagaaagctcgtcgcctcaatgcccctctttgctaacgccgatcccaactttgtcacaagcatgttaactaaactccgattcgaagtcttccagccaggtgactacattatccgggagggcaccattggaaagaagatgtatttcatccagcacggcgtcgtctctgtcctaacgaagggtaacaaggagactaaattggcagacggctcctactttggtgagatatgtctattgacgcggggacgacggacagcgtccgtgcgtgctgacacatactgtcgcttgtacagcctgtcagtggacaacttcaacgaggtgctcgaggagtacccgatgatgaggagagcgttcgagacagttgctctggaccgactggatcgcattggaaaaaagaactccatcctgttacataaagtgcaacatgatctgaactccggcgtttttaattatcaggagaacgagatcatacagcagattgtgcagcacgatcgagaaatggcccactgcgcacaccgcgttcaggctgcagcctcggctactccaacaccaacaccagttatttggaccccactgatccaagccccactgcaggcagcggctgccacaacatctgtagcaattgctttaacccaccacccgaggcttcccgccgccatatttcggcccccccccggatcgggcctgggcaacttgggggccggccagaccccccggcatctgaaaagactccagagtctgattccgtctgctttggggagtgcatctccagcgtcctctccctcccaggttgacacccctagctcttcctcattccatatccagcagctcgccggctttagtgcccctgccggtctctccccactgcttccctccagtagcagctcacctccccccggtgcctgtggtagcccatctgcccctacgcctagcgccggcgtcgcggctacaactatagctggatttgggcactttcataaagctctgggtggcagcttgtctagcagcgactcccccctcctgacccctctccagcccggggcccgaagccctcaggcagcgcagccaagccctgccccccccggtgccaggggcggattaggcctaccagagcactttctgcctccacctccaagtagcaggagcccctcgtcatcaccgggtcaactgggtcagcctcccggggagctgtcactgggccttgccaccggtcccttgagcacgccggagaccccccctcgccagcctgaaccgccgtctctggtggcaggtgcgagcgggggtgcatcccctgtggggtttacaccgagaggtggtttaagcccccccggccacagcccaggcccacccagaacatttcccagtgcgccacccagagccagcggaagccacggtagtctcttgctgccaccggcatcatccccgcctcccccgcaggtgccacagagacgtggcacgccaccactaactcctggacgccttacccaggatttgaaactaatcagcgccagccagccagcattgccacaggatggggctcagactctgagaagagcctccccccacagctcaggggagtcgatggcggccttccccctgttccctagggcagggggagggagcggcgggtccggatcttctggcggtctggggcctcctggaaggccttatggcgccattccaggccagcacgtgacactgcctaggaagacttccagcggctccctccctccccccttgtctctgttcggcgcccgggcaacatcaagcggcgggccgccgttaacagcaggcccccagcgggaaccaggggcaaggcccgagccggtgaggagtaagctgccgagtaatctgtag

SEQ ID NO: 120375 - DNA, 396 bp, Artificial Sequence
  Description of Artificial Sequence: Synthetic coding sequence
atgaacctaccatcaacaaaggtatcttgggccgctgttacccttctgctactcctcctgctcctgcctccagcgttactcagtagcggagctgctgctcaacctttgcctgactgttgccggcagaaaacatgctcatgcagattatacgagcttttgcacggcgcaggcaatcacgccgcaggaatcctgaccttaggcaagagacggtcaggcccgcccggtcttcaggggcggcttcaacggctgctacaggcgtctggcaaccatgctgccggcattctgaccatgggcagacgggccggagccgagcccgctcctaggccttgtttaggcaggcggtgtagcgctccggcggcagcgagcgtcgcgccggggggacagagtggaatctag

SEQ ID NO: 120376 - DNA, 1050 bp, Artificial Sequence
  Description of Artificial Sequence: Synthetic coding sequence
atggcggcgacagcagctgaggccgtggccagcggcagcggcgaacccagagaggaggcaggggcactgggccccgcctgggacgaaagtcaactgcggagttatagctttccgacccgccccatacctaggctttcgcagtccgacccaagagctgaggagctgatcgagaatgaagagccagtcgtcctgactgacaccaacctggtctaccctgcactgaagtgggatctggagtatctgcaggagaacatcggcaacggggatttcagcgtatactccgcgtcgacgcacaagttcctctactatgacgaaaagaaaatggcaaacttccagaactttaaaccgaggtctaacagagaggagatgaaattccatgagtttgtggagaagctgcaggacattcagcagcgaggtggagaagaacgactgtacctgcagcagaccctgaacgacacggtggggagaaaaatcgtgatggattttctgggcttcaactggaattggataaataaacaacagggcaagcggggttggggtcagctcacctccaatctgctcctgatcggaatggagggcaatgtgactccggctcattatgatgagcagcagaattttttcgcgcagattaagggatataagagatgcatcctgtttccccccgatcagtttgaatgcctgtacccctatcccgttcaccatccatgcgaccggcagtctcaggtggactttgataatcccgattacgaaaggtttcctaacttccagaacgtggtgggctacgaaacagtagtcggcccaggggacgtgctctacatcccgatgtattggtggcaccacatagaaagcctgctcaacggaggtattaccattactgtaaacttttggtataagggcgccccgacccctaaaaggatcgagtaccccctgaaggcccaccaaaaggtagccattatgagaaatatagagaagatgctcggggaagccttgggaaatccacaggaggttggccccctgttgaacaccatgattaaagggcggtacaattag

SEQ ID NO: 120377 - DNA, 1149 bp, Artificial Sequence
  Description of Artificial Sequence: Synthetic coding sequence
atggtctctgtgggatgtgttgtctttctttttttcttcttcggagtccgaaatagaaggtccttccgcttccgatggggcccatcccttgcagcagaaatggctgctactgctgctgaggctgtagctagtggatcaggcgagcctcgcgaggaggccggcgccctaggacctgcttgggatgagagccagttgaggagctacagctttcccacccgcccaatccctcgcctgagtcaaagcgatcccagggctgaggagctgattgagaacgaggagccagttgtgctgaccgacaccaatcttgtatacccagcactaaaatgggaccttgagtacctgcaagaaaacattggaaatggggacttctcggtgtatagcgcttccacccacaagttcctatactatgacgagaagaagatggcgaatttccagaactttaagccccgttctaatcgtgaagaaatgaaatttcacgagtttgttgagaaactgcaggacattcaacagaggggtggggaagagcggttatacctgcagcaaacattgaacgatactgtgggacgcaagattgtgatggacttcctcggattcaactggaattggatcaataagcagcaggggaagcgaggatggggccagctcacaagcaatctcctcctgattggaatggagggcaacgtcacacctgctcactacgacgaacagcagaacttcttcgctcagattaagggctacaagagatgtatcttgttccctcctgatcagtttgaatgtctctatccgtatcctgtacaccacccgtgtgatcgacagagccaggtggatttcgataaccctgactacgagagatttccaaactttcagaacgttgtggggtatgagacagtggtgggccctggtgacgtgctgtatattccaatgtattggtggcaccatatcgagtctctcctgaatggggggattaccattacagtcaatttttggtacaagggggcccccaccccaaaacggatcgaatacccactgaaagcccatcagaaagtggcgattatgcgcaatatcgagaaaatgctgggggaggcgctgggaaacccccaggaggtgggtcctttacttaacactatgataaaaggcaggtataactag

SEQ ID NO: 120378 - DNA, 579 bp, Artificial Sequence
  Description of Artificial Sequence: Synthetic coding sequence
atggcaaatttccagaacttcaaaccgaggtctaaccgcgaggagatgaagttccacgaattcgtcgagaagctgcaggacattcagcagcgcggtggggaagaacggctgtatctccaacagaccttgaacgatactgttggtagaaaaatcgtgatggactttctgggatttaactggaactggatcaacaaacagcagggaaagcgcggttggggtcagctgacctctaacctgctgctaatcggtatggaagggaatgtgactccggctcactacgatgagcagcagaatttctttgcccagattaaaggttacaaaaggtgtattctcttcccacccgatcagtttgaatgcctctacccgtatccggtccaccatccgtgtgatcgacagtcacaagtggatttcgacaaccctgactacgaacggttcccaaactttcagaatgtggtgggctacgaaacagtcgtcgggcccggagacgtgctgtatatcccaatgtattggtggcatcatattgaatccctgctcaacggcggcattaccatcactgtgaatttctggtacaaggggtag

SEQ ID NO: 120379 - DNA, 1803 bp, Artificial Sequence
  Description of Artificial Sequence: Synthetic coding sequence
atgcgtcccgcagctggagccgcacgcagaccgcggtgctgcaccagttggttaacaaggtgcccaagtccagccgcttcagctcctacgtggacccgaccactgagctgcgcctccccgtccgcgacctgtgcctgtaccgccagtgccccccagttggagctcattggtcacagcatctttgatttcattcatccctgtgatcaggaggagctgcaggacgcactgacaccgcagcagaccctgtccaggcgcaaggtcgaggctcctactgagcgctgcttttccctgcgtatgaagagcactttgacttctcgtggcagaacccttaacttgaaggccgccacatggaaggtgcttaattgttcaggccatatgagagcctacaaacctccggctcaaacatcacctgcaggcagtccagattccgaacccccgcttcaatgtttggtccttatctgtgaagcaatccctcaccccggctccctcgagcctcccctaggccggggggcatttctttcaagacacagcctggacatgaagttcacatattgcgacgaccggatcgccgaggtggccggttattcacccgacgatctcattggatgtagcgcctatgaatatatacacgcccttgattccgacgccgtaagcaaatcaatccacacactgttgagcaaaggtcaagccgttactggccagtacagattcctggcacggtcaggtggctacctctggacccagacacaggccacagttgtcagcggtggacgtggccctcagtcagagtctatagtgtgtgtccactttctgatctcccaagtagaggagaccggggttgttttatctctggaacagactgaacagcactctagaagaccaattcaacgcggtgctccatcacagaaagataccccgaatcccggcgactctttggatacaccaggcccccgaattttagcctttcttcacccacccagcctgtccgaagcagccctggcggctgacccccggagattctgttctcctgacttgcgccgcctccttgggcctatcctcgacggagctagtgtggctgcgacgccttcaacccctctcgccaccaggcacccacagtcgccattgagcgcagaccttcccgatgaactgcccgtaggcacagaaaatgtgcacaggctgtttacgagcggtaaagacacggaagccgtggagaccgacctagacatcgctcaggatgccgatgccctggacctggagatgcttgccccctacatttctatggatgatgatttccagctcaatgcgtcggaacagttgccacgggcctatcaccgccctctgggcgcagttcctcgccctcgtgccaggtcttttcacgggctgagtccccctgcattggaaccctccctcctgcctcgttgggggtcagacccacgactctcttgttcctccccctccagaggcgacccctccgccagctcccctatggccggggccagaaagcgtacattggcccagtccagtgaggacgaggatgagggggttgagttgctcggcgtgcgaccgcccaaacgctctccctcgcccgaacatgagaacttcctgctgtttcctcttagcctttcatttctgttgactgggggaccggccccgggtagtctccaggatccttctacaccactgcttaaccttaacgagccgctaggacttggcccttctcttctgtcaccgtacagcgatgaggatacaacccagcctggtgggcccttccaaccaagagccggctccgcccaggccgattag

SEQ ID NO: 120380 - DNA, 1353 bp, Artificial Sequence
  Description of Artificial Sequence: Synthetic coding sequence
atgagacctgccgccggggctgctcggcggccccgctgttgtaccagctggctgaccagatgcccttctccagcagcctccgccccaacctggacccgtccacttagttgcgcctcacctagtgccacctgcgcatgcaccgcttccgccccccagttggagctgatcggccatagcattttcgacttcatccatccatgcgatcaagaagagcttcaagacgcacttacaccccagcaaacactgtctagacgtaaggttgaagcgcccacggagaggtgcttttccctcaggatgaagagcaccctgacgagtcgcgggcgaactctgaacctgaaggctgccacatggaaggttctcaactgctctggacacatgcgggcatataagccacctgcccagaccagtcccgccggttcgcccgattctgagcctcccttacagtgtctggtgctgatttgtgaggcgatcccacacccaggcagtctggagccacccttgggcagaggcgcattcctttcccggcatagtcttgacatgaagttcacgtattgtgacgatcgcatcgctgaagtggccggctacagtccggatgatctaatcggttgcagtgcctatgaatatattcacgcactggactcagatgctgtgtctaaatccattcacacactgctgtctaagggacaggccgtaacaggccaataccggttcctggctcgttctggagggtatctctggacccaaacccaggcaactgtggtctcaggaggcagagggccacagtctgagagcatcgtctgtgtgcattttctcatctcccaggtggaggagaccggtgtagtgctgtccctcgagcagaccgagcaacatagccggcggcctattcagcggggggccccaagtcagaaagatacacctaaccccggtgattcattagatacacctgggccaaggatcctggcttttcttcacccgccgagcctcagtgaggccgctttagcagccgaccctcgaaggttttgcagccccgacctccggcgtctgctggggccgatcctggacggagcgtcagtagccgctaccccgagtactccacttgcgacaaggcacccgcaaagcccactgagtgccgacctacctgacgagcttccggttggtactgagaatgtgcatcgtttgttcacatccggtaaggacaccgaagcagtggaaaccgacctggacatcgctcaggacccttcaacccccctgctgaatttaaatgagcctttaggttttcacttcgttacacagtccggagtgcaatggcacaagcacagctcacctcagccacgcccgcccggcctcaagtag

SEQ ID NO: 120381 - DNA, 1899 bp, Artificial Sequence
  Description of Artificial Sequence: Synthetic coding sequence
atggccctcggcttacaacgggccagatccaccaccgaactacgcaaggagaaatcccgtgacgctgctcgctcacgtcgctctcaggagacagaggtactttatcaactggcgcacacactgcctttcgcccgcggcgtgtctgcacacctggacaaggcctcgattatgagattaactatctcgtaccttcgcatgcatcgcttgtgcgccgccggcgaatggaaccaagtaggggccggcggggagcctttggacgcctgctacctgaaagcactcgagggcttcgtgatggttctaacagccgagggggacatggcttatctttctgaaaacgtgagtaagcacctcggattgagtcagcttgagctgatcggtcactcaatctttgattttattcacccatgtgaccaggaggagctgcaggacgctcttacccctcagcagacactgtcccgtagaaaggtcgaggccccaaccgagcggtgcttttcactgagaatgaaatccaccctgacttctcggggacgcaccctcaacctaaaagcagccacgtggaaggtcctgaactgctcaggacatatgagggcatacaaacccccggcccagacttcgcctgcaggctccccggactctgagcccccacttcagtgcctagttcttatctgtgaagccattcctcaccccggttctttggaaccgccactcggcagaggtgcgttcctctcccggcactccctggacatgaagtttacctattgcgatgaccgtattgcagaagtggccggttacagccccgatgacctaatcgggtgttcagcctatgagtatatccacgccctggatagtgatgccgtgtcaaaatctattcacactctcctatctaagggtcaggccgttaccggccagtaccggttcttggccagatctgggggctatctttggacacagacacaggcaacagtggtgagcggggggcgagggccgcagtcagagagcattgtttgcgtgcacttcctcatctcacaagtggaggaaacgggggtcgtcctctccctcgagcagacagagcagcatagtcggagaccaattcagagaggagcaccaagccagaaagatactcctaaccctggcgattcacttgacaccccagggccgcgcattcttgcctttttacatcctccgagcctaagtgaggctgcattggccgcagaccctcgcagattttgttccccggacttgagaagattactgggaccgattctcgacggcgcttccgtggctgcgaccccatcaaccccactggcaacacggcacccacagagcccactcagtgctgacctcccggatgaactcccggtgggcaccgaaaacgtccaccggttatttacgagtggaaaggatactgaagccgtagagactgatcttgatatcgcccaagatgcagatgcccttgacttggaaatgctggccccctacatttctatggacgacgacttccagctcaacgcctccgagcagctgccccgagcctatcataggccccttggggccgtccctcgaccgcgggccagaagctttcacggcctttcgccccccgccctggagccctccctcttgcctcgatggggctccgacccaaggctgtcgtgttcatctccatctagaggtgaccctagcgcttcatctcccatggcgggagctaggaaacgaactctcgctcaatcctctgaagacgaggatgaaggggtggaactgctcggggtccgtcccccgaagaggtcaccatccccggaacacgagaactttctattgttccctctgtcccttgtttgctgggggatcaatgggatactttggcctagtctcccgtcctggttgaaaccaaccgtgctgtag

SEQ ID NO: 120382 - DNA, 1731 bp, Artificial Sequence
  Description of Artificial Sequence: Synthetic coding sequence
atgcggctcactattagctatctgaggatgcatagactttgcgccgccggagagtggaatcaggtaggagcaggaggcgagccactggacgcttgctaccttaaagctctggaaggcttcgtcatggtcttaacagcagaaggtgatatggcttatctctctgaaaatgtttctaagcacctcgggctgagccaactggagctcatcggtcactccatctttgatttcatccatccctgcgatcaggaagagctccaggatgcactcaccccacagcagacgctctctcggcggaaagtggaagcgcccacagagaggtgtttctccctgcggatgaaatctacactcacgtcccgcggccgcactctgaacctgaaggccgcgacgtggaaagtgctgaactgtagcggacatatgagggcttataaacctccggctcagactagcccagccggctctccagacagcgagcccccgcttcagtgtctcgtacttatctgtgaggctattccacacccaggctcgctggaaccacctctgggcagaggcgcttttctgagtcgccatagcttggatatgaagttcacttattgtgacgaccggatcgctgaagttgcgggttatagcccggacgacttaatcgggtgctcagcctatgaatatattcatgcactggattcagatgcagtgtccaagtctatacataccctgctatcaaagggccaggccgtgacaggccagtaccgctttctcgcgcgcagcggaggatacctctggacccagacccaagcaaccgtggtgagcggaggacggggaccacagtcagaaagcatcgtgtgtgtccatttcttaatcagccaggtggaggagaccggagtagttctgtccttagagcagactgagcagcacagtaggcgtcctatacagagaggcgccccctcacaaaaggacacacctaaccccggcgattcattggacacgccaggtccccggatcttggcctttctgcacccaccctcactgtccgaggcagctctggcagctgacccacggcgtttttgctcccctgacctaagacggctgttgggccccattctcgatggggcctctgtggctgccacaccgagtacccctctagccacccgccacccacagagtcccctgtctgccgacctaccagatgaactgccagtcgggacagaaaatgtgcacaggcttttcacaagcgggaaggataccgaagcagtcgagactgacttggatatagctcaggacgccgatgcactggatttagaaatgttggctccttatatctccatggatgatgatttccaactcaatgccagcgaacagctgccccgagcctatcatagacccctcggggcagtccccagacctagagcccggagcttccacggactgtctccacccgctctggagccgagcctcctgccgagatggggaagcgacccccggctgtcttgttccagcccatcaagaggcgacccctcagcctctagtcctatggctggggccaggaagagaacacttgcgcagtccagcgaagacgaagacgaaggagtggagcttttgggcgtcaggccacctaagaggtctcctagccctgaacatgaaaattttcttctttttcccctaagtctggtatgctggggaattaatgggattctgtggccatctctaccatcttggttgaagcctaccgtactgtag

SEQ ID NO: 120383 - DNA, 2004 bp, Artificial Sequence
  Description of Artificial Sequence: Synthetic coding sequence
atggattggcaggatcacaggtcgacgacggagttgcggaaagagaaaagtagagatgcagcgagaagcagacgatcacaggaaaccgaggttctataccagttggctcacaccctgcctttcgcccggggggtgtcagcccacttggacaaggcgagcattatgcgactcactatcagctacctgcggatgcaccgattatgcgctgcaggggagtggaatcaagtaggagcaggaggggaacccctggacgcttgctacctgaaggccctagaaggctttgtcatggtgctgactgctgaaggggacatggcttatctctctgagaacgtcagcaaacatctggggttgtcccagctagagctgatcggccacagcattttcgacttcattcatccttgcgatcaggaggagctgcaggacgccctcacccctcagcagacactgagcaggcggaaagttgaagcgccgacggagagatgcttctccttaaggatgaaaagtacgttgacgtcaaggggacgcacactgaatctcaaagcagcaacgtggaaggtgctgaactgctcagggcacatgcgggcctataagccccccgcccaaacctcccccgccggctcgcccgactctgagcctcctcttcagtgtttggtccttatctgcgaagcaattcctcacccaggcagtctggagcctcctctcgggaggggtgccttcctgtcccgacactccctggatatgaaatttacctattgcgacgatcgcattgctgaggtggccggctatagccccgacgacctcattggttgtagcgcttacgagtatattcacgccctcgactccgacgcagtgagtaagagcattcatactttactctccaagggccaggccgttactggccagtatcgctttctggctcggtcggggggctatctctggacccagacgcaggctaccgtagttagcggcggcagagggcctcagtccgaatcaatagtttgcgtacatttcctcatttctcaggtggaggaaacgggggtggtgctgtctctggaacaaacggagcagcactccaggcggcctatccagagaggtgcgccatcccaaaaggacacccccaaccctggagactctttggacacaccaggcccccgtatcctggcttttctccacccccccagcctgtcagaagctgccctcgccgcagacccccgcagattttgctctccagacctcaggcggctcctcggccctatacttgacggcgctagtgtagcggccactccctctacacccctggcaactagacatcctcaaagccccctcagcgccgacctgccggacgagcttccagtaggcaccgaaaatgtgcacagactcttcacaagtggcaaagatacagaggccgttgaaaccgacctggatatcgcccaggatgcggatgccttggacttggaaatgctggctccctatatcagcatggatgacgatttccagcttaatgcctcagagcagttgcccagggcctaccatagacctctgggtgcggtcccgaggccacgtgcacgttcgttccatggtctatctccgcccgccttagaaccaagtttactgccccgctgggggtcagacccgagactctcttgttcatcacccagccggggggatcctagtgcgtctagccccatggccggggcccgcaagagaactttagctcagagttctgaggatgaagatgaaggtgtcgagttactgggcgtaagacccccaaaacgcagtccctcgcctgagcacgagaacttcctcctctttcccctttcactaagttttctcctcaccggaggtcctgcaccggggagcctccaggatccatccacgccgctgctcaacctaaatgaacctctgggcctagggccctcactcttaagtccatactccgatgaggatactactcaaccagggggcccattccagcccagggctggttcagcgcaggcagactag

SEQ ID NO: 120384 - DNA, 1842 bp, Artificial Sequence
  Description of Artificial Sequence: Synthetic coding sequence
atgcgtttaacaatttcttacctgaggatgcacaggttatgtgccgctggggagtggaatcaagtcggggccggcggcgaacctttggacgcttgttatcttaaggcactcgaggggttcgtcatggtccttaccgccgaaggagatatggcatacctgtccgagaacgtgtccaagcatctcggcctgagtcagctcgagctgataggccattccatcttcgacttcatccacccttgtgaccaggaggagttgcaggacgccctcaccccacagcagacactgagtaggcgaaaggtggaggctcctacagagcggtgctttagccttagaatgaagtctactctcacttcacgagggcgcaccctgaatttgaaggctgctacatggaaggttttgaactgctcaggccacatgcgagcctataagcctccagcacaaacatctcccgccgggagcccagattctgagccccccctgcagtgtctggtgctcatttgtgaggcgattccacaccctggtagcctggagccccccttgggccgcggtgcctttctcagtcggcatagtcttgacatgaagttcacatactgcgatgaccgtattgcggaggttgccgggtacagcccagatgacctgatcggatgctcagcctacgaatacattcacgcccttgactcagatgctgtgtcgaagagcatacacacactactttcgaaaggacaggccgttacgggacagtataggtttctggctaggtcaggcgggtatctgtggacccagactcaagctaccgtcgtgtctggcgggcgcggaccacagtccgagtctattgtctgcgtgcatttccttattagccaggtcgaggagactggtgtggttctctccctagagcaaaccgagcagcacagcaggcggcccatccagcggggcgcaccctcccagaaagacactccaaaccccggtgactccctcgacacgcccggcccaaggatactggcgttcctgcatccgccctcactctccgaagctgcactggcagcggacccaaggagattctgctccccggacttacggcgcctgcttgggcccattctcgatggagctagtgtcgccgcaacccctagcaccccactcgccacacggcacccgcagagccctctctccgcagatctgcctgatgaattacccgtgggcaccgaaaatgtacatagattgtttactagtggaaaggacacggaggctgtggagactgaccttgatattgcacaggatgctgacgccctcgacctggaaatgctggccccttacatttcaatggacgacgactttcaactcaatgcctctgagcagcttccacgcgcctaccacaggcccctcggcgctgtgccacgaccccgcgcccgcagctttcacggactgagcccaccagctctggagcctagtctgttgccacgctggggttcagatcctagattatcatgcagtagcccctcccgaggggacccatccgctagctcccccatggcgggcgcccgcaagcggacccttgcccagtcaagtgaggatgaagatgagggcgtggaactgctcggggtgcgaccccccaagagaagccctagcccagagcacgagaatttcttgcttttcccccttagtttgagcttcctgctcaccggtggcccggcccccggctctttgcaagatcctagcacgcccctcttgaacttgaatgagccactcggcttggggcccagccttctgtcgccttacagcgacgaggatacaacccagccgggtggcccttttcagccaagggccggatcggctcaagcggactag

SEQ ID NO: 120385 - DNA, 2010 bp, Artificial Sequence
  Description of Artificial Sequence: Synthetic coding sequence
atggccttagggctgcagagagccagatccaccactgaactacgaaaggagaagtcgagggatgcagcacgaagccgccgcagccaagagactgaagtcctctaccagctggcccacactctgcccttcgcgcgaggcgtttctgcccacctggataaggcgtccatcatgagattaaccataagctacttaagaatgcaccggctgtgtgccgctggagaatggaatcaggtcggcgcgggaggcgaaccccttgatgcctgttacctaaaggccctggaagggtttgtgatggtgctcacagcagagggcgacatggcatatctgtcagaaaatgtgtctaagcacctgggcctgtcacagctggaactgatcggtcacagtatatttgacttcatccacccctgcgaccaagaggaattacaggacgcactgacaccacagcagacgctgtcaagacgaaaggtggaggcacctaccgagcggtgctttagtctgcggatgaaaagcactttgacatcgaggggaagaactctgaacctgaaggcagcgacatggaaggtgctgaactgtagtggccacatgagggcatacaaaccacccgcccagaccagtccagccggctcacccgatagtgagcctccattacagtgcctggtgttgatctgtgaagccatcccacatccgggtagtcttgaacctccccttggccggggtgcatttttaagtagacacagcctggacatgaagttcacgtattgcgatgaccggattgccgaggtggccggatatagccctgatgatttgatcggctgttccgcctacgagtatatccatgcactggactcagacgccgtctcaaagagtattcataccttgctaagtaagggacaggccgtgaccggccagtaccgattcttagcccgcagcggcggatacctctggacccagacgcaagccacggtcgtgagtggcggccgaggcccacaaagtgagagcatcgtctgtgtccacttccttatcagccaggttgaggaaacaggcgtcgttctctctctggaacagactgagcaacactcaaggcgcccaattcagagaggcgctccttcacaaaaggacacacctaatcccggggactccctggatactcccgggcctagaatcctggccttccttcatcctccctctttatccgaagcggctctggcggcggatcccaggcggttttgcagcccagacctgaggagactcctcgggcccatcctggacggcgcatcagttgccgcaaccccgtctaccccattagcaacacggcatccacagagtcctctgagcgcagacctgccagacgagctgcctgtgggcaccgaaaacgtgcataggcttttcacgtccggaaaagataccgaggccgtggagactgatctcgacatagctcaggatgcagacgcactagacctggagatgctggccccctacatctctatggacgatgattttcagctgaacgcctccgaacagctgcctcgggcataccacaggcctctgggtgccgtcccacgacctagggccaggagcttccatggactgtcacctcccgccctggaacccagcttgctacccaggtgggggtccgacccccggctgagctgtagcagcccgtcaagaggggatccgtccgcgagcagtcctatggctggcgcccgaaagcgaacactggcgcagtccagtgaagatgaggacgagggagttgagcttttaggagtgaggccaccaaaacggagcccttcgccagaacacgaaaacttcctactcttccccctctccctctcatttctgttgacaggaggcccggcccctggttctctgcaggacccgtcaactcccttactgaatctgaacgaacccctcggactgggccccagtcttctctctccatactccgacgaagacactactcagcctggggggccttttcaaccgcgagccggatctgctcaggctgactag

SEQ ID NO: 120386 - DNA, 1092 bp, Artificial Sequence
  Description of Artificial Sequence: Synthetic coding sequence
atggctctgggactgcagcgggcccgctccactactgagctccgaaaggaaaaatcaagggatgctgcaagaagtaggcgctcccaggagaccgaggttctttaccagcttgctcacaccctgccatttgctaggggcgtttctgcccatctggacaaggctagcataatgagactgacaatttcatacctccgcatgcatcgattgtgcgctgccggagagtggaaccaggtgggcgccggcggagagccactggatgcctgttacttaaaagccctggagggcttcgttatggtgttgaccgccgaaggcgatatggcatatctgtccgagaacgtgtcaaagcacctgggcttgtctcagctggagctcatcgggcattcaatctttgatttcatacacccctgcgaccaggaggaactgcaggatgcactgaccccccaacagacactgagccgccgcaaggttgaggcccccactgagaggtgcttcagcttgcgcatgaaaagcaccctgacaagcagaggccggaccctgaacctgaaggctgctacctggaaagtgctgaattgcagtggacacatgagggcgtataagccccccgcacagaccagccctgcaggaagcccagacagcgagccccccctgcagtgcctggtgcttatttgcgaagcaattccacatcccggatctctggaacctccgctcggtcggggcgccttcctttcccggcattctctggacatgaagtttacgtactgcgacgacaggattgcagaggtcgctgggtacagtcctgatgatttgattggatgttcagcttacgagtatatccatgccctggactctgacgctgtgtctaaatctatccacacctgtatgtatcctatatcccccggcgctaaacccgcagcaacttggcccccagctgacaccaggactcctcaactgcccataccccaagacgcccttccgccccacctaaacacatcatcactgctaccaaagccgcagggaactgtgagcttcctggccccctcctatccggttccaagatacttttcacctcacttgccaccttggtggccttag

SEQ ID NO: 120387 - DNA, 1839 bp, Artificial Sequence
  Description of Artificial Sequence: Synthetic coding sequence
atgctgccaatgccttccggacgccccagatcttgcgccagaaagagtcccggtatgcgccctgctgcaggcgcagccaggagaccacgctgctgtactagctggctgaccaggtgtccgtcaccggccgcatcggctccaacttggactcgacctctgagctgtgctagtcctagcgcaacctgcgcctgcactgcgtctgctccacaactggagcttattggacactctatttttgacttcatccacccctgtgatcaggaagaactgcaggatgctctcactccacaacagaccctctccaggagaaaagtggaggctccgactgagagatgcttcagcctgaggatgaaaagcactttgacctccaggggaagaactctaaacttgaaggcagcaacatggaaagtgctgaactgcagcgggcatatgcgggcttacaagccccctgcccaaaccagtccagccggaagccccgactctgaaccgccactgcagtgcctggtcctgatctgcgaggccatcccacatccgggtagtctagaacccccactgggaagaggggccttcctctcacggcacagccttgacatgaaattcacttactgtgacgataggatcgccgaagtggctggatatagccctgatgacctcattggatgcagcgcctacgaatatatccatgcgttggactccgacgctgtgtcaaagtctatccacactctcctgtccaaagggcaggctgtgaccggccagtacaggttccttgctcgctctggtggctacctctggacacaaactcaggccaccgtggtatcagggggcagggggccacaatcagaaagcatcgtctgcgtacactttctgattagtcaggtggaggagacgggtgttgtcctgagcttggaacagactgaacagcatagccgtagaccaatccagcgcggggctccttctcaaaaagatactcccaaccctggagatagcctggacactcccggacctaggatattggccttcctgcatcctcccagtctatcggaggcagctctggctgccgatccccgccgtttctgttcccccgacttacgaaggcttctgggaccaattcttgatggagcttcagtggccgctaccccatctactcccctggctacacggcatccccagtcccctctgtccgctgatctgcccgacgaactaccggttggtaccgaaaacgtgcacaggctatttacctcagggaaagacaccgaagctgtcgaaacagacctcgatattgcgcaggatgccgatgcactcgacctggagatgctggccccctatatcagcatggacgacgatttccagttgaacgcaagcgaacagttacccagagcgtaccacagacccctgggcgccgtgcctcgccctcgtgcccgctctttccacggactttcacctccggcattagagccctccctgttgccacggtggggcagtgatccccggctgagctgctccagtccctcaaggggagacccttctgcctcatcccccatggccggggcaaggaagcgcacactggctcaaagcagtgaggatgaggacgagggcgtagagttattgggagtgcgccccccaaaaagaagcccctcacctgagcacgagaacttcctactgtttcccctttcgctgtcatttctgctcacgggcggtccagcaccggggtcacttcaagacccaagcacccccctcttgaatttaaacgaaccactggggtttcacttcgtcacccagagtggcgtacagtggcataagcacagctccccacagccaaggccaccaggcctcaaatag

SEQ ID NO: 120388 - DNA, 600 bp, Artificial Sequence
  Description of Artificial Sequence: Synthetic coding sequence
atgcgcccggcggccggagcggctcgcaggccaaggtgttgcacatcttggctcactcgctgcccctcgcccgcagcgtccgcccctacgtggactcggcccttgagctgtgctagcccctcagcgacatgtgcatgcacagccagcgctccgcagttggaactgattggccatagcatctttgattttatacatccctgcgatcaggaagaactccaagacgccctgaccccccagcaaactttgtcccgcagaaaggtggaagcacctacagagaggtgttttagcctccgaatgaagtcgacattaacgagccgtggaaggaccctcaatttgaaggctgcgacatggaaagtattgaattgttccgggcacatgagggcttacaaacctcccgcccagaccagtcccgcgggctcccctgactctgaacctcctctgcagtgtctggtactgatctgtgaagctatcccccacccgggttctttggaaccgccactgggcagaggcgcttttcttagcagacacagccttgatatgaagtttacctattgtgacgataggatcgctgaggtggccggctatagtccaatgacttag

SEQ ID NO: 120389 - DNA, 714 bp, Artificial Sequence
  Description of Artificial Sequence: Synthetic coding sequence
atgagacccgctgcaggcgctgcacgcagacctcggtgttgtacaagttggcttacgcgatgtccaagtccagcagcatcagctcccacatggacccggcctttaagctgtgcaagtccatccgccacttgcgcatgcaccgcgagtgcaccacaagaggagctacaggacgctctcacaccccaacaaactctctctcgtcgtaaggtagaggctcccaccgagcgatgtttcagtctaagaatgaagtctacattgacctcaaggggacgcacactgaatctcaaagcagcgacctggaaggttctcaattgttcaggacacatgagagcgtacaaaccccctgcgcaaaccagccccgcaggctctccagattccgaacccccattacagtgcttagtactgatctgtgaggccatcccacatcccggtagcctggagagattcgtgccagtgagcagtgccgccacttctctctgcctgccctcactttccccatctaaggtggccgggtactcacctgatgacctgatcgggtgcagcgcttatgagtatatccacgctttggatagcgatgccccccaggacgcattaccccctcatctgaacaccagcagcctactgcccaagccacagggcacagtctcttttctcgccccctcgtacccagtcccaagatacttctccccacatctacccccttggtggccttag

SEQ ID NO: 120390 - DNA, 1092 bp, Artificial Sequence
  Description of Artificial Sequence: Synthetic coding sequence
atggcactgggcttgcaacgggcacgctctacaactgagttacgcaaggaaaaaagcagggatgctgccagaagccgccgttcccaagagaccgaagtcctgtaccagttggctcacactctgccgttcgcgcgcggcgttagcgctcacctggacaaggcctccatcatgcggctgacaatctcctacctgcgcatgcatagactgtgtgccgccggtgagtggaaccaagtgggcgcaggtggtgagccactggacgcttgttacttgaaggcactggagggtttcgtcatggtgctgaccgctgaaggtgacatggcttatctgtctgagaatgtttctaagcatctcgggctgagtcagctcgaacttatcggccatagtatcttcgattttattcatccttgcgaccaggaagaactgcaggatgccctgacgccacaacagacactgtctcggcgaaaggtcgaagcccctaccgaacggtgcttctctctgaggatgaagagcaccctgaccagtcgtgggagaacattgaacttgaaagccgctacatggaaggtgctcaactgtagcggacacatgcgagcctataaaccccccgctcaaacctctcccgctggctccccagattccgaaccgccactgcaatgtcttgtactcatctgcgaggcgatcccacacccgggcagccttgaaccacctctcggtagaggcgccttcttatcccggcacagcttagacatgaaatttacgtactgtgacgaccgcattgctgaagtggccggatacagcccagacgacctcatcggctgttccgcctacgaatatatccacgcactggattccgatgccgtctccaagtccatccatacttgtatgtatccgatctcgcccggagcaaagccagccgccacttggccaccggctgatacacggacacctcagctgcccatccctcaggacgcacttcccccccacctgaatacatcatcattgcttccgaagccacagggtacagtaagttttttggctccctcctacccggttcccagatacttctctccacacctgcccccatggtggccgtag

SEQ ID NO: 120391 - DNA, 2976 bp, Artificial Sequence
  Description of Artificial Sequence: Synthetic coding sequence
atggcagacaaggttagaaggcagcgcccacgccggcgagtttgttgggcactagtcgctgtcctcctggcagacctgctggcattgtccgatactctcgccgttatgtcagtcgacttaggaagtgagagcatgaaggtggctatcgtgcttaataaagaatccagacggaagacgcccgtcattgtgaccctgaaagaaaatgaacggttcttcggggattccgccgcgagcatggctatcaagaacccaaaggctacccttcgttactttcaacacctgctgggaaagcaagccgacaaccctcacgtcgctctgtaccaggccaggttccctgagcatgagttgacgttcgaccctcagagacagacggttcacttccagatcagttcccagctgcagttcagtcctgaggaagtgttgggcatggtgcttaactattctcgcagcctcgcagaagatttcgcggagcaacctattaaggatgcggtgataaccgtcccagtcttttttaatcaggctgagcggcgggctgttctgcaagctgccagaatggcgggactgaaggtgcttcagttaataaacgataataccgccaccgccctgtcatacggcgtgttccgacgcaaggatatcaacacgactgcgcagaacatcatgttctacgatatgggttcaggtagcacagtgtgtaccatcgtgacatatcagatggtgaaaaccaaagaggctggcatgcaaccccaactgcagatccgcggcgtggggttcgatcgcacacttggcgggctagagatggagttgcgcttgcgcgagcgtcttgccggcttattcaatgaacagcgtaaaggccagcgcgccaaagacgtgcgtgaaaatcccagagctatggccaagttgcttagagaagccaaccgacttaagaccgtactgagtgctaacgcggatcacatggcccagatagaaggactgatggacgacgtggactttaaggccaaagtcacacgagtggagttcgaggagctctgtgcagacctctttgagagagtccccggccccgtccagcaggccttgcagtccgcagagatgtcacttgatgagatcgaacaagtcatactggttgggggagctactcgagtccctcgggtgcaggaagtgctgctcaaagcggtgggtaaagaggagctgggcaagaacattaacgccgatgaagctgccgcaatgggagcagtctaccaagcagccgccctttctaaggcattcaaggtaaagccttttgtagtgagggacgcagtggtgtatcccatactggtagaatttacaagagaggttgaagaggagcccggaattcatagcctcaaacataataaacgcgtgctcttttcaagaatgggcccttatccgcaaaggaaagtgatcaccttcaatcgctactcacacgacttcaatttccatattaactatggtgatctcggcttcttgggtccagaggacttacgggtgtttggtagtcagaacctcaccaccgtcaaacttaaaggtgtgggggactcttttaaaaagtatcctgattacgaatctaagggcataaaggcccattttaatttggacgaatcaggcgtgcttagcctagatcgcgttgaatcggtgttcgagacgctggtcgaagattccgcggaagaagaatctacacttaccaagctgggaaatacaatatcaagtctctttggcggcggcaccacacccgacgctaaggagaatgggacagataccgtccaggaagaggaagaatctcccgctgagggcagcaaagatgagccaggggaacaggtggaactgaaggaggaagcggaagctcccgtggaagacggtagccagccgcctcctcctgagccaaagggagatgccacccccgagggcgagaaggcaaccgaaaaggagaatggtgacaaatctgaggcgcagaagccttcagaaaaggcagaagcaggccctgagggagtggcccctgctccagagggggagaagaagcagaagcccgcacgcaagcggcgcatggttgaagagattggcgtcgagctggtggtgttggatcttcctgatttgcccgaggataagctggcccaaagcgtgcagaagctccaggatttaaccctgcgggatctcgaaaaacaagaacgggaaaaggcagctaacagtctggaagcattcattttcgaaacccaggacaagctttatcaaccagagtatcaggaggtgagcactgaagaacagcgagaggagatttccggaaagctttctgctgctagcacctggctagaggatgagggggtcggagccacgacggtgatgctgaaggagaaactggcggaattacggaagctctgtcaggggctcttcttccgagtcgaggagagaaagaaatggccagagcggctttccgcgctggataacctgttgaatcactcttccatgttcttaaagggcgctaggctgatcccagagatggatcagatctttacagaggttgagatgactactctcgagaaagtcattaacgagacctgggcctggaagaacgccaccctcgccgaacaggccaagctgccggctaccgaaaagcctgtcctgttgtcaaaagatatcgaagccaaaatgatggcattagacagggaggtgcaatacctgctgaacaaagccaagttcaccaagccccgtcctcgacctaaggacaagaacgggaccagagccgagccacctctaaatgcgtccgctagtgaccaaggagagaaggtaatccctccagcagggcagacagaggatgcagagccaatctcagaacctgaaaaggtagagacggcgggctccgaaccaggcgacactgagcccctcgagctgggaggtccaggggcagaaccagagcagaaggagcagtctactggacagaagaggccactgaagaatgacgagctgtag

SEQ ID NO: 120392 - DNA, 3000 bp, Artificial Sequence
  Description of Artificial Sequence: Synthetic coding sequence
atggctgataaggtccgcagacaacgtcctaggcgtcgggtgtgttgggcactggtagcggtccttcttgctgacctgctcgccttgtcagacactctcgcagttatgtccgtcgatctcggcagcgaatccatgaaggtggctattgtgaagccaggcgtgcccatggagatagtcctgaacaaggagagccgaaggaaaacgcctgtaatcgtgactctcaaagagaacgagaggttcttcggagactccgccgcgtcaatggcaatcaagaatcccaaggccacactgagatacttccagcacctactcgggaaacaggctgacaatccacatgtcgccctgtaccaagccagattcccagagcacgagctgacctttgacccacagcgccagacagtccatttccagatcagctcacaactgcagttcagccccgaagaggtgttgggaatggtcctgaactattcgagatctttggccgaggacttcgcggaacaaccgataaaagacgccgtgatcactgtgccagtattttttaaccaggctgaaaggagagccgtcctgcaggcagcccggatggctggtttgaaggtcttgcaactgattaatgacaacaccgcaacggctctctcatacggggtgttccgcaggaaagatatcaacacaactgcccaaaacataatgttctacgatatggggtccggctctaccgtgtgcaccattgtcacctaccagatggtcaagaccaaagaagccggcatgcagccacagctccaaatacgaggggtcggttttgatcgcactctgggtggcctcgagatggaactcaggctcagggagagactggcaggcctcttcaatgaacagagaaagggtcagcgcgctaaagacgtcagagaaaatccccgggccatggccaagcttctcagagaggccaataggctgaaaacggtgctaagcgcaaatgcggatcatatggcccagattgaagggctgatggacgatgtcgactttaaggccaaagtgacccgggtggagttcgaggaactctgcgctgaccttttcgagcgggtgcctgggcccgttcagcaggcacttcagtcagctgaaatgtcgctagacgaaatcgagcaggttatcctagtgggaggcgctacaagagttcctcgggtgcaggaggtgctgttaaaggccgtgggaaaggaggagctggggaaaaacattaacgctgacgaagccgccgcaatgggggctgtctatcaagccgccgcactgtccaaagccttcaaagtcaagccatttgtcgttcgcgatgctgtggtgtacccgatcctggtggagttcacacgggaagtggaagaagagcccgggatccactccctgaagcataacaaacgggttctgtttagcagaatggggccttacccccaacgaaaggtgattaccttcaataggtactctcacgactttaattttcacataaattatggagacctggggttcctgggacctgaggacctccgtgtgtttggctcccagaacttgactaccgtcaagctgaagggggttggggactccttcaagaagtatccagactacgaaagcaaaggaattaaggctcattttaacttagatgaaagtggagtgctgagtctcgacagagtggaaagtgtgttcgaaaccctggtggaggatagcgccgaagaggaatctactctcacaaaactaggaaatactattagctctctcttcggcggaggcactaccccagatgccaaagagaatggcaccgataccgtgcaagaggaggaggaatcgcctgcagaaggatccaaagacgagccaggagagcaggtcgagttgaaagaagaggccgaggcgccagtggaagatgggtcacagcctccgcctcctgaacctaaaggcgacgcgactcccgaaggcgagaaagctaccgaaaaagagaatggtgacaaaagcgaggctcagaagcccagtgagaaagcggaggccggacccgaaggagttgcacccgcccctgaaggagagaaaaagcagaagccggctcgcaagcgcaggatggtggaggagattggggtggagctggtggttctggacctgcccgaccttccagaggacaagctggcgcagagcgttcagaaattgcaagatctgacattgcgagatctggagaagcaagagagggaaaaggctgctaattctcttgaagcctttatcttcgagacccaggataagctgtaccagccagaatatcaggaggtgtccacagaggagcagagagaggaaatatctgggaagctgtcagctgcctccacgtggctagaggatgagggggttggagctacgaccgtaatgctgaaggaaaagctggctgaactcagaaagttatgtcaaggccttttcttccgagtggaggagcgcaagaagtggcctgagcggctttcagccctggacaacctcctgaatcacagttctatgttcctgaaaggagcaaggctgatccccgaaatggaccagatcttcacagaagtggagatgacaacgctcgaaaaggtgatcaatgaaacttgggcctggaaaaacgcaactcttgcagagcaggccaaactgccagcaacggaaaagcctgtgttattgagcaaggacatagaggctaaaatgatggcccttgaccgggaagttcagtacctactgaataaagctaagtttaccaaacctcgccccaggcctaaagataagaatggtactcgtgcggagccacctcttaatgcttcagcgagtgatcagggtgagaaggtgatcccacctgccggccagaccgaggatgccgagcctatatccgaacccgagaaggtggaaactggctctgagcccggagataccgaaccactggagctcggagggcccggggcggagcctgagcagaaagaacagtccactggccagaagcgtcctctgaagaatgacgagttatag

SEQ ID NO: 120393 - DNA, 2547 bp, Artificial Sequence
  Description of Artificial Sequence: Synthetic coding sequence
atggttctaaattactcaagatcgctcgctgaagatttcgccgaacaacccatcaaggatgcggtcatcaccgtgcccgtatttttcaaccaggcggaacggcgcgccgtgctgcaggccgcccggatggctggcctgaaagttctccagctaataaacgacaatacagctacagcgctctcttatggggtgtttaggagaaaggatatcaatacaacagcccagaacattatgttttatgatatgggctccggctcaaccgtgtgtaccatcgtgacctaccagatggtgaaaactaaggaggcggggatgcaaccgcagctgcagatcagaggcgtcggcttcgataggactcttggtggtctggaaatggaattgcgcctgcgcgaaaggctcgctggattattcaatgagcagcgtaaggggcagcgggcgaaagacgtacgtgaaaatcctagagcaatggcgaagctgctgagagaggccaaccgccttaagactgtcctgagcgccaacgccgaccatatggctcagatagaagggttaatggacgatgtggactttaaggctaaggtcacccgcgtggaatttgaggagctgtgtgcggacttgttcgagagggttcctggccctgtacagcaggcacttcaaagcgcggaaatgtctctcgatgagatcgaacaggtgatattagttgggggagctaccagggtcccaagggtacaagaggttttgctcaaggccgtcggcaaggaggaattgggcaagaatatcaacgccgacgaggccgcggccatgggcgcggtgtaccaggcggccgctttgagcaaagcttttaaggtcaagcctttcgtggtaagggacgcagtggtgtatccaattctggtcgagtttacaagagaggtggaagaggaacctggcatccattcactcaagcacaataagcgagttctcttctcccggatgggcccctacccccagcgcaaagtaatcacattcaataggtattctcatgacttcaactttcatatcaactacggggacctgggtttcctcggacccgaagatcttcgcgtgttcggttcacagaatctgactaccgttaagctcaagggggttggagacagtttcaagaaataccctgactacgagtcgaagggaatcaaagcccatttcaatctggatgaatccggggtgttatcattggatcgggtggaatccgtatttgaaaccctggtagaagatagcgccgaggaggaaagcaccctgaccaagctgggcaacacaatttcttctctcttcggggggggcaccactcccgacgcaaaagaaaatggaactgacaccgtccaagaggaagaggaatctccggccgaagggagcaaagatgaaccgggagagcaagtggaactgaaagaggaagcagaggcccctgtcgaggatggatcgcaacctcccccgcccgaacccaagggcgacgccaccccggagggggaaaaggccacagaaaaggagaacggggacaaatcagaagctcaaaagccgtcagaaaaagctgaggcgggacctgaaggagttgcccccgcccccgagggagagaaaaaacagaagcccgcacgaaagaggcgaatggttgaggaaatcggtgtggaactggtcgtgctggacttgccagatcttcccgaggacaagctggcacagtcagtgcagaaactgcaagatctcaccttacgtgacctcgagaagcaggagcgggaaaaggccgcgaattctctggaagcttttattttcgaaacacaggacaagctgtatcaaccagaataccaggaagttagcaccgaagagcagcgcgaggagataagcggcaaattaagtgctgcctccacatggctggaagacgaaggggtaggagccaccaccgttatgttaaaggagaagctcgctgagctccgcaaactctgtcagggactatttttcagggttgaggagcggaaaaagtggccagagcgactgagcgccttagataatctgctgaaccactcttcgatgttcttaaagggtgccaggctgatcccagaaatggatcagatttttactgaggtcgaaatgaccactctcgagaaggtgatcaacgaaacctgggcctggaagaatgcaaccctcgcagagcaggcaaagcttcccgccaccgagaagcctgttttgctctcaaaggatatcgaagcaaaaatgatggcgctggatagggaagttcaatacctgctgaataaggccaaattcacaaagccaaggccgcggccgaaagacaaaaatgggacgcgcgcggagcccccgctgaacgccagcgcctccgaccagggtgaaaaggtgattccacctgctggacaaacagaagacgccgagcccatctctgaacctgagaaggtggaaacgggatcagaacccggcgatacagagccccttgagttggggggccctggcgccgagccagaacagaaggaacagtccactgggcagaagcgtcccctgaaaaacgatgaactgtag

SEQ ID NO: 120394 - DNA, 2040 bp, Artificial Sequence
  Description of Artificial Sequence: Synthetic coding sequence
atggcagacaaagtacgacgccagcgcccaaggcgacgcgtgtgctgggccctggtcgcagtcctgctggctgatctgctcgccctttccgacactttagcagtgatgagtgtcgacctggggagcgaaagcatgaaggtggccattgtaaagccaggtgtgcccatggagatcgtgttgaataaggagagcagacgaaaaacgcctgtgatcgtgaccttaaaagagaacgaaaggtttttcggagactccgcagcctccatggcgattaagaacccgaaagcaaccctgcggtattttcagcacctgctgggcaaacaggcagacaatcctcatgttgccctgtaccaagcacgcttccctgagcatgagctaacattcgacccccaacgccagactgtacacttccaaatcagtagccagctgcagttcagtcctgaggaggtgctcgggatggtgttaaactattcccgcagcctggccgaagacttcgctgagcagccaattaaggatgctgtgattacagtgcctgtgttctttaatcaggctgagcggcgcgcagttttgcaagccgctcgaatggctggcttaaaggttctccagctgatcaatgataacacagccaccgcgttgagttacggcgtgttcagacgaaaagacatcaacaccaccgcccagaacatcatgttctacgatatgggtagcggctccacagtgtgcaccatagtgacgtaccagatggtgaaaacaaaagaggccgggatgcagcctcagcttcaaatccggggggtgggattcgataggactcttggaggcttggagatggagctgagactgcgagagagactggccgggttattcaacgaacagagaaagggacaaagagccaaagacgttcgagaaaatccccgcgcaatggcgaagctgttacgtgaggctaatcgacttaagacagtcctctcagctaacgcagatcacatggcccagatcgaggggctgatggatgacgtggacttcaaggccaaggtgactcgggtggaatttgaagaactgtgcgctgacttgtttgagcgggttcctgggccagtgcagcaggcccttcaaagcgcagagatgtcgctcgatgagattgagcaggtgatactcgtgggtggcgccactcgtgtgcctagagttcaggaggtactgctgaaggccgtagggaaagaagagctgggtaagaatattaacgccgatgaagccgccgcgatgggcgctgtgtaccaggccgccgcgttatccaaagcttttaaggtaaagccctttgtggtgcgggacgctgtcgtgtatcccattctggttgagtttactcgcgaggtggaggaagagcctggtatccactcactgaagcataataagagagtactgttttcccgaatggggccatacccccagcgtaaggtgatcacctttaaccggtattcgcatgattttaattttcacatcaattacggagatctggggttccttggcccagaggatctgcgtgtgttcgggagtcaaaatctgacaactgttaagctgaaaggtgtgggcgattcctttaagaagtacccggactacgaatccaaaggaatcaaggctcacttcaacctagacgaaagcggggtgctgtctctggaccgggtagagagtgttttcgagacccttgtggaggactcagccgaggaggaaagtaccctgaccaaactcggtaacacaatatcatctctttttggagggggaaccacccctgatgcgaaagagaatggcactgatacggtgcaagaagaggaagaatccccggcggagggcagcaaagacgagcccggtgaacaggtggagttgaaggaagaggccgaagcacccgtggaggatggcagtcaacccccccctcccgaacccaagggtgatgccacccctgaaggggaaaaggccactgagaaggaaaatggcgacaagagtgaagcacagaagcctacttccgtctgccgagctagcgtgactaggtttgggttttag

SEQ ID NO: 120395 - DNA, 444 bp, Artificial Sequence
  Description of Artificial Sequence: Synthetic coding sequence
atggccgataaagttcgtcggcagaggcctagacgtagagtgtgttgggctctggtggccgtcctgctggccgacctgcttgccctgtccgacactctcgccgtgatgtccgttgaccttggcagcgaatcaatgaaggtcgcgatcgtaaagccgggagtcccaatggagatagtgcttaataaggagagccggcgaaagacgccagtgatagttacactgaaagaaaatgagcggttttttggagacagcgcggcttctatggcgatcaagaaccccaaggcaactttgaggtacttccagcacctcttgggcaagcaagctgataatccccacgttgctctgtatcaggctagattccccgagcatgagctcacattcgatccccagcgccagacagtgcactttcagatcagttcacagctgcagttttcgcccctctag

SEQ ID NO: 120396 - DNA, 1680 bp, Artificial Sequence
  Description of Artificial Sequence: Synthetic coding sequence
atggcgataaagaatccgaaagccacactaagatatttccaacatctgctcggcaagcaggccgataatccacatgttgccctgtatcaggccagattccctgaacacgagctgacattcgacccacagcggcagaccgtccatttccagataagtagccaacttcagttttcgcctgaggaagtgctggggatggtgcttaactactccagatctttggccgaagacttcgctgaacaacctattaaggacgctgtgatcactgtgccagtgttctttaaccaggcggagagaagggctgtgcttcaggctgcccggatggcaggcctgaaagtgttacagttaattaatgacaacacagcgacggctctctcttatggcgtcttcagaagaaaagacataaacactactgcgcagaatatcatgttttacgacatgggctcaggatctaccgtatgtaccatagttacctatcagatggtcaagacaaaggaagctggtatgcagcctcagctccagatacggggagtggggtttgacaggactttggggggtcttgagatggagctgcgactgcgagaaaggctagctggactgtttaacgagcagcgtaagggccagcgtgccaaagacgtgcgtgaaaaccccagggccatggcgaaactactccgggaagcaaaccggctcaaaactgttttatcagccaacgctgaccatatggcccaaatcgaagggttgatggatgatgttgactttaaggcgaaggtaacaagagtggagtttgaagaactgtgcgccgacctgttcgagcgggtccctgggccggtgcagcaggctctgcaatcggccgagatgtccttggacgagattgagcaggtaattctggtgggaggagcaacacgcgtcccccgggtccaggaagtcctgctgaaagctgttgggaaagaggaactcggaaaaaacattaacgcagatgaagccgctgccatgggtgctgtgtaccaggcagccgctctgagtaaagccttcaaggtgaagccgtttgttgtgagggacgcagtggtgtatcctattttggtcgaattcacccgagaggttgaggaggagccaggtattcatagtttgaaacataacaaacgcgtgctgttttcccgcatgggcccttatccccaacggaaggtgatcacttttaatagatatagtcacgatttcaacttccacatcaactatggcgatctggggttcctcgggccagaggacctgagggtatttggaagccagaatttgaccacagtgaagttgaaaggagtgggagattcgttcaagaagtatcccgattatgagtcaaaggggattaaggcccacttcaatctcgacgaatcaggcgtgcttagcctggacagagtcgagtcagtttttgaaacactggtggaagactcagctgaggaggagagcacactaacaaaactgggcaataccatttcatcactttttggtggggggacgacaccagatgctaaagaaaacggcaccgataccgtccaaatgctattcctctgccccgcaaggctaccgcaatccaagcaggccatagaccgattccacaccgcggtaacatgcatggagcctccatggggaaggcgttgtcgcgctaggccagcctggcgattgtgttcttag

SEQ ID NO: 120397 - DNA, 2943 bp, Artificial Sequence
  Description of Artificial Sequence: Synthetic coding sequence
atgtggcagtcccggggccccatgctattccacctcggactctgcgtgggcgctgcgggtatgatccgggaatggtttgtgccaattaggagggagaagggcagtcgactcatttgccccggcggtaccatggcggacaaggttagacgccagcgcccacgccgcagagtttgctgggctctggtagcagttcttctcgcggacctcctggctcttagcgacactctagccgtaatgtcagtcgacctcggaagcgaatcaatgaaagtggccatcgttaaacccggggtccccatggaaatcgtgctgaacaaagagagtagacgaaagacgcccgtgatcgttactctgaaagagaatgaaagattcttcggcgatagcgctgcttctatggccataaaaaatccgaaggccacacttcggtattttcagcatctgctgggcaaacaggcggataacccccatgtagccctgtaccaagcaagatttcccgaacacgagctgacctttgatccccagcgccagaccgtgcacttccagatttcatcccagctgcaattttctccagaggaggtgctcgggatggtgctgaattattccaggtccctggctgaggactttgccgaacagccgatcaaggatgcggtcataaccgttcccgttttctttaatcaggcggagcgaagagccgttctgcaggcggctaggatggccggattgaaagtcttgcagttgatcaacgacaataccgcaaccgccctttcctatggggtgtttcgtcggaaggacattaatactaccgcacaaaatattatgttttacgatatgggcagcggttcaaccgtctgcacaattgtgacttatcagatggtaaagaccaaggaggcaggcatgcaacctcagttacagatacggggcgtgggctttgatcgcactctcggtggactggaaatggaattgagactgcgagaacgcctggcaggcttgttcaatgagcaacgaaaggggcagagagcaaaggacgttagagaaaatccgagagctatggccaagctgctgcgggaggcaaaccgactcaaaacagttctcagtgcaaatgccgaccacatggcccagattgaggggctgatggatgatgtcgacttcaaagccaaagtgacccgcgtggaattcgaggaattatgcgccgatttgtttgagagagtgccaggccctgtgcagcaagcactgcagagcgctgaaatgtccctagatgagattgagcaggtaattttagtgggtggcgccacacgcgtgccccgggtccaagaagtcctccttaaagcggtaggaaaggaggagttagggaagaatattaacgctgacgaagctgcagccatgggggcagtttaccaagccgctgctctgagtaaggcatttaaggtgaagccattcgtcgtgagagacgcagttgtgtatcccatcctcgtggagtttacacgggaagtggaggaagagcctggaatccacagtctcaaacacaataaacgagtgctgttctcccgcatgggaccctatccgcagcgcaaggtcataacattcaaccggtactcgcacgatttcaactttcacattaattatggcgatctggggtttctcggaccagaagatctgcgcgtgttcgggtctcagaaccttactacagtcaagttgaagggtgtcggcgatagtttcaaaaagtaccccgactatgagagtaagggcatcaaggcacacttcaatctggacgagtccggcgtattgtctctggatcgcgtcgaaagtgtgtttgaaactctggttgaagacagtgcggaagaggagagcacactgacaaagcttgggaacaccatttctagcctctttggcgggggcacgacaccagacgcgaaggaaaatgggacagataccgtgcagaagccatccgagaaagccgaagcaggcccggagggcgtggcccctgctccagaaggagagaagaaacagaagcccgccaggaagaggaggatggtggaagaaataggggtagaacttgtggtcctcgatttacctgacctccctgaagacaagctggcacagtccgtacagaagctgcaagatcttactcttcgggacctcgagaaacaagagagagagaaggcagctaacagcttggaggcttttattttcgagacacaggataagctttaccagccagaataccaagaggtttccacggaagaacagagagaagagatctctggcaaactttctgctgcatcaacatggctggaagacgagggcgtaggggccacaaccgtgatgctgaaggagaagctcgctgaactgcgaaagttgtgtcagggcctcttctttcgcgttgaagagaggaagaagtggccagaaagattaagcgcgctggataacctgctcaatcatagcagcatgtttcttaagggtgctaggttgattcctgagatggatcaaatctttactgaagtagaaatgactactttggaaaaggttataaatgagacttgggcctggaaaaatgcgacgctggccgaacaagccaaattgcccgccactgagaagccggtcttactgtcgaaggacatagaggcaaagatgatggcccttgaccgggaggtgcagtatctcctgaacaaggccaagtttacgaagccacggcctagaccaaaagataagaacggaacacgggccgagcccccactgaatgcatccgcttcagaccagggagaaaaggtgattccgccagccggacagacagaggatgcggagcccatatccgaacctgagaaggtggaaacaggtagcgaaccaggggacacggagccactcgagctcggcggaccaggagccgaacctgaacagaaagaacagtccaccggccagaaaagacccctgaaaaacgatgaactttag

SEQ ID NO: 120398 - DNA, 333 bp, Artificial Sequence
  Description of Artificial Sequence: Synthetic coding sequence
atggctcccaggggttgcatcgtggccgtcttcgctatattttgcatttcacggctgctgtgtagccacggcgcacccgtggcccccatgactccgtacctaatgctatgccagccgcacaaaagatgcggggataaattttatgatccccttcagcactgctgttacgacgacgcagtggtcccccttgccagaacacagacgtgcggaaactgtacctttcgggtctgttttgagcagtgctgtccgtggacattcatggtgaagctgattaaccaaaattgtgattcagcaagaacatctgacgaccgtctttgccggtctgtgagttag

SEQ ID NO: 120399 - DNA, 360 bp, Artificial Sequence
  Description of Artificial Sequence: Synthetic coding sequence
atggttcccaggatctttgctcccgcatacgtgtctgtgtgtcttttgctcctgtgtcctcgagaggttattgcacctgcaggttccgaaccctggttatgtcagcctgcaccaaggtgcggcgacaagatctacaatccactcgagcagtgctgctataacgacgccattgtctccctgtctgagacccggcagtgcgggcctccatgcactttttggccatgttttgagctttgttgcttagattcctttgggctgaccaatgacttcgtggtcaaactgaaagtccagggggtgaatagtcaatgtcacagcagtcccatttcatcgaagtgcgagtctaggagacgcttcccctag

SEQ ID NO: 120400 - DNA, 393 bp, Artificial Sequence
  Description of Artificial Sequence: Synthetic coding sequence
atgcgatttagcgtaagtggtatgcgaaccgactatccccgaagcgtgttagcaccggcctacgtgtctgtgtgcctgcttcttctgtgcccacgcgaagtgattgctcccgccggcagcgaaccctggctctgtcagccagcgcccaggtgcggagacaaaatttacaatcccctggaacagtgctgctacaacgatgccatcgtaagtctttcagagacgcggcaatgtggaccaccctgtacgttctggccctgtttcgagctgtgttgcctcgactcctttgggcttaccaacgactttgtggtcaaattgaaggtgcagggagtcaatagtcagtgtcactcctcaccaatctctagcaaatgcgaatccaggaggagattcccctag

SEQ ID NO: 120401 - DNA, 378 bp, Artificial Sequence
  Description of Artificial Sequence: Synthetic coding sequence
atgaggcctcgatgttgcatcttagccctcgtgtgctggataaccgtgtttctgttacagtgcagcaaaggtacgactgacgctccggtggggtccgggctttggctttgtcagcctactccacgctgtggaaacaagatctacaaccccagcgagcaatgctgctacgacgatgcgatattgagcctcaaagaaactaggaggtgcgggtccacttgcacattttggccatgctttgagctgtgttgtcctgagtcattcggaccccagcagaaattcctggtgaagttgagggtccttggcatgaaatctcagtgtcatctttctcctatctctagaagttgcactcgtaaccgaagacacgtgctgtacccttag

SEQ ID NO: 120402 - DNA, 375 bp, Artificial Sequence
  Description of Artificial Sequence: Synthetic coding sequence
atggttccgcgcatctccgccgctatttttatctttgagttgctcggctcaaacagtgaaggagtgacagatctccgcctgtggctttgccagccggctccacggtgtggagaatggacgtataaccctttggaacaatgttgcgacgacggagtgatccttgacctgaatcaaactcggctgtgcgggagcagttgtaccttttggccctgctttcagcactgttgcctggaaagtctgggctcccaaaaccagaccgtcgtgcggtttaaggtgccaggcatgaagcccgactgcaaaagttctccaatcacacgcatctgcgcgcaggaataccacccgaaatcgcccgtgtccaggagcgatctgatatag

SEQ ID NO: 120403 - DNA, 1068 bp, Artificial Sequence
  Description of Artificial Sequence: Synthetic coding sequence
atgggccccggacgctgcctgctgaccgcgctcctactgctggcactggctccaccacctgaggcatcacaatattgtggcagattagagtactggaatcctgacaacaaatgctgcagtagttgtctgcagcggtttgggccccccccatgcccagattatgaatttagggaaaactgcggtctcaacgaccacggcgactttgttacaccacccttccggaagtgttcctcaggccagtgcaaccctgatggagctgaactctgttccccctgcggtggcggtgccgtgacacccactcctgctgccgggggcggaaggaccccttggaggtgccgcgaaaggcccgttcccgccaaaggccattgccccctgactcccggcaatcccggagccccgagcagccaggaacggagttctcctgcatcctccatcgcatggcgaaccccagaaccagtcccccaacaagcctggccaaacttcttgcccttggtggtgttggttctactgcttactttggcagtgatcgctattcttctctttattctgctgtggcatctgtgctggccaaaggagaaagctgacccctacccatatccaggactcgtttgtggagttcccaatacacacacaccatcttcttcccatctgagctcacccggcgcgctggaaacgggggatacatggaaggaagcatccctgctgcccctgctgtcacgggagcttagcagcctggcatcccagcctctgtctcgtttgttggacgaactcgaggtccttgaagaactgattgtgctgctcgatcctgagccaggacctggtggcggtatggctcatggcaccactagacaccttgccgcacgttacggcttaccggcagcctggagcactttcgcctactccctgcggccgtcacgttcccccttacgagcacttatcgagatggttgtcgccagagagccgtccgcttctctaggccaactgggaacccacctggcccagctgggtcgtgccgacgctttgcgggttttgagtaagcttgggtctagtggcgtgtgctgggcttag

SEQ ID NO: 120404 - DNA, 504 bp, Artificial Sequence
  Description of Artificial Sequence: Synthetic coding sequence
atggggccaggacgatgcttgcttacagccctgctgctgttagctctagccccacctccagaggcatctcagtactgcggaagattggagtattggaacccagataataagtgttgcagctcttgtttacaaagattcggccctccgccttgtcctgaactgagttccttggcttcacaaccactgtcgcggcttcttgacgaactcgaggtcctggaggagttgatcgttctgctcgacccggagcccgggccaggaggggggatggcccatggaacaaccaggcacctggccgctcgctacggcctgcccgcagcctggtcaaccttcgcttatagcttacggccctcgcggtcccccctcagggctctgattgagatggtggtggctcgtgaaccatctgcaagtctcgggcaactgggtacccatctggcccagttgggccgggcagacgctctcagagtactttcaaagctcggatcatcaggcgtgtgttgggcttag

SEQ ID NO: 120405 - DNA, 723 bp, Artificial Sequence
  Description of Artificial Sequence: Synthetic coding sequence
atgccagaacgcgactctgagcccttctccaatcctctggcgcctgacggccacgacgtggacgacccccacagtttccaccagtctaagctcacaaatgaggacttccggaagctcctgatgaccccgagggcagcaccaacgtcggcgcccccgagcaaatccaggcatcacgagatgccccgcgagtacaatgaggacgaagacccggctgctcgacgtaggaagaagaagtcgtattacgctaagctgcggcagcaggagatcgaacgagagcgagagctagctgagaagtatcgtgatcgggccaaggagcggagggatggagtcaataaggattacgaagaaaccgaattaatctccaccacagccaactatagggctgtgggccctactgctgaagccgataaatcggccgctgagaaaagaaggcaattgattcaggagtccaagtttctcggcggcgacatggaacatacgcacctggtgaaaggactggatttcgcactgctgcagaaagtgcgcgctgaaatcgcaagtaaagagaaagaagaagaagaactgatggagaagccgcagaaagagacaaagaaagatgaggatccagaaaacaagatcgaattcaagacaaggctcgggcgtaacgtttatagaatgctatttaagtccaaggcttacgagcgaaacgaactattcttgccaggaagaatggctatgtggtag

SEQ ID NO: 120406 - DNA, 1674 bp, Artificial Sequence
  Description of Artificial Sequence: Synthetic coding sequence
atgccagagagagatagcgagcctttctccaatcccctggcacccgatgggcacgatgtggatgaccctcactcttttcaccaaagtaagcttaccaacgaggactttcgaaaactgctgatgaccccaagagcggcacccacttctgcaccccccagcaagtctcgccatcacgagatgcccagggagtataatgaagacgaggaccctgccgctcggcgtcgaaagaaaaagagctactatgcaaaactgaggcagcaggaaatcgagcgggagagggagctggccgagaaatatcgcgaccgcgcaaaagaacggagagacggagttaataaggactatgaagagaccgagctgatcagcacaaccgcgaattacagagccgtgggtcccacagccgaggcagacaagtcagccgccgaaaagagaagacagctgatccaggagtctaaattcctgggaggagatatggaacacacgcaccttgtaaaagggttagattttgccctcctccaaaaggtgagagctgaaatcgcaagtaaagagaaggaggaggaggagttgatggaaaaaccccagaaagagaccaagaaggacgaagatccagagaataagattgagtttaaaactagactgggcagaaatgtctaccgcatgctctttaaatccaaagcatacgagcggaacgaactcttcttgccaggacgcatggcttacgtggttgacctggatgatgaatacgcagacacagatatcccgacgaccctcatccgcagcaaagcggactgtcccactatggaggcacaaactacactcacaacaaatgacatcgtgatctccaagttaacgcagatactgagctacctgcgccagggcacacgtaacaaaaaattgaaaaagaaggataagggcaagctggaggaaaaaaaaccacctgaggctgacatgaacatcttcgaagatatcggggactacgtcccctccaccactaaaacgccacgcgataaagagcgcgagaggtaccgggaaagagagagagaccgcgagcgtgacagggatcgcgacagggagcgcgagagagaacgggatcgggagagggaaagagagcgagatcgagagagggaagaggagaaaaagcggcactcttatttcgaaaaacccaaggtggatgatgaacccatggatgtggacaaaggtccgggcagcactaaggaactcattaagtcaatcaatgaaaagtttgccggctccgcagggtgggaaggtaccgagtcactgaaaaaacctgaggataaaaaacagcttggcgactttttcggcatgagcaattcttatgctgagtgttaccccgccacgatggatgacatggcagttgactctgacgaggaagtagattactccaaaatggaccaaggaaataaaaaaggcccgctaggaaggtgggatttcgatactcaggaagaatactcggaatatatgaataacaaggaggctctgcccaaggccgccttccagtatggcattaaaatgagcgagggtcgaaagacgaggcgattcaaggaaaccaatgataaagccgagcttgaccgccagtggaaaaaaatctcagctatcattgaaaaaaggaagaagatggaggcagacggcgttgaggtgaagaggcccaagtactag

SEQ ID NO: 120407 - DNA, 1560 bp, Artificial Sequence
  Description of Artificial Sequence: Synthetic coding sequence
atggatgctgacgaaggccaggatatgtctcaggtgagtggaaaggaatccccaccagtctccgatacaccagacgaaggcgacgaaccgatgcccattcccgaggacctgagcaccacttccggcggccaacagtctagcaaatctgatagagtggtggcatccaacgttaaggtggagactcaatccgacgaagagaacggtcgcgcctgtgaaatgaatggtgaggagtgcgccgaagacctcaggatgctggacgcatctggcgaaaagatgaacggctcccacagagaccagggtagttctgcccttagcggtgtcggggggattcgcttgcccaacggaaagttgaagtgtgacatctgtgggataatatgcattggccctaacgtattgatggtgcataagaggagtcatacaggagagaggccctttcaatgtaaccaatgtggggcatctttcactcagaagggaaacctgctgaggcacatcaaattacactccggagagaagccatttaaatgccacctgtgtaactatgcttgtcgaagacgggacgcattaacaggacatctcagaacgcattctgtcgggaagccacacaagtgtggatattgtggccgatcgtacaagcaacggtcatccctcgaggagcacaaagagcgttgtcacaattatctcgagtctatgggcctgccagggaccctgtatcctgtaataaaagaggaaaccaaccacagcgaaatggcggaggatctatgtaaaatcggctctgagaggtcactggttttagataggctcgcctcaaacgtcgccaaacgaaagagcagcatgccacagaaatttctcggggataaggggctttctgacacaccctacgatagctctgcgtcttatgaaaaggagaatgaaatgatgaagtcacatgtcatggatcaggcgatcaacaatgctatcaattatctaggcgccgagtcactgaggccacttgtgcaaactcctcctggcggctccgaagtggttccagtgatttctcccatgtaccagcttcacaaacccctcgcagagggaacaccacggtctaaccactcagctcaggacagcgctgtggagaatctccttctgctgtcaaaagccaagctggtgccttctgagagggaagcctcaccctctaactcatgtcaagactcgacagatacagagagtaataatgaggagcagagatcaggtcttatctacctgacaaaccacattgcgccgcatgcccggaacggactatctctcaaagaagaacatagggcgtatgacctccttcgcgctgcttctgagaacagccaggatgccctgcgcgtagtatctactagcggcgagcaaatgaaggtgtacaagtgcgaacactgccgggtgctctttctggaccacgtgatgtacaccattcacatgggttgtcacggatttagggacccttttgagtgtaacatgtgtggttatcactcgcaagaccggtatgagttctcttcacacatcaccagaggcgagcaccgatttcatatgagttag

SEQ ID NO: 120408 - DNA, 1299 bp, Artificial Sequence
  Description of Artificial Sequence: Synthetic coding sequence
atggacgcagacgagggacaggacatgagtcaggtgtccggcaaggaaagccccccggtatctgacactccagatgaaggcgatgagccaatgccgatccccgaagatttgtccacaacgtccggcgggcagcagtcgagcaagagcgatcgcgtggtgggggagaggcccttccagtgtaatcagtgtggggctagtttcacacaaaagggcaatctgttgagacacataaaacttcacagcggcgaaaaaccgttcaagtgccacctgtgtaattacgcatgtaggcgacgagatgctctcacaggccacctcagaacccatagcgtggggaaaccccacaaatgtggctactgcggacggagttataaacaaagatccagcctggaggaacacaaggaacggtgtcacaattacctagagtcaatgggcctgcctggcactttgtatccagtcattaaagaggagaccaatcatagcgagatggctgaggatctgtgcaaaataggcagcgaaaggtccttggtgctcgatagattagcttccaatgtggcgaagcggaaatcctccatgccacagaagtttctcggtgacaagggtctcagtgataccccatacgatagctcagccagctatgaaaaggaaaatgagatgatgaaatcccatgttatggatcaagccattaacaacgcaattaattatctgggtgcagagtctttgagaccactggtccagactccccctggggggtccgaagttgtaccggttatcagccctatgtaccagttacacaaaccactggctgaggggacacccaggagtaaccacagcgcacaggacagcgcagtcgagaatttgttactgctcagtaaagctaaactggttccatctgaaagggaggcatccccatctaactcttgccaggatagcaccgataccgaaagcaacaacgaggagcaacgctctggtctcatctacctgactaatcacattgcaccccacgctcgaaacggcctgtctctaaaagaggagcacagggcttacgaccttctgcgcgctgcctctgaaaattctcaagatgccttgcgtgtggtgtctacctctggagaacagatgaaagtttacaagtgtgagcattgccgcgtgctatttctggaccacgtgatgtacacaattcacatgggctgtcatggttttcgggatccatttgagtgtaacatgtgcggataccattcccaggataggtatgagttttcatcacacatcactagaggggagcaccgtttccatatgagttag

SEQ ID NO: 120409 - DNA, 870 bp, Artificial Sequence
  Description of Artificial Sequence: Synthetic coding sequence
atggatgcagacgagggtcaggacatgtcgcaagtgagcggcaaagaaagcccacccgtctcagacactcccgatgaaggcgacgagcctatgccaatccctgaagatcttagtactacctcaggcggtcaacagagctctaaaagcgaccgcgtggttggagacaaaggcctttctgataccccgtacgatagctcggcttcttacgaaaaggagaacgagatgatgaaatctcacgtcatggaccaagccattaacaacgcaattaactaccttggggcggaaagcttgaggcccctggtacagacgcctccaggcggctccgaggtagtcccggtaatctcgcctatgtaccaactccacaaacctctagccgaaggcactcctagaagcaatcacagtgcccaggattccgcagtggagaaccttcttctgctctctaaggcaaaattagtccccagcgaaagagaagccagcccgagcaatagttgccaagactcaaccgacaccgaatccaataatgaagagcaaagaagtggcctgatctaccttacaaaccacatagcccctcacgcacggaacggactgagcctcaaagaggagcacagggcttatgatttgttaagggccgctagtgaaaactcccaggatgccctgcgggtcgtcagcacaagcggcgagcagatgaaagtctacaagtgtgaacactgccgtgtcttattcctggatcatgttatgtacacaattcacatggggtgccacggctttcgagatcctttcgaatgtaacatgtgtgggtaccattcccaggacagatacgagttttcctcccacattacccgaggggagcatagattccatatgtcttag

SEQ ID NO: 120410 - DNA, 1131 bp, Artificial Sequence
  Description of Artificial Sequence: Synthetic coding sequence
atggatgccgatgaaggccaggacatgtcccaggtctccggcaaagagagtcctcccgtgagtgatactcccgacgaaggagatgagcctatgcccatcccagaggatctgagcacgaccagtggcgggcagcaaagcagcaaatccgaccgcgtggtggcctccaatgtgaaggtggagacccaaagcgacgaggagaacggaagagcctgtgagatgaacggagaggaatgtgccgaagaccttcgcatgcttgacgcctcaggtgaaaaaatgaatggatctcaccgtgaccagggcagcagtgccctcagcggtgtgggcgggatccgactgcccaatggcaaactgaagtgcgacatatgtgggattatctgtatcggccccaatgtactcatggttcacaaacggtctcacactggggataaggggctgtcagacactccctacgacagtagtgcttcatacgagaaggaaaatgagatgatgaagagccacgtgatggatcaggctattaacaatgccatcaactacttaggggctgaatcattgaggcctcttgttcagactccccctggtggaagcgaagtagtgccagtcatcagtccaatgtatcagctgcataagcctcttgctgaaggaacccctcgctccaaccattcagcacaggacagcgcagtagagaatctcctactcctttccaaagctaagttggtccctagcgagcgcgaggcttcaccttcaaactcatgccaagatagcacggatactgagagcaacaatgaagagcagagatcgggacttatatatttgacaaaccatattgcccctcatgcccggaacggactctcactaaaggaagaacaccgcgcttatgatctgctcagagccgcctcagagaactcacaagacgcgctgagagtggtttccacctctggcgaacagatgaaagtatacaagtgcgagcactgcagggtgctttttctcgaccacgtcatgtacaccattcacatgggatgtcacggatttcgggaccctttcgagtgtaacatgtgtgggtatcacagccaagatagatatgagtttagctcacatatcacccgaggcgagcacaggtttcacatgtcgtag

SEQ ID NO: 120411 - DNA, 1299 bp, Artificial Sequence
  Description of Artificial Sequence: Synthetic coding sequence
atggacgccgacgaagggcaggatatgagccaagtctcaggtaaggaatcgccgcctgtgtcagacacacccgacgaaggggatgagcctatgccgataccagaagacctaagcaccacttcaggagggcagcagtcttccaagagcgatagagtggtggctagcaatgtcaaggtagagactcagtccgatgaagagaatggcagagcatgtgagatgaatggcgaggaatgcgctgaggacctacgcatgcttgatgcctctggcgagaagatgaacggatcgcatcgggatcaaggctcatctgctctttctggcgtgggcggaatcaggttgcctaacggcaagttaaagtgcgacatctgcggcattatatgcatcggtcctaatgtgctgatggtgcacaagcgctcacatacaggggaaaggccctttcagtgtaatcaatgtggggcatccttcacccagaaaggcaacctcctgcgccacatcaaactgcactccggtgagaagccctttaagtgtcacttatgcaattacgcctgccgccggcgcgacgcactgactggccaccttaggacacacagcggcgataagggactttccgatacaccttatgactcatcagcaagttatgagaaagagaacgagatgatgaagagccatgtgatggatcaggcaatcaacaacgccatcaattacttgggagccgagtccttacgccccttagtacagacaccacctggcggcagcgaggttgtgccggtgataagcccgatgtaccaactgcataagcccctggccgaaggaacaccccggagcaaccattcagcacaggatagcgccgtggaaaacctgctcctgctgtctaaggcaaagctagttccgagcgaaagggaagcatctcctagcaattcatgccaagattccacagacacggaaagcaataatgaagagcaacgcagcggactgatctacttaaccaaccatatcgccccacatgcccgaaacggcctgagtctgaaagaagaacacagggcatacgacctgttgcgcgccgccagcgagaatagccaagatgcactgcgtgtagtctcgacgtctggggaacagatgaaggtctataagtgcgaacattgtcgggtgcttttcttggatcatgtgatgtacacgattcacatgggatgtcacggctttcgggatccatttgagtgtaatatgtgcggataccactcgcaggacaggtatgaattttcctcccacatcacaagaggcgaacataggttccacatgtcttag

SEQ ID NO: 120412 - DNA, 1434 bp, Artificial Sequence
  Description of Artificial Sequence: Synthetic coding sequence
atggatgcggatgagggccaggatatgagccaggtctccggaaaggaaagcccacccgtctccgacacccctgatgagggtgatgaacccatgcccatacccgaagatctgtctactacaagcgggggacagcagtctagtaagtcggatagagtcgtcgcgtctaatgttaaagtggaaacccagagtgatgaagagaatggacgcgcgtgcgagatgaacggtgaagaatgtgcagaggatctgcgcatgcttgatgcctctggtgaaaaaatgaacggatcccaccgggaccagggctcttcggccctatcaggtgtaggcggtatcaggcttccgaatgggaagttgaagtgcgacatatgtgggattatttgtatcggaccaaatgtcctgatggtgcacaaaagaagccataccggggaaagaccattccagtgtaaccaatgcggcgcctcctttactcagaaaggcaacctactgagacacataaaattacacagtggcgagaaaccctttaagtgccatctctgtaattacgcctgcaggcgtagagacgctctgaccgggcacctgagaacccatagcgtcataaaagaggagactaaccattccgaaatggccgaggatttatgcaagattggatcggaaagaagcttagtcctcgatagattggcaagcaacgttgccaagcgcaagtcatcaatgcctcagaagtttctcggggacaaaggactgagtgacaccccttacgattcttcagcctcctacgaaaaagaaaacgagatgatgaagtcccacgtcatggaccaagcgataaacaacgccatcaattacctgggcgccgaaagcctccggcctctggtccaaacgcctcccgggggaagtgaagtggtccctgttatctcccctatgtatcagctacataagccgctggctgaggggactcctagatccaatcactccgcccaagactcggccgtagaaaacctcctccttctgtcgaaagccaaactagttccctctgagcgcgaggctagccctagtaatagttgccaagacagcactgacactgagtcgaacaacgaagagcagcgatcaggactaatctatctgaccaatcacatagccccacatgctcgtaacggtctgtccctcaaggaggagcaccgcgcttatgacctactcagagccgctagcgagaattcccaggacgccctccgtgtggtgagtacttccggcgaacaaatgaaagtctacaaatgcgaacattgccgcgttctatttctggaccatgtgatgtatactatccacatgggctgtcatggcttccgtgacccctttgagtgcaatatgtgcggctatcactcacaggaccgctacgaattctcctctcacattaccagaggggaacatagattccatatgtcttag

SEQ ID NO: 120413 - DNA, 1299 bp, Artificial Sequence
  Description of Artificial Sequence: Synthetic coding sequence
atggacgccgacgaaggacaagacatgtcccaggtatctggtaaggagagccctccagtgagcgacactccggatgagggggatgaaccaatgcctatacctgaggacctttccaccacgtcaggaggacaacagtcgtctaagagcgatcgagtggttggcgaacgcccctttcagtgtaaccagtgtggggcctccttcacacagaagggtaacctgctgagacacattaaactccactccggggaaaagccattcaaatgccatctgtgtaattatgcctgtagacgtcgagacgctctcaccgggcacctgcggacgcattccgtgggcaagcctcacaaatgtggatattgcggacgaagctataaacagcgctcttctctggaagagcacaaagaacgctgtcacaactaccttgagtctatgggtctcccagggacgctgtacccggttatcaaggaagaaaccaaccattcagagatggcggaagacctgtgtaaaatcggatccgagcgaagtcttgtgcttgaccgcctggccagcaacgttgctaagaggaagtcgtccatgccccaaaaattcctcggcgataaggggctgtccgacaccccatatgactctagcgcatcttatgagaaggagaacgagatgatgaaatcacacgtgatggatcaggcaatcaacaatgcgatcaactacttgggagcggaatctctgagacccctagtccagacacctcctgggggaagcgaggtagttcccgtcatttcccctatgtaccaacttcataagccacttgctgaggggacaccccgctccaaccactctgcacaggacagcgccgtggagaacctactacttctgtcaaaggctaagctggtgccctccgagcgggaggctagcccaagtaactcatgtcaggatagcacggataccgagtcaaacaatgaagagcagagatccggcctcatctatctgacgaaccacatagcaccacacgctaggaacggactctccctaaaagaggaacaccgagcttacgatctcctccgagccgcttccgaaaatagccaagatgctctaagggtagtgagcacatctggggaacaaatgaaagtgtataagtgcgaacactgccgagttctgtttcttgaccatgttatgtatactattcacatgggctgtcacggattccgggaccctttcgaatgtaacatgtgcgggtatcactcacaggaccggtacgaattcagttctcacattactaggggcgaacacagattccatatgtcatag

SEQ ID NO: 120414 - DNA, 1434 bp, Artificial Sequence
  Description of Artificial Sequence: Synthetic coding sequence
atggacgccgatgagggccaggatatgagtcaagtgagcggtaaagagtcccctcccgttagcgacaccccggatgagggagatgagcctatgccaattccggaagacttgtccactacttccgggggacaacagagttcaaagtccgatcgggtagtcgcctccaacgtgaaagtggaaacccagagcgatgaggaaaacggacgtgcctgcgagatgaatggagaggagtgcgctgaagatctccgaatgttggacgcatcgggagagaaaatgaatggtagccatcgggaccagggtagctctgccctcagcggagtaggtgggataaggctccctaacgggaagttgaagtgcgatatatgtggtattatttgtatcgggcctaacgttcttatggttcataaaagatctcatacaggagaaaggccttttcagtgcaaccaatgcggagcgagttttactcagaaggggaatctcctgcgtcacataaagctgcattccggggagaaaccatttaaatgtcatctgtgtaattatgcatgcagaagaagagacgccctgaccggacacctgagaacccattcagtaatcaaggaggaaaccaaccacagcgaaatggcagaagacttatgtaaaattggcagcgagcgaagcctagttcttgacagactcgcaagcaatgtcgctaagagaaaatctagcatgcctcagaagttcctgggagacaagggcctgagcgatactccctacgatagctccgcctcctacgagaaagaaaacgagatgatgaagagccacgtcatggatcaggccatcaataacgccataaactatttaggcgcagagagcctgagacctctcgtgcaaaccccccctggcgggagtgaggtcgttccagtcattagccctatgtatcagctccataagccactggcagaggggacaccacgttctaaccatagcgctcaggatagcgccgtggaaaatcttcttttactgtcaaaggcaaagcttgtccctagcgagcgggaggcgtcccccagtaattcctgccaggacagcactgacaccgagagcaacaatgaagaacagcgctctgggctgatctatcttactaaccatattgccccccatgcccggaatggtcttagcctcaaagaggaacaccgggcttacgatctcctgcgtgctgcatctgaaaatagtcaggacgcgctgcgggtggtgtcaaccagcggagagcagatgaaagtctacaagtgtgaacattgccgggtcttgtttctcgaccacgttatgtacactattcacatgggatgccacggatttcgtgacccttttgaatgcaatatgtgcgggtaccacagtcaggacaggtacgagttctcctctcacatcactcggggagagcatagattccatatgagctag

SEQ ID NO: 120415 - DNA, 681 bp, Artificial Sequence
  Description of Artificial Sequence: Synthetic coding sequence
atggacgccgatgagggccaagacatgtcccaggtgtccgggaaggaaagcccacctgtctccgacacaccagacgagggtgatgaacctatgcctatccccgaagacctaagtactaccagtggagggcagcagagttccaaatcggatcgtgttgtggcgagtaatgtaaaagtcgaaacccagagtgacgaagagaatgggcgggcctgcgaaatgaatggcgaggagtgtgctgaagacctgcggatgctcgacgctagtggtgagaaaatgaatggatcccatcgcgatcagggcagtagtgccctaagcggggtcggagggatccgactaccaaatggcaagctgaagtgcgatatttgtggtatcatctgtatcgggccaaacgtactgatggtccacaagagatcccataccggcgaacggcctttccagtgtaatcagtgcggcgccagcttcacccagaaagggaatctgttgagacacatcaagcttcattctggcgagaaaccattcaaatgtcatctttgtaactatgcctgcaggaggcgagatgcgctaacggggcacctgcgaactcactccgtgattaaggaagaaactaaccattctgaaatggccgaggatctgtgtaagatcggtagtgagatctctcgagcaggccagacctcaaaatag

SEQ ID NO: 120416 - DNA, 1758 bp, Artificial Sequence
  Description of Artificial Sequence: Synthetic coding sequence
atgcacactccgcccgcgctcccgagaaggtttcagggaggcggcagagtccgtacccccggttctcaccggcaagggaaggacaacctggagcgagacccaagtggaggctgtgtccctgacttcctcccacaggcccaggactcgaaccatttcatcatggaaagcttgttttgtgagagttccggagatagttcccttgaaaaagagttccttggagccccggtggggccatccgtgtccacgccaaactcacagcattcatcgccttctaggagtctgtcagcaaatagcatcaaagtggagatgtactccgatgaagaaagttctcggttattaggccccgatgagaggttgctcgagaaagacgattctgtgatcgtggaagatagcttatccgaacccctgggttattgtgatggttcaggtcccgagcctcactcccccggcggcattcgactgcccaatggcaaacttaagtgcgacgtttgcggaatggtttgtataggtcccaacgtactcatggttcataagagatctcataccggggagaggccttttcactgcaatcagtgtggagccagcttcacacagaagggaaatctccttaggcatataaagttgcactcaggagagaagcctttcaaatgtcctttttgcaattatgcatgtcggagaagggacgccctcacgggacacctcagaacacacagtgtttcatctcccacggtggggaaaccctataagtgtaactattgtggcagaagttacaaacaacaatcgactctggaggaacacaaagaaaggtgtcacaattacctgcagtcgctgtccacagaggctcaggcgctcgcaggtcagcctggagatgaaatccgagacctggagatggtgcccgattccatgctccactcatcctcagagcggcctacctttatcgaccggctggcgaattctctgaccaagagaaaacgctctactccgcagaagttcgtgggggagaaacaaatgcggttctccttaagtgatctgccttatgacgttaatagtgggggctatgaaaaggacgtggaattggtggcgcatcatagcctagaacccggatttgggagtagtctggccttcgtgggcgcagagcaccttcgcccgttgcggctgccacctaccaattgcatttccgagctcacaccagtaatttcctccgtgtacacacagatgcagcccctgcccggcaggttggagttgcctggctccagggaagccggagaaggaccagaggatttggcagacggcggaccgctcctttacaggccaagaggtcccttaacagatccaggggcaagcccatcaaatggctgccaagactctacagacaccgaatcaaaccatgaggacagggtagccggggttgtgagcctgccccaaggaccgcctccacagcctccaccgacaatcgtcgttggacggcatagccccgcttacgcaaaagaggatccaaagccacaggaaggtttgctccgcgggactcctgggcctagcaaagaggtgttgcgggtggtgggcgagagcggcgaaccggttaaggcattcaaatgtgaacactgccgaatcctctttctggaccatgtcatgtttacgatccacatgggctgccacggcttccgtgacccctttgaatgtaacatttgtggctaccatagccaggatagatatgagttctctagccacattgtccggggcgagcataaagtgggctag

SEQ ID NO: 120417 - DNA, 1452 bp, Artificial Sequence
  Description of Artificial Sequence: Synthetic coding sequence
atgtactcggatgaggaatcatctcggctattaggacctgacgaacggctacttgagaaagatgattctgtaatcgtcgaagactctctttccgaaccgctcggatattgtgatggttccggcccggaacctcactcccctgggggcattaggctgcccaatggcaagctaaagtgtgacgtatgcggaatggtttgcatcggacctaatgtgcttatggttcacaagaggtcccatacaggagagaggcccttccactgtaaccagtgcggggctagtttcacccagaaaggaaatttactgcgccatattaagctgcatagcggagaaaagccttttaaatgtcctttctgtaattatgcatgtcgccgaagagatgccctgaccggacacctcagaacccacagcgtgtcatctccaaccgtcgggaaaccatataagtgtaactactgtggccggagctacaaacagcagtcgaccctggaggagcacaaggagcggtgtcataattacctacagtccctctcaaccgaggcacaggccctcgccggacagcccggggacgaaattagggatctagagatggtacccgacagcatgctccactcatcttcggagaggcctacattcattgatcgactagctaattccctgactaaacgcaagcgaagtaccccccaaaagttcgtaggggagaaacagatgagattctcgctctctgacctcccttacgatgttaactcaggaggctacgagaaggatgtggagctggttgctcaccattctttggaacctggattcggttcctccctggcctttgtcggagcggagcacctgagaccactcaggcttccccccaccaattgcataagtgaactaacccctgtgatctcgtcagtctatacccaaatgcaacccctgccaggtcgcctggaactgcccggctctcgtgaggccggagaaggcccggaggaccttgcagatgggggacctttactctatcggccacgaggcccactcaccgaccccggcgcaagcccgagcaatggctgccaggatagtaccgatactgagagtaaccatgaggaccgcgtggccggcgtcgtgagcttgcctcaaggacctcctccacaaccccccccaacaatcgtggtgggtcgtcactcgccggcatacgccaaagaggaccccaaacctcaagaagggctgcttcgtggaacaccaggtccatcgaaggaggtgctcagagttgtgggggagtccggtgaacccgtgaaagcatttaagtgcgagcattgccgcatactgttcctggatcatgtgatgttcacaattcatatggggtgccatggttttagggatccattcgagtgtaacatttgcggatatcacagtcaagaccggtacgagttcagctcgcatatcgtgagaggagaacacaaagtggggtag

SEQ ID NO: 120418 - DNA, 1758 bp, Artificial Sequence
  Description of Artificial Sequence: Synthetic coding sequence
atgcacacaccccccgcccttcctaggagattccagggagggggacgcgttagaacacctgggtcccatcggcagggcaaggataacctagagcgcgacccaagcggaggttgtgtgccagatttcctgccccaggctcaggatagcaaccacttcatcatggaaagtctgttttgcgagtcatccggcgacagctcattagagaaggaatttctgggggcccccgtaggcccaagcgttagcacacctaacagccagcattcctctccaagcagaagtttgagcgcaaacagcattaaggtcgaaatgtactctgacgaagaatcctcccggcttctcgggcccgacgaaaggctactcgagaaggatgattctgtcatagtggaagattctctttctgaacctcttgggtattgtgatgggagcggacctgagccccacagccctggcggtatccgactcccgaacgggaaactgaagtgcgacgtgtgtggcatggtatgcattggccccaatgtgcttatggtacacaaaagatcgcacaccggcgagcgcccctttcattgcaatcaatgtggtgcatcatttacccagaagggaaacctcttgaggcacatcaagctccactcaggggaaaagccattcaagtgtcccttttgtaattacgcatgtcggcgtagggacgctttaaccggccacttgaggacccactcagtgtcatcccccactgtgggtaaaccatacaagtgtaattattgcgggcggagctacaagcagcagtcaacactcgaggaacacaaggagcgttgtcacaactacctgcagtcacttagcacggaagcccaagctctggctgggcagccgggggacgagattcgcgatctggagatggtgcccgatagcatgctacactcaagctctgagagacccacatttatcgacaggctcgccaactccctaacaaagagaaagcggagcactccgcaaaagttcgtcggggaaaaacagatgcggttctccctgtccgatttgccgtacgatgtgaatagcggcgggtacgagaaagatgtggaactcgttgctcatcactctttggagccaggtttcggatcctcattagccttcgtgggggccgagcacctgcgcccacttcggctgccgcccacgaattgtatctctgaactgacacccgtgatctccagcgtgtatacccaaatgcagccgcttccaggacggctggagttacccggctcccgagaggcaggggagggacctgaagaccttgcggatggaggaccactgctgtataggccacgcgggcctctgactgacccgggcgcctcccctagtaacgggtgtcaggattcaaccgacactgaatcaaatcacgaggaccgggtggccggtgtggtgtctctgccccagggtccgcctccgcagccacctccaacgatcgtggtaggcagacactcccccgcctatgcaaaagaagaccctaagccccaagagggattgcttcggggcacccccggcccatccaaagaagtgctgcgagtcgtgggtgagagcggagaacccgtaaaagctttcaagtgtgaacactgccggatactctttctggaccacgtcatgttcactatccacatgggctgtcacggcttccgagacccttttgaatgcaacatttgtggctatcacagtcaggacagatatgagtttagttctcatatcgtgcggggcgaacacaaagtgggctag

SEQ ID NO: 120419 - DNA, 33 bp, Artificial Sequence
  Description of Artificial Sequence: Synthetic coding sequence
atgcacacccctccagccctgccgcggaggtag

SEQ ID NO: 120420 - DNA, 1863 bp, Artificial Sequence
  Description of Artificial Sequence: Synthetic coding sequence
atgaacaacttcatcctcctggaagaacagctcattaagaaatcacagcaaaagagaaggactagcccatccaacttcaaggtccggttcttcgtactgacaaaagcaagcctggcctatttcgaagatcgacacgggaaaaaaagaactctgaaggggtccattgagctctcgcgcatcaagtgcgtggaaatcgtaaagtccgatatctccattccgtgtcattacaaatacccgtttcaggttgtgcacgacaactacctactctatgtgtttgcccccgatcgtgagagcagacaacggtgggtgcttgccctcaaggaagaaactcgcaataacaattctctagtgcccaagtaccacccaaatttctggatggacggcaagtggcggtgttgttctcaattagagaaactggcaaccggttgcgcccagtacgatcccactaaaaacgcaagcaaaaagccactgcctccaaccccagaagataacaggagaccactttgggaaccagaagaaactgtggtcatcgccctgtatgattaccagactaacgatccgcaggagttggccctgcggcgcaacgaagagtattgtctcctcgactcctctgagatccactggtggcgggtgcaggatcgtaatggccatgagggatacgtgccatcctcctacctggtggaaaagtcacccaacaacctcgagacttatgaatggtataacaagtccatttcacgtgataaagccgagaaactccttctggacaccggaaaggagggcgcgttcatggtgagggacagtagaaccgccggaacctatacagtttctgtgttcactaaagccgtcgtgtcagaaaataatccctgcatcaagcactaccatatcaaagagaccaacgataacccaaagcgctactacgtggccgagaagtatgtgttcgattctatacctctcttgattaattatcatcaacacaacggtggagggctggttaccaggctgcgctaccccgtatgcttcggaagacagaaagcccccgtgacagcgggtcttcgctacgggaagtgggtgatcgatccatctgagctgacttttgtccaggaaattggatctggccagtttgggctggtacatctaggttactggctgaacaaggataaggtggcgataaaaacaattagggaaggagctatgagcgaggaagactttatagaagaggccgaggtaatgatgaaactgagtcacccaaaactcgtacaactgtatggagtatgtctggaacaagcgcctatctgtttggtttttgagttcatggagcatgggtgtctgagtgactatctgcgaacccagagggggcttttcgcggccgaaacattactcggcatgtgcctggacgtgtgtgaagggatggcttatctggaggaagcatgtgtgatccacagggatctggcagctcggaattgtctggtgggcgaaaaccaggtcatcaaggtttccgacttcggaatgacacggtttgttttggatgatcagtatacgagctccacaggaaccaaattccccgtcaagtgggcctcccccgaggtgttctctttctctagatattcttccaaatccgatgtctggagcttcggagtcctaatgtgggaggtgttcagcgagggaaaaatcccctacgagaaccgctccaatagcgaagtggttgaggacatttctacagggtttcggttatataaaccacgtctggcgtccacacatgtgtatcagatcatgaatcattgttggaaagagaggccagaggacaggcccgccttcagtcgactactccggcagttggcagaaatcgccgaatccggcctctag

SEQ ID NO: 120421 - DNA, 1899 bp, Artificial Sequence
  Description of Artificial Sequence: Synthetic coding sequence
atggagacaccagccgccgctgcccccgccgggtctttgtttcctagctttctgctgctcgcctgcggcacactggtggcagccttgctgggcgcagctcatagattaggactgttttatcagcttttacataaagtcgacaaggcgtctgtccggcacggtggggagaatgtggccgccgtgctgagggcccacggggtacgcttcatcttcacactggtgggcgggcacatctccccgctgttggttgcttgcgagaaacttggaattagggttgtggacacccgccacgaggtaaccgctgttttcgccgctgatgccatggctcgactgtccggcacagtgggcgttgctgcagtgaccgctggacccggcctgacgaatacagtcacggccgtgaagaatgctcagatggcccaaagcccgattttattattagggggtgccgcgagcaccctgctgcagaaccgtggggccttacaggccgtagatcagctaagccttttccgaccactgtgcaagttctgtgtgtccgtccggcgagtgcgggatattgtacctactctgagagctgccatggccgctgcacagtcaggtacaccagggccagtcttcgttgagctcccagtggacgtgctgtatccttatttcatggtccaaaaagagatggtacctgcaaagccaccgaaaggcctggtgggtagggtggtgtcctggtacctggagaattacctcgccaatttatttgcaggtgcttgggaaccccagcccgagggacccctgccactcgatataccgcaggcaagccctcagcaggtacaaagatgtgtagagatcctttccagagccaaaaggcccctcatggttctgggctcccaggctctcttaacccccacatctgcggataagttgagagccgccgttgaaaccctgggcgtgccatgcttcctgggaggcatggccagaggcctactggggagaaaccaccctctgcacattcgcgaaaatagatccgcggctctgaagaaagcggatgtgatcgtgcttgccggcactgtgtgcgattttcgcttatcctacggtagggttttgtcccacagctccaaaattatcatcgtgaaccgtaatagagaagagatgcttctgaactccgatattttctggaaaccgcaggaagctgtacagggagacgttggctcatttgtcctaaagctcgtggaggggctccagggtcaaacttgggctccggattgggtagaagagctccgcgaagcagatcggcagaaagagcaaacatttagagagaaggccgcgatgcctgtagcgcagcatctcaacccagtgcaggtcctgcagctagtggaggagaccctgcccgataacagtattctggtcgtcgacgggggtgatttcgtgggtaccgcagcccatttggtgcaacctaggggaccactgcgttggttagacccgggcgctttcggaactttgggggtcggggccggtttcgctctgggggcgaagctatgtcgccccgatgctgaagtgtggtgtctctttggagatggggccttcgggtactcacttatcgagttcgacaccttcgtgcggcacaaaatccccgtgatggcattggtgggaaacgacgcaggctggacacagatctctcgggaacaagttccctctctgggttctaatgttgcctgcggcttggcctataccgattatcataaggcagccatggggttgggcgctaggggccttctgctgtccagggaaaatgaggaccaggttgtgaaggtgctacacgatgcccaacagcagtgtagggatgggcatcccgtcgttgttaatattctaatcgggaggactgacttcagagatggttctatcgctgtttag

SEQ ID NO: 120422 - DNA, 678 bp, Artificial Sequence
  Description of Artificial Sequence: Synthetic coding sequence
atggagaccccagccgccgccgctccagcgggctccctttttccgtcctttctcctccttgcatgtggaacccttgtggccgctcttctgggggccgcacaccgactgggactgttttatcaacttctgcataaagtggataaggcaagcgttcgccacggaggggaaaacgtagcagcagtcctgcgcgcacacggggtgcgattcatcttcactctggtgggggggcatatcagtcctttgctcgtcgcttgtgagaaacttgggattagagtcgtcgatacccgtcatgaggtaaccgccgtgttcgccgcagacgccatggcacgactgtccggtaccgtgggagtggccgcagtaaccgctggccccgggctgacgaacacagtgactgcggtgaagaatgcacagatggcccagagccccatacttctgctgggtggtgctgccagcacccttctccaaaatcgcggtgcccttcaggccgtggaccagttaagccttttccgccctcccccgggctgtggccagcacccacattgggaggacggcctcccccgttggcttcattgctgtatagggccatgcgggtcaggacgtctggctgcgtttctccccctcgattgcgtgcagctcgtgtggagccttatcattgcttgtcctggcccaatcccttag

SEQ ID NO: 120423 - DNA, 789 bp, Artificial Sequence
  Description of Artificial Sequence: Synthetic coding sequence
atggagactccggctgcagccgccccagcaggaagtctctttcccagctttctgttgttggcgtgcggcacattagttgcagcactgctgggagctgcccacagattagggttgttttaccagctgctgcataaggtagacaaggcttcagtgcgccatggaggggaaaacgtggccgcagtgctgagggcgcacggggtgcgttttatttttacactcgttggcggccacatctcacccctcctggtagcatgtgagaaactcggaatacgcgtggtggatacacgtcacgaggtcacggccgtgttcgctgccgacgccatggcccgcctgtctggtacagttggcgtcgccgccgtgactgccgggccagggcttacgaacacagttacggcagtcaagaacgcacagatggctcagagtcccatactcttgcttggaggcgccgcctctaccctccttcaaaacaggggcgctctgcaagccgtggaccaactgagcctcttcaggcctctgtgtaaattttgtgtttccgttcgtcgcgtgcgagatatcgtacccacactccgtgccgctatggcagctgcccagtctggtaccccgggcccagtgtttgtagagcttccagtggatgtgctctatccatacttcatggtccagaaggagatggtacccgctaaaccacccaaagggctggtcggccgcgtggtgtcttggtaccttgagaactatcttgctaatcttttcgctggcgcatgggaacctcaaccggaaggacccctcccttag

SEQ ID NO: 120424 - DNA, 501 bp, Artificial Sequence
  Description of Artificial Sequence: Synthetic coding sequence
atggagacaccagcagccgctgcacccgccggaagcctgtttccgagctttctgcttttggcttgcggtaccctcgtcgctgccttattgggggcagcccaccgattaggcttgttctaccaactgctccacaaagtcgacaaggcttctgtccggcatggaggagagaacgtggctgctgtcttacgggcacacggcgtgaggtttatcttcaccttagtggggggtcacatatctcctctcctggtggcgtgcgagaagctcgggattcgcgtggtggacactcggcatgaggtgacagcagtgtttgctgcagacgcaatggctcgactgagtggaacagtgggagtcgcagccgtgacggccgggcccggattgacaaacaccgtgactgctgtgaaaaacgcccaaatggctcagagcccaattctgctgctcggcggggcagcctcaacgcttctgcagaatcgaggcgctctacaggctgtcgatcagttatag

SEQ ID NO: 120425 - DNA, 621 bp, Artificial Sequence
  Description of Artificial Sequence: Synthetic coding sequence
atggccgcaactaggtgcctacgttggggactctcccgtgctggagtctggcttcttcctccacccgctcggtgcccgcgcagggcgctccacaagcagaaggacgggacagaatttaagagcatctacagcctggataaactctaccccgagagtcaagggagcgacacagcctggcgcgttcccaacggcgccaagcaggccgacagtgacatacccctcgataggctgacaatctcatactgccggtcaagcggacctggcgggcagaacgtgaataaggttaattcgaaggcagaagtgaggttccacttagccaccgccgagtggatcgctgagcctgttagacagaagatcgccatcacacacaagaacaagatcaaccggttgggagagctgatcctcacgtccgaaagctcaaggtatcaatttaggaatctcgccgactgtctccagaaaattagggatatgatcactgaagccagtcagactccaaaggaacctaccaaggaggacgtgaagttacatcggatccgcatcgagaacatgaatagggagaggctgcggcagaaacgtattcattctgcagttaagacctctcggcgggtcgacatggattag

SEQ ID NO: 120426 - DNA, 471 bp, Artificial Sequence
  Description of Artificial Sequence: Synthetic coding sequence
atgtgccactcgaggtcttgccacccaacaatgactattctgcaggcccctaccccagccccgagtacaattccagggccaagaagaggcagcggcccggagatcttcacctttgaccctctacctgagcccgccgccgcgcctgccggcaggccttcggcttctcgagggcatcgcaaacgctcccggcgggtgctgtaccctagagtggtcaggcggcagctgcctgtagaggaacccaatcctgcgaaacgtttactgttccttctgctcacaatcgtgttttgtcagatcctgatggccgaggaaggggttcccgcccctttgcccccagaagacgcgccaaacgcagcctccctggccccgacacccgtgtcagcagtactcgagccattcaatctcacaagtgagcctagcgactatgccctggacctctccacgtttctgcaacaacatcccgcagcattctag

SEQ ID NO: 120427 - DNA, 417 bp, Artificial Sequence
  Description of Artificial Sequence: Synthetic coding sequence
atgtgtcatagtaggagttgccacccaacgatgaccatcctgcaagcaccaacgcctgcgcctagcactatccccggccctaggcggggctcaggacccgagatatttacgttcgacccactccccgagccagctgccgctcctgccgggcggccttccgccagtagggggcacagaaagaggagtcgccgcgtcctctacccacgagttgtgagtatagccgaggtggggatccgaggagtgcgttgcccaggggtgactggggagagacctgattccagaggcctggacctaacttgtctgctcttttgtctgccattggggcccgctcccgcagctagtcggggtaccgagccgtcacagaaagcctctctgtctgccgcccaccacagactccttcctgaccctgacgggtag

SEQ ID NO: 120428 - DNA, 579 bp, Artificial Sequence
  Description of Artificial Sequence: Synthetic coding sequence
atgtgccacagtcgtagttgtcacccaacaatgacaatcttgcaggcacccacccccgccccgtcaacaattccaggaccacgaagaggcagtggccctgagatattcacctttgaccccctccctgagcctgccgctgctcccgctggtcgtcccagtgcgtctcgcggacacaggaaacggtctaggcgagtgctaccttctagcggcgaatacaggcgttcgggccacagccggggagccctcccctggagtcactggggtacgacacgtctacagggtctggacctgacttgtttattattttgcctgcccctggtgcgtcgacagttaccagtcgaagagcctaaccccgcaaagaggctgctgttcctcctgctcacaatcgtattctgccagatcctcatggcagaggagggagtgccggctcctttacctccagaggacgctccaaatgcggcctcactggccccaacaccagtgtcagccgtgctggaaccatttaatttgacttcagaaccaagcgattacgccctggatttgtcaacatttctgcagcagcatcctgctgcgttttag

SEQ ID NO: 120429 - DNA, 471 bp, Artificial Sequence
  Description of Artificial Sequence: Synthetic coding sequence
atgtgccactcgagatcctgtcatccaacaatgacaattctgcaggctccaacccccgctccaagtaccattcctgggccgcggagaggcagtggacccgagatctttactttcgatcctcttcccgagccggccgcggctcccgccgggagaccatctgcctcccgggggcacaggaagagatctcgcagagtgttgtacccacgcgttgtccgccggcaactgccagtggaagagcccaatcctgccaaacgactcctctttcttctcttaaccatcgtcttttgccagatacttatggccgaagaaggggtccctgcccccctgccacccgaggacgctcccaacgctgcgagcctagctcctaccccggtgagccccgtattggaacctttcaatcttacatccgagccatctgattacgcgctagatttgtccaccttcctgcagcaacacccggctgcattttag

SEQ ID NO: 120430 - DNA, 417 bp, Artificial Sequence
  Description of Artificial Sequence: Synthetic coding sequence
atgtgccacagcaggtcttgtcaccccacaatgacaatcctgcaggccccaacccctgcaccatcaactatcccaggtccccgacggggttcggggcctgagattttcacattcgatccgttgccggagcccgccgccgctccagccggccgcccctcagcctcacgcggacacaggaaaaggtcacgacgtgtgctctatccccgggtcgttagcatagccgaggtgggaatacggggggtgcgttgccctggggtcacaggagagcgaccagactcccgcgggcttgaccttacgtgtctgctgttttgtctcccactgggccccgctcctgcagctagccgaggaacagagcccagccagaaagcttccctctcagcagcacaccatcgcctgctacctgacccagacgggtag

SEQ ID NO: 120431 - DNA, 417 bp, Artificial Sequence
  Description of Artificial Sequence: Synthetic coding sequence
atgtgtcatagtcgcagctgccaccctaccatgacaattctccaggctcccacccctgcacctagcacaataccaggccctagacgcggctctgggcctgaaattttcacatttgatcctctgccagagccagcagcggctcccgctggaagaccctccgcaagcagaggacacaggaagcggtccaggcgtgtgctttaccctcgcgtcgtttccatagctgaagtggggattagaggggtcaggtgccctggcgtcacgggcgaacgccccgactctcggggactggacctgacatgcttgcttttttgccttcctctgggacctgctcccgccgcttctaggggtaccgagccgtcccagaaagcctctttgagcgcagcacatcaccgcctcctgcctgacccggacggatag

SEQ ID NO: 120432 - DNA, 471 bp, Artificial Sequence
  Description of Artificial Sequence: Synthetic coding sequence
atgtgtcactctagatcttgccaccccaccatgactatcctgcaggccccaacacctgctcccagcacaatcccagggccacgccgcggctctggccccgagatcttcacttttgaccccctcccggaacctgccgctgctcctgcaggccggcccagtgcatctagagggcatcggaaacggagcaggagggtgctctatcctagggttgtgcgtaggcaactgccagtggaggaacctaaccccgccaaacgcctgctctttctattgctgacaattgttttttgccagatcctgatggccgaggaaggagtccccgcgcctctgccgcctgaggatgcccccaacgctgcttccctggcaccaaccccagtgtcacccgtgctggaacctttcaatctcacctctgagccttctgattacgccctggatctctccacgttcctgcagcaacaccccgcagctttttag

SEQ ID NO: 120433 - DNA, 417 bp, Artificial Sequence
  Description of Artificial Sequence: Synthetic coding sequence
atgtgtcatagtcgcagttgtcacccgaccatgacgatcctgcaggctcctacacctgcaccctctacaatccctggtcctcggagaggtagcggccccgagatcttcactttcgacccccttcctgagcccgctgctgcccccgctggacgtccttctgcgagtagagggcaccgcaaacgcagtaggcgcgtgctttatcctagggtagtgtccatcgcagaagtaggcattagaggcgtcaggtgtcccggcgtgactggggagcggcccgattcgagaggcctggatctgacctgcttgctgttttgcctgccgctgggccctgctcccgcagcaagcagaggtacagagccctcacagaaggcctctctgtcagctgctcatcaccgcctgttgcctgatcccgacggctag

SEQ ID NO: 120434 - DNA, 471 bp, Artificial Sequence
  Description of Artificial Sequence: Synthetic coding sequence
atgtgccactctcgcagctgccatcccacaatgacaatcttgcaggctcctacaccggcacccagcacaattcctggccctagaagaggctccggccccgaaatctttactttcgacccactccccgagcctgcagccgctcctgccggcaggccctcagcttctagaggacacagaaagcgctcccggagagttttgtaccccagggtggtccggcgccagctgccagtagaagagcctaatcccgctaagcgcctcctgtttctgctccttaccatcgttttttgtcaaattctgatggcagaggagggggtcccggcgccactacccccggaggatgccccaaacgccgcctccctagcaccgacaccagtgagccctgtcctggaacctttcaatcttaccagcgagcccagcgattatgccctggatctgtcgacatttttgcaacagcacccggcagcgttctag

SEQ ID NO: 120435 - DNA, 417 bp, Artificial Sequence
  Description of Artificial Sequence: Synthetic coding sequence
atgtgccatagccgctcttgccatcccacaatgactattctacaggctccaacacccgccccttccacaatccccggtcctagaagaggaagcggccctgagatcttcacttttgacccacttcctgagcctgctgccgctccagcgggtcggccctctgcttcacgcggccataggaaacgttcccgcagagtgctgtaccccagagtggtgtcgatcgcagaagtggggatccgaggtgtgagatgcccgggagttaccggggaacgcccagattccagaggtctggacctgacttgtctgctgttctgtttgcctttgggtccagcccccgctgcaagtagaggaactgagccaagccagaaggcatctctgtcagccgcacaccatcgtctgcttccggatccggatggctag

SEQ ID NO: 120436 - DNA, 471 bp, Artificial Sequence
  Description of Artificial Sequence: Synthetic coding sequence
atgtgccatagcagaagctgtcatccgacgatgacaattctgcaggctcctacaccagccccctccaccatccccgggcctaggcggggctccggacctgaaatcttcactttcgacccgctgccagagcctgcagctgctcctgccggcagaccttccgcctcacggggccacagaaagcgaagccgcagggttctttatccccgggtggttaggaggcagctcccagtggaggagccaaatccagctaagagactgctctttcttctgctgaccatcgttttttgccaaatactgatggccgaggagggagttccagcaccactcccacctgaagacgccccaaacgccgcctctctggcacctacaccggtgagcccggtattagaaccatttaatctcacctcggagcctagtgattatgcgctggatctgagcacttttctccagcagcaccctgcagccttttag

SEQ ID NO: 120437 - DNA, 417 bp, Artificial Sequence
  Description of Artificial Sequence: Synthetic coding sequence
atgtgtcacagtaggagttgccaccccaccatgaccattctgcaggccccgaccccagcaccaagcacaatcccaggtccccgccgaggatctggaccagaaatattcactttcgatccattaccagagccagctgcagctccagccggtcgccccagcgctagtcggggccatcggaaacgaagtcgccgcgtcctgtatccacgggtggtctcgatcgcagaagtaggaatccgcggggtcagatgtccaggggtgacgggcgagcgccctgacagcagagggttggacctgacatgcctgcttttttgtctccccctcggcccagccccggctgcaagtcgcgggacagagcctagtcaaaaagctagcctatcagcagcacatcacagactcctgcctgaccccgacgggtag

SEQ ID NO: 120438 - DNA, 471 bp, Artificial Sequence
  Description of Artificial Sequence: Synthetic coding sequence
atgtgtcacagccgcagttgtcatcctaccatgaccattcttcaggcacccacaccagcccccagcacaatccccgggcctcggcgcggctccgggcctgagattttcacctttgaccctctgcctgaacccgcggccgcacccgcaggccggccttctgcaagccgcggacaccgcaagcggtccaggcgtgttttataccccagggtggtgcgcagacagctgcctgtagaggagcctaaccccgccaagcgccttctttttctgttgctgaccatcgttttctgccagatcctcatggcagaggaaggcgtgcccgccccactgccccctgaagacgctcccaacgcagcgagcctggccccaacccctgtaagccccgtcctggagccattcaatctgacctccgagccatctgactatgccctcgatctgtccaccttccttcagcagcatccagccgccttttag

SEQ ID NO: 120439 - DNA, 249 bp, Artificial Sequence
  Description of Artificial Sequence: Synthetic coding sequence
atggcattcacgctctatagcctcctacaggcagccctgctgtgcgtcaacgccatagccgtcctgcatgaggagcgcttcctcaagaatatcggctggggcactgatcaaggcataggcggattcggcgaggagcccggaattaagagtcagcttatgaatctgatccgatccgtgcgcactgtgatgcgggtccctctgatcatagttaattctatcgcaattgtcctgctcttgttgtttggctag

SEQ ID NO: 120440 - DNA, 984 bp, Artificial Sequence
  Description of Artificial Sequence: Synthetic coding sequence
atggaattcaagctggaagcccaccgaatcgttagtatcagtttaggaaagatctacaattcgcgcgtccagaggggagggattaagcttcacaaaaacctgctggtatcactggtactaagaagtgccaggcaggtgtacttgtcagacccatgccccggactgtacctggccgggcccgctggcactcctgctccaccaccacagcagcaacctggggaaccagccgcaggacctcctgccggctggggtgaaccgccccccccggccgcaagagccagctggccagagaccgaaccccagcctgagagatccagcgtcagcgatgccccgcgcgtgggggacgaggtgcctgtggctaccgtgaccggcgtgggtgacgtgtttcagggcggagaagcagatgcaaccgaagctgcttggagtagagttgaaggtcccagacaggcggcggctcgagaggccgaggggaccgccggcggatggggtgttttccctgaagtttccagagcggcacggcgaccctgtggctgccctctgggaggcgaggatcctcctggaaccccggcagccacgccaagagctgcgtgctgttgcgcgccccagccagctgaggatgagccgcccgctccccctgctgtgtgccctaggaaacggtgcgcggccggagtgggcgggggacccgctggctgtccagcccccggtagtacacctttaaagaagcctcgacgaaacctcgaacagccaccttccggaggggaggacgatgatgcagaggagatggaaacaggaaatgtggccaacctgatatcgatttttggatctagctttagtggcttgcttcgcaagtcccctggcggaggacgcgaggaggaagagggagaggagtccggtcctgaggccgctgaacctgggcagatctgctgcgataaaccggttctgcgcgacatgaatccgtggagtactgctatagttgctttctag

SEQ ID NO: 120441 - DNA, 420 bp, Artificial Sequence
  Description of Artificial Sequence: Synthetic coding sequence
atggagtttaagctggaagctcatcgtatcgttagcattagcctgggtaaaatctacaattccagggtccaacgcggaggcataaaactgcataaaaacctgttggtcagtttagtattgagaagcgcacggcaagtctatttgagcgatccatgtccaggactctatctggcaggcccagcaggcacccctgccccccccccacagcagcagcccggtgaacccgccgccggcccacctgctggctggggtgagcctcctcccccagcggccagggctagctggcccgaaaccgagccccagcccgaaaggtcttctgtgtccgatgcgccgagggtcggggatgaggtgcccgtggccaccgtcaccggggtgggagacgtctttcaggggagatcggctgctatttccagatgctag

SEQ ID NO: 120442 - DNA, 546 bp, Artificial Sequence
  Description of Artificial Sequence: Synthetic coding sequence
atggaagccatgaacgtcgagaaagcgtcagcagacggaaatctgccagaggtcatctctaacattaaggaaactctgaagattgtttcaaggaccccagttaatattacaatggccggtgacagtgggaatggcatgtcaacctttatttcagctctgcgaaataccggccacgagggcaaggccagtcctcccacagaactggtgaaggcaactcagcgctgtgccagctatttcagtagtcatttttccaatgtggtgttatgggaccttccggggaccgggtcagcgactacaaccttggaaaactatctcatggaaatgcagtttaaccgttatgactttatcatggtagcctcagcccagttcagtatgaaccacgtgatgctcgccaaaactgcagaggacatgggtaagaagttttacatcgtttggaccaaacttgacatggacctttcaactggggctctgcctgaagtgcagctgctccagatccgtgagaacgtcctggagaacttgcagaaagaacgggtctgtgaatattag

SEQ ID NO: 120443 - DNA, 1020 bp, Artificial Sequence
  Description of Artificial Sequence: Synthetic coding sequence
atggccgctgaagacgagcttcaactcccacggctgcccgagttgtttgagacaggtcggcagctgctggatgaggtagaggtggctactgagcccgccgggagcagaatcgtgcaggagaaagtcttcaaggggctggatctcctggaaaaggcagccgagatgcttagtcagttagacctattcagccggaatgaagacctggaggagattgccagtaccgatctgaagtacttattggtacccgcatttcaaggggcgttgacaatgaagcaagtcaatccctctaaacgtttagatcacctacagcgcgcgcgagaacactttattaactacttaacacagtgccattgctaccatgtagcagaatttgaactcccaaagactatgaacaatagtgccgaaaatcatacagcaaattcctccatggcctacccctccctggtggctatggcgtctcaaagacaagctaagatccagcgatacaagcagaaaaaggagcttgaacaccgcttgtccgctatgaaatctgcggtagagagcggccaagccgatgatgaacgtgtccgggagtattatctgctgcatttgcagcgctggatcgacatttcactggaagaaatagagtctatagatcaggagattaagatccttcgtgagagagactcgagtcgcgaggcgtctactagcaactcaagcagacaagaaagaccaccagtgaaaccctttattctgacgaggaatatggcccaagcaaaagtgttcggcgccggataccccagcctgccgactatgaccgtcagtgactggtatgagcagcaccgcaagtatggggcactccccgatcaaggaatcgccaaagcagcccccgaggaattccgtaaggctgcccagcaacaggaggagcaagaggaaaaggaagaggaggacgacgagcagactttgcatcgcgcccgcgaatgggatgactggaaggatacccatccacgaggctacgggaaccgccagaatatgggatag

SEQ ID NO: 120444 - DNA, 1020 bp, Artificial Sequence
  Description of Artificial Sequence: Synthetic coding sequence
atggccgccgaagatgaactgcagctcccgagactgcccgagctgttcgagactggaaggcaactgctggacgaggtggaggtggcaacagagcctgcaggtagtcggattgtgcaggagaaagtgtttaaggggctggacttgctggaaaaagccgctgagatgctcagccaattagacttattctcaaggaacgaggacttagaagagatcgcctccaccgatcttaaatacctgttggtcccagcattccagggagcgttgaccatgaagcaagttaatccttctaagagattagaccacctccaaagggctagagagcacttcattaactacctgacccagtgccactgctaccatgtggccgaatttgaactgcctaaaactatgaacaactcagccgaaaatcataccgcgaattcatctatggcgtatcctagcttagtggcaatggcctctcagaggcaagcaaagattcagcggtataagcagaaaaaagaacttgaacatagactatccgccatgaaaagcgctgtcgagtccggccaggcagacgacgaaagagtacgggagtattatctactgcacctgcagagatggatagacatatccctggaagaaattgagagtattgaccaagaaattaaaatcttgagggagagggatagttcgagggaagcaagtacgagcaattcaagccgccaggaacgaccacctgttaaaccttttattctcacccgaaacatggcccaggcaaaagtgtttggagcgggttatccgtccttgccgaccatgaccgtgtcggattggtatgaacagcacaggaaatacggagcgctgccagatcaagggatagctaaagccgcacccgaagagttccgcaaggccgcacagcagcaggaggagcaggaagagaaagaggaggaggacgatgagcagaccctccatcgcgcccgtgaatgggacgactggaaagacacacacccacggggttatggaaaccggcagaacatgggctag

SEQ ID NO: 120445 - DNA, 480 bp, Artificial Sequence
  Description of Artificial Sequence: Synthetic coding sequence
atgaagaaccatctcctcttttggggagtgcttgccgtgttcataaaggctgtccatgtgaaagcccaggaggacgagcggatcgtgttagtagataacaagtgtaagtgcgccaggattacttcccggattatccgctcctccgaagatccgaatgaggacattgtcgaacggaacatacggataattgtgcctctgaataatagagagaatataagcgatcccaccagccccctgcggacccgttttgtctatcacttgagtgacctttgtaagaagtgtgatcccacagaggtggaactggacaaccagatcgtcacagcaacacagagtaacatatgcgacgaagatagtgcgaccgaaacatgctatacatatgaccgaaataaatgctacacagccgttgttcccctggtttatgggggcgagactaaaatggtggaaaccgcactgacgccagacgcttgttacccggactag

SEQ ID NO: 120446 - DNA, 213 bp, Artificial Sequence
  Description of Artificial Sequence: Synthetic coding sequence
atgaaaaatcacctcctcttctggggtgtcctggccgtcttcataaaagcggtccatgttaaagcccaggaagatgagagaatcgtactggtcgataataaatgtaagtgtgctagaattaccagccgaatcattcggtccagcgaggaccccaacgaggatatcgtagaaagaaatatccggattatcgtccccttaaataacagggaatag

SEQ ID NO: 120447 - DNA, 480 bp, Artificial Sequence
  Description of Artificial Sequence: Synthetic coding sequence
atgaagaaccacctgctattctggggcgtgcttgccgtgttcatcaaagcagtgcatgtcaaagctcaggaggatgaacggatcgtcctcgtagataataagtgtaaatgtgcccggatcacaagtcgcatcatacgcagcagcgaggatcctaatgaggacattgtggaaagaaacattcgcattattgtgcctctgaacaacagggagaatatttctgatccgacgtctcctctacgcacccggttcgtttatcacttgtctgatctgtgtaagaagtgcgatcctaccgaggttgagctggataaccagatagtgactgctactcagtcaaacatctgcgacgaggactctgccactgagacttgctacacttatgacaggaacaagtgctacacggctgtcgtgccactggtttacgggggtgaaacgaagatggttgaaacagctctgacccccgacgcttgctacccggattag

SEQ ID NO: 120448 - DNA, 528 bp, Artificial Sequence
  Description of Artificial Sequence: Synthetic coding sequence
atgaagaaccatctcctattctggggagtgctggccgtgtttatcaaagccgtccatgtaaagggttcccgggattcttctgcctcagcttcccgcgtggcagggatcacagcacaggaagatgagcggatcgtgctggtggacaacaagtgcaagtgcgccagaataaccagccggatcatccgctctagcgaagaccccaatgaagacatcgtcgagaggaacatcagaattatcgttcccctcaataaccgtgagaacatctccgaccccacttcaccactaaggacaagatttgtctaccatcttagcgacctatgtaagaagtgtgacccaacagaagtcgaactggacaatcagatagtcactgccacacagtccaacatttgtgacgaggattctgcaacggaaacctgctacacttatgacaggaacaagtgttatactgcggtggtgccactggtctatggcggcgagacaaaaatggtcgaaacagcactcacccctgatgcttgctatcctgattag

SEQ ID NO: 120449 - DNA, 642 bp, Artificial Sequence
  Description of Artificial Sequence: Synthetic coding sequence
atgagaccaggaaccggccagggggggctcgaggcccctggcgagccaggcccaaatctgcggcagagatggcctctgctgctcctgggcttagccgtggtaacccacggcctactgcgccctactgccgcaagccagagcagagccctcgggcccggcgcacctggcggaagctcaaggtcctccttgcgatctagatggggaaggtttctcctacagcgcggctcgtggacaggtcctcgttgttggcctcgtgggttccagtcgaagcataattctgtcacccacgttttcggtagcggcacccagctgactgtactgtcccagcctaaggccactccatctgtcactctctttccacctagttcggaagaacttcaagccaacaaagctacattggtctgtctgatgaatgatttctaccccgggattctcactgtcacctggaaggcggacgggactcctattacgcagggtgtggaaatgaccacgccaagcaagcaatccaataacaaatatgcggcctccagctacctctccctgaccccagagcagtggagaagtcgccggtcttatagctgtcaagtcatgcatgaaggcagtacagtggaaaaaactgtggccccagcagaatgtagctag

SEQ ID NO: 120450 - DNA, 255 bp, Artificial Sequence
  Description of Artificial Sequence: Synthetic coding sequence
atgcgaccaggaacggggcagggaggcctggaagcaccgggcgagcctggccctaacctgcggcagaggtggcccttattattgcttggacttgccgtggtaacccatggcctcctgcgccctactgctgcgtctcagtccagggctcttgggcctggcgctccagggggttccagccgttcttcgctgaggtcccgttgggggcgaagcgcacagggccaccctctgggtcatagcgtgccggccgtgctctag

SEQ ID NO: 120451 - DNA, 2982 bp, Artificial Sequence
  Description of Artificial Sequence: Synthetic coding sequence
atggcttctgcggccgtggaatcttttgtcaccaaacagctagatctgttagagttggagagggacgccgaggttgaggaacgaaggtcttggcaggagaacatctctttaaaggagctgcaatcccggggcgtctgtctgctcaaactgcaagtgtcctcccagaggaccgggctctacggtcggttgttagttacatttgagccaaggcggtacggaagtgccgcagccctccccagcaactccttcacatctggtgacatcgtaggactttatgacgctgccaatgaagggtcccagctggccaccggtattcttacgcgggtaacccaaaaaagcgtgacagtcgcgtttgacgagagccacgatttccagctatctctcgaccgtgagaattcgtacaggttgcttaagttagcaaacgacgttacctataggcgattaaaaaaagccttaattgcgctgaaaaaatatcactctgggcctgcctcgtccttgatcgaggttctgtttggacgctcagcaccctctcctgcctccgagatacacccactgacttttttcaatacatgcctggatacaagccagaaggaagccgtcctgttcgcactttcacagaaggagctggccataatccacggtccgcctggaactgggaaaacaaccacagtggtggaaattatcctccaagccgtgaagcaagggctgaaggtcctgtgctgtgctccctctaacattgcagtggacaatcttgtggagaggctagcattgtgtaaacagcgtatcttacggcttggccaccccgctcgtttgttggaatccatccagcaacacagtctggatgccgtgctggcccgtagtgacagcgcccagatcgtcgccgacattcgtaaagatatcgaccaagtgtttgtaaaaaataaaaaaacccaggataaaagagagaaatctaacttcaggaatgagataaagctgctccggaaagaactgaaggagagagaagaggccgctatgctggaatccctgacatccgcgaatgtggtcctggccaccaacaccggcgcgtcagctgatggacccctgaaactgttacccgaatcttacttcgatgtcgtggtgatcgatgagtgcgctcaggctctcgaagcatcctgctggatcccgcttctcaaggcccggaagtgcatcctggccggcgaccataagcagttaccaccgaccacggtctcccacaaagctgccttggctggtctgtctttgagtctgatggagagactggcggaggaatacggtgccagggttgtgcgaacgctgactgtccaatatcggatgcaccaggcaattatgcgctgggcgtctgacacaatgtacctggggcagctgaccgcccatagctctgttgccagacacttgctccgcgacctccctggtgtggctgccaccgaggaaactggagtaccactgcttcttgtcgatacagcgggctgtgggctgtttgagttggaggaagaggatgagcagtccaaagggaaccctggcgaagtgagattagtctccctccacattcaggcgttggtggatgccggagtgcccgccagagacatagctgtagtcagtccgtacaacttacaagtagacctgctgaggcagagcctcgtgcaccggcaccctgagctggagatcaaatcagtggacggatttcagggtagagagaaggaggcagttatcctttcttttgtacggagcaaccgcaagggagaggtgggcttcctggcggaagatagacgcattaatgttgccgtgacccgcgcgaggagacacgtggcagtgatctgcgactcaagaacagtcaacaaccacgcattccttaagactcttgtcgagtatttcacccaacacggagaggttcgtactgcatttgaataccttgatgatattgtgccagagaattactcgcacgagaacagtcaagggtcttcacacgctgccacaaagccccaggggcccgcgacctccacacgtacaggctctcagcggcaggagggcggccaggaagccgcagctccagcccgacaggggcgaaagaaacctgcgggaaaaagcctggctagtgaagcaccttctcagcctagcctgaatggcggatcacctgagggcgtcgaaagccaggacggcgtcgaccatttccgggccatgattgtggagttcatggcctcaaagaaaatgcagcttgaattccctccaagtttgaactcacatgaccggctcagggtccaccagatagccgaggaacacgggctaagacacgacagctctggcgagggcaagcgccgatttatcactgtgtccaagcgcgccccacgtccaagggccgccctgggcccacctgccggcactggggggcccgcccctttgcaaccagtacctcctactcccgcgcagacagaacagccgccaagagagcagcgaggacctgatcaacccgaccttagaaccctacacttggaacgtctgcaacgagtccgcagcgcccagggacaaccagcgagtaaggagcagcaggcatcaggtcagcagaaactgcctgagaagaaaaagaaaaaggctaaaggccacccagcgaccgatctaccgacagaagaggatttcgaggcactagtgagcgcggccgtgaaggcagataacacctgtggatttgccaagtgtacagccggggttacaacccttggccagttctgccagctttgctctcgtaggtactgcctgtcccaccacctccccgaaatccatgggtgtggtgagcgggcccgtgcccacgcgcgccagcgtatttcaagggagggcgtgctttacgcgggatcaggcaccaagaacgggtccttagatcccgccaagagagcccagcttcagagacgactggataagaaactctcagaactgagtaatcaacggacaagtagaaggaaggaacgcggtacatag

SEQ ID NO: 120452 - DNA, 1287 bp, Artificial Sequence
  Description of Artificial Sequence: Synthetic coding sequence
atgcaggagttgcaccttctgtggtgggccctgctccttggcctcgcgcaggcatgcccagagccctgcgactgtggcgagaaatacgggttccaaatcgccgattgtgcatacagagatctggaatctgtacccccggggttccctgccaatgtgactaccctctctctgagcgcaaacaggttgcctgggctgccggaaggagcttttagagaagtgcccctgctgcagtccctgtggctggctcacaacgagattagaactgttgccgcaggtgccttagcctcactcagtcatttgaagtccctagatttatctcacaacctgatatctgactttgcctggtcggacttgcacaatctgtccgccctccagctcttaaagatggacagcaatgagctgacatttatcccgagggacgcatttcggtcacttcgtgcccttagatctctgcagctgaaccataataggctccacacactcgccgaaggaacgttcacaccactcacagccctctcccatcttcagattaatgagaatcccttcgactgcacatgtggaattgtctggctgaagacctgggcactgacaacagcagtctcaatccccgagcaggacaacattgcttgcacctccccgcatgtgctgaaggggacacccctgagtaggctgcctcccctaccatgttccgcacctagcgtccagctgtcataccaaccctctcaggacggcgccgaactacgacccggattcgtgctggctctacattgtgatgtggacggtcagccggcaccgcagctgcattggcatatccagatcccgagcggcattgtggaaattacttcccctaacgtcggaactgacggtcgcgccctccctggcacaccggtggcctccagtcagccgcggtttcaggcctttgccaatggttcattgctgatccccgacttcggcaagctcgaggagggcacctattcctgtctcgctaccaacgaactgggctcagcagaatcatctgtcgacgttgctctggcaacgccaggagaaggcggcgaggacacccttggaagacggttccatggcaaggccgttgaaggaaagggatgttatacagtggacaatgaagtacagccttctgggccagaagacaatgtggtgatcatctatttgagcagggcaggaaatccggaagccgctgtggctgaaggtgtccccgggcaactgccccccggcttactgctactgggccagtctcttttactgtttttcttcctgacctccttctag

SEQ ID NO: 120453 - DNA, 1287 bp, Artificial Sequence
  Description of Artificial Sequence: Synthetic coding sequence
atgcaggagctccaccttctttggtgggcactgctgttggggctcgcccaggcatgcccagagccctgcgactgcggtgagaagtacggtttccagatagcggattgcgcctatcgtgatttagaatcggtgccccctggttttcccgccaacgtcacaactcttagtttgagcgcaaaccgcttaccaggcctgcccgagggggcttttagggaagtaccactgctccaatccctctggcttgcacacaatgagattcgtaccgtggcagccggggcccttgcaagtcttagccacctgaagagtctggatctgtcccacaatctgatctccgatttcgcttggtctgatttgcacaacctgagtgctttacagttgctgaaaatggactccaacgaattgacttttataccacgggacgcatttcgctctctccgggcacttcgatccttacagcttaaccacaatcgcttgcatacgttagcagagggcaccttcacaccattgaccgctctcagtcaccttcagattaacgagaatcccttcgactgcacctgcggcattgtttggctcaaaacttgggccctaactacagccgtatcaattcctgaacaggataacattgcttgcacctcgccccacgttcttaaagggacaccactaagcaggctccccccccttccgtgtagcgccccgtcagtgcagctgtcctatcagcccagccaggacggggcagaactgcgcccaggcttcgtacttgcgctgcactgtgacgtggacggacagcccgccccgcagctgcactggcacattcagattcctagtggcatcgtcgaaattacaagtccaaacgtaggaacagatggcagggctttacccggcactcccgttgccagttctcaaccacggttccaagcttttgccaacgggtcattgctcatccctgatttcgggaaactcgaagagggcacatattcttgcctcgctaccaacgagcttggaagcgctgaatcttccgtggatgtggctctggctactcctggggaaggcggggaggatacactgggcaggcggtttcatggcaaggcagtagaaggcaagggttgctacaccgtcgataacgaagtgcagccttctgggcctgaagacaacgtcgttattatttacctgtcccgtgcaggaaaccctgaggctgcggtggctgagggcgttccagggcaattgccgcctggcctgcttctcctaggacagagcctgttactgtttttcttcctaactagcttttag

SEQ ID NO: 120454 - DNA, 444 bp, Artificial Sequence
  Description of Artificial Sequence: Synthetic coding sequence
atgcaagaactgcacctgctgtggtgggccttactgttaggcctggcccaggcatgtcccgaaccgtgtgactgtggggagaaatacgggttccagattgctgattgcgcctacagagatctggagtcagtgccacccggctttcctgctaacgttacgaccttatccctgagcgccaataggctcccaggtctgccggaaggcgcatttcgcgaagtccctctgctccagtccctgtggttggcacacaatgagattcggacagtcgcagctggcgcacttgcctctctgtctcacctcaagtccctggatctttctcataacttgattagtgactttgcttggtccgatctacacaatctgagtgctctacagctgttaaaaatggactccaacgagctcacctttatccccagagatgccttcaggagcttgcgggcctag

SEQ ID NO: 120455 - DNA, 552 bp, Artificial Sequence
  Description of Artificial Sequence: Synthetic coding sequence
atgcaggaactgcatctcctttggtgggctttgctgctgggactcgcacaggcatgtcctgagccttgtgactgcggagagaagtacggattccagatcgctgactgcgcctatcgagacttggagtcagtcccgcctgggtttcctgccaacgttactaccctctcactgtcggcgaatagattgccaggactgcctgaaggggcattcagagaggtgcccctcctccagagtctgtggctggcccacaacgagattcggactgtagctgccggagctctggccagcttgtctcacctcaagagcttggacctgagccacaatctaatcagcgactttgcatggtcagacctccataatctgtccgccctgcaactgctcaaaatggacagcaatgaactcaccttcatccctagggacgccttcagaagcttacgagctctccgatcgctacaactgaatcataacaggcttcacacactcgccgagggaaccttcacaccactgactgccctgtctcatctgcagatcaacgagaatccatttgattag

SEQ ID NO: 120456 - DNA, 2238 bp, Artificial Sequence
  Description of Artificial Sequence: Synthetic coding sequence
atgttccctctgcgtgcattgtggttggtgtgggctctcctcggggtggctggaagttgccccgagccgtgtgcatgcgtcgataagtacgcccaccaattcgcagactgcgcctacaaggagctgagagaggtgccagaggggcttccggccaacgtaaccacattatctctttccgccaataagatcacagtgctaagaagaggcgccttcgccgacgtgacacaggtgacttctttgtggttggcccacaacgaagtgcgcaccgtcgaacctggagctctagcagtgctgtcccagctgaagaacctggacctgagccataattttatctcttcctttccatggtctgaccttcggaacctctcagctctccaacttttgaagatgaatcataaccgcttaggcagcttgcctagggacgctttaggagcactgccagaccttagaagcctcagaattaataataacaggctgcgcactttagcgcccgggacatttgacgccctctcagctttgagccacttacagctttatcataatccgtttcactgcggttgcggactcgtgtggctgcaggcctgggcggcttcgacacgggtgtctctgcctgaaccagattctattgcctgcgcaagcccccccgcccttcagggggtgccagtttatcgactccctgccctgccctgcgcaccaccgtctgttcatcttagtgcagagcctcccctcgaagcgcctggaactcctctacgggcaggactagcgtttgtgctgcattgcatcgccgatgggcatccaaccccaaggctccagtggcaattgcagattccagggggcaccgtggttcttgagccgccagtgctgtccggagaggacgacggggtgggcgccgaggaaggcgagggcgagggagatggtgaccttcttactcagacccaggctcagacccccacccctgcgccggcttggccagccccacccgctactccccgctttttggcactcgcgaacggatcactcctggtaccactgctctcagcgaaggaggccggtgtgtacacttgtagggcccataatgagttgggggcaaatagcacttccataagggtcgccgttgcagcaactgggcctcccaaacatgctcccggcgcaggcggtgagcctgacggacaagctccaacaagtgagaggaaatcaactgccaaaggccgggggaattctgtgctgccgagtaaacctgagggcaagatcaaggggcaaggcttggcgaaggtgagcattctgggggagactgagacagagcctgaagaggacaccagtgaaggagaggaagctgaggaccaaattctagccgaccccgctgaggaacagcgttgcggcaatggagaccctagccggtacgtcagtaaccacgccttcaaccagagtgctgaacttaaaccccatgtattcgaactgggcgtcatagcactcgacgttgccgaacgggaagccagggtgcagctgacgcccctagcagcaaggtggggccctggaccggggggggctggcggggcaccacggccagggcgccggccactccggcttttgtacttgtgtcctgcaggagggggcgcagccgtacagtggtcccgcgttgaggagggtgtcaatgcctactggtttaggggcctgcggcccggcacaaactactctgtgtgcctggccctggcaggagaggcatgccacgtgcaagtggtctttagtactaagaaagaattgcccagccttcttgtgatcgtcgctgtgagcgtgtttctgttggtccttgcaacagtgccactgctgggggcagcgtgttgccaccttctggccaagcatcccgggaagccctaccggcttatcttaagaccccaggctcccgaccctatggagaagagaattgccgccgactttgacccaagggcaagctacctagagtctgaaaaaagctacccagctggtggggaagccggaggagaagagcccgaagatgttcagggggagggcctggacgaggatgctgagcagggggatccatcgggtgatcttcagcgggaggagtccctcgcagcttgttcattggtcgagtctcaaagcaaagcgaaccaggaggagttcgaagcaggttcagagtacagcgatagactgcctctgggcgccgaagccgttaatatcgcccaggaaatcaatgggaactaccgtcagaccgcgggatag

SEQ ID NO: 120457 - DNA, 1005 bp, Artificial Sequence
  Description of Artificial Sequence: Synthetic coding sequence
atgttccccttgagagccttatggctcgtctgggctctactgggagtagctgggagctgtccagaaccatgcgcttgtgtggataaatatgctcatcagttcgcggattgtgcttacaaagagctaagggaggtgcccgagggcctccccgccaacgttaccacactgtcactgtctgccaataaaattaccgttctgaggcggggggcctttgctgacgtgacacaggttacctctctctggctggctcacaacgaagttcgcaccgtcgaacctggtgccctagctgtgttgtcccaactaaaaaatctggatctctcacacaattttatctctagcttcccttggtccgatctgagaaacctgagcgcactccagctgcttaagatgaaccataatagacttggttcgctcccgcgggacgcactgggcgcactgcctgacctgcggagcttacggattaacaacaacagactggccggcgaggcctgtcacgtacaggtggtgttctccaccaaaaaggagctgcccagtttgctggtaatcgtcgccgtgtccgtattcctgcttgtgctcgccactgtacctttgctgggcgcagcatgttgtcacttactagccaagcaccccgggaaaccctataggttgattctgcggccccaggctccggacccaatggagaaacggatcgccgccgacttcgacccccgcgcgagttatttggagtctgagaaatcttaccccgccggaggcgaggcagggggcgaagagccagaagacgtccagggcgaaggccttgacgaagatgccgagcaaggcgatcccagtggtgacctacagcgtgaggaatcattagcggcatgcagcttagtcgaaagccaatccaaggctaatcaagaggagtttgaagctgggtccgaatattccgaccgccttccactcggagccgaagcagtcaacattgcccaggaaataaatggtaactaccgacagacggcagggtag

SEQ ID NO: 120458 - DNA, 2238 bp, Artificial Sequence
  Description of Artificial Sequence: Synthetic coding sequence
atgttccctctgagagccctttggttagtgtgggccctcctaggcgtcgcaggttcgtgtcccgagccatgcgcatgcgttgataaatacgcacaccaatttgccgattgcgcttacaaggaactcagggaggtccccgaggggctgccggctaatgtgactacactctctctctccgccaacaaaattactgtcttgagacgcggagcctttgctgacgtgactcaggtcactagcctgtggttggcacataacgaggttcgcactgtagagccaggtgctctggctgtgttgtcccagctgaagaatctcgacctgagccacaacttcatctcatcctttccctggagtgacttgcgcaatctcagcgccctgcagttattaaaaatgaatcacaaccgattaggatcgctcccccgcgatgcactaggtgccctaccggaccttcgtagtcttagaatcaacaacaaccgcttacgtaccctggccccggggaccttcgatgccctctctgcattgagccacctgcagttataccacaatccttttcattgtggttgcgggctggtgtggctacaggcttgggccgctagcaccagggttagcctccccgaacctgattccatagcctgtgcatctcctcccgcactccagggggttccggtctaccgtctcccggcccttccatgcgctcctcctagtgtgcacttatccgccgagccgcctctggaggcacccggtacccccctcagggccgggctggccttcgtgcttcactgcattgctgatggccatccaactcccaggcttcaatggcagctgcagatccccgggggcacagtggttctggaaccaccagtgctctcaggcgaggatgatggcgttggcgccgaagaaggggaaggagagggcgatggagatcttctgacgcaaacccaggcgcagactcctacacccgctcccgcttggccagccccccctgctacccccaggttcctcgctttagccaacgggtccctcctcgtcccacttctcagcgccaaggaagcgggcgtatacacttgcagggctcataatgagctcggggccaacagcacctctattagagtggccgtagccgcaaccgggcctcctaagcatgcaccgggagcaggaggagagccagatgggcaggctccaacctcggagcgcaagagcaccgccaagggacggggaaatagcgtgctgccatccaagccagaaggtaaaattaaaggccagggtctggcaaaggtgtctatactgggcgaaacagagactgagccagaagaagatacctccgaaggcgaggaggccgaggatcagattctggccgaccctgcagaagagcaaaggtgtgggaacggagatcccagccgttatgtcagcaaccacgccttcaaccaaagcgcggaacttaagcctcacgtttttgaactgggcgtgattgcactggacgtcgctgagcgagaggcaagggtacagttaacccctttggctgcgcggtggggccccggacctggcggagccggcggtgcccccaggccagggagaaggcctctgcggttgctttatctgtgccctgccggcggtggtgctgctgttcagtggtcgcgggtggaggaaggggttaatgcgtactggtttcgggggctaagaccaggcaccaattattccgtgtgcctggctttagccggagaagcttgccacgtccaggttgtgtttagcacaaagaaggaactgccatcactcctcgtgattgtagcagtatccgtcttcctgctggtactcgctactgtccccctcctgggggccgcctgctgtcaccttcttgccaagcatcccgggaagccttaccggttgatcctgagaccacaagcgcctgaccccatggagaagcggattgccgccgatttcgaccctcgagcatcatacctggaatccgagaaatcttatcctgcaggaggagaggcggggggggaggaacccgaagacgtccagggcgaaggactagacgaagatgctgaacagggggacccttcaggtgacttgcaacgggaggaatccctcgccgcctgcagtctcgtggaaagccagagcaaggccaatcaggaagagttcgaggcgggctcggaatactcagatagacttcccctgggtgccgaggccgtgaatatcgcgcaggaaatcaacggcaactacaggcagactgctgggtag

SEQ ID NO: 120459 - DNA, 2238 bp, Artificial Sequence
  Description of Artificial Sequence: Synthetic coding sequence
atgtttcctctgagggctctgtggctggtctgggcgttactgggcgtggccgggagttgccccgagccctgcgcttgcgtagataagtatgcacaccagttcgctgactgtgcttataaagaactccgggaggtgccggaagggttacccgcaaatgtcaccacactcagcctctcagcaaataaaatcacagtgctgcggcgcggcgccttcgctgacgtcacacaggtcaccagtctatggctggctcacaacgaggtgaggaccgtcgagcccggggctctggcggtgctcagccagctaaagaatctcgaccttagccacaacttcatctcttcctttccttggagcgacttgagaaatcttagcgccctgcagttgctgaagatgaatcataataggctgggtagtctcccccgtgatgcactaggcgccctccctgacctgaggtcactgcgaatcaacaataatcgcctaagaaccttagccccgggaacatttgacgcactatctgccctgtcccatttgcagttatatcacaacccctttcactgtggctgcggactggtttggctgcaggcatgggcggcctcgactcgggtgtccctccccgagcctgactctatcgcctgcgcttcccctcccgctctgcagggggtgccagtgtaccggttgccagcccttccatgcgcacctccttcagtgcatttgtccgccgaaccccccttggaagcacctggcactcccctacgagcgggactggcctttgtgctccattgcatcgccgatggccaccctactccgaggctgcaatggcagcttcagatccctggtggcactgtggtgctcgagcctcccgtcctctctggcgaagacgacggagttggcgcagaggagggggagggagaaggcgacggcgacctccttacacaaactcaggctcagaccccaaccccggcaccagcatggccagcccccccagcgacaccacgattcctcgctcttgccaatgggagcctgctggtgcctctgctgtccgccaaggaagccggcgtctatacttgccgggcccacaacgagcttggggccaactcaacgtctattcgggttgcagtggccgccaccggaccacctaagcacgcgccaggggccggcggagagcctgatggtcaagccccaacaagtgagagaaagtccaccgctaaaggccgagggaatagcgtcttacctagtaagcctgaaggcaagatcaagggccagggcttagccaaagtctcgatccttggcgaaactgaaaccgagcctgaagaagatacttccgagggcgaggaggccgaagaccaaatcctagccgatccagctgaggagcagcgctgcggcaatggtgacccttcgaggtacgtgtctaatcacgcttttaatcagtctgcagaattgaagccacatgtgttcgagctgggcgtgatcgcccttgacgtggccgagagggaggctagggtgcagttaactccactggccgcccggtggggtccaggcccaggaggagcaggaggcgcaccaagacccgggcgccgaccccttcgattgctttatctgtgtcccgccggaggaggtgctgccgttcaatggtctcgcgtcgaagagggcgtgaacgcatactggttcaggggtctgcgccccgggaccaattattcggtgtgcttggctctcgcaggggaggcatgccacgtccaggtggtgttcagcacaaagaaggagctcccaagcctgcttgtgatagtggcggtctcagtgtttctgctggtgctcgctactgtcccactgctaggcgccgcgtgttgtcacctgctagctaaacatcctggtaaaccgtatcggcttatcctgcggcctcaggcacccgacccgatggaaaagagaatcgcggctgattttgatccacgggcatcttatttagaatcggaaaagtcataccccgcggggggcgaggccgggggagaggaacctgaggatgttcagggcgaaggtctggacgaagacgccgaacagggagatccgtccggggatctgcagcgcgaggagagtctggctgcctgcagccttgttgaatcacagagcaaggccaaccaggaggagtttgaggcaggctccgagtatagcgatcgcctcccgctgggcgccgaagccgtcaacatcgctcaagagattaatggcaactaccgtcaaactgctgggtag

SEQ ID NO: 120460 - DNA, 2238 bp, Artificial Sequence
  Description of Artificial Sequence: Synthetic coding sequence
atgttccctttacgtgccttatggctggtgtgggcgctcctgggcgtcgccgggtcatgccccgagccctgcgcctgtgtggataaatacgcccaccagttcgctgattgtgcgtataaggaactgagggaggtaccggagggcctccctgcgaacgtcacaacattgagcttgtcagctaacaaaattacagtgctaagacgaggagcctttgctgatgtgacccaggtgacaagcttatggctggcccataacgaggtacggactgttgagcccggagcgctggctgtcctgagccaactgaaaaacctggatctgtcacataacttcatttctagttttccttggtcagacctccgaaatcttagcgccttgcagctgttaaagatgaaccataacaggctgggttccctacccagagatgccttaggtgccttaccagacctgaggtccttgcgcattaacaacaacaggttacgcacccttgcccctggcactttcgacgccctcagcgcactgagccatctgcaactttatcataacccctttcactgtgggtgcggtctggtgtggctccaagcatgggctgcctccacacgtgtgtccctgcccgaaccagactctatcgcatgcgctagtccacctgccctgcagggagtccctgtctataggctgccagctttgccttgtgccccaccatctgtccacctgtccgccgagcctcctctcgaggcacccggcactccacttagggcaggactggcctttgttctccactgcatagcagatgggcacccaaccccacggcttcagtggcagttgcagatccctggcggcacagtagtgctagagccccctgtcctaagcggcgaagacgacggagtgggcgcggaggaaggggagggtgaaggcgatggcgatctgctgacccagacccaagcgcagacacccaccccggcacccgcttggcccgcaccgcctgcaacccctcggtttcttgcccttgccaacgggtctctcctggttccactgctcagcgctaaggaggcaggggtttacacatgcagggcccacaatgagctgggtgctaactccacaagcatcagggttgccgtggctgccactggcccacctaagcacgcccctggcgctgggggagaacctgacggccaggcccctaccagcgaaagaaaaagcactgcgaaagggcggggaaactctgtcctgccctctaaaccagagggtaagataaaggggcagggccttgcgaaggtgagtatccttggagagacagagaccgagcctgaggaggacacgagcgagggtgaggaagctgaagatcaaatcctggctgaccccgcggaagaacagagatgtggcaacggagatccatctaggtacgtatcaaatcacgccttcaatcaatctgcagagctcaagccccatgtctttgaattaggagtgattgccctcgatgttgctgaacgcgaagcacgggtacagctgacaccgctggctgccagatgggggccaggacccggtggggccggcggggctccaagacctggccgacgacctttgcgcctcctgtatctgtgcccagccggagggggagccgcggtgcaatggtctagggtagaagagggcgtgaatgcttactggttccgaggtttgcgcccaggaactaactacagtgtgtgcctcgccctggccggagaagcgtgtcacgtccaagtggtattctccactaaaaaagagctgccatccctgcttgtcatcgtggccgtgagtgtttttttgctcgttcttgccactgttcccttgctgggcgctgcgtgttgtcacctcttagcgaaacaccccggcaagccttacagactgatcctaagaccccaggcgccagatccaatggaaaagcgcattgctgccgatttcgacccccgcgccagttacctggagtcagagaaaagctacccggcagggggagaggctggaggggaagagcccgaagatgtgcagggtgagggcctcgacgaggacgccgagcaaggcgaccctagcggcgatctgcagagagaggagtccctggctgcgtgctccctagttgaatcccagtccaaggctaaccaggaggagttcgaggccggttccgagtacagtgaccggctcccgctgggcgcagaggctgtcaacatcgcgcaggaaattaacggtaactatcgccagacagccggatag

SEQ ID NO: 120461 - DNA, 2238 bp, Artificial Sequence
  Description of Artificial Sequence: Synthetic coding sequence
atgttcccccttagagcgttgtggctggtgtgggcactgttaggcgtggccggtagctgtccggagccatgtgcttgcgtcgacaagtacgcgcaccagtttgctgactgcgcctataaggaactgcgagaagtcccagagggattacctgcgaacgtcacgacgctttcactgtctgcgaacaaaattactgtcctgcgccggggcgcctttgcagatgtaacacaggttacatcactctggctagcacataacgaggtgcgaaccgtcgagcccggcgctctggccgtgcttagtcagctgaagaaccttgatctctcccacaatttcatatcctcctttccctggtcagacctccggaatctttctgctctgcagcttctgaagatgaatcacaaccggcttggaagcttgcctcgcgatgccctgggcgctctccctgacctgcgtagcctgcgtatcaataacaatcgcctccgaaccttggccccaggcacttttgatgccctaagtgcgctcagtcatctgcagctctatcataatcccttccattgtggctgtggcctcgtgtggctgcaggcctgggccgccagcacgagagtttcgctgcccgagccggatagcatcgcttgtgcttctccccccgccctccagggcgtgcccgtgtacaggttgccggcactgccctgtgcccccccttctgtgcacctgtccgccgaaccgccacttgaggcaccgggtacgcccctgagagccggactcgccttcgtcctccattgtatcgccgacggccacccaacaccccgccttcagtggcagctccagattcccggaggcacagtagtgctggagccgcctgtcttatccggtgaggatgatggcgtaggggcagaagagggggagggcgagggagatggagatttgctcactcagacacaggcacagacccccaccccagctccagcctggcccgctcccccagcaacacctcggtttttagctcttgccaatggctcattgcttgtaccacttctgagcgctaaggaagcaggggtgtatacatgtcgggctcataacgagctgggcgcaaacagcacttcgattcgcgttgcagtggctgcaactggcccccctaaacatgccccaggggccgggggagagccggatggccaggcccctacatctgagcgcaaatcaactgctaaaggacgcgggaattctgtgctgccatccaagcccgagggtaaaatcaaggggcagggccttgccaaagtctccatcctgggggagaccgaaacggagcctgaggaagacacctcggagggcgaggaggcggaagaccagatcctggcagacccagccgaagagcagcgttgcggtaatggcgatccatcaagatacgtgagcaatcacgccttcaatcagagcgcagaacttaagccccacgtcttcgagctcggtgtgattgcactggatgtggccgaaagagaggcccgtgtacagctgactccattggcagctcggtggggaccgggccccggcggggccggtggggcaccacgtcctggccgtagaccattacgtcttctgtacctgtgcccagccggcgggggggctgcggtgcagtggagccgggtggaggaaggtgtgaatgcttactggttccgcgggctccgtccagggactaattactcagtttgtttagccttagctggggaggcgtgtcatgtccaggtcgtgttctccaccaaaaaagagctgccctccctgctggtaattgtggccgtctccgtttttcttctggtgcttgcgactgtgcccttgttaggggccgcgtgttgccacctgctcgcaaagcacccggggaagccctatcgacttatactgcggccacaagctcccgatcccatggaaaagcgcatcgcagctgactttgacccgcgagcgtcatatctggagtcagagaaatcttatcccgcggggggagaggctggaggggaagagccagaagacgttcaaggcgaggggcttgatgaggacgcagagcaaggggaccctagtggagatctccagagagaggagagcctggcagcctgcagcctcgtcgagtcccagtccaaggccaaccaagaagaatttgaagctggaagtgaatattctgacagactaccccttggggctgaagcagtgaacatcgcccaggagatcaacggcaactatcgtcagactgcaggttag

SEQ ID NO: 120462 - DNA, 4011 bp, Artificial Sequence
  Description of Artificial Sequence: Synthetic coding sequence
atgaccctggacagacccggcgagggggcaaccatgctaaagacctttactgtgttgctcttttgcattcgtatgtcgctgggcatgaccagcattgtgatggacccccagcccgagctctggatcgagagtaattatccgcaggccccttgggaaaacattacactctggtgtaggtctccttcccggatttcgtccaaatttctgctgctgaaagataagactcagatgacctggatacgtccttcccacaagacctttcaggtgagcttcctcataggtgcccttacagaatccaatgccgggctgtaccgttgctgttactggaaggagaccgggtggtccaaaccatctaaagtgcttgaactggaggcccctggccagctgcccaaacccatcttctggatacaagcagagactccagctctgcccggttgcaacgtgaacatactctgccatgggtggcttcaagacctggtcttcatgttgttcaaagaggggtacgctgaaccagtggactaccaggttcccaccgggacgatggcaatcttcagcatagacaacctgacccccgaggatgaaggcgtgtatatatgccgtacccacatccagatgctgccgacactctggagtgagccatctaaccctttgaagctcgttgtggcaggcctgtaccctaaaccgacgctaacggcgcacccagggcctatcatggccccaggagagtctcttaacctaagatgccaaggtccaatctacgggatgactttcgccctgatgagagtcgaagatctagaaaagtccttttatcataagaagacaatcaagaacgaagctaactttttcttccagtcactcaagatccaggacactggacattatctctgtttctactacgacgcgagttacagaggctctcttctctcagatgtcctgaagatctgggtcaccgatacctttccaaagacctggttgctggcgcgcccatctgccgtggtccagatggggcagaacgtatccctccgatgccggggccccgtggacggagtgggcctggcactctataagaaaggcgaagacaagccactgcagtttctggatgccacatcaatcgacgacaatacctcgtttttcctgaataacgtgacatactccgacacaggtatttactcgtgtcactacctcctcacttggaagacctcaattcggatgccttctcacaacaccgtggagctaatggtggtggacaaaccccctaaaccaagcctgagcgcatggccttccactgtgttcaaacttgggaaggcgatcacattgcagtgccgcgtaagccacccagtcttggagttctctttagagtgggaggagagagaaacgtttcagaagttcagcgtgaacggcgacttcattatctctaatgtggacggaaagggaacgggcacttacagctgttcataccgagtcgaaacacaccccaatatatggtcccaccgctctgaaccactaaagttaatggggccagctgggtacttgacttggaattatgtacttaacgaagccatcagactgtctctgattatgcagctggtggctctgctcctggttgtcttgtggattcgctggaaatgtcggcgtctgcgcataagggaggcttggctgctaggcacggcacaaggtgtcaccatgctgttcattgtaaccgccttgctttgctgcgggctctgtaacggcgtacttattgaggagaccgagatcgtcatgccgacgccaaaacctgaactgtgggccgagaccaactttcctctggctccctggaagaatctcactctgtggtgcaggtccccttcaggatccacaaaagaatttgtactgttaaaagatgggaccggatggatcgcaacaagacctgcaagcgagcaggtgcgagctgccttcccactcggcgccctgacgcagagtcatacaggcagctaccactgtcactcttgggaagaaatggcagtgagcgaacccagcgaagcactggagttagtaggcaccgatattctcccaaagccagtgatttccgcaagtcctaccatacgcgggcaggagctgcagctgaggtgcaagggctggttagccgggatgggtttcgctctgtataaggaaggggaacaggaacccgtccagcagctaggcgcagtgggcagagaggcgttcttcaccattcagcgaatggaggataaggacgaaggaaactatagctgccggacccatacggaaaagaggcctttcaagtggtctgagccctcagaaccgctggaattagtgataaaggagatgtaccccaaacccttcttcaagacatgggcctcgcctgtggttacgccaggagccagggtgacattcaattgctcaactccccaccagcatatgtcatttattctctacaaggacgggagcgagatcgcctcttcagatagatcgtgggccagccccggggcatccgcagctcatttcctcattattagtgtaggcatcggtgatggaggtaattacagctgccgctactatgatttcagtatctggtccgagccatctgaccccgtggaattggtggttaccgagttctatcctaagcccacgctgctggcgcagccaggccccgtcgtcttcccaggaaaatccgtgatcctccgttgtcagggaacatttcaaggaatgcgcttcgcactacttcaggagggagctcatgttccactgcagtttcgctcggtgtctggtaactccgcagatttcttacttcataccgtgggcgccgaggacagcgggaactactcatgtatatattacgagacgacgatgagcaatcgcggtagctatctgagcatgcccctgatgatctgggtgaccgacacatttcctaaaccctggctctttgcagagccgtcgagcgtggtacctatggggcagaatgtaactctctggtgcaggggtcccgttcatggggtcggctatattctacacaaggagggtgaggccacatctatgcagttatggggaagcacctctaacgatggtgccttccccatcacaaacatcagtggcacgagtatggggcgatactcatgctgttaccaccctgattggacctccagtattaaaatacagccatcaaacacgttggagctgctcgtgaccggattactacctaagccttccctcctagcacaaccaggccctatggtagcgcctggcgagaacatgacactacagtgtcagggcgaattacctgatagtaccttcgtgttacttaaggagggcgcccaggagcctctggaacagcagcgccccagcggctaccgggccgatttttggatgcctgccgttcgcggagaggactctggaatctattcatgcgtatactatttggatagcaccccattcgccgcgtctaaccactctgatagcctggaaatttgggtaaccgacaagccaccgaagccatccctgagcgcttggccctccacgatgttcaaactgggaaaggatattacactgcagtgtcgagggcccttacctggggtcgagtttgtgctggagcatgacggagaggaagcaccacagcaattctccgaagacggggacttcgtgatcaataatgtggaaggaaagggtatcgggaattattcttgtagctatcgactccaagcctatccagatatttggtccgagccaagtgaccccttggagcttgttggcgctgcagggcctgtcgcccaggaatgcactgtaggaaacatagtccggtcatccctcatcgttgtggttgtggtggccctgggcgttgtgctggccatcgaatggaaaaagtggccgcgactgagaactcgtggcagtgagactgatgggcgggatcagactatcgccctcgaggaatgcaaccaggagggagagccggggacaccagcaaattctccctccagcactagccaacgtatatcggttgagctgcctgtccccatttag

SEQ ID NO: 120463 - DNA, 729 bp, Artificial Sequence
  Description of Artificial Sequence: Synthetic coding sequence
atgacattggacaggcccggcgaaggcgcgaccatgctaaagaccttcaccgtgctgctgttctgcattaggatgtcactcggcatgactagcatcgttatggatccacaacctgagctgtggatcgagtccaactatccacaggcaccctgggagaacatcacactttggtgtcgttccccctcaaggatctcatcgaagtttctcctgctgaaagacaaaacacagatgacctggattcgcccttcacacaagacctttcaggtgagtttcctcataggcgcgctaaccgaatcaaacgcaggcctttatcgctgctgctattggaaagaaaccggctggtcaaaaccttctaaggtactcgaactggaggctccaggacagctgcctaaacccatcttctggatccaggctgagactcccgcgctgcccgggtgtaacgtgaacattctctgtcacggttggctccaagatctagtgttcatgctgttcaaagaaggctatgctgagcccgttgactaccaagtccccaccggaactatggccatattctccattgacaacctcactccagaagacgagggggtttatatatgcaggactcatatccagatgttaccaaccctatggtctgagccatcaaacccactgaagctcgtcgtcgccgggggttgcggatacgggtgttggcacttggccattgtagtgcctggcattatggcaggctag

SEQ ID NO: 120464 - DNA, 729 bp, Artificial Sequence
  Description of Artificial Sequence: Synthetic coding sequence
atgaccctggatagaccaggcgaaggcgcgacaatgctgaaaactttcaccgtgctcttgttttgtattaggatgtccttgggaatgactagcattgtgatggaccctcagccggagctttggattgagtctaactacccgcaggctccctgggagaacatcactctttggtgccggtcaccctcacgaattagtagcaaattcctcttgcttaaagacaaaacacaaatgacctggattagaccctcacacaagacattccaggtgtcattcctgattggagcactcacggagtcaaatgcaggcctatacaggtgctgctactggaaggagaccggctggtcaaagccaagcaaagtgctcgagttagaagctcctggccaacttcctaagcctatcttttggattcaggctgaaacgccagcattacccggttgcaatgtgaacatcctctgccacggatggctgcaagatcttgtgtttatgctgttcaaagagggatatgccgaacctgtcgactatcaggtcccgactgggacaatggccattttttccattgataatctaacccccgaggatgagggcgtatatatctgccgcactcatatccagatgcttccgacactctggagtgaaccctctaacccattgaagctagttgtcgccgggggctgcggctacggctgttggcacttagccatagttgtgccgggtattatggccggatag

SEQ ID NO: 120465 - DNA, 4026 bp, Artificial Sequence
  Description of Artificial Sequence: Synthetic coding sequence
atgacgctggacagaccaggagaaggggccaccatgttgaagactttcactgtcctactcttctgcatcagaatgtctctcggaatgacaagcattgtcatggacccgcaaccagaactttggatagagtcgaactacccccaggctccttgggaaaatatcacgttatggtgccgctcaccctcacgaatctctagtaaatttctcctgctcaaggacaagacgcagatgacgtggattaggcccagccacaaaacatttcaggtttccttcttaataggggcacttacagagtcaaacgctggcctgtatcgttgctgctactggaaggagactgggtggagcaaaccctctaaagtgctcgaactagaagcccccggccaactccctaaaccgatcttctggatccaagccgagacacctgccctcccaggctgtaacgtcaacattctatgccatggctggttgcaggatctggtgttcatgcttttcaaggaagggtacgctgagcctgttgactatcaggtgcccactggcaccatggctatctttagcatcgataacctcacgcctgaggacgagggtgtgtatatctgtaggacacacatacaaatgctgccaacgttgtggtctgaaccctccaaccctcttaagctcgttgtggctggcctgtacccaaaacctacactgactgcacatccaggtcctatcatggcccccggcgaatctctgaacctgagatgtcaggggccaatctacggaatgacatttgcgttgatgcgggtggaggacctcgaaaagagtttctaccacaaaaagacaatcaagaatgaggcaaatttcttctttcagtcgctaaagatccaagacactgggcattatctgtgtttttattacgatgccagctatcggggtagtctgctatcggatgtgctcaaaatctgggtcaccgacaccttccccaagacatggctgttggccagaccctctgcagtggtccagatggggcagaacgtgtctctccgctgtcggggaccagtggacggtgtggggttggctctgtacaaaaagggtgaggacaaacccctccagttcttggacgcaactagtatagatgacaatacttctttcttcttgaacaacgttacatattctgacaccgggatctactcctgccactacctcctaacctggaagacttccatacggatgcccagtcacaacaccgtagagctgatggtggttgataagccccccaagccctccctttccgcctggcccagcaccgttttcaagctcggcaaggcaatcactctacaatgcagggtgtcacatcccgtgctcgagttcagcctggagtgggaggaacgtgagacatttcaaaaattttctgtgaatggtgacttcatcatctcaaacgtggatggaaaaggaactggaacgtattcttgcagctaccgcgtcgagactcaccccaatatatggagtcacagatcagaaccactaaagttgatgggccctgccggttatctgacatggaactatgtcctcaatgaggcaattcgcctgtctctgattatgcagctggttgccttgctacttgtggtgctgtggatccgctggaagtgtcgcagactgaggattcgggaggcttggctgctgggtacggcccagggggtgacgatgcttttcattgtcacggccttactctgctgtgctatttccttcgctggattatgcaacggagtgctcatagaagaaacagaaatcgttatgccgacccctaagcctgaactctgggcagagactaacttcccgctcgcgccttggaagaacctcacgctgtggtgccgctctccctcaggtagcacaaaggagtttgtcctcctgaaggatggtacagggtggatcgcaacccggcctgcttccgaacaggtacgtgccgctttcccactgggcgcactgactcaaagccacacggggtcatatcactgccactcctgggaagaaatggcagtttcggagccctcagaagcacttgagctcgtcgggactgatattttacccaaacctgtaatttctgcctcgccaacgattcgcggccaagaactgcaactgagatgcaaaggttggctggcggggatggggtttgctctgtacaaagagggtgaacaagagcccgtgcagcagctcggtgctgtgggcagggaggcattctttacaatccaaaggatggaggacaaagacgagggcaattactcatgccggactcatactgaaaaaaggccattcaagtggtcagagccctctgaacccctcgaactcgtgatcaaggaaatgtacccgaagcccttcttcaagacctgggcctcccccgtcgtgacaccgggagcaagagtcactttcaattgctctactccccatcagcatatgtcgtttatcctttacaaagatgggtcagaaatagctagtagtgaccgatcatgggcctcaccaggggcctctgccgcacacttcctgatcatttcggtgggaattggagatgggggtaattatagctgccgatattacgacttctccatctggtccgagccctcagaccctgtggagctggtggtaacagaattttacccgaagcccacactgctggctcagccaggaccagtcgtgtttccaggaaagtccgtgatcctgcgttgtcagggcaccttccagggaatgcggttcgcactgcttcaggaaggtgcacacgtgccgctccagtttcgttcagtctccgggaatagcgccgatttcctgctccatacggtcggagccgaagacagcggaaattattcatgtatctactatgagacaacaatgagcaacagggggtcatacctcagcatgccacttatgatttgggttacggacaccttcccgaaaccatggttatttgccgaacccagttccgtggtaccgatgggccagaatgttaccttgtggtgtagaggccccgtgcatggcgtgggatacatactgcacaaagaaggtgaggcaacttccatgcagctctgggggtcaacaagcaacgacggggctttcccaattaccaatattagcgggactagtatggggaggtactcctgctgctaccaccctgactggacgagtagtattaagatccagccgagcaacactctggagctcttggtgacgggtctgcttcccaagccgagcctgcttgcccagcccgggccaatggtcgcccccggagagaatatgactctccaatgtcagggcgagctcccggactcaacattcgtcctccttaaggagggtgcccaggagcctctcgagcagcagcgcccttccgggtacagggcggacttttggatgcctgccgtcagaggagaggactccggtatatacagttgtgtgtactacctggatagcactcccttcgccgcttcaaatcattccgactcactagagatttgggtcacagataaacccccgaaaccaagtctatctgcctggccaagcactatgtttaagctgggtaaggatataactctgcaatgtagagggccactgcccggtgtggagtttgttctcgaacacgacggagaagaagctccccagcagttttccgaggacggtgatttcgtaatcaacaacgtcgaggggaagggaatcggcaactattcctgcagttaccgtctccaggcctacccagatatttggagtgagccatccgaccccttagagctggtgggtgcagccggacccgtggcacaagagtgtactgtggggaacattgtgcgcagctccttgatcgtggtagtggtcgttgccctaggtgtagtcctcgcaatcgagtggaaaaaatggccgagactgcgtaccagaggctccgaaacagacggaagggaccagaccattgccctcgaggagtgtaatcaggagggggagccaggaacaccagcgaactcgccctcttccacctcccagcgcatttccgttgaactgccagttcccatttag

SEQ ID NO: 120466 - DNA, 3984 bp, Artificial Sequence
  Description of Artificial Sequence: Synthetic coding sequence
atgacgcttgataggcctggcgagggagccacgatgctcaaaacatttaccgtgctgttgttctgcattctgatggatcctcaaccagagctgtggattgagtccaactatccccaggccccttgggagaatattacactgtggtgccgttcaccttcacgcatctcaagcaagtttctgctgcttaaggacaagacccagatgacatggatccgtcctagtcacaagacattccaggtttccttcctgattggagctctgaccgagagtaatgccggactctacagatgttgttattggaaggagacaggttggtcaaagccatctaaagtgcttgagttagaggccccagggcaactgcccaaaccaattttctggatccaagcggagactcccgccttgcctgggtgcaacgttaacatcctctgtcacggctggctgcaggacttggtgttcatgttgtttaaggaggggtatgctgagccagtggactaccaggttccaacaggcaccatggcaatcttctcaattgataatctgacccccgaagacgaaggggtgtacatctgtcggacacatatccagatgttgcccacattgtggtctgaaccgtcgaaccctctgaagttggtcgtagccggactctatcctaagcccaccttaactgcacatccagggcctataatggcgcctggagagtcattaaacctccggtgccaaggccccatctatggaatgaccttcgcacttatgcgggtagaggatctggagaaaagcttctatcacaagaagacgataaagaatgaggcgaattttttcttccagagcctgaaaattcaagacacaggtcattacctttgtttttattacgatgccagttatcggggcagtctgctgagtgatgtgctgaagatctgggtgacagacacatttccaaagacgtggctgctagctcgcccatcagccgttgtgcaaatggggcagaacgtatctttgaggtgtaggggcccagtggatggagtgggtctcgcgctgtataagaagggagaagataaacccctgcagtttttggacgctacatccatcgacgacaacacatccttcttcctcaacaatgttacctacagcgacacaggaatttactcctgtcactatctactgacctggaaaacatccatccggatgcccagccacaatacggtggaattaatggtggtggataaacctccaaagcctagtctgtccgcgtggccttccaccgtcttcaaacttgggaaagccatcaccctgcagtgccgggtatctcatcctgtgctggaattctcgctcgagtgggaggaaagggaaaccttccagaaattctcggttaacggcgactttatcatcagtaacgtggacggcaagggcacaggaacctacagttgctcttaccgggtggaaacccaccccaatatctggtctcaccggtcggaaccccttaagctgatgggacccgctggatatttaacctggaactacgtgcttaacgaagcgatacgcttgtcattaattatgcagctggttgctttgttgctggtggttctgtggatacgatggaagtgccgtagactccgaattcgcgaggcctggctcctgggcactgctcagggagtgaccatgctgttcattgtgaccgccctgctgtgctgcgggctgtgcaacggtgtgctcatcgaagaaactgagatcgtgatgcctacgcctaagcccgaactgtgggcagagaccaactttcccttagccccttggaaaaacctgacgctttggtgtcgatctccaagcggttccactaaggagttcgtacttcttaaggacggcaccgggtggatcgccacacgccccgcgtccgaacaggtacgggccgcctttcctctaggcgcactgactcagtcccacactgggtcctaccactgtcattcctgggaagagatggcggttagtgagccctccgaggcacttgaactcgtaggtaccgatattctccccaagcccgtgataagcgcttcccctacaatcaggggccaggagctgcagctgagatgtaaggggtggttggctggtatgggattcgcactatataaagagggtgagcaggaacccgtacagcagctgggggccgttggccgcgaggcgtttttcacaattcagcggatggaagataaagacgagggaaactattcctgtagaacacacacagagaagcgaccttttaaatggtcagagccttccgaacctttagaactagtgataaaggagatgtaccccaaacctttcttcaaaacatgggcctccccagttgtgactccaggtgctagggtcacgttcaactgcagcaccccgcaccagcatatgagcttcatactgtataaggatgggtccgagatcgcatctagcgacagatcctgggcgtcgcctggggcttcagccgcccacttcttgataatttccgtcggcattggggatggtggtaattattcctgccgatactacgacttctctatatggagcgaaccctcagatcccgtggaactggtcgtgactgagttctatcctaaaccaacgctgctggcccaacctgggccagtcgtattccccggcaaaagtgtcattctgaggtgccagggtacttttcagggaatgcggttcgcattgctccaggagggtgcgcacgtacccctgcagttcagatctgtgagcgggaatagtgcggatttccttttgcacactgtcggcgcagaggacagtgggaactactcctgcatctactatgagactactatgagcaatagggggtcttatcttagtatgcctcttatgatctgggttaccgatacttttcctaagccctggttatttgcggagccaagtagcgtggtgcctatgggccagaacgtgacactgtggtgtagaggcccagtccacggagtcggatacatccttcacaaagaaggcgaagccacttcaatgcagctctggggctcaacgtctaacgatggagctttccctattactaacatctctggcacttcgatggggaggtattcctgctgttatcaccccgactggacatcttcgattaagatccagccatcaaacaccctcgagctgcttgtgaccggtctgctccccaagcctagcttgctagctcaacccggaccaatggtagcccctggagagaacatgacactgcaatgccagggggagctccccgactctaccttcgtactcctcaaggaaggtgctcaagagcctcttgagcagcagcgcccttccggctatcgagccgacttttggatgcctgccgtccgaggcgaagatagcggcatttacagctgcgtgtactacctcgattccacaccttttgccgcaagcaatcattccgacagcttggagatctgggtgaccgacaaaccccctaaaccatcactgagtgcgtggccgtctacaatgttcaagcttggtaaagatatcactctccagtgtagggggcctctgccaggcgtcgagtttgttcttgaacatgacggcgaagaggctccgcagcagttcagcgaagatggcgatttcgtcattaacaatgtagaaggcaaagggattggcaactacagttgctcttaccggttgcaagcctaccctgatatttggtctgaaccttcagaccccctggagttggtaggtgccgccggaccagtagctcaggaatgcacagtggggaatatcgtgcgctcctccctcatcgtggtggttgtggtggcgctaggtgtagttcttgccatcgagtggaagaaatggcctagactgagaacacgaggctccgaaactgatggcagggaccagactatcgctctggaggagtgcaatcaagaaggagagccggggactccagctaattcaccaagcagcactagtcaacgaatttccgtcgaattaccagtaccgatctag

SEQ ID NO: 120467 - DNA, 3984 bp, Artificial Sequence
  Description of Artificial Sequence: Synthetic coding sequence
atgacgttggaccgtcccggtgagggagcaactatgttgaaaacctttaccgttctgctgttttgtattttaatggatcctcaacccgaactgtggatcgaatccaactacccgcaagcaccctgggaaaacattacactgtggtgccgctctccctcccggatcagcagcaagtttctcctcctgaaggataagactcagatgacttggatccgccctagtcacaaaacttttcaggtctctttcctgataggggccctaaccgagtccaacgccggactctatcggtgctgctactggaaggaaaccggttggagcaagcccagcaaagttttagagttggaagcccctggccagttaccaaagcctatcttttggattcaagcagagacccctgctttgcctggttgcaatgtgaatatcttgtgtcatggttggctccaggacttggtctttatgttgtttaaagagggctatgcggagccagtagattatcaggtccctacaggaactatggctatcttctcaatcgacaatctgacccccgaagacgaaggagtatacatttgcaggacacacatccagatgctacccacactgtggtccgaacccagcaatcccttgaagctagtcgttgctggcttgtatcctaaacctacccttaccgctcatccgggacccatcatggctccaggggaaagtttgaatctgcgctgtcaaggccccatatacgggatgacctttgccctcatgcgggtagaggacttggagaagagcttctatcataagaagacgatcaagaacgaggctaacttttttttccaaagcttaaaaatccaggatacaggacattatctgtgcttctactacgatgcatcgtatcgagggtctctcctgtccgacgtgcttaagatctgggtgaccgacaccttccccaaaacatggctgctggcacgcccctccgcagtggttcagatgggtcagaacgtgtcattgcggtgtcgaggaccagtcgatggggtgggactggcattgtacaagaaaggtgaggacaagcccctgcagttcctggatgctacgtcaatcgacgacaatacttccttcttcctcaataacgttacatacagcgacactggaatttactcttgccattacctcctgacttggaagaccagcatccgcatgccctcccacaataccgtggaactgatggtcgtagacaagcctcccaaacctagcctgagcgcttggccatccaccgtgttcaaactagggaaagcaattactctccagtgtcgagtgtctcatcctgtcctggaattctcactcgagtgggaggaacgcgagacatttcagaagttttctgtgaatggggacttcataatttccaacgtggatggaaaaggcacaggcacctacagctgttcttatagggtggaaacacacccaaacatctggtcccaccgcagcgagccgttaaagctgatgggcccggccgggtatctgacctggaattatgtgttgaacgaagctattaggctcagcttaattatgcagctggttgcgctactgctggtggtactttggattaggtggaaatgcaggcgcctccgcatccgcgaggcgtggcttctgggcacagcccagggcgtgacgatgttgttcatagtgactgccttgctctgctgcggactgtgcaacggagtgctcatcgaggagaccgagatcgttatgccaaccccgaaaccggaactatgggcagagaccaactttcccctcgctccttggaagaacttaaccttatggtgtcggtcaccgtccggctcaaccaaagagtttgtgctgctgaaggacggaacaggctggattgccacccgccctgcaagtgagcaggttagggccgccttccccctgggggctctgacccagtcacacaccgggtcctaccactgccactcttgggaagaaatggccgtttctgaacctagcgaagccttggagttggtcggcaccgatatcttgccaaagcccgtgatatctgccagtcccaccatccgcggacaggaattgcagctccggtgcaagggctggcttgccggtatgggatttgccctttataaagagggagaacaggagcccgtgcagcagcttggggcagtgggccgcgaggcgttttttaccatccagcgcatggaggataaggatgagggcaattactcttgtcggacgcacacagagaagcgtccattcaaatggtcggaaccgagtgaaccactcgaactggttattaaggagatgtacccaaagcccttttttaagacctgggcttccccagtggtaacacccggcgctcgtgtaacttttaactgctctactccccaccagcacatgagctttatactgtataaggatggatcagaaattgcatctagcgatcggtcgtgggcgtcaccaggcgcaagcgccgcccactttctgataatctcggtgggcatcggagatggggggaactactcttgtcgctactacgacttctcaatttggtccgaaccctccgatcctgtggagctggtggtcacagaattttaccccaagcccacactcctcgcccagcctggcccagtggtctttcccggcaagagcgttatcttaagatgccaggggacctttcaggggatgcgctttgctctcttgcaagagggcgcccatgtgccactacaattcagatctgtaagcggcaactcggctgacttcctactccatacagttggggccgaggactccggtaattattcatgcatttactacgagactacaatgagcaataggggatcctacctgagcatgccacttatgatctgggtgacagatactttccccaaaccgtggctgtttgccgagccaagttccgttgtgccaatggggcagaacgtgacactgtggtgtaggggtcccgtccacggagtaggctatattttgcacaaagagggagaggccacatcgatgcagctctggggatccacttcgaatgacggagcttttcctattacaaatatttcgggcacaagcatgggacgatactcttgttgttatcaccccgactggacgtcatctattaaaattcagccttcaaatacgctagagttactggtcacaggcctgctgcccaaaccttccctgctggcccagcccggacccatggtcgcccccggggagaacatgacccttcaatgtcagggtgaactgcccgattccacctttgtcctccttaaagaaggcgcccaggaacccctcgagcagcagaggccatcaggctacagggctgacttctggatgcctgctgtccgcggtgaggacagcggtatatactcctgcgtctattacctggattccaccccctttgctgcctccaaccattctgacagtctggagatttgggtgacagataagccccctaagccgtccctgtccgcatggcctagcaccatgttcaagcttggaaaggatatcactttgcaatgccgaggccctctgcccggcgtggaattcgtcctggagcacgacggggaggaggccccccagcagttctctgaggatggtgactttgttatcaacaatgtggagggcaaaggaattggtaactattcgtgttcgtaccggctccaggcttacccagacatttggagtgaacctagcgatccactagaactcgtaggtgcagccgggcccgtagcccaggagtgtaccgtgggaaatatcgtccgatcgtcactcattgtggtagttgtagtcgcactcggagtggtcctggcaatcgagtggaagaaatggcctcgccttcggacaaggggctcggagactgacggccgcgaccaaactattgccttagaggaatgcaaccaggagggagagcctggaacccctgccaactccccctctagtacttcccagcgcatttctgtagagttacccgtcccaatttag

SEQ ID NO: 120468 - DNA, 3645 bp, Artificial Sequence
  Description of Artificial Sequence: Synthetic coding sequence
atgaagtgtttctttcccgtactgagttgtttggccgtgctgggggtggtgtccgcccagcgacaggtaacagtgcaggaaggacccttatatcgtaccgaagggagccacatcacaatctggtgcaacgtgtcaggttaccagggcccaagcgaacagaacttccaatggagcatctacttgccttcctcaccagagcgggaagtccagatcgtcagtaccatggatagctccttcccatatgccatttatactcagcgggttagaggcggcaaaatcttcatcgagcgcgtccaggggaattcaaccctgctgcacattacggatttacaggcgcgcgatgccggcgagtacgagtgtcatactcctagtactgataagcagtattttgggtcttattccgccaaaatgaatctggtggtcattccggatagtcttcagacgaccgctatgccacagactctgcaccgcgtagaacaagacccactggaactcacttgcgaagttgcaagtgaaacgattcagcactctcacctctccgtggcctggcttaggcaaaaggtcggcgagaaacctgtggaggtaataagcctgtcacgagattttatgctccattcatcgagcgaatacgctcaaagacagtccctgggcgaagttcgtctggacaagcttggtcggaccacgttccgtcttacaatcttccatctgcagcccagcgaccagggggagttctattgtgaagcagcagagtggatccaggaccccgatggcagctggtacgccatgaccagaaagcgttccgagggcgccgttgtcaacgtccagcctaccgataaagaattcacagtaagactggaaaccgaaaaaaggcttcacacagtgggggagcccgtggagtttaggtgtattttagaagcccagaatgtgcccgaccggtatttcgctgtgagctgggcctttaacagctccctcatcgcgaccatgggccctaatgcggtcccagttctcaattcagagttcgcacaccgcgaggcacggggacagctgaaggtcgcgaaggagtcggattccgtgtttgtcctaaagatataccatctccgccaagaagatagtggaaagtacaactgccgcgttactgagagggagaaaaccgtaactggcgaattcattgataaggagtctaaaagacctaagaacatcccaataatcgttctgccactgactgataactgggtcgttaaggtgcctcagcatcaccagctgttatcccagggtcatctggaatcatcaatttctgtggaggtcgcctctaacgcctctgttattttggagggggaagacttgcggttctcttgtagcgtgaggacagcgggaagaccacaggggaggttttccgtgatatggcagttagtggacaggcagaatagaaggtctaatataatgtggctggatcgggacgggaccgttcagccagggagctcctattgggaaaggtcatccttcgggggtgtccaaatggagcaggttcagccaaattcattttcactcggaatattcaatagccggaaggaggacgaaggacaatacgaatgtcatgtgacggagtgggtgcgggccgtagatggtgaatggcagattgtgggggaacggagggcctccacccccatctctatcacggcacttgagatggggttcgctgttacagccatttcccgcaccccaggggtgacttattccgacagcttcgatctacagtgcatcatcaagccgcattatcccgcctgggtgccagtgtcagtgacctggagatttcaacccgtcggcaccgtggagtttcacgatcttgtgacattcactagagacggaggggtgcagtggggagaccgcagctcctcgtttcgcacgcgtacggccatcgaaaaagcagagtcctcaaataatgtgagactcagtatctctcgggcaagcgacactgaagcaggaaaataccaatgcgtggccgagctgtggcggaagaattataacaatacttggacgagactggcagagcgcacctctaatcttctcgagattagggtgctacagcccgtgactaaactgcaggtcagcaagagcaagaggaccctgactttggtcgagaataaacccattcagctcaactgttcggtgaagagccagacttcccaaaattcccattttgcagtgctatggtacgtgcacaagccatctgacgctgacggcaaattgattctgaaaactactcacaactcagccttcgaatacggaacttatgcggaagaggaggggctacgggccaggctgcaatttgaaaggcacgtatcgggtggcctgttcagccttacagtacagcgcgctgaagtaagtgattctggtagctactattgtcacgtggaagagtggctgctgagccctaattacgcttggtacaaactggccgaggaggtctctgggcgcactgaggtaactgtaaaacagcctgatagcaggcttaggttaagccaggcccagggcaacctgagtgttctcgagacccgccaagtgcagctggaatgcgtagtgctgaaccgaacctccattactagtcagctgatggtggagtggttcgtttggaaacctaaccaccccgaaagagaaactgttgcgagactgtcccgcgatgctacctttcactatggcgaacaggctgctaagaataatctgaagggaaggctccacctggagtcaccatcccctggcgtctatcgacttttcattcaaaatgtggccgtacaggacagcggtacttactcctgccatgtcgaggagtggttgccttcacctagcgggatgtggtacaagcgagccgaagacactgctggccagaccgcactcacagtcatgaggccggatgcatctctccaagtcgataccgtggtgccgaatgccacagtcagcgaaaaagccgctttccagcttgactgtagcatcgtcagtagatctagccaggacagccgattcgccgtcgcctggtatagcctcaggacaaaggccgggggtaagcgtagttctcctggacttgaggaacaggaggaggagcgcgaggaggaggaagaggaggatgatgatgatgacgatgatcctaccgaacggactgctctgctgagcgtcggccccgatgctgtgttcggaccagagggaagtccctgggaggggcgactgagatttcagcgactcagtcccgtactgtacaggttaaccgtgctgcaggcctctccccaggacactggaaattattcgtgccacgtcgaagagtggctgccatccccccagaaagagtggtataggctcactgaggaagaatccgccccaatcggaatccgggttctcgacacttccccaacactccagtccataatttgtagtaacgacgccctcttttactttgtgtttttctaccctttccccatctttggtatcctgatcataacaatactcctggtgcggtttaagtccagaaacagctccaagaacagcgacggtaaaaacggggttccccttctgtggatcaaggaaccacatttaaactacagccctacgtgtttggaaccaccagtcttaagtattcaccccggggcgatagactag

SEQ ID NO: 120469 - DNA, 3645 bp, Artificial Sequence
  Description of Artificial Sequence: Synthetic coding sequence
atgaagtgtttcttcccagtactgtcctgtctcgctgtattgggggtcgtgagtgcacagaggcaagtgaccgtgcaggagggaccactctacaggacggaaggttctcatatcacaatctggtgcaatgtgtctggctaccagggccccagtgaacagaacttccagtggagtatttatctgccctcctcccctgaacgcgaagtgcaaatcgtgagcactatggattcaagcttcccatatgccatatatacgcagcgagtaaggggcgggaaaatctttatagaacgcgtgcagggtaacagcaccctcttgcatataactgacctccaggctcgagacgcgggtgagtacgaatgtcacacgccatccacagataagcaatattttggctcctactctgcgaaaatgaatctggtcgtgatacccgattccctgcagacgaccgctatgccacagacactccatcgagtggaacaggaccctctggaactgacatgcgaggtcgcttcggagaccatccagcattcccatctgagtgtggcttggctgagacaaaaggtcggggagaaacctgtggaagttatcagcctgagccgggacttcatgctccattcctcgtcagagtatgctcagcgccagtccctgggagaggtgcggctggataagctaggaaggaccactttccgcctcacaatattccacttgcaaccatccgaccaaggagagttctactgtgaagccgctgagtggattcaggacccggatggctcatggtatgccatgacccgtaagcgctcagagggggcagttgttaacgtacagccaaccgacaaagaatttaccgtgcgccttgaaacagaaaagcgactgcatacagtcggagagcccgtagaattccgttgcattttggaggcgcagaacgtgccggatagatattttgccgtgagttgggcctttaatagctccctcatcgcaacgatgggaccaaatgcagttccggtcctgaacagtgagtttgctcaccgagaggccaggggtcagctgaaagttgctaaagagtctgactctgtgtttgtactcaagatctaccacttgcggcaggaggacagtggaaaatataattgcagggtgaccgagagggagaagacggtaactggggaattcattgataaggagagcaaaaggcccaagaacatccctataatcgtgctgcctctgactgacaactgggtcgtaaaagtcccccagcatcatcagctgctgtctcagggccacctggaatctagcatttccgtggaggtcgcatcgaacgccagcgtgattttggaaggcgaggatctccgtttctcctgcagcgtcagaacagcaggtagaccgcaggggcggttcagtgtcatctggcagctcgttgaccgacaaaacagacggtctaacatcatgtggcttgatcgtgatggcacagttcaacccggcagctcttattgggagcgttccagcttcggaggagtgcagatggagcaggttcagcccaatagcttctcattgggcatcttcaatagtagaaaggaagatgagggccagtatgagtgccacgtaactgagtgggtacgtgcggtggacggcgaatggcaaattgtcggggagcggcgggcctctacccccatcagcattactgcactggagatgggttttgccgtgaccgctatttccaggactccaggggttacatactctgattctttcgatcttcagtgtatcataaaaccacactacccggcctgggtgcctgtgagcgtgacttggcgctttcagcccgtcggcactgtggagttccacgacctggtcacttttacgcgggatgggggagtgcagtggggagataggagctcctcctttaggacacgcaccgcgatcgaaaaggctgaatcctcaaataacgtacgactgtccatttcgcgcgcatccgatacagaagctggcaagtaccagtgcgtggccgaactctggagaaaaaattacaataatacctggactagactggccgaacgcacctccaatctactggagattagagtgcttcaaccagtgacaaagctgcaggttagcaagtccaaaaggacgctgacactggtggagaataagcccattcagctgaactgctctgtgaaatcgcagacaagtcagaacagccacttcgccgttctctggtatgtccataaaccatccgacgcagacggcaagcttatcctgaaaacaacacataacagtgcattcgaatatggcacctacgcggaggaggaaggacttcgagcacgactccagttcgagcgccatgtgtctggtggactgttctcactaacagtccaacgggctgaggtctccgactccgggtcatactattgtcatgtagaggaatggctgttgagcccaaactatgcatggtacaaactggccgaagaggttagcggtaggacggaggtcacagtcaaacaaccagatagtcggctgcgactgagccaagcgcaaggaaacctttctgttttggagaccagacaggtgcaactggagtgcgtggtgttaaaccgaacaagcatcacctctcagctgatggtggagtggtttgtgtggaagcccaaccatccagagcgcgagaccgtggccaggttgtctcgagacgcaaccttccactatggtgaacaagctgctaagaacaatttaaaagggcgcttacaccttgaaagcccatctcccggagtgtaccggcttttcatccagaacgttgccgtgcaagactctggtacatacagttgccacgtagaggagtggctgcccagtccttctggtatgtggtataaaagggcggaggacacagcaggccagaccgctctgacagtgatgaggccagacgcaagcttgcaagtcgatactgtcgtaccgaacgccacagtctccgagaaagccgcctttcagctggattgctcaatagtatctcgcagcagccaggattcccgctttgccgtagcctggtacagtctcagaactaaagcaggcgggaagcgcagctcaccagggctggaagagcaggaagaggagagggaggaagaggaggaggaagatgacgacgacgacgacgaccccaccgagaggacagcactgctttctgtcggcccagatgccgtgtttgggcccgaaggctccccctgggagggacgcctacgctttcagcgcctgagccctgtattgtaccgtctgaccgtgctacaagcctctccccaggacaccggcaactattcttgccacgtagaggaatggcttccgtcaccccagaaagagtggtatagactgacagaagaagaatccgcccccattggcattagagtgctggacacttctcccacgctgcagtctataatatgctccaacgatgccctcttttattttgtcttcttctatccatttccgattttcggcatcctgatcatcacaatcctgctggtgagattcaagtctcggaatagctcgaagaactccgacggaaagaacggcgtccctttactgtggattaaggagccacatctgaactattctcctacctgtctggagcctcccgtactgtctattcaccccggggccattgattag

SEQ ID NO: 120470 - DNA, 3585 bp, Artificial Sequence
  Description of Artificial Sequence: Synthetic coding sequence
atgaagtgtttttttcctgtattaagttgcctagccgttctgggagtggtgagcgcgcagcgtcaggtgaccgttcaggaggggccattgtaccgaaccgagggtagtcacataaccatctggtgcaacgtatccggctaccagggcccgtccgagcagaacttccagtggagcatctatctgccttcctcgcctgaaagggaggtgcaaattgtaagtacaatggattcatcgtttccctacgctatttacacgcagagggtgaggggggggaaaatcttcattgaacgggtccaaggaaactctactttgttgcatatcacggacctgcaagcacgggacgcaggagaatacgagtgtcatacccccagtaccgataaacaatattttggtagttactctgctaaaatgaatttagtggtgatcccagacagtctgcagacaaccgctatgccccaaaccctccacagagtggagcaggacccccttgaattaacatgcgaggtcgctagcgagactattcagcactcacatctgtctgtagcgtggttgcggcaaaaggtgggggagaagcctgtggaggtcatctctctgtcccgcgatttcatgcttcacagctcctcagagtatgctcagcgtcagagcctgggagaggtgcgtttagacaagctgggtcgcaccacatttcggctcacaatctttcatctgcagccatctgatcagggagagttttactgcgaagcggccgagtggatccaggacccagacgggtcatggtatgcaatgactcgcaagagaagtgaaggtgccgtggttaatgtgcaaccgaccgacaaagagtttaccgtgcgcttagagactgaaaaaagactgcacaccgtgggcgaaccggtggaattcaggtgtattctggaagcccaaaacgtaccagacaggtatttcgctgtcagttgggcctttaatagtagcttgatcgccactatggggcccaacgccgtgcccgttttaaacagcgagtttgcacatagagaggcccgcggccagcttaaggtcgccaaggagtcggacagcgttttcgtgttgaaaatctaccacttaaggcaggaagattccggcaaatataactgtcgggtgaccgagcgtgagaaaaccgtgactggcgaattcatcgacaaggaatcaaagagacctaaaaatatcccgatcatagtcctaccattgaaatcctccatctccgtcgaagttgcatcaaacgcgtccgtcattctggaaggagaggacttgaggttttcatgcagcgtacgcactgccggccgcccccagggtcgcttttcagtaatatggcagctggtcgacaggcagaataggcgctccaatattatgtggctggatagggatggcaccgtccagcccgggtctagttactgggagcgctccagctttggaggagttcagatggagcaggttcagcctaatagcttctctctcggcatctttaactccagaaaggaggatgaaggccagtatgagtgccatgtcactgagtgggtgcgcgccgtggacggagagtggcagatagtgggagagaggagagcctccacacctatttccatcactgctctcgagatgggctttgctgtgaccgcgatttcccggaccccgggggtcacatattccgactccttcgatcttcagtgtatcatcaagccgcattacccagcctgggtcccagtcagcgtgacatggcgatttcagccagtgggcactgtcgagtttcacgatctcgttacattcaccagagacggcggcgtccagtggggcgatcgcagttcttcctttcggacccggacagccatcgaaaaggcagagagcagcaataatgtgaggctgagcatcagtcgagcttctgacacagaggccggcaagtaccagtgtgtcgccgaactatggcgcaaaaactataacaacacatggactcgacttgcagaacgcacctccaaccttttggagatacgcgtgctccagcctgtaaccaaactgcaggtgtccaagtcaaagaggacgctgaccctagtggaaaacaaacctatacagctgaattgttccgtcaagtcccagacttctcagaacagtcatttcgctgtcctctggtatgtgcacaaaccatccgatgccgatgggaagctgattcttaaaacaacccataactcggcttttgagtatggaacgtatgcggaggaggaagggcttagggccaggctgcagttcgagagacacgtgagtggtggtcttttcagcctgacagttcagcgcgctgaggtatccgattccggttcttattactgtcatgtcgaagaatggctgctgtccccaaattacgcctggtacaagctggcagaggaagtttccgggcgaaccgaagtgactgtgaagcagcccgactctcgattaagactgtcccaggcccaggggaacctgtcagtgttggaaacacggcaggtacagctcgagtgcgttgtgctcaacagaaccagtattaccagccagttaatggttgaatggtttgtatggaagcctaatcacccagagagggagactgtggcccgcttatctcgggatgccaccttccattatggtgaacaggcagccaagaataacctgaaaggtagactgcacctggagtctcccagtcccggcgtttaccggctcttcattcagaacgtggctgtccaggacagtggaacatacagctgtcacgtggaggagtggcttccgagtccatctgggatgtggtacaagagggccgaggatactgccggccagacggccctgacggttatgcggccagatgccagcctgcaagttgacaccgtggtgcctaacgccaccgtctcagagaaggccgctttccagctcgattgttcaattgtctcacggtccagtcaggactcccggtttgccgtagcatggtattccctgagaactaaggcaggtggcaagagatcgagcccgggactcgaagagcaggaagaggaacgggaagaagaagaagaagaggacgacgatgacgatgacgaccccaccgagagaactgcgttactgagtgtgggtcctgacgccgtttttggccccgagggttccccgtgggagggccgtctgaggttccagagactgtctcccgttctgtaccggctcacagtgttacaagcatctccccaagatacaggcaattacagctgccacgtcgaagagtggctgcctagccctcagaaggagtggtatcgcctgaccgaggaggagagtgcccccattgggattcgcgtgcttgacacatcccccactctccagtcaattatttgtagcaacgacgccctattttactttgtatttttttaccccttcccaatctttggcattctcatcattacaatcctgctggtgcgctttaaaagtcggaatagcagcaaaaactctgacggaaaaaacggcgtgcctctcctgtggataaaggagcctcacctcaactattctcctacctgcctcgaaccccccgtgctcagtatccatccaggcgctatcgattag

SEQ ID NO: 120471 - DNA, 726 bp, Artificial Sequence
  Description of Artificial Sequence: Synthetic coding sequence
atgggaaccgcatctcgctctaatatcgctcgccacctgcagactaatctcatacttttctgtgttggagccgtgggagcgtgtactttatcggtgacacagccgtggtatctggaggttgattatacacacgaagctgtgactatcaagtgtacattcagtgccacgggttgcccaagtgaacagccaacgtgtctctggtttagatatggagcccaccagcctgagaatctctgtctcgatggctgcaaaagcgaagccgacaaattcaccgtgcgggaagccctaaaggaaaatcaggtgtcactgactgtcaatcgagtgacctctaacgacagcgcaatctacatctgtggtatagcgttcccgtccgtcccagaagcccgggcaaaacagaccggcggtggaaccacgttggtagtcagagagattaaactcctgtccaaagaactaagatcttttcttaccgccctagtgtcattgctctccgtgtatgttactggggtctgtgtggcatttatactgcttagcaagtccaagtcaaatcctcttcgtaataaagaaatcaaggaagatagccagaaaaagaagtctgcacgacgaatctttcaagaaatcgcccaggagctgtatcacaaacgacacgtggagaccaaccagcagagcgagaaggacaataacacctatgaaaaccgtcgcgttctatctaactacgagcgcccctag

SEQ ID NO: 120472 - DNA, 1842 bp, Artificial Sequence
  Description of Artificial Sequence: Synthetic coding sequence
atgggcgcactaagacccacgctgctgcctccctctcttccattgttacttctgctgatgctaggcatggggtgttgggcacgcgaggttctggtaccagaagggcctctgtacagggtggccggcaccgctgtcagcatttcatgtaatgtgacaggctacgagggccccgcacagcagaacttcgaatggttcctctaccggccggaagctccggacactgcgctgggaattgtcagcacaaaggatacacagttctcttacgccgtcttcaagtcccgggtggtcgctggggaggttcaggtccagcgcttgcaaggtgacgctgtcgtgctcaaaatcgcacgcctgcaggctcaagacgcaggtatatatgagtgtcataccccctccaccgatactcggtatcttggatcttattcaggaaaagttgaactacgcgttttgccagacgtgcttcaggtctctgccgccccacccggcccccggggtagacaggctcctacgtctccgcccaggatgacagtgcatgagggacaggaattggctctgggttgcctagcaaggaccagtactcagaagcatacacacctggccgtctcatttggaagatctgtccctgaggctcctgtaggccgcagtacgctgcaagaggtcgtcgggatccgcagcgatctcgctgtggaggcaggcgccccctatgctgagaggctggcagccggagagttgcggttagggaaagagggaaccgataggtatcggatggttgttggcggggcccaggcaggagacgcagggacttaccactgtacggccgccgagtggatccaggacccagatggcagctgggcacagatagcagagaagcgggcagtgttagctcatgtggatgtccagacactgagctcccaattggcagtcaccgtcggacccggtgagaggagaatcggtccgggggaacctcttgagctcctttgcaacgttagtggggcactaccccctgcagggcgacatgcagcctattcggtgggatgggagatggccccagcaggcgcgcctggtcccggccgactggtcgctcaacttgatactgagggtgtgggttccctcggcccaggctacgagggccgacacattgctatggaaaaggttgccagcagaacctaccgcctgcggctggaagccgcacgaccaggtgacgctgggacttatcgctgtctagctaaggcctatgtccgtgggtcgggaacccgcctccgcgaagcagcttcagcccggtcccgtccactcccagtgcacgtgagagaagagggtgtggtgctcgaagccgtggcctggctggccgggggcactgtgtacagaggcgagactgcatccttgttgtgcaacatcagcgtgcgaggcggcccacctggcctgcgacttgccgcatcctggtgggtagagcgccccgaagacggtgagctttcttcagtcccagcacaacttgtcggaggcgtcgggcaggacggcgtggcagagttaggagtgaggcccggcggcggcccagtctctgtggagctggtgggccctaggtcccatcgcctgcggctccattcactgggacctgaagacgaaggggtgtatcactgcgccccatccgcttgggtgcagcacgccgattattcctggtatcaggcgggcagcgcacggtctggacctgtgaccgtttacccgtacatgcatgctcttgataccctatttgtccctttactggtgggaacaggggtcgccttggtgacaggtgcgacagtcctgggaactatcacctgctgcttcatgaaacgcttgcgcaagcgttag

SEQ ID NO: 120473 - DNA, 1581 bp, Artificial Sequence
  Description of Artificial Sequence: Synthetic coding sequence
atgggtgctctgcgccctactctcttacctccatctctcccattgttactcctgctgatgctggggatgggctgctgggcaagggaggtactggtgccggaaggcccactttatcgcgtggccggaacagctgtgtcaatttcatgtaatgtgaccggatacgaaggccccgcccagcaaaacttcgagtggttcctctaccgcccagaagcccccgataccgcgctaggaattgtgtctactaaggacacacaatttagttatgcagtctttaaaagccgtgtggttgcgggcgaggtacaggtccaacggctccagggggatgctgttgtgctcaagattgctagactccaggcccaggatgcagggatatacgaatgccatactcccagcaccgacacacgatatctcggttcatactctgggaaggttgagctccgcgtgctgcccgatgttctgcaggtctcggcagcgccgccagggccaagagggaggcaggcacctaccagtcctcctcgcatgaccgttcacgaagggcaggaactcgccctcggctgcctagctcggacgtccacccagaaacacacgcacctggccgtgagtttcggtcgttccgtcccggaggcccccgtgggccgtagcacactccaggaagtcgtggggattcgcagcgatcttgctgtggaggccggcgccccttacgccgagagactcgccgccggggaattacgcctcgggaaggagggtactgaccgctataggatggtggttggaggagcccaggctggcgacgctgggacctatcactgtacagccgccgaatggattcaggatccggatggcagttgggcacagatcgctgagaagagagccgtgcttgcccatgtggatgtgcagaccctcagttcacagctggccgtcaccgtcgggccaggcgaaaggcgcatcggacctggggaacctctggaattactgtgcaacgtgtccggagccttgccacccgccgggcggcacgccgcatacagcgtgggatgggaaatggcaccagccggcgcccccgggccgggccgcttggtagcccaactggatactgaaggtgtgggaagcctgggccccggttatgagggacgccacattgcaatggaaaaggtcgcctcgagaacttatcggctgcgtttggaggctgcacgcccgggagacgcaggcacgtataggtgcttggctaaagcgtatgtgcgaggcagcggcacgcggcttcgggaagcagcgagcgcccgctccaggcctcttcccgttcacgtcagagaagagggagtagtcctggaggctgtggcatggctggcaggaggcactgtttatcgcggcgaaaccgcctctctgctgtgcaacattagtgtgagaggcggtcctcctgggctgcgatctgcaagatccgggcccgtcaccgtgtatccatacatgcacgctctggacacactgttcgtgcccctcctagtgggcaccggcgtcgccctggtgaccggcgctacggttctcggtacaattacctgctgtttcatgaagcgtctgcggaagcggtag

SEQ ID NO: 120474 - DNA, 1842 bp, Artificial Sequence
  Description of Artificial Sequence: Synthetic coding sequence
atgggggctcttcgtcccactctcctgcccccctctctgccactgctgctgctcctgatgctgggcatggggtgctgggcaagagaggttctggtgcctgagggtccactgtatagagttgctgggaccgccgtgtcaatctcttgcaacgtgacaggttacgaaggtcccgctcagcagaactttgaatggtttttgtacaggcccgaggcacccgatacagccctgggcattgtgtccacaaaggacacccagttttcttacgccgtgtttaaaagccgtgttgttgctggggaagttcaggtgcagaggctgcagggggatgccgtcgtgcttaaaattgcacgcctccaggcccaggacgccggtatctacgaatgccatacgccttctacagatactagatacctggggagctattctggaaaggtggaactccgagtgctaccagacgtgctgcaggtatcggccgccccaccaggacccagggggcgacaggccccaacgtcccctccccggatgacagttcacgaaggtcaagaactggctctggggtgcctcgcacggactagcacccagaagcatacccatctggcagttagctttggccgtagtgtaccagaggcaccagttggaagatcaaccctgcaggaggttgttggaatacggagcgacctcgccgtggaagctggggcaccctatgccgaacggctggcagcgggggaactgcggctgggcaaagaaggtactgatcgctatcggatggtcgtaggaggagcacaggccggcgatgctggaacatatcactgcacagcagctgagtggattcaggatcctgatgggtcttgggctcaaatagccgaaaaaagagcagtgctggctcacgtggatgttcagacgttgtcttcccagttggcagttacggtaggccctggtgagagacgaatcggccctggcgagccactagagttattatgcaatgtgagtggcgctctgccacccgcaggtagacacgcagcctatagtgtgggttgggagatggcccccgccggcgcgccagggcctggtcgcttagtcgcacagctcgacactgaaggagtgggtagtttgggccctggctacgaaggccgacatattgctatggagaaagtagctagtcgcacgtatcgtttacggcttgaggccgccagaccaggcgatgccggaacataccggtgtcttgctaaggcctacgtgcgcggatcaggcactagacttcgggaagctgcttctgctcggtctaggccgctgcccgtacatgtgcgtgaagagggggtcgtgctggaggctgttgcatggcttgccggcggcacagtttatcgaggggaaacagcctccctcctctgtaatatctctgtccgtggagggccacccggactgcgcctagctgcatcatggtgggtggagcgccctgaagatggcgagctgagttccgtgccagctcaacttgtcggcggtgtgggccaggatggtgttgctgaactcggcgtacgcccaggcggcgggcccgtttcggtcgaactagtcggcccgagatctcaccgcctccggcttcactcactcgggcccgaagacgaaggagtataccattgtgctccaagcgcctgggttcagcacgctgactacagctggtatcaggctggtagtgcaagatcgggccccgtcacagtttatccatatatgcatgccctggacacactttttgttcccttgctggttggtaccggagtggcactcgtgactggtgcgactgtgcttggaaccattacctgttgtttcatgaaacgacttcgtaagcgctag

SEQ ID NO: 120475 - DNA, 906 bp, Artificial Sequence
  Description of Artificial Sequence: Synthetic coding sequence
atgggagcattgcgacccactctcctgccgcctagtttacccttgcttttgttgctcatgctggggatgggctgttgggcccgggaggtactggtgcccgaggggcctttgtacagggtagcagggaccgccgtcagcatttcgtgcaacgtgactggctacgaaggaccagctcaacagaatttcgagtggttcctttaccgccctgaggccccggataccgccttgggaatcgtctctacgaaggatacacagttctcctatgctgtgttcaagagccgcgtcgttgccggcgaagttcaggtgcagaggctacagggagatgcagtggtgttaaagatagctcgcctgcaggcccaggatgctgggatatacgaatgtcacaccccttcaaccgacaccaggtacctgggttcttacagtggaaaggtggagcttcgggtccttcccgacgtgctgcaggtcagcgccgctccacctggaccacgaggccggcaggcccctaccagcccccctcggatgaccgtccacgagggccaggaacttgcactgggatgcctcgcccgcacctctactcagaagcacacccatctagcagttagctttggccgtagtgtgcctgaggcccccgttggcaggagtacactgcaggaggtcgtgggaatacggtccgatctcgcagtcgaggcaggcgctccatacgccgagagactcgcagccggcgaacttcgacttggcaaggaaggcacagatcgctacaggatggtcgtaggaggagcccaggccggggatgcagggacctaccactgcaccgcagcagaatggatacaggacccggacggttcatgggcacagatcgctgagaaacgggccgtcctcgcacacgtcgacgtccagacgttgtag

SEQ ID NO: 120476 - DNA, 2154 bp, Artificial Sequence
  Description of Artificial Sequence: Synthetic coding sequence
atggtgtggtgtttggggctagccgttcttagtctggttatcagccaaggcgccgacggacggggaaaacccgaagtagtgtctgtggtgggccgggcgggggagtctgtggtgcttggctgcgatctgcttcctcccgccgggagaccaccactccatgttatcgaatggctccgctttggattcctgctgcccattttcatccagttcggactatattcgccccgaatcgaccctgattatgtcgggagagtgcggctccagaaaggcgcctctttacagattgagggcttgcgtgtggaggatcaggggtggtacgagtgtagagtgttttttttggatcagcacatacccgaggacgacttcgccaacggttcctgggtgcatctaactgtgaacagtccgccccagttccaggagactcctcccgccgtacttgaggtacaagaactcgagcccgtgacgctgagatgtgttgccaggggcagcccactccctcatgtgacctggaagttaagaggtaaggacctgggacagggccaggggcaagtgcaagtgcagaatggaacattaaggataagaagagtcgaacgcggatctagcggtgtctacacatgccaggcaagctcaacagaaggttcagctacacacgccactcagctcctcgttctgggaccgccggtaatcgtggtgccaccaaagaattcgaccgtgaatgcttcgcaggatgttagcctggcttgtcacgcagaagcctaccctgctaacctgacctattcttggtttcaggacaatatcaatgtgttccacatcagccggctgcagcccagagtcaggattctggttgatggctccctgcgcctgctggctacccagcctgacgacgccgggtgttatacctgcgtgccgagtaacggcctcctgcatccaccttcagccagcgcgtacttgaccgtcctctaccctgcacaggtgaccgcaatgccccctgaaacaccactgcccatagggatgccaggagtgatccggtgtcctgtgagagccaatcctccgctgctctttgtttcatggactaaggatggcaaggcgctgcaacttgacaagttccccggttggagtcagggtacagagggttcgctcattattgccttggggaatgaggacgccctgggcgagtattcgtgcactccatataactcccttggtacggctggaccgtcccccgtcactagagttctgctcaaggcccccccagccttcatcgaacgtccaaaggaagagtattttcaggaagtgggccgcgagctgctaatcccctgcagcgcgcaaggagatccacctccagccgcccccccttctcccttgcccggcccaggcccactgttgcaatacctgtctctgcccttttttagggaaatgaatgttgacggcgactggcctccactggaagaaccttccccagccgccccccccgactacatggatacccgtcgctgccccacgtcaagctttctcaggagtccggaaacccccccagtgtctcccagggagagcttacccggtgcagtggtcggggctggagccacagccgagccaccatacacggcccttgctgattggacgctcagagaaagactgctgcctggtctgctacctgcggccccacggggatctcttacatctcagagcagtgggcgtggttctgcctcgtttttgcgcccaccaagcactgccccaagcgccggaggttcatatttatcaccagcgcccggggatacaagcagctgggcctctggacctgagcgctggccacggcgcgagcacgtggtcaccgtttctaaacgtcgaaacactagcgtggacgagaattacgaatgggattccgaattcccaggggacatggaactgttggaaacccttcaccttggtctggcatcaagccgactacgaccagaagccgagcctgagcttggtgtcaaaaccccagaggaaggctgtctgttgaacaccgcacatgtcacgggacccgaggctcggtgtgcagcgctgcgggaggagttcctggcatttagacgacggagggacgctacaagggctcgactgcccgcctaccgtcagcctgtgccccatcctgagcaagccaccctcctatag

SEQ ID NO: 120477 - DNA, 3492 bp, Artificial Sequence
  Description of Artificial Sequence: Synthetic coding sequence
atggtttggtgtctcggactcgccgttctcagtctcgtgatctcacagggagctgacggccgaggcaagcccgaggtagtgtcagtggtgggaagggcaggagagagcgtggtgctaggctgcgatttgctccctcccgctgggcggcctcctcttcatgtcattgaatggttgaggttcggcttcctactgcctatttttatccagttcggcctgtattcaccacggatcgatcctgattatgtgggccgagtgcgactgcagaaaggggcatccctgcagatcgaagggctacgtgtggaagaccaaggctggtatgaatgtagggttttcttcttagaccagcatatccctgaggacgattttgctaacggtagctgggttcacctcaccgtgaacagtcctccacagtttcaggaaacacccccagcggtcctcgaggtgcaggaattagagccggtgacacttcgctgcgtcgcaagaggctcacccctcccccatgtgacgtggaaattgcgagggaaggatctcggacagggacaaggacaagtgcaggtgcagaacggcacgctaagaattaggcgcgtcgagagagggagcagtggagtgtatacgtgccaggccagctccactgaggggagcgcaactcatgcgactcaactgcttgtactgggccctccggtgattgtggtcccacccaaaaatagtacagtgaacgccagccaggatgtgtctttggcctgtcacgctgaggcctaccccgccaacctgacctactcctggttccaagataatataaatgtgttccatatctctcgcttacagccccgcgttaggattcttgttgatggctccctgagactattggcaacccagcctgacgacgcaggctgttacacctgtgtaccatctaatgggttgctacatccaccctcagccagcgcctacctcaccgtgctgtgtatgcctggagttattaggtgcccagtccgagcaaatcccccattgttgttcgtgtcctggactaaggatggaaaagccctgcagctggacaaattccccggctggtcacagggaaccgagggctccttgataatcgccctgggtaatgaagacgccctgggagagtattcttgcacaccttacaactccctgggaaccgcagggcctagtcccgtgacccgggtactgttaaaggccccaccagccttcatcgaaaggcctaaagaggaatactttcaggaggtcggaagggagctgctgattccttgcagcgcccagggtgatccgccacccgtcgtgtcatggactaaggtggggagggggttgcagggacaagcccaggtcgactccaacagtagccttatactgcgccccctgacgaaggaggcccatggccattgggagtgctccgccagcaacgcagtcgctcgggtggcaacatctaccaacgtctatgtcctcggcacatctcctcacgtggtgacaaacgtctctgtcgtcgctctcccgaagggggccaacgtcagctgggaaccaggcttcgacgggggctacctgcagagattctcggtgtggtatacccctctcgcgaagagaccggatagaatgcaccacgattgggtgtccctggcagtgccagtgggggccgctcatctgctcgttccaggcctgcaacctcatacccagtaccagttttctgtgctggcacagaataaactcgggtctggacccttctccgagattgttctcagtgccccggagggcctgccgacaaccccggccgccccggggcttcctccaactgagattccccctcctctgagccctcccagaggccttgtggcagtccgaacaccgagaggggtgctcctgcactgggatccgcctgaactcgtacccaagcgcctcgacgggtacgtcctcgaagggcgacagggaagtcaaggatgggaggtgctggatcctgctgttgccggcacagagacggagttactcgtgccagggttgattaaggacgttttatatgaattccggctagtggcgtttgcggggagcttcgtctcagacccctccaatacagctaacgtatcaacaagcgggttggaagtatatcccagtaggacgcagctccccgggctgctgccacaacccgtgctggccggagtggtagggggcgtttgcttcctgggcgtcgccgtgctggttagtattctggccggatgcttactgaatcgtcgcagggctgcccggaggagacggaaacgtcttaggcaggatccaccgcttatcttctcaccaacaggcaagtctgcggctccatctgccctgggctccggcagcccagactccgtcgccaagctaaaactccagggtagccccgttccctccctgagacagagccttctctggggcgaccctgctggcactcccagtccacatcccgacccacccagttcccgcggaccgttgccactggagccgatctgtagagggcctgatggtaggtttgtcatgggccccacggttgccgctccacaggagcgctcagggagagagcaagcagagccccggacccccgcccaaaggttggccaggtcattcgattgctcatcgagttcacccagcggagctccccagcctctgtgtatcgaggacattagcccagttgcccctcctccggctgcaccaccttcacccctgcccgggccaggacccctgctgcaatatctctccctccctttcttccgcgagatgaacgtggacggtgattggccacctctcgaggagccctctccagcagccccaccagactacatggatactaggcgctgcccaacctcaagtttccttagatcacctgaaactcctcccgtctcacccagggagtcgttacctggagctgtggtgggtgctggagccaccgcagaaccaccctacaccgctctagccgactggacacttagagaacggttgttacctggcctgcttccggcggcaccaagggggagcttgacctcccagagttcgggccggggcagtgccagcttcctccgtccacccagtactgctccgtcagccggcggcagctatctcagccctgctccgggcgacaccagcagctgggcatccggcccagagcgctggccccggagagagcatgttgtgaccgtgtctaagcggagaaatacctctgtcgacgagaactatgagtgggattccgagttccccggcgatatggaactcctcgaaacacttcatctcggactagccagctccaggctgagacccgaggccgaacccgagctgggagtgaagacccccgaagagggttgtctcctcaataccgcccacgtcacgggtcctgaggctagatgcgctgccctaagagaggaattcctggcctttcgtcgaagacgcgacgctacccgcgcgcgccttcccgcttaccgccaaccagtgccgcaccctgagcaggccactctgctgtag

SEQ ID NO: 120478 - DNA, 3540 bp, Artificial Sequence
  Description of Artificial Sequence: Synthetic coding sequence
atggtctggtgcctcggacttgcagttctgagcctggtgattagccagggtgccgatggacgcggtaagcctgaagtggtctcggtggttgggagagccggcgagtcagttgtgctcggatgcgacttgctcccgcctgctggcagaccacctctccacgtcatcgagtggcttcgattcggtttcctgctgcccatcttcatacagttcggcttgtatagtcctagaatcgatcccgattatgttggtcgcgttcggcttcagaaaggggcatctcttcagattgaaggattacgggtcgaagaccagggctggtatgagtgcagggtgttcttcctcgaccagcacattcccgaggacgattttgctaacgggtcttgggttcaccttactgtgaactcccccccccagtttcaggaaaccccccccgccgtcctggaggtgcaggaactggagcccgttacgctgcgctgtgtcgccagagggtctcctctgccccatgtgacctggaaacttagggggaaggacttgggacaagggcagggacaggtgcaagttcagaacggaacactgaggattaggagagttgagcgtggctcgtctggagtctacacttgtcaggctagctcaactgaaggatccgcgacccacgcgactcagcttctggttctcggcccccccgtcatcgttgtgccgcccaagaacagcacagtaaacgccagccaagatgtgagcctcgcctgccacgctgaggcctaccccgccaatctaacctattcctggttccaggacaatatcaacgtgtttcacattagcaggcttcaacctcgcgtgcgcatccttgtggatgggagcctgaggctgcttgcaacacagcctgatgacgctggttgctacacttgtgtgccttccaacggccttctgcacccacccagcgccagcgcttatctgacggtgctgtaccccgcccaggtgactgccatgccaccggagacacccttgcctatcgggatgccaggcgttattaggtgtcccgtgcgagccaatccaccactgctgtttgtgagctggacgaaagacgggaaggcactgcagctcgacaaattccctggctggtcacagggtaccgaaggttctctgatcatcgctctagggaatgaggacgccctaggagaatacagctgtactccctataattccctcggaacagccggtccttcccctgtgacacgcgtgctattaaaagcaccccctgccttcatcgaaagacctaaagaggagtactttcaggaggttggacgagagttactcatcccatgcagcgcacagggcgaccctccacctgtcgtgtcctggactaaggtcgggaggggcctgcagggccaggcccaggtcgacagcaattcctccctcattctgaggccattaacaaaagaggctcatggacactgggagtgcagcgcatcgaatgccgtggctcgtgtggctaccagcactaacgtatatgtgttaggcacctccccccacgtggtcacaaacgtgtctgtcgtggccttgcccaagggcgccaacgtgtcctgggagccaggatttgacggcggataccttcaacggttttccgtgtggtatacaccccttgctaaaagaccagacaggatgcaccacgactgggtgtccctcgctgttccggtcggcgcggctcatttgctggttccagggctgcagccacatactcagtaccagttttccgtcctcgctcaaaataaactgggctctggccctttcagcgagatcgtcctctcagctccggaaggccttccaactacaccagcggcacccggactgccccccacggaaatccctcctcctctcagcccacccagaggtttggtcgccgtccgaactcctaggggggttcttctccactgggatcccccagaactggtccctaaacgcctggacggatacgtgttggagggaagacagggaagtcaaggctgggaggtgcttgatccagcggtcgcaggaacagagactgaattactggtccccggcctcatcaaggacgtcctctacgagtttcggctggtggcgttcgccggcagctttgtgtcagatccatccaacacagctaacgtgtctaccagcggactggaagtgtacccctccagaactcaattgcctggcttactgccgcaacctgtgcttgctggagtagtggggggtgtctgcttcctcggcgtggcggtcctcgtgtcaatcctggcaggatgcctgctcaatcgaaggcgtgcggcccgtagaagaaggaagaggctgagacaggacccaccattaatctttagccccacaggaaagtcagccgctccctccgcccttgggagtggcagtcccgacagcgtcgctaagctcaagctgcagggatcccctgtcccttcactgcgacagtcgctgttatggggagacccggcaggcaccccatcccctcatcccgaccctccatcttcaaggggcccactacccctcgagcccatatgccgtggcccagacggccgcttcgttatggggcccacggttgcagctcctcaggagaggagcggtagggagcaggctgaaccgaggacccctgcccaacgtttagctcggtcgttcgactgttctagttcttctccaagcggcgctccccagccgttatgcattgaagacatttcccccgtggctcctccacctgcggcccccccgagccccctgcccggccccgggccacttctgcaatacctaagccttccctttttcagagagatgaatgttgacggtgattggccaccccttgaggagccctctccagcagctccaccggattatatggatactcgtaggtgccccaccagtagcttcctgcgctcgcccgaaaccccaccagtctcaccccgggaatccctgccaggtgcagtcgtgggagctggagccacagccgagccaccctacacagcactggctgactggaccttgagagaacgcctcctgcctggactgctcccagccgccccaagagggagcttaactagccagagctccggcagaggcagtgcttccttcctcagaccgccctccactgcacctagtgccggaggctcttacctctcccccgcccccggcgacacatcatcctgggcctcgggccccgaacggtggcctagacgagaacatgtagtgaccgtgtctaaacggcggaacactagcgtggacgagaactacgaatgggacagcgaattccccggcgacatggagctcctggaaaccctccatctgggcctagcctcgtctaggctgaggccagaggctgaacctgaattaggagtgaagacgcccgaagaagggtgcctgcttaatactgcacacgtgaccggacctgaagccaggtgtgcagccctgcgcgaagagtttctggcatttaggcgccgcagagatgctacacgggcacgcctccctgcttaccggcagccagttcctcatcccgagcaagcaactttgctctag

SEQ ID NO: 120479 - DNA, 4050 bp, Artificial Sequence
  Description of Artificial Sequence: Synthetic coding sequence
atgatttggtacgtcgcaacgttcattgcctccgtcatcggcactcgggggctggccgctgagggtgcccatggactgcgagaagaacccgagttcgttactgcccgagcaggcgagtctgtagtcctgaggtgcgatgtcatccaccctgtgacagggcagccccctccttatgttgttgagtggtttaaattcggtgtgccaatccccatcttcataaaattcgggtactatcctccacatgtggatcctgaatacgccgggagagcctctctgcacgacaaggctagtcttagactagagcaggtgcgaagcgaggatcagggctggtacgaatgtaaagtattaatgctcgaccagcaatacgacactttccataatggctcttgggttcacctgactataaacgccccacctactttcaccgaaaccccaccacagtatatcgaagctaaagaagggggttcaattactatgacctgtactgcttttggcaatccaaagcccattgtcacctggttgaaagagggaactttactgggcgcctctggcaaataccaggtgagtgacggctctttaacagttacaagcgtcagcagagaggaccgaggcgcttacacgtgtcgggcctacagtatccagggggaggcggttcacaccacccatcttcttgtccaggggcccccatttatcgtaagccctcctgagaatattaccgtcaacatatcgcaggacgccctcctgacctgccgcgccgaggcttaccctggaaacctgacttacacatggtactggcaggacgaaaatgtttactttcagaatgatctcaagctgagggtaagaattttgattgacgggactctgattatttttcgggtgaaacctgaggactccggcaaatacacgtgcgttccaagcaactccctcgggcggagtccctctgctagcgcctaccttacggtccagtaccccgctagggttctgaacatgccccccgtcatttatgttcccgtgggcatccacggctacatacgatgccccgtggacgccgagccaccagctactgtcgttaagtggaataaagatggacgcccactgcaagtcgaaaagaatttgggatggacactgatggaagacgggtctatacgcatcgaggaggcgaccgaggaggctctgggcacctacacttgtgtgccttataacaccctggggacaatgggacagtccgcaccagcacggctcgtcctgaaggatcccccttacttcacagtcttacccggttgggagtaccgacaggaagccggccgcgaactgctcatcccatgcgcagcagccggtgatcctttccctgtcattacctggaggaaggttggtaagccgtcccggtccaaacacagcgcactgcccagtggatccttacagtttagggctctaagtaaagaagatcacggcgagtgggagtgcgtagccacaaacgtggtgaccagcatcacagcctcaacccacctgacggtgattggcacgtcgccccacgctccaggatcggtcagggtacaggtgtcaatgacaaccgccaacgtgtcatgggagccagggtatgatggcggctacgagcaaaccttcagcgtctggatgaagcgtgcccagtttggtccccatgactggctatctctgcccgtgccacccgggcccagttggctcttggtggacacactcgaaccagagaccgcttaccagtttagcgtcctcgcacagaacaagctcggaaccagcgcctttagtgaggtggtcacagtgaacacacttgccttccctatcactacacctgaaccacttgtgctggtgactcccccacgttgtctgatcgcaaatagaactcaacagggcgtgctcttatcctggctccccccagccaaccatagttttcctattgaccggtacattatggaattccgcgtggccgagagatgggagctcctcgacgatggcatccctggtactgagggcgagttctttgctaaagatcttagccaggacacgtggtatgaatttcgagtgttggccgtgatgcaggatctcatttctgagccgagtaacatcgctggcgtgagttctaccgacatctttccacagcccgacctgaccgaggatgggctcgccagacccgtgttggccgggatcgttgccactatttgcttcttggccgcagccatcctgtttagcaccttggcagcatgctttgtcaacaagcagcgaaaacgcaagcttaaacgtaaaaaggatccgccactatccataacgcactgtaggaagtcgttggagtcaccattaagtagcggcaaggtgtctccagagtccatccgtacactgagagctccaagtgaaagttctgatgaccagggccagcctgccgccaaacgcatgctttccccgacccgcgaaaaggaactgtctctgtacaaaaaaacaaaaagagctatcagctctaaaaagtatagcgtagccaaagccgaagcagaagcggaggcgacaacccctatagaactcatttcacgagggcctgatggtaggtttgtgatggacccagccgaaatggagccctctttgaaatccaggaggatagagggtttcccatttgctgaagagactgatatgtaccccgagttccgacagagtgacgaggaaaacgaggatccgcttgtgccgacaagcgtggctgctttgaagagccagctgacacccctgtcatcttcccaggaaagctatctgccccctcccgcctatagcccgagattccagcctcgcggccttgaaggtcccggcggattggaaggtcggttacaggcaactggccaggcccggcccccggctccaaggccttttcaccacggtcagtactacggatacctgagcagcagcagtcctggtgaagtggaacccccaccgttttacgtgcctgaggttggatcacccctctctagtgttatgtcctctccccctctgccaaccgagggacccttcgggcatcccacaattcctgaagagaacggggagaatgcgtctaactccaccctcccgttaacccagacccccaccggcggccgaagtccggagccatggggaagaccagaatttccctttgggggtctggagacaccagctatgatgtttccgcaccaacttccaccttgcgatgtcccagaatcactgcagcctaaagctggcctgccacgaggccttcctcctacctccctgcaagtgcccgccgcctacccagggatactctccttggaggcccccaaagggtgggctggtaagagcccaggccgcggacccgtccccgcccctcccgccgcaaagtggcaggaccgccccatgcaaccgctggtcagtcagggacagttacgacacacaagtcagggcatgggaatacctgtgctgccttatccggaacccgctgagcccggggcccacggcgggcccagcacgttcggattagacactagatggtacgagccacagcctagaccccgcccctctccccgacaggctcgccgcgcagagccttcactccatcaagtcgtgttgcagccatctcgattgtcgccacttacacagagccctttatccagtcgcacaggcagcccggagcttgctgccagggcaaggccacgccccggcctcttgcagcaagcggaaatgtctgagattacgctgcaacctccagcagcagtgtcttttagcaggaagtcaacacctagcactggaagcccatcccaatcctccagaagcgggagcccgtcctatcggcctgcaatgggatttactactttggctacaggttatccgtctcctccacccggcccagctcccgctgggcctggtgactctttggatgttttcggccagacaccatccccccgcaggaccggagaggagctcctgaggccagagacccccccccctacactgcctacgagcggcaagcttcagcgcgatcggcctgctcctgccacctccccacccgagcgggctctttctaagctgtag

SEQ ID NO: 120480 - DNA, 1509 bp, Artificial Sequence
  Description of Artificial Sequence: Synthetic coding sequence
atggcatggccaaagctgccagccccgtggctgttgctatgcacgtggctgcccgctggttgtctgtctcttctcgtgaccgtccaacatacggaaagatatgtgactctgtttgcatccattatcttgaagtgcgactatacaacatcagcccagttgcaggatgtggtggtgacatggcggttcaagtctttctgtaaagacccaatcttcgactattattcagcctcctaccaggccgctctcagcctggggcaagatcctagcaatgactgtaacgataatcagagagaggtgcgcatcgtggcccagcgcagaggccagaatgaacccgtcctgggcgttgattatagacagaggaagattacgattcagaatagggcagatctcgtgattaacgaagtaatgtggtgggatcatggggtatattattgcacgatcgaggcgcccggcgatacctcaggcgatcccgataaagaggtgaagctgatcgttctgcactggttaaccgttatttttattatactcggtgcactgctgctgcttctgctcatcggggtctgctggtgtcaatgctgccctcagtattgctgctgctacattcgctgcccatgctgtccagctcattgttgttgtccagaggaagatctgtccctgccaagttccctgccccagatgcctatgacccagaccactaatcagcctcccattgcaaatggagtactagagtacctggagaaggaactgcggaacttaaacctcgcccagccacttcccccagatcttaaaggccgcttcggccacccatgttcaatgctgagcagtctgggatcggaggtggtcgagcgccgtattattcacctgccacctctgatccgggatctgagcagctcaagaaggacatctgatagcctgcaccaacagtggttgactcccattccctcaaggccctgggacctccgggaaggaagatcccatcaccactatcccgactttcaccaggagctgcaagatagaggacccaaaagttgggctttagagagaagagagctcgatccctcctggtccggtcgccatagaagctcccgcctgaatggaagcccgattcattggtccgaccgagactccctctctgatgtaccctcgagtagcgaggcgagatggcggcccagccatcctccctttagatccaggtgccaagaacggccaagaagaccatcccctcgcgagtcaacacagagacatggtcgacgacggcggcatcgttcttacagtccacctctaccttctgggctatcttcatggtcaagtgaagaagacaaggagagacagccgcagtcctggcgcgcccaccggcgtggatcacatagccctcattggcctgaggagaagcccccgagctaccggtcgttagatattacccccggaaaaaattctaggaaaaaaggctccgtcgaacggcggtccgagaaagattcatctcatagcggcagatccgtggttatttag

SEQ ID NO: 120481 - DNA, 1641 bp, Artificial Sequence
  Description of Artificial Sequence: Synthetic coding sequence
atggcttggcctaagctgcctgccccatggctgcttctgtgtacttggctccctgccggctgtcttagtctcttggttaccgtgcagcacaccgaaaggtacgtgactctatttgcaagcatcatcctcaagtgtgattacacaacaagcgcacagctgcaggatgttgttgttacctggcgctttaagtctttctgcaaggatccaatattcgactattacagtgcatcttaccaagcagcactctccctgggtcaagaccccagcaatgactgtaatgacaatcaaagggaagtaagaatcgtcgctcagaggcgaggtcaaaacgagccagtcctgggcgtggactaccggcagagaaagataacaattcaaaaccgcgccgatttagtcatcaatgaagtgatgtggtgggatcacggcgtgtattactgtactatcgaggctcccggcgatacaagtggcgatcccgataaggaggtgaaactgatagtgctccattggcttacagtgatttttattatactgggcgcactcctgctgctgctcttaattggggtatgctggtgccagtgctgtccgcagtattgttgctgctatatcagatgtccttgctgccctgcacattgctgctgcccggaagaagcgctggcacggcaccgctacatgaagcaagcccaggcactggggccacaaatgatgggtaagcccctgtattggggagcagaccgcagcagtcaggtgtcatcctaccctatgcaccctctgctacagagggacttgtccctgccatcatctttaccccagatgcctatgacacagacaaccaaccagccaccaatcgcaaatggtgtcctggaataccttgagaaggaactgcgcaacctgaacctggcacagcctctcccaccagacttgaagggtcggtttggccacccgtgtagcatgctgagctccctaggttctgaggttgtcgaacgaagaatcatacatctgccacctctgattagagaccttagttcgtcacggcgaacctctgacagtttacatcagcagtggctcacaccaatccctagcaggccttgggacctaagagagggccgttcacatcatcattatcctgacttccatcaggaactgcaggatcgtggaccaaagagctgggctctggagcggagagagctggaccctagttggagtggtaggcacaggtctagccgcctgaatgggtcccctattcattggtccgacagggactcccttagcgatgtgccaagctcgtctgaggcgaggtggaggcccagccacccaccatttcgctcccggtgtcaggagcgtccccgtcgacctagtccaagggagtctacacagagacatggacggcgacgacgccataggagttattccccacccctcccaagcggcctttcttcgtggagttctgaagaagacaaggagcgccaaccgcagagctggcgcgctcataggagggggtcccatagcccccactggcccgaggaaaaaccaccatcataccggagcctcgatattacaccaggtaaaaattcccggaagaaagggtccgtcgagaggcgttcagaaaaggattcatcacactccggtaggagtgtggtgatttag

SEQ ID NO: 120482 - DNA, 639 bp, Artificial Sequence
  Description of Artificial Sequence: Synthetic coding sequence
atggcttggccgaagctgcccgccccatggctcctcctgtgtacctggctaccagcaggctgcttgtcattgttggtcaccgttcaacacacagaacggtacgtgaccctatttgcgtccatcattttgaagtgtgactacacaacatccgcgcaactgcaggacgtagttgtcacatggcgttttaagagtttctgtaaggatccaatttttgactactacagtgcatcctaccaggcggcactgtccttagggcaggatccgagcaatgactgttgttgctgcccagaggaggcgctggcacgccatcgttatatgaaacaggcgcaggcactggggccccaaatgatggggaagcccctgtattggggggctgaccggtcaagtcaggtttctagctatcctatgcaccctctcctccagagagacctcagcttgccttcttcccttcctcaaatgccaatgacccagaccaccaatcaaccacctattgctaatggggtgctggagtacctggagaaggaactgagaaatctgaatttggcacagcctctccctcctgacctgaagggcaggttcggacacccctgttctatgctctcatctttgggaagtgaaaaccaaatagaagagttttag

SEQ ID NO: 120483 - DNA, 1374 bp, Artificial Sequence
  Description of Artificial Sequence: Synthetic coding sequence
atggcatggccaaagcttcccgccccttggctcctcttgtgcacttggctgcctgccgggtgcctgtcacttctagtcacagtgcagcacaccgaacgctacgtgacactatttgccagcattattctcaagtgtgactacacaacatccgcacagctccaagacgtcgtggtgacatggcgattcaagtccttctgtaaagatcccattttcgactattactctgcctcttatcaggcggctttgagcctcggccaggacccctcaaacgactgtaacgataaccaacgcgaggtgcgtatcgtagctcagagacgcggtcagaacgagcccgtgctcggcgtggactaccggcagcgcaaaatcacgatacaaaaccccctggccaggcacaggtacatgaaacaagcgcaggccctgggacctcagatgatgggcaaaccgctgtactggggcgcagacagatcttcccaggttagctcttacccaatgcatccacttcttcagagagatctcagcctgcctagcagcttacctcagatgcccatgacgcaaaccaccaatcagcctcccattgccaacggagtcttggagtacctggagaaagagctgagaaacctgaaccttgcccagccactaccccccgatctgaaaggtagattcggtcatccctgcagcatgttatcatctctgggctcagaagtggtcgagagacggatcatacacttgcccccactcatccgggatctgagctcctccaggagaacatccgacagtctacaccagcagtggctcacacccattccaagccgcccttgggacttgcgggagggcagatcccatcatcattaccccgattttcaccaggagctccaggataggggaccaaagtcgtgggctctggagcgtcgggaattagacccctcgtggtctggaaggcatcgctcttcccgccttaatggctctcccattcattggtcagatcgtgactcactgtccgacgtcccatctagcagcgaggctagatggaggccctcacacccgcctttccggtcccgatgccaagagagacccaggcgacctagcccccgggagagcactcagagacacgggcggcgacgcagacatagatcttattcccctcccctccccagcggcctctcgtcctggagctctgaggaagataaagagcgtcaaccacagagttggcgggcacaccgtagagggagtcactctcctcactggcccgaggaaaagcccccatcatatcggagcttagacatcactcccggcaagaatagcagaaagaagggaagtgtggaacgcagaagcgagaaggacagtagccactctggacggtccgtggtgatttag

SEQ ID NO: 120484 - DNA, 1545 bp, Artificial Sequence
  Description of Artificial Sequence: Synthetic coding sequence
atggcggggaacatcttttgcccattcgccctgttcttcttacccatgtcccgcgtcggtcacctgcagcactttctgttgctgcttgctctcggctgcctgtccctgctggtcacagtacagcataccgagcgctacgtgactcttttcgcctccattattctaaagtgtgattatactacatccgctcagctgcaggacgtagtcgtcacatggagatttaaaagcttctgcaaagaccccatttttgactactacagcgccagctatcaggctgccctttcactgggacaagatccatcaaatgattgcaacgacaaccagcgggaagtgcggatcgttgcacagaggcgcgggcagaatgagcccgttctgggcgtagactataggcaacgaaaaatcacgattcagaatcgggccgacctagtcattaacgaggtcatgtggtgggatcacggggtgtattattgcactatcgaggccccgggggacacttccggcgaccccgataaagaagtgaaactcattgtgctacattggctcacagtgatttttattattctaggggccctgttgttgttgcttcttataggtgtttgctggtgtcagtgttgtccacagtactgctgctgttatattcggtgtccatgctgtccagctcactgttgctgtccagaggaagacctatcactgccctcgagcttgccccagatgccaatgacccaaacaacaaatcagccaccgatcgcaaacggggtgctcgagtacctcgagaaggagttacggaacttaaatctggctcagcccctgcctccagacctaaagggtcggtttggtcatccctgctcaatgctgagtagcctggggtccgaagttgtggagcggcgtatcatccacttgccgccactgattcgcgacctcagcagtagcaggagaacgtctgactccttgcaccagcagtggcttacacctataccttcacggccctgggacctgcgtgaggggcgttcccatcaccattaccccgattttcaccaggagctccaagatcgcggtccaaagagctgggccctagaacggagagagctcgatccgtcctggtcaggccggcatcgcagctcacggctgaacgggagccccatccactggagcgaccgcgactcacttagcgacgttcccagcagcagtgaggctaggtggcgacctagccatccaccttttcggtctcgatgtcaggagcggccccggcggccctctccgcgggagagcacacagcgccatggcaggagaagaaggcatagaagctactcaccccctctgccatcaggtctgagctcatggtcaagcgaggaggataaggagaggcaacctcagagttggcgcgctcaccgccggggatcccacagcccccattggcctgaagagaagcctccctcatacagatccctagatatcacaccgggcaaaaactcccgaaaaaagggctccgtagaaaggaggtccgagaaggatagtagccactccggccgaagcgtggttatttag

SEQ ID NO: 120485 - DNA, 1800 bp, Artificial Sequence
  Description of Artificial Sequence: Synthetic coding sequence
atggagggtccactcacccccccccccttacaggggggtggcgccgcagcggtgcccgagccaggagcaagacaacatcctgggcacgagacagctgcgcagcgatactctgccaggctgctccaagccgggtacgaacctgaaagccccagactagacctagccacccaccctaccacccctcgctcggaattatcctccgtggtgctgttggccggcgttggagtgcagatggaccgcctaagacgcgcgtctatggcggactatctgatttccggtgggaccgggtatgtgcccgaagacggcctcacggcccagcaactctttgcttccgcggacggtttaacatacaacgactttctcatcctaccagggtttattgacttcattgccgatgaagtagatctcacctctgctctaactcgcaagataactctcaaaacacccctcattagttcccccatggataccgtaacagaggccgatatggcaatcgccatggcgctcatggggggaattggatttattcaccataactgtacccctgaatttcaagccaacgaggttagaaaggttaagaagtttgaacagggcttcataaccgacccagtggttttgtcgccctcccacactgtcggtgacgttctcgaggccaagatgcgccatggcttctccgggattccgatcaccgagacagggactatgggctcaaaactggttggcatcgtgaccagccgcgatatagatttcctggccgaaaaagaccatacaacactgttgtctgaagtgatgactcctaggatcgaactggtggtagctcctgccggcgtcacccttaaggaggctaacgagatcctgcagaggtcaaaaaaagggaaacttcccattgtgaatgactgtgacgaacttgtggcaattatcgcgagaaccgatcttaagaagaatcgggactacccactggccagtaaggactcacagaaacagttactgtgcggagccgctgtcgggactagggaggacgacaaatataggttagatctcctcacacaagccggtgtagacgttattgtgcttgacagcagccaggggaatagcgtgtatcagatagccatggtccattacattaagcaaaagtacccgcacctccaggtgattgggggaaatgttgtaaccgcagcccaggccaaaaacctcatcgatgcaggagtagacggactccgcgtggggatggggtgtggctctatatgcattactcaggaggtgatggcgtgcggacgcccgcagggcaccgcagtttataaagtagccgagtatgcaaggcggtttggtgtcccgatcatcgcagacggggggatacaaacagtcgggcacgttgtgaaagcactggcgctgggggcatccactgtgatgatgggctccctccttgccgcaacgacagaggcccccggcgaatacttcttctctgacggtgtccgtctgaagaaatatcgaggcatgggttccctggatgctatggaaaaatcttcaagcagtcagaaacgctacttttccgagggcgacaaggttaagattgcccagggggtctctggtagcattcaagacaagggatcaatacagaagttcgtgccttacctgatagcaggcattcagcacgggtgccaagacatcggagccagatcgctgtccgttctccgctctatgatgtacagcggggaactgaagtttgaaaagcgcactatgagtgctcagattgagggtggggtgcacggtctccacagttacgaaaaaagactttattag

SEQ ID NO: 120486 - DNA, 1470 bp, Artificial Sequence
  Description of Artificial Sequence: Synthetic coding sequence
atggcggattatctcatcagcggcgggacgggctacgtacctgaagatggcttaactgctcagcaattgttcgcttcagccgacggcctgacatacaacgatttcctcatactgccaggatttattgatttcatcgctgacgaggtcgacctgacgtccgctctcactcgcaagatcactctgaaaacacccctgatctcatcgccaatggacacagtgacagaggctgacatggccatcgccatggctaaattcgaacaaggattcattacggacccggtcgtactgtccccaagccacacggtcggagacgtgctggaagccaaaatgagacacggattctcagggattccgataacagagaccggcaccatgggctctaaattagtggggatcgtgaccagccgcgacatcgatttcctagcggagaaagatcacacgacactcctctccgaggtgatgacgccaaggattgagctcgtggtcgccccagccggggtcacacttaaggaggccaatgagattcttcagcggagtaagaaaggcaagctacccatcgtgaacgactgtgacgagctggtcgcaattattgcacgaacagatttaaagaagaatcgtgactatccactcgctagtaaggattcacaaaagcagctcctgtgtggagccgccgtgggaacaagggaggatgataagtacaggctcgatctattaacccaggcaggggtggacgttatcgtgctggattcatcccagggcaattccgtctatcagattgccatggtccactacataaaacaaaaatatccgcatctgcaggtgataggggggaatgttgtcactgccgcccaggccaagaatctcattgatgccggggtggatggcctgagagtgggaatgggctgcgggtcaatctgcattacacaggaagttatggcatgtggtagaccccagggaacggctgtgtacaaagtggctgaatacgcccggcggtttggagtgccaattattgccgatggcgggattcagactgtgggtcacgtggtgaaagcgcttgcgctgggggccagcactgtgatgatgggttccttgctcgcggccacaacagaggcacccggtgaatactttttcagcgatggggtgcggctgaagaagtacagaggcatggggtcacttgacgcgatggagaagtcttcctctagccaaaaacgatacttctccgaaggggacaaagtgaaaattgcccagggtgtgtctggctcgattcaagataaaggctcaattcaaaagtttgtgccttatctaatcgctgggattcagcacggatgccaggatattggagcaagaagtctctcggtgctgcgtagcatgatgtattccggtgagttgaaatttgaaaagcggacaatgagcgcccagattgagggcggtgttcatggtttgcacagctacgagaagaggctttactag

SEQ ID NO: 120487 - DNA, 1692 bp, Artificial Sequence
  Description of Artificial Sequence: Synthetic coding sequence
atggagggtccacttacccccccgccactccagggcggcggcgcagctgctgtgcccgagcccggcgctcgccagcacccaggacatgagaccgctgcccagaggtacagcgcccgcctcctgcaggcaggctatgagccagagtccatggctgattatcttataagcggcggtactgggtacgtccccgaagatggcctcacagctcaacagttgttcgcgtcagcagacgggctgacctataacgattttttaatcctgcccggcttcattgatttcattgccgatgaggtcgacctcacttctgctttgactcggaagattacactcaagacaccccttatttcatctccgatggacaccgtgaccgaagctgatatggctatcgcaatggcactgatgggcgggatcggctttatccaccataactgcacccccgaattccaggccaacgaggtgagaaaggtgaaaaaattcgagcaggggtttattacagacccggtggtgctatctcctagtcacacggtgggagacgtgttagaagccaaaatgcgtcacggctttagtggcattcccatcacggaaacagggacaatggggtctaaactggtgggcatcgttacaagccgggacatcgacttcctagccgagaaagaccacaccacactactgagtgaggtgatgaccccaagaattgagctcgtggtggcgccagccggcgttactctcaaggaagcgaacgagatcctgcaaaggtccaagaaagggaaattacccatagtgaatgactgtgatgaactggtggcgattattgctcgcactgacttaaaaaagaatcgggattaccccctggctagtaaagattcacagaagcaactgctgtgtggtgccgcagttggtacaagagaggatgataagtatcgtcttgaccttctcacacaggcaggagtggacgtgatcgtgctcgactcttcgcagggcaactcagtttatcaaatcgcaatggttcactatatcaaacagaaatatccccacctacaggtgattggagggaatgtggttacagccgcacaagccaagaatctgatcgacgctggtgtggatggccttcgggtcgggatgggatgcggctccatatgcattactcaggaggtgatggcctgtggtaggccccaggggacagccgtatacaaagtagcagagtacgcccggcgcttcggcgttccaataatcgcagacggaggaattcagacagtggggcacgtggtgaaggccctcgctttgggcgcatctacagtcatgatggggagtcttctggcagccaccacggaggcacccggagagtatttcttcagcgatggcgtgcgcttaaagaaataccgcggaatgggctccctggacgcaatggaaaaaagctcctcgtcccaaaaaaggtatttttccgaaggagacaaagtcaagatcgcgcaaggtgttagcgggagcatacaagacaagggctccatacagaaatttgttccgtatctcatcgccggtatccagcacggctgccaggatattggggcccgctcactaagcgtcctacgatcaatgatgtatagtggcgaactcaaatttgagaaacgtacaatgtccgcccagatagagggcggagtgcacggattgcactcctacgagaaacggctctattag

SEQ ID NO: 120488 - DNA, 1770 bp, Artificial Sequence
  Description of Artificial Sequence: Synthetic coding sequence
atggaaggacctttgacaccccctcccctccagggcggcggggcggccgcggtccccgagcccggggccagacagcaccctggtcacgagacagccgcacaacggtatagtgctcgcctgcttcaggcagggtatgagccagagtcctgttttctgctggagcttagcagcgttgtgcttctggccggcgtcggggtgcagatggatcgtctgagaagagcatctatggcagattacctaatttccgggggtaccggctacgtgccagaagatgggctgacggcccaacaactgtttgcctctgctgacggattgacttacaatgattttctgatccttccagggttcatcgattttatcgctgatgaggtggatctcacctcagcactgactagaaaaatcactctgaaaactccactgattagtagtcctatggatactgtgactgaggccgacatggccattgccatggcccttatgggcggcatcggcttcattcaccacaattgcaccccggaatttcaggcaaatgaggtcaggaaagtgaaaaagttcgagcagggatttattaccgatcctgtcgttctttccccaagccacacagttggggatgtactcgaagctaaaatgcgtcatggcttctctgggatcccaatcacagaaaccgggacaatggggtcaaagctagtagggattgtcacctccagggacattgactttctggcagagaaagaccacacaaccttgctgtccgaggtgatgactccacgtatcgagctcgtggtcgctcccgctggagtcacattgaaagaagccaacgagattctccagagatctaaaaaggggaagctccctattgtgaatgattgtgatgaactggtggccattattgcaagaactgatctgaagaagaatcgcgactaccctctggcgtccaaggatagccagaagcagttgctgtgtggcgctgccgtaggcacccgggaagacgacaagtataggctggatctgctgacacaggcgggcgtggatgtcatcgtattggatagtagtcagggaaattcagtttatcaaatcgccatggtccattatatcaaacagaagtaccctcacctgcaggtgatcggtggcaatgtcgttacagctgcccaggccaaaaacttaattgatgcgggagttgatggtctgcgggtggggatgggctgtggcagtatttgcattacacaggaggtgatggcctgtgggaggcctcaaggcaccgctgtgtacaaggtagccgagtacgccagacggtttggggtccctataatcgcagacggaggaatccaaacagtgggtcatgtggtgaaagccttggctctgggtgcatctaccgtgatgatgggctctttgttggctgctaccacagaggcccccggagagtatttcttttcagatggggttagactgaaaaaataccgtggcatgggcagcctggacgcaatggagaaatcctcgagttcccagaagcgatactttagcgagggtgataaagtgaaaatagcgcagggcgtgagcgggagcatccaggacaaggggagcatacagaagttcgtgccctatttgatcgccggtattcagcatggctgccaggacataggcgctaggagcctgagcgtgcttagatcaatgatgtacagtggggaattaaaatttgaaaagagaacaatgtcagctcagatcgaagggggagtgcacggtttacactcttacgaaaaaagactgtactag

SEQ ID NO: 120489 - DNA, 1593 bp, Artificial Sequence
  Description of Artificial Sequence: Synthetic coding sequence
atggaaggccctctgacacctccgcccctccaaggagggggtgccgctgccgtgccagaacctggcgctagacagcatcccggccacgagacagcagcccagcgatactctgcacgactgctgcaggccggctacgagcccgagagcgattttctaattctgccaggattcattgactttatcgcggacgaagtggatctgaccagtgccttaacaagaaagatcacattaaagactcctcttatctctagccccatggatacggttaccgaagccgatatggccattgccatggcccttatgggcggcatcggcttcatccaccacaactgtacgccggaatttcaagcgaacgaagtcagaaaagtgaagaaatttgaacagggtttcataaccgatcctgtggtgctctccccatctcacactgtgggcgatgttctggaggcgaaaatgcggcatggcttttctggaatcccgattaccgagacaggaactatggggagcaagctggtgggtatcgtcacaagccgggacattgattttcttgctgaaaaggatcacaccaccctattatctgaggtcatgactccccgcatcgagttggtcgtggcccctgctggggtcactttgaaggaggcaaacgaaatacttcagcggtccaaaaagggaaagttgcctatcgtgaacgactgcgatgagctggtcgctatcatcgctcgtaccgacctcaaaaagaatcgcgattaccccctggcgtctaaagattcgcagaaacagctgctctgcggcgccgccgttgggacccgggaggatgataaatatcgcctggatctgctgacccaggcaggagtagacgttatcgtgctggattcctctcaggggaactcagtgtaccaaattgccatggtccattatatcaagcagaaatatccgcacttacaggtgatcggtggaaacgtggtgacggccgctcaggcaaaaaacctgatcgacgctggggtagacggcctgagggtgggaatgggttgcggatccatttgcattactcaggaagtaatggcttgtggtcgccctcagggcaccgccgtttacaaagtggctgaatatgctcgacggttcggtgtccctatcatcgccgacggcggcatccaaacagtggggcatgtcgttaaagcactggcattgggagctagcaccgttatgatggggagtctacttgcagccacaacggaggcaccaggagaatatttctttagtgacggcgtgagattgaaaaagtaccgaggaatggggtccctggatgcgatggaaaagtctagcagcagtcaaaagagatacttctcggagggagacaaggtaaagatcgcgcaaggagtgagcggcagcatccaggacaagggctccatccaaaaattcgtgccatacctgatagcaggtatccaacacgggtgtcaagatatcggagcaaggagcctgtccgtgcttaggagcatgatgtactctggcgagctcaagtttgaaaagcggaccatgagcgcgcagatcgaagggggagttcacggactacacagctacgaaaagaggttgtattag

SEQ ID NO: 120490 - DNA, 1701 bp, Artificial Sequence
  Description of Artificial Sequence: Synthetic coding sequence
atggagggccctctaactccacctcctcttcagggaggaggggcggccgcagtgccggagcccggggcccggcagcatccggggcacgagaccgcggcccagcgatattccgcgcgccttctccaggctggatacgaacccgaaagtccaaggctagacctggccacacaccctacaacacctcggtccgaattaagcagcgttgtcctgctggccggcgtcggggtccagatggatcgtttgcgtagagcatcagactttctcatcttaccaggatttattgactttatcgccgatgaggtcgaccttacctcagctcttacaaggaagattaccctcaagacaccactcatcagttctcccatggatactgtgactgaggccgacatggctatagccatggctctgatgggggggatcggattcatccaccacaactgcactcccgaattccaggcaaatgaggttcggaaagtgaaaaaattcgaacagggatttattaccgatcccgtagtcttgagtccaagtcacactgttggggacgtcctggaagccaaaatgcggcatggtttcagcggcatccctatcaccgaaaccgggaccatgggatccaagcttgtagggattgtgaccagtcgggatattgacttcctcgcggaaaaggaccacaccactctgctgtcagaggtcatgacaccacgaatagagcttgttgttgctccggccggagtgaccctcaaagaggctaatgaaatactgcagagatcaaagaaggggaagcttcccattgtcaatgactgtgatgagctggtggccatcattgcgcggactgatttgaagaagaaccgcgactaccccttagcctccaaagatagccagaaacaactgctctgtggggctgctgtcggcaccagggaagatgacaagtaccgcctggacttgctcacacaggctggcgtggacgtgatcgtcttggacagtagccagggcaactccgtgtaccagatcgcaatggttcactatatcaagcagaaatatcctcatttacaggttatcggtggcaacgtagttacagccgctcaggctaagaatctgatagacgccggagtcgatggtctgcgagtgggaatggggtgtggcagcatttgcattacgcaagaggtgatggcctgcgggcggccccagggtaccgccgtgtataaggtggctgaatacgcccgccgtttcggcgtgcccatcatcgcagatggaggtattcagacagttggacacgtagtgaaggctctcgctttaggagcaagtacggtgatgatggggagtttactggccgcaaccaccgaagcaccgggggagtatttcttctccgatggggtaagactgaagaaatatcgtgggatgggcagtctggatgcaatggagaagagttcctctagccagaagagatacttctctgagggggacaaagtgaagatcgcacaaggagtctccggaagtatccaggataagggtagcatccagaagttcgttccatacctcatagctggcatacaacacggatgccaagacatcggcgctagatctttgagcgtactccgttcgatgatgtattctggtgagcttaaattcgagaagcggacgatgtcagctcaaattgagggcggagtacacggtctgcattcatatgaaaagcggctttattag

SEQ ID NO: 120491 - DNA, 1530 bp, Artificial Sequence
  Description of Artificial Sequence: Synthetic coding sequence
atggctgattatctgatctccggtggcactggctacgtgccggaggacggtctgaccgcccagcagttgtttgccagcgctgacggattgacgtacaacgatttcttaatcctccctggattcattgacttcattgccgatgaggtggaccttacttctgcactgacccgaaagataacactcaagacaccgctgatatccagccccatggatactgtgactgaggccgatatggctattgctatggccctgatgggaggcattggcttcattcaccacaactgcactcccgagttccaagcgaatgagaagtttgagcagggtttcatcactgaccctgtagtgctgtctcctagccataccgttggcgacgtgctggaggccaaaatgcgacacggtttttccggcatcccaatcacagaaacaggtacgatgggaagcaaactggtcggcatcgtcacatcacgcgacatagatttcctcgcggagaaggaccatacgaccttgttgtcggaggtcatgactccacgcatagagctggtggtcgcccccgccggagtaacgctaaaggaagcgaatgagattttacaaaggtctaagaaaggtaagcttcccatagtgaatgactgtgacgaactcgttgcaataatcgctcgcactgacctaaaaaagaacagagactacccgcttgcctctaaagacagtcagaagcagctcctgtgcggcgcagccgtgggcacacgtgaggacgataagtataggcttgacctgttaacgcaggcaggagtcgacgtgattgttctggattctagccagggcaattccgtctatcagattgctatggtccactatatcaagcagaagtacccacatctacaagttattggagggaatgtggtgacagcagcccaggccaaaaatctgattgatgccggggtggatggcctcagagtgggtatggggtgtggttctatttgtatcacccaagaagttatggcctgtgggcgcccacaggggacggcagtctacaaggttgccgaatatgcccggcgtttcggtgtaccaatcatcgcagacggaggtatccaaactgtgggtcacgtggtgaaagcgttagcactcggcgctagcactgtaatgatgggatcattattagcagctacaaccgaggcccctggagaatacttcttcagcgacggtgtgcggcttaaaaaatatagagggatggggtctctcgatgcaatggaaaagagctcctcttcccaaaaaaggtactttagtgaaggcgacaaggtgaaaatcgcccagggggtgtctggcagtatccaggacaaaggatcaatccagaagtttgtgccatacttaatcgccggcattcaacacggttgtcaggacatcggggctaggtcgctgtctgtgctgagaagcatgatgtattctggggagctaaagtttgagaagaggactatgtctgcccagattgagggaggtgtgcacggtttgcattcctatgaaaagagactctactag

SEQ ID NO: 120492 - DNA, 1470 bp, Artificial Sequence
  Description of Artificial Sequence: Synthetic coding sequence
atggcggactatctcataagcggaggcactggctatgttccagaagacgggctcaccgcacagcagctcttcgcaagtgctgacggattaacctacaacgatttcctgatcctcccgggcttcattgacttcattgccgacgaagtggaccttacaagcgcccttactcggaaaataaccctcaagacaccgcttataagctctccgatggataccgtgaccgaagccgacatggccatcgctatggcaaagtttgaacaaggcttcattacggaccccgtcgtcttatccccctcccacaccgtgggggatgtgttggaggccaaaatgagacatggcttctcaggtattcccattaccgagacagggaccatgggttccaagctggttggcattgtgacttctagagacatcgattttctagccgagaaggaccatacaacgctgctctccgaagtaatgacacctcgcatcgaactcgtggtcgcccctgcaggggttaccctgaaggaggccaatgaaatactgcaaaggagtaagaaaggtaagctgccaatcgtaaacgattgcgacgagcttgtggccattatagcaagaactgacttgaagaagaacagagattatccgcttgcgtctaaggactctcagaaacagctactgtgtggagccgccgtgggaacccgcgaagacgacaaatatcgtctggacctgctgactcaagccggtgtcgatgttatagtgttggatagcagtcaaggcaatagcgtgtaccagattgccatggttcactatataaaacagaaatacccacatctgcaggtaataggtgggaatgtcgtcacggccgcacaggccaagaatctgatcgatgccggagtcgacggattgcgagtgggcatgggctgcggctcgatttgtatcacacaagaggtcatggcttgtggacgaccacagggcacagctgtgtacaaggtggccgaatatgctaggagatttggggtgcccataatcgccgatggcgggatccaaaccgtgggacatgtggtaaaggcattagcactgggggcaagtacagttatgatgggcagtttgctggcggccacaacagaggctccgggagagtactttttcagcgatggggtacgactcaagaagtatcgggggatggggtcacttgatgccatggagaagtccagtagcagccaaaagagatacttctctgaaggtgacaaggtgaagatagcccagggcgtttctggatccatccaggacaagggctcaattcagaaattcgtgccgtatctgatcgccggtatccagcacggatgtcaagacattggggcacggagcctgtcagtgttgcgctctatgatgtacagtggggagctgaaatttgagaagcggaccatgtcagcccagattgagggcggagtccatggcctccacagttatgagaaaaggctttactag

SEQ ID NO: 120493 - DNA, 1545 bp, Artificial Sequence
  Description of Artificial Sequence: Synthetic coding sequence
atggccgactacctcatctctggcggaacctcctacgtacctgacgatggactgaccgctcagcaactgttcaactgtggagacggtcttacatacaatgatttcttgatcttacctggatacatagacttcacagccgaccaggtcgacctaacttctgcacttactaagaaaatcacactgaagacccctctcgtctcaagccctatggacacagtcaccgaggcaggtatggcgattgcgatggctctgaccggcggtatcggattcatccaccacaactgcactcccgagttccaggcaaacgaggtgcgcaaagtgaaaaaatacgagcaaggattcattactgatcccgtggtgctctctcccaaagatcgggtgcgggatgttttcgaagccaaagcccgtcacggattctgtggaattcccatcaccgatacaggcaggatgggatccaggttggtgggtatcattagcagccgcgacatcgatttcctgaaggaagaagagcacgactgctttcttgaggaaatcatgactaagagggaggatctggtagttgcaccagctggcatcacactgaaggaggctaatgaaattcttcagaggtcgaagaagggcaaactcccaattgtgaatgaggacgatgagctggtggccatcattgccagaaccgatctcaagaaaaaccgggattatcccctcgctagtaaggatgccaagaagcagctactctgcggcgccgctatcggaactcacgaagacgataagtaccggctcgatctcctagcacaggccggtgtcgacgtggtggtgctggacagctcacagggaaatagcatcttccaaatcaacatgatcaaatacatcaaagacaagtaccccaatctacaggtgataggcggcaatgtggtgacggctgcgcaggccaagaatctcattgacgcgggcgtcgatgctctcagggtgggaatgggctcaggtagcatctgcatcacacaagaggtgctagcatgcgggcgaccccaggccacagccgtgtacaaggtgtccgaatacgccagacgctttggcgtccccgtgatcgctgacggcggcatacagaacgtgggccacatagccaaggccttggcacttggagcatcgacagtcatgatgggaagcctgctggctgcaaccaccgaggccccaggggaatactttttctcagatggaattcgactgaagaaatacagaggcatgggatctttggatgcaatggacaaacacctgtcatcgcagaataggtacttctctgaggcagacaagattaaagtggctcaaggggtgagcggtgcagtccaggacaagggctcaatccacaaatttgtcccatacctgatcgctggtatacagcacagttgccaagatataggcgctaagtcactcactcaggtccgcgcaatgatgtactcgggtgagcttaagttcgaaaaacgcacctcgagcgcccaggttgaaggcggagtgcattcactgcacagctatgagaagaggctcttttag

SEQ ID NO: 120494 - DNA, 1074 bp, Artificial Sequence
  Description of Artificial Sequence: Synthetic coding sequence
atggccgactatctaatatccggcggcacttcctacgtgccagatgatggtttaacagctcagcagctctttaattgcggagacgggctgacctacaacgatttcctgattctcccaggttatatagatttcacagctgatcaggtggacttgaccagcgccctgacaaaaaagatcaccctgaagacacctctcgtatcctcacctatggacacggtaactgaagcgggtatggcaattgctatggcactcacaggagggatcgggttcatacaccacaattgtacgcccgaatttcaggccaacgaggttcggaaagttaagaaatacgagcaaggcttcattacagatccggtagtactgtctcccaaagacagggtgcgcgacgtctttgaggctaaagcaaggcatgggttctgcgggataccaattaccgacacggggaggatgggtagccggctggtcggcataatctcttcccgcgacatagacttccttaaagaagaagagcatgactgtttccttgaagagatcatgacaaaacgcgaggacctggtggtggcccccgcaggaattacccttaaggaggcaaacgaaattctacagagatccaagaaagggaagttgcctatcgtgaatgaggacgatgaactggtggccattatcgcacggactgacctgaaaaaaaatcgcgactacccgctggcatccaaggatgccaagaagcagctgctctgtggggccgctattggcacccatgaggacgataaataccgcctcgacttgctggcacaggccggagtggacgtggtcgtactggatagttctcagggcaacagcattttccagatcaatatgatcaaatacatcaaggacaagtaccccaatctccaggtgatcggagggaacgtggtgaccgccgctcaggcaaagaaccttatcgacgcaggcgtggatgcactccgggtcggcatgggatccgggtcaatttgtatcacacaggaggtgttggcatgtgggaggccccaagcaactgccgtgtgtacacagaagcagcacccacatttccagtag

SEQ ID NO: 120495 - DNA, 501 bp, Artificial Sequence
  Description of Artificial Sequence: Synthetic coding sequence
atgctgcgaggtgttctgggaaagacctttcgcctggttgggtacactattcagtatgggtgtatcgcccattgtgcattcgagtatgtgggaggcgtcgttatgtgcagtgggccttccatggagcctacaattcaaaattcagacatcgttttcgccgagaatctgagtagacacttttacggcattcagcgcggcgacattgttatcgccaagagcccatcggaccctaagagcaatatttgtaagagggtaatcggcctggaaggtgataagatactgactacaagccccagcgacttctttaaaagtcacagctatgtccccatgggccacgtatggttggaaggcgacaatctgcagaatagcactgactcacgttgctatggacccatcccctacggtcttattcgaggtcgcattttttttaagatatggccactgtcagactttgggtttctacgggctagccccaacgggcatagattctccgatgattag

SEQ ID NO: 120496 - DNA, 324 bp, Artificial Sequence
  Description of Artificial Sequence: Synthetic coding sequence
atgctgaggggggtgctgggcaagaccttccggctggtaggctacacaatacagtatgggtgcatcgcgcattgtgcgtttgagtacgtggggggcgtcgttatgtgttctggcccatctatggagcccacaattcagaattccgacattgtgtttgcggagaatttgtcgaggcacttttatggtattcagcggggtgacatagtgattgctaagagcccttccgacccaaagagtaacatttgtaagcgagtgatcggcctggaaggagacaaaattctgaccacgtcaccctctgatttctttaagtcacactcctactag

SEQ ID NO: 120497 - DNA, 291 bp, Artificial Sequence
  Description of Artificial Sequence: Synthetic coding sequence
atgctgaggggtgttctgggaaaaacctttaggctggttgggtatacaattcaatatggctgcattgcacattgtgcatttgaatacgttgggggagtcgtaatgtgctctggccccagcatggaacctacaatccaaaacagcgatatcgtcttcgcagaaaacctgtctaggcatttctatggtatacaacggggagatatcgtcatcgcaaaatccccctcagatccaaagtcaaacatctgcaagagggtgatcgggttggaaggagacaagatcctgaccacatag

SEQ ID NO: 120498 - DNA, 501 bp, Artificial Sequence
  Description of Artificial Sequence: Synthetic coding sequence
atgctgcgtggggttctcggaaagaccttcagactggtcggatacactatccaatacggatgtatcgcacactgtgcttttgagtatgttggaggcgtcgtcatgtgctctgggccttccatggagccgaccatccagaatagtgatatcgtgtttgctgaaaatctgtctcgccacttctacgggatccagaggggagatattgtgatcgccaagtcccctagtgacccaaaaagcaatatttgcaagcgagtgatcggcctggagggtgataaaatactgaccacctcgcctagtgacttttttaagtcacactcttacgttcccatgggccacgtttggctcgagggggataacctgcagaatagcacagactcccgttgttacgggcccatcccctacggactcatcaggggaaggatctttttcaagatctggcctctgtctgatttcggctttctccgcgcctcacccaatggacaccggttttccgatgactag

SEQ ID NO: 120499 - DNA, 528 bp, Artificial Sequence
  Description of Artificial Sequence: Synthetic coding sequence
atggcccaaagtcagggatgggtgaagcgctacatcaaggccttttgcaagggttttttcgtggctgtccctgtggctgtgacatttctggatcgggtggcctgtgtcgccagggttgagggtgcaagtatgcaaccgtcgctcaatccagggggcagccaatcttccgacgtggtattacttaatcactggaaagttagaaattttgaggtccacagaggtgatattgtaagcctcgtcagtcccaagaaccccgaacaaaagatcatcaagcgggtgatcgccctggagggtgacattgtgcggaccattggacacaagaacaggtacgttaaagtcccaaggggacatatctgggtggagggagatcaccacggccactccttcgattccaattcattcgggcctgtgagcctcgggctgctgcatgcgcatgcgactcacattctctggcccccagaaaggtggcaaaagctggagagcgttctaccccccgagcgccttcctgtccaacgggaagaggaatag

SEQ ID NO: 120500 - DNA, 528 bp, Artificial Sequence
  Description of Artificial Sequence: Synthetic coding sequence
atggcacagtctcagggctgggtgaagagatatattaaagctttctgcaagggctttttcgtagccgttccagtggccgttacgtttctggaccgtgttgcatgtgtcgcccgcgtcgagggtgcgtctatgcagcctagtctcaatccagggggtagccagagctctgatgttgtgctacttaaccattggaaggtccgaaacttcgaagttcaccgcggcgatattgtgtctctcgtgtcacctaagaatcccgagcagaaaattattaagcgagtgatagctctggaaggagatattgtcaggacgatcgggcataaaaacagatacgttaaagtgccccggggccatatttgggtggaaggagaccatcatgggcacagcttcgattccaatagcttcggacctgtgagcctaggtctgctgcatgctcatgccactcatatactgtggccccctgagaggtggcagaaactcgagtcagtgcttccaccagagcggctgccggtccagcgagaagaagaatag

SEQ ID NO: 120501 - DNA, 528 bp, Artificial Sequence
  Description of Artificial Sequence: Synthetic coding sequence
atggcccaatcccaggggtgggtgaaaagatacataaaagcattttgcaaagggttttttgtagccgttccagttgccgtcacttttctggaccgggtagcctgtgtggctagagtggaaggggccagcatgcaacctagtctgaaccccggcggttctcagtcaagtgacgtggtgttattgaaccactggaaggtgcgcaactttgaggtccaccgcggagatatagtgtccctggtctcccccaaaaaccccgagcagaagatcataaagcgcgtgattgcacttgagggtgatatagtgcgaactataggccataaaaatagatacgtgaaagtcccccgcgggcatatctgggtggagggggatcatcatggtcactcctttgattcaaactcatttggtcctgtttcactggggctgttacacgctcatgctactcacatcttgtggccacccgagaggtggcaaaaactggagagcgttctcccccctgagcggctccctgtgcagagggaagaggaatag

SEQ ID NO: 120502 - DNA, 333 bp, Artificial Sequence
  Description of Artificial Sequence: Synthetic coding sequence
atggcccaatcccagggctgggttaagcgctacatcaaggccttctgtaagggcttcttcgtcgccgtgccagtggcagtcacgttcttggatagagtcgcctgcgtggccagagtagaaggtgcctctatgcaaccgtcactgaaccccggcggaagtcagagctctgacgtagtcctcctgaatcattggaaagtgcgcaacttcgaagtgcaccggggcgacattgtcagtctcgtttctccaaagaaccccgaacagaagatcattaaacgggtcatcgcgctggagggggatatcgtgcgggacggacggaaattaaaaagaatttag

SEQ ID NO: 120503 - DNA, 240 bp, Artificial Sequence
  Description of Artificial Sequence: Synthetic coding sequence
atggcacaaagtcagggatgggttaagcggtatatcaaggcattctgcaagggcttttttgtggctgtacccgtggctgttactttcctcgatcgtgtagcgtgtgtggcgcgagtggaaggagcttcaatgcagccatctctgaacccaggaggttcacagagctccgatgttgttctgctaaatcactggaaggttagaaattttgaagtgcaccggggggacattgtgtcactctag

SEQ ID NO: 120504 - DNA, 528 bp, Artificial Sequence
  Description of Artificial Sequence: Synthetic coding sequence
atggcccaatcccaaggctgggtgaagcgatacattaaagccttctgcaaggggttttttgtagcagtccccgttgccgtgaccttcctagatcgagtggcctgtgttgcccgggtcgaaggtgcatctatgcaacccagtctcaacccaggaggatcgcagtcctctgacgttgtactcctgaaccattggaaagtgagaaactttgaggtgcacagaggagacatagtgagcttggtgtccccaaaaaaccctgagcaaaaaataattaagcgagttatagctctggagggggacatcgtgcgcactatcggacacaaaaaccgatacgtgaaagtgccacggggccacatttgggtcgaaggagaccatcatggacactccttcgattccaactccttcggcccagtgagtttaggattgttgcacgcccacgcgacccacatactgtggccgcccgagagatggcagaagttggagtcggtgctgcctcctgagcggctgccggttcagcgggaagaggaatag

SEQ ID NO: 120505 - DNA, 555 bp, Artificial Sequence
  Description of Artificial Sequence: Synthetic coding sequence
atggtgagaaagctcaaatttcatgagcagaaactactgaaacaggtggactttttaaactgggaggttacggatcacaacctgcacgagttgcgcgtccttcgaagataccggctccagcgccgtgaggattacactcgctataatcagctgtctcgcgctgttcgcgaactggctaggaggctgcgggatctgcccgaaagggatcagtttcgagtgagggcctctgccgcgctccttgacaagctctacgccctgggcctggtgcccactaggggcagcttggagttatgcgacttcgtgaccgcaagctctttttgccgtagaaggctccccacagtgctgctaaagctcagaatggcgcaacatctacaagcagcggttgcttttgtggagcagggccatgtgagggtgggaccagatgttgtgaccgatcccgcatttttagtgaccagatccatggaggacttcgtcacctgggtcgattctagtaaaataaaaaggcacgtcctggagtataatgaagagagggatgacttcgacctcgaggcctag

SEQ ID NO: 120506 - DNA, 555 bp, Artificial Sequence
  Description of Artificial Sequence: Synthetic coding sequence
atggtgagaaagttgaaattccacgagcagaaactgcttaagcaggttgacttcctgaattgggaggtgaccgatcataatctacacgaactgagagtgctccgcaggtacaggctccaaagaagagaagactacacccgatacaatcagctgtctagagcagtgagggagttggctaggagactcagagatctccccgaacgggaccagtttagagtgcgcgcaagcgccgcactactggataagttgtatgcgcttgggctggtgcccacaagaggttctcttgagctgtgtgacttcgtgacagcctcctcattttgccggcggcggcttccaacggtgttgttaaaactcaggatggcccagcatctgcaggctgctgtggccttcgtcgaacaggggcatgtccgcgttggccccgacgtggtgaccgacccagccttccttgtgacccggtcgatggaggatttcgtgacctgggtggacagctctaagatcaagcggcacgtgttggaatataatgaagaacgcgacgacttcgatttagaggcatag

SEQ ID NO: 120507 - DNA, 96 bp, Artificial Sequence
  Description of Artificial Sequence: Synthetic coding sequence
atggaagacttcgttacctgggtggattccagcaagattaagcgtcacgtgctagaatacaacgaagagagggatgacttcgaccttgaagcttag

SEQ ID NO: 120508 - DNA, 876 bp, Artificial Sequence
  Description of Artificial Sequence: Synthetic coding sequence
atgctgaggagagaggctagattgaggagagagtacctttataggaaagcacgcgaagaagcccagaggtctgcccaagaacgaaaagaacgcctgaggcgggctctggaagaaaatcgactcatccctacggaactgcgtcgggaggccctcgctctccagggatcattagagtttgacgacgccggtggtgaaggcgtgacgtctcatgttgatgatgagtaccggtgggctggtgtggaggatcctaaggtgatgatcaccactagccgagatccgagtagcaggctcaagatgttcgctaaggagctaaagctcgtgtttccaggcgcacagcgcatgaaccggggaaggcacgaggttggtgccctggtgagagcttgtaaggctaacggagttacggacctacttgtcgtgcacgagcatcgcggtacaccagtgggtttgattgtgtctcacctccccttcggacccaccgcctactttactctgtgcaacgttgtcatgcgtcatgacattcccgacttaggcacaatgtctgaagctaagccccacttgatcactcacggtttctctagcagactgggcaaaagggtttctgacatacttagatacttgttccctgtgccaaaggatgactcacatagggtgatcaccttcgcaaatcaagacgactacatttctttcaggcaccatgtgtataagaagacagaccacagaaatgtggagcttacggaggtgggcccacgctttgaattgaagctttacatgatccgacttgggacgcttgagcaggaggccaccgccgatgtggaatggaggtggcacccatacactaatacagccagaaagcgagtgttcctcagtaccgagtag

SEQ ID NO: 120509 - DNA, 2928 bp, Artificial Sequence
  Description of Artificial Sequence: Synthetic coding sequence
atggatctgaactccgcgtccacagtcgttttacaggtgctgactcaggctacgtcacaggacactgcggttctcaaaccagccgaagagcaacttaagcagtgggagacacagcccggattctattcagtcctcctcaacatttttaccaaccacaccctggatatcaacgtcagatggctcgctgttctgtatttcaagcacggaatagaccggtactggcggcgggtggctccccacgcgctcagtgaggaggagaaaacaaccctgagagccgggctcatcactaacttcaatgagccaatcaatcaaatcgctacacagatcgcagttcttattgctaaagtggcccgcttggactgtcctaggcaatggcccgagctcatacccactctcattgagagcgttaaggtgcaggatgacctgcgccagcaccgcgccctgctgactttctaccatgtgacaaagacgctcgcgtcgaaacgattggctgccgaccgtaagctcttctatgacctagctagcgggatctataatttcgcttgctccctgtggaatcatcacacggacaccttcctgcaagaggtgagcagcgggaacgaggcagctatcctgagtagcttagagagaacgctgcttagtctgaaagttttgcgtaaattgacagttaacggctttgttgaaccccacaaaaacatggaagtgatgggcttcctgcatggcattttcgagaggctgaaacagttcctcgagtgctcgcggagcataggcaccgacaatgtttgtcgagaccgactcgaaaagacaatcattctattcaccaaagtgctgttggatttcttggatcagcacccattcagctttacgcccctaatccagagaagtcttgaattttctgtgtcttatgtgtttaccgaggtcggagagggtgttacttttgaaaggttcatagtgcagtgcatgaatcttatcaaaatgattgtgaaaaactacgcatataaaccgtcgaaaaattttgaggacagcagccccgagacgctggaagcgcacaagattaaaatggcttttttcacttaccctactctcaccgagatatgtcgacgcctggtatcccattactttttactaaccgaggaggagctcaccatgtgggaggaggaccctgagggtttcacagtggaggaaacaggaggcgatagttggaagtattcattacgcccatgcacagaagtgctttttatcgatatctttcacgagtacaaccagaccctcacacctgtgttactagagatgatgcagacactgcaggggccaacgaacgtggaggatatgaacgccctgctcattaaggatgctgtctataatgcagtgggtctggctgcatacgaactgtttgactccgtggactttgaccaatggttcaaaaatcagctgctgcccgaactgcaagttatccataacaggtacaagcccctgagacggcgcgtgatatggctcatcggtcagtggatttcggtcaagtttaaaagtgacctgcgcccaatgctttacgaagcgatctgtaacctgctgcaagatcaagacctggtggtacggatcgagaccgcaacaactctgaagttgactgttgatgactttgaattccggacagaccaattcctgccttatctcgagacaatgtttactctgctgtttcaactgctccagcaggttacggagtgtgatacaaagatgcacgtgttgcacgtcctgtcctgcgtaattgaacgcgtgaacatgcagattcgaccctatgtgggatgcctggttcagtaccttcccttgctttggaaacaaagtgaggaacataatatgctccgatgcgctatattaacgactctgatccacctggtccagggtctcggagcagactcgaagaacctgtatcccttcctcctgccagtgattcagctatcaaccgatgtgtctcagccccctcacgtatacttgctcgaagatggtctcgagctatggctcgtgacactggaaaacagcccttgtatcacccctgaactattacgaatttttcagaacatgtcccctctgctggagttgtcatccgagaacttacgtacatgctttaaaatcatcaacgggtacatatttctgagctccaccgagttcctgcaaacttatgccgttgggctgtgtcagagcttttgtgaattgctcaaagaaattacaactgaaggccaagtgcaggttctgaaggtcgtagaaaatgcactgaaggttaaccctatcctgggtcctcagatgttccaacctatcctcccttatgtgtttaagggaataattgaaggggaacgataccccgttgtgatgtcaacctatttaggtgttatgggccgggttttgctgcagaacacgtccttcttcagctccctattgaatgaaatggctcacaagtttaatcaggaaatggaccagctcttaggaaacatgatagagatgtgggtagaccgcatggataacataacgcagcccgagagaaggaagctgagtgctttagccttactgtccttgttaccatccgataactccgtcattcaggacaagttttgcggtattataaacatatcggtggaggggctccatgatgtgatgaccgaagaccccgaaacaggaacttataaggattgtatgctgatgagccatctcgaagaacccaaggtgaccgaggatgaagagcctcctacagaacaggataaacgcaagaaaatgcttgctttgaaggaccccgtacatactgtctcgcttcagcagtttatctacgagaagctgaaggcgcagcaagagatgttaggagaacaggggtttcaaagtttaatggagacagttgacacggaaatcgttacccagcttcaggagtttctgcagggtttctag

SEQ ID NO: 120510 - DNA, 3048 bp, Artificial Sequence
  Description of Artificial Sequence: Synthetic coding sequence
atggtgcagccaatcatacatctgggttacgtcgtgtactctctgctttacctgggctataaacccgtccagcacgtgacggccctgaacaccgtatccagctgccacaagatggtgtctatggatctgaactcggcttcaacagtggttctgcaggtcctcacacaagcaacctctcaagatacagctgtcttgaagccagccgaagagcaacttaagcagtgggaaacccagccaggattctatagtgtgctccttaatatctttacaaaccacaccctggacattaacgtgcggtggctggctgtcctgtatttcaaacacgggattgacagatactggagaagagttgcccctcatgcactgtctgaagaggagaagacaactctccgggccgggcttatcaccaattttaacgagccaatcaatcagatagccactcagatcgccgtactcatcgcaaaggttgcccgactcgactgccctcggcagtggcctgagctaattcccaccctcatcgaaagcgtgaaggtgcaggacgacctgcggcagcacagagccctgctcacattttatcacgttacgaaaacgctggctagcaagagacttgctgccgaccggaagcttttctacgaccttgcttcgggaatctacaatttcgcttgcagcctttggaatcaccacaccgatacatttctccaggaggtgagcagcggcaacgaagccgccatactgagctctctggaacggacattgttgtccctgaaagtccttcgaaagttaaccgtgaatggtttcgtcgagccgcacaaaaatatggaggtcatgggcttcctgcacggcatcttcgaaaggctgaagcaattcctagagtgtagtcggtctattggaaccgacaacgtctgtagggataggctcgagaaaaccattattctgtttacgaaggtcctgcttgatttcttagatcagcaccccttcagtttcacgcctctcattcagcgaagtctggagttcagtgtgagctatgttttcactgaagttggcgaaggggtcacattcgagcgcttcattgtgcagtgtatgaatttaattaagatgatcgtgaagaattatgcatataaaccaagtaaaaacttcgaagattcaagccccgagactctggaggcacataagatcaaaatggctttcttcacctatcctacactcacagagatctgcaggagattggtgtcacattatttcctgctcaccgaggaagagctgacgatgtgggaggaagatccagaggggttcactgtcgaagaaacggggggagactcctggaagtatagcctgcgcccctgcaccgaggtgctcttcattgacattttccatgaatacaatcaaaccttgacacccgttctgctggagatgatgcaaacccttcaggggcctaccaacgtggaggatatgaacgccctcctcataaaagatgctgtgtataatgctgtggggctggctgcctatgaactcttcgactcagtcgatttcgatcagtggtttaagaaccaattactcccggagctgcaggttattcataatcgctacaagcccttacgacggcgggtcatatggctgatcgggcagtggatatcagtaaagtttaaatccgacctccgacctatgctctacgaggcaatctgtaacctgttgcaggaccaggatcttgtggttcgcatcgagacggctaccacgctcaagctgacggtggacgattttgagttcaggacggatcagtttttgccgtacctagaaaccatgtttaccctactttttcagttgctgcaacaagtgacagaatgtgacacaaagatgcacgtgctgcacgtgctctcatgcgtgatagagagggtgaacatgcagatccgcccctacgtcggatgtttagttcagtatttacctttgttgtggaagcaaagtgaagagcataacatgcttcgttgcgccatcctgacgaccctcatccatctggtgcaaggactgggggctgattctaagaatctgtatccatttcttctgcccgtcatccagttatcaactgatgtgtcgcagccaccccacgtctacttgctggaggacgggctggaattgtggctcgtcactctggagaacagcccttgcataacccccgagttgctgagaatatttcagaatatgtctcccttgctggagctctccagtgagaacttgcgaacctgtttcaagataatcaacgggtacatctttctgtcctccacagagtttcttcagacttacgcagtggggctgtgccaatcattttgtgaactactcaaagagataactaccgaagggcaggtgcaagtgctcaaggtggtagagaatgccctgaaggtgaatccaattttggggccccagatgttccagccgattctaccctacgtttttaagggtatcatcgagggcgaacggtatcccgtagtcatgtcaacctacctcggcgtgatgggcagggtcctccttcaaaatacctccttcttcagctcactgctcaacgaaatggctcataaatttaaccaggaaatggaccagctactcggcaacatgatcgaaatgtgggtcgaccggatggacaatatcacgcagccagaaaggcgcaagctgagcgcccttgcactgctttctctcctaccatctgataacagcgtgatccaagacaaattctgcgggatcatcaatatttcagttgaaggtctgcacgacgtcatgacagaagaccccgaaactgggacttacaaggactgtatgcttatgtctcacctcgaggagcccaaagtgacggaggatgaagaaccgcctacagagcaagacaagaggaagaagatgttagcccttaaggatcccgtgcacaccgtatcactgcagcagtttatttatgaaaaactcaaggcccaacaagaaatgctgggagaacaggggtttcaatcccttatggagacggtggacaccgagattgtgacccagctgcaagaattcctgcagggattttag

SEQ ID NO: 120511 - DNA, 195 bp, Artificial Sequence
  Description of Artificial Sequence: Synthetic coding sequence
atggatctaaatagtgcgagtaccgtggttctgcaggtgctgactcaggccactagccaggatactgcagtgctgaagccagccgaagagcaactcaagcagtgggaaacccagccgggattttatagcgtgctacttaatatcttcaccaaccacacactggatattaatgtcaggtggttggctgtgttatag

SEQ ID NO: 120512 - DNA, 489 bp, Artificial Sequence
  Description of Artificial Sequence: Synthetic coding sequence
atggatttgaattcagcttccaccgtggtactgcaggttttgacgcaggccactagtcaagacacagccgttctcaagcctgctgaggagcagctgaaacagtgggagacccagcccggcttctattcagtcttactcaatatctttacaaatcatacgcttgatattaatgtgcgctggcttgctgttctttatttcaaacatgggattgaccggtactggaggagggtagcaccccacgcactgtctgaggaggagaaaacaactttgcgggcgggcctgatcaccaattttaacgaacctatcaaccagattgccacacaaatcgccgttctcatagcaaaggtggcaaggctggactgcccacgccaatggccagaacttattccgaccctcatcgagagtgtgaaggtgcaggacgacttgaggcagcaccgcgccttgctgacattttatcacgtcacaaaaaccctggccagcaagaggtag

SEQ ID NO: 120513 - DNA, 450 bp, Artificial Sequence
  Description of Artificial Sequence: Synthetic coding sequence
atggatttgaacagcgcaagtaccgttgtgctacaggtgctgactcaggccacgagccaggatacagccgtcctgaagcctgcagaggagcagcttaagcaatgggaaactcagccagggttctattcagtgttacttaacatttttacaaatcatacactggacattaacgtgcgctggcttgcggtcctgtactttaagcatggcatcgatcgatattggaggagagtggcccctcacgcactgtccgaagaggagaagacaacactccgcgctggactgattactaattttaatgagccaataaaccagatagcgacccagatcgccgtcttaatcgccaaggtggcccggctcgattgccccagacagtggccagagctgatacctaccttgattgaatccgtgaaagtgcaagatgatctccgtcaacaccgcgcccttctgtag

SEQ ID NO: 120514 - DNA, 1425 bp, Artificial Sequence
  Description of Artificial Sequence: Synthetic coding sequence
atgatgcagaccctgcagggtccgaccaatgtggaggacatgaatgctttgcttataaaggacgctgtttataatgctgtcggcctggcagcttacgagctattcgattctgtggactttgatcaatggtttaagaaccagcttctgcccgaactgcaggtaattcacaatagatacaagccactgaggaggcgggtgatttggctgatcggtcagtggatctccgtcaagtttaagagtgatctcaggccaatgttgtatgaggctatctgtaatcttttgcaagatcaggacctggtggtccggatcgagactgctaccaccttgaagctcacagtggatgactttgaattccgtactgatcaatttctcccatacttggaaacaatgtttactctcttgttccagctgctgcagcaagttactgaatgcgatactaaaatgcacgtgcttcacgtcctgagctgcgttatcgaacgggtgaatatgcaaatacgaccatacgtcgggtgtttagtccagtacttgccgctgctttggaagcagtccgaggaacacaacatgctccgctgtgccatcctgaccaccctgattcacttggtgcagggattgggtgcagactccaagaatttgtacccctttttacttcccgttattcagctcagtaccgatgtctctcaaccacctcacgtttacttgctggaagatggcctcgagctttggctggtgaccctcgagaactcaccatgtataacacccgagctactaaggatttttcaaaacatgtcaccactgctcgaactgtctagtgagaatctgcgtacatgctttaagattataaatgggtatatcttcctttcaagcactgaatttctgcaaacttatgcagttggactgtgccagtccttctgtgaactgcttaaggagatcaccaccgagggtcaggtgcaggtcctgaaagttgtcgaaaatgcccttaaagtcaatcctatactggggccacagatgtttcagccgatactgccatacgttttcaagggcattatcgagggagaaagatatcctgtcgtcatgtcgacctacttgggtgtgatgggtagagtgttgttgcaaaacaccagcttcttctcaagcctcctcaacgaaatggcccacaagtttaatcaggaaatggatcagctcctggggaatatgatcgagatgtgggtggaccggatggataacatcactcagcctgagcgaaggaaactcagcgctcttgccttgttatccttgctgcctagtgacaactcagtaattcaggacaagttttgtgggatcataaacatatcagtggagggcctgcatgatgtcatgacagaggaccctgagacgggcacatacaaggattgcatgctgatgagccatctggaagaacctaaatag

SEQ ID NO: 120515 - DNA, 3117 bp, Artificial Sequence
  Description of Artificial Sequence: Synthetic coding sequence
atggatccaaacacaataattgaggcgttacgtggcacgatggacccagcactccgggaggccgcagagcgacagctcaacgaggcacacaaatctctaaacttcgtttctactctgctccaaataactatgtccgagcaactggatctaccggttagacaggctggcgtgatctacctaaaaaatatgatcactcagtactggccggaccgagagaccgcacccggcgacatctcaccctataccattcctgaggaggacaggcattgtatacgggaaaatattgtggaagccattatacactctcccgaactgatccgggtgcagctgaccacctgtatccatcacataattaaacacgattatccctcaagatggacagctatagtcgacaagataggtttttatctccagtccgacaattccgcctgctggttaggtatcctgctgtgcctctaccagttagtgaagaactacgaatacaaaaagcccgaggaaaggtccccgttggtggctgctatgcaacatttcttgcccgtgctcaaagatagattcatacagttactgtctgatcagtcagaccagtcggtactaattcagaagcagatttttaagatattttacgcactagtccaatacacactgcccctggaactgattaaccaacagaacctgacagagtggatcgagatactgaagactgtggttaaccgggacgttcccaacgaaactctgcaggtcgaggaggacgatcgacccgaactaccttggtggaaatgtaagaagtgggcgttgcacatcctggccaggctgtttgagcgctatggatctcctggcaatgtgagcaaggagtacaacgagttcgccgaggtgttcctcaaggcgttcgccgttggagtgcaacaggtccttctgaaagttttgtaccaatataaagagaagcagtatatggcgccccgggtacttcagcagactctcaactatattaatcagggcgtttcccacgcactgacctggaagaatctgaagccgcatatccaagggatcatccaggatgtaattttccccctgatgtgttacaccgatgccgacgaagaactttggcaagaagatccatacgagtatattaggatgaagttcgatgtattcgaggatttcattagcccaacaactgcagctcagaccttgctattcaccgcttgctctaaaagaaaagaggtgctgcagaaaactatggggttttgctatcagattctgactgagcctaatgccgatccacgcaagaaagatggtgcccttcatatgatcggctcgctcgctgagatcttactaaaaaagaaaatctacaaggaccaaatggagtatatgctccagaaccacgtgttccccctgttctcttcagaactgggctatatgagagcccgcgcatgctgggtcctgcactacttttgtgaggtgaagtttaagtcagaccagaatctgcaaactgcccttgagctgacacggcgatgcttaatcgacgacagagagatgccagtgaaggttgaggcagcaatcgctctgcaggtgctgatatctaatcaggagaaagccaaagagtacataactcccttcattcggcccgtaatgcaggctctacttcatattattagggagacggagaatgacgatctgactaacgtcatccagaagatgatctgcgagtactccgaggaggtcacaccaattgccgttgaaatgacgcagcaccttgcaatgacttttaaccaggtaatccagactggccctgacgaggaggggtcagacgataaggctgtaacagctatgggtattctgaataccattgataccctgcttagtgtcgtggaagatcataaggaaattactcagcagctggagggaatctgtctgcaggtgataggcaccgtgttgcagcagcacgtcctcgagttctacgaggaaatcttctccctggctcattccctgacatgtcaacaggtctccccccagatgtggcagctgctccctttggtctttgaggtcttccagcaagacggcttcgactacttcaccgacatgatgcccttactacataattatgtgactgtggatacagacacgctgctctccgataccaagtacctggagatgatctactctatgtgcaagaaagtgctgaccggcgttgctggtgaggacgctgaatgccatgcagctaaacttctcgaggttattattcttcagtgtaagggacgggggatcgatcagtgtatccccctctttgtcgaggccgcactcgaaaggcttactcgggaagtcaagacatccgaactgcgaactatgtgtctccaagtggcgatcgccgcgctgtactataacccccacctcctactcaacacgctagagaatctgcggtttccaaacaacgtggagccggtcacaaatcactttattacccagtggctcaacgacgtcgactgtttcctaggccttcatgatcgaaaaatgtgtgtgctgggactttgcgctttgattgatatggagcagatcccacaagttctcaatcaggttagcggacagatacttccggccttcattctgctgttcaatggactgaagagagcctatgcctgccatgctgagcacgagaacgactcagatgacgatgacgaggctgaagacgacgacgagaccgaggagctgggctccgacgaagatgatatagatgaagatgggcaggaatatctggagatactggccaaacaggcaggagaggatggggacgatgaggattgggaggaagatgatgccgaagaaaccgcgctagaggggtactccacaattatcgacgatgaagataatccagttgacgagtatcaaatttttaaagccattttccaaactatacagaacaggaatcctgtgtggtaccaggccctgacacatggtctaaatgaggaacagaggaaacaattgcaggatatcgctactttggcagatcagcgaagggctgcacacgaatctaagatgatcgaaaagcacggggggtataagttctcagcgccagttgtgcccagttctttcaactttggcggccctgcccctggaatgaattag

SEQ ID NO: 120516 - DNA, 3114 bp, Artificial Sequence
  Description of Artificial Sequence: Synthetic coding sequence
atggaccttaacagaataattcaggccctgaaggggacgatcgacccaaagctgcggattgctgcagagaatgagctgaatcagtcttataaaataatcaactttgcccccagcttgttaaggataatcgtttctgaccatgtggagtttcccgtcaggcaggcagccgctatttacttaaaaaatatggtgacccagtactggcccgacagggagccccccccgggagaagctatctttccattcaatatacatgagaatgacagacagcagattcgagacaatatcgtcgagggcattatccgatcacctgacttggtgcgcgtgcaattgaccatgtgcctccgggctattatcaaacacgacttccctggacactggccgggggttgtggacaagatcgattactacctgcagagccagtctagtgcatcatggttaggatccttactctgcctataccagctcgtgaagacatatgagtacaagaaagccgaggagcgcgagcccctgatcatcgccatgcagatattcctgcccaggatccaacaacaaattgttcagcttcttcctgattcaagttactactccgttctgctgcaaaaacagatactcaaaattttttatgcgctagtccagtacgcgttacctcttcagctggtgaataatcagacgatgacgacgtggatggaaatctttagaacgataattgacagaacagtccccccagagacactacatattgacgaggacgatcgacccgagctggtgtggtggaagtgtaagaaatgggctcttcatatcgtggcccggcttttcgagcgatacggtagtccagggaatgtgaccaaggagtattttgaattcagcgagttctttctaaagacctacgccgtgggtatacagcaagtactcttaaaaattctggatcagtaccgccagaaagagtatgtggcccccagagttttgcagcaggccttcaactatctcaaccagggcgtggtgcattccatcacctggaaacagatgaagccgcacatccaaaatatatctgaagatgtaatcttctcagttatgtgctacaaggatgaggacgaggagctctggcaagaggacccttacgagtatatccggatgaagtttgatattttcgaggactatgcctcgccaaccactgccgcccaaaccctattgtacaccgcagccaagaagcggaaagaagtccttcctaagatgatggctttttgctaccagatcttgactgatccaaatttcgacccccgcaagaaggatggagctctccacgtgattgggtcacttgccgagattctactcaagaaatcactctttaaagaccaaatggagctgttccttcaaaaccatgtgtttccactgctcttatccaatctgggatatctccgggcaagatcttgctgggtgctccatgcattctccagcctcaagttccacaatgagctaaatctgcgcaatgcagtggagcttgcaaagaaatcccttatcgaggataaagagatgccggtaaaggtggaggctgccctcgctctgcagagcctcatctccaaccaaatccaggccaaggagtacatgaaaccgcacgttaggcccatcatgcaggaactgctgcatattgtcagagaaacagaaaacgacgatgtgactaacgtgatccaaaaaatgatttgtgagtacagccaggaagtagccagtattgctgtcgatatgacacagcacctcgccgaaatattcggcaaggtcctacagtctgacgagtatgaagaggtagaggataagactgtgatggctatgggaattctgcacacaatcgataccatcctgaccgtggtggaagaccataaggagataacccagcagttggagaatatttgtctgcgcattattgacctcgtgctgcaaaaacatgtgattgagttctatgaggagatcctctcccttgcttacagcctcacctgccacagcattagtccacaaatgtggcagctgcttggcatcctctatgaggtgttccaacaagattgcttcgagtacttcacagatatgatgcctcttctgcacaactacgtgacaatagacactgacaccctgctgtcaaatgcaaaacatttggagatcttattcacaatgtgccgcaaggtgttgtgtggcgatgcgggcgaagatgctgaatgtcacgccgcgaaactcctggaggtgattatccttcagtgtaaaggccgtggaatcgatcagtgtatccctctgtttgtgcagctcgtgctggaaaggctcaccaggggtgtgaagacctccgagctccgtaccatgtgtctgcaggtggccatcgcggccctctattacaaccctgatctgctgctgcacacattagaacgcatacaactcccgcacaatccagggcccataacggtccagttcataaaccagtggatgaacgacaccgactgttttttgggtcaccacgatcgtaagatgtgcatcatcggtctgagcattctgttggagctgcagaaccggcctccggcagtggacgcggttgttggacagatcgttccctccatcctgtttctgtttctggggctgaagcaggtatgtgctactcggcaattagtcaaccgagaggacaggagcaaagccgaaaaggctgacatggaagagaatgaggagattagctcagacgaagaggagaccaacgtgaccgcgcaggccatgcaatctaacaacgggcggggcgaagatgaggaggaggaagatgacgattgggacgaagaagtgcttgaggaaacagcccttgaaggtttctccacacctttggacctggataattccgtggacgaatatcagttctttacacaggccttgataacagtccaaagtcgggatgccgcctggtaccagttgctgatggcacccctgagtgaggaccagagaacagcactccaggaagtttatacactcgctgagcaccggcggacagtggccgaggcaaagaagaagatcgaacagcagggcggtttcacctttgagaataagggagtgttgtccgcattcaacttcgggaccgtgccttcaaacaactag

SEQ ID NO: 120517 - DNA, 2499 bp, Artificial Sequence
  Description of Artificial Sequence: Synthetic coding sequence
atggaaagcctgactctgaaaggatacgccctccccctgcagttagttaacaaccagaccatgactacttggatggaaatttttcggacaattattgacagaaccgtcccaccagaaaccctgcatatcgacgaagacgacaggccagagctggtctggtggaaatgcaaaaagtgggccctgcacatagtcgcccgactgttcgagaggtacggatcgccaggaaacgtaactaaagagtatttcgagttcagcgagtttttcttaaagacctatgcggtgggcattcagcaggtgctcctaaaaatacttgaccagtacagacaaaaggagtatgtcgcacctagagtgctgcaacaggccttcaattacctgaatcagggggtggtgcatagcatcacctggaaacagatgaagccacacattcagaatattagcgaggacgtgatcttctcagtgatgtgttacaaggacgaagatgaagagctatggcaggaggatccctatgagtatatcagaatgaaattcgacatcttcgaggattacgcttcccctacgaccgcagctcagaccttactttatactgctgccaagaagcgcaaagaggttctgccgaaaatgatggcattttgctatcagatccttaccgatcccaacttcgacccacgcaagaaggacggtgcactgcacgttattgggtcacttgctgagattctgctaaagaagagcctgttcaaagaccagatggagcttttcctacagaaccatgtgttccccttgttgcttagcaatctagggtacctgcgcgcccgtagttgctgggtgcttcatgctttctcttctctgaaattccacaacgagctgaatctgaggaatgcagtagaactggccaagaagagcctgattgaggacaaagaaatgccagtcaaggttgaagccgctttagctttgcagtccctgattagcaatcaaatccaggcaaaagagtatatgaaaccacacgtcagacccatcatgcaagaactgttacacatcgtgagagagacagagaacgatgacgtcacaaatgtcattcagaaaatgatatgcgagtattcgcaggaagtggcttccattgctgtggacatgacccagcacttagcggaaatctttggcaaagtgctgcagtccgatgaatacgaggaagtggaggataaaacggtgatggccatgggcatactgcataccatagatacaattctgacagttgtggaggatcacaaggagatcacccagcagctggagaacatttgtctcagaattattgatctcgtcctgcagaagcatgtgattgagttttatgaggaaattctgtccttggcctattcattaacctgtcactccatttcaccccaaatgtggcaattgctcgggatcttatacgaagtgtttcagcaggactgctttgaatattttaccgatatgatgcctcttctgcataattacgttacgatcgacaccgacactcttctgtccaacgctaaacaccttgaaattctgttcaccatgtgccggaaggtgctgtgcggcgacgctggggaggatgccgagtgtcatgctgctaagctcctagaagtgattatcctgcagtgtaagggacgaggcatcgaccagtgcattcccctgtttgtgcagcttgtcctcgaaagactaaccaggggggtcaaaacaagcgagctgcgcaccatgtgcctacaggttgccatagcggccctctattataatcccgatctcctgctccacactttggaacgcatacagctgccccataatccaggacccattacggtccaattcatcaaccaatggatgaacgataccgactgcttcttgggccaccacgacagaaagatgtgcattattggcctgagtatcttactggaactgcaaaatcgccctcccgccgtggacgctgtggttggacaaatcgtgccaagtatcttgtttttatttttaggcttgaagcaggtatgtgccacacgtcaactggtgaatcgggaagaccgctcaaaggccgaaaaggccgatatggaggagaatgaggagatatcatccgatgaggaggaaactaatgttacagctcaggcaatgcagtccaataatgggcggggcgaggatgaggaggaggaagatgacgactgggatgaagaggtactggaggagacagcccttgaaggattctccacgcctctggatcttgataacagtgtcgacgaatatcaattcttcactcaagccctcataacggtccagtccagggacgctgcttggtatcagcttcttatggctcccctctcagaggatcagcgcacagccctacaggaagtttacactctggcagaacatcggagaactgtcgctgaagccaaaaagaaaatagagcagcagggtggcttcacctttgaaaataaaggtgtgctttccgctttcaactttggtactgttccgagcaataactag

SEQ ID NO: 120518 - DNA, 1542 bp, Artificial Sequence
  Description of Artificial Sequence: Synthetic coding sequence
ttgtcgagtggtcacgaactggcaaaagaatatatgaagccgcacgtgcgtcctatcatgcaagagctgcttcacatcgttcgcgagactgaaaacgacgatgtcactaacgtgatccaaaagatgatatgcgagtatagtcaagaggtggcatccatcgccgttgacatgactcagcatctagccgaaatctttggcaaagtgttgcagtcagacgaatacgaagaagtggaagataaaacggtaatggccatgggcatcctgcacactatcgatacaatccttaccgttgtggaagaccacaaagaaatcactcagcagctggagaacatctgtttaagaatcatcgacctggtcctgcagaagcacgtgattgagttctacgaagaaatcctcagccttgcctatagcttaacatgtcacagtataagcccgcagatgtggcagcttctgggaatcttgtatgaggtttttcagcaggattgctttgaatacttcaccgatatgatgcccctgcttcacaattatgtgacgatcgacacagacaccctcctgagcaatgctaaacatctggaaatcctttttaccatgtgcaggaaggtcctgtgcggggacgcgggagaggatgcggaatgccacgctgccaaactgctggaggtgatcatactgcagtgtaagggcaggggcatcgaccaatgtattcccctctttgtgcagttggttcttgaaaggctgacccgcggtgtgaaaacaagcgagctcaggacaatgtgcctgcaggttgccattgcagccctgtattacaatccggacctactacttcacacgcttgaacgcattcagttaccccataaccccggcccaattacagtccaattcattaaccagtggatgaacgatacggattgtttcttgggtcatcacgacaggaagatgtgcataattggcctttccatcctgctggaactccagaaccgcccaccggcagttgatgcagtggttggccagattgttccaagcatcctgttcctcttcctgggcctgaagcaggtgtgcgctacccggcaattggtaaatcgcgaagaccgatcaaaggccgagaaggctgacatggaggaaaatgaagaaatttcatcagacgaggaggagacaaacgtcaccgcccaggccatgcagtccaacaacggacgaggagaggacgaagaagaggaagatgacgactgggatgaggaagttttggaggagacagccctggaaggttttagcaccccgctcgatctcgacaacagcgtggacgaatatcagttcttcacccaggcactgatcaccgtgcaaagcagggatgccgcttggtatcaactgctgatggccccgcttagtgaggatcagagaactgctctacaggaagtgtacaccctagccgagcacaggcggactgtggcggaggcaaaaaagaagatagaacagcagggcgggttcactttcgagaacaaaggagtactgtccgcatttaactttgggacagtgccatccaataactag

SEQ ID NO: 120519 - DNA, 3546 bp, Artificial Sequence
  Description of Artificial Sequence: Synthetic coding sequence
atgcctgaaaacccagctactgacaaactccaggtgctgcaggtgctggaccgcttaaagatgaaactacaggaaaagggtgatacatcccaaaacgagaagctttcgatgttctacgagacccttaaaagcccactattcaaccaaattttgactctgcaacagtccattaaacaactaaagggccagttaaatcatatcccctcagactgctctgcaaatttcgacttttctaggaagggtctcttggtgtttaccgacggctcaataaccaacggcaacgtccatcgtccaagcaataactcaacggtctccgggctgtttccctggacacctaaactgggtaatgaagacttcaatagtgtgatccagcaaatggcccaggggcggcagatcgagtatattgatattgagcgcccttccaccggcgggctgggtttctctgtcgttgcgctgagaagccaaaatctggggaaggttgatatcttcgtaaaagacgtacagcccggctccgtggctgacagagatcagcgtctgaaggaaaatgaccagatactcgcaattaatcatactccccttgaccagaacatctctcaccaacaggccatcgcattgctccagcaaactaccggtagcttgagactaattgtggccagagagccagtgcatacaaaatcctcgacttctagctccctcaatgacacaaccctccccgagacagtctgttggggacacgtggaggaggtggaattaattaacgatgggagcggattaggttttggtatcgtgggcggcaaaacgtcaggggttgtagttcgcacaatcgtccccggcggccttgccgaccgggacggccggctccagaccggtgatcacattttaaagatcggaggcacaaatgtgcaaggaatgacttcagaacaggttgcccaggtactccgtaactgcggcaacagcgtgagaatgctagttgcacgtgaccctgccggtgacataagtgtcaccccacctgcgcccgcggccctgcctgtggctctcccaacagttgcaagtaaggggccaggcagcgactccagcctgttcgagacgtacaacgtggaattggtccgcaaggatggccagtcattagggatcaggatcgttggttacgtggggacctcgcataccggggaggcttccgggatctatgtgaaaagcatcattccggggagcgcagcctatcacaacgggcatatccaagttaatgataaaatcgttgccgtggatggagttaatattcagggcttcgccaatcacgacgtggtggaagtgctgagaaatgctggtcaggtcgtgcacctcaccctagttcggcggaaaacaagtagttctacttctcctctggagcctccttctgatcggggcacggtcgtagagccattgaaacctccagcactgtttctgactggggccgttgaaacagagaccaacgtcgacggagaggacgaggagatcaaggaacgaatcgataccctgaagaatgataatatacaagctttggagaaactggagaaggtgccagactcaccagaaaatgagctgaaaagcaggtgggagaacctgctaggcccagactatgaagtgatggttgcaactctggacacgcagatcgctgacgacgctgagctacagaagtacagtaagttactgcctatacataccctgcgccttggggtagaggttgattcattcgatgggcatcattacatctcctctattgtgtctggaggtcccgtggacacactggggctattgcagccagaggatgagctgcttgaagtgaacggcatgcagctatacggcaagagcaggagagaagctgtcagctttcttaaagaggttccaccaccttttacactggtgtgttgcagacggctatttgatgacgaggcaagcgtggatgaacccaggaggacggagacgtccctacctgagaccgaagtggaccataacatggatgtaaataccgaggaggacgatgatggtgagctcgccctctggtcacccgaagtgaaaatcgtcgagttggtaaaggactgcaagggcctaggttttagtatccttgactaccaagaccccttggaccctacaagaagcgtgatagtaatccgctccttagtggcggacggagtggccgaacggtcaggcggtttactgcccggagatagacttgtctcggtcaatgaatattgtcttgataatactagtctggctgaagcagttgagattttgaaggctgtacccccagggttagttcacctcggcatctgcaagccgttagtcgaggacaacgaggaggagagctgttacatcctgcatagtagtagcaatgaagacaaaacagaattctctgggacaattcacgacattaattcctccctcatcttggaggcacctaagggtttccgggacgagccttactttaaagaggagctcgtcgacgaacctttcttggatttggggaagagctttcactcacagcagaaagaaatagagcagagcaaagaagcctgggagatgcacgaattcctgactcctaggctgcaggagatggacgaagaaagggaaattctggttgatgaggaatacgagctctatcaagatccatctcctagcatggaactctaccctctcagtcacatccaggaggcaacacctgttccttctgtgaacgaacttcatttcggcacccagtggctccacgacaacgaaccgtctgagtcgcaggaggcgcggaccgggcgcaccgtgtacagtcaagaggcccagccatatgggtactgcccggaaaatgttatgaaggagaacttcgtaatggaatccctgcccagtgttccatcgactgaggggaattcccagcaagggcgcttcgacgatctggagaacttgaactcactggcaaagacttcactagacctcggcatgattcctaatgacgtacaaggcccaagtctgctcatagacttgcccgttgtagctcagaggagggaacaggaggacctgcctttgtatcagcaccaagctaccagggttatatcaaaagcatctgcctacactggcatgcttagctctaggtatgcaactgacacatgtgagctgccagagagggaggagggggagggggaagaaacacccaacttcagtcactggggcccaccccggatcgtggagatcttcagagagcccaatgtcagtttgggaatatccattgttggggggcagaccgtgataaaaaggctcaaaaatggcgaggaattgaagggcatttttatcaagcaggtactggaagacagtcctgcaggcaagactaacgcgctcaagactggggacaaaattctggaagtgagtggggttgacctccagaacgcctcacatagcgaggccgtcgaggccatcaagaacgctggcaatcctgtggtgttcatagtccagtctctgagcagcacacctgcctgggtcacagagcaggacagcgtctctaaaaagaagaagaaccacgagggctag

SEQ ID NO: 120520 - DNA, 600 bp, Artificial Sequence
  Description of Artificial Sequence: Synthetic coding sequence
atggtgcagggcggcttcccagaaaaaattagacagcgatacgccgacctgcccggtgaactgcatatcatcgaactggaaaaagacaagaatggcctgggacttagtctggctggaaacaaagatcggagcagaatgtccatatttgttgtcggaatcaaccccgagggacctgccgccgcagatggacggatgcggatcggtgatgaacttctcgagattaataaccagattttgtatggcaggagtcaccaaaatgcctctgcaatcattaagactgctccttctaaagtgaagctggtgttcatcagaaatgaagatgcggtaaaccaaatggctgtaacacctttccccgtacccagctcatcgccttcgtcaatcgaggatcagagcggcacggaaccaatttcatctgaagaagatggatctgttgaagtggggatcaagcagctcccggaaagtgagagctttaaactggctgtaagtcaaatgaaacaacaaaaataccctacaaaagtctcattcagcagccaagagattcctcttgctcccgcttcctcttaccacagtaccgatgccgactttaccggctacgggtag

SEQ ID NO: 120521 - DNA, 4746 bp, Artificial Sequence
  Description of Artificial Sequence: Synthetic coding sequence
atgcccgaaaacccagccaccgacaaactgcaggtgctccaggtgctggaccgtttaaagatgaagctgcaagaaaaaggtgacacgtcccagaatgagaaactaagcatgttctatgaaaccttgaagtcccccttgttcaaccagattctgactctacagcagagcataaagcaactgaagggacagctaaaccatatcccttctgattgcagcgcgaatttcgacttctcaaggaaggggctgcttgtgttcactgatgggtccattacgaatggaaatgtgcaccgcccttcaaacaactctacagtgtctggtttgtttccgtggacaccaaaattggggaacgaggactttaacagtgtgatccaacaaatggcgcaagggcgccagatcgagtacattgatattgaaagaccttccactggaggactgggcttttccgtcgtggccctccgtagccagaatctggggaaggtggacatcttcgtcaaagatgtgcagcccggaagcgtggcagaccgggatcaacggctcaaagaaaatgatcagatcctggccatcaatcacacacctttagatcagaatatctctcatcaacaggctatagcactcttgcagcagaccaccggcagtctgcgactcattgttgctagggaacctgttcacacaaaatcatcaaccagcagttcccttaatgacactactttgcctgagacggtgtgttggggacacgtggaggaagtcgagctgattaacgatggcagtgggctaggcttcggcatcgtggggggtaaaacctctggcgtggtcgtacgaacaatcgtgccaggtgggctcgccgacagggacgggcggctccaaaccggcgatcacattctgaaaatcggcgggaccaatgtccagggcatgactagtgagcaggttgcccaggtgctgcgcaattgtggtaattctgtgagaatgctggtagcgcgcgacccagccggcgacatttctgtgactccccctgcccctgctgctctcccggtagccctgccaaccgtggcaagcaagggacccggtagtgacagcagtctatttgaaacctacaatgttgaactcgtccgaaaagatggccagagtctaggaataaggatcgtgggatacgtagggacaagtcatactggggaagctagcggcatctatgtaaaaagcatcattccgggaagcgccgcataccataatggacacatccaggttaacgataaaatcgtggcagtggatggagtcaatatccagggttttgcgaaccacgatgtcgtcgaggtactgcggaacgccggccaggtcgtgcatctcacactggtcaggcggaaaacttcaagctccacttcccccctggaacccccttcagaccgtggaaccgtggttgagcccctcaagcccccagcactctttttgactggagcagtcgagacggaaactaatgtggacggagaagacgaagagattaaagagcggatcgataccctcaagaacgataatatacaggcactggagaagcttgagaaggtaccggacagtccggagaatgagctgaaaagccgctgggagaacctgttaggacccgactacgaggtgatggttgccacacttgacactcaaattgctgacgacgcggaattacaaaaatattccaagcttctccccattcacacgcttcggctcggggtggaggttgattcctttgacggccatcactatatatcatccattgtgtcaggcgggcctgtagacactctaggcctgcttcagccggaggacgaactattggaagtgaacgggatgcagctctatggaaaaagcagaagggaagctgtctcatttctcaaagaagtaccccctcctttcacactagtatgctgtcgcaggctgtttgatgacgaggccagcgtcgacgaaccccgtcgcactgagacttcgttgccagagacagaggtagatcataacatggatgtgaacaccgaagaggacgatgacggagagctcgctttgtggtcaccagaagtgaaaatcgtggagctggttaaggattgcaaaggcttgggcttttcaatcctggattaccaggacccgctcgacccgacccgcagcgtcatcgtcatcaggagtcttgtcgccgacggcgtggcagagcgatccggcggcctcctgccaggagacaggttggtcagtgtcaatgaatactgtttagacaacacgtctctggccgaagctgtggaaatcctcaaggccgtgccacccggattggtacacctaggaatatgcaaacctctcgtggaagacaacgaagaagaaagctgctatatcctgcatagttctagcaatgaagacaagacagagttttctggtactatccatgacattaattcttcactgatcttagaagccccgaaaggtttccgcgacgagccctactttaaagaagaactggtggacgaaccattcctcgatttgggcaagtcatttcactcgcagcaaaaggagattgaacagagcaaagaggcatgggagatgcacgaatttctaacgcctagattacaggaaatggacgaagaaagagagatcttagttgatgaggagtatgagttgtatcaggacccctccccgagtatggagctatatcccctgtcccatatacaggaagccactccagtgccgagtgttaatgagcttcattttggaacccagtggctgcatgacaacgaacctagcgaaagtcaagaggccaggacagggcgcacagtgtatagccaggaagcgcagccttacgggtactgcccagagaacgttatgaaggagaattttgtcatggagtccctgccctccgtgcctagtacggaggggaactcccagcagggccgctttgacgatctggaaaacctcaattctctggcaaagacaagcctggatttgggaatgataccaaacgatgtacaaggcccttctctcctgattgacttgcccgtcgtcgcgcagaggagggaacaggaggacctacccttataccagcaccaggctacaagagtgatttctaaagcttccgcctatactggtatgctaagcagccggtacgcaacagacacgtgcgagctcccggaaagggaggagggggaaggggaggagaccccaaatttctcacactgggggccaccgcgaatagtggagattttccgcgaacctaacgtgtctctgggtatctccatcgtcggtgggcagacagtaataaaaaggctgaaaaacggggaagaactgaagggcattttcatcaagcaagtattagaggactcccccgccgggaaaaccaacgcattgaagactggcgacaaaatcttggaagtctccggcgtggacctgcaaaacgcgagccacagcgaggctgtcgaggcaattaagaatgctgggaatcccgttgtgtttatcgttcagtcactctcctcgaccccaagggtcatacccaatgtgcataataaggcaaacaagattaccggtaaccagaatcaagatacacaggaaaagaaggagaagcgccagggcacagcacctccccccatgaaactcccccctccttataaggccctcactgacgattctgacgagaacgaggaagaagacgctttcacagatcaaaagatacgacagaggtacgccgatctgcccggagagctccacatcatcgagctcgaaaaggacaagaatggacttggactgagccttgccgggaacaaggacaggagtcgcatgagcatctttgtggttggcattaaccccgagggccccgcagcagccgatggccggatgcggattggggacgaactgctggagatcaataatcagatcctctatggtcggtcacatcagaacgcctccgcaatcattaagactgcccctagtaaagtaaagctagttttcattagaaatgaagacgctgttaaccagatggccgtgacccccttcccagtgccttcttccagcccaagctcgatcgaagaccagtcaggcaccgaaccaatttcatcggaagaggatgggagcgtggaggttggcattaagcagctgccggagagtgagtcatttaagctagccgtaagtcaaatgaagcagcagaaataccccactaaggtttccttcagttcacaggagattccacttgcccctgcctctagttaccacagcacagacgcagactttaccggctacggtggctttcaggctcccctgagcgttgacccggcaacctgtcccattgtaccaggccaagagatgatcatcgaaatttctaaaggccgctcaggcctcgggctgtcgatcgtgggcgggaaagacactccccttttctggcgccttggaagtcccagagcctggtctcagcatctggtgagagcctttatgctccatcatccagtgacagaggtcgaaggtcagaatgccatcgtgatccatgaggtttacgaggagggagcagcagctcgggacggccgactatgggccggggatcaaatcctcgaagtgaacggggtggatctgagaaactcaagccacgaagaggccatcacagccttgcgtcagacacctcagaaggtcaggctggtggtgtatcgtgatgaggcccactatcgggatgaggaaaatctggaaatttttccagtggatctccagaagaaggccggacgaggtttaggcttgagtattgtgggcaagtag

SEQ ID NO: 120522 - DNA, 5406 bp, Artificial Sequence
  Description of Artificial Sequence: Synthetic coding sequence
atgcccgagaacccagccactgataagctgcaggtgctgcaggtgttggaccgcctaaaaatgaaactgcaggaaaaaggtgataccagtcagaatgagaagctttccatgttctacgagactctgaagagccctctgttcaatcagattctgaccctgcagcaatccatcaagcagcttaagggtcaactgaaccatatacccagcgactgctccgccaatttcgatttcagccggaaaggattgctggtctttacagacggatccatcactaacgggaatgtccatcggccttccaataacagtaccgtttccggcctgttcccatggactccgaagctaggtaacgaagattttaacagtgttatccaacagatggcacagggacgccagattgagtacattgacatcgagagaccttcaactggaggtctcggattttccgtcgtagcgttgaggagtcaaaatctcggaaaagtagacattttcgtcaaagacgtgcagcccggaagtgtggccgaccgagaccagagactgaaggaaaatgaccagattctggcaatcaatcatacacctctggaccagaacatctctcaccaacaggcgattgcgctcttacagcagacgacaggatcgctgcggctgatcgtggcccgggagcccgtacatacgaaatcaagcacctcctcctcactgaatgacacaaccttaccagagaccgtatgctggggacacgtggaagaggtcgaactgatcaacgacgggagcggactgggctttggtattgtaggaggcaagaccagcggtgtggttgttagaacgatcgtgcccggagggttagccgaccgcgatggcagactgcagactggcgaccacatactgaagatcggtggcaccaacgttcagggtatgacctcagaacaagtggcccaggttctgcgcaattgcggtaattctgtgcggatgttagtggctcgggaccccgccggcgacatatccgtcaccccacccgcccctgccgccctcccagtggccttaccaactgtggcctctaaagggcccggctccgattcttcgttattcgagacatacaatgtggagctcgtaaggaaagatggccaatctttggggattaggattgtcggatacgtgggcacttcacatacaggagaggcaagcggaatatacgttaagagcattatacctggtagcgccgcttaccacaacggacatatccaggtgaacgacaaaattgtggctgtcgacggagtgaacattcaggggtttgccaatcatgatgttgtggaggtccttcgaaacgcaggccaggtggtgcacctcacccttgtgaggagaaaaacatccagctcgacctccccactggagcctccttccgatcgaggcaccgtggtggagccactgaaaccccctgctctgttccttaccggcgctgtcgagactgaaacaaatgtggacggcgaagacgaagaaattaaggagcggatcgatacactcaagaatgacaacatccaggccctggaaaagctcgagaaggtgccagatagtcccgagaacgaactgaagtcacggtgggaaaacctgctcggtcccgactatgaggttatggttgctaccctggacacacagatcgcagacgatgccgagcttcagaagtactcaaaattgctcccaatccacaccctgaggcttggggttgaagtggactctttcgacgggcaccattatatttcttccatagtcagcggcggcccggtggacacgttaggactcctccaaccggaagacgaactcctcgaggtaaacggtatgcaactctatgggaaaagtcgccgtgaagcagtcagctttctgaaggaggtccctccccctttcacactcgtgtgttgccgcagacttttcgatgatgaggctagcgtagacgagcccagacgcactgaaaccagtctgcctgagacagaagtggaccacaatatggatgtgaacaccgaagaagacgatgacggagagcttgctttatggtcccccgaagtgaagattgtagagctcgtgaaagattgcaaggggctgggcttctctatcttggattaccaggacccactggatcccacccgcagcgttatcgtcatccgatccctggtcgccgacggcgtggctgagaggagtggcggactgttgccaggagaccgactggtttctgtgaatgaatattgtttggataatacctcgctcgctgaggctgtggaaatcttgaaggccgttccccctgggctggtgcaccttggaatctgcaagccactcgtcgaagataatgaggaagagtcctgctatatcctgcactcctcttcgaacgaggacaagacagagtttagcggtacgatccacgatattaattcatcattgatcctggaagcccctaagggttttcgagacgaaccctactttaaggaagagttagttgacgaacctttcctcgacctcggtaagtcttttcattcacagcaaaaagagatcgaacaatccaaggaagcctgggaaatgcatgagttcttgacaccacgcctgcaggagatggacgaagagagagagatcctggtcgatgaagagtacgaactctaccaagacccttcaccgagtatggaattatatccgctgtcccatattcaggaggctactccagtcccgtcagtcaatgagcttcacttcgggacccagtggcttcacgacaatgagccgtcggagagccaggaggctagaactgggcggaccgtgtatagtcaggaggcccagccatatggctattgcccagagaacgtgatgaaagagaattttgtgatggaatccctgcctagtgtcccctcgacggaaggaaacagccaacagggccgttttgacgacttggagaatttaaacagcctggctaagacctccttggatctagggatgatccctaacgacgttcaggggccaagcctgctcattgatctgcccgtcgtggcgcagaggagggaacaagaagatctacctctctaccagcatcaggccacaagggtcatctcaaaggcttcagcttatacgggaatgctgagcagccggtacgccaccgatacctgtgagctgccggaaagggaagaaggagagggggaagagactcctaacttcagtcattggggccctcccagaatagtggagatcttcagagaacccaatgtgtcactcggcatctccatagtgggtggacagaccgtcattaaaaggttgaagaatggagaggagttgaaaggaattttcattaaacaagtccttgaagattcaccagctggaaaaactaacgcactcaaaacaggtgataaaattttagaggtgtccggagttgacctacagaacgcctcccactccgaggccgtggaagctataaaaaacgccggaaaccccgtggtgttcatcgtgcagagtctctcatcgacaccaagggtgatccccaatgtgcacaacaaagcaaacaaaatcactggaaatcagaatcaggacacacaggagaagaaagaaaagagacagggcaccgcgccccctcctatgaaacttcccccaccttacaaagcactcactgacgattcagatgagaacgaagaggaagatgcctttacagatcaaaagattcggcagaggtatgctgacctgcctggggagctgcatatcattgaactggagaaagacaaaaacggactgggcctgtctctggccggaaacaaggatcgttcacggatgtctatatttgtggttgggattaaccctgagggccccgcagctgctgacggacgcatgaggatcggcgacgaactgctcgagatcaataatcagattctgtatgggaggtcacatcaaaatgcaagtgcaattattaagaccgcacccagtaaagtaaagctggtcttcatcaggaacgaagacgccgtgaatcaaatggccgttactccctttccggtgccctcttcctctcccagcagcattgaggatcaatccggaacagagcccatcagctccgaagaagacggaagtgtggaggtgggaatcaaacaactacccgagtctgagagcttcaagctggcagtgagccagatgaaacagcaaaagtaccctaccaaggtgtccttcagctcccaggaaatcccactggcccctgcctccagttatcacagcacggacgctgactttacaggctacgggggcttccaggcccctcttagtgtggaccctgcgacctgcccgattgtacccggtcaggagatgatcatagagataagcaagggcagaagcggcttgggtttgtcgattgttggcgggaaagacacgcctctgaacgcaattgttattcatgaagtgtatgaggagggagcagccgctagagatggcaggttgtgggccggcgaccaaatcctggaagtcaacggtgtggacttgcgcaactcatctcatgaagaggcaattaccgccctgagacaaactccacagaaggtaagactcgtggtgtacagggatgaagcgcattaccgagacgaagagaatcttgagatctttcctgtcgatttacagaagaaagccgggaggggtcttggtctgagtattgtagggaagcgcaatggcagcggcgtctttatttcagacatcgtaaagggaggtgccgcagacttggacggtaggctgattcagggagatcagattttgagtgtgaatggggaggacatgcgcaacgcatcccaggaaacggtagcgactatccttaagtgtgcacagggcctagttcagttggagattggccgactgcgcgccggatcctggacctctgccaggaccacgagccagaactcccaaggctcccagcagtctgctcactcctcatgccacccaagctttgcaccagtgatcactggcctgcagaatctggtgggcacaaagcgcgtgtcggacccatcccagaaaaatagcggcactgatatggagcccaggacagtcgagataaatcgcgagttaagtgatgcactgggcatttccattgccggaggacgcgggtctcccctgggggatatacccgtatttatcgccatgatccaggcgtctggggtggctgctagaacccagaagctgaaggttggtgataggatcgtgtctatcaatggacagcctttggatggactgagccacgcagatgtggtgaacctcctgaaaaacgcctatgggagaataattctgcaagtggtcgccgatacaaatatttcagctattgccgcacagctagagaacatgagcacaggttaccacctgggaagcccgaccgcagagcaccatccagaagatactgaggaacaacttcagatgactgctgattag

SEQ ID NO: 120523 - DNA, 4572 bp, Artificial Sequence
  Description of Artificial Sequence: Synthetic coding sequence
atgccagagaacccggccactgacaagcttcaggtgctgcaagttctggacaggttaaaaatgaagctccaggaaaaaggggacacctcccaaaatgagaagctcagcatgttttatgaaacactgaagagtcccctatttaaccagatcctcaccttgcagcagtcaatcaagcagttaaaaggtcagcttaatcatatcccttcagactgctctgctaacttcgatttctcacggaaagggctcctcgtgtttaccgatggctcaatcaccaatggcaatgtccaccgcccttcaaataacagcacagtaagtggactcttcccttggacaccaaagttgggcaatgaggactttaactctgtgattcagcagatggcgcagggtaggcagatagaatatattgacatcgaaaggccctctaccggtggcctgggtttttctgtggtggccttaagatcccaaaatcttggtaaagtggatatcttcgtcaaggacgtccagcctggctctgtcgccgaccgggatcagagattgaaggagaatgatcagatcctagctatcaaccacacacccctggaccaaaacatctcgcatcagcaggccattgctctacttcaacagacaactggcagtcttagacttatcgtcgccagggagccagtccatactaagagctccacatcgtcaagcctcaacgacaccaccctcccggagaccgtgtgctggggacacgtggaagaggttgagctcattaacgatggtagtggattaggctttggcatcgtgggcggcaaaacctccggtgttgtggtgagaactatcgttcccggcggcttggcagatagggacggcagactccagaccggcgatcacatcctaaagattgggggcaccaacgttcaggggatgaccagcgagcaagtcgctcaggtgctccggaattgtggcaatagcgtccgcatgcttgtggcccgagatcctgccggtgatataagcgtgacaccgcctgctcccgcagccctaccagttgccttacctacagtcgctagcaaaggccctggctccgattcctcactgttcgagacctacaacgtcgagctggtccgtaaggatggccagagtttgggaattcgcatcgtgggctacgtaggcacttcccacaccggcgaggcaagcggaatttatgtgaagtccatcatccccggaagcgctgcgtaccacaacggccatatccaggtcaatgataaaatagtggccgtcgatggagttaacatacagggctttgctaaccatgatgtggtagaagttctccgaaatgcaggacaagtggtgcatctcactctggtccgccgcaagacctcctcatccaccagcccattggagcccccttcagacaggggtaccgtggtggaaccactgaagcctccagcgttgtttctgaccggggccgtggagacagaaaccaacgtagatggagaggatgaagaaatcaaagagagaatcgacaccctgaagaatgacaacatacaagcactcgagaaactggaaaaagtacccgactcacccgaaaacgagctcaagtcgcgttgggagaacctgctcggacccgattacgaagtaatggtggcgacactggatacgcagattgccgatgatgctgaacttcagaagtattctaagctgttgccaatccataccctccgattgggcgtggaggtggatagctttgacgggcaccactacataagcagcatcgtcagtggtggacccgttgacaccttaggcttactgcaacccgaagacgagttactggaagtcaatggtatgcaactctacggtaaatcaagaagggaagccgtttcctttcttaaggaggtgccaccgccattcactctggtttgctgtcggaggctgttcgacgatgaggcaagtgtggacgagcctaggcggacagaaacatccctaccggagactgaggtcgaccataatatggatgtcaacaccgaggaagatgatgatggcgaactggcactgtggtccccggaggtaaaaatcgtggagctggttaaagactgtaaaggactcggattttcaatcctggattatcaagaccctctagaccccacgcgaagcgtcatcgtgatccggtccctagtggcggacggggtggcagaaagatctggtgggttgctccctggagatcgtctcgtctccgtgaacgaatattgcctcgacaacacctcccttgctgaggcagtggaaatactcaaggccgttccccctggcctggttcatctgggaatctgcaagccacttgtagaagacaacgaggaggagtcttgttacatcctacactcctcaagcaacgaagacaagaccgaattctctggaaccattcacgatatcaactcaagcttgatcttagaggcacccaagggcttccgagacgagccctacttcaaagaagagctcgtagatgagcctttcctagacttaggcaaaagctttcactcacaacagaaagaaatcgaacagtctaaggaagcctgggaaatgcacgagttccttacgccccggcttcaagagatggacgaggagcgtgagatccttgttgacgaggagtacgagctctaccaagaccccagccccagcatggaactttatcccctttcacatatccaggaggctacacctgtcccctcggtgaacgaactgcactttgggactcagtggctgcacgataacgagccaagtgagtcccaggaggccaggactgggaggaccgtctatagtcaagaggcccaaccctatggctattgtccagagaacgtgatgaaagaaaacttcgtgatggaaagccttccaagcgtcccgtcaacggaaggcaactctcaacaaggcaggtttgatgacttagagaacctcaattccctggctaaaacatccctggacctgggaatgattccgaatgacgttcagggaccgagccttctgatagacctacctgtggtagcacagagacgcgagcaggaggacttgcccctgtaccagcaccaggccactcgagtgatttctaaggccagtgcctacaccggcatgctgtcttcccggtacgctacagatacttgcgagctgccggaacgggaagaaggggaaggagaagaaacaccaaatttctctcattggggacccccacggattgtggaaatctttagagagcctaatgtttcgttgggcatctctatcgtgggagggcagaccgtaatcaaacgtttgaagaatggcgaggagctaaaggggatattcattaaacaggttctggaagacagcccagccgggaaaactaacgcattaaagacaggggataaaatactcgaggtttccggagtcgacttacagaacgcgtcccatagcgaagctgtagaagctatcaaaaacgctgggaatcctgtggttttcattgtgcagtctctgtccagtacccccagagtgatccccaacgttcataacaaagcaaacaaaatcacaggcaaccagaatcaagatacccaagaaaagaaggagaagcggcagggtaccgcccctccaccaatgaagctgcctccaccctacaaagcgctaactgacgacagtgatgagaatgaggaggaggatgcgttcacggaccagaagattcgccagcgctatgctgatctccccggggaactgcatataatagagctcgagaaggacaaaaacggcttggggctgagcctggctggcaataaggatcgttcgcgtatgagtatatttgtagttggtatcaaccctgagggccctgccgctgcagacggcaggatgcgcattggagacgagctcctggaaattaataaccaaatactgtacggtagatcccatcagaatgccagcgctattattaagacagcaccgtctaaagtgaagctggtgtttatccgaaacgaggatgcagtgaaccaaatggcagtgactccattccccgtgccgtcgagctcaccatcctctattgaagaccagtcgggcacagagcccatttcgtccgaggaggatgggtctgtggaggttggtattaaacaactaccagaatccgagagtttcaagctcgccgtgtctcagatgaagcagcaaaagtatcctacaaaagtgtctttctcctcccaggagattccattggccccagccagtagctatcattccactgatgctgattttaccggatacggtggattccaggcccctctgagtgtggaccccgccacatgtccaattgtgccaggccaagagatgatcatcgagatatccaagggaaggagtgggttgggtctgtcaattgtggggggaaaggatacgccactcgtcaatggtgtggatctacgaaacagctcccatgaagaggctattaccgccctccggcagacaccacagaaagtgagactggtagtctaccgtgatgaggcccattacagagacgaggaaaacctggaaatttttcctgtcgacttgcagaaaaaggctggccggggcttggggctgtccatagtggggaaatag

SEQ ID NO: 120524 - DNA, 1359 bp, Artificial Sequence
  Description of Artificial Sequence: Synthetic coding sequence
atggtgcagggtgggttcccggagaagatccggcaacggtacgctgatctgccgggcgagctgcatatcatcgaactggagaaggataagaatggattgggattgagtctcgccggtaataaagaccgttcacgaatgagtattttcgtggtggggattaaccctgaggggcctgctgccgctgatggacgcatgaggattggtgacgagttgcttgagattaataatcagatcctgtacgggcggagtcatcagaatgcatcagccattattaaaacggcgccttctaaagttaagttggtatttatccgtaacgaagacgctgtcaaccaaatggctgtgaccccttttccagtccccagcagctccccttctagcattgaagaccagtccgggactgagcctatctcctccgaggaggacggcagtgtggaggtgggtattaaacagctcccggagagcgaatccttcaagttagcggtaagccagatgaaacagcagaagtaccccactaaggtgtccttctcaagccaggaaatccccctcgctcctgccagctcttatcacagcactgacgccgactttactggctacggtggatttcaagccccactaagtgttgacccagctacttgtcccatcgtgcccggtcaggaaatgattatcgagatttccaaaggacgtagcggtctaggcttatctattgtaggaggcaaagacacgcctttattctggcggctcggcagccccagagcttggtctcagcatctcgttcgggcctttatgctgcaccaccctgtgaccgaggttgaagggcagaatgccatcgtgattcacgaggtttacgaagagggagcggctgccagggatggacgactctgggcaggggatcagatcctcgaggtgaacggcgtggatctgcggaactcgagccatgaggaggccatcacggccctccgtcagaccccgcagaaagtgagactggtggtgtaccgggacgaggcgcactatagggacgaggaaaacctcgaaatatttcctgtggatttacaaaaaaaggcagggcgtgggcttggactctcaatcgtgggcaagagaaatggaagcggtgtgtttatctctgacattgtgaaaggcggcgcagccgatctggacgggcgactgatccaaggcgaccaaatcttatccgtgaacggagaggatatgcggaatgccagccaagaaaccgtggctaccatcttgaagtgcgcccaaggtctcgtgcagcttgaaattgggcgcctccgcgcaggttcttggacctctgcgcggactaccagtcagaattcacaggtggtcgatggatttagtagcgattag

SEQ ID NO: 120525 - DNA, 594 bp, Artificial Sequence
  Description of Artificial Sequence: Synthetic coding sequence
atggcggtgacccctttccccgtgccatcttcttcccctagctccattgaagaccagtccggcactgagccgatcagctctgaagaggacggctccgtagaagtggggatcaagcagctccccgaatccgaaagtttcaagcttgcagtcagccagatgaaacagcaaaagtatcccaccaaggtcagcttctcgtctcaagagatccctctggcaccggccagctcttaccatagtacggacgccgattttactggttacggcggcttccaagccccactcagcgtcgatcctgctacatgccccatcgtgcccgggcaggaaatgattatagagatctccaaaggccggtcagggctggggctttccattgtcggcggcaaagacacacccttggtgaacggggtggacctgaggaattcctcccacgaagaggcaatcaccgcgctcaggcagacaccacagaaggtgaggttggtagtgtacagagatgaagctcactaccgcgacgaagaaaatctggagattttccccgtcgatctccaaaagaaggcgggccgagggcttggattgtcaatagtcggcaagcgatag

SEQ ID NO: 120526 - DNA, 1236 bp, Artificial Sequence
  Description of Artificial Sequence: Synthetic coding sequence
atgagccccgctaggcttcggcctcggttgcacttctgtctggtgctgttgttactactggttgttccagccgcctggggatgtggaccaggccgagtcgtgggatcccggcggcgaccacctcggaagctggtgcccctggcctacaagcagttcagccctaacgtgcccgagaaaacccttggggccagtgggaggtacgagggaaagatcgcccggagcagtgaacggttcaaggaattaacacctaactataaccctgacatcatttttaaagacgaggagaatactggagcagataggctgatgacccagaggtgtaaggacaggctgaactccctagccatcagcgtcatgaaccagtggccaggagtgaagttacgcgtaacggagggatgggatgaggatggccaccattctgaggaaagcttgcattacgagggtcgggcggtcgatatcacgacctcagaccgggacaggaataagtatggcctactggcccgacttgccgtggaagctggatttgactgggtctattacgaaagcaaggcccacgtgcactgttcagttaagtctgaacatagtgcggccgcaaagaccggtggatgttttcctgctggcgcacaggtgagactggaatccggggctagagtggctctgtctgctgttagaccgggagaccgtgttctggccatgggcgaggatgggagtcccaccttcagcgatgtccttattttcctggaccgtgaaccccaccgcctgcgggcattccaggtgattgagacccaggatccccccagacggctggccctgacccccgcccacctactgttcacggctgacaatcacactgagccggctgcccggtttcgggctactttcgcctctcatgtccagcccggacagtacgtgttggtagccggagtgcctggccttcagccggctagggtagcagccgtcagtacacatgttgctctgggggcctatgccccactgacaaagcatggtaccctggtggtggaagacgttgtcgcatcatgcttcgcggcagtagccgaccaccacttggcacaattggccttctggcccctgaggctgtttcactctctggcttgggggagctggacccccggagaaggcgtgcactggtatccccagctgctctacaggctgggacggctgctgctcgaagaggggtctttccaccctctgggaatgtccggtgccgggtcttag

SEQ ID NO: 120527 - DNA, 1212 bp, Artificial Sequence
  Description of Artificial Sequence: Synthetic coding sequence
atggctcatgctatggagaattcatggacaatcagcaaggagtaccacatcgacgaggaggttggattcgccctgcctaacccacaggagaaccttccagacttttacaacgactggatgttcattgccaagcacctgcccgacctgatcgagtcaggccaactccgggaacgggtcgagaaacttaatatgctaagtattgatcacttgaccgatcataagtcgcaaagactggcgaggctggtattaggatgtattaccatggcctatgtctgggggaaaggtcacggtgacgtgcggaaggtcctcccgcgaaatatcgctgtcccttattgtcagctctcaaaaaaacttgagttgcctccaattctggtttatgccgattgcgtattggctaactggaaaaagaaagacccgaataagcccctgacatacgagaacatggatgtactattctcatttagagacggagactgctcaaagggtttttttctcgtttcactgctggtggagattgcagcggcctcggctatcaaagtcataccaacagtgtttaaggccatgcagatgcaagaacgagatactttacttaaagctctgttggaaattgcctcttgcctcgaaaaagccctgcaggtgttccaccagatccacgatcacgtcaatcccaaggccttcttttccgtgcttcgtatctatctgtcaggttggaaaggaaatccccagctgagcgatggactggtctatgagggtttctgggaggatccgaaggagtttgctggtggctcagctggacagagttccgtgttccaatgtttcgatgtgttactcggaatacagcagaccgccggaggcggccacgcagctcaatttctccaggacatgcggcgctatatgccacctgcccaccggaacttcctgtgttctttggaatctaacccgtccgtgagggaattcgtactttccaaaggggatgccggattgcgagaggcctatgacgcatgcgttaaagccctggtgtccctcagatcttaccatcttcagatcgttacgaagtacattcttataccggcgtcacaacagcctaaggagaataagactagcgaggacccaagcaaattggaagccaagggcacaggcggaaccgatctcatgaatttcctgaagacggttcggtctaccaccgaaaagtccctgctaaaggagggatag

SEQ ID NO: 120528 - DNA, 237 bp, Artificial Sequence
  Description of Artificial Sequence: Synthetic coding sequence
atggctcatgctatggaaaacagctggaccataagcaaggagtaccacatcgacgaagaggtgggattcgctctgcccaatccccaggagaacctacccgacttctataacgactggatgtttattgcaaagcacctgcctgacctcatcgagtccggacaattgcgggaaagagtggagaagctcaacatgctgagtatcgaccacctcactgatcataagagtcagaggctttag

SEQ ID NO: 120529 - DNA, 543 bp, Artificial Sequence
  Description of Artificial Sequence: Synthetic coding sequence
atggcccatgccatggaaaattcctggaccataagcaaagagtaccacatcgacgaagaagtaggtttcgcgttgccaaacccgcaggagaacctacccgacttttataacgattggatgtttatcgcgaaacaccttcctgatttaatcgagtccgggcaactgagggagcgcgtggagaagctgaacatgctgagtattgaccacctcaccgaccacaaatcacagcggctcgcccgcctagtgcttggttgcatcactatggcctatgtttgggggaaggggcacggcgacgtgagaaaagtcctcccccggaatatcgctgtgccttactgtcagctaagcaaaaagctcgagttacctccgatactggtttacgccgattgtgtgctggccaactggaagaaaaaagatcctaataagcctttgacatacgagaatatggacgtactgttttctttccgagacggagactgttcaaaaggcttttttttggtttctctactggttgaaattgccgccgcaagtgccatcaaagtatag

SEQ ID NO: 120530 - DNA, 1212 bp, Artificial Sequence
  Description of Artificial Sequence: Synthetic coding sequence
atggctcacgctatggaaaattcctggaccatcagcaaggagtaccacatagacgaggaagtgggattcgccctgcccaacccacaggagaacctgcccgatttctacaatgactggatgttcatcgcaaagcacctcccggacctcatagagtccggccaactgcgcgaaagagtcgagaagctaaacatgctgtccattgatcacctgacagatcataagtcacagagactggccaggctcgtgctgggctgcatcacgatggcctatgtctggggtaagggacacggcgacgtcagaaaagttctcccgcggaatatcgccgtcccctattgtcaactgtccaaaaagttggaattgcccccaatacttgtctatgctgactgtgttctggccaattggaagaaaaaagatcccaacaaaccgctaacctatgaaaacatggacgttctcttctcttttagggacggcgactgttctaaaggattctttctggtgtccctgctggtggaaatagctgctgctagcgcgataaaagtgatccctacggtctttaaggccatgcagatgcaggaacgggatacgctgcttaaggccctcttagaaatcgcgtcatgcctcgagaaagcactgcaggtattccatcagattcacgaccatgttaatcctaaggcctttttttctgtcctaagaatctaccttagcggctggaaaggcaacccccagttgagtgacggcctggtttacgaggggttctgggaggaccccaaggagtttgcaggagggagcgccggtcagtcaagcgtgttccaatgtttcgatgtacttctggggattcagcagacggccggggggggccacgctgctcagttccttcaagatatgcgtaggtatatgcctccagcccacagaaactttctttgttcactggagagtaaccccagcgtgagagagtttgttctgagcaaaggagacgcaggtctgcgtgaagcttacgatgcatgcgtgaaagccctggtatccctgcggtcctaccatttacagatagttaccaagtatatcctcatacctgcgtcccagcaacccaaagagaacaagacttcagaggacccttctaaactggaggctaaaggcacaggtggcactgatctcatgaacttcctcaagacggtgcgttcaacgaccgagaagagcctcctcaaagaaggctag

SEQ ID NO: 120531 - DNA, 144 bp, Artificial Sequence
  Description of Artificial Sequence: Synthetic coding sequence
atggctcatgctatggagaactcttggacaatcagcaaggagtaccacatcgatgaagaggttggcttcgctctaccaaacccacaagagaatctcccagacttctacaacgactggatgttcatcgctaaacacctgccgtag

SEQ ID NO: 120532 - DNA, 1224 bp, Artificial Sequence
  Description of Artificial Sequence: Synthetic coding sequence
atggagcctcatcggcccaatgtgaaaaccgccgttccgctgtctctggagtcataccacatctcagaagaatatggcttcctgttgcctgattccctcaaggagcttcccgaccactacaggccatggatggagatcgcaaacaaattgccccagctgatagatgcccaccagctccaggcccacgtcgataagatgcccctattgagctgtcaattcttgaagggacacagagagcagagactggcccacctggtcctgagtttcctcacaatgggttatgtttggcaggagggggaagcccagccggcggaggtgctgccaaggaacctagcattaccctttgtcgaggtctcgaggaacttgggtctgcctcctatcctggtgcattccgatctggtgcttactaattggactaaaaaggatcccgatggttttctggagatcggaaatttggagactattatcagttttcctgggggcgaatctctccacggatttatcctggtgactgccctagtggaaaaggaggccgtgcctggcattaaggcgctcgtccaagccactaacgctatcctgcagcccaaccaggaagccctgctgcaggccctgcagagactacgcctcagtatccaggatatcactaaaactcttggccagatgcacgattacgtggacccggacatcttctatgctggtatacgcatattcctctccggatggaaggacaatccggcaatgccagccggcctcatgtacgagggggtgagccaggagcccctcaagtattcaggcggaagcgctgctcagtcaacggtgctgcatgcatttgacgaattccttggcattaggcacagcaaggagtccggggattttctttaccggatgcgggactacatgccgccatcccacaaagccttcattgaggatattcattctgccccatccctgcgcgattatattctgagttctggccaggaccatctactgactgcttataaccagtgcgtgcaagccctcgcagaacttaggtcataccacatcactatggtgaccaagtatctgattactgcagctgccaaggctaagcatgggaagccaaatcacctgccaggtccacctcaggcactcaaggatcgcggcaccggtggtactgccgtcatgagctttctaaaaagtgtccgggataagactctcgaaagcatcttacacccccggggctag

SEQ ID NO: 120533 - DNA, 1263 bp, Artificial Sequence
  Description of Artificial Sequence: Synthetic coding sequence
atgttgcacttccactattatgatacatctaataaaattatggaaccacacagaccgaacgtcaagacggcagttcctcttagtctggagagctaccatataagcgaggagtatggattcctgttgcctgatagtctgaaggagctcccagatcactataggccctggatggaaatagcaaacaagttgccgcagctgatagacgcgcatcagctgcaagcccacgtggataaaatgccacttctgtcttgtcagtttttgaaaggccacagagagcagcgtctcgcacatctcgtgctgtcttttctgacaatggggtacgtgtggcaggaaggtgaagcacagcccgcggaggttcttcctaggaacctcgctctccccttcgtggaagtgtcacggaacttgggactgcctcccattctcgttcacagcgacttggtgctcacaaattggaccaagaaggatcccgatgggttcctggaaatcggaaatctggagaccatcatttcctttccgggcggagagtctttgcacggtttcattctggtgacagcactcgtggagaaagaggcagttccagggatcaaggctctagtgcaggcaacgaacgcaattctgcagcctaatcaggaggcactgcttcaagccctgcaaaggttgaggttgagtatccaggatatcacaaaaacacttggacagatgcatgactacgttgaccctgatatcttctacgcgggtatccggatatttctctccggctggaaggacaacccggcaatgccagcaggccttatgtacgagggcgtcagccaggagccccttaaatatagtggggggagtgctgcacagtccaccgtgctacatgccttcgatgaatttctcggcatccggcattccaaagaaagtggtgacttcctgtatcgtatgagggattatatgccacccagccataaagcgtttattgaggacatccactccgcaccttcccttcgcgactacatcctctctagcggacaggatcatctcctgaccgcatataaccagtgtgtgcaggcattagcagagctgcgctcttatcacattaccatggtgactaagtaccttatcactgcagctgccaaggcgaaacacggcaaacctaaccacctgccaggtccaccccaggccctcaaggatagaggtacgggcggaacagcggttatgtcctttctgaaatctgtgagggataagacacttgaaagcattctgcaccctaggggctag

SEQ ID NO: 120534 - DNA, 792 bp, Artificial Sequence
  Description of Artificial Sequence: Synthetic coding sequence
atgaagggaggattcactgggggagacgagtatcaaaaacacttcctaccgagagactacctggccacatactactcatttgacggcagccccagccccgaggcagagatgctaaagtttaatctggagtgcctccacaagacttttggccccgggggactccaaggagatactcttattgacatcgggtcgggccccaccatctaccaggttctggccgcgtgcgactcttttcaagatatcaccctgagtgatttcacagatcggaaccgcgaagaattagagaagtggttgaaaaaagaacctggtgcatatgactggactcccgctgtaaagtttgcctgtgaattggagggcaatagcgggagatgggaagaaaaagaagaaaaactgagggctgccgtcaagcgggtcctcaaatgtgacgtgcacctcggtaaccctctcgcgcctgctgtgctgcccttggctgactgcgtcctgacattgttagcaatggaatgcgcctgttgcagcctcgacgcctatagagcagctctctgtaatctagcatcactgctgaagccaggtggccacttggtgactactgtgactctccggctgccctcatatatggttggcaagcgcgaattctcttgcgtcgccctggaaaaagaggaggtcgagcaggctgtgctcgacgcgggcttcgatattgagcagctcctccactctccacagtcctactccgtgacaaacgccgctaacaacggagtgtgctttatcgtcgctcgtaaaaagcccgggccttag

SEQ ID NO: 120535 - DNA, 789 bp, Artificial Sequence
  Description of Artificial Sequence: Synthetic coding sequence
atgaaaggtggcttcaccggtggagacgagtaccaaaaacacttcttgcctagagattacctagctacatactattccttcgacggctctccgtcacccgaggcggaaatgctcaagttcaacttagaatgcctccacaagacattcggccctggcttgcagggtgataccctgatcgacatcggatccgggccaaccatttatcaggtgttagccgcttgtgattcgtttcaagatatcacattgagtgacttcaccgacagaaaccgggaagagctcgaaaagtggttgaaaaaggaaccaggcgcctatgattggacccccgctgttaagttcgcttgtgaattagagggcaactctgggcgctgggaagagaaggaagagaagctgcgagcagctgtcaaacgggtgctgaaatgtgacgttcacctgggaaaccccctcgcgcctgccgtactccctctagccgactgcgtgctgacattgctagccatggaatgcgcatgttgctcgttagacgcctaccgggctgctctgtgtaacttggcgtccctgcttaagcccggcggtcacctggtgaccaccgttacactccgactcccctcttacatggtgggtaaaagagaattttcttgtgtcgcactggagaaggaggaagtcgaacaggcggttttggatgccggctttgatattgagcagctgttgcacagcccgcagagctatagcgtgacgaacgccgcaaataatggcgtgtgctttatcgtggctagaaagaagcctggcccttag

SEQ ID NO: 120536 - DNA, 600 bp, Artificial Sequence
  Description of Artificial Sequence: Synthetic coding sequence
atgaaaagtgggctgtggtactttttcctgttctgcctgagaatcaaggtgctcacaggcgagattaatgggtccgctaattacgagatgtttattttccacaatggaggtgtgcagatcttatgtaagtatccagacatcgtgcagcagttcaagatgcaacttctgaaaggcggacaaattctgtgtgacctgacaaaaacgaaaggatcaggcaacacggtaagtattaagtctcttaaattctgccacagccagttgtcaaacaactctgtgtcgtttttcctgtataacctggatcactcgcatgccaactactacttctgcaatctctccatcttcgatccccctcccttcaaagtgacactcacaggcggatatcttcatatctatgaatcacagctgtgttgtcagctgaaattctggctcccgattggctgcgctgcatttgttgtcgtctgcatcttgggctgtattctgatttgctggctgaccaagaaaaaatatagcagcagtgtgcatgaccctaatggcgaatatatgtttatgcgcgccgtgaatactgccaaaaaaagtaggctaacagatgtcacgttgtag

SEQ ID NO: 120537 - DNA, 507 bp, Artificial Sequence
  Description of Artificial Sequence: Synthetic coding sequence
atgaaatccggtctgtggtactttttcttgttctgcctgcgaattaaagtgctgaccggcgagattaatggatcagccaattacgagatgttcatctttcataacgggggcgtccagatactctgtaagtacccagacatcgtccagcagtttaaaatgcaactgttaaagggagggcaaatcttatgcgaccttaccaaaactaaaggcagcggaaacaccgtctcgattaagtcactgaaattctgccacagccaactgtcgaacaatagcgtgtccttttttctgtataacctggaccattcacatgctaactactatttctgcaatctgagcatctttgacccaccacccttcaaggtgaccctcacagggggctacctccatatttatgaaagtcaattatgttgccagctgaagttctggctgccaatcggatgcgccgcctttgtagtggtgtgcatcttagggtgtatcctgatttgttggctcactaagaagatgtag

SEQ ID NO: 120538 - DNA, 930 bp, Artificial Sequence
  Description of Artificial Sequence: Synthetic coding sequence
atgcgcctcggatcaccggggctgctgttcctcctcttttcctctctccgcgctgacacgcaggagaaggaggttcgcgccatggttggcagcgacgtggagctcagctgcgcatgtcctgagggtagtcgctttgatctgaacgatgtgtacgtatactggcagaccagcgagagcaagactgtcgtcacataccacatcccacaaaactcttccctcgagaatgttgattcaaggtaccgcaatagggctctgatgtcccctgcaggtatgctgcgtggggatttctccctcagattgttcaacgtgaccccgcaagatgaacagaaattccattgtctcgtcctgagccagagccttggcttccaggaagttctctcagtcgaggtcactctgcacgtcgcggcaaacttctccgtgcctgtggtgtccgctccacactctccaagccaagacgagcttacgttcacctgcacatccatcaatggctatccaagacctaacgtctactggattaataagaccgacaactctcttctcgaccaggccttgcagaacgacaccgtattcctgaacatgagagggttatacgatgttgtgtcggtgctaagaatagccagaacccctagcgtgaatattggctgttgtatcgaaaacgtgctgttgcagcagaacctgaccgtgggcagtcagacaggaaatgacataggtgagcgcgataagattaccgagaatcctgtcagtactggagagaaaaacgccgccacctggagcatacttgccgtgctttgtctgttggtggtggtcgctgttgctattgggtgggtgtgtagagaccgatgcctgcaacatagctatgcaggggcctgggccgtgtcaccagagactgagctgactgaatcctggaacttgcttctcctgttgtcgtag

SEQ ID NO: 120539 - DNA, 558 bp, Artificial Sequence
  Description of Artificial Sequence: Synthetic coding sequence
atgagactggggagccctggactgttgttcctgcttttttcgtcgctgcgggctgccaatttttccgttcctgtggtgtcagctccacattctcccagccaggatgagctgacttttacctgcacgtccatcaacggctatccacggcccaacgtctattggataaataagacagataactcccttctggatcaggccctccagaacgatactgtgtttctgaatatgcgtggtctttacgatgtcgtgagcgtgttaagaatcgcgagaaccccgtccgttaatatcgggtgctgtatagagaatgttctgctgcagcagaatctgacagtggggagccagaccggtaatgatattggggagcgtgacaagattactgaaaaccctgtgagcaccggcgagaagaatgccgccacttggagcattttggctgtgctgtgcttacttgtcgtggtcgctgttgctatcggctgggtttgtcgcgatcgctgtttgcagcactcatacgccggagcctgggcagtgtctccggaaactgagctgaccggtcatgtgtag

SEQ ID NO: 120540 - DNA, 909 bp, Artificial Sequence
  Description of Artificial Sequence: Synthetic coding sequence
atgaggcttggctcacctggcctcctgtttctcctgttttcctctcttcgcgcggatactcaggagaaggaagtgagagctatggtgggctctgacgtcgaactctcatgtgcctgtcccgagggatctcgttttgatctgaatgacgtgtacgtttactggcaaacttcagagtccaaaactgtggtgacctatcatattcctcaaaacagttcacttgaaaacgtcgattcaagatacaggaaccgggccctgatgtctcccgccgggatgcttcggggcgattttagtctccgattgttcaatgtaacgccacaggatgagcagaagttccactgtctcgtactctctcagagcctgggctttcaggaggtgctgtcagtcgaggtgactttgcacgttgcggccaatttcagcgtgccagtcgtgagcgctccccatagcccgtcacaggacgagctcaccttcacctgcaccagcattaatggttatcccaggcccaacgtctattggatcaacaagactgacaactccctcttagaccaggctcttcaaaacgataccgtgttcctgaatatgaggggcttgtatgacgtcgtttccgtcctccgtattgcccgcacaccaagcgtgaatattggctgttgtatcgaaaacgtcttgctgcagcaaaatctcactgtagggtcacaaactgggaatgacatcggggagagagacaaaataactgaaaatccagtctctactggcgaaaagaatgcagctacatggtccatattggcggtgttgtgcctgcttgttgtcgttgcagtcgctataggatgggtgtgccgcgacagatgtctgcaacacagctatgcaggcgcctgggccgtgagcccggagacagagctaacgggccatgtttag

SEQ ID NO: 120541 - DNA, 1101 bp, Artificial Sequence
  Description of Artificial Sequence: Synthetic coding sequence
atggtgctccatctcctcctgttcctgctcctgactcctcagggcggacactcgtgccaggggctcgaattggcacgagagctagtcctagccaaagtgcgggccctgtttcttgacgctttaggacctcccgctgttacccgggagggaggtgatcctggagtcaggaggctgcccagacgtcacgctctgggtggctttacacatcggggatcagaacccgaagaggaagaagacgtgtcccaggcgatcctatttccggccacagatgctagctgcgaagataaaagcgccgcgagagggctggcccaagaagctgaagagggccttttcaggtacatgttcagaccttcccagcacacacgcagccgacaggtgacaagtgctcagctatggttccacacgggactggaccggcagggaaccgccgcatcgaattcgagtgaacctctgctcggactcctcgccctttctcctggcggccccgtggctgtccccatgagtctgggccatgctcctcctcattgggctgtgctgcatctggccactagcgccctgtctctgttgactcaccctgtgcttgtgctgttgctgaggtgccccctgtgtacttgctcagcccggccagaagcaacgccctttctggtcgcgcataccagaacaagacctcccagcgggggcgaacgcgccaggcgcagtaccccactaatgagctggccttggagcccaagtgccctccggcttctgcagaggccccctgaggaacctgcggcacacgccaactgccaccgtgttgctctaaatatttcttttcaggaattgggctgggaaagatggattgtgtatcccccctccttcattttccattattgccacggcggttgcggactgcatattcctccgaatctttctttaccagttccaggagccccacctacacccgcacagccatattccctgctgcccggcgcccaaccttgttgtgcagcccttccaggtaccatgaggccccttcacgttagaaccacctctgatggcggctattccttcaagtacgagactgttcctaatctgctcactcagcattgtgcctgcatctag

SEQ ID NO: 120542 - DNA, 1281 bp, Artificial Sequence
  Description of Artificial Sequence: Synthetic coding sequence
atgccccttctctggctgagaggttttctcttggcatcctgctggattattgtgcgctcttcccccacacccgggagcgagggccattccgcggctcctgattgcccctcttgtgccctggcagctttgccaaaagatgtgccaaactctcagccagagatggtggaggcggtgaagaagcacatcctgaacatgctgcatctcaagaagagacctgatgtcacccagcctgttccaaaggccgctctcctcaacgcaatccgcaaattgcacgtgggaaaagtcggcgagaacggctatgtggagatcgaagacgatattggtcgaagagccgagatgaacgagctgatggaacaaacgtccgagattattactttcgccgaaagtggaaccgctcgaaaaacactgcatttcgaaatctcaaaggagggcagcgacctaagcgtcgtggagcgggccgaggtctggctgtttctcaaagtgcctaaagccaaccggactcggacaaaagtaaccataaggctgttccagcagcaaaagcatccccaaggatctctggacaccggagaggaggccgaggaggtcggcctaaagggagaaaggtccgagttgttactgagtgaaaaggttgtggatgccaggaagagtacctggcatgtcttccctgtatcttctagcattcaacgacttttagatcagggaaaatctagcctagacgtcaggatcgcctgtgagcagtgtcaggaaagtggggctagcctggtgctcctgggcaaaaagaagaagaaagaagaagagggcgaagggaagaagaagggagggggtgaaggcggggccggcgctgatgaggagaaagaacagagccataggcctttcttgatgctgcaggcacgacagagcgaggatcaccctcaccgcaggagacggaggggactggaatgcgacggcaaggtgaatatctgctgcaaaaaacagttcttcgtgagttttaaagatattgggtggaacgactggatcatcgcgcccagtggttaccatgcaaattactgtgaaggtgagtgtccatcgcacatagccggcaccagtgggtctagcttgtcatttcattccactgtgatcaatcactatcggatgcgggggcactctccgttcgctaacctgaagtcttgttgcgtgcccacgaagctgcggcccatgtctatgttgtattatgacgatggacagaatatcattaaaaaggacattcaaaacatgatcgtagaagagtgtggctgctcttag

SEQ ID NO: 120543 - DNA, 1281 bp, Artificial Sequence
  Description of Artificial Sequence: Synthetic coding sequence
atgcctctgctgtggctccgcggctttttactagccagctgctggattatcgtacgatcttctccaaccccaggctccgaaggacactcagctgcccctgactgtcccagctgtgctctcgctgccttgccgaaggacgtccccaacagccagcccgagatggtagaggctgtgaagaaacacatcctaaacatgctccatcttaaaaagaggcctgatgtgacacaaccagtaccaaaggccgccttacttaacgccattcgaaagctccatgtaggcaaggttggggagaatgggtatgtagagatcgaagacgacataggtcggcgggctgagatgaacgagttgatggagcagacttccgagataattacctttgctgaaagcggcacagcccggaagaccctgcattttgaaatttccaaggaaggcagcgatctgagcgtagttgaacgggcggaggtctggctgtttctcaaagttcccaaggctaatcgtactaggactaaagtcactattagactttttcaacagcagaagcaccctcagggctccctcgacacgggagaagaggccgaagaggtgggacttaagggtgagagatcggaactgctgctcagcgaaaaggttgttgatgcccggaaaagtacatggcacgtgttcccagtgtcatctagcattcagcggcttctcgatcaaggtaagtcgtctctcgacgtgaggatcgcctgtgaacagtgtcaggaatccggggcaagcctcgttctcctcggaaagaagaaaaaaaaagaagaagagggggaagggaaaaaaaagggcggtggcgagggcggcgccggcgccgatgaggagaaggaacaatcccaccgaccattcttgatgctgcaggctaggcagtccgaagatcatccccaccgtcggcgtcggagggggctggagtgtgatggtaaagtcaacatatgttgtaagaagcaattcttcgtaagtttcaaggacataggctggaacgattggatcatcgcacccagtggataccatgctaattactgcgagggcgaatgcccttctcacatagccgggaccagtggaagtagtctctctttccattccactgtgatcaaccactatcggatgcgggggcactcgccattcgccaaccttaaatcatgctgtgtgcctaccaagttacgaccgatgagcatgctgtactatgacgatggacagaacataatcaagaaagacattcagaatatgattgtggaagagtgcggctgtagctag

SEQ ID NO: 120544 - DNA, 1224 bp, Artificial Sequence
  Description of Artificial Sequence: Synthetic coding sequence
atggacgggcttcccgggcgcgccctgggcgctgcatgcctcctgctcttagccgccggatggctgggtcctgaggcctggggtagtccaactccccctccaacacctgcagctcctccccctccccctccccccggtagtcccggcggctcacaggacacctgcacttcctgtggaggcttccggcgcccggaagagctggggagggttgacggggactttttagaggcagtcaagaggcacatcctgagtcgccttcaaatgaggggaaggccaaacatcacgcacgcagtccctaaagctgcaatggtgaccgccctccgcaaactgcacgcaggcaaagtgcgagaagatggcagggtggagattccgcacctggatggccatgcgtcccccggcgcggatggccaggaaagagtatcagaaatcatatcattcgcagaaaccgacggacttgcctccagcagagtgcgactgtacttcttcatttccaacgaggggaaccagaatctcttcgtggtgcaagcctcactgtggctgtacttgaagttacttccttacgtattggaaaagggctctagaagaaaggtgcgtgtgaaggtgtattttcaggaacagggccatggggatagatggaacatggtggaaaagagggtggatttgaagcgttcaggctggcacacttttccattgacagaggctatccaggcgttgtttgagaggggcgagcgtcgtttgaatctggatgtgcagtgcgatagctgccaggaactcgccgtggttcccgtgtttgtggacccgggtgaggagtcacacaggccatttgtggtggttcaggcaagactgggggacagccggcatcggataagaaagcgcggactggagtgcgacggacgcaccaatctgtgttgcaggcaacaattcttcattgacttccgattaatcggttggaatgactggatcatagccccgaccggctattatgggaactactgtgagggttcttgccccgcttacctggctggagtaccgggaagcgcttcttcctttcacacagccgtggtaaaccaatatcggatgcggggcctgaaccctggtaccgtgaatagctgttgcatacctacaaagctcagcactatgagcatgctctatttcgatgatgaatataatatcgtcaaacgggacgttcccaatatgatagtggaggagtgcggctgcgcatag

SEQ ID NO: 120545 - DNA, 1059 bp, Artificial Sequence
  Description of Artificial Sequence: Synthetic coding sequence
atgacatccagcctgctcctggccttcttgctcctggcacccaccactgtggcaactccacgcgcaggaggtcagtgccccgcttgtggcggcccaacgttagaattggaatctcagcgagaactgctgctggacctagccaaacgcagcattctggacaaacttcatctgacgcagaggcccacgctgaaccggcctgtatcgagggctgctctgagaactgcccttcagcatctccacggtgtgccacagggtgccctcctggaagataatcgcgaacaagaatgcgaaattattagttttgccgaaactgggttgtcaaccatcaaccagactcgactcgacttccattttagctccgaccgcacagccggagatcgagaagtacagcaagcatcactgatgtttttcgtccagttaccgtccaatacaacatggaccttgaaagtgcgcgtactggttctgggcccccacaacaccaacttaactctcgctacacagtatctgctggaagtcgatgcttccggttggcaccagctccccctcggacccgaggctcaagccgcctgtagccagggacatcttactctggaactggtactggagggtcaggtggcccagtcctccgttattcttggtggtgctgcccaccgccctttcgttgcggctagagttcgtgtcggtggcaagcaccagatccacagaagaggaatcgactgccagggtgggtctcgcatgtgctgccggcaggaattcttcgtagatttccgtgagatcggttggcacgactggattattcagccagagggctacgccatgaacttctgtattgggcagtgtcccctgcatattgccggaatgccaggtattgccgccagcttccataccgcagtgctgaacttgctcaaagcaaatactgctgccgggacaacaggagggggctcctgctgtgtgccaacagcaagacgccctttaagcctgctctattacgatcgggatagcaacattgtcaagactgacatccccgatatggtcgtggaagcttgtgggtgttcatag

SEQ ID NO: 120546 - DNA, 1053 bp, Artificial Sequence
  Description of Artificial Sequence: Synthetic coding sequence
atgcgcctgcccgatgtgcagctatggctggtactgctctgggcactggtcagggcacagggtactgggagcgtgtgcccgtcttgcggcggcagtaagctcgctccccaggccgaacgggccctggtgctcgaacttgccaaacaacaaattctggatggactgcatctcactagtcgcccccggattactcaccccccccctcaggcagctctgacccgtgctctacgacgcctccagcctggctccgtcgctccagggaacggagaggaagttatttcgtttgctactgtgaccgactccacttctgcttactcatctctgttaaccttccatctgtctactccgcggtcacaccatctttatcacgcgcgactctggcttcacgtactgccaactcttcctgggaccctctgcttaagaatcttccgatgggggcctcgccggagaagacagggctcccgcactctactcgcagaacaccacatcacaaatctgggatggcatactctgactctaccttcgtctggactcagaggcgaaaagtcgggggtgctcaagctacaactggactgtcgccctctcgaaggcaatagcaccgtcacaggccagccccgaaggctgctggataccgccggacaccagcagccctttcttgaactcaaaattcgggccaacgaacccggcgccggtcgggccaggaggagaacccctacatgtgagccagcgacccccctgtgctgccggagggatcactatgttgattttcaggagctgggctggcgtgattggattctgcagccggaggggtatcaactgaactattgttctggccagtgtccaccccatcttgcgggttcacccggcatagcagctagcttccattcagccgtgtttagccttttgaaggcaaataacccctggcccgcaagtactagctgttgtgttcctacagcccgcagacctctgagcttactgtacctggatcataacgggaatgttgtgaaaacagatgtcccggacatggttgtcgaagcttgcggatgttcctag

SEQ ID NO: 120547 - DNA, 4062 bp, Artificial Sequence
  Description of Artificial Sequence: Synthetic coding sequence
atgagttcccccatgcccgattgtacttcaaaatgccgatccttaaagcacgccctggatgttctttccgtggtaacaaaggggtctgagaaccagatcaaggccttcctatcgtcccactgctacaacgcagctaccataaaggatgtgttcgggagaaatgcccttcatctggtcagtagctgcggcaaaaaaggcgtacttgactggctgatacaaaagggcgtggacctcctggtcaaagacaaggaaagtgggtggacggccctccaccggagcattttttacggtcacattgactgtgtgtggagcttgcttaaacatggggtctccttatatatacaagataaggagggactgtcagccctggatctagtaatgaaggataggcccacccacgtggttttcaagaacaccgatcctaccgacgtatatacttggggggacaataccaatttcaccctcggccatgggtcacaaaattctaaacatcacccagagctcgtcgatctgttcagcaggagcggcatatatatcaagcaggtcgttttgtgtaaatttcattctgtttttcttagccagaaaggccaggtgtacacctgcggtcacggaccgggcggcagacttggccacggggacgaacagacctgtcttgttccacggctcgtggagggtcttaatggtcacaattgttctcaggtggctgcagccaaagaccacacagtagtcctcacagaggacggatgtgtgtatacattcgggctgaacattttccatcagctgggtataattccccctcccagtagctgcaatgtgcctaggcagattcaggccaaatacctcaaaggtcggacaattataggcgtcgcagcgggacggtttcatactgtgctgtggacacgcgaggccgtatatacgatgggcctaaacggagggcagctcggatgcttattggaccctaatggagaaaagtgcgtaacagctccaaggcaggtcagcgcactccatcataaggatatagccttgagcctggtggctgccagtgatggggccacagtctgtgtcacaacgcggggtgatatatacctgctcgccgactaccagtgcaagaaaatggcttccaaacaactgaacctgaagaaggttctggtctctggcggtcacatggaatacaaggtggatcccgagcatctgaaagaaaatggaggccaaaagatctgcattctggcaatggatggtgcgggcagggttttctgctggcggagcgtcaacagttccctgaagcaatgcagatgggcctatccccggcaggtctttatctcggacattgcgttgaataggaacgagatcttattcgtcacgcaggacggggagggtttccgcgggcgttggttcgaagaaaaaaggaaaagcagtgaaaaaaaagagatactgtccaatctgcataatagtagctcggacgtttcatacgtgagtgatatcaattctgtctatgagagaattcgcctagaaaagctgacatttgcacaccgtgctgtctccgtgagcacagatccctctggttgtaatttcgcaatcctgcaaagtgacccaaagacttccttgtatgagattcccgcggtttcctcgtcctcattctttgaagaattcggcaagctgctcagagaagccgacgagatggacagcatccatgacgtaacattccaggtgggcaatcggctctttcccgcacataaatatatactagcggtgcacagtgatttcttccaaaaactgttcctgagcgacggaaacacgtccgagttcacagacatttatcagaaagatgaggactccgctggttgccatctgtttgttgtcgagaaagtccaccctgacatgtttgagtatcttctgcagtttatctatactgacacatgcgatttcttgacccatggctttaaaccacgaatacacttgaataagaatccggaagagtatcaaggaactctcaattcacacctgaacaaggtgaatttccatgaggacgataaccagaagtctgcgttcgaagtctataaatccaaccaggctcagacggtcagtgaacgacagaagtcaaagcctaaatcctgtaaaaagggcaagaatattcgggaggatgatcccgtgcggatgctccagaccgtggccaagaagttcgacttttcgaatcttagttcaaggctcgatggcgtgcgttttgaaaatgaaaagatcaacgtgattgccaaaaatactggcaacaagctgaaactttcccagaagaagtgctcttttctgtgcgacgtcactatgaaaagtgtggatggcaaagagttcccctgtcacaaatgtgtcctgtgcgcaagactggagtattttcattccatgctgagttcttcctggatcgaagccagttcatgcgccgcattagaaatgcccattcactcggatattctgaaggtgattctggactatttatacacggacgaagccgtggtaatcaaggagagccagaatgtggatttcatatgtagtgtgttagttgtggccgatcaattgctaatcaccagattaaaagagatatgtgaagttgccctgacggaaaaactgacactgaaaaatgccgcgatgcttctggagttcgccgctatgtattcagcaaagcagctaaagctatcttgcctacagtttataggcctcaacatggccgctctgctggaggcaaggtcattggatgtgttgtctgatggggttctgaaggaccttagtgaattctatcgcaaaatgatccctgccatggatcgccgggtcattactccttatcaagatgggccggacatctcgtacttggaggtcgaagacggagatatttttctcaaagaagaaataaatatggagcagaatcacagtgaaacaatgtttaaaaaggccaaaactaaagcaaagaagaagcctcgaaaaaggagcgactccagtggaggatataatctcagtgatattatccagtccccctcatcgacagggcttctgaagagtggaaagacaaatagcgttgaaagtctgccagagctgttaactagcgactccgaaggctcatatgccggggtgggaagccctcgtgaccttcagtcccctgatttcacgactggcttccatagtgacaaaatagaagccaaagtaaagccctacgttaacggcacgtcccctgtgtattctcgcgaggatttgaagccgtgggaaaagtcaccaatactgaaaatctccgcaccacaaccgataccttccaacagaatagataccaccagctctgcctcttgggtggcaggaagcttttcacctgtgagtcctccagtagtcgacctccgcacaattatggaaattgaggagtctcggcaaaaatgcggcgcaactcccaagtctcacctggggaagaccgtctcccacggggtgaagttgtcgcaaaagcagcgtaagatgattgcgctgactaccaaagaaaataattcgggaatgaatagcatggaaacggttctgtttacgccatcaaaggcacctaaacccgttaatgcatgggcctcctctcttcattccgtgtccagcaagtcattccgtgacttcttactcgaggagaagaagagtgttacaagccatagcagcggagatcatgtcaaaaaagtgtcattcaaggggatcgagaattcccaggccccaaaaatagtccggtgtagcacacacggcactccaggacctgaagggaatcacattagcgacctgccgttgctggacagccctaatccatggctaagtagcagtgtgacagccccttccatggtggcgcctgttacctttgcatccattgtcgaggaggagctccaacaggaggctgctctgattaggtctcgagagaagccgcttgctttgattcagattgaagaacatgccatacaagacctgctggtgttctacgaggcttttggcaacccagaggagtttgtgattgtggagaggacaccccaagggcccctcgccgttccaatgtggaataagcatggctgttag

SEQ ID NO: 120548 - DNA, 1386 bp, Artificial Sequence
  Description of Artificial Sequence: Synthetic coding sequence
atgtggcaactaacttcattgctgctattcgtcgcaacctggggcatctcaggaacccccgcacccctcgacagcgtgtttagcagttctgagcgcgcgcaccaagtattaagaatccgcaaacgggcaaatagtttcctggaggaactcaggcacagttcccttgaacgggaatgcatcgaagagatctgtgactttgaagaggcgaaggagatattccagaacgtggacgacactttagcgttttggtccaagcatgtggacggtgaccagtgtttagttctgcccctcgaacacccatgcgcttctctgtgctgtgggcacggcacgtgcatagatggaatcggaagcttctcatgtgactgtcgatccggatgggaagggcgcttttgtcagagggaggtttcgtttctgaattgctcactagacaacggcggttgcacccattattgtttggaagaggtgggatggagaaggtgtagttgtgctcccggctataaactcggagacgacctgttgcagtgccatcccgctgttaagttcccatgtggacgtccatggaaaagaatggaaaagaaacgttctcacctcaagagagatactgaggatcaagaggaccaagttgatcccagactaatcgacggaaagatgacaaggagaggcgatagtccttggcaggtcgtgctcctggactctaagaagaagctggcttgcggggcagtactgatccatccaagctgggtgttaacagctgctcactgcatggatgaatcaaaaaagcttctagttcgcctcggtgaatacgatttacgacgctgggaaaaatgggaattggacctggacattaaggaggtatttgttcaccccaattacagcaaaagtacaacagataacgacattgccctgcttcacctggcccaaccggctaccttgagccaaacaatcgttccaatctgcttgcctgacagcggtctggctgaaagagagcttaatcaagcaggtcaagagactctggtcaccggatgggggtaccatagctcccgcgaaaaagaagccaaaaggaataggacattcgtgctgaacttcattaagatccctgtggtaccgcataacgaatgttcagaagtcatgtcaaatatggtgagcgagaatatgctgtgtgccggtattctgggagatcggcaagacgcgtgtgagggtgactccggagggcctatggtcgcttctttccatgggacctggtttttggtcgggctagtgagctggggggaaggatgcggattacttcataattacggtgtgtacaccaaggtgtcccgataccttgactggattcacggccacatcagagacaaagaagccccccagaagtcctgggcaccttag

SEQ ID NO: 120549 - DNA, 405 bp, Artificial Sequence
  Description of Artificial Sequence: Synthetic coding sequence
atgaaggcattttcaccagtacgaagtgttaggaagaattccctctctgatcacagcttggggatctcgagatccaagacccccgtcgatgatcctatgtccctcctctacaacatgaacgactgttattccaaacttaaggaactcgttccatcgatccctcagaacaagaaagtgagcaagatggagattcttcaacacgtcattgattatattctcgatctgcagatagcattggatagccatcccacaatcgtcagcttgcaccatcagcgacccggtcagaaccaagcaagcagaaccccacttacaacactaaataccgatatcagtatcctctctctccaggcctctgaattccctagcgagctgatgtctaacgattcaaaagccctgtgtggctag

SEQ ID NO: 120550 - DNA, 405 bp, Artificial Sequence
  Description of Artificial Sequence: Synthetic coding sequence
atgaaggccttcagtcccgtccgctctgtccggaagaacagcctcagcgatcattcccttggaatttctcggtctaaaacacctgtcgatgacccgatgtcgttgctctataacatgaatgattgctactcaaagctaaaggagctcgtgccaagtattcctcagaacaagaaggtgtctaagatggaaatattgcagcatgtgatcgactatattttggacctgcagattgccctggatagtcacccaaccattgtcagtcttcatcaccagaggccgggacagaaccaggcctcacgaacacccctcacaactctaaataccgatatttccatcttgtctcttcaggcatcagaattcccctccgagttaatgtcaaacgattccaaggctctgtgtgggtag

SEQ ID NO: 120551 - DNA, 360 bp, Artificial Sequence
  Description of Artificial Sequence: Synthetic coding sequence
atgaaggccctgtcccccgtcaggggctgttatgaggcagtgtgttgcctttccgagcgaagccttgcgatagctcgtggtcgggggaagggacctgcagccgaagaacccttgtccctgctcgatgacatgaaccactgctattctcggctccgagagctggtgcctggtgtgccccgagggacgcagcttagccaggtggagatcttgcagcgtgtgatcgactatatcctcgatttgcaggtcgttctggctgagcctgctcccggcccacccgacgggccgcaccttccaattcagacggccgaactaactcctgaattagtcatctctaatgacaagagaagtttttgtcactag

SEQ ID NO: 120552 - DNA, 486 bp, Artificial Sequence
  Description of Artificial Sequence: Synthetic coding sequence
atgaaggccgttagcccggtgagaccttcaggacgcaaggctccgagcgggtgcggagggggggagctcgccctgagatgcctggccgagcatggtcactctttaggaggatctgctgccgccgcggccgccgccgcggccgctcggtgcaaggccgccgaggcggctgctgacgagccggccctgtgcctccagtgtgacatgaacgactgttacagccgcctgcgacggttggtccccaccatccccccaaacaaaaaggtatcaaaggtggagatcctacagcatgttatagattacattctggacctacagctggcgctcgagacccaccccgctcttctccgccagcctccaccacccgcccctccccaccatcctgcagggacctgccccgcggcaccacctagaaccccactgaccgctcttaacacggaccctgctggcgccgtgaacaagcaaggtgacagcattctgtgtcggtag

SEQ ID NO: 120553 - DNA, 843 bp, Artificial Sequence
  Description of Artificial Sequence: Synthetic coding sequence
atgctgggtcagcagcagcagcagttatattctagcgccgccctgctaacaggggaacgatcaagactgctcacttgctatgtgcaggactacctggaatgtgtggaaagtctgcctcacgacatgcagcgaaacgtgtcggttctccgcgaacttgacaacaaatatcaggagacattaaaagagatagacgacgtgtacgaaaaatacaagaaggaggatgatctgaaccagaagaagcggctgcagcagctccttcaaagggcactgattaactcccaggaactgggggatgaaaaaatacagattgtgacacagatgctggagcttgttgaaaatagagcgcggcagatggaactgcacagccagtgctttcaagatcctgcagaatccgagagggcgagcgataaagcaaagatggactcgtctcagcccgagcgctcaagcaggagaccgcggagacagcggacgagcgagagtagagacctgtgtcatatggcgaacgggatcgaggattgcgacgatcagcccccaaaggaaaagaagtcaaagagtgccaagaaaaaaaagcgctcaaaggcaaagcaggagcgcgaagcctcgccggttgagtttgccatcgatccgaacgagccaacctattgcctgtgtaaccaggtctcatacggggagatgattggctgcgataatgagcaatgtcctatagaatggttccatttttcttgcgtgtccctgacttacaaaccgaagggaaaatggtactgccctaagtgcagaggagacaacgaaaagaccatggataaaagcaccgaaaaaacaaaaaaagaccgtcgctcgcgttag

SEQ ID NO: 120554 - DNA, 723 bp, Artificial Sequence
  Description of Artificial Sequence: Synthetic coding sequence
atggatcaggatggtgatcagcaactggggcccagcagaattctggcaccccagaccctgaaagagatcgacgatgtatacgagaaatataagaaggaggatgacctgaatcagaagaaacgtctgcagcagttactgcagcgggccctgatcaatagtcaagagctgggagatgaaaaaatacagattgtcacccagatgttggagctggttgagaatcgtgctcgccaaatggagcttcatagccaatgcttccaggaccctgctgagtccgaacgcgcttcagataaggcaaagatggactctagtcaacctgagaggtcctcccgaagaccacggcggcagcggacttccgagagtagggacctttgtcatatggctaatggaattgaagactgtgatgaccagcctcccaaggagaagaaatctaagtcagcaaaaaaaaaaaagagaagcaaggctaagcaggagcgagaagcctcgcctgtggaattcgccatagaccctaatgagccgacatactgcctatgtaaccaggtgagctacggagaaatgataggttgtgacaatgagcagtgtcccatcgagtggttccatttcagctgtgtgtctctaacctacaagcccaaggggaagtggtactgccccaagtgccggggggacaacgagaagactatggacaagagcaccgagaagaccaagaaggaccgcagaagtaggtag

SEQ ID NO: 120555 - DNA, 1257 bp, Artificial Sequence
  Description of Artificial Sequence: Synthetic coding sequence
atgctgtacttggaggactatctcgaaatgattgagcaacttcctatggaccttcgggatcgttttaccgagatgagggagatggacctgcaggtgcagaatgcaatggatcagcttgagcaaagggtcagcgagttctttatgaacgccaagaagaacaaacccgaatggagggaagagcagatggcctctattaagaaggactactataaagccctggaggacgcagacgaaaaggttcagctggccaatcaaatttacgatctggttgacagacatttgcgaaaactggaccaagaactcgccaagttcaagatggaattggaagctgacaacgccggcattactgagattctggaaagacgctccctggagcttgatacgccatcacagccagtaaacaaccatcacgcgcattcgcacaccccagtggagaaaaggaaatacaatccgactagtcatcacacaacaaccgaccacatccctgagaagaaattcaagtctgaagccttactgtcaaccctgacatcagatgcgtccaaggagaacacactggggtgcagaaacaataatagtactgcatcttcgaacaatgcgtacaacgtgaacagtagtcaacctctgggaagctacaacatcggttcactgtcaagtgggacaggagcaggggccataacaatggctgctgcacaggctgtgcaggctaccgctcaaatgaaggaaggtagaagaacttcgtctttgaaggccagttacgaggcctttaaaaacaatgacttccaactaggcaaagagttcagtatggcgcgggaaacagtggggtacagcagctccagcgccttgatgaccaccctgacccagaacgcctcaagctcagcggccgattccaggagcggaaggaaatccaagaacaataataaaagttctagccagcagtcttcaagtagctcttcctcttcttcgctgagcagttgcagtagttcctccactgtagtccaagagatctcacagcagacaacagtcgtgcccgagtccgattctaactcccaggtcgattggacctacgatcccaacgagccccgttactgtatctgcaatcaggtttcttacggggagatggtcggctgcgataatcaggactgccctatcgagtggtttcactacggctgtgttggcctcacggaagcccctaagggcaagtggtactgtccgcaatgcaccgccgccatgaaaagaagaggcagcagacacaaatag

SEQ ID NO: 120556 - DNA, 279 bp, Artificial Sequence
  Description of Artificial Sequence: Synthetic coding sequence
atgctctacttggaggactacctcgagatgattgagcaattgccaatggatctccgtgatcgcttcactgagatgagagagatggacttgcaggttcagaacgctatggaccaattagaacaacgagtgtcagagttctttatgaatgccaaaaagaacaagccagagtggcgcgaagagcaaatggctagcatcaagaaggattactataaagctctggaggacgcagatgagaaagttcagctagccaatcagatttacgacttacaacacttctag

SEQ ID NO: 120557 - DNA, 723 bp, Artificial Sequence
  Description of Artificial Sequence: Synthetic coding sequence
atggccaccgctatgtatctggagcattacctggatagcattgaaaacctgccctgcgagctgcaacggaatttccagctgatgagggagctcgatcagaggacagaagacaagaaggcagagatagacatcctcgctgctgagtacatctcgactgtgaaaaccctgtcgccggatcagcgagtggaacgactgcagaagatccagaatgcatattctaagtgtaaagagtacagtgatgataaggtccagttggccatgcagacatatgaaatggtggataaacacatacggcgtctcgacgcagatttggcccggttcgaagccgacctcaaagacaaaatggagggatctgatttcgagtcttccggaggccgcggcttgaagaaggggaggggacaaaaagagaagagaggaagccgtgggcgaggaaggcggacttctgaggaggacacacctaagaaaaaaaagcataaggggggcagcgaatttactgatacgattctttcggttcacccgtctgatgttctggacatgcccgtcgatcctaacgagcccacctattgcctgtgtcatcaagtgagctatggagaaatgattggatgcgataacccggactgtcctatcgaatggtttcatttcgcttgcgtggacttgacgacaaagccgaaggggaaatggttctgtcctcggtgcgtgcaggagaaacgcaaaaaaaaatag

SEQ ID NO: 120558 - DNA, 681 bp, Artificial Sequence
  Description of Artificial Sequence: Synthetic coding sequence
atggcaactgctatgtaccttgaacattacctggatagtatcgagaacttgccatgcgagctccagcgcaactttcagctcatgagggagctggatcagcgaaccgaggacaagaaggcagagatcgatatactggccgccgaatacatcagcactgtgaagactctctcgcctgaccaaagagttgagaggctgcaaaagatacagaacgcatacagcaagtgtaaagagtattcagatgataaagtccaattagcaatgcagacctatgaaatggttgataaacatatccgccgcttagacgcagacttagctagatttgaggctgatttaaaggacaagatggagggctcagactttgaatctagcgggggacgcgggcttaagaaagggcgcgggcaaaaggagaagcggggttctagaggaagagggcgccgaacttctgaagaggacacacccaaaaagaaaaaacataaaggtggctccgagttcactgacacgattctcagtgtacatccatccgatgtgctcgatatgccagtggaccccaacgaacccacatattgtctgtgccatcaggtgagctatggagaaatgatagggtgtgataatcctgattgtccgattgagtggttccactttgcttgtgtggaccttacgactaaaccaaaggggaagtag

SEQ ID NO: 120559 - DNA, 2265 bp, Artificial Sequence
  Description of Artificial Sequence: Synthetic coding sequence
atgttttctggagggtgtcacagtccgggctttggcagaccaagcccagccttccctgcacctggctcacccccccctgcgcctaggccctgccggcaggaaacaggagagcagatagctattaagcaatgtaggcaagagctgtcaccccgcaaccgggagcgctggtgtttggagattcaaattatgcgccgcctcacccatcccaacgtggtcgccgcccgcgacgtgccagaagggatgcaaaacctggctcctaatgatctaccactcctcgccatggaatactgtcaagggggcgatctcaggaagtatctgaaccaattcgaaaactgttgtgggctgcgcgaaggcgctatcctgacactgctcagcgatatagcgtcagctctccgctatctccacgagaacagaatcatccaccgtgatctcaaacccgagaacatagtccttcagcaaggggaacaacgactcatacataaaattattgatctgggctacgccaaggagcttgatcaggggtcgctttgcacatctttcgtggggacactccagtaccttgcccccgaactgctggagcagcagaaatacacagtcaccgttgactattggtccttcggaacacttgctttcgagtgtattaccggcttccgccctttcctccccaactggcaacctgtgcagtggcactctaaggtgcggcaaaagtctgaggtcgacatcgtggtttcagaggatttgaacggtactgtgaaattttccagctccctcccatatccaaacaatcttaacagtgtgctggccgagcgtctggaaaagtggctgcaactgatgctcatgtggcaccccagacagcgcgggacagacccaacgtacggaccgaatggatgttttaaagcactggatgatatcctaaacctcaagttggtgcatatccttaatatggtcactggaaccatccacacctacccggtcacagaagatgaatcactgcaatcacttaaagccagaattcagcaggacacaggcattcctgaggaggaccaggaactcctgcaagaagccgggctggccctgattcccgataagcccgccacacagtgcatctctgacggaaagctgaacgagggccacacattagacatggatttggttttcctgtttgacaactctaagatcacatacgagacgcaaatctcacccagaccacagcctgaaagcgtttcttgtattctgcaagagcccaagagaaacctagcctttttccagctccgaaaagtctgggggcaagtgtggcacagcattcagaccctgaaggaggattgcaacagactgcagcaaggacagcgcgcagccatgatgaaccttctgagaaacaattcctgcttgtcaaaaatgaagaatagtatggcttccatgtcacagcagctcaaggctaaactggatttctttaagaccagcatccagatcgatctcgagaaatatagcgagcaaaccgagttcgggatcaccagcgacaaattactccttgcctggagggaaatggaacaagctgttgagttgtgtggtcgcgaaaatgaggtgaaactgttagtcgagagaatgatggccctgcaaaccgatatcgtggatctccagcgcagcccaatgggacgcaagcaagggggaaccctggacgacctagaggaacaagcccgagaactctaccgcaggctgcgagaaaaacctagagatcaaaggacagaaggggatagccaggagatggtgagactgcttcttcaggcaatccagtcattcgaaaagaaggtgagagtaatttacactcagctgtccaaaaccgtcgtgtgcaaacagaaggccctagagctcttgcctaaggtggaggaggtagtgtctctcatgaatgaagatgagaagactgtggtgcggctccaggagaagcggcaaaaagagctctggaacctgctcaaaatagcatgttcaaaggttcgcggacccgtgtccggttccccggattcgatgaacgcttccaggctgtcacaaccaggccagctgatgtcacagcccagtacagctagcaatagccttcctgaaccagccaaaaaaagcgaggagttggtcgcagaagcccacaacttatgtacgcttctagagaatgcaatccaggacacagtccgagaacaggaccagagcttcaccgccctcgactggagttggctgcagaccgaggaagaggaacactcctgcctagaacaggcctcgtag

SEQ ID NO: 120560 - DNA, 963 bp, Artificial Sequence
  Description of Artificial Sequence: Synthetic coding sequence
atgaaccgacatctgtggaagtcccaactgtgtgagatggtccagccttcaggagggcctgccgctgaccaggacgtgttaggcgaggaatcccctctaggaaaacctgccatgttgcatctcccatctgagcaaggcgcacccgagactctgcaacgctgcctggaagagaaccaagagctgcgggatgccatacgccaatccaaccagattctgcgcgagaggtgtgaggagctgctgcattttcaggcctctcagagggaagaaaaggagtttctgatgtgcaaattccaggaggcacgcaagctcgtcgagcggttgggattggagaaactggacctgaagaggcagaaagagcaggctttgagagaggtggagcacctaaaaagatgtcagcagcagatggcagaagataaggcgtccgtgaaggcccaagtgacttccctgctgggcgagttgcaagaatcccagtcacgtctggaggcagccaccaaagaatgtcaggctctcgagggcaggagaaaactggctcagctccaggtggcctaccatcagctttttcaggagtacgataatcacataaaatctagcgtagtagggagtgagagaaagcgagccgatatctacaaagccgacttccaagcagagaggcaagccagggaaaaattggctgaaaagaaggagctgctgcaggagcagcttgagcaattacagagagagtattccaagctgaaagcctcctgtcaagagtccgcccgaattgaggatatgaggaagcggcacgtggaagtgtcgcaagctcctcttccgcccgccccagcctacctctcctccccgctcgcgctgccaagccagcggaggagtccacctgaggagccacctgatttttgctgcccaaagtgccagtatcaggctcctgatatggacacgctgcagattcacgtgatggaatgcatcgagtag

SEQ ID NO: 120561 - DNA, 1602 bp, Artificial Sequence
  Description of Artificial Sequence: Synthetic coding sequence
atgtcttcagacggaaccatacgtcacagtaaagttcgccaaaaaagcgaagtggacatcgtcgtgtcagaagatctgaatggcactgtaaaattcagctcttcccttccatatccaaataaccttaattctgtgctcgccgagcggttagagaagtggctgcagctgatgttgatgtggcatccacgacagagagggaccgaccccacctacggaccaaatggctgtttcaaggcgctcgacgacatattgaatctgaagctggtgcacattctaaacatggttactggaacaatccatacctatcctgtgaccgaggatgaatctctgcagagtttgaaggcccggattcagcaggataccggtatacctgaggaggatcaggagcttttgcaggaggccggattggcactcatcccagataagcccgcaacacagtgtatctcagatggaaagctgaacgaagggcatacgctggatatggatcttgtctttctgtttgataattctaagatcacatacgaaacacagatctcccctcgcccacaacctgaatctgtgtcttgtatattgcaggaaccaaagcggaacctggctttcttccagctgcggaaggtgtggggccaggtgtggcactcaatccagaccctgaaggaggattgcaatcggctacaacaagggcagagggccgctatgatgaacttattacgcaacaatagctgtttatcaaaaatgaagaattccatggccagcatgtctcagcaattgaaagccaagctggacttttttaagacaagcattcagatcgacctagagaaatactccgagcaaaccgagttcggaatcacgtcggacaagctgctcctagcttggcgagagatggagcaagcggtggagctgtgcgggagagagaacgaagtgaagctgctcgtggagcgcatgatggctttgcaaaccgatatcgttgatcttcagcggtctcccatgggtagaaaacaaggtggaactcttgacgaccttgaggaacaggctagagaactgtatcgtcggttgagagaaaaaccaagggaccagaggaccgaaggtgactcgcaagaaatggttagactccttctccaggctattcagtcattcgagaagaaagtaagagtgatctacacccagctgtccaaaaccgttgtgtgtaaacagaaagcccttgagctcctgcccaaggtcgaagaggtcgtttcactaatgaacgaggacgaaaaaaccgttgtgaggttacaagagaagagacagaaggaactgtggaatctgctgaaaatagcttgcagcaaagtaaggggacctgtctcggggagcccagactccatgaatgcgagtcgcctatcgcagccaggacaactgatgtcacaaccctccaccgctagcaattccctccctgagccagctaaaaaatccgaagaactggtagccgaagcccacaacctctgtacgctgctggagaatgccatacaggacaccgtgcgtgagcaggaccaaagctttacggccctagattggtcgtggcttcagactgaagaagaggaacattcgtgtttggagcaggcatcttag

SEQ ID NO: 120562 - DNA, 2094 bp, Artificial Sequence
  Description of Artificial Sequence: Synthetic coding sequence
atgtcttcggacgggacgattcgcctaactcatcccaacgtggtggcagcaagagatgtgcccgaggggatgcagaacttggctcccaatgacttgcccttactggctatggaatactgtcagggaggggacctcaggaagtacttgaaccagttcgagaactgctgcggcctccgcgaaggggccatcttgaccctcctgagcgatatcgccagcgcgctgagatatctccacgagaacaggattatccaccgcgacctcaaaccagaaaacatagttctccaacaaggcgagcaacgcctcatccataaaatcatcgatctggggtacgccaaagaattggatcagggcagcctctgcacctccttcgtaggaactctgcaatacctagctcctgagctgttggagcagcagaaatacaccgtgactgtggattattggtccttcggtacacttgccttcgagtgcatcactggctttagaccctttttacccaactggcagcctgttcagtggcatagtaaagttcggcagaaatctgaagtggacatcgttgtgagcgaggaccttaacgggacagtgaagttcagttcatcgctcccctatcccaacaacttgaatagcgtgctggccgagagattagaaaagtggctgcagctgatgttgatgtggcaccctagacagcgcgggactgatcctacttacggtcctaatggatgcttcaaggctctcgacgacattctcaatctcaagctggtgcacatactcaatatggtcactggcaccatccacacctaccctgtgactgaggatgagagcttacagtctttaaaagcaaggattcagcaggacactggcatccctgaggaggaccaggagttattgcaggaggccggcctggccctgatccccgacaaaccagccacacagtgcataagtgacgggaagctcaatgagggacacactttggacatggaccttgtcttcctgttcgacaattccaagatcacctacgagactcagatatcacctaggccccaaccagaaagcgtcagttgcatcttacaggagccaaagaggaacttggcgtttttccagctgcgtaaggtgtggggccaagtctggcattcaattcagaccctgaaggaggactgtaatagactacagcaaggacaaagagccgctatgatgaacttgctcaggaacaactcttgcctgagtaaaatgaaaaatagcatggccagcatgtcccaacagctaaaggcgaaactcgattttttcaagacatccattcagatcgatctagagaaatacagcgaacaaacagagtttgggataacctctgataagttgctcctcgcctggcgggaaatggaacaagcggttgaactttgcggccgagagaacgaggtgaagctgctggtggagcgaatgatggcgctgcagaccgatatagtggacttgcagaggtcgcccatgggcagaaagcaggggggcacactcgacgacttagaggaacaggcacgggagctgtacagacgcctgcgggagaaaccgagggatcagaggacagaaggggacagccaggagatggtgagactcctcctacaggcaatccagtctttcgaaaagaaagtgcgggtcatctatacccagctttccaagaccgtcgtctgtaagcagaaggctttggagctgctgcccaaggtagaggaggtagtctcactcatgaatgaggatgagaagactgtggttagactgcaggaaaagcgacagaaggagctgtggaacctattgaaaatcgcatgttcaaaagtgagaggacctgtgtcagggagtccagactccatgaacgctagcaggctgagtcagccaggtcagcttatgtcccaaccaagcactgcttcaaattccctgcctgagcctgctaagaagagcgaagaactggtggcggaagcccacaatctttgcaccctgctggaaaacgctatccaggatacggtgcgagaacaggatcagagttttactgccctggactggtcctggctgcagaccgaagaggaagagcattcgtgtctcgaacaggcatcctag

SEQ ID NO: 120563 - DNA, 2271 bp, Artificial Sequence
  Description of Artificial Sequence: Synthetic coding sequence
atgagttggagcccttcattaactacccagacatgcggcgcctgggaaatgaaggagcggttgggcacaggtggcttcggcaatgtaattcggtggcacaaccaggaaactggggaacaaatcgctataaaacagtgcagacaggaactctccccacggaatagggagcgatggtgcttagagatacaaataatgcgccgactcactcatccaaacgtggtggccgctcgcgacgtgcctgaagggatgcagaacttggcccctaatgacctccctctgctggcgatggagtactgccaggggggcgatcttcggaagtatctcaatcagttcgagaactgctgtggccttagagaaggagccatcctgacgctcctatcagacattgcatctgctctcagatacctgcatgagaatcggattattcacagggacctgaaacccgagaacatcgtgctgcaacaaggagagcaacggttgatccataaaatcatcgatctgggctacgcaaaagaactcgaccaaggcagcctctgtacaagctttgttggaaccttgcagtatttagcccccgagctactcgaacagcagaagtacacggtgaccgtcgactactggagtttcggcaccctagcctttgaatgcatcactggcttccgtcccttcctcccaaattggcagcctgtgcagtggcactcaaaggtcaggcagaaatctgaggtggacatcgtcgtttctgaagatctgaatggtaccgttaaattttctagctccctcccatatccaaataacctcaattccgttctggctgaacggctggagaaatggttgcagctgatgctgatgtggcatccacggcagcgcggaaccgatcctacatacggccctaatggatgttttaaggctttagacgacatcctaaacctcaaattggtacacattctaaacatggttacaggcaccattcacacttaccccgttacagaggacgaaagccttcagtctctcaaggccagaatccagcaggacacaggtatacctgaggaagatcaggaactgttacaggaggccggcctcgccctcatacccgataaaccggcaactcaatgtataagcgatggtaaactaaatgaaggtcatacattggatatggatctggtgtttctgttcgataacagcaagattacatacgagacacaaatctcccccaggccgcaaccagaaagcgtatcctgcatcctccaggagcctaagagaaatctggcattttttcaactgcgcaaggtctgggggcaggtttggcacagcatccagactttgaaggaagattgtaaccgactgcagcaagggcaaagagctgcaatgatgaatctgcttcgcaacaatagctgcctttccaaaatgaagaatagcatggcctccatgtctcagcagcttaaggcgaaacttgatttttttaaaacatctatccagattgatttggagaaatactcggagcagacggagttcggtataaccagtgacaaactgctgctggcgtggcgcgaaatggaacaggccgttgaactgtgcgggcgggaaaatgaagttaagctgctcgtcgaacgtatgatggccttacagacagacattgtcgacctgcagcgctcacccatggggaggaaacagggcggaaccctcgacgacttagaagagcaggctcgcgagttatatcgacggctgcgggagaaaccgagagaccagaggaccgaaggtgactcacaagaaatggtgcgtctactgctccaggctattcagtccttcgagaaaaaagtccgcgtgatctacacgcagctgagcaagaccgtcgtctgtaagcaaaaggcgcttgaattactgcctaaagtcgaggaagtggtttctctgatgaacgaagacgagaaaaccgttgttcgactgcaggaaaagcgtcagaaggaactttggaacctgctgaagatcgcttgttccaaagtgagagggccagtctcaggatctcctgactccatgaatgcgagccgccttagccagccagggcagctgatgagtcagccatccaccgccagcaattcccttcctgaacctgcaaagaagagtgaggagctggtggcagaggcacacaacctctgtactctgctcgagaacgcaatccaagacacagtacgggagcaagaccagagcttcaccgcgctggactggagctggctccagaccgaggaggaggagcactcttgtctcgagcaggccagttag

SEQ ID NO: 120564 - DNA, 3999 bp, Artificial Sequence
  Description of Artificial Sequence: Synthetic coding sequence
atgcgcaacctgaagctgttccgcactcttgaatttcgcgatattcagggacccgggaatccccagtgcttcagtctgagaaccgaacagggcactgtactgatcggctcagaacatggcctaattgaagttgaccctgttagtcgggaagtgaaaaacgaagtcagtttggtagctgaaggattcctgcctgaagacggatcgggccgcattgttggagtgcaagacctgctggatcaggaaagtgtgtgtgtggcaaccgccagcggggacgtgattctatgcagcctgagcactcagcagctggaatgtgtggggagcgtggcgtccggcatttccgtaatgagttggtcaccggatcaggaactggtgcttcttgctaccggacagcagacacttattatgatgaccaaggactttgagcctattcttgagcagcagatacatcaggatgactttggtgaatccaagtttattacggtaggatggggccgaaaggagactcagttccatggcagcgaaggtcgacaagctgctttccagatgcagatgcacgaatcagcactcccatgggacgaccataggccacaagtgacttggagaggtgacggacagttctttgccgtgtcagtggtctgtcccgagacaggagcccggaaagtacgagtttggaatagggaatttgccctgcaatccacaagcgaaccagtggccggcctcggacctgctctggcctggaagcctagcgggtctctcatagcgtccacacaggacaagcccaaccaacaggacattgttttcttcgagaagaatggcttgctgcatggtcacttcaccctgcccttcctgaaggatgaagtgaaggtgaatgatcttctatggaacgcagacagttccgtgctggcggtgtggctcgaagacctgcagcgggaggagtcttctatccccaagacctgcgttcaattatggacggtgggcaattaccactggtatctcaagcaatcactgagcttcagcacatgtggaaaatctaaaattgtttctctgatgtgggatccggtgaccccctacagattgcatgtgctgtgccaaggttggcactatctcgcatatgactggcactggactactgaccggagcgtcggcgataattcatccgatctgtccaacgtcgccgtcattgatggcaatagggtgctggtcacagtctttcggcagaccgtcgtgcccccgccaatgtgtacttatcaacttctcttccctcaccccgtcaaccaagtgacattccttgcccatcctcagaagagtaatgatttggcagttctggacgcctccaatcagattagcgtgtacaaatgtggagattgtccaagcgccgatcctacagtgaaactgggggcggtgggcggctcagggttcaaggtatgcctcagaacaccccacctcgagaagcgatacaaaatacagttcgagaacaatgaggatcaggacgtaaaccctctgaaactgggactgctgacatggatcgaggaagatgtctttcttgccgtatcccactcagaattctctccacgctcagttatccatcacctgacagccgcatcaagtgagatggatgaggaacatggtcagttgaacgtgtctagtagcgcagccgtagatggtgtgatcatatcactctgttgcaactcaaagactaagtcggtcgtactgcaactagctgatggccagattttcaagtatctttgggaatccccctcccttgcaattaagccttggaagaactccgggggcttccccgtgagatttccatatccttgtactcagaccgaacttgccatgattggtgaagaagagtgcgtgctcgggctgactgatagatgtagattctttattaacgacatcgaggtggcaagcaacatcacttcatttgcagtctacgatgagttcctgctcttgaccacccactcccacacatgtcaatgcttctgtcttagggacgcaagtttcaaaacattgcaagcaggcttatcttctaaccatgtgtcccatggcgaagtgctgaggaaggttgagaggggctcccgcatcgtgacagtggtacctcaagacacaaagctggtgcttcaaatgcctcggggtaatctggaagtcgtccaccacagggctcttgtgctagcccagataaggaagtggctggataaactcatgtttaaggaagctttcgaatgtatgagaaagttgcggatcaacctgaatctgatttacgatcacaaccctaaggtcttcctgggaaatgttgagacattcataaaacagattgactctgtgaaccatattaatctgttctttacagagctaaaggaggaggacgtgacaaaaacaatgtaccccgcccccgttacctcttcagtctatttatctcgggatccagatggaaataagatcgacctcgtgtgtgatgccatgagggccgttatggagtccatcaatccccacaagtattgtttatccatcctgacgtcccatgtcaagaaaacaaccccagagttggaaatcgttctgcagaaagtccacgaacttcagggtaatgcaccttcagaccccgacgctgtttccgcagaggaagccctcaaatacctgctgcatctggtggacgtgaatgaactttacgaccacagcctgggaacttacgacttcgacctcgtcctcatggtcgctgagaagtcgcagaaggatcctaaagagtatctgcccttcctaaacacacttaaaaaaatggaaactaattaccagaggttcacaattgataagtacctgaaaaggtacgagaaagccatcggacacctgtccaagtgcggccccgaatactttcctgagtgcttgaatctgatcaaagacaaaaacctgtataatgaggctcttaagttatacagcccctcctcccagcaatatcaggacatcagcatcgcctacggcgaacatctcatgcaggagcatatgtacgaaccagcaggtctcatgtttgcccggtgtggggcccacgagaaagccctgagtgcgttcctgacatgcggaaactggaagcaggccctttgtgttgccgctcagttaaattttaccaaggatcagctggtcgggctgggtcgaactctcgcgggaaagctcgttgagcagcgaaagcatatagacgccgcaatggtccttgaggagtgtgcccaggattatgaggaagcagtgttactgctcttagaaggcgcagcttgggaagaagcgctaagactggtgtacaaatacaataggctcgatataatagaaacaaatgtgaaaccgagcattcttgaggctcagaaaaactacatggctttcctggatagccagactgctacgttttcaagacataaaaagagattactggtggtaagagaactgaaggaacaggcacaacaggcaggcctcgacgatgaggtgccccacgggcaggagtcagacctgttcagcgaaacttctagcgtggtcagcggaagcgagatgtctgggaagtacagccactccaactctaggatcagtgctagaagttcaaagaatcgtcggaaggctgaacggaagaaacatagcttgaaagaggggtctcctctggaggacttagccttgctagaggccctcagcgaagtcgtgcaaaatactgagaatctgaaggatgaggtgtaccacatcctaaaagtccttttcctgtttgaatttgacgagcagggacgggagctacagaaagccttcgaagacactttacagctgatggaacgcagccttcccgaaatctggactctgacataccagcagaactccgccactcctgttttggggcctaactctactgcaaacagtattatggccagctatcaacagcagaaaaccagcgtcccagtgctggacgcagagttgttcattccgcctaaaattaaccgacgcacccagtggaagctgtcactgctcgattag

SEQ ID NO: 120565 - DNA, 2952 bp, Artificial Sequence
  Description of Artificial Sequence: Synthetic coding sequence
atgtgggatcctgtgaccccttaccggctccatgtcctgtgtcaaggatggcattacctggcttacgactggcactggaccaccgatagatctgtgggcgataatagtagcgacctatctaatgtggctgtcatagatggcaatcgagtgctagtcactgtctttagacagaccgtagttccaccacctatgtgcacctatcaattgctcttcccacatcccgtgaaccaagtgacctttctggcccatccacaaaagtccaacgacctggctgtgctggacgccagcaaccaaatctcagtatacaaatgcggagactgtcccagcgccgaccccaccgtgaagctgggcgccgtgggcgggtccgggtttaaggtctgccttcgaacaccgcatctggaaaagcggtataagatccagtttgagaataatgaagatcaggacgtgaatccactgaagcttgggctccttacttggattgaggaagacgtcttcctggcagtctctcactcagagttttctccgcggtctgtcatacaccacctaacagccgccagttctgagatggacgaggaacatggccagctgaacgtgagttcgagcgccgcagtggacggcgttatcatctctctgtgttgcaactcaaaaacaaagtccgtggtgcttcaactggccgatgggcagattttcaagtatttatgggagtccccatcccttgccattaaaccctggaagaacagtggcggtttcccagtcagatttccttatccatgtacccaaaccgagttggcaatgattggggaggaggaatgcgttcttggccttactgatcggtgccgctttttcataaacgatatcgaggtggcctctaacatcacaagttttgcagtctacgacgagttcctgcttctgacaacccactctcacacttgtcagtgtttctgcctcagggacgcaagcttcaagacactccaagctggtttgtcttccaatcacgttagtcacggggaggtattgagaaaagtagagagagggagtcgcattgttaccgtggtgcctcaggatacgaagttagtcctccagatgccgcgagggaatcttgaggttgtgcaccacagagctctggtgctagctcaaatccgcaagtggcttgataagctcatgtttaaagaggcttttgagtgcatgcggaagctgcgcataaatctgaatctcatctacgatcataaccctaaagttttcttaggaaacgtggaaacatttataaaacaaatcgactcagtgaatcacataaacctcttttttaccgagctaaaagaagaagacgtcaccaagaccatgtatccggcacccgtcacctctagtgtttacctaagtcgtgaccccgacgggaataagattgacttggtttgcgacgccatgagagcggtcatggaatccatcaacccacataaatattgtctgagcatcctcactagccatgtgaagaaaacgacacccgaactggaaatagtacttcagaaggtccacgagctgcagggaaatgcaccctccgatccagatgccgtctctgctgaagaggcacttaaatatctcctgcatctggtcgatgtgaacgaactgtacgatcacagtctgggcacctatgatttcgacctggtactgatggtggcggagaaatctcaaaaagatccaaaggagtacttacccttccttaacactctgaaaaagatggagacaaactaccagaggtttactattgataaatatctcaagcgctacgagaaggcgattggtcatctttccaagtgtggacccgagtacttcccagagtgtctaaacctcataaaagataaaaatctgtataatgaagcactcaagctctactccccgagttctcagcagtatcaggatataagtatcgcctatggggaacatttgatgcaggagcatatgtacgagccagcagggcttatgttcgcccgatgtggtgctcatgagaaggcactatcagcttttctcacatgtggcaattggaagcaagcactctgcgttgctgctcaactcaacttcacaaaggaccaactcgtgggcttggggaggaccctggcgggcaagctggtggaacaacgaaagcatatagatgctgcaatggtgctggaagagtgcgcacaagactatgaagaagcggtgttattactcctggaaggcgccgcctgggaggaggcactgagattggtttacaaatacaaccgcttagacataattgaaacgaatgttaaaccttccatcctggaagctcaaaaaaactatatggccttcctcgatagccagacagcaacattttctcgacacaagaaaaggctgctggtcgtgcgagaactaaaagaacaagctcagcaagcaggattggatgatgaagtgccacatggccaggagtctgatctcttttcagagacttcaagcgtggtttccggatcagaaatgtcagggaagtactctcactcgaacagccgtataagcgcccggtccagtaagaatcggcgaaaagctgagcggaagaagcattcactaaaagagggctcacctctcgaggacttggcgctcctggaggcactatccgaagtcgtccagaacacggagaacctcaaagatgaggtgtaccacatcctcaaggtgttgttcttattcgaatttgatgagcaggggagagagcttcagaaggccttcgaagataccctgcagttaatggagcgcagccttccagagatctggaccctgacttatcaacagaattccgccactcccgtcctcgggccaaactctacagctaactctattatggcctcctatcagcagcagaaaaccagtgtccctgtgctcgacgctgagctgttcatccctccaaaaataaacagacgaacacagtggaaactttccctattggattag

SEQ ID NO: 120566 - DNA, 2151 bp, Artificial Sequence
  Description of Artificial Sequence: Synthetic coding sequence
atgcagtctactgcaaactatctatggcatactgacgacctgctaggccaaggcgctacagccagcgtgtataaagccaggaataagaaaagcggggagctggtcgccgtcaaggtgttcaacaccacctcttacctgaggcccagagaggtgcaagtgcgcgaattcgaggtcttgagaaaattgaaccaccagaacatcgttaagctgttcgccgttgaagaaaccggcggctcacgccagaaagtgttagtgatggagtattgcagcagcggttctctcctgtccgtgctggaaagtcctgaaaatgccttcgggttgccagaagacgaattcctggtggtccttagatgcgtagtagctggcatgaaccaccttcgcgagaatggcatcgtgcaccgggacattaaaccggggaatatcatgcgcctcgtgggagaggaggggcagtcaatttataaactgactgacttcggtgcggcccgcgagctggatgacgacgagaagttcgtgtcagtgtatggtaccgaggagtacctccacccagatatgtatgagagggccgttctcagaaaaccacagcaaaaggcctttggagtcacagtcgacctttggtcaattggagtgactttatatcatgcagctactggcagcctgcctttcattcccttcgggggcccgaggcgcaataaggagattatgtataggattactacggagaagcctgcaggggccatcgccggcgcgcagaggcgagagaatggtcctttggaatggagttacacgctccccattacctgccagctgtcgcttggcctgcagtcccagctggtgcctatcctcgcaaatattctggaagttgagcaggcaaaatgctggggcttcgaccaattttttgcagaaacaagtgatatcttgcagagagttgtagtccacgttttctctctgtctcaagcagtcttgcaccacatttatatccatgcacacaatactatcgcaatatttcaggaggccgtgcacaaacagacatcagtcgcacctcggcatcaggagtatctgttcgaaggacacctgtgcgtgttagagccttcagtgtccgcacagcatatcgcccacactaccgcgtcctcacccctgacactgtttagcacggcaattccaaaggggctggcctttcgggacccagccctggacgtaccgaagtttgttcctaaagtcgacttacaggcagactataacactgccaaaggagtgctgggcgcaggataccaggcattacggctggctagggctctcttagacggccaggagctaatgtttagaggcctgcattgggtgatggaggtgcttcaggcaacctgcagacggacgttggaggtagccaggacttccctcctttacctgagctcttctctgggcaccgagaggttctccagcgtggcgggtaccccagagatccaggagctgaaagctgctgccgagctgcgctctcgcctgcgcaccctagctgaagttctgagccgctgcagtcaaaatattaccgagacacaggagtcactatctagcttgaatcgcgagctggtaaagtccagggaccaagtacatgaagataggtctattcagcagatccagtgctgtctcgacaagatgaactttatctacaagcagtttaaaaaatcccggatgcggccgggactgggttacaacgaggagcagattcacaaactggataaggtaaactttagccacctcgctaagagactattgcaggtgtttcaagaggaatgtgtgcaaaaataccaggcatctctggtcacgcacggcaagagaatgagagtagtccacgagacgcgcaaccaccttcggttagtgggatgttcagtcgccgcttgcaacactgaggcccagggcgtgcaagaatctttaagtaaactgctcgaagaactgtctcaccagcttctgcaggatagagctaaaggggcgcaggccagcccgccaccgattgccccatatccgtcccccactcgtaaagatctgcttttacacatgcaggaactgtgcgagggaatgaagcttttggcctccgatctgctggataacaacagaattatagagagactgaacagggttcccgcccccccggacgtgtag

SEQ ID NO: 120567 - DNA, 1896 bp, Artificial Sequence
  Description of Artificial Sequence: Synthetic coding sequence
atggagtactgttcaagcgggagccttctcagcgtgctcgaaagcccggagaatgccttcggcttgccggaggacgaattcctggttgtgttgcgctgtgtggtggccggcatgaatcacctgagagaaaatggaattgtgcatagggacatcaagcctggaaacatcatgagactggtcggagaagagggccagtctatctacaagctgaccgacttcggagccgcccgcgagctggacgatgatgaaaagtttgtttcagtgtatggcacggaggaatacctgcacccagacatgtacgaaagggcagttcttcgcaaaccgcagcagaaggccttcggagtgacagtcgacctatggtcaattggcgtgactctgtaccacgcagccactggcagtcttcctttcatccccttcgggggtccaagaaggaacaaggagattatgtacagaataactactgagaaaccagcaggagctatagccggagcacaacggcgtgagaacggaccgcttgaatggtcctacacattacctatcacttgtcagcttagcctcgggctgcagagccaattggtccccattttggctaacatcttggaagtggagcaggccaaatgctggggttttgaccaattcttcgctgagacctctgatatcctccagagagtcgtggtccatgtcttctctctctctcaagcagtgcttcaccatatatatatccacgctcacaatactattgcgattttccaggaagctgtgcacaaacagactagtgttgccccacggcatcaggagtatctcttcgaaggccatctttgtgtgttagaaccaagtgtgagtgctcagcacatcgcgcataccaccgctagctcacccttaaccctgtttagcaccgccataccaaaaggacttgcatttcgcgaccccgccctcgacgtgcctaagtttgtgccgaaggtggacctccaggcagactataacaccgctaaaggtgtgctgggagccggataccaagctctcaggctcgcaagggcgttactcgatggacaggaactcatgtttcgagggctacattgggtgatggaggtattgcaggcaacatgtcggaggacattggaagtggcacggacatccctcctctatctaagctcttctcttgggactgagcgttttagcagcgtcgccggcacaccagaaattcaggagttgaaagccgctgctgagctgcgcagccgtctgagaactctggccgaagtactgtcccggtgctcacagaacattaccgagactcaggagagcctctcgtcactcaatcgcgagctggtcaaatcccgtgaccaggtgcatgaggataggagtatccagcagatacagtgctgcctggacaagatgaattttatctacaaacagttcaagaagtccagaatgagacccggcctggggtataacgaggaacagattcataaactggataaggtgaacttttcccaccttgccaaacgactgctgcaggtctttcaggaggagtgtgtgcagaagtaccaggccagcttagtcactcacggaaagaggatgcgggtcgtccacgagacgcggaatcatctgagattggtcggatgttccgtggccgcttgcaacaccgaagcccagggcgttcaggaaagtctgagtaagctactggaggaactgtcccatcagttactgcaggaccgggccaaaggtgcgcaggctagccctccaccaattgccccatatcctagccctacaaggaaagacttactactgcacatgcaggaactctgcgaaggcatgaagttgctggcatccgatttactggacaataacaggatcattgaaaggctgaatcgtgtgcccgctccgcctgacgtgtag

SEQ ID NO: 120568 - DNA, 1107 bp, Artificial Sequence
  Description of Artificial Sequence: Synthetic coding sequence
atgaaccgacatttgtggaagtctcagctctgtgaaatggttcaaccatccggaggtcccgccgcagatcaggacgtcctgggggaagagtcccccctgggcaagcccgccatgcttcatctgccatctgagcagggcgcccccgaaaccttacaaagatgtcttgaggagaatcaggagctcagggatgctattaggcagtcaaatcaaatcctgcgggaacggtgtgaggagttactacattttcaggcatcccaacgtgaggaaaaagaattcctgatgtgcaaattccaggaggctaggaaacttgtggaaaggttaggactcgaaaaacttgaccttaagagacaaaaagaacaagctctgcgggaggttgaacatctgaaacgatgccagcagcagatggccgaagataaggccagtgtgaaggctcaggtaacaagtctgctcggcgagctgcaagagagccagtcacgcttagaggccgctaccaaagagtgtcaagctctggagggacggaggaagctggcccagcttcaagtggcttaccatcaactattccaggagtacgacaaccacataaaaagctctgtagtgggctccgaacggaagcgcggaatgcaacttgaggatctgaaacagcagctccagcaggctgaagaggcacttgtcgccaagcaagaagtgattgataagctgaaggaggaagccgaacagcataagatcgttatggagacagtgcccgttctgaaggcacaggcagatatttataaagcagactttcaggcagagaggcaggccagagagaagctggcagagaagaaggagctgttacaggagcagctcgaacagcttcaaagggaatacagcaagcttaaggcctcctgccaggagtcagcaaggattgaagacatgcgcaaaagacacgttgaggtgagccaggcccccctgcctccggctcctgcttatttaagttctcccctggcactcccctctcagaggcgtagtcctccagaagagcccccagatttttgctgtccaaagtgccagtatcaggcacccgacatggacactctccaaatccacgttatggagtgcatcgaatag

SEQ ID NO: 120569 - DNA, 1260 bp, Artificial Sequence
  Description of Artificial Sequence: Synthetic coding sequence
atgaatagacacctgtggaagtctcaactgtgtgaaatggtgcaacccagcggggggcccgccgccgaccaggatgttttgggtgaggagagtccattgggcaagcctgctatgctccatctccccagtgagcagggcgcccccgagacactgcagcggtgccttgaggaaaatcaggagctgagagatgctatacggcaaagtaatcagatactccgggagagatgcgaggaactccttcatttccaggcaagccagagggaagagaaagagttcctgatgtgtaagtttcaggaagcacgtaagctcgtggagcggctcggcctcgaaaagctggacctgaaacggcagaaagaacaggcattgcgagaggtggaacacctgaaacgttgtcagcagcagatggcagaggacaaggcctcagtgaaagcccaggtcacgtcactcctcggcgagctacaggaatcacagagccgcctcgaggctgctactaaggaatgccaagctttggagggccgcgccagggctgcctcagagcaggcgcgccagctggagagcgagagagaggctctgcaacagcagcatagtgtgcaggttgaccagctccgcatgcagggacagagtgtcgaggcagcgctcagaatggagcgacaagccgcgtccgaagagaaaaggaagctggcgcaactgcaggtcgcatatcaccagttgtttcaagagtacgacaaccatataaagtctagcgtggtcggatcagagagaaaacgcgggatgcaactggaagacttgaaacaacaactccagcaggccgaggaagccctggtggctaaacaggaagtcatcgacaaactgaaagaggaggcagaacaacataagatcgtgatggaaaccgttcccgtactgaaggcacaagcagacatctacaaagctgactttcaggcagaacgccaggccagagaaaagttagcggaaaaaaaagagcttctgcaggagcagctggaacagttgcagagagaatactctaaactgaaagcctcttgccaggaatcagcacgcattgaggacatgcgcaagagacacgtggaggtcagtcaggcacctctgccacctgctccagcctatctgtcgtcccctctggccttgccaagccaacgaaggtcaccacccgaggagcctcccgacttctgctgccctaagtgtcaatatcaggcccccgacatggacactcttcagatccatgtcatggaatgcatagaatag

SEQ ID NO: 120570 - DNA, 1260 bp, Artificial Sequence
  Description of Artificial Sequence: Synthetic coding sequence
atgaatagacatctgtggaagagccaattgtgcgagatggtgcaacctagtggcggtccggccgccgatcaggatgtgctcggggaggaatcccctcttgggaagccagctatgctgcatctgcccagtgagcaaggcgctccagagacactacagagatgcttggaggagaaccaagaattaagagatgcaataaggcagtcgaaccagatattgcgggaacggtgcgaggagttgctgcactttcaagcgagtcaaagagaggagaaggagttccttatgtgcaagttccaggaagccagaaagttagtcgagcggctcggtcttgagaagctggacctgaagcgtcagaaggagcaggctcttagggaggtggagcacctgaaacgttgtcagcagcagatggccgaagataaagcgagcgtgaaggctcaagtgacaagtctcctaggcgaactgcaggaatcacagagccgacttgaggccgcaaccaaagaatgccaagccctggagggccgagccagagcggctagcgagcaagcgcgccagcttgagagcgagagggaggccctccagcagcagcactccgtccaagttgatcagctgcgaatgcagggccagtcagtcgaagccgctctgcggatggaacggcaagccgcttctgaggaaaaacggaaacttgcgcagctgcaagtggcttaccaccagttgttccaagagtacgacaaccatataaaaagttcggtcgtgggttccgaaagaaagcgcggtatgcagctcgaagatctcaagcagcagctccagcaggctgaggaggcccttgttgccaaacaggaggtcattgacaaactgaaagaagaagccgaacagcacaagatagtgatggagacagttcctgttctcaaagctcaagccgacatctataaggccgattttcaggctgaaagacaggcccgtgaaaaacttgcagaaaaaaaggaactgctacaggaacagttggagcaactacagcgggaatattccaagctcaaggcgagttgccaggagagtgcaagaatagaggacatgcgtaagagacacgtagaagtgagccaggcacctctgccccccgctcccgcctacctgtcaagtcccttagccctgccatcccaacgcaggagccctcctgaagagcctcccgacttctgttgccccaaatgccagtaccaggcccctgatatggatacactccagattcatgtgatggaatgtattgaatag

SEQ ID NO: 120571 - DNA, 1260 bp, Artificial Sequence
  Description of Artificial Sequence: Synthetic coding sequence
atgaacagacatctgtggaagtctcagctctgtgagatggtccagcctagtggcggaccagctgccgatcaggacgtgcttggagaagaaagtcctttagggaagcctgccatgctgcatttgccatccgagcaaggtgcaccggagaccctccagaggtgccttgaagagaaccaggagctgcgcgacgccatccgtcagtcaaatcagatactcagggagaggtgcgaggaactcctgcacttccaggcatctcagagagaggaaaaggagttcctgatgtgtaagttccaggaggcacggaaactggtcgagcgattggggctagagaagctggacctaaaaagacagaaagaacaggcccttagagaggtcgagcacttgaagcggtgccagcagcagatggccgaagataaagcaagtgtgaaagcacaggtgacatcgctccttggtgagctgcaggaaagccagtcacgtcttgaggccgccacgaaggagtgccaagctctcgagggacgcgcacgtgcggcttctgagcaggcacgccagctggagtctgaaagggaagccctgcagcagcagcacagtgttcaggttgatcagttgcggatgcagggccagtcagtagaggcagccctgcgtatggagcggcaggctgcttcggaagagaaaagaaagttggcacaacttcaagtggcataccaccagctcttccaggaatatgataatcatataaaaagtagtgtggtgggatctgaaaggaaacggggaatgcagctggaagatttgaagcagcagttacaacaggccgaggaggcgctggttgcaaagcaggaagtgatcgataaactgaaggaggaggccgagcagcataagatagtgatggaaacagtgcctgtactgaaggcccaggcggacatctataaagctgactttcaggcggaaagacaggcgcgcgagaaattggccgagaagaaagagttgctgcaggaacaattggaacagctgcagcgtgagtacagcaagcttaaggcgtcttgtcaagagtctgccagaattgaggacatgcgaaagcggcacgttgaagtgagccaggccccacttccccctgctcccgcttacctgtcaagtccactggcccttcctagtcagcgccgaagccccccggaggagcctcctgatttctgctgtccaaagtgtcagtaccaggcccctgacatggacacactgcagatccacgtgatggaatgcattgagtag

SEQ ID NO: 120572 - DNA, 1464 bp, Artificial Sequence
  Description of Artificial Sequence: Synthetic coding sequence
atggccttggtcatacaggttgggaagctgagacctcgagaagtccggacacctcaaacaattaacccctccctgttcccttctctccccgttaagctgtcgagcatcatcgaggtgccgagtgggggagagcggtgttgctctcgccggacattggtttacaaagcgagagcattctggaaaggcgccccgctcccttgttggatgaaccgccatctgtggaagagccagctgtgcgagatggtgcagccgagcggaggccccgccgccgatcaggatgtgttgggcgaggaatcacccctcgggaagccagcgatgttacaccttccatcagagcaaggagcccccgagacgctgcagagatgtttggaggagaatcaggagctgagggacgccatccgtcaaagtaatcagattctgagagagaggtgtgaggagttgttgcattttcaagcctcccagcgagaggagaaggagttcctcatgtgcaagttccaggaggcccgcaaactggttgagaggcttggcctcgaaaagctggatctcaaaagacagaaggagcaggccctccgcgaggttgaacacttgaagcgctgccagcaacagatggctgaagataaggccagtgtaaaagctcaggtcaccagcctattgggtgaactgcaagaatcacaatcccgactcgaagctgccacaaaagagtgtcaagccctggaaggcagagcaagagccgccagtgaacaagctagacagctcgaaagcgagagggaggcactgcagcagcagcattcagtccaggtggatcagttgcgcatgcagggtcaatctgtggaagctgctctgcggatggagaggcaggctgctagtgaagaaaagaggaagttggcccagctgcaggtcgcgtaccaccagctgtttcaggagtatgacaatcacataaagtcgagtgtggttggctctgaacggaaaagaggtatgcagttagaagacctcaagcaacagctacagcaggccgaagaggcccttgtggccaagcaggaagtgatagataagctgaaggaagaggcggagcaacacaaaatcgtcatggagactgtgcctgtgttgaaggcccaggccgacatctataaagctgatttccaggccgaacggcaagctcgcgagaaactggccgagaagaaggaattattacaggagcaacttgagcagctgcagagagaatattcaaaattaaaggctagctgccaggagagcgctcgcatcgaggacatgaggaaacggcatgtggaggtatctcaagccccccttccaccagcccccgcttatctgagtagccctctcgctcttcctagccagcggcgctcaccgcccgaggagcccccagatttctgttgtcctaagtgccagtaccaggctcctgatatggacacgttacaaattcacgttatggagtgcattgaatag

SEQ ID NO: 120573 - DNA, 621 bp, Artificial Sequence
  Description of Artificial Sequence: Synthetic coding sequence
atgaacaggcacctttggaaaagccagttgtgcgagatggtccagccttcaggtggtcctgctgccgaccaggacgttctaggggaggagagtccactcggtaagccagcaatgctgcatctgccgagcgagcaaggggcccctgagaccctgcagcgttgcctcgaagaaaatcaagagctgcgtgatgcgatccggcagagcaaccagattcttagagaaaggtgtgaggagcttctacattttcaagcctcacagcgagaagagaaagagtttctcatgtgtaaatttcaagaggcgcgcaaactggttgaacgcctcggactggagaagcttgatcttaagcggcaaaaggagcaagctctccgagaagtggagcacctgaaaagatgtcaacagcagatggctgaggacaaggcttccgttaaggctcaggtgacaagtctgcttggcgaattacaagagtcccagtctcgcctggaagcagccacaaaagaatgccaagccctggagggcagagcgcgagccgcatccgaacaggccaggcagctggaaagtgagcgcgaggccttgcagcagcagcattccgtgcaagtggaccagctcagaatgcaaggctag

SEQ ID NO: 120574 - DNA, 756 bp, Artificial Sequence
  Description of Artificial Sequence: Synthetic coding sequence
atgaatcggcacctctggaagtcccagctgtgcgaaatggtacaaccgagcggcgggcctgcggccgaccaggacgtcctcggtgaggagtcccctttggggaagcctgcaatgctgcacctgccctctgaacagggagccccagaaactcttcagcgatgtctcgaggagaatcaggaacttcgagacgcaattcgccagagtaaccaaattctgcgagagagatgcgaggagctgctccacttccaggctagccagcgtgaagaaaaagagttcctgatgtgcaaatttcaggaggcccgaaaacttgtagaacgattaggccttgagaagctggatctgaagcggcaaaaggagcaggctttacgcgaggtcgaacacctcaagagatgtcagcaacagatggccgaagataaggcttcagtcaaggcacaggtcacttcactgctcggggagctccaggagtcgcagagtcgcctggaagctgcgaccaaagaatgtcaagccctggagggcagggcccgggccgcgtctgagcaagcaaggcagctagaatctgagagggaggcgcttcagcagcagcacagtgtccaagtggaccaactccgcatgcagggccagagcgtggaggcagccctgcgcatggagcgccaggccgcatctgaggaaaaaaggaagctcgcgcaacttcaagtcgcttaccatcaactgttccaggaatacgataaccacatcaagagctcggtcgtgggctag

SEQ ID NO: 120575 - DNA, 417 bp, Artificial Sequence
  Description of Artificial Sequence: Synthetic coding sequence
atgaacagacacctatggaaatcacagctctgtgagatggtccaaccatctggcggccccgcagctgatcaggatgtactgggtgaggagtccccactcggcaaacccgctatgcttcatttgcccagcgagcaaggagcccccgagacactgcagcgatgtctggaagaaaaccaagagctaagggatgccatccgccagtcgaatcagatcctgagggaacgctgcgaggagctcctgcattttcaggcatctcaacgcgaagagaaggagttcctcatgtgcaagttccaggaagctcgcaagctggtggaacggcttggcctcgaaaagctggatctcaaaagacagaaggaacaggctttacgcgaagtagaacacctcaagaggtgccaacagcagatggccgaagactag

SEQ ID NO: 120576 - DNA, 1257 bp, Artificial Sequence
  Description of Artificial Sequence: Synthetic coding sequence
atgaatcgtcacctgtggaagtcacagctctgtgagatggttcagccctctggcggacctgccgcggaccaggacgtactgggcgaggaaagtccgttagggaagccggccatgctacatctacccagcgagcagggtgcgccagaaactcttcagaggtgcctggaagaaaaccaggaactgcgcgatgcaataagacagagtaaccaaatcctccgcgaacggtgtgaagagcttcttcactttcaggcttcccagcgggaggagaaggaattccttatgtgtaagttccaagaagctagaaaactcgtcgagcgcttgggactggaaaaactggacctcaaacggcagaaggagcaggccctacgcgaagtggaacacctcaagagatgccagcaaatggccgaggacaaggcatccgtgaaggcccaggtaacaagtctgttgggcgaactgcaggagagtcagagccggcttgaggccgctacaaaagaatgccaggccctcgaggggagggccagggctgcctccgaacaagcacgccagctggaatccgagcgtgaagctcttcaacaacagcactcagtccaagtcgaccagctgcggatgcagggtcaatctgtagaagccgcccttaggatggaacgtcaagcagcatcggaggaaaagcggaagctggctcaactccaagtggcgtaccaccagctgttccaggagtatgacaatcacatcaagtcatccgtggtgggctctgaacggaagcgaggcatgcagctggaggatctgaaacaacagctgcaacaggccgaggaagccctggtggctaagcaggaagttatagataaactaaaagaggaggctgagcagcacaagattgtgatggagacagttcctgtcctaaaagcccaagctgacatttacaaggccgactttcaggccgagagacaggcacgagaaaagttagcggagaagaaggaactgctgcaagaacaactggaacagctgcagagagagtactctaagctgaaggcttcttgtcaggagtccgccagaatagaagatatgcgaaaacgccacgtggaggtgtcacaggcccctctaccccccgcgcccgcctatctgagctctcctttggccctgccaagccaacgtagaagccctccagaagagcccccagatttttgctgtcccaagtgccagtaccaggcccccgacatggacaccctgcagattcatgtaatggagtgcatagagtag

SEQ ID NO: 120577 - DNA, 2181 bp, Artificial Sequence
  Description of Artificial Sequence: Synthetic coding sequence
atgctcagagcctgccagcttagcggggtgaccgctgctgcacagtcctgcttgtgtggtaagttcgttctccgtcccctgcgcccctgtagacgttacagcacctctgggtcttccggattgacaacagggaagattgccggggccggtctgctattcgttggcggcgggatcggcggcaccatactttacgccaagtgggattcacatttccgggaatccgttgagaaaaccatcccttacagtgacaagttgttcgaaatggtgctcggccccgctgcgtataatgtccccctcccgaagaagtctatacagagtggacctctgaagatttcatccgtatctgaagtgatgaaagaaagcaagcaaccagcctcccagctgcagaaacagaagggggacaccccagcttccgctactgcgcccacggaagccgcacaaatcatctcagcggccggcgataccctttcagttcctgctccggctgttcagcctgaagagtcattgaagaccgaccatccagagatcggcgagggcaaacctacgcctgccctgtccgctctggcgaagagcctcgaagacgcactgagacagaccgccagtgtcactctgcaggccattgcagcccagaatgcagctgtgcaggccgtcaatgctcactcgaacattctgaaggctgctatggataactccgagatagcaggagagaaaaagagcgcccagtggcggaccgttgaaggcgcccttaaggaaagacgcaaggctgtcgatgaggccgccgacgcgctccttaaagcaaaagaggagctcgaaaagatgaaatccgtcattgaaaacgcgaagaaaaaagaggttgctggagccaagccccatatcaccgctgccgagggcaaactccacaacatgatcgttgatctggacaacgtcgtcaaaaaagttcaagctgcacaaagtgaagcaaaggtcgtttcacagtaccacgaattggtggtccaggctcgagatgatttcaaacgagagttagacagtattacgcctgaagtgttgccggggtggaaggggatgagcgagtacaatttagcagataaactaagcacggacgatctgaactccttgatcgctcacgctcataggcgtatcgaccagctcaatcgggaactcgcagagcagaaggcgacagagaagcaacatattaccctggccctcgagaaacaaaaactggaggagaagagagcctttgactccgctgtggcaaaggccctcgagcaccatcgatccgagatccaggccgagcaggaccggaagatagaagaggttcgtgacgcaatggagaacgagatgagaacacagctaaggagacaggcggctgcccacaccgaccacctcagggacgtcttgagagtgcaggagcaggagctcaagagcgaatttgaacagaacttgtctgagaagctgtctgaacaggagctccagttcagacggctatcccaagagcaagtcgataattttaccctggatatcaatacagcatatgctcggcttcggggcattgagcaagcagttcagagccatgcagttgcggaggaggaggccaggaaggcccatcagctgtggctgtccgtcgaggctctcaaatatagtatgaagacgtcctcagctgagacgcccacaatccctctgggctcagccgtggaggctatcaaagctaactgttccgacaatgagttcactcaggccttaaccgctgccattccccctgaaagtcttacacggggggtgtactcagaagagaccctgcgcgcacgcttttatgccgttcaaaaactcgctaggagagtggctatgattgatgagacaagaaacagtctttaccagtactttctaagctatctccagtccctgctgctttttccaccgcaacagctcaagccacccccagagctgtgcccggaggatatcaatacatttaaattgcttagctatgcatcttattgtatcgagcatggcgatcttgaactggcggctaagtttgtgaaccagctgaagggagagagccgaagagtggcacaggactggcttaaagaagctaggatgacattggagacaaagcagattgtggaaatattgactgcatacgcttcagctgtcggcatcggcactacccaagtgcagccagagtag

SEQ ID NO: 120578 - DNA, 1119 bp, Artificial Sequence
  Description of Artificial Sequence: Synthetic coding sequence
atgttgcgagcctgccagctgagcggcgtcaccgccgctgcccaatcctgtctctgcggaaaattcgtgctacgaccgctgcgcccttgtaggcgatattcgacctctgggtctagcggccttacaacaggcaaaattgcaggcgcaggactgctgttcgttggaggcgggattggcggtactatcctgtacgccaagtgggattcccactttcgggaaagcgtggagaaaacgattccatacagcgacaaattgtttgaaatggtgcttggtcctgctgcctataacgttccactgcccaaaaaatctatccagtctggcccgttgaagatttcatctgtgtcagaagtgatgaaggagagcaaacaacccgcctcccagctgcaaaaacagaaaggggatacaccagcgagtgcaacagccggcgatacattgagtgttcccgctcccgccgtgcagcccgaggaatccctgaagacggaccacccggagattggagaaggcaagccaacccccgccctgtccgaggcaagctcctcttcgatccgagagcgacccccagaagaagtggctgcaagactggcgcagcaggaaaaacaagaacaggtgaaaattgagtccctggctaaaagcctggaggatgctctcagacagacggcttcagtcactctgcaggccattgccgcaataccacctgaatcactgaccaggggggtgtatagcgaggaaacactgcgcgcccgcttctacgcagttcagaagctcgccaggcgcgtggccatgattgatgagactcgcaatagcctctatcagtactttttgagctatcttcaatctcttctcttgttccccccacagcaactgaaaccacccccagaactctgccccgaagacatcaatactttcaagttactgagttatgcttcttactgtatcgagcacggggatctggagctcgctgccaaatttgtcaatcagcttaagggtgaaagtagacgagtggcgcaggactggttaaaggaggcacgtatgactttagagacaaagcagattgttgagattctcacagcctatgcttcagcagtcggcatcggcacgacgcaagtgcagcccgagtag

SEQ ID NO: 120579 - DNA, 1980 bp, Artificial Sequence
  Description of Artificial Sequence: Synthetic coding sequence
atgctgagggcatgccagctgtccggcgttacagcagccgcgcaaagctgtctttgtgggaagttcgtactgcgccccctgcgtccctgtaggaggtactctacctcagggagtagcgggttgacaaccgggaagatcgctggcgcaggtctgctcttcgtcggaggtggaatcggtggaacaatcctgtatgcaaagtgggatagtcatttcagagaaagtgttgagaaaaccattccctacagtgacaaactgtttgagatggtgttaggacccgctgcatataatgttcccctgccgaaaaagtctatccagtccggcccattaaaaatctcttctgtgagcgaagtgatgaaggagagcaagcagcctgcaagccagctgcaaaagcagaagggcgatacacctgcttccgcaacagcgctggctaagagtctcgaggatgccctgaggcagaccgcttcagtgacactgcaggccatcgcagcacagaacgctgcagtccaggccgtcaatgcccatagcaatattcttaaggctgctatggacaattccgaaatagccggcgaaaagaaaagtgcccaatggcggaccgtggagggagccctaaaggagagacggaaggctgtcgacgaagcagccgacgctttactgaaggctaaggaagagctggagaagatgaagtctgtgattgaaaacgcaaaaaaaaaggaagtggccggagccaagccacacatcactgcagccgaagggaagttgcataatatgattgtggatctggataacgtcgtgcaggctagggacgactttaagcgggaactcgattcaatcacccctgaggtgctacccgggtggaagggcatgtccgtaagcgatctggcagacaaactaagcaccgatgatttgaacagcctgatagcccacgcccacagacggatcgaccaactgaatagagaactggcagagcaaaaagccaccgagaaacagcatattacactcgctttggaaaagcaaaagctggaggagaagcgggctttcgatagcgctgtggctaaagctctcgagcatcatcgcagtgagatccaagcagagcaagatcgaaaaattgaagaggttcgggatgcaatggaaaatgaaatgcgtacacagttgcggaggcaggcagccgcccacacagaccacctgcgcgacgtcctgcgagtccaggagcaggaactgaagtctgaattcgagcagaacttaagtgaaaagcttagcgaacaggaactgcagttccggaggttgtcgcaagaacaggtcgacaacttcactctggatatcaacactgcctatgcccggttgcgaggcattgagcaggctgtgcagagccatgccgtggccgaagaggaagcccgtaaggcgcaccagttatggctctctgttgaggccctgaaatacagtatgaaaacctcgtctgcagagactccaaccatccccttaggatctgctgtggaagctatcaaggcaaactgttccgataatgagtttacacaggccctgacagctgccatccctcctgagagcttgacccggggggtttatagtgaagagacgctgcgcgcacgcttttatgccgtgcagaaactggcaagacgcgtggctatgattgacgagacccgcaattcgttgtatcaatacttcttgtcgtacctccaatctctgctcctgtttccacctcagcagttgaagcccccccctgaattgtgccctgaggacatcaataccttcaaactgctgtcctacgcctcctactgcattgagcacggggacctagaactggccgcaaaatttgtgaatcagctgaaaggagaatctagaagggtggcacaggattggctgaaggaggctaggatgaccctggagactaaacagatcgtggagattctgaccgcatatgctagcgccgtaggtattgggaccacgcaggtacagcctgagtag

SEQ ID NO: 120580 - DNA, 2277 bp, Artificial Sequence
  Description of Artificial Sequence: Synthetic coding sequence
atgctccgggcttgtcaactgtctggcgtgacggccgcggctcaaagctgtctctgtggcaagttcgtacttcgcccccttcggccttgccggcggtactccactagcgggagctccggactgacgacggggaaaatcgctggagcagggctcctgtttgtaggcgggggcatcggaggaactatactgtatgccaagtgggactcccacttccgagagtcagtagagaaaaccattccctacagcgataaactgttcgagatggtgcttggacctgctgcttacaacgtgcccctgcctaagaagagtatccagtccggccccttaaagatctcctctgtgagtgaggtcatgaaggaaagcaagcagcccgccagccagctccagaaacagaagggggatactccggcctctgctaccgctcccactgaggcagcccaaattatcagcgctgccggggacacactcagtgtccccgccccagccgttcagccagaagagtcactaaagactgaccatcctgaaattggggaggggaagcccacgcctgccctctccgaggaggcatcttccagcagcattagggagcgacctcctgaggaggtggctgcacggttggcacagcaagaaaaacaagagcaggtgaaaatcgaatctctagcaaaatctcttgaggacgcacttaggcagaccgcttccgtgaccctgcaggctatcgcagctcaaaacgctgccgtgcaggcggtgaacgcccatagcaatatcctgaaggcagcgatggacaattccgagattgccggcgagaagaaatccgcgcagtggcggacagtcgaaggcgcgctcaaggaacgtcgaaaggctgtggacgaggccgccgacgccctgttaaaagccaaggaagaattggaaaaaatgaagtccgtgatcgagaacgccaaaaaaaaggaagtcgcgggcgccaaacctcacataactgccgcggaaggcaaactccacaatatgatcgtggacttggacaacgtcgtgaaaaaagtgcaagcggcccaaagcgaagccaaagtggtgtcccaataccacgagctggtagtgcaggcgagagacgacttcaagcgagagcttgactcaataactcccgaggttctgccaggttggaaaggtatgagcgtctccgaccttgccgataagctctcaacagatgacctgaactcattgattgctcatgcccataggcgtattgaccagcttaacagagagttggccgagcagaaagcaacagaaaagcaacacataactttggccctggagaagcagaagctggaggagaagagagccttcgattctgccgtcgctaaagccttggagcaccacaggtcagagatccaagccgaacaggatcggaaaatcgaagaagtgagagatgccatggaaaacgaaatgaggacgcagctgcgacggcaagccgccgcacatactgatcatctacgggacgtattgcgggttcaagagcaagagttaaaaagcgagttcgagcagaatttaagcgagaaactgtcagagcaagagctgcagtttagacgacttagccaggaacaggtggacaactttacactcgacatcaacacggcatatgcccgactgagaggcatagaacaggcggttcagtctcatgcagtcgcagaggaggaggccaggaaggcccatcagttgtggctgtctgtggaggcgctaaaatacagtatgaagacctcctctgccgagaccccaacgatccccctgggttctgccgtagaggcaatcaaggccaattgctcggataatgagtttactcaggccctcactgccgccatccctccagagtcgttgacccggggagtctactcagaggaaacattgcgcgcacgcttttacgctgttcaaaagttggcaaggagagtagccatgattgatgaaactagaaactccctctatcagtacttcctgtcgtacttacagtctctattgttattcccgcctcaacagctgaaaccacccccagaattgtgccccgaggatatcaatactttcaaactgctgtcttacgcctcatattgtatagagcatggggatctagagttggcagccaaatttgtcaaccagctgaagggagaaagccggcgtgtggctcaagattggcttaaagaagctcgaatgacgctcgagaccaagcagatcgtggaaattctgaccgcttatgcaagtgccgttggcatcgggaccacacaggtgcagcccgaatag

SEQ ID NO: 120581 - DNA, 2274 bp, Artificial Sequence
  Description of Artificial Sequence: Synthetic coding sequence
atgttgcgcgcctgtcagttgtcaggggtgaccgcagcggcccagtcctgcctgtgcggtaaatttgtcttaaggccactgcgaccgtgtcggcggtattctacttccggctcctctggcctgaccacaggcaagattgcaggagccgggctcctctttgttggcggggggataggcgggaccattttatatgccaagtgggactcacacttccgggaatctgttgaaaaaacaatcccgtactctgataaactcttcgaaatggtattaggacctgccgcatataacgttcctctcccaaaaaaatccatccaaagtgggccgctaaaaattagttcagtgtccgaagtgatgaaagagagcaaacagcctgcatcacaattgcaaaagcaaaagggggacactccagccagcgccaccgcacccacggaggcagcccagatcatatccgcggccggcgatacgttatccgtccccgcccctgccgttcagccagaggagtcgcttaaaacggaccacccggagattggcgaggggaagcctacaccagctctcagcgaggccagtagttcctccatcagagagcggccacccgaagaggtggcagcccggctggcacagcaagaaaagcaagagcaagtgaaaatcgagtccctggcgaagagtctggaagacgcactcagacaaactgcttccgtgacactgcaggcgatcgctgcccagaatgctgctgttcaggccgttaacgcccactccaatatcctcaaggcagccatggacaatagcgagatcgccggcgagaagaaaagtgctcaatggcgcacagtcgagggggcactgaaagaacgtcggaaagccgttgacgaggctgccgacgcccttttgaaagctaaggaagaattagaaaaaatgaaatcagtcatcgagaatgccaagaagaaggaggtggctggagccaagcctcacatcaccgcagcagagggcaagttacacaacatgatcgtggatctggataacgttgtgaagaaggtgcaggccgcccaatctgaggcaaaggtcgtctcccagtatcacgagctggtggtgcaggccagagacgatttcaaacgcgaattagattccataacccctgaggttttgccaggctggaagggcatgtctgtttcagaccttgccgataagcttagtactgacgatctgaactcactcattgctcatgcccatcggaggattgaccagctgaatcgcgagctggctgagcagaaagccaccgaaaagcaacatatcactctggctctggaaaaacagaaactggaggaaaagagggcatttgactcagcagttgctaaggcactggagcatcacaggtcagagatacaagctgaacaagatagaaagatcgaggaagtccgggatgccatggagaacgaaatgaggacgcagctgaggcggcaggccgcagcccacaccgaccacctgcgggacgtgctgagagtccaggaacaggaacttaagtcagagttcgagcaaaacctaagtgaaaagctgagcgagcaagagctccaatttcgccggctctcgcaggaacaggtggacaacttcaccctggatattaacacggcctacgctaggctccgaggtatcgagcaggcagttcaaagccatgctgtcgctgaggaagaggctaggaaggcccaccagttgtggctttcggtggaagccttgaagtactccatgaaaacttcgtcagcggaaacgcctacaatcccgctaggaagcgccgtcgaggccatcaaggccaattgtagcgacaatgagttcactcaggcccttacagccgcaatcccccctgagtccctcacacgtggcgtgtattctgaagaaacgcttcgtgcaagattttatgccgttcagaaactggcacgaagagttgccatgatcgatgaaacccgtaattccctttaccagtatttcctttcttatctccaatcacttctgctgtttcccccccaacagctgaagccacctccagagctgtgtccggaggatattaacacgttcaagctgctttcctacgctagctactgcattgaacacggagatctggagttggccgccaaattcgttaaccagctcaagggagagagtagaagagttgcccaggattggctgaaggaggccaggatgacactggaaaccaagcagattgttgagatcctgacagcgtatgctagcgccgtgggtatcgggacgacacaggtgcaacctgagtag

SEQ ID NO: 120582 - DNA, 2244 bp, Artificial Sequence
  Description of Artificial Sequence: Synthetic coding sequence
atgctgagagcctgccagctgagcggggtcacagccgctgcgcaatcatgtttgtgtgggaaatttgtgctgagacctctgagaccctgtcgccgttactcaacaagtgggagcagcggtctgactacgggcaaaatcgccggcgctggcctcctttttgtgggtggaggcatcggaggcaccattttatacgcgaaatgggacagtcactttcgcgaatcagtggagaagacaattccatacagcgataaactgtttgagatggttctggggccggcggcttataatgtcccccttcctaagaagtcaatccagtcaggcccgctcaaaatttctagtgtctccgaggttatgaaagaatccaaacagccagcttcccagctgcagaagcagaaaggtgacactcctgctagtgcaactgctggcgatacacttagcgtgccagcgcccgccgtgcagcccgaggaatcattaaaaaccgatcatccagaaatcggagaagggaaacctacacctgccttatcagaggaggcttctagctcatctatcagggaacgccccccagaagaagtggctgctaggctggcacagcaagagaaacaggagcaggtcaaaattgaatccctggcaaagagtctggaagacgccctgaggcagacggcctcagtgaccctccaagccattgcagcccaaaacgccgccgttcaggctgtgaacgcacattctaacatcctgaaagcagcaatggataactcggaaatagcaggggaaaagaaaagcgcccagtggagaactgttgaaggcgcactcaaggagcggcggaaagcagtagacgaagcagccgacgctttgctcaaggctaaagaagaactggagaaaatgaagtctgtcattgagaacgcaaaaaaaaaagaagttgcaggcgccaagccccacataactgccgccgaggggaaactccacaacatgattgtcgacttggacaacgtggtgaagaaggtgcaggctgcacagtccgaagccaaagtagtgagtcagtaccacgaactggtagtgcaggcgcgcgatgactttaaacgagagcttgacagtattacacctgaagtgctccccggttggaagggtatgagtgtgtctgacttggcagataaactttccacagacgatcttaatagcctgattgctcacgcccataggagaatcgaccaactcaaccgggaactggccgagcaaaaggccacggagaaacagcatataaccttggcgctggaaaagcagaaactcgaggagaaaagagcatttgacagcgccgtggccaaagccttagagcatcaccgcagtgagatccaggccgagcaggaccgtaaaatagaggaggttcgagatgccatggagaacgagatgaggacacagctccgccggcaagctgccgcgcacactgatcacctgcgagacgtgttacgggttcaggaacaggagctgaagtcagaattcgagcaaaatctgagtgagaagctaagcgaacaggagctacagtttagaaggctgtctcaggaacaggtggataatttcactttagatataaacaccgcgtatgctcggctgcgaggcatcgagcaggccgtccagagtcacgcagttgcagaagaggaagcacgaaaggctcatcagttgtggctttctgtggaggccctaaagtattctatgaagacgagttcagccgagacgcccaccataccactgggcagcgccgttgaagccattaaggctaactgtagtgacaacgaattcacacaagccctcaccgcagcaatccccccagagtccttaacaaggggagtgtactccgaagagactcttcgcgcgaggttttatgccgtccagaaattagcaagacgcgtggcaatgatcgacgagacacggaattcgctgtatcaatactttcttagttaccttcaatctctgttactcttccccccccagcaactgaagccccctccggaactctgcccggaggacattaatacattcaagttgctttcgtatgcgtcctattgcatcgaacacggtgacctggagcttgccgccaagttcgtgaatcaattgaagggtgagtctcggcgggtggcccaggactggctgaaagaagctcgcatgacgcttgaaactaagcagattgtggaaatcttgaccgcttacgcctctgctgtgggcattggcacaacccaggtgcagccggagtag

SEQ ID NO: 120583 - DNA, 2244 bp, Artificial Sequence
  Description of Artificial Sequence: Synthetic coding sequence
atgctgagagcatgtcagttgtccggggtgacagcagccgctcagtcttgcctatgtggtaaattcgtacttcggccactgcggccttgtaggcgatattctacaagcggatctagtggactgacgaccggaaaaatagccggtgccgggctgctgtttgtcgggggaggtatcgggggaactattttgtatgcgaagtgggattcccacttcagggagtctgtggaaaaaacaatcccttattcagacaagctctttgagatggtattgggacctgccgcctacaatgtccctctcccaaagaaatcgattcagtcaggaccactgaaaatttcctctgtttcggaggtcatgaaagaatccaagcaaccggctagccagctgcaaaagcagaagggggacacaccggcgagtgccacagccggcgatacccttagcgtcccagcaccagccgtgcagcccgaggagagcctcaagaccgaccatccagaaatcggcgagggtaagcctacacctgctctgtccgaagaggcttctagcagttctattagagaacgccctcccgaggaagtcgcggctcgtctggctcagcaagagaagcaggagcaagtgaagattgagtctctcgcaaaaagtctagaggatgcactgcgccaaacagcatccgtcacactgcaagccattgcagcacagaatgccgccgtgcaggctgtaaacgcccattccaatattctcaaagctgctatggataactctgagatcgccggcgagaagaaatccgcccaatggaggactgtggagggcgccctgaaagaacgtaggaaggccgtcgacgaggctgccgacgcgctactcaaagcaaaagaagagctcgagaaaatgaagtctgtcatcgagaacgcaaagaagaaagaagtcgcgggagcaaaaccacatatcacagcagctgagggtaagcttcataacatgatagtcgatctggataatgtcgtgaagaaggtccaggccgcacaatccgaggccaaggtcgtgtcacagtatcacgagttagtggttcaagctagggatgactttaaacgcgaactggacagtataactcctgaggtgctccccggttggaagggaatgtccgaatacaatctcgccgacaagctctccactgacgacttaaactcactgatcgcgcatgcgcaccgccggattgatcagctgaatagagagctcgctgaacagaaagctaccgagaaacagcatatcaccctagctttggagaagcagaaactcgaggaaaagagagcgttcgactccgccgtggcaaaagcccttgagcaccatagaagtgagatccaagcagagcaggatcggaagatcgaagaggtgcgtgacgcaatggaaaacgagatgcgtacccaactgcgaaggcaggccgccgctcacacagaccacttacgggatgtcttgcgtgttcaggagcaagaattgaaatcagaatttgagcagaatctaagcgagaagctgtccgaacaggaattacagtttagaaggctgtcacaggaacaagtggataacttcacactcgacatcaatactgcctacgcaaggcttagaggcatcgagcaggccgtgcagtcccacgccgtagccgaagaggaagcaaggaaagcccaccaactttggcttagcgtcgaagcactgaagtacagcatgaagacctcatccgccgaaacgcccacaatacccctcggatctgcggtggaagccatcaaagccaattgctcggataatgagttcacccaggcactgaccgcagcgattccgccggagtccctgactcggggtgtgtacagcgaagagaccttacgcgcccgcttctacgccgtgcagaaactcgctcgaagagtagccatgattgatgagactcgcaattcattgtatcagtattttctgagctatttacagagcttactgctgttccctcctcagcaactcaagcctccaccggagttgtgtcccgaggatataaacacctttaagcttctgtcatacgcgtcctattgcatagagcacggcgacctggagctcgctgccaagttcgtaaaccagttgaagggagaatcaaggcgggtggcccaggactggctgaaagaggctcgcatgaccttggagacaaagcagatcgtggaaatactgactgcttatgccagtgcagtcgggatcgggaccacacaggtccagcccgaatag

SEQ ID NO: 120584 - DNA, 579 bp, Artificial Sequence
  Description of Artificial Sequence: Synthetic coding sequence
atggacagggcccaccgtttgggtcaaacgaagcaggtgaccgtttataggctgatctgcaagggcaccatcgaggagaggattctgcaacgagcaaaggaaaagtcagaaattcagcgcatggtcatctccggaggcaatttcaaacccgacactctcaagcctaaggaagtggtgtcccttctcttagacgacgaggagctcgagaagaaactgcgacttcgccaggaagaaaaaaggcagcaagaggaaacaaaccgggtgaaggagcggaaacggaagagagagaaatatgcagaaaagaagaaaaaggaagacgaactagacggtaagcggcgtaaagagggagtcaacctggtaattcccttcgtcccaagcgctgacaattcaaatttaagcgcagatggcgacgatagtttcatatcagtggattccgccatgcctagccctttttctgagatttctattagtagcgaacttcataccgggagcatacccctcgatgaaagctcaagcctagctccagattcactggtgcgcaaacagggcaaaggcactaacccctctgggggccgatag

SEQ ID NO: 120585 - DNA, 4671 bp, Artificial Sequence
  Description of Artificial Sequence: Synthetic coding sequence
atggcatccgagctcggagctagggatgatggtggttgtacagaacttgccaagcccctttacctgcagtacttggagagggccctgagactcgatcacttcctcaggcagacatctgctattttcaacaggaacatttcctctgatgacagcgaagacgggcttgacgattctaatcccctacttcctcagtctggtgaccctctaatccaggtcaaagaggaaccgccaaactccctcctgggcgagacatcaggtgccggatccagcgggatgctgaacacctattctctcaacggtgtgctgcagtctgagagcaaatgtgacaaaggtaacctttataacttctctaagttgaaaaaatcacgtaagtggctgaaatcaatcttgctgtctgacgaaagcagcgaagcggactctcagtctgaggacgacgatgaagaggaactcaacctgtctagggaagaacttcacaatatgctgcggttgcataaatacaaaaaattgcatcagaataagtacagcaaggacaaagaacttcaacagtaccagtactactccgctggactgctgtcaacctatgacccattctatgagcagcagaggcatctgttggggcccaaaaaaaagaagtttaaggaagagaagaagctgaaagcgaagctgaagaaagtgaagaagaagcgcagaagagacgaggaactgagttcggaagagagtcctcgcagacatcatcatcagactaaggtctttgcaaagttttctcacgatgccccacccccaggaactaaaaagaaacatctctctatagaacagctgaacgctcgtcgccgcaaggtctggctcagtatcgtgaaaaaagaactcccgaaagctaataagcaaaaggcctccgctcgaaatcttttcttgaccaacagtcgtaagctggctcatcagtgtatgaaagaggttagacgcgcggccttacaggcacagaagaattgtaaggaaaccctgccacgggcacgacgcctcacaaaagaaatgttgctgtactggaaaaagtacgagaaggttgagaaggaacatagaaaacgggccgaaaaggaggcactcgagcaacgaaaactcgacgaggagatgagagaggccaaaagacagcagaggaaactgaattttctgataacccagacagagctctacgcacactttatgtctcgtaagcgcgatatggggcacgacgggatccaagaagaaattctacggaaattagaggactctagcactcagcggcagattgacattggcggaggggttgttgtgaatattactcaggaggattacgactcaaatcactttaaagcacaagctctgaagaacgcagaaaatgcttaccacatccaccaggctcgtaccagatcttttgacgaagatgccaaggagtcacgggccgccgccctgagagctgccaacaaaagcggaaccggatttggggaatcatattcactagcaaaccccagcatccgcgcgggcgaggatattccccagcccactatcttcaacggcaagttaaaggggtaccaattaaaaggcatgaattggttggccaatttgtacgaacagggcattaatgggattttggcagacgagatggggcttggtaaaactgtacagtctattgctcttctggcccatttggccgaaagagagaatatctggggccccttcctgatcatatctccagcttccactcttaacaactggcaccaggaattcacaagattcgtccccaaatttaaggtgctgccctattggggaaatcctcatgatcggaaggtaattagacggttctggtcccagaagaccctatacacacaggacgctcccttccatgtggtcataacttcatatcagctcgttgtacaggatgttaagtatttccagcgggttaaatggcagtatatggtgttagatgaggctcaggctctgaagtcctcaagctccgtccggtggaaaatacttctacagttccaatgccgaaatcggctgctgcttactggtacacctatacagaatacaatggcagagctgtgggccctgcttcacttcattatgcctactttgtttgatagccacgaggagttcaacgaatggttttctaaggatatagagtcccatgcagagaataaatcagccatagacgaaaatcagctttcacgcttgcatatgatcctgaagcccttcatgctgcggaggatcaagaaagacgtcgaaaacgagctgtctgacaagattgagatcctgatgtactgccagctcacaagtcgacagaaattgctgtaccaagccctcaaaaataagatttccatcgaggacttattgcagagcagcatgggcagtactcaacaggcgcagaataccactagctccttgatgaatcttgtgatgcagtttcggaaggtgtgtaaccacccagaactctttgaacgacaggaaacttggtcccccttccatatcagcctcaagccttaccacatctcgaagtttatctataggcatggacagatcagggtttttaaccatagccgcgatagatggctccgggttttatctccttttgcccccgattatatccagcgatcacttttccatagaaaagggatcaatgaggaatcgtgtttctcattcctccgtttcatcgacataagccctgccgagatggctaacctaatgctgcagggattgctcgcaagatggttggcgctatttctctctttgaaggcatcttacagactccaccagctgcgaagctggggggcccctgaaggggaatcgcaccagagatatctgaggaataaagattttttactgggggtgaattttccgctaagctttccaaatctttgttcttgtcccctgctgaaatcgcttgtgtttagtagccactgtaaggctgtgtctggctacagcgaccaagtggtccatcagaggcggtctgcaacttcgagtttacgtcgatgtcttctgaccgaactgccctcattcctctgcgtggcatccccacgagtcacagccgtcccactcgactcttactgtaacgatcgctctgctgagtacgaacggagggtgctgaaagaggggggcagtctggccgcaaaacagtgcttgctgaatggcgctcccgagctagccgccgactggctgaatcgaagatcgcagttcttccctgagccggcaggcgggctctggtccataagaccccagaacggatggtcatttatccgaatccctgggaaggaaagtttaatcaccgactccggtaaactgtacgcattagatgtgctgctcactcgtttgaagtcacaaggccatcgggtgctgatctattctcaaatgaccaggatgattgacctgctggaggagtacatggtttaccgcaagcatacttatatgcgcttagatgggtctagcaagataagcgagaggagggacatggttgcggactttcagaatcggaacgacatctttgtgtttctactgtcgacacgtgcaggtgggctcggcatcaatctcaccgccgccgacaccgtcatcttctacgactcagactggaacccaactgttgatcaacaggcaatggaccgggctcatcggctggggcaaaccaagcaggtcacagtttatagattaatttgcaagggtacaatcgaggaaaggatcttgcagagggctaaagagaagtctgagatccagagaatggtgatctctggcggtaattttaaaccggataccttgaagccgaaagaggtggtgagcctactgctagacgacgaggaacttgaaaagaaactgcgcctgcgacaggaagagaagcgacagcaggaggagactaatagagttaaagagagaaaaaggaagagagagaagtacgcggagaaaaagaagaaggaggacgaactggatggcaagcggagaaaggaaggggtcaacctggtaatcccttttgtcccaagtgcagataacagtaatctgagtgccgacggcgatgattccttcatttccgtggacagcgccatgccatctcctttctctgaaatctccatttcatctgagctgcacaccggtagcatccccctcgatgagagttcttccgatatgctggtgatcgttgatgatccggcatcaagcgccccacagtcccgcgcgactaactccccggccagtattacgggctccgtaagcgacaccgttaatggaatctcgatacaggagatgccggctgccgggcgggggcactcagcgcgatcacgaggcaggccaaagggcagtgggtccacagctaagggcgccgggaagggaaggagtaggaagtctactgccggaagcgcagccgcaatggccggcgccaaggctggggcagcagctgcatctgccgcagcctatgccgcatatggatataacgtcagcaaagggattagcgctagtagtcctctgcagacatctctggtgcgccccgctggtttagccgacttcggacccagctccgctagctcccctctttcctcacccctctctaagggaaacaatgtgcccgggaacccaaagaacctccatatgactagcagccttgctcctgattccctggttcgtaagcagggcaaggggactaatcccagtggtgggcgctag

SEQ ID NO: 120586 - DNA, 4671 bp, Artificial Sequence
  Description of Artificial Sequence: Synthetic coding sequence
atggcatcagagctaggggccagggacgatgggggatgtacagaactggccaagccactgtacctccagtatctggaaagggctcttaggctggaccatttcctgcgacaaaccagcgccattttcaaccgaaatatctcaagtgatgacagcgaagacggcctggatgatagcaatccactcctgccgcaaagcggtgatccattgatccaggtaaaagaggagccacctaattccctgctgggcgaaacttctggagccgggtcatccggaatgctcaacacttacagcctgaacggtgtgttgcaaagcgagtcaaaatgcgataaggggaatctgtacaacttttcaaagctgaagaaatcccgcaaatggctgaaaagcattcttctgagtgacgaatcctccgaggccgacagccagtcagaggacgatgatgaagaggagctaaatctgtcaagggaagaacttcataatatgcttcggctacataagtacaaaaaacttcaccagaacaaatattcgaaagacaaagagcttcagcagtaccaatactatagtgccgggttgctgtctacctacgatcctttctatgaacagcagagacacttgcttggtcctaagaagaagaaatttaaagaagagaaaaagctgaaagctaagcttaaaaaggtaaagaaaaagcggcggcgcgacgaagagctcagctccgaagagtcccccagacgacatcaccaccaaacgaaggtttttgcaaaattttcacatgacgcccccccaccgggcacaaaaaagaaacatttgagtatagagcaactcaacgctcggagacgaaaggtgtggctttcaatcgtgaaaaaggagctgccgaaagctaataaacagaaagcttctgcacggaacctcttcctcacaaacagtaggaaactcgcccaccagtgcatgaaagaagtgcggcgcgccgcgttgcaagctcaaaagaattgtaaggaaactctccctcgagccaggcggctgacaaaggagatgctgttgtactggaagaagtacgagaaagttgagaaagaacaccggaagagagcggagaaagaagcactagaacaacggaagctggacgaggagatgcgggaggctaaacgacagcaaagaaagttgaattttctcattacccagacagaactgtacgcccacttcatgagtcgaaaacgcgatatgggacatgatggcatccaggaggagatccttcggaagttggaagactcttccactcagaggcagatagatatcggcggcggagtcgtggttaacattacgcaggaggactacgatagtaatcattttaaggcgcaggcccttaaaaacgccgagaatgcgtaccatatccaccaggcaaggaccagaagcttcgatgaagatgcaaaggagtcccgggccgctgctttgagagccgccaacaaaagtggaactggtttcggtgaatcttacagtctagcaaatccatccatccgagctggcgaggatatccctcaacccactatatttaacggaaagttgaaaggataccagttaaaaggcatgaactggctggccaacctctatgaacaaggcatcaacgggatccttgcagacgagatgggcctggggaagactgttcagagcattgcactgctggctcacctcgctgagcgggagaacatctggggcccgttccttattatctcacctgctagtaccttgaacaattggcatcaggagttcaccagattcgttcctaaatttaaggtactaccttattggggtaatcctcacgatcgcaaggtgattcgtcgtttttggagccagaaaactttgtatacacaggatgcaccgttccacgtggtcatcaccagctaccaattggttgtgcaggatgtcaaatattttcagcgtgtcaagtggcagtatatggtcctggatgaagcccaggcgctgaaaagcagttcctcggtgcggtggaaaatcctgttgcagtttcaatgtaggaatcgccttctcctgactggaactccgatccagaacacaatggccgagttgtgggctctcctgcacttcataatgccaactctgtttgactcccacgaagagttcaacgagtggttttccaaagatattgagtcccatgccgagaataaatctgctatagatgagaaccaactcagccgccttcacatgatcctgaagcctttcatgctgcgaaggattaagaaggacgtcgaaaatgagctgtcggacaaaattgagatcctgatgtactgccagttgacctcacggcagaagctgctgtatcaggccctcaagaataagattagtatcgaggatctcctacaaagcagcatgggatccacacagcaagctcagaacaccacctccagcctaatgaatttggtcatgcaatttcggaaggtttgtaaccacccagagttattcgaacgccaggagacctggtctccttttcatatatccttgaaaccctatcacattagcaagtttatttatcgccacgggcagatacgagtgttcaatcactcacgcgacagatggctccgggtcctatccccctttgctccagactatattcagcgttccctgttccatcgcaagggcattaacgaggaaagttgtttctcatttctgcgattcatcgacatttctcccgccgaaatggcgaacctgatgctgcaagggttactggcccgctggctggccctgttcctgagcctgaaggctagttatcggctgcatcagttaagatcttggggggctcctgagggcgaatcccaccagaggtacttacgcaacaaagactttctattaggagttaatttcccactgagcttccccaacctgtgctcttgtcccctgttgaaatcactagtgttttcttcccattgtaaggctgtcagcggttactctgatcaagttgtgcaccaaaggcgcagtgccacttcctccttgagaaggtgcctgctaactgagctgccctcgttcttatgcgttgccagccccagagtcacggcagtgcctctcgactcctactgtaacgaccgttctgcagagtatgagcggcgcgtgcttaaagagggagggagtctcgccgccaagcagtgcctgcttaatggcgcaccagagcttgctgcagactggctgaaccgccgtagtcagttttttcctgaacccgccggaggcttatggtccattaggccccagaatggatggtcgttcatccgtatccccggcaaagagagtcttattacggattcgggcaaactgtacgctctggacgtactgttgaccagacttaagagtcagggtcatagagtgctcatttactcccagatgacaagaatgattgacttacttgaagaatacatggtgtaccggaaacacacgtacatgcggcttgacggtagcagcaagatcagcgagagacgagacatggtggcggattttcaaaatcgcaatgacatttttgtcttcttgctgagtacccgggccggcggacttgggataaatctaacggcagccgacaccgttatattctacgattcggattggaaccccaccgtggaccagcaagccatggatcgagcgcaccgacttggacagactaaacaggtcaccgtctaccggctgatctgtaagggcacaatagaggagcgcatactccagagggctaaagaaaaaagcgaaattcagcggatggttatctcaggggggaactttaagccagatacgctcaagcccaaggaagtggtcagtctgcttctggatgatgaagaactggaaaagaaactcagactgcggcaggaggagaaacgccaacaggaagagaccaaccgcgtgaaggaacgtaaacgaaagagggaaaagtatgcggaaaagaagaagaaggaggatgagctcgacgggaagcgtcggaaggagggcgtcaacctggtgatcccattcgtgcctagtgctgataattccaacctcagtgcagatggagatgacagctttatatctgtggacagtgcgatgccaagtccgttcagcgagattagcatctctagcgagcttcacacaggttcgatccccctggacgaatccagctcggacatgttggtcattgtggacgatccagccagttctgcccctcagtcacgagcaacaaacagccctgcgtccatcaccggcagcgtgtccgacacagtgaatggtataagtattcaggagatgcccgctgctgggagaggccattctgcacggagtagaggcagacctaaaggctcgggatccacagcgaaaggagccgggaagggacgttctagaaaatccaccgctggcagcgcagctgcaatggccggcgctaaagccggggccgctgccgcttctgcagctgcatacgcagcctatggatataatgtgagcaaggggatcagcgcttcatcaccgctgcagacatcacttgtgcgccccgccggactggccgatttcggccccagctcagcgtcatctccgctgtcctccccgctcagtaagggcaacaatgtccccggaaaccctaagaacctgcatatgactagttcattggcccccgactccctagtgcggaagcagggtaaaggaaccaatcctagcggaggaaggtag

SEQ ID NO: 120587 - DNA, 585 bp, Artificial Sequence
  Description of Artificial Sequence: Synthetic coding sequence
atggccgcgtccctggtgggaaagaagatagtgttcgtgacgggaaatgctaaaaaattggaagaagttgtgcagattctgggcgacaagtttccttgcaccctcgtcgcacagaagatcgatctgccagagtaccagggggaaccagatgagatttcgattcagaaatgccaggaagccgtcaggcaagtgcagggaccagtgctggttgaagatacttgcctatgtttcaatgctttgggaggcctccctggaccttatattaagtggtttctcgaaaaactcaaacccgaaggcttgcaccagttgctagctgggtttgaggacaaaagtgcctacgcattatgcacctttgcgctgagtacaggggatcccagccagcctgtgcggcttttcagaggtaggaccagcgggaggattgtcgcaccgagagggtgccaggattttggctgggacccatgtttccagcccgacggctacgaacagacatacgctgagatgcctaaggccgaaaagaatgccgtgtcacatagattcagggccctgcttgagctccaggagtatttcgggtcactggctgcctag

SEQ ID NO: 120588 - DNA, 462 bp, Artificial Sequence
  Description of Artificial Sequence: Synthetic coding sequence
atggcggcttcactcgtgggaaagaagatagttttcgtgaccggtaacgccaagaagctggaggaagtgcaggggccagtcttggtcgaagacacgtgtctgtgcttcaatgcccttgggggcctccctgggccttatattaagtggttcctggaaaaactcaagccagaggggctccatcagctgctggccgggtttgaagacaaaagcgcctatgctttatgtacttttgctctcagcaccggagatccgtctcaaccagtaagactgtttagaggtcggacctcaggccggatagtggctccacgcggttgtcaggacttcgggtgggacccttgcttccagccggatgggtatgagcagacctatgcagaaatgcctaaagcagagaagaacgccgtgagtcaccggtttagagcactgctcgaattacaggagtatttcggctctctcgcggcatag

SEQ ID NO: 120589 - DNA, 534 bp, Artificial Sequence
  Description of Artificial Sequence: Synthetic coding sequence
atggctgcttccctggttgtgcagatactgggagataagttcccctgtaccctggtggcccagaagatcgacctacccgaataccagggtgagcctgacgaaattagcatccagaagtgtcaagaagctgtcagacaggttcaagggccggtgctagttgaggacacctgcctgtgctttaatgctcttggagggctacccgggccatatatcaagtggttcctggagaagcttaaacccgagggtttgcaccagcttctggcgggattcgaagataagagcgcatatgctctttgcactttcgccctatccactggcgacccctcgcagccagtcagactgtttcgcggccggacaagtgggaggatcgtagctccgagggggtgtcaggacttcggctgggacccttgttttcagcctgacgggtatgagcagacctatgccgagatgcctaaagcagagaagaacgccgtttcgcaccgcttcagagcactgctcgagctccaagagtacttcgggtcactcgctgcatag

SEQ ID NO: 120590 - DNA, 8232 bp, Artificial Sequence
  Description of Artificial Sequence: Synthetic coding sequence
atgtctgacaaaatgagctctttcctacacatcggggatatctgttctctctacgcggagggatccactaacggcttcatctcaacgctcgggctggtggatgacagatgcgtcgtccaaccagagacaggggatctaaacaaccctccaaagaaattccgggactgcctcttcaagctgtgccccatgaaccgatatagcgcccagaaacaattttggaaagcagccaagcccggcgctaactcgactacagacgcggtcctcttaaataagctccatcatgctgccgaccttgagaagaagcaaaatgagactgagaataggaagctcctgggtaccgtgattcagtacggcaatgtgattcagttgttgcatctcaaatcaaacaagtatctgacagttaataagagactgccagcattgctggagaagaatgccatgagagtgactctcgatgaggccgggaatgagggaagttggttttacattcagccattctacaaactgcggagtattggagactcagtagtgatcggggataaagtggtcctcaatcccgtaaatgccggccagccgctgcacgcgtcaagtcaccagcttgtagacaatccaggatgtaatgaagtgaatagcgttaactgcaacacctcatggaagattgtgctatttatgaagtggagcgacaacaaggacgatattcttaagggaggcgacgtcgttcgtctgttccacgccgagcaggagaagtttctgacctgtgacgagcatcgcaaaaagcagcacgtgttcctgagaacaacggggagacagtcagccactagcgcgacctcaagtaaggctctgtgggaggtcgaggtggtccagcacgacccctgcagagggggcgccggctactggaacagtctgtttcgcttcaaacacctggcaaccggtcactacttggcagccgaagtggaccctgatcaggatgcttcaaggtcacgattacggaacgctcaggagaaaatggtctactcccttgtgtctgtccccgaaggtaacgatatttccagtatcttcgaattggaccccacgacccttaggggaggtgattccctcgtgccccggaacagttatgtgaggctgaggcatctgtgcaccaatacatgggttcactccacaaacatcccgatcgataaagaagaggagaagccagtcatgctgaagatcggcacctcaccagtcaaagaggataaggaagccttcgccattgtgccagtgtctcctgctgaggtgagagacctggatttcgccaatgatgcctcaaaggttctcggatccatcgccggaaagttagagaagggtacgataacccagaatgagaggcgcagtgtgactaagctgttggaggatctggtctatttcgtcacagggggaactaactccggccaggacgtccttgaggtggtgttcagcaagccaaaccgcgaaagacaaaagcttatgagagaacagaacatccttaaacagatcttcaagctgcttcaggcacccttcacagattgcggcgacggtcccatgctgagacttgaagaacttggcgaccaaagacacgcccctttccgacatatctgtcgtctgtgctacagggtgctgaggcactcacaacaggactaccgtaagaatcaagaatacatcgccaaacagttcgggttcatgcagaagcagattggatacgacgttttggcagaggacaccatcacagccttacttcacaacaaccgtaagctcttggaaaagcatattaccgcggccgagatcgacacatttgtatcactggttcggaagaatagggagcccaggtttttggactatttaagcgatctgtgcgtgagcatgaacaaatccatccccgtcacccaggagttgatatgcaaagcagtgcttaatccaaccaacgccgacatccttattgaaaccaaactggtgctgagcagatttgagtttgaaggggtcagctctactggagaaaacgcccttgaggcaggcgaggacgaggaggaggtttggttgttttggcgagactctaataaggaaataagatctaaaagcgtccgcgagctggctcaagatgccaaagagggacagaaggaggatcgcgacgtgttgagttattaccggtaccaactgaacttgttcgctcggatgtgcctggacaggcaatatttagcaataaacgagatctccgggcagctggacgtcgaccttatcctccgctgtatgtccgatgagaatctcccatacgatctgcgcgccagcttttgcagacttatgctgcacatgcatgttgacagggacccccaggaacaggtgactcccgtcaagtatgctagattgtggtcggagatcccaagcgaaattgctatagatgactacgactcttccggcgcttctaaggacgagatcaaagagaggttcgcccagacaatggagttcgttgaagagtacttgagggatgttgtatgtcagcggttcccattttctgacaaagaaaaaaataagcttactttcgaggttgtgaacctggcgaggaacttgatctactttggcttttacaatttctccgatcttctgcgcctcaccaaaattttgctggccatcctggactgtgtgcacgtcacaaccatattcccaatcagcaagatggccaaaggagaggagaataaagggaataacgatgtcgaaaaactgaaaagcagtaacgtgatgcgctcaattcatggtgtgggcgaactcatgacccaggtcgtccttcgcggtggaggcttcctccctatgactcctatggctgctgcaccagaaggcaacgtcaagcaagcagaaccagagaaggaggatattatggtgatggatactaagcttaagattattgagatcctgcagtttattctgaacgtaaggctggattataggatttcttgtctcttgtgtattttcaagagggagttcgacgagtcaaattcacaaacctccgagacgagctctggcaattcatcccaggagggtccgagcaacgtgcccggtgcattggatttcgaacatatcgaggaacaggcggaggggatttttggagggagcgaagagaatacccccctggacctggatgaccacggtggccgtacattcctacgtgtcttactgcacttgactatgcatgactatccaccactggtcagcggagccctgcaattattattcaggcatttctcacagagacaagaggttttacaggccttcaaacaagtacagctgctggtgacgtctcaggacgtagacaactacaaacagataaagcaggaccttgaccagctccgaagcattgtggaaaagtcagagctttgggtgtataaggggcagggacccgatgaaacaatggacggcgcaagcggtgagaatgagcacaaaaagacggaggaaggcaacaacaagcctcagaaacatgagagcacaagttcctataactatcgcgtagtgaaagagatcctgatccgtctgtctaaactgtgcgtgcaagagtcagcttctgtgagaaaatcaaggaagcagcagcagcggctgcttcgaaacatgggcgcgcatgccgtcgtgttagagctactgcaaattccttacgagaaggcagaagacaccaaaatgcaagagattatgcgattggcgcacgagtttctgcagaatttctgcgccgggaaccagcagaatcaggctttgctgcacaaacacatcaacctattcttaaacccaggcattttggaggcggtgacaatgcagcacatattcatgaacaattttcagctctgctcggaaatcaacgagcgtgtcgtgcaacactttgtgcactgtatcgagacacacggacgtaatgtgcagtacatcaagttcctccagactattgtgaaggcagagggtaagtttattaagaaatgtcaggacatggtgatggctgaacttgttaactccggggaagacgtgttagtgttctataatgatagagcttcttttcagacacttatacagatgatgcggagtgagcgcgatcgtatggacgaaaacagccctctcatgtatcatatccaccttgtagagctgctcgccgtgtgcactgaaggtaaaaatgtttacacagagatcaagtgtaactctctcctcccactggacgatatagttagggtggtgacgcatgaggattgcatccctgaggtgaaaatcgcctacatcaactttctcaatcactgctacgtggacactgaggttgaaatgaaggagatctacacttccaatcacatgtggaagctttttgagaatttcttagttgatatttgccgcgcttgtaataatacatctgacagaaagcatgctgattcaatcttagagaagtatgttactgaaatcgtgatgagcattgtgactacgttcttctcctctccattcagcgatcagtcgacaaccctgcagactcgtcaacctgtcttcgttcagcttctgcagggcgttttcagggtgtaccattgcaactggctgatgccgagtcagaaagcgtctgtggagtcatgcatacgggtgctcagcgatgtcgcaaagagccgagcaatcgccatacctgttgatttggattcacaggttaacaacctctttctcaaaagtcatagtattgtgcaaaaaaccgctatgaactggcgattatccgctaggaacgctgctaggagggactcagtgcttgcagccagccgtgactataggaacatcatcgagcgcttacaggatatcgtgagcgccctggaggatagattacgaccactggtgcaagcagaattgtctgttttggtcgacgtgcttcacagacccgagctgctattccccgagaacaccgacgcccggagaaaatgtgaatctgggggttttatatgtaaattgatcaagcacacaaagcagctgttggaagaaaatgaggaaaaattatgcatcaaggtcctacaaaccctccgggagatgatgaccaaagaccggggatacggagagaagttaatttctatcgacgagctcgataatgccgaactgcctcctgcacctgacagtgagaacgccacagaggaactggaaccttcacctcccctgaggcagcttgaagatcataaacggggcgaggcactgcggcaggtcttggtcaacagatattacggaaacgtacgaccatcaggtcgtagggagtcactgaccagcttcgggaacggccccctctccgcaggcggaccgggaaaaccgggaggcggaggcggcggcagcggatcttctagcatgtcgaggggcgaaatgtctctcgccgaagtgcagtgccacctcgacaaggaaggcgcaagcaatctggttattgacctgataatgaacgcgagttcggaccgagtgtttcacgaatccatcctgcttgcgatcgcattgctggagggcggaaacacgacaatccagcacagtttcttttgtaggctgaccgaggataagaagtctgagaagttttttaaggtgttttatgatcgaatgaaagttgcgcagcaggagattaaggccacggtgaccgtcaacaccagcgacctgggaaataagaagaaagacgacgaagtggatagggacgccccctcacgcaagaaggcaaaggagcctactacgcagataaccgaggaagtccgggaccagcttctggaagcatcggcagccactaggaaagccttcacgacattccgacgtgaggcagaccctgacgaccactaccagccaggcgaaggcacccaggcaacggcagataaggccaaagatgacctcgaaatgtccgctgtcattaccattatgcagcccatcctgcgttttttacagttactttgcgagaaccacaacagagatttgcagaattttctcagatgccagaataacaagactaactacaatctggtgtgtgaaaccctgcagtttctggactgcatctgcggatcaactacagggggactgggacttctgggcctttacattaatgaaaagaacgtcgcccttattaatcagactctcgagagtctgacggagtattgccaggggccatgtcacgagaatcaaaattgtatagcaacccacgagtctaatggaattgacatcataacagccctgatacttaacgatattaatcccttgggtaaaaagagaatggatcttgtgctcgaactgaaaaacaacgcgagcaaactgctgttggccattatggagagcaggcatgattccgagaatgcggagaggatcttgtataatatgcgccctaaagagctggtggaagtgatcaagaaagcttatatgcagggcgaagttgaatttgaggacggtgaaaatggggaggacggtgcagcgagcccacgtaacgttggacacaatatctatattctcgctcaccagctggctcgccataacaaagagctgcagtccatgttaaagcctggtggtcaggtcgatggggatgaggccctggagttttacgccaagcacacagctcaaattgagatcgtaagactagatcgaacaatggagcagattgtgtttccggtgccctccatctgcgaatttttgacaaaagaatctaaactgaggatctattatacaacggaaagggacgagcagggatccaagattaacgacttttttctgaggtctgaagatctgttcaacgagatgaattggcagaagaagttgagagctcagccggtcctgtactggtgtgcacgcaacatgtccttttggtcttcaatatctttcaacctggccgtcttgatgaatcttctagtggcattcttctacccctttaaaggtgtgcgcggtggaaccctcgagcctcactggagtggactgttgtggacagctatgttgatctcccttgccattgtcattgcgctgccgaaaccacacgggatccgggcactgattgcgtctaccatacttcgcttgatatttagcgtgggccttcaaccaaccctatttctacttggagccttcaatgtgtgcaataaaataatctttctaatgtcttttgtcggcaactgcggcacatttacgcgaggatatcgggctatggtgcttgacgtggagtttctttatcacctgctgtatcttgtcatctgcgcgatgggcctctttgtgcatgaattcttttacagtctcctgctcttcgatttggtctacagagaggagaccctcttaaacgtgatcaagtctgtcaccaggaatggccgttctataatactcacagcagtgctcgcactcatactggtatacctgtttagtatcgtggggtacctattcttcaaagatgactttattttagaagtcgatagactgcctaacgagaccgctgtgcccgaaaccggggagtcactggctagcgagttcctgttctctgatgtctgcagggtcgaatcaggtgagaattgcagctcccccgcccctagggaagagctagtgcctgccgaggaaacggagcaggacaaggaacacacttgcgaaaccttattgatgtgtattgtaacagtactgagtcacggactgagatccggaggcggtgtgggggacgtgcttaggaaaccatcaaaggaggagccgctgttcgctgccagagtaatatacgacttgctttttttctttatggtgatcatcattgtcttaaacttaatcttcggcgtaatcatcgatacatttgcggatctccgatcggaaaagcaaaaaaaagaggagatccttaagacgacttgctttatctgcggcttggagagagataaattcgataacaagaccgtcacattcgaggagcacatcaaagaggagcacaacatgtggcactacctttgcttcatcgtcctcgtcaaggtgaaggactccacagaatataccggtcccgagtcctacgtggccgagatgataaaggagcgcaatctggactggttcccaaggatgcgcgccatgtctctcgtgtcctccgatagcgagggcgagcagaacgaactgcggaatttgcaagaaaagctcgagtccaccatgaagctcgtgacaaacctgtctggccagcttagcgagctcaaggaccagatgaccgagcagcggaaacagaagcaaagaattggactcctgggtcaccccccacatatgaacgtgaatccccagcaacctgcatag

SEQ ID NO: 120591 - DNA, 8232 bp, Artificial Sequence
  Description of Artificial Sequence: Synthetic coding sequence
atgtccgacaagatgtcttcctttcttcacatcggcgatatctgttcactatacgccgaagggagcacgaacggttttataagcacacttggacttgttgacgatcgctgcgtggtgcagcccgaaaccggggaccttaataatcccccgaagaagttccgtgactgcctgttcaagctgtgtcctatgaaccggtatagtgcccaaaaacaattttggaaggccgcaaaacctggagctaacagcaccaccgacgccgtgctcctgaataagctacaccatgctgccgacttagaaaagaaacagaacgagaccgagaatcgtaaactactagggaccgtgatacagtatggcaatgtgattcaattgcttcacttgaaatccaacaagtacttgacagtgaacaaaagactcccagcccttctggagaagaatgccatgcgggtgacactggacgaggcagggaacgagggaagttggttctacatccagcctttctacaaattgcggtccataggcgacagtgtcgttatcggcgataaagtggtgctcaacccagtcaacgctggccagcctctgcatgctagtagccaccagctggtcgataatcctggttgcaacgaagtgaatagcgtgaattgcaacacgtcttggaaaatcgtattgttcatgaagtggtcagataataaagacgacattcttaaaggaggagatgtcgtccgcctattccacgccgagcaggagaagttcctgacctgcgacgaacatcgaaagaagcagcatgtcttcttacgtaccaccggcaggcagagtgctactagtgccaccagcagcaaggcactgtgggaagtcgaagtggtgcagcatgacccatgccggggaggagccggttactggaattcactctttcgcttcaaacatctggcaacaggccactacctggccgctgaggtagatcctgacttcgaggaggagtgcctggaattccagccgtcagtggatcccgaccaagatgcttcccgttcgaggctgcgcaacgcgcaggagaaaatggtttactcattggtttccgtccctgagggcaatgatatctccagcatctttgaattggaccccacaaccctccgcggaggggattcgctggtgccgcgaaatagttacgtcagactgcgtcatctctgtaccaacacatgggtgcacagcacaaacattcccatcgataaagaggaagaaaagcccgtaatgctcaagataggaacttcaccagtgaaggaggacaaagaggcttttgccatcgtccctgtgtcaccagcggaagttagggatcttgatttcgccaatgatgcctccaaagtcctgggctctatcgccgggaaactggagaaaggcactattacccagaacgaaaggaggagcgtcaccaaattgctggaagacttggtctacttcgtcacgggaggcaccaatagtggccaggatgtgctggaagttgtcttttcaaaacccaatagagagcggcagaagcttatgcgcgagcagaatattctaaagcagatcttcaaattgctgcaggcaccattcaccgattgtggcgacggcccaatgttaaggctggaggagctaggggaccagagacacgctcccttccgacatatctgtcgtctatgttatagagtcttgcggcatagccagcaggattatcgaaaaaaccaagagtatatcgctaagcagtttggctttatgcaaaaacagatcggttatgatgtgttagcagaggacaccatcacagccttgctgcacaacaaccgcaaactgctcgaaaagcacataacagcggccgaaattgataccttcgtatccctagtgcgaaaaaaccgggagcctagatttttggattatctgtccgatctttgcgtgagcatgaataagtcgatccccgtcacacaggagttgatctgtaaagccgtgttgaaccctacaaacgctgatatcctaattgaaaccaaactggtcctctcgcgattcgagtttgagggtgttagctcgacaggcgagaacgcactcgaagccggtgaggacgaggaggaggtctggctgttctggcgggatagtaataaagaaatccggagcaagtctgttcgcgaacttgctcaggacgcaaaggagggccaaaaggaagacagagatgtcctctcctactatagatatcagctgaatctctttgcccggatgtgcctcgaccgccagtatctggctatcaacgaaatcagtggtcaactggacgtggacctgatacttaggtgcatgtctgacgaaaacttgccatatgacttaagagcgagtttttgcaggctcatgctgcatatgcacgtggatcgcgatcctcaagaacaggtgaccccggtgaagtacgcccgcttatggtctgagattccctctgagatcgccatcgatgattatgatagttccggcgcatcaaaagatgagatcaaggagagatttgcccagaccatggagtttgttgaagagtatttacgtgacgtagtctgtcaaagattcccatttagtgataaagaaaaaaacaagctcacattcgaggtggtgaacctcgcaaggaacctcatttatttcggattttacaacttctcagacctcctgaggctgaccaagattctgctcgccatcctcgactgtgtacatgtgaccactatctttccaatatccaaaatggcaaaaggagaggagaataagggaaataatgacgtggaaaagctgaagagctccaatgtaatgaggagcatccacggggtgggtgaactcatgacgcaagtagtgttgcgtggtggcggattcctcccaatgactccaatggcagccgcacccgagggaaatgtcaaacaggctgagccagagaaggaagatatcatggtcatggatacaaagttgaagattatcgaaatcctgcagtttatcctgaatgtcagactggactaccgaatcagttgtcttctgtgtatttttaagcgagagtttgatgaaagtaatagtcagacatctgagacctcttcagggaattctagtcaagagggtccatccaacgtacctggcgccttagattttgaacacatcgaggagcaggcggagggaattttcggcggcagtgaagagaatactccattagatcttgacgaccacggcggtcgaacctttctgcgggtattgctgcacttaacaatgcatgattacccccctctcgtcagcggagccctgcagctcctattccggcactttagccagcgccaggaagtgctccaggcattcaagcaggtgcagcttctcgttaccagccaggatgtggacaattacaagcagatcaaacaagacctcgatcaattgcgctcgatcgtcgagaagagtgagttatgggtgtataagggacagggccccgacgaaaccatggacggcgctagcggggagaacgagcataagaagactgaagaagggaataataaaccacagaagcatgaatccacgtcttcatacaattacagagtggttaaagagatcttgattcgcctctccaaattatgcgtacaagaatctgctagcgtgagaaagagcagaaagcaacagcagcggttgctgaggaacatgggggcacatgcggtggtgctggagttgctacagatcccatatgagaaggctgaagatactaagatgcaggagattatgcggctcgctcacgagtttcttcagaacttctgtgcaggtaaccagcagaatcaggcactccttcacaaacatattaatctgttccttaacccaggaatactggaagcagtgaccatgcagcacatctttatgaataactttcagctgtgctccgagatcaacgaaagggtagtccagcattttgtacactgtatagaaacacacggtcgcaacgtacagtacatcaagttccttcaaacaatagtcaaagccgagggcaaattcattaaaaagtgtcaggacatggtaatggcggagcttgttaactctggcgaagacgttctggtgttttataacgatcgggctagctttcagacattaattcagatgatgcggagtgaacgcgaccgcatggacgaaaacagcccactgatgtatcacatccatctggttgagcttttggctgtttgtacagaagggaagaacgtctatactgagatcaaatgtaattcactcttacccttagacgatattgttcgggtggttacacatgaggactgcattcccgaagtgaagatcgcttacataaacttcttgaatcactgctacgtggataccgaggtagagatgaaagaaatctatacttcaaaccacatgtggaagctatttgagaacttcctggtggatatctgtcgcgcgtgcaacaacacatcagacaggaagcatgccgacagcatcctggaaaaatacgtgaccgagatagtcatgtctattgtgactacctttttcagctccccatttagcgaccaatcaactaccttgcagaccaggcagcctgtgttcgtgcagctccttcagggcgtctttcgagtgtaccattgtaactggttgatgccctctcagaaggcctccgtggaaagttgcatcagggtcctctccgatgtggcaaagagtagggccatagctattccagtcgatctggacagtcaggtgaacaaccttttcctgaagtcccactcaattgtgcagaagaccgcaatgaattggagactgtctgctcgcaatgcagcgaggcgggactctgtgctagcagccagccgcgactataggaatatcatcgagcgcctgcaagatatcgtgtccgccctggaggatcgactgcgcccgctcgtgcaggccgaacttagcgtcctcgtggacgtcttacacaggcccgagctgttgtttccagaaaataccgacgccaggcgcaaatgcgagtccggggggtttatatgcaaacttataaagcacaccaagcagctattggaggagaatgaggaaaagttgtgtatcaaagtgctccaaaccctgcgcgaaatgatgacaaaggaccggggttatggcgaaaaactcatatccatcgacgagctggataacgctgagctgccccctgccccagacagcgaaaacgccaccgagaagggagaggcactgaggcaagttctggtgaatagatattatggaaacgtgcggccttctgggaggcgggagtcacttactagcttcggaaatgggcccttgtcagccgggggacctggaaagccagggggaggcggcgggggcagcgggtcctcatcaatgagtcgcggcgagatgagtttggcagaggtccaatgccacctggacaaagaaggagcgtcaaatctcgtcattgatttaattatgaatgcctcctctgatagggtgttccatgaatcgattctgttggcaatcgcgctgcttgagggcggtaatacgactatccaacactctttcttttgccgcctcaccgaggataaaaagtccgagaaattcttcaaagtgttttatgaccggatgaaggttgcccagcaggagatcaaagcaaccgtgaccgtgaatacaagcgacctcggcaataaaaagaaggacgatgaggttgaccgtgacgctccgagtagaaagaaagcaaaagagcctactacccagatcacagaggaggtaagggatcagttacttgaggcgagcgctgcaacaaggaaggctttcacaacctttaggagggaagctgatcccgatgaccactatcagcccggcgaaggaacccaggctaccgctgacaaagcaaaagatgacttggagatgagcgcagtgattactattatgcagcctatcctgcggtttctgcaacttctgtgcgagaatcacaatcgcgatctgcagaatttccttcggtgtcaaaataacaagaccaattacaatctggtgtgcgaaaccctccagtttctggattgcatctgtgggtcaaccacaggtggactcggcctgctgggattatacattaatgagaagaatgtcgctttgataaatcagaccctggaatctctcaccgagtattgtcagggaccttgccacgaaaatcagaactgcatcgccactcacgagtccaacggcattgacatcatcactgctctgatactaaatgacatcaatccactggggaaaaagcggatggacctggtcttagagcttaaaaataacgctagcaaattactgctggctataatggaatctcgacacgattcggaaaacgcagaacgcatactgtacaatatgcggccaaaggaactcgtagaagtgattaaaaaggcatatatgcagggcgaggtggagttcgaggacggagagaatggggaggacggcgcggctagtccgcggaatgttggtcacaatatatatatcctcgctcaccagctggcccggcacaacaaggagctgcagagtatgcttaagccaggcggccaggtggacggagatgaggctctggaattctacgcgaagcatacggcccagattgagatcgtgcggttagatcggacaatggaacagattgtgtttccggtcccttctatatgcgagtttctgacgaaggagagtaaattgcggatctactatacaaccgagcgcgacgagcagggttccaaaataaacgatttcttcctccgaagtgaggacttgttcaacgagatgaactggcagaagaagctaagggcacagcctgttctctattggtgtgctcgtaacatgagtttctggtcctccatttcttttaatcttgcagtgctgatgaacctgctcgtggcctttttttatcctttcaagggagtcaggggtggaacactggaaccccactggtccgggcttctgtggacagcgatgctcataagcctggccatcgtgatcgcattaccgaaaccgcacgggatacgcgccttgatagccagtactatactcaggttgatcttttccgttgggctccagccaaccctcttcctgctcggggccttcaatgtctgtaataagatcatttttttaatgtcctttgtcggtaattgcgggacttttactcgggggtacagggcgatggtcttagatgtcgagttcctgtaccatctcctgtatttagtcatatgcgccatgggcctgtttgtgcatgaattcttctacagcctactactcttcgaccttgtgtaccgcgaagaaaccctgctgaacgtgataaaatctgtgactcgcaacgggcggagtataattctcactgcagtcctcgcgctgattcttgtgtaccttttcagtatagtgggttatttgttttttaaagacgactttattctggaagtggatcgactcccgaacgagaccgcagttcccgaaacgggcgagagccttgcaagtgaattcttgttctccgatgtttgtagagtagaatcaggggagaactgttcttcccccgcccccagagaggagctggtccctgctgaagagactgagcaggacaaagaacatacgtgtgagacattgctgatgtgcattgtgacagttctcagtcacggtctgcgttccggcggaggggtcggcgatgtgctgcggaaaccatccaaagaagaacctctgttcgcagcccgtgtgatttacgaccttctattcttcttcatggtgattataattgtcttgaacctcatcttcggggttataattgacacatttgccgatctgcggtcagagaaacagaagaaggaggagattttgaagacaacatgtttcatctgcggactggagagagataaattcgacaataaaactgtgacctttgaggaacatattaaagaggagcacaacatgtggcattatttatgtttcatagttctggtaaaggtcaaggattcaaccgagtacacaggtccggaatcatacgtggcggaaatgatcaaggagaggaacctggactggtttcctcgcatgcgtgcaatgtctttggtgagcagtgattcggagggggaacagaacgaattaaggaatcttcaggaaaaattagagagcactatgaagctggtgacaaatctctccggccagctctctgagcttaaagaccagatgacggagcagagaaagcaaaaacagcgtattggcttactgggacaccctccccatatgaacgtgaatcctcagcaacccgcatag

SEQ ID NO: 120592 - DNA, 8277 bp, Artificial Sequence
  Description of Artificial Sequence: Synthetic coding sequence
atgtcagacaagatgagctcctttctccatattggcgatatctgctccctttatgcggaaggctcaaccaacggcttcatttctacactgggtctcgtcgatgataggtgtgtcgtacaacctgaaacaggcgatctcaacaatcctccaaagaaatttagggactgcctgttcaaactgtgccccatgaacaggtatagcgcgcagaagcagttctggaaggcagccaagccaggagccaatagtaccactgacgctgttcttctcaacaagctacaccacgccgcagacctggagaagaagcagaacgagaccgaaaatcggaaacttttggggactgtaattcagtatgggaacgtcattcagctcctgcatctgaagagcaacaaatatcttacagtgaacaaaagactgcccgcgctcctggagaagaatgccatgcgcgtgacgctggatgaagctggcaatgagggaagttggttctatatccagcctttctataaactgaggagcattggagattctgttgtcatcggagataaggtggtgctgaaccctgtaaacgccggccagccgctgcatgcatctagccatcagctggtggataacccggggtgtaacgaggtgaattctgtgaactgtaatactagctggaagattgttctgttcatgaagtggtctgacaacaaggacgacatcctcaaagggggggatgttgtgcgactgttccatgccgaacaggaaaagttcctgacctgcgatgagcatagaaagaagcagcatgtcttcctcaggaccacgggtagacagtccgcgacatcggccacttctagcaaagccctttgggaggtcgaggtggttcagcatgacccctgcagggggggggctggttactggaactcactgtttcggttcaagcacttagctactgggcactacctagccgctgaagtggatcccgattttgaggaagagtgcctagagtttcaaccaagcgtggacccagaccaggacgcaagtagaagccgattgaggaatgcacaggagaagatggtctattcactcgtcagtgtgcccgagggcaacgacatctcaagtatcttcgaactagaccctaccactctgaggggcggtgacagcctggtcccccgaaattcctacgtgaggctgcgacatctgtgtacaaatacctgggtacatagtacaaacattccgatagacaaggaggaagaaaaacctgtaatgctcaagatcggtacatcacctgtcaaagaggacaaggaggctttcgcaatagtgccagtgtctcccgcagaggtgcgggacctcgatttcgccaacgatgcatccaaggtgctggggagtatcgccgggaagctggagaagggcacaattactcagaatgagcgccgctcagttacgaaactactggaggatctggtgtatttcgtgaccggtgggacaaatagcggacaagatgtacttgaagtggtttttagtaagcccaaccgcgagcgtcaaaaactcatgcgcgaacagaatatcctgaagcagattttcaagctcttacaggctccattcaccgattgcggtgatggccctatgttgcgtcttgaggagcttggggaccagaggcatgcccccttcaggcatatctgtcgcctttgctatcgagtcttgcgccactcccagcaggattaccgtaaaaatcaggagtatatagcaaaacagtttggatttatgcagaagcagattgggtacgatgtgttggccgaggacacaatcacagctctgttacacaataaccgcaagctgctggaaaaacacattacggccgctgaaatcgacactttcgtcagtcttgtgagaaaaaaccgcgaacctcgcttcctcgactacctcagcgacctatgtgtgtcaatgaataaaagtatccctgtgacccaggaactaatctgtaaggccgtgttgaatcctactaacgctgacattctcattgagaccaagctggttctctcccggtttgaatttgagggagtgtctagtactggcgagaacgcattagaggcaggtgaagacgaggaagaagtgtggcttttttggagggactctaataaggagatccgttcaaagtccgtccgcgaactggctcaggacgcaaaggaaggccaaaaggaggaccgggatgtactgtcctattacagataccagctcaatctctttgctcgcatgtgtttggacagacagtaccttgctattaatgaaatctcggggcagctggacgtagatctgattttgagatgcatgtctgacgaaaacctgccatacgatctgagggcatctttctgcaggctgatgctgcatatgcatgttgatcgggatcctcaggagcaggtgactcccgtgaagtacgctcggctgtggtcagaaattccgtcggaaattgcaattgacgattacgactcctctggcgcctcaaaggacgaaatcaaagaaagattcgcccagactatggagttcgtggaagagtacctgcgagacgtagtttgtcagaggtttcctttcagtgataaagagaagaataaacttacattcgaggttgtcaaccttgccaggaatttgatatatttcggcttttacaacttttccgacctgctgaggttgaccaagattttgctggccatccttgactgcgtccatgtgacgacaatattcccaatatcgaagatggccaaaggcgaagaaaacaagggcaataatgacgtggagaagctgaaatcaagtaacgtcatgcggtccatacatggagtcggcgagctgatgacacaagtggtactcagaggtggcgggtttttgccaatgacccccatggccgcagctccagagggcaatgtgaagcaggccgagcctgaaaaggaagatatcatggtgatggatacgaaactgaaaatcatcgagattctgcagttcattctgaacgtaaggttagactatcgcattagctgcctactttgcatcttcaagagggagtttgacgagtcgaattcccaaacctccgaaacttccagcggaaactcttctcaggaagggcctagcaacgtacccggagccctggacttcgaacacattgaggagcaggccgagggcatctttggggggtctgaggagaacacccccttagatctggatgatcacggcggccggacctttctgcgggtgctcctgcaccttacaatgcatgattatccgcccctggtgagcggcgccctccagttgctgtttaggcatttttctcagcgtcaagaggtcctgcaggccttcaagcaggtgcagcttctggttaccagccaagacgtcgataattataaacaaattaagcaggacctggatcagctccgctctattgttgagaagtccgaattgtgggtgtataaggggcaagggccggacgaaaccatggatggagctagtggcgaaaacgaacacaaaaaaacagaggagggcaacaacaagccccaaaagcacgagagcacttcctcatataactaccgagtcgtgaaggagatcctgataagactgagcaaactctgcgttcaagagtccgccagtgtgagaaagagtcgtaaacaacagcaaagattgctccggaacatgggcgcacacgctgttgtcctggagttactacaaatcccctacgagaaagctgaggatacaaagatgcaagagatcatgagattagcgcacgaatttttacagaatttttgtgcaggaaaccagcagaaccaagccctgctgcataagcatataaatcttttcctgaatcctggcatcctggaagcggtgacaatgcaacacatcttcatgaataatttccagctctgctcagagatcaatgaaagagtagttcaacatttcgtgcattgcattgaaactcacgggagaaatgttcaatacatcaaatttttgcagaccatagtgaaggcagaaggaaaattcattaagaagtgtcaggatatggtcatggccgagctggttaatagcggggaggacgtgctcgtattctataacgacagggcctcattccagactttaatccagatgatgcgaagcgaacgggaccggatggatgagaatagcccccttatgtaccacattcacctcgtcgagctgctggctgtgtgcaccgagggcaaaaacgtttataccgagatcaagtgtaacagcctcctccccctcgacgatatcgtgcgcgtcgtcactcatgaagattgtattcccgaggttaagatcgcctatatcaactttttaaatcattgctacgtcgatacagaggtggagatgaaggaaatatacacaagtaaccacatgtggaaattattcgagaacttcctggtcgatatttgccgcgcatgcaacaacacgagtgatcggaagcacgcggatagcatcctggagaaatacgttaccgagatcgtgatgagtatcgtgacaacatttttttcatcccccttcagcgaccaatccacgacattgcagacacgacagccagttttcgtgcagttgttgcagggggttttcagggtttaccactgtaattggctaatgccatcccagaaggcgtctgtcgagtcatgcatcagggttctgagtgatgttgcaaagtcacgtgccatcgcgataccagtcgatctggattctcaggttaacaacctgtttctcaagagccattcgatagtccaaaagaccgctatgaactggagactcagcgctcgtaacgcggctagacgagactcggtcttggccgcctcccgggactatcggaacatcattgagcgactccaagatattgtaagcgcgctggaggaccggctcaggccgctcgtccaggctgaactgagcgtacttgttgacgtgctgcatcgcccagagttgctgtttcccgaaaacactgacgcacggcggaaatgcgagtccggcggatttatatgcaagctaattaaacatacgaagcaactgcttgaagagaacgaggaaaaactttgtatcaaggtgttgcagacccttagggaaatgatgaccaaggatagagggtatggtgagaaattaattagcatcgatgagctcgacaatgccgaactgccacccgctcccgactcagagaacgccaccgaagagttagaaccttcccccccgctccgccagttagaggatcacaaacgcggagaggccctgcggcaggtgcttgtcaatcggtattatggtaacgtgaggccttctggacggagagaatccttgacctcgttcggcaatggcccacttagcgctggcggtccagggaaaccaggagggggggggggcgggtccgggtctagtagcatgtcacggggcgaaatgagcctagccgaagtgcagtgtcatctggacaaagaaggcgcatcaaacctcgtgatcgaccttatcatgaacgcatcctccgatagagtcttccacgagtctattttgttggcaatcgcccttctagagggcggcaacaccactatccaacattcattcttttgtaggctaacagaggataaaaaatctgagaagtttttcaaggttttctacgatagaatgaaggtggctcagcaggagatcaaggccaccgttaccgtgaatactagcgacctgggaaataaaaagaaggacgatgaagtggatagagacgcacctagtcgtaagaaggctaaagaacctaccacgcagattactgaagaggtccgagatcagttgttagaggcatcagctgctacgcggaaggcctttacgaccttccggcgcgaagcagatcctgatgaccactaccagccaggcgaaggcactcaggcgaccgccgacaaagcgaaggatgatcttgaaatgtccgctgtgattaccatcatgcaaccgatcctgcgcttcctccaattactgtgcgaaaatcacaacagagatctgcagaacttccttcgctgtcagaacaacaaaaccaactataatctcgtgtgcgaaacactccagttcctggactgcatttgtgggtcaactaccggtggcctcggattgctggggctgtacatcaacgagaaaaacgtagccttaatcaaccagacgctcgagtcactgactgagtactgccaaggcccttgtcatgaaaatcagaattgtatcgccacccatgagtccaacggtatcgatatcattaccgcactgatcttgaatgacattaatcccctgggcaagaagcgcatggacctcgtcctggagctgaaaaacaatgctagcaaactactactcgctataatggaatctaggcacgacagcgaaaatgctgagaggatcctgtacaatatgcgccctaaagagctggtggaagtgataaagaaggcttacatgcagggagaagtggaattcgaggacggcgagaatggggaagacggcgctgcctctcctcggaatgtgggccataatatttatatcctagctcaccaacttgctagacataataaggaactgcagtccatgctgaaacctgggggtcaggtggatggagacgaggcattggagttctatgctaaacacacagcccagattgaaattgtaaggctcgatagaaccatggaacagatcgtgttcccggttccttcgatctgcgaattccttaccaaggagtccaagttgcgtatctactatacaaccgaacgggacgagcaggggtctaaaatcaacgacttcttcctgcgctccgaagacctgtttaatgagatgaattggcagaaaaagctccgtgctcaaccagtgctctactggtgtgccagaaatatgtcattttggtccagcatctccttcaacctggcggttctgatgaaccttctggtcgcctttttctacccgttcaaaggtgtgcgcggcggaacgttagaaccacactggtcaggactcctctggaccgctatgctgatctcccttgctattgtaattgccttaccaaagccccacggcatcagagccttgatcgcctcaacaatattaaggctcatctttagcgtcgggctgcaacctactttgttccttctcggggcttttaacgtgtgcaacaagattatctttctgatgtcttttgtcggtaactgcggcacattcacacgaggctatagagccatggtgctggatgtggagttcctgtatcacctgctctacctcgtgatttgtgccatgggactttttgtgcacgaattcttttacagcctgctgctcttcgacctcgtgtacagagaagagacgctgctaaatgtgattaaaagcgttacccgcaatggcaggagcatcatcctgactgccgtgctggcgctcatcctagtctacctgttttccatcgtcggatacctgttcttcaaggacgacttcatccttgaggttgatcgcctgccaaatgagacagctgtcccggaaaccggcgagagcctggcctcagagttcctgttttccgacgtctgccgagtggagagcggcgagaactgctcatctcccgccccgagagaggagttggttcccgcggaggaaacagagcaggacaaggaacacacctgcgaaactctgctcatgtgcatagtgaccgtcctgtcacatgggctgcggagtggaggtggagtcggcgatgtgctaagaaaacccagtaaggaagaacctctgttcgccgcccgagtgatatacgacctcctgttcttttttatggtgatcatcatcgtcttgaatctcattttcggggtgattattgatacattcgctgacttgcggtctgagaagcagaagaaggaagagattctgaaaacaacctgttttatctgcggtctggagcgcgacaagtttgataacaaaaccgtaaccttcgaggagcatatcaaggaagaacacaacatgtggcattatctctgtttcattgtgctcgtgaaagtgaaagactctaccgaatatacaggaccggaatcctacgttgccgaaatgatcaaggagagaaatcttgactggtttccaaggatgcgtgctatgagtttggtgtcctcagattctgaaggggaacagaacgagctacgcaatctgcaggagaaactcgaaagcaccatgaagctggtcaccaacctctcaggtcagttgtccgaattaaaggaccagatgacagagcagagaaaacagaagcagcggatcggactcctcggccatccaccacatatgaacgtgaatccccagcaacccgcctag

SEQ ID NO: 120593 - DNA, 8133 bp, Artificial Sequence
  Description of Artificial Sequence: Synthetic coding sequence
atgtccgataaaatgagtagttttctacatatcggcgacatatgttccctctacgcagagggctcaacgaacggcttcattagcactttgggcctggtggacgaccgttgtgtagtgcaaccagaaactggcgatcttaataacccccccaagaagttccgggactgtttgttcaagctgtgtcctatgaaccggtacagtgcgcagaagcagttctggaaggccgcgaagccaggcgctaattccaccacggacgcagtgctgcttaataaacttcaccatgctgccgacctcgaaaaaaagcagaacgaaaccgagaataggaaactactggggactgtgattcagtacgggaatgtcattcagctactgcacttgaaaagcaataagtatctcacagtcaacaaaaggcttcccgctctgctggagaagaatgccatgagggtcacactcgatgaagcgggcaatgaaggtagctggttttacatccagcccttttataagcttaggagcattggcgattcggtggtgatcggcgataaggtagtgcttaaccctgtgaacgctggacagccactgcacgcatcatcccatcagctcgtggacaatcccggctgcaacgaggtaaatagcgtgaactgcaatacaagctggaagattgtgctctttatgaaatggtcggacaataaggatgacattctaaagggcggtgacgtggttcggctttttcacgccgagcaggaaaagttcttgacgtgcgacgagcacagaaagaaacagcacgtgttcttgaggacaactggccgccagtcggcgaccagcgccaccagctctaaggccctgtgggaggttgaggttgtgcagcatgacccgtgcaggggcggtgctggctattggaacagtcttttccgcttcaaacacctggccacgggtcactaccttgctgcagaagttgatccggattttgaagaggagtgtctggaattccagccctctgtggaccccgaccaagacgcttcacgctcaaggctacgaaacgcccaggagaagatggtgtattccttagtgtctgtgccagaagggaatgacatatccagtattttcgaattggaccccacaaccctgagagggggcgatagccttgtgccccgaaattcctacgtgagactccggcacctttgcaccaacacctgggtgcattctacaaacattccgatcgacaaggaggaggagaagcccgtgatgctgaaaattgggacttcgcccgtaaaagaggacaaggaagcattcgccattgtaccagtgtccccagctgaagtgagggatctggattttgccaacgacgcaagcaaagttttaggctcaattgctggaaagctagaaaaaggcaccatcacacagaacgaaaggaggtccgtcaccaagttgctggaagacctcgtatactttgtcacaggcggcaccaacagcgggcaggatgttctggaggttgttttctctaaacctaaccgggagagacagaaattgatgagggagcaaaacatactgaaacagattttcaaactccttcaggctcctttcaccgactgtggcgacggccctatgttaagattggaagaactgggcgatcagaggcatgctcctttccggcatatttgtcggctgtgctaccgggttcttcggcattcacagcaggactaccgaaagaatcaggaatacattgctaaacagttcggttttatgcagaagcagataggttacgacgttctggctgaagatacaatcacagccttgcttcacaataacagaaaactgctggagaagcatattacagccgccgaaatcgacacttttgtctctctcgttcgcaaaaatagggaacccaggtttctggactacctgtcggacctttgtgtgtcgatgaacaaatcaatacccgtgactcaggaactgatatgcaaggcggtgctcaaccccacaaatgctgacatactaattgagaccaaactggttctaagccgcttcgagtttgaaggagtatcttcaactggcgagaatgccctcgaggcgggggaggatgaggaagaagtgtggttattttggagggactctaacaaagagattagaagcaaatccgtgcgcgaattggcccaggatgccaaggaaggacagaaggaggaccgggacgtgctgagttattatcggtaccaactaaacctgttcgcccgcatgtgtctggatagacagtatctggcaatcaacgagatcagcggacagctggacgtagacttaattttgcgatgcatgagtgacgagaatctgccttatgacttgcgggcctccttctgtagactgatgctacacatgcatgtggacagggatccacaggagcaagttacgcccgtgaaatatgcacgcctctggagtgaaatccccagtgaaattgctatcgacgactatgactcaagtggagcaagcaaagacgagatcaaggagcgcttcgcccagaccatggagtttgtggaggaatatctcagggatgttgtctgccagagattccctttttctgataaggagaagaacaaactgacattcgaagtcgttaacctggcccgaaatctgatctattttggtttttataacttcagtgatctactgaggttaaccaagatcctgctcgcgattcttgattgtgttcacgtgactaccatattccccatcagcaaaatggcaaagggcgaggaaaataaaggctctaacgtcatgaggagtatccacggtgtgggcgagctcatgacccaagtggtgctgcggggcgggggttttctacccatgactccgatggccgccgccccagaaggcaacgttaagcaggccgagccagagaaggaggacataatggttatggataccaagctcaagattatagagatcctacaatttatcttgaatgtgcgccttgattatcgaatcagctgtttgctatgcatctttaagcgagagttcgacgagagtaacagccagacgtctgagacctctagcgggaattcatcacaagagggaccgagcaatgtgccaggggctctggatttcgagcacatagaggagcaagccgaaggcatttttgggggctctgaggagaacacccccctagatcttgatgatcatggcggccgcacctttctcagagtgctgctccatctaaccatgcacgattacccccctctcgtctccggggctcttcagctgctttttcgtcacttttcacagagacaggaagtcctgcaggccttcaagcaggtacaattgcttgtcacttctcaggatgtggacaactacaagcaaataaagcaggatctggaccagctacgcagcatcgttgagaaatccgagttgtgggtttacaagggtcaggggcccgatgagactatggacggagctagcggagaaaacgaacataagaagaccgaagagggaaataataagccgcagaaacacgaatcaacttcttcatataactaccgagtcgtcaaggagatcctgattcggctcagcaagctctgtgtccaagagagcgcaagcgtaagaaagagccggaagcagcagcaaagactcctgagaaacatgggggcacatgcagttgtcttggagctgctccagatcccttacgagaaagctgaggacactaagatgcaggagattatgcgcctggcccacgaatttctgcagaacttctgcgccgggaaccaacagaatcaggctctgttacacaaacacattaatctgttcctaaatcctggcattctcgaagcggtcacaatgcagcacattttcatgaacaacttccaactgtgctcagagatcaacgagagagtagtccaacatttcgtgcactgtatcgaaacccacgggagaaatgtgcagtacattaaattcttgcaaacaatcgtaaaggccgagggcaagtttattaaaaaatgtcaggatatggtgatggctgagctggtgaatagcggggaggacgtactcgtcttttataatgatcgtgcaagtttccaaacacttatccagatgatgaggagcgagagggaccgaatggatgagaacagtcctctgatgtatcatatccacctggtggagctccttgccgtgtgcacagagggaaaaaatgtgtacacagagatcaagtgtaactctcttttgcccctggacgatatcgtacgagtggtgacccacgaagactgcatccccgaagtgaagatcgcttacatcaactttctaaaccactgctacgtagatacggaggtggaaatgaaagagatatataccagcaaccacatgtggaagctctttgagaattttttggtcgatatttgcagagcatgtaataatacctccgaccgaaagcacgctgactctattctcgaaaaatacgtcaccgaaatcgtgatgagtatcgtcacgactttcttctcctctccgttttccgatcaaagcacaacgttgcagactcggcagcctgtgtttgtacaactgctccagggtgtttttagagtgtaccactgtaattggctgatgccatctcaaaaggcgtctgtcgagagctgtattagggttctgtcagacgttgccaaaagtagagccattgccatcccggtcgatttggactcacaagtcaacaacctttttctgaagtcccactccattgtgcagaagacggcaatgaattggaggctgtccgcaagaaacgccgctaggagagattcagtcctcgccgcctccagagattaccgaaacatcatcgagcggctgcaggatattgtgtcagcgcttgaagacaggctcaggcctctggtccaggctgaactgtccgtcctagtagacgttctgcataggcccgaactacttttcccagaaaacacagacgcaaggagaaagtgcgagtctggcggtttcatttgtaagctcattaagcacactaaacagctgcttgaagagaacgaggaaaaactgtgcatcaaagtgctccagaccttacgcgagatgatgacgaaggacagaggatacggcgagaagggagaagctttgagacaggtgttagtaaataggtactatggtaatgtgcgaccgtcaggccggcgagaatcactgactagcttcggcaacggacctctctctgccggcgggcccggaaagcctggcggcgggggaggaggatccgggtcttcaagcatgtcgcgtggcgagatgagtcttgctgaggtgcagtgtcacttagataaggaaggagcaagcaacctggttatcgatctgatcatgaatgccagttccgacagagtttttcatgagtccatacttctggctatagccctgctggagggagggaacacaaccatccagcacagttttttttgtcgcttaacagaggacaagaaatcggagaaattctttaaagtcttctacgatcgcatgaaagtggcccagcaggaaatcaaggctacggtgactgttaacacctcagatttgggcaacaagaaaaaggacgacgaagtggacagggacgctccaagcaggaaaaaagccaaagagcccactacccaaatcacggaggaagttagggaccaactactagaggccagtgctgccacgaggaaagcttttacaacttttcgccgggaggccgatcctgacgatcattaccagcccggtgagggaacccaggcaacagccgataaggctaaggatgacttggagatgagcgccgtgattaccattatgcagcctatcctgaggtttctccaattgctttgcgagaatcacaatcgggacctgcagaatttcctccgatgtcaaaacaataagaccaattataatctggtctgtgaaaccctacagttcctggattgcatctgtggatccactaccggcgggctagggctcctgggattgtacataaatgagaagaatgtggcccttatcaatcagactctggagtctctgacagagtactgccaagggccgtgccatgagaaccagaattgcatagcaacccacgagagtaatgggatcgacatcattaccgctctgattttgaacgatatcaacccactgggcaagaagcggatggatcttgtacttgagcttaagaataatgccagcaaattgttgttagccatcatggagtcccggcatgattcggaaaatgcagaaaggattctgtataacatgcggcctaaagagctggtggaggtaataaagaaagcgtatatgcaaggcgaagtcgagttcgaggatggcgaaaacggcgaagacggggccgcttcaccccggaatgtgggccataatatctacattctagctcaccagctggcaagacacaacaaagagctacagtctatgctcaagcccggcggccaagtggacggcgacgaagctctggaattttacgctaagcacacagctcagattgagatcgttcgccttgaccgtaccatggagcaaattgttttccccgttcctagcatctgcgagtttcttaccaaggagtctaagctacggatctactacacaaccgagcgagacgaacagggctcaaaaattaacgacttcttcctgaggagcgaagatctcttcaacgaaatgaactggcagaagaagctgagagcccagcccgtgctttattggtgcgccaggaacatgtccttttggtccagtatttcgtttaacttggccgtgcttatgaacctcctggtagcgttcttttacccctttaagggtgtcagaggaggcacgctggaaccccactggtccgggttactctggactgccatgttaatatcccttgccattgtcattgctctgccgaagcctcacggaatacgagctctgatcgcctctacaattctaaggcttatcttctccgtaggtctgcagccaacattgttcctgctcggcgcttttaatgtctgtaataagatcatcttcttgatgagcttcgtagggaattgcggtacgttcacacgaggataccgggcaatggtgctggacgtagaatttctctatcatttgctgtaccttgttatctgcgccatggggttgtttgttcatgagttcttctactcattattgctgtttgacctcgtctacagagaggagacactgctgaacgtgatcaagagcgtgactcgcaacggccgctcaattatcctgaccgccgtgctcgctttgattcttgtttatcttttctcaatagtcggctatctgttttttaaagacgacttcatactcgaggttgatcgccttccaaatgaaacagcggtgccagagacgggcgagagtctggcctcagagttcctcttcagtgacgtctgtagggtcgagtccggagagaactgctcatctccagccccccgcgaggagttggtgccagcagaggaaacagaacaagataaggagcatacgtgtgaaacgttacttatgtgcattgtgacagtcctgagtcatgggctgcgttcagggggtggcgtgggcgatgtgctgaggaagccttctaaggaggagcctctgtttgctgctagggtaatctacgatctcttgtttttcttcatggtcatcataattgtcctgaaccttatcttcggcgtcataatcgataccttcgccgaccttcgctcagaaaaacaaaagaaggaggaaatcctcaagactacatgtttcatttgtggcctcgaaagggacaagtttgacaataagacagtcacatttgaggagcatattaaagaggaacacaatatgtggcattacctctgcttcatagtgttggttaaggttaaggactcaactgagtacacagggcctgaatcctatgtcgctgaaatgatcaaggaacgaaatttggactggtttccaagaatgcgtgcaatgagcttggtctcctccgattcggagggtgaacagaacgagctgcgtaacctccaggaaaaactggagtccacaatgaaactggtcactaatctgtcaggccagctttcagaactaaaagaccaaatgactgagcagaggaaacagaaacaacgcattggcctgctcggacaccctcctcatatgaatgtgaatccacagcagcctgcctag

SEQ ID NO: 120594 - DNA, 8133 bp, Artificial Sequence
  Description of Artificial Sequence: Synthetic coding sequence
atgtcggataaaatgagcagcttcttgcacataggagacatctgcagtctatatgccgagggtagtacaaatggctttatctccactttggggctcgtcgacgatcgatgcgtggttcagccggaaaccggcgacctgaacaatcctcccaaaaaattccgggactgcctgttcaaattatgtccaatgaataggtacagtgcacagaagcagttttggaaggcagccaaacccggggcgaatagtaccaccgatgccgtcctgttgaataagctgcatcatgctgccgatctcgaaaagaagcagaatgaaaccgaaaatcggaagctgctaggcaccgtgattcaatacggtaatgtgatacagttgctccacctgaaatccaacaagtatcttactgtaaacaagaggttgccggctttgttggaaaaaaacgctatgcgcgttaccctggatgaggcagggaatgagggatcctggttctatatccagcccttctataagctgcggtctatcggggactcggtagtgatcggcgataaggtagtgcttaacccagtcaacgctggccagcccctccatgcctcctcacaccagctagtagacaatccaggatgtaacgaggtgaattcagtgaactgtaatacatcttggaagatcgtgctgttcatgaaatggagcgataacaaagacgacattctgaagggcggcgacgtcgtcagactgttccacgccgaacaagaaaaattcctcacttgcgacgaacacagaaagaagcagcatgtgttccttcgcacaaccggtcgccaatcagccaccagtgccacttccagcaaggcactatgggaagtcgaagtcgtgcagcatgacccctgtagaggcggcgctgggtattggaattctctcttcagattcaaacatctagctaccggacattacctggccgcagaagtggatcctgatttcgaggaagaatgtctcgaattccagccgtccgttgacccggaccaggatgcttccagaagccggttacggaatgcccaggagaagatggtctattctctggttagtgtgcccgagggtaacgacatttcttcgatttttgagctcgaccctaccacactgcgaggtggagactccctggtgccccggaatagttatgttcggctcaggcatctgtgtaccaacacctgggtacatagtactaacattcctatagataaggaggaggagaagcctgtcatgctgaaaatcgggacttcacccgttaaggaagataaagaggcattcgccatcgttcctgtttcccccgccgaggtgagagatctggacttcgcaaacgacgcgagcaaggtgctgggctcgattgcgggaaaacttgagaaggggacgatcacccagaatgaacgccgtagcgtgacaaaactgctggaagatctggtgtacttcgttaccggcgggactaattccggacaggatgtcctagaagtggtgttctcgaaaccaaatagggaaaggcagaaacttatgcgcgagcagaacatcctcaaacagatcttcaaattactgcaagctccttttaccgattgtggcgatggtccaatgttgaggttggaggaactcggtgaccagagacatgcacctttcagacatatttgtcgcctgtgttaccgtgtattgcgacatagccagcaggactatagaaagaaccaggaatacatcgctaagcagtttgggttcatgcagaagcagattggttacgatgtgctggcggaagatacaatcactgctctgcttcacaataatcgcaagcttttagagaaacacatcacagccgctgagatcgatacttttgtttcccttgtccggaaaaacagagaaccccggttcctggactatctcagtgacctttgcgtgtccatgaataagtctatacctgtcacacaggaactgatctgtaaggctgtattaaaccctacaaacgccgacattcttatcgagaccaagcttgtactgagccgttttgaatttgagggggtaagcagcaccggtgaaaatgcacttgaagctggcgaggatgaggaggaggtctggctgttttggcgcgatagtaacaaagaaattcgctccaaaagcgtgagggagctggcccaggatgctaaagagggccagaaggaggaccgcgacgtcctgtcgtactaccggtaccaactgaatctgtttgccaggatgtgtctggaccgacagtaccttgccataaacgaaatttccggacagttagatgtggaccttatcctgagatgtatgtccgacgagaacctgccctacgacctgagggcatcattctgtcgcttgatgctgcacatgcatgttgatagggatcctcaggagcaagtgaccccagttaagtatgcccggctgtggtctgaaattccctccgagatagccatcgacgattatgattcttcaggtgcttcaaaagacgagataaaagagcgttttgctcagacaatggaattcgtcgaagaatatctgcgtgatgtcgtttgtcagcgcttcccttttagcgataaagagaagaacaagctgacttttgaggtcgttaatctcgctcgcaatctgatttactttgggttctataactttagcgacctgctcaggcttaccaaaattctgctcgccatcttagactgtgtccacgtgacaacgatttttccaattagcaagatggctaagggcgaggagaataaaggttctaatgtgatgaggtctatacatggagtaggcgagctgatgacccaggtagtgttacgaggaggcggctttttgccaatgactcctatggccgctgcccctgaggggaacgttaaacaagctgaacccgaaaaggaagatataatggtcatggacaccaaactgaagatcatagaaattctgcagttcatccttaacgtacggctggattatagaatcagctgcctactttgtatctttaaacgcgagtttgacgagtctaattctcagaccagtgaaactagttccggtaacagtagccaggagggtcccagtaatgttcccggcgctctcgacttcgagcatatcgaggagcaggccgaaggcatctttggggggcgcaaagagaacactccgcttgatctggatgaccatggcgggagaactttcctgcgtgttctcctccatttgactatgcacgactatcctcctttggtttccggtgccctccagctgctatttcgtcatttctcccagcggcaggaagtgctgcaagcctttaagcaagtacagctgttggtaaccagccaggacgtggataactacaagcagattaagcaggatctggatcagttaagatcgatagtggaaaagagcgagttgtgggtttacaagggccagggacctgatgaaaccatggacggcgcaagcggtgaaaatgagcataaaaagaccgaggaaggcaataataagccacagaaacacgaaagcacgtcctcttataactatcgtgtcgtgaaagagattctgatacgcttgagcaaactgtgcgtgcaggaatctgcctccgtgcgcaaaagtaggaagcagcagcagaggctgctgcgaaacatgggtgctcacgctgtggtcctggagctgttacaaatcccatatgagaaggcagaggacaccaagatgcaggagattatgcggcttgcccatgaatttctccagaatttttgtgctgggaaccaacagaatcaagcgcttctacataagcatatcaacctatttctgaacccggggattctcgaagcagttaccatgcagcacattttcatgaataatttccagctgtgttctgagatcaatgaacgggtagtacaacatttcgtgcattgcattgaaacccacggcagaaacgtgcaatatatcaaattcctgcagacaatagtgaaggctgaagggaaattcattaagaagtgccaggatatggttatggccgagctcgtgaatagtggggaggacgtgcttgtgttttataatgacagagcatcatttcagacacttatacagatgatgaggagcgaaagagacagaatggatgagaacagcccgctcatgtaccacatccatcttgttgagttgctcgcagtttgtacggagggcaagaatgtttatactgagataaaatgcaactcattgttgcccctggatgacattgtcagggtcgtgacacatgaggactgtatcccggaggtgaagattgcttacatcaattttctgaaccattgctatgtcgacaccgaggttgaaatgaaagagatctacacttccaaccatatgtggaaactgttcgaaaatttcttggtggatatatgcagagcttgcaataacacaagcgataggaaacatgccgactctatattggaaaaatatgttaccgaaattgtaatgtcgatcgtgactacttttttttcatctccatttagcgatcagtctacaaccctgcagacaaggcagcctgtgttcgtgcagctactccaaggagttttccgggtctaccattgcaactggctcatgccctcgcagaaggccagtgttgaaagctgcattagagttctgagcgatgtggccaaatcccgggccatcgcaataccggtggatctcgattctcaggtgaataatctgtttctgaagagccattcaatcgtgcagaagactgcgatgaattggcgcctcagcgctaggaatgctgcgcgcagagatagtgtgttggccgcgtccagggactacaggaacattatagagcggttgcaggatatagtctcagccctggaggaccgcctgagaccacttgtacaggcagagttaagcgtgcttgttgatgtcctgcaccgccccgagctgttgttcccagaaaatactgatgcccgcagaaaatgtgagagcggcggatttatctgcaaattaatcaaacatacaaagcagctccttgaagaaaatgaggaaaaactttgtataaaggtgttacagacactcagggagatgatgacaaaggataggggctatggagagaagggcgaggccctccgacaggtgctcgttaacagatactacggtaatgtacgaccctccggccggcgggagagtttaacttcctttggcaacggcccgcttagtgccggtggccctggtaagcctggcggtggaggggggggctccggatccagctctatgagtaggggcgagatgtctttggcagaagtccaatgccacctagacaaggaaggcgcatctaacttagtgattgatctcatcatgaacgccagtagcgatagggtcttccacgaatcaatcctcctcgccatcgccttactggaagggggcaacaccacaattcagcattctttcttttgtcggctgaccgaggataagaagtccgaaaagttttttaaggtgttctacgacagaatgaaggtggcccagcaagagattaaggcgactgtgaccgtgaacacctctgaccttggaaataaaaagaaagatgacgaggtagatcgggacgcaccttctcgcaagaaagccaaagagcccaccacgcagataacagaggaggtgagggatcagcttctggaagcctctgcagctacccggaaggctttcaccactttccgcagggaggcagaccctgacgaccattaccagcctggtgaaggtacccaagcaacagccgacaaagcaaaggatgatttggagatgtccgcggtgatcactatcatgcaacctatcttgagatttctacagctgttgtgcgaaaaccacaatcgggacttgcaaaactttctacgatgccagaacaacaagacaaactacaacctcgtctgcgaaaccttgcagttcctagactgtatatgcggaagtactaccggtggcctgggcttgttgggactctacataaacgaaaaaaatgtagcattgatcaatcagacactggagtccctcactgagtactgccagggcccctgccacgagaaccagaactgtatagccacacatgagagcaatggaatcgatatcataacagcccttattcttaacgatatcaacccactcgggaagaagaggatggatctggtgctcgagctcaaaaataacgctagtaagcttctgctagcaatcatggagtctcggcacgacagcgagaacgcagagaggatactgtacaacatgagacccaaggagctagtcgaggtaattaaaaaggcctacatgcaaggggaagtggaattcgaggatggagaaaatggtgaagacggggcagcctcccccaggaatgtggggcacaacatttacatcctggcccaccagttagcaaggcataataaagagctgcaatctatgctcaaacctggcggtcaggtggacggggacgaagcacttgaattttacgcgaagcacaccgctcaaattgagatagtcaggctggaccggaccatggaacagatcgtgtttccagtgcccagtatatgcgaatttctgactaaggagagcaagctccggatttactatacaactgagcgtgatgagcagggctccaagattaacgacttctttctccggtccgaggacctgttcaatgagatgaactggcagaagaagctcagggcacaacctgttctttattggtgtgccaggaacatgagcttctggtctagcatttcgttcaaccttgccgtcctcatgaatttgctggtggcattcttttatccctttaagggtgtgcgcggaggaacccttgagccacactggtcggggttgctttggactgcaatgctgattagtctggcaattgtgattgccttgccgaagccacacggcattcgggctctgatcgcatcgactattcttcgactcattttcagcgttggattgcagccgaccctgtttctgctgggggcattcaacgtgtgcaataagataatctttctgatgtccttcgtcgggaactgcggcacctttacaaggggttacagggctatggttttggacgtagaatttctctatcatttgctttacttagttatttgtgccatgggcctctttgtacacgagtttttctatagtctgcttctatttgacctggtatatcgtgaagaaacactccttaacgtgattaagtcagtgacaaggaacggccggagcatcatcttgacagccgttctcgccttgattctggtttatctgttcagtatcgttggctatctcttcttcaaagacgactttattctggaagtagaccgactccccaacgaaaccgcagtgcctgaaaccggagagtcccttgcttccgaatttcttttttctgatgtgtgtcgggtggagtcaggggaaaattgtagtagccccgccccaagggaagagctggtgcccgcggaggagactgagcaggataaagaacacacatgtgaaacacttttgatgtgcattgttacagtactatcacacggccttcggagtggaggaggcgtcggcgacgtgcttcgcaagccctctaaagaagagccgctgtttgcagcccgggttatttacgatttactgttcttcttcatggtgataataatcgttctcaatcttatttttggtgtcattatcgataccttcgcagatctgcgctctgaaaagcagaaaaaagaagaaatcctgaagacgacatgtttcatctgcggcctagaacgagataagtttgacaataagactgtaacttttgaggaacatataaaagaggaacataatatgtggcattatctatgttttattgtattggtcaaggtgaaggactcaaccgaatacacgggccctgagagttacgttgcagaaatgatcaaggaacgcaacctagactggtttcccaggatgagagctatgtctctggtgtcctcagatagcgaaggcgagcaaaacgagctgcggaacctgcaggagaagctggagagcaccatgaaactggtcaccaaccttagcggtcagctgtctgagttgaaagaccagatgaccgaacagaggaagcagaagcaacgcatcggtctcttgggtcaccctccccatatgaacgtgaatccccagcaacctgcgtag

SEQ ID NO: 120595 - DNA, 3615 bp, Artificial Sequence
  Description of Artificial Sequence: Synthetic coding sequence
caggagccaggtcattgtcacagtcgggggccgggtcagccaagccagcagcctctctcgcaggtcccccaacattgtgcggaggcgatgaactggcgcctctctgcaaggaatgccgcccgcagagactccgtgcttgctgctagccgcgattacagaaatattatcgagcgccttcaggatatagtgagtgccttggaggaccgcctgcgccctctagtgcaggccgagctcagtgttttggttgatgtgctgcaccggcccgagttgttgttcccagagaatactgacgcccgccgcaaatgcgagagcggtggtttcatttgcaaattgatcaagcacaccaagcagttactcgaggagaacgaggaaaaactgtgtattaaagtgctgcagactctgagagaaatgatgactaaggataggggctacggggaaaaactcatctcaattgacgaactggacaatgcagaactgccgcctgcacccgactcggaaaatgcaactgaggaattggagccttccccccctttgcgacagcttgaggatcacaagagaggtgaagccctgcgacaggtcctggttaataggtattatggcaacgtcaggccgtctggcaggagagagtcgctcacctcctttggtaacgggcccttgtcagcgggcgggcccggaaaaccaggaggcggggggggcgggagcgggagcagtagcatgtctaggggggagatgtccctggctgaggtgcagtgtcatctcgacaaggagggcgcgtctaacctggttattgatcttattatgaacgccagctctgatcgcgtttttcacgagagtattttgttggcaatcgccttactggaagggggtaatacaaccatccagcacagttttttctgccgtctgaccgaagataaaaaaagtgaaaagtttttcaaggttttctatgatagaatgaaggttgcacaacaagaaataaaggcgacagtaactgttaacactagcgatctggggaacaaaaagaaggatgacgaggtggaccgggacgcacccagtaggaaaaaagcaaaagagcccaccacccagattactgaggaagttagggatcagctcctcgaagcttcagctgctactagaaaggctttcaccacctttcgacgcgaggctgaccctgacgatcattaccagcctggagaaggaacacaggctaccgctgataaggctaaggatgatttagagatgagcgcggtgataactattatgcagcctatcctgagattcctccagttgctgtgcgaaaaccacaaccgcgatctgcaaaattttctcagatgtcaaaataataaaactaactataatcttgtgtgcgagaccctacaatttctcgattgcatctgcggatcgaccactggcggactcggtctgctgggattgtacattaacgagaaaaacgtcgccctgatcaatcagactctcgaatccttaactgagtactgtcaaggaccttgtcatgagaatcagaattgcatcgctacacacgagagcaacggtatagacatcatcactgcactcatcctcaacgatattaacccccttgggaagaaaaggatggacctcgtcctcgagttaaagaataacgcctctaagttgctcctcgcaataatggagagcagacacgactcggaaaacgcggagagaattttgtacaatatgaggccgaaagagctcgttgaggtgatcaaaaaagcctatatgcagggagaagtggaatttgaagatggggagaacggagaggacggtgcagcaagtcctaggaacgtcggccacaacatttacattctcgcccatcaacttgcaagacataacaaggaactgcagtctatgttgaagccgggcggtcaggtcgacggagatgaggctctcgagttttacgcaaagcatacagcccaaatcgaaatcgttcgactggacaggacaatggagcagattgtgtttccggtgcccagtatatgtgaatttttgactaaagaatccaagttgagaatatattataccactgagcgggacgagcagggtagcaagatcaatgactttttccttcggtccgaggacctcttcaatgagatgaactggcagaaaaagctgagggctcaaccagttctctattggtgcgcacgaaatatgagcttttggagctctatctcattcaatctcgccgtgctcatgaacctgttggtcgcctttttctacccatttaagggagtgagaggcggtactttggaacctcactggtcgggcctcctatggactgccatgctcataagtttagctatcgtaattgccctgcccaaacctcacggcattagggccctgatcgccagcactatactccgactgatcttctcagtggggctgcagcctactctattcctattaggcgcctttaatgtgtgcaacaagattatttttctaatgtcctttgtggggaactgtggtacctttactcggggctacagagcgatggtgctcgatgtggaatttctctatcatctgctttatctcgttatctgcgccatgggactcttcgtgcatgaattcttctattccttattactttttgaccttgtgtacagggaggagaccttgctgaacgttataaaaagtgtgacacggaatgggagatccatcattttgaccgctgtgttggcactgatcctggtgtacctgtttagcatcgtaggctatttgttcttcaaggacgatttcatcctggaggtggaccgccttcccaacgagaccgcagtaccagagaccggagaaagcctagcaagcgagtttctgttttctgatgtgtgcagagtggaatcaggtgagaattgtagctccccagcccctagagaggaactggtgcccgccgaagagactgagcaggacaaagagcatacctgcgagacacttcttatgtgtattgtgacagtgttgagccacggactgcgatccggaggcggagtaggggatgtcctgcgcaagccgtcaaaggaagaaccgctgttcgctgccagggtgatctatgacttgctgttcttctttatggtgattattatcgtgttgaacctgattttcggagtgatcattgatacatttgcagatctacgttctgaaaaacagaaaaaagaggaaatccttaagactacctgcttcatctgcgggctggaacgagacaagttcgacaataagaccgtaaccttcgaggaacatatcaaagaggagcacaatatgtggcactatttatgttttattgtcctcgtgaaagtcaaggacagcacagagtacacaggcccagaatcatatgttgccgagatgataaaagagcgcaatctagactggttcccacggatgagagcgatgtctttagtgagttccgattccgaaggtgagcagaatgagcttcgcaacttgcaagagaaactcgagtccacgatgaaacttgtgacaaatctgtcaggccaactctccgagctgaaggaccagatgaccgaacagagaaaacagaagcaacggatcggtttgcttggccacccgccccacatgaacgtcaatccacagcagcccgcttag

SEQ ID NO: 120596 - DNA, 8232 bp, Artificial Sequence
  Description of Artificial Sequence: Synthetic coding sequence
atgagtgataaaatgagtagttttttacatattggagatatttgttccctgtacgccgaggggtctactaatggcttcatcagcaccctcggactggtcgatgaccgatgtgtagtccagcctgagacaggtgatcttaacaacccacctaaaaaatttcgcgactgcttgtttaagctgtgccctatgaacaggtattctgctcagaaacagttctggaaagctgccaagccgggcgcaaatagtacaacggatgctgtgctcctgaataagttacaccatgccgccgatttggagaaaaaacagaacgagaccgaaaaccggaaattgcttggcaccgtgatccagtatggaaatgttattcagctactccacctgaagagtaataagtacttgactgttaataaacgattgcctgctttgcttgaaaagaatgccatgagagtaactctagacgaagccggcaacgaggggtcgtggttctatattcagcccttttacaaattgaggtcaataggagattcggtggtgattggagataaggtagttttgaatcccgttaatgctggtcaaccactccatgccagctctcaccagctcgtggataacccgggctgcaatgaggtaaatagtgtcaattgcaataccagctggaagatagtgctattcatgaagtggtctgacaacaaggacgacattctgaagggcggcgacgtggtgagactattccacgcagagcaggaaaaattcttgacctgcgacgagcataggaagaagcagcatgttttcttgcgtacgaccgggagacagagcgctacaagcgccactagctcaaaggccctgtgggaggtggaggtggtccagcatgacccctgccgcggcggtgccggatactggaattcactattccgattcaagcacctggccacaggccactaccttgccgcagaagtggacccagatcaggatgcctctagatccagacttagaaacgcccaggagaaaatggtgtattctcttgttagcgtaccagaaggtaatgatatctcttctatctttgagcttgacccaacaacactgcgtgggggcgactcattagtacctcgtaactcttatgtgcgactgcgccacctgtgcaccaatacatgggtgcactctaccaacattccgatcgacaaagaggaggagaaacccgtgatgctcaagataggtacctcaccagtcaaggaggacaaagaggcctttgccatcgtccctgtgtcgcccgccgaggtgagggatctcgattttgcaaatgacgcttccaaagtgctgggtagcatcgctggcaaactggaaaaggggactattacacagaacgagaggaggtcagtcacaaaactgctggaagatcttgtttattttgtaaccggggggaccaactctgggcaggatgtgctggaagtggtcttctccaagcccaatagagagcgacagaaactgatgagagagcagaacattcttaagcaaatctttaagctgttgcaggcaccgttcaccgactgcggcgatggtcctatgcttagattagaggaattaggtgaccagcgccatgcaccatttcgccacatttgccggttgtgttaccgcgtgcttagacatagtcagcaagactatcgtaaaaaccaagagtatatcgctaagcaattcggttttatgcagaagcagatcggttacgatgttttggccgaggataccattaccgctctgcttcacaacaaccgtaagctgctcgaaaagcatataaccgccgctgaaatagatacttttgtttcccttgtaaggaagaatagggagccacgtttcctggattatcttagtgacctctgcgtgagcatgaataaatctattcctgttacacaggagctcatttgcaaagccgtgctcaacccaaccaacgccgatattctgatcgaaactaaactcgtgctgtctaggtttgagtttgagggcgtcagttctactggggagaatgctttggaggcaggcgaagacgaggaagaggtatggctcttctggagggacagcaacaaagaaatccggagtaaatcagtgcgtgaactggcccaagacgctaaggaaggtcagaaggaggaccgtgacgtgctctcttattatcgataccagctgaacctgtttgcgcggatgtgcctggataggcaatatttggccatcaatgagatctcgggtcagctggatgtcgacctgattctgagatgcatgtccgatgagaacttgccgtacgatctgcgcgcaagcttttgcagactgatgctgcacatgcatgtcgaccgagacccacaggagcaggtaactcctgtgaagtacgcgaggctctggagtgagataccctctgagattgccatcgacgattacgattcaagtggggcaagcaaagacgaaatcaaggagcggttcgctcagaccatggagttcgtggaggaatacttaagagatgtggtctgccagcgcttcccatttagcgataaggagaagaacaaacttaccttcgaggtagtgaatttggcacgcaatctgatctacttcggtttttacaatttctctgacctgcttagattgacaaagattttacttgcgatcctggactgtgtgcatgttacgactatatttccgattagcaagatggccaagggggaggagaataagggaaacaacgacgtggaaaagttaaaatcttcaaacgttatgagatctattcacggagtgggagagctaatgacacaagtggttctcagaggaggcgggttcctgccaatgacgcctatggctgcggcacctgagggcaatgtcaagcaagccgagccggagaaggaggacattatggttatggatactaagctgaaaattatcgagattttacagttcattttaaatgtgcgactggattaccgtatctcctgcctgctgtgcattttcaaaagagaattcgacgaatcaaacagccagaccagtgagacctcttcgggaaatagttcacaggaaggaccttcaaatgtccccggagcactcgactttgaacatattgaggaacaggctgaaggtatattcggagggtcagaagagaatacacccctagatttggacgatcatgggggcaggacctttctgagagttcttcttcacctgacaatgcatgattaccctcccctcgttagcggcgccttgcaacttcttttcagacatttttcccaaaggcaggaggttctgcaggctttcaagcaggtgcaactgcttgttacatctcaggacgtcgacaactacaagcagatcaaacaggatcttgatcaactgcgctccatagttgagaagtccgagctatgggtgtataaaggccaaggccctgatgagactatggacggggctagtggcgaaaacgagcacaagaagaccgaagagggcaataacaagccccagaaacacgagtctaccagttcttacaactaccgtgttgtcaaggagattctcattaggctcagtaagctttgcgtgcaggagtccgccagcgtccggaagtcccgaaaacagcaacagcgtctccttcggaacatgggggcacatgccgtggtgctagaactattgcagatcccatatgaaaaggcggaagacaccaagatgcaggagatcatgcgattggcccacgaattcctgcagaacttttgcgccggaaaccagcagaaccaggccctcctacataaacacatcaatctgttcttgaatcctgggatcctggaagcagtgaccatgcaacacatcttcatgaacaacttccagctgtgctccgagattaacgagagggttgtccagcactttgtccactgcattgagacacacggccgtaatgtgcagtatattaaatttttacaaaccatcgttaaggcagagggaaaatttattaagaagtgccaggatatggtgatggccgagctagtgaactctggggaggatgtgctggtgttctataatgacagagcaagcttccaaactcttattcagatgatgaggagcgagagagatagaatggatgagaattcccctctgatgtatcatattcacctggttgagttactggccgtttgcaccgaggggaagaatgtttacacagaaatcaaatgcaatagcttgttaccgttagatgatattgtccgagtggtgactcacgaggactgcattccggaggtcaaaatcgcctacatcaatttcctcaatcattgttatgtagacacagaggttgaaatgaaagaaatttacaccagcaatcacatgtggaagctgttcgagaatttccttgtcgatatttgtagagcatgcaacaatacaagcgacagaaagcacgccgacagtattctagaaaaatacgtgaccgaaatagttatgtccattgtgaccacgttcttctcaagtcccttctctgaccagagcacaaccttacagacccgacagcccgtctttgtgcagctcctgcagggcgtgtttcgtgtttatcactgcaactggctgatgccctctcagaaggccagtgtggaaagttgtattcgtgtgctgagcgacgttgccaaatctcgcgcaattgcgatcccagtggacctggacagccaggttaataacctctttcttaagtctcatagcatcgtgcaaaagactgccatgaactggcgactttcagctcgcaacgccgcaagacgggatagtgtcctcgcagcttctagggactacagaaatatcattgagcggctgcaggatattgtatccgcgctggaggatcgtctgcgaccactggtccaagctgaactttcggttcttgtggacgttcttcaccgaccagagctgctctttcccgaaaacaccgatgcccgcagaaaatgcgaaagtgggggttttatttgcaagcttattaaacataccaaacagctactagaagagaatgaagagaagctatgcataaaggtgttacagacactgagggaaatgatgacaaaagatagaggctatggagagaaactgatctctatcgatgagctggataacgccgagttgccaccagcccctgactcagaaaacgccacagaggagctggagccgtctcccccactccggcagctggaagaccataagcggggtgaggcgctgcggcaggtgctggtcaacagatattatggaaatgtacggccctcgggaaggcgagagagcttgacatccttcggcaatggccccctgtctgctggaggccctggaaaaccaggaggggggggcgggggttctgggtcgtctagtatgtccaggggcgaaatgtctctggctgaagtccagtgtcatctggataaggaaggtgctagcaacttagtcatcgacctaatcatgaacgcttcatccgatcgggtatttcacgagagcatattgttggccatcgccttacttgaggggggcaatactaccatccagcactcatttttttgcaggctcacggaggacaaaaagtccgaaaaattcttcaaggttttctatgacaggatgaaggtggcacaacaggagattaaggcaacggtgacagtgaacacaagtgacctgggcaataagaagaaagacgatgaggttgatcgggatgctcccagcaggaagaaggcaaaggaaccaaccactcagataaccgaggaggtgcgcgatcagctcctagaggcctccgcggctacccgaaaggccttcaccacgttcagacgggaggctgacccggacgaccactaccagccaggtgagggtacacaagctacagcggacaaagccaaagacgacctggagatgtctgcagttattacaattatgcagccgatcttgcgcttcctccagctgctgtgtgaaaaccataaccgggatctccaaaactttctcaggtgtcagaacaacaaaactaactacaatcttgtgtgcgagacccttcaatttttggactgcatctgcggttccacgactggaggtctgggcctcctgggactgtacatcaacgaaaaaaatgtcgccctgatcaatcagaccttggagagcttgaccgagtattgccagggaccatgccacgaaaatcagaattgcattgccactcacgaatcgaatggtattgatattatcaccgctctgattctcaacgatatcaatcctctgggaaagaagaggatggacctggtgctcgagctcaagaataacgcatcaaagttgctcctcgcgataatggaatctaggcacgattcggaaaacgcagagcgtatcctttataatatgaggccgaaagaattggtcgaggtgataaaaaaggcctatatgcagggcgaggtagagtttgaggatggcgaaaatggagaggatggagcggcatctccacggaatgtagggcacaacatctatatactcgcacaccagctggccaggcataataaggagttgcagtcaatgctgaaacccggtgggcaggtcgatggcgatgaggccctggagttctacgccaagcacacagcccaaatcgaaattgtgcgccttgatcgcacaatggagcagattgtcttcccagttccctctatctgtgaattcctgaccaaagaatcaaaacttcgtatctactacaccacagagagggacgagcaggggtccaaaatcaacgacttctttttgcgctcagaggacctgttcaatgagatgaactggcagaagaagcttcgcgcacagccagtcctgtattggtgtgcccgaaacatgtcgttctggtctagtataagctttaatctcgcagttttgatgaacctcctggtcgctttcttctaccctttcaaaggtgttcgggggggaacccttgaaccacactggtccgggttactatggaccgctatgctgatttctctggccatcgtaatcgctctgccaaagcctcacggaatacgtgctctcatcgcttccaccatcttgcgcctgattttttcggtcggcctgcaacccaccctgttccttctgggcgcattcaacgtttgcaacaagatcattttcctcatgtcgttcgtgggcaattgtggcaccttcacccgaggttatagggcaatggtgctggacgtggagttcctctatcaccttctgtacctcgtcatttgcgccatggggctcttcgtccatgagtttttctacagcctgttgctcttcgatcttgtctacagagaggagacccttttgaacgtcattaagtctgtgactagaaatggacggagcattattctgacagccgtgctggcactgattctggtgtacttgttctctattgtcggctatctcttttttaaagacgactttatactagaagtcgatcgcttacctaacgaaactgcggtgcctgagacgggggaatcattggcaagtgaattcctgttttctgacgtatgtagagtcgagagcggcgaaaactgtagctccccggctcctagagaagaattggttcctgcagaggaaaccgagcaggataaagaacatacatgtgagactcttctgatgtgcattgtgacagtgctgtcacacgggctaaggtccggcggaggtgtcggggacgttcttagaaaacccagtaaagaagagccactgttcgctgcccgcgtgatatacgaccttctgttcttcttcatggtgatcataatagttctcaatcttatcttcggagtgataattgacactttcgctgatctgcgctctgagaagcaaaagaaagaggaaattcttaaaaccacttgttttatttgcgggcttgagagggataaattcgacaataagaccgttacttttgaggagcacattaaggaagaacacaacatgtggcactacctttgcttcatcgttctggtgaaggtgaaggattccaccgaatatacagggccagagtcgtatgttgccgagatgatcaaagagcgaaatttggactggtttccccgcatgagggccatgtcactggtgtcatcagactccgaaggcgagcaaaacgaactaaggaatctgcaggaaaagctagaatcaaccatgaagctggttaccaatctctccggtcagctaagcgagctaaaggaccaaatgaccgagcagcggaagcagaagcagagaatcggcctgctggggcaccccccacatatgaacgtcaatcctcagcaacctgcgtag

SEQ ID NO: 120597 - DNA, 8088 bp, Artificial Sequence
  Description of Artificial Sequence: Synthetic coding sequence
atgagcgataaaatgtcatcttttctacacattggggacatttgctctctctatgcggaaggcagtacaaacgggttcatcagcactttaggacttgtggacgataggtgtgttgtgcagcccgagactggcgatcttaataatccccccaagaagttccgtgattgcctgttcaagctctgtcctatgaataggtactccgcccaaaagcagttttggaaggctgccaaacctggcgccaattctacaactgacgccgtcctgttgaacaagctccaccacgcagctgacctggaaaaaaagcagaatgaaacagaaaaccgaaagctcctgggtactgtgatccagtacgggaatgtgattcagctccttcacctcaagagtaacaaatatctgaccgttaacaaaagattacctgcgctactcgagaaaaatgcgatgagggtgacacttgatgaagcaggtaacgagggctcatggttctatatacaaccattctacaaactcagatcgataggagatagcgttgttatcggagacaaagtggtccttaatcccgtaaatgcaggccagccactgcatgctagctcacaccagctggtcgataatcccgggtgcaacgaagtaaactcagtgaactgtaacacttcctggaagattgtgctttttatgaagtggtctgataacaaagatgacatcttgaagggaggggacgtggtgcgcctgttccacgctgaacaggagaaatttctgacttgtgatgaacacaggaaaaagcagcacgtcttcctgcggacgaccgggcgccaaagcgccacgtccgctacttcaagcaaggctctgtgggaagttgaggtggtgcagcacgacccctgccgaggtggggccggctactggaacagcctttttcgcttcaagcacctggctaccgggcactatctggccgccgaagtcgatccagatcaagacgcctcaaggtctcgtctgcggaacgctcaggagaagatggtttactcactggtgtcagtgccagagggtaatgatatcagttcaatattcgagctcgacccaaccactctgagagggggcgactcactggttcctcgaaacagctacgtgagactgcggcacctatgcaccaacacttgggtgcactcgaccaatataccgatcgataaggaggaggagaaaccagtcatgcttaagatcggcacctcacccgtcaaggaagacaaggaagcattcgcaatagtgcccgtatctcctgctgaagttcgggatcttgatttcgccaatgatgctagcaaggtcctgggctcaatcgctgggaaactggagaaagggactattacacagaacgagcgccggtccgtgactaagctgctcgaagacctggtgtacttcgtgacaggcgggaccaactctggccaggacgtcttagaagtggtgttttcaaagcccaatagagaaagacagaaactgatgagggagcagaatatcctgaagcagatctttaagctcttgcaggcaccctttaccgactgcggcgacggacctatgcttaggttagaggagctcggtgatcagagacacgcgccatttcgccacatatgcaggctctgctatagagtccttcgccatagccagcaggattatcggaaaaaccaggaatatattgccaagcaattcgggttcatgcagaagcagatcgggtacgacgtattggccgaggatacaattacggcactcctgcacaataaccgaaaacttttagaaaagcatatcaccgccgccgagatcgacacatttgtctcattggtgcgtaagaatcgagagcccagattcctggactatctgtctgatctctgcgtctccatgaacaagagtatccccgttacacaggagctgatttgtaaggctgtcctgaacccaacaaacgcagatatccttatcgaaactaaactcgtgctgagtcgcttcgagtttgagggcgtgagcagcacaggcgagaatgctctggaggctggcgaggatgaagaagaggtttggctgttttggagagattccaacaaggagatccgctccaaatccgtgagggagttggcccaggatgcaaaggaaggtcagaaggaggatcgggatgtgttgtcgtattatcgctaccagctgaatctcttcgccagaatgtgtttagatagacagtacttagccatcaacgaaatctcaggccaactggacgtggatctgattctccgatgtatgagcgatgaaaacctaccatatgacctacgtgcgtctttttgtcggcttatgctgcatatgcacgttgacagggatccccaagagcaggtcacaccagtgaagtatgctagactgtggagcgagattccatcagagattgctatcgacgactacgatagctccggcgcttctaaagacgaaatcaaagagcggttcgcccagacaatggagtttgttgaggagtatcttagggatgttgtctgccagcgctttccattttccgataaagaaaaaaataagttgacattcgaggtggttaacttggctcggaacctcatctatttcggtttctacaatttcagtgacctacttaggctgactaagatattattagctatacttgactgcgttcacgtgactactattttccctatcagtaaaatggctaagggggaggagaataaaggatcaaatgttatgaggtctattcacggtgttggagaacttatgacacaagttgtgctgcggggcggagggtttctgccaatgactcccatggctgcagccccagaagggaatgtgaagcaggcggaacccgaaaaagaagatattatggtgatggacacgaaattaaaaataatcgagattttacagtttatcctcaacgtccggctcgactaccgtatctcttgcttgctgtgcatttttaagcgagaatttgacgaaagcaactctcaaacttccgaaaccagctccggtaattccagtcaggagggtccatcaaatgtgcctggcgctctggactttgagcacattgaggagcaggcagagggcatcttcggcgggagtgaggagaacaccccactggatctggatgatcacggtgggcgcacgtttctcagagtcctcctacatctgaccatgcacgattatccaccacttgtttccggtgctttgcaattgctgtttcggcactttagccagagacaggaggtactgcaagcttttaagcaggtacagctcctggtaacctcccaggacgtagataattataagcagataaaacaagatctagatcagcttaggtccatcgtggagaagtccgaactctgggtctacaaaggccagggccctgacgagacaatggatggggcttccggggaaaatgagcataagaaaactgaggaagggaataataaaccgcagaaacatgagtcaacctcaagctacaattaccgagttgtgaaagagatcctgattcggctgtcaaaactctgcgtgcaggagagcgcatctgtccgcaagtcccggaagcaacaacagcgcttgcttcggaatatgggagcccacgccgtggtcctggagttgctgcagattccatatgagaaagccgaagatactaagatgcaggaaatcatgagactcgctcatgaatttcttcagaacttctgcgctgggaaccagcagaaccaggctctcctccacaaacatatcaacctgttcctgaaccctggtattttggaagctgttacgatgcagcacatttttatgaataactttcaactctgcagcgaaattaacgaaagggtggtgcaacatttcgttcactgcattgaaacccacggccgcaacgtgcagtatataaaatttctacagactattgtcaaagccgaaggtaaatttataaagaaatgtcaggacatggttatggctgaactcgtaaattccggtgaggacgttctcgttttctacaatgatagagcaagctttcagacgctgatccagatgatgcgctcagaaagggacagaatggacgaaaactctccattgatgtatcacatccatctggtcgagctccttgcagtgtgtacagagggaaaaaacgtgtataccgaaattaagtgcaattctttgttgccccttgatgacatcgtccgcgtagttactcacgaagactgtatccccgaggtaaagatcgcctatatcaacttcctcaatcactgctatgtcgatacggaagtggagatgaaggagatctacacatccaatcacatgtggaagttgttcgagaatttcctggtggatatatgcagggcttgcaacaacacatctgatcgaaagcacgctgatagtatcctggagaaatatgttacagaaatcgtgatgtcaatagtgacgacttttttcagcagccccttcagtgatcagagcaccaccctgcagactaggcaacctgtgtttgtgcagctgctgcagggcgtctttagagtgtaccattgtaactggctgatgccaagccagaaggcgtcggtcgaaagttgtattcgggtcctctctgacgtggctaagagcagagcaatagcgataccggtggacttggactcccaggttaataatctgtttctaaagagtcacagtatcgtccagaagactgcaatgaactggaggctcagtgcgcggaatgctgcccggcgagattcagtcttggcggcctccagggactatagaaatattatcgagagactccaggatattgtgagtgccttggaggaccgcctccggccactcgtccaggcagaactgtccgtgctggtagatgtgctgcaccgtccggagctcctgttcccagaaaacactgatgccagacgtaaatgcgagtctggtggattcatctgcaagttgattaagcacacaaagcagctcctcgaggaaaatgaagagaagctgtgtatcaaggtcctgcagaccctccgagaaatgatgaccaaagatagaggctatggcgagaaaggtgaagctttgaggcaggtcctggtcaaccgatactacgggaacgttcgcccatccgggcggcgggaaagtctgacttcctttggcaacgggcctctgtccgcaggagggcccggcaagcccgggggcggtgggggaggctcgggatcctcctcaatgagcaggggcgagatgtcactcgctgaggtccagtgccacctcgataaggagggcgccagtaacctagtaattgatctgataatgaacgcctcctccgacagagtcttccacgagtctattctgttggctattgctcttctggaagggggcaatacaacaattcagcattcatttttctgtcgtctcaccgaagacaaaaagtctgaaaaattcttcaaggtcttttatgaccgtatgaaggtagcccagcaggagattaaggccactgtgacagtgaacacttccgacctgggcaacaaaaagaaggatgacgaagtggacagggacgcaccctctcgtaagaaagccaaggaacctactactcagatcacagaggaggttagagatcaactgctagaagcatccgcagcaacccgcaaagcgtttactaccttccgtagagaagccgacccggacgaccactatcagcctggggaaggcacgcaggcaactgccgataaagccaaagatgaccttgaaatgtccgcagtaataacaataatgcagcccatcttgaggtttttacagctgctatgcgagaatcataatagagacctccagaatttcttgaggtgtcagaataataaaacaaactataatttggtgtgcgagacactgcagttcctggattgtatctgtggctccacaacaggtggactaggtctgctcggcctttacataaacgagaaaaacgtagcactcattaatcagactctggagagcctcacagagtactgccagggcccttgccatgaaaaccagaactgtattgctacacacgagtctaacggaatcgatatcatcacggccttgatcttgaatgatattaatcccctgggaaagaagagaatggacttggttctcgaattaaaaaataacgccagtaagctgctgctcgccatcatggaatccaggcacgattccgagaacgcagagagaatcctttataacatgcggcccaaggagctggtggaggtgattaaaaaggcctatatgcagggagaagttgagtttgaggacggtgagaatggagaggatggcgcagcaagtccaaggaacgtggggcataatatctacatcctggcacaccagctggccagacacaacaaagagctgcagagcatgctcaagccaggcggccaggtggatggtgacgaagctctcgaattttacgccaagcataccgcacagattgaaatcgtgagattggaccggacaatggagcagatagtttttcctgtcccttctatctgcgagttcctcactaaggagtcaaagctaagaatttattataccactgaacgggacgagcaaggatctaagattaatgatttcttcctgcgctccgaggacctgttcaacgagatgaactggcagaagaagctccgggcccagcccgtcctgtactggtgcgcaaggaatatgagcttttggagctcaatttcattcaaccttgccgttctgatgaatcttctcgtcgcttttttctatccgttcaaaggggtgcgcggcgggacgctcgagccacattggtccgggctgttgtggacggccatgctgatttctctggccatagtcatcgcgcttcccaaaccccacggaatcagagcactgatcgcttccaccattcttaggttaatcttttctgttggcttacagccgaccttattcctgctgggagcatttaacgtttgtaataaaatcatctttctgatgagctttgtgggtaattgcggcaccttcactcggggctaccgggccatggttctggacgtcgagtttttgtatcacctgctgtaccttgtcatctgtgctatgggcctgtttgtacatgaatttttttattccctgttacttttcgacctggtgtaccgggaagaaacactcctaaacgtcattaagtcagtgaccagaaacggacgttccatcatcttgaccgctgtcctcgctttaatcttggtgtacctcttcagcattgtcggttaccttttcttcaaggatgatttcatcctggaggtggaccgcctgcctaatgaaactgcagtgcctgaaaccggggagtccttggcctccgagtttcttttttccgatgtctgcagggtcgaaagtggcgaaaattgcagctcacccgccccacgcgaagaacttgtgccagccgaggagactgagcaggacaaggaacacacgtgcgagaccctcttgatgtgcatagtgaccgtgctgtctcatgggctacgatctgggggcggcgtcggcgatgtgctgcgaaaacctagcaaagaagaaccgctgttcgcagctagggtgatctacgatttattatttttctttatggtgatcataatcgtgctcaatttgatcttcggggtgatcattgatacgttcgccgacctgaggtccgaaaaacaaaaaaaagaagagatcctgaaaacgacgtgtttcatctgcggcctggaacgggataagttcgataataagaccgttaccttcgaggagcacattaaagaagaacacaatatgtggcactacctgtgtttcatcgtgctggtaaaggttaaagatagcactgaatacacgggcccggagagctatgttgccgaaatgatcaaggagcggaatctggactggtttccccggatgcgggccatgagcctcgtgagcagtgattctgaaggcgagcagaacgagctccgtaatcttcaggaaaaactcgagtctacaatgaaactcgtgaccaacctgtctggtcagcttagtgaattgaaggaccaaatgactgagcagcggaaacaaaaacagcggattggactgctaggacatcctccccacatgaatgtgaatccgcagcagcctgcctag

SEQ ID NO: 120598 - DNA, 2166 bp, Artificial Sequence
  Description of Artificial Sequence: Synthetic coding sequence
atgtctgataaaatgtcatcatttctccacatcggggatatatgctcgttgtacgctgaaggcagcacaaacggctttatttcaactctagggcttgtggacgataggtgtgtggtgcagccagaaactggtgatctgaataatccacctaaaaagtttcgagactgcctttttaagctttgtcccatgaatcgctatagtgcacagaaacagttctggaaagccgctaaacctggcgcgaactctaccaccgacgcagttttacttaataagctgcaccacgccgcagatctggaaaagaaacaaaacgagaccgagaatcggaagctgctcgggaccgtcatccaatacggaaacgtcattcagttgctgcatttgaagtctaacaagtatttgactgtgaataagagactcccagctctgctggagaagaatgccatgagggttactttagacgaagctggcaatgagggctcctggttttatatacagccgttttacaagctgaggtctatcggcgattctgtagtgataggcgacaaagtggtgctgaaccccgtgaacgctggacagccactgcatgcctcttctcaccagcttgtggataacccgggatgtaatgaggtgaattctgtgaactgcaacacctcgtggaaaatagtgctgtttatgaagtggagcgataataaagatgacattcttaagggcggggacgtagtgcggcttttccacgccgagcaagagaaattcctcacatgcgacgaacataggaagaagcagcatgtttttctgagaaccacaggtcgccagagcgccacatcagctaccagctccaaggccctgtgggaggtcgaggtggtccagcacgatccatgtagaggaggtgctggttattggaacagcctgtttcgcttcaaacaccttgcaaccggccattacttggccgctgaggttgaccccgattttgaggaggagtgcctggagtttcagccctctgtatgtaacaagataatctttctcatgagtttcgttggcaactgtggtacatttacccgggggtacagagcaatggtgctcgacgtcgagtttttataccacctgctctaccttgttatctgtgctatgggactgtttgtgcacgaatttttttatagtcttctcttgttcgacctggtatacagggaggaaacgctgctgaacgtgataaagtcagttacccgaaatggccgcagtattattttgacggccgtgctggctctcatattggtgtacctattttcgatcgtgggctatttgttcttcaaggatgatttcatcttagaggtggaccgtcttccaaacgagaccgcagtgcctgagaccggggaaagcctggcatccgagtttctgttttccgacgtctgtcgggtggaaagcggtgagaattgcagttctcccgcgccccgggaagagctggtaccagcagaagagaccgagcaggataaagagcatacctgtgaaacactgctcatgtgtattgtgactgtcctgtcccatgggctgaggagtggcggcggagtaggcgatgtgctacgcaaaccgagcaaagaggagccacttttcgcggctcgagttatttatgatcttctgttttttttcatggtgatcatcatcgtactgaaccttattttcggtgtgatcatcgatacatttgccgatctccgctctgagaaacaaaagaaggaagagattttgaagaccacatgttttatctgcggccttgaaagagataagttcgataataagacagtgacgtttgaagagcacatcaaagaagagcataacatgtggcactacttatgcttcatcgttctagtgaaggtaaaagactctactgagtataccggtccggagagttacgtggcagagatgatcaaggagcggaatctggattggtttccccgaatgagagctatgagtttagtgtcatctgattccgagggtgagcagaacgagctgcgcaatttgcaagagaaattggagagtacaatgaagctagtaaccaatctgagcggacagttgagcgaactgaaagaccagatgactgagcaaaggaagcaaaaacagagaatcggcctgctggggcatccccctcacatgaatgtgaatccacagcaacctgcctag

SEQ ID NO: 120599 - DNA, 546 bp, Artificial Sequence
  Description of Artificial Sequence: Synthetic coding sequence
atgacagagaaaatgtctagctttctatatatcggagatatagtctcgctgtatgcagagggtagcgtgaatggcttcatttccacactgggacttgtggacgatcggtgtgttgtgcatcctgaagccggtgacctagctaaccctcccaagaaatttagggattgcctattcaaagtttgcccaatgaatcggtattctgcccagaaacagtactggaaggcaaagcaggccaaacaggggaatcatacagaggccgcgttgctgaagaaacttcagcacgccgctgagttagaacagaaacaaaatgaaagtgagaacaagaagctgctcggagaaatagtgaagtattcgaacgttattcaattgctgcatattaagagcaacaaatacctgacagtcaacaaaaggctaccggcgctgctggagaaaaacgccatgagagtttccctcgatgccgctggaaatgagggcagttggttctatattcatcccttctggaagctgaggtccgagggtgacaatgatgcgagcttttggatctag

SEQ ID NO: 120600 - DNA, 8106 bp, Artificial Sequence
  Description of Artificial Sequence: Synthetic coding sequence
atgacggaaaaaatgtctagctttctgtatattggggacatcgtatctctgtacgcagagggctcggttaatggatttatctccaccctcggactggtggatgatcgatgtgtcgtccatcccgaggcaggggatctcgccaacccccccaagaagttcagagactgcctgtttaaagtgtgtccaatgaacagatattctgctcagaaacaatactggaaggctaagcaggctaaacaggggaaccatacagaggctgcactacttaagaagctgcagcacgccgccgaactggagcaaaaacagaatgagtccgaaaataaaaagctacttggcgagatcgtgaaatactccaacgttatccagctccttcatattaagtccaacaaatacctgacggtgaataagaggttgcccgccttgctggagaagaatgctatgcgtgtgtctttggatgctgccggcaacgagggtagttggttttacattcacccattttggaagctacgctctgagggggataatatcgtagtcggagacaaagtcgtgttgatgcccgtcaatgctggtcagcccctgcatgccagcaatatcgaactgctggacaatcctggatgtaaggaagtaaacgctgtgaactgcaacacctcatggaagattactttattcatgaagtacagttcctacagggaggacgtgcttaagggcggagatgtagtgaggctattccatgctgaacaagaaaaattcctgacttgtgacgagtatgagaagaaacagcatattttcctgcgtacaacgctccgtcagagcgccacaagtgctacctcatctaaggccctgtgggagatcgaagtagtccaccacgacccatgccggggaggggccggccagtggaattccctgtttcggtttaagcaccttgcaactggaaactacctggcggccgagctgaatcctgattatcgggatgcacaaaacgaaggcaaaaatgtgcgggacggagtaccaccgacttctaagaaaaaacgccaagctggggagaagataatgtatacgctggttagcgtgccccatggtaacgatattgcctctctgtttgagctggacgccacaacacttcagcgcgcagactgcctggtacctagaaacagctatgtcaggctgaggcacctctgcacgaacacatgggtaaccagtacttctattcctattgataccgatgaggaacgtcccgtcatgctaaagataggtacctgccagaccaaggaagacaaggaagccttcgcaatagtgagcgtgcctttgtccgaagtccgggatctggatttcgccaacgatgcaaacaaggtgctggccaccactgtgaaaaaactggagaatggcacaatcactcagaacgagagacggtttgttacaaagctcctggaggatctaatcttcttcgttgcagatgtgccaaacaatggacaggaggtcttagacgttgtcataactaagccaaatcgcgaacgtcagaagcttatgagagagcagaatatcctggcacaggtgttcgggatcttgaaagcacctttcaaagagaaagccggcgagggcagcatgttgcgtctggaggacctgggcgaccaaaggtatgccccttataagtacatgttgcgactttgttaccgcgttctcagacattcgcagcaagattatagaaagaaccaagaatacatcgccaagaacttttgtgtaatgcagtcgcagatcggctatgacatactcgcggaggatacaatcaccgcactgctacataataaccgtaagctgctggagaagcacattacagctaaagaaatcgagacttttgtgtccctcctccggaggaatcgggaaccaagatttttggactacctgtctgatctatgtgtttccaacacaacagcgatcccagtaactcaggagcttatctgtaagttcatgctgagccctggcaatgccgatattttgatacagaccaaggtcgtatctatgcaggcagataatccgatggagagttccattctgagtgacgatatagacgatgaggaagtgtggctctactggatcgacagtaacaaagaacctcacggcaaggctataagacatctggctcaggaggctaaggagggcacaaaagcggatctggaagtcctcacctactaccgctaccagctcaatctgttcgctagaatgtgtctggaccggcaatacctagcaattaaccagatttcaacacagctgagtgttgacctcattctccggtgcgtgagcgacgagagtttgccatttgatttacgcgcttcattttgtaggctcatgcttcacatgcatgttgacagagacccacaagagtccgtggttcccgtgaggtacgctcgtttgtggacagagatccctactaagattaccattcatgagtacgattcaattaccgacagcagccgtaacgatatgaagcgaaagtttgcactgactatggagtttgttgaagaatatttaaaggaggtggtaaaccagccatttccattcggcgataaagaaaagaataagctgacttttgaagtggttcacctggctaggaacttaatttattttggattctattccttctccgagttgttgcgcctgactcgtactctcctcgccattctggacatcgtgcaggctccaatgagctcttatttcgaaagactcagcaagttccaggacggcggcaacaatgtcatgagaacaattcacggggtcggtgaaatgatgactcagatggtattatctagaggttctatttttccaatgagtgtgcccgacgtcccaccgtccatccacccgagcaagcaggggagtcccacagagcacgaggatgtcactgtgatggatacgaagttgaagatcattgaaattctgcagtttatcctgtccgtcaggttagattatagaatctcatatatgctgagtatctacaagaaagaatttggagaggacaacgacaacgctgagacttcagcctccggaagcccagatacacttctcccctccgccatcgtacctgatatagatgagatcgccgcgcaagcggaaacaatgtttgccggacggaaagaaaaaaaccccgtgcagctggacgatgaaggcggccgcacgttcctcagggtcctcattcacctgatcatgcatgactatccccctctgttaagtggggcactgcagcttctgtttaaacatttcagccaaagggctgaagttctccaagcgttcaaacaggtgcaattattggtctctaaccaagatgtggacaactacaaacaaataaaggccgatctagaccagttgagattgaccgtggaaaaatctgagttatgggtagagaaaagctcaaattacgaaaacggagaaattggcgaaagtcaggtcaaaggcggggaggaaccaatcgaggagtctaacatattgagcccagtgcaggatgggactaagaagcctcagattgattccaataaatctaataattaccggattgttaaggaaattcttatccgtctgtcaaagttgtgtgttcagaataagaaatgtaggaatcaacaccagagactgctgaaaaacatgggcgcacacagtgtagttctggacctgctccagattccctacgagaagaatgatgaaaaaatgaatgaagtgatgaatttagcccatacatttctgcagaacttttgccgggggaaccctcaaaatcaagtcttactccataagcacctgaatttgttcctcacacctggtttgctggaagccgaaaccatgcgccatatttttatgaacaattaccacctgtgtaatgagatatcggaacgggtggtccagcacttcgtccactgtattgagacccacggcagacacgtcgaatacctgagattcttacagaccattgtgaaggccgatggcaaatacgtcaaaaagtgccaagacatggtgatgaccgaactgatcaatggcggggaagacgttttgatattctataatgaccgtgccagcttcccgatactcctacatatgatgtgctctgaacgggacaggggcgacgagtctggacccctggcctaccatataacactcgtcgagcttttagctgcttgcaccgaaggaaaaaatgtctataccgagattaagtgtaatagcctcttaccgcttgacgatattgtgcgggtggtgacacacgatgattgcattccggaagtgaaaatagcctacgtaaattttgtgaaccactgttacgtcgacaccgaggttgaaatgaaagagatctacacaagtaaccatatttggaaattgtttgagaacttcctggtggacatggctcgcgtgtgtaacaccaccaccgatagaaaacatgcggacatcttccttgaaaaatgtgtgactgagtcgataatgaatattgtgtctgggttctttaactcacctttctccgataactccacttctcttcagacacaccaacccgtattcatccagctgctgcagagcgcgttccggatatacaattgtacctggcctaacccagcacagaaagcttccgtggaatcatgtatacggactttggcagaagtagctaagaaccgcggtattgcaatccccgtggacctcgactcccaagttaatactctgttcatgaaaagtcacagtaacatggtgcagcgggccgctatggggtggaggctgtcggctcggtctggaccccggttcaaggaagctctgggaggcccggcgtgggactacaggaacatcatcgagaagctgcaggacgtggtcgcatcccttgagcaccaattttcacctatgatgcaagcagagttcagtgtcttggtggatgtgctgtactcccctgaactcctgttcccagagggatcagatgcaagaatccgctgtggcgcttttatgagcaaactcattaatcacaccaaaaaattgatggagaaggaggaaaaattgtgcatcaagatcctgcagactctccgcgaaatgctcgagaagaaggattctttcgtggaggagggcaacacactgaggaaaattcttttgaaccggtattttaagggagactattcaatcggtgtgaacgggcacttatccggggcctactctaaaactgctcaagtcgggggaagcttctctgggcaagattctgataagatgggtattagtatgtctgatattcaatgtctgctcgataaagagggagcctcagaactcgttattgacgtaatagtcaataccaagaacgacaggatcttcagtgaaggcatatttctaggaatcgccctgctagagggcggaaatactcaaactcagtactcattctatcagcagcttcacgagcagaagaaatcggagaagttttttaaagtcttgtacgataggatgaaagccgcccagaaagagatccggagcaccgtgaccgtgaatacgatagatctcgggaataagaagcgcgacgacgacaatgagcttatgacttctggacccaggatgcgggtgcgcgactcaactctccatttgaaggaggggatgaaagggcagctgacagaggcgagctctgctactagcaaggcatactgtgtctatcggcgtgagatggatccagagatcgatattatgtgcacagggccagaggccggcaatacggaggagaagtctgcagaagaggtgacaatgtctcctgcgattgccatcatgcagcccatattgcggtttctccagctgctctgcgaaaatcataaccgggagttacagaactttctacgcaaccaaaacaacaaaaccaattataatttggtgtgcgaaacactccagttcctcgactgtatttgcgggtccacgaccggaggactaggtttacttggcctatatattaacgaaaaaaacgtggccctagtgaaccaaaatcttgagtctttgactgagtattgccaaggaccatgtcacgaaaaccaaacttgcatcgcgacgcacgagtcaaacggaatcgatataatcattgctctaatactgaacgatattaaccccctcgggaagtaccgaatggatctcgtgctccaattaaagaataacgcgtcgaaattgctgcttgccatcatggagagtaggcatgactccgagaacgctgaaaggatcttatttaacatgcggcctcgcgaactggtggatgtgatgaagaacgcttataaccaggggttagaatgtgaccatggagacgacgaaggcggggacgacggagtgagccccaaggacgtcggacataatatttacatcttagcacaccagcttgccaggcataataagctgctacagcaaatgctcaaaccggggagtgatcctgatgaaggagacgaggctctcaagtattacgcgaatcataccgctcagatagagatcgttaggcacgatcgcactatggagcagatcgtcttcccagtgcctaacatttgtgagtatctcactagagagagcaagtgccgggtcttcaataccaccgaacgggatgaacagggctccaaagtcaatgacttctttcagcagactgaagatctgtataacgaaatgaaatggcagaaaaagatcaggaataatccggccctgttctggttcagtagacacattagcctgtggggttcaatctcattcaatctggccgtctttattaacttggccgtggctctgttttatccttttggcgatgatggcgatgaaggaactctgtctcccctgttttccgtgctgctctggattgccgtggccatctgcacttccatgctgtttttcttctccaagcccgtggggattcggccttttttggttagcataatgttgagatccatctataccataggcctcggccctacactgatcctcctgggggctgcaaacctctgtaacaagattgtgttcttagtctcttttgtcggcaatcgtgggaccttcacccgggggtacagagctgttattctggacatggcattcttgtatcacgttgcctacgtgttggtgtgtatgctcggcttatttgtgcatgagttcttttattcgtttctgctgtttgaccttgtgtatagggaggagactctcctcaatgtcatcaagtctgttacacgtaacggaaggagcataatcttaaccgccgtgctcgccctcatcctggtctacctattctccatcatcggattcctgtttttgaaggacgacttcacgatggaggtggataggctgaagaatagaacccctgttaccggatctcatcaggttccaactatgactctgacaaccatgatggaagcatgcgccaaagagaactgttctcccaccatacccgccagtaataccgccgacgaggaatacgaggacggcatagaaagaacctgcgatacactgcttatgtgcatcgtaacagttctaaatcagggacttaggaatggcggtggggtgggcgatgttttgagacgtcctagtaaagacgagccactgtttgctgcaagagtggtttacgacttgctcttttactttatcgtcatcattattgttctgaaccttatattcggtgtcattattgatactttcgctgatctcaggtccgagaagcaaaagaaggaagaaatcctcaagacgacatgtttcatctgtggactcgaaagggacaagtttgacaataagaccgtgagcttcgaggaacacatcaagtcggaacataatatgtggcactatctgtatttcatcgtgctggtcaaggtcaaggaccctaccgagtataccggacctgaatcctatgtagcccagatgatcgtagagaaaaatctggactggttccctaggatgcgcgctatgagcctggtctccaacgaaggcgattctgaacaaaacgagatccggagtctgcaggaaaaactggagtctacaatgtccctggtgaagcagttaagcgggcagttggccgagctgaaggagcagatgaccgaacagcgcaagaataagcaaaggctgggtttcctgggatccaacactccccacgtgaaccaccacatgcccccacactag

SEQ ID NO: 120601 - DNA, 8016 bp, Artificial Sequence
  Description of Artificial Sequence: Synthetic coding sequence
atgtctgagatgagctcgtttctgcacatcggggacatcgtgtccctgtacgcggagggaagcgtaaacgggttcattagcacccttgggctcgtagacgacaggtgcgtcgttgaaccagcagccggagatttagacaatccccctaagaagttccgagactgtctgtttaaagtgtgcccaatgaacaggtattcggcccagaagcagtattggaaagcaaagcaaacaaaacaagacaaggagaagattgccgacgtagtgctcctgcagaaactacagcacgccgctcagatggaacagaaacagaatgataccgagaataaaaaggtgcacggtgacgtggtaaagtacggctcagttatacagctgctgcacatgaagtctaataaatacctgacggtgaataagagattgcctgcccttctggagaaaaacgccatgagggttactcttgacgcaacggggaacgagggaagctggttgttcatacaacctttttggaaacttcggagcaacggtgacaatgtggtggtgggcgacaaggttatcctgaatccggtcaatgcaggtcaacctctccacgcctcgaattacgaattgtctgataacgccggatgtaaagaggtcaattcagtgaattgtaacacttcctggaagattaatctgttcatgcagttcagggatcatctggaagaggtcctcaaaggaggagacgtagtccgcctgttccacgcggaacaggagaagtttctaacctgcgacgagtacaagggcaagctgcaagttttcctgaggaccaccctccgacagtcagctaccagcgcaacctccagcaatgctctgtgggaagtagaggtagtccatcatgatccctgcagagggggtgccggacattggaacggcctctataggttcaaacacctcgcaaccgggaactacctggccgctgaggagaacccctcgtataagggggacgcaagtgatcctaaggccgcagggatgggagctcagggtaggacaggtaggcggaatgccggggaaaagattaagtactgcctggtggctgtaccgcacggaaatgacatcgcaagtctgttcgagttagatcccaccacattgcaaaaaactgatagcttcgttcctagaaatagctacgtgcgcttgcgtcacctctgtactaacacatggattcagagtacgaatgtgcccatcgatattgaagaggaacggccgatcagactaatgctagggacatgccctaccaaagaagacaaggaggccttcgccattgtgagcgttccagtgagcgagattcgtgatttagatttcgccaacgatgcctcttctatgctcgctagtgctgtcgagaagctcaatgagggtttcatcagccagaacgatcggcggttcgtgatccagttgttggaagatcttgttttctttgtctcagacgttcctaacaacgggcagaatgtgctggatattatggtgacgaagcccaaccgcgaaagacagaaactgatgcgggagcagaatatacttaagcaggtcttcggcatcctgaaggccccctttagagaaaagggcggtgagggcccgctcgtgcgcctggaagaactcagcgatcagaagaatgctccttaccagcatatgttcaggctctgctatcgcgtgctacggcattctcaggaggattacaggaaaaaccaggaacacatcgcaaagcagttcggtatgatgcagagtcaaatcggatacgacatactagccgaggataccattaccgctctgttacacaataatcgcaaactgttggagaaacatattactaaaactgaagtcgagactttcgtgtctctcgtgagaaaaaacagggaaccccgttttttggattacttgagtgacctgtgtgtgagcaaccatattgcaattccggtgactcaggaactgatctgcaaatgtgtgctggaccccaagaatagcgatattcttatcagaacagagctgcggccagtgaaagagatggcacaatctcatgagtatctctccattgaatatagtgaagaggaggtgtggcttacatggactgataagaataatgaacaccacgagaaatctgtgcggcagctggctcaggaagcacgcgctggaaatgctcatgacgaaaacgtcctgtcttattaccgctatcagcttaagctctttgcacggatgtgtttggaccggcaatacctggcaatcgatgagatttcacagcagctgggggtggatttaatcttcctgtgcatggctgatgagatgctgccattcgacctgcgcgccagcttttgccatcttatgttgcacgtccatgtggatagggatccacaggaactcgtgaccccagtgaagttcgcccgactatggacagagataccaacagcaattaccataaaagactacgactccaatctaaatgcatcccgcgatgataagaagaataaatttgctaataccatggagttcgtggaagattatctaaataacgtagtctccgaagctgtaccattcgctaatgaggaaaagaacaagctcaccttcgaggtcgtttctcttgctcataacctgatctactttggcttctacagtttctcagagctgctcaggctgaccaggaccctgctcggtatcatcgactgcgtccagggtcctcccgccatgcttcaagcatacgaggaccctggtggcaaaaacgtgcgccggtccatccaaggggtggggcacatgatgagcaccatggtactgagtcgcaagcagtcggttttcagtgcgccctctctgtccgctggcgcctcagcagccgagcccctggacaggtctaaatttgaggagaacgaggacattgtggtcatggagactaagctaaagatacttgaaattctgcaattcatactgaacgtgcgacttgactaccgcattagctacctcctatccgtgtttaagaaggagttcgtcgaggtttttcctatgcaggactcaggagccgacgggaccgcacccgccttcgactcaactacagccaatatgaatctcgatcggattggggagcaggctgaagcaatgttcggagtcggcaaaacaagcagcatgcttgaagtggacgacgaaggcggccggatgttcctcagagtgctgattcaccttacaatgcacgattacgctccgcttgtttccggtgcgctacaactgctgtttaaacacttcagccagcgccaagaagccatgcacacattcaagcaggtgcaactactcatttccgcccaggacgtggagaactacaaggtgatcaagagtgagcttgaccgtctccggaccatggtggaaaaatccgaactttgggtggacaaaaaggggagtggtaaaggagaggaagtggaagctggcgcagctaaggacaagaaggaacggcccacagacgaagaaggcttcttgcacccgcccggcgaaaaatcaagtgagaattatcagatcgtgaagggcatactcgaacgactgaataaaatgtgtggggttggggaacagatgcgcaagaagcaacagcgcctgttaaagaacatggatgcacataaagtgatgctagatctcctgcagataccatatgacaaaggggacgctaagatgatggagatcctccgctatacccatcagtttttgcaaaaattttgtgcaggcaaccccgggaaccaggcactgctccataagcatctgcacctgttcctgactccgggcctcttagaggcagaaaccatgcagcacattttcctgaacaactaccagctgtgcagtgagatatcggaacccgtcctgcagcacttcgttcatctgctcgccacacatgggcgccatgtacagtatcttgatttcctgcatacagtgatcaaggccgagggaaaatatgtcaagaagtgccaagatatgatcatgacagagctgacaaatgcaggtgatgatgtggtggttttttacaacgacaaggccagccttgctcacctgctggacatgatgaaggcggcaagggatggagtcgaggatcattcacccttaatgtatcatatctctctggtggacctgttagccgcatgtgctgaaggtaagaatgtgtataccgagattaagtgcacatccttactgccacttgaagatgttgtgtccgtggttacacacgaggactgtatcaccgaagtaaagatggcctacgtgaacttcgtgaatcactgttatgtggacactgaggtcgagatgaaagagatttacaccagtaaccatatctggactttatttgagaattttacgttggacatggccagggtgtgtagcaaacgggagaagcgagtggcagatccgaccctcgaaaagtatgtgctctcagtggtgctcgataccatcaatgcctttttcagcagcccatttagcgagaactcaacctcgctgcagacccatcagacgatcgtagttcaactgctgcagagtactacccgattgctggagtgcccatggttgcagcaacaacacaaggggtcagtggaggcctgtatacgcactttagctatggtagcaaaaggacgagcaatactgctgccaatggatcttgacgcacacattagttctatgttatcttcaggggcctcctgtgcagcagctgctcagaggaacgcgagtagctacaaggctacaactcgggcattcccaagggtgacccccacagccaaccagtgggactacaaaaacattatcgagaagctgcaagacataattaccgcactagaggaaaggttaaaacctctcgtccaggccgagctatctgttctagtggatgtgttacattggcctgaactcctcttcctggaaggcagtgaagcatatcagagatgcgagtcagggggattcctttcgaagcttattcagcacacaaaggacctgatggagtccgaggaaaagctgtgcatcaaggtgttgcgtacattgcagcagatgctgctgaaaaagaccaaatacggcgaccgcggaaatcagctaaggaaaatgctcctgcagaattacttgcagaacaggaaatctacgagtcggggagacctacctgatccgattggaactggactggacccggactggagcgcaatagcggccacccagtgcagactggacaaagagggcgccactaagttagtgtgcgatctaatcactagcaccaaaaacgagaagatcttccaggagtccattggactggcaatacacctccttgatggtggtaatactgagatacagaaatctttccataatttaatgatgtctgataaaaaatctgaaagattttttaaggtgttgcatgacagaatgaagcgcgcccagcaggagactaaatctaccgtggccgtcaacatgaacgacctaggtagtcagccccatgaggatagagagccggtcgatcccactacgaaaggtcgtgtggcctctttttctatccccggatcgagctccaggtacagtttggggccttctctgcggcgcgggcacgaagtttcagaacgtgtgcaatccagcgagatgggtacatcagtgcttattatgcagcctatactgagattcctgcagctgctgtgcgagaaccacaaccgggacctgcagaattttcttagatgccagaacaataaaactaattataacctggtgtgcgaaacactgcagttcctagacataatgtgcggaagcactacagggggcttagggctgctgggcctgtatataaatgaagacaacgtcggcttggtgatccagacactagaaactctgaccgagtactgtcagggcccctgccatgaaaaccaaacctgtatcgtgacccacgaatcaaacgggattgatataatcacagccctgatactaaacgacatatcacccttgtgcaaatatcgcatggaccttgtcttacagcttaaggacaatgcatctaaacttcttctggcactgatggaaagccggcatgattccgaaaatgccgaacggattctgatctctctgcgacctcaggaactcgtggatgttatcaagaaagcttatcttcaggaggaagagagggagaactccgaagtgtccccacgggaagtgggacataacatctatattctcgccttgcagctcagtcggcacaataagcaactccagcatctcttgaagccagtcaaaagaattcaagaagaggaggccgaaggaatttcttcaatgctgtctctgaacaataagcagcttagccaaatgctcaagagctccgccccagcccaggaggaagaggaggatcccttggcttactatgaaaaccataccagccagattgaaatcgtccgccaagaccgatccatggagcagatagtgtttccggttcccggtatctgccaattcctcaccgaggaaaccaaacatcgtttgtttacaaccactgaacaggacgaacagggttccaaggtgtctgactttttcgaccagtcttcgtttctccacaatgagatggagtggcagagaaaactcagaagcatgcccctcatctattggttctcccggagaatgactctttgggggtccatttcgttcaacctcgctgttttcatcaatatcatcatcgctttcttctacccgtatatggagggagcatccacaggcgtgctcgatagccctctgatctcccttctcttttggattttgatttgcttttccatcgctgccctgtttaccaagcgatattccatacggcctctgatagtcgccctcatccttcgcagcatctactacttaggcataggtcccacattgaatatcctgggagctttaaacctgaccaacaaaattgtctttgtggtatcattcgtgggcaacaggggcactttcatcaggggctataaggcaatggtaatggacatggaatttctttaccatgtaggatacatcttgacctcagtgttaggcctgttcgcccacgaactcttttacagcatcctgctattcgacctgatctatagagaggaaaccctctttaatgtgatcaaaagtgtgactagaaacggtagaagcatccttcttactgccttactcgcacttatcctggtctatttattcagcatagtcgggttccttttcttgaaggatgacttcatattggaggtcgaccgcctaccaaataaccattccactgcaagccccttgggcatgccacacggggctgccgcctttgttgacacctgctctggggataagatggattgtgtgtcaggcctctctgttccagaagtgctagaggaagatagagagctcgattccactgagcgtgcctgcgataccctgcttatgtgcattgtgactgttatgaaccatggcttgcgaaacggcggaggggtaggtgacatcctgaggaagccttcgaaggatgagtcactgttcccagctagggtagtatatgacctactgtttttttttattgtaatcattatcgttctgaatctcatcttcggcgttatcatcgacacctttgccgacctgcgcagtgagaaacagaaaaaggaggaaatcctcaaaaccacatgctttatctgtggactcgaaagggacaagttcgataataaaaccgtctcattcgaagaacacatcaagctggagcacaacatgtggaattacctctactttattgtgctggtgcgtgtgaagaataaaaccgactatacagggccagagtcttacgtggcacagatgatcaaaaataagaaccttgattggtttcccagaatgagagccatgtctctcgtctccaacgagggtgagggggaacagaatgagatccggattcttcaagataaactgaatagcacaatgaagttggttagtcacctgacagcgcagctaaacgaactcaaagaacagatgactgagcagaggaagaggcgtcaacgtctgggcttcgtcgatgtccaaaactgcatttcaaggtag

SEQ ID NO: 120602 - DNA, 1326 bp, Artificial Sequence
  Description of Artificial Sequence: Synthetic coding sequence
atgtgtgtgtgtcagacgatggaggtgggccagtatgggaagaatgcatcgagagcaggcgaccggggggtcctgttggagcccttcattcaccaggtgggcgggcattccagtatgatgagatacgacgatcatacggtgtgtaaaccactgatatctcgcgagcaaaggttctacgaaagcctgcctccggagatgaaggaattcactcccgaatataagggcgttgtgagcgtgtgtttcgagggtgattccgatggatacatcaatcttgtagcctacccatacgtcgaatctgaaactgtggagcaggatgataccacggagagagagcagcctcgaaggaaacactcccggagatccctacacagatcaggctctggatcagaccataaagaggagaaggccagccttagcctggagaccagtgaatcctctcaagaggctaagagtcccaaggtggaactgcacagccactccgaagtcccttttcaaatgctagacggaaattccggactgagcagcgagaagatctctcacaacccatggtcgctgaggtgtcacaagcaacaacttagtaggatgcgcagcgagagcaaagaccgtaagctctacaaatttttgctcctcgagaatgttgtccatcattttaagtacccttgcgtcctggatttgaaaatgggtaccagacagcacggggatgacgcatctgccgagaaggcagcccgccagatgcgaaaatgtgaacagagtacctctgccacgctaggcgtaagagtctgcggaatgcaggtttatcagctggacaccggccactatctgtgccgtaataaatattacggacgaggcctgtccatagagggatttcgcaatgccctctaccagtacctgcataatggtcttgacctgaggagggacctcttcgagcctattttgtctaagctccggggactgaaggccgtacttgaaaggcaggctagttacagattttactcttcgagcctgctcgttatttatgatggtaaggaatgtcgcgccgaatcatgcctggatcggagaagcgaaatgaggctgaaacacctggacatggtgttgccggaagtggcctcatcttgtggtccaagtacatccccaagcaacacgtctccggaggcgggtccttcgtcacagcccaaggtggatgtacgaatgatcgatttcgctcactctacgtttaaagggtttagggacgacccaacagtccatgatgggcccgaccgaggctacgtctttgggctagaaaacttgatcagtatcatggaacaaatgcgagacgagaatcagtag

SEQ ID NO: 120603 - DNA, 831 bp, Artificial Sequence
  Description of Artificial Sequence: Synthetic coding sequence
atgttggacggcaattctggcctgagctctgagaagatatcacacaatccctggagcctgcggtgccacaaacaacaactgagtagaatgcgctcagaatccaaggaccggaagctgtacaagttcctgctactggagaacgtcgtccaccacttcaaatatccatgtgtgctggatctgaaaatgggcactcgccagcacggcgatgatgcaagtgctgagaaggctgcgcgccagatgaggaagtgtgaacagtccacctccgcaacattaggggtccgcgtgtgcggcatgcaagtttatcagctggatactgggcactacctgtgccggaacaaatactatggtagaggactctcaatagagggcttccgcaacgcgctgtaccagtacttgcacaatgggctggatctcaggagggatctgtttgagcccatcctgtcgaaactgagggggctgaaggcggtcttagagagacaggcgtcttacaggttttatagtagctcgttactcgtgatctatgacggcaaggagtgtcgagcagaatcatgtttagacaggcgctctgagatgcgcctgaaacatttggacatggtgttacctgaagtggcctcctcatgcggtccgtctacatcaccaagcaacacatcgcccgaagcaggaccatcctcccagccaaaagttgacgtgcgcatgatagattttgcccactcaacctttaaaggctttagggatgatcctacagtccatgatggcccagatagaggctatgttttcgggcttgagaacttaatctccatcatggaacaaatgcgagacgagaaccaatag

SEQ ID NO: 120604 - DNA, 831 bp, Artificial Sequence
  Description of Artificial Sequence: Synthetic coding sequence
atgctagacggcaacagtggcttgtccagcgagaagatctcacataacccctggagcctcagatgtcataagcaacagttgtcccgaatgaggagcgagtcaaaggataggaaactgtacaagttcctgctcctggagaatgtcgttcatcatttcaagtacccctgcgtgctcgacctgaagatgggcacgcgacagcacggtgacgacgcgtccgccgaaaaggccgctcggcagatgagaaagtgcgaacagagtacttctgccaccttaggcgtcagggtgtgcggaatgcaggtgtatcagctggacacagggcattacctgtgtcgaaacaaatactatgggagaggcctgtctatcgaaggcttcagaaatgctctttaccagtacttgcacaacgggctggatcttagaagagatctgttcgaaccaatcttgtctaaacttaggggtctcaaggctgtgctcgaacgacaggccagctatcgattttattctagctccctgctggtgatatatgatggcaaagagtgccgagccgagagctgtctggaccgccgaagcgagatgcgtctgaagcatctggacatggtgctcccagaggtcgcctctagctgtggcccatcaacttccccctctaacaccagcccggaagctggtcctagcagccaaccaaaggtggatgtgcggatgatagacttcgcgcattccacttttaaaggttttagggatgacccgactgtacatgatgggcccgatcgggggtatgtgtttgggctcgaaaatcttatttctattatggaacaaatgagggatgaaaatcagtag

SEQ ID NO: 120605 - DNA, 1281 bp, Artificial Sequence
  Description of Artificial Sequence: Synthetic coding sequence
atgagtcccgctttcagggcgatggacgtggaaccacgcgccaagggcgtgctgttagagcctttcgttcaccaagtgggggggcatagctgcgttctgcgcttcaacgaaaccacactgtgtaagcctctcgtcccacgcgagcatcagttttacgaaacgttgcctgctgaaatgcgtaaattcaccccacagtataagggggtggtgagcgtgcggttcgaggaggatgaggatagaaacctctgtcttatagcgtatccactcaagggcgaccacgggatcgtagacatagtggacaattctgattgcgagccaaaatctaaattgctgcgttggaccacaaacaaaaaacaccacgtgctggagactgaaaaaacaccaaaggattgggttcgccaacaccggaaagaggagaagatgaagagccacaaactcgaggaagagtttgaatggcttaaaaagtctgaagtgctctattacaccgttgagaagaagggaaacatctcaagccagcttaaacattacaatccatggagcatgaaatgccatcaacaacagctccagaggatgaaggaaaatgcgaagcatcgaaaccagtacaagttcatacttctcgagaacctaacatcgcgctatgaagtaccatgtgtactggatctcaagatgggcaccagacagcatggcgacgatgcctcagaagagaaagccgcaaatcaaatcagaaagtgccagcagtcaacctctgccgtaattggagtgcgcgtctgtgggatgcaggtgtaccaagcgggttctggacagctcatgttcatgaacaagtaccatggccgcaagctcagtgtgcagggcttcaaggaggctttgttccaattttttcataacggtcggtatttaaggagggagcttctggggccggttctcaagaaattgacggagctgaaagccgtgctcgagcggcaggaatcctataggttctattcctcttcgctgctcgtgatctatgatggaaaggagcgacccgaggtggtcctggatagcgacgcagaggatctcgaagacctgtctgaagagtccgccgacgagtcggccggcgcctacgcctacaaacccataggcgcgtccagtgtcgacgtgaggatgatagacttcgcccacacaacttgcagactgtatggggaggacaccgtggtgcacgaaggccaggatgctgggtacatttttggcttgcagtccttgatcgacattgtaactgagatttccgaggaatcaggcgagtag

SEQ ID NO: 120606 - DNA, 294 bp, Artificial Sequence
  Description of Artificial Sequence: Synthetic coding sequence
atgtcgcccgcatttcgggccatggatgttgagccccgggcgaagggggtccttctggagccattcgtgcaccaggttggggggcattcatgtgtgcttagatttaacgagacaaccctctgcaagccattagttccaagagagcatcaattctacgagacattaccagcagagatgagaaaattcacacctcagtataaggggcagtcgcaaaggccgttggtctcatggccttcactgccgcactttttcccctggtccttccctctgtggcctcaaggatctgtagcgtag

SEQ ID NO: 120607 - DNA, 294 bp, Artificial Sequence
  Description of Artificial Sequence: Synthetic coding sequence
atgagtccagcctttcgggctatggatgtcgagccacgggccaagggggttttgctcgaaccattcgtccaccaggtgggtgggcattcttgcgtgctgcgttttaacgagacgaccctttgcaagccattggtccctagagagcaccagttttatgaaaccttacctgccgagatgcgcaagtttactcctcaatataagggtcaatcccagcggccgctcgtctcttggccttccctccctcactttttcccctggagtttccctctgtggcctcagggttcagtggcttag

SEQ ID NO: 120608 - DNA, 558 bp, Artificial Sequence
  Description of Artificial Sequence: Synthetic coding sequence
atgagtctgaacctgccggaggcatcactgctctcccgcgcctcatggccagaacaagctaaggagcctaggcgcgagggtcacactgataaacagcagacagaggacgtgctagcggcaggcttaagatgcttgcctcacctaccagccatctgcgctcggagaatgtctccggcatttcgagccatggacgtggagccacgcgctaagggcgtccttctggagccctttgttcaccaggtggggggccattcatgcgtattgagatttaacgaaacaactctctgcaaacccctggtgcccagagagcaccagttttacgagaccctgccagccgagatgaggaaattcaccccccagtacaaaggtaaatcacagctgctggaaggtttgcctcactggaggggggacgttagagaccggggccacggcagaccctggcaaccaagcctcgaaccatcgcttcctcccactttgtgttttccaagcctcagcagcttctcgtccagctggccctccgctcagcacctgaccccttctgtgttcaatccatggtag

SEQ ID NO: 120609 - DNA, 264 bp, Artificial Sequence
  Description of Artificial Sequence: Synthetic coding sequence
atgtcacctgccttccgtgctatggacgtggaaccccgcgccaagggcgtcctgctggagcctttcgtgcaccaggtaggaggccacagctgtgtactgcggttcaacgagactacgttatgcaagccccttgtacctcgtgagcaccagttctacgagacgctcccggccgagatgcggaaattcaccccacagtacaaaggcgatattagcagccatcagcacgggggcgtgtttgtaggggaatggggatccctgctgtag

SEQ ID NO: 120610 - DNA, 567 bp, Artificial Sequence
  Description of Artificial Sequence: Synthetic coding sequence
atgaacctgtgtcagtctcccttccaagaaggatgccagtcgttgctggcatcgtggcctgagcaggccaaagagcccagaagagaaggccatacggacaagcagcaaacagaagacgtgttagccgctggcctcaggtgtctgcctcatctgccggcaatctgcgccagacggatgagccctgccttcagagctatggacgtggagcctagggccaaaggcgtactgttagagccttttgttcatcaggtaggcggacatagctgcgtgctgagattcaatgagactaccctgtgtaagcccctggtgccgcgtgaacaccagttctacgagacgcttcccgctgagatgcggaagtttactccccagtacaaggggaaaagccaattgctcgaggggcttccacattggcgcggagacgtgcgcgacagaggccatggccggccgtggcagcccagcctggaaccaagcctgccccctactctgtgcttcccaagcctgagttcctttagctccagttggccatccgctcagcatctgacccccagtgtgttcaatccctggtag

SEQ ID NO: 120611 - DNA, 1233 bp, Artificial Sequence
  Description of Artificial Sequence: Synthetic coding sequence
atggttgtgcaaaattcagcggacgctggggacatgagagccggagtccagcttgagccctttctccaccaagttggaggccacatgagtgtcatgaagtacgacgaacatacagtttgcaaaccattggtatcgagagagcagcggttctacgaatcccttccccttgccatgaagcggtttaccccgcaatacaagggcacagtcaccgtgcatctatggaaagactctactgggcatctctctctggtggccaatcccgtaaaggagtctcaggaacctttcaaggtgagcaccgaatccgccgcggtggccatatggcagacgctgcagcaaactaccggttctaatggttccgactgtacactcgctcaatggccacatgcgcaactcgccagaagcccaaaggagtccccagccaaggctctgttgcgctctgaacctcaccttaatacccctgctttctctctggtggaggacactaatggtaaccaggtggagcgaaagtcctttaacccatgggggcttcagtgccatcaggcccatctcactagactgtgctccgagtaccctgagaacaagcggcatcgcttccttcttctggaaaacgtagtgtctcagtatactcatccgtgtgtgctcgacctaaagatgggcacgcgtcagcatggcgacgatgcgtcagaggagaagaaggcacgtcatatgcgaaaatgtgcccagagcacaagcgcgtgtctgggggtccggatatgcggaatgcaggtgtaccagaccgacaaaaaatactttttgtgtaaagacaaatactacgggaggaaactgagcgtcgagggtttccgccaagcactgtatcagttcctccataatggcagccatctccgtagggagctgcttgaacccattctccatcagttaagggccctgctatctgtgatcagatcccagtcaagctacagattctattcatcatccctgctggtgatctacgacgggcaggaaccccccgagcgcgcaccaggctccccccatcctcatgaggccccgcaggccgctcacggctcctcccccgggggcctcactaaggtggacattagaatgattgacttcgcgcacactacatataagggctactggaatgaacacaccacttacgacggccctgaccccgggtatatcttcggactagaaaatctcatccgaatcttgcaagacatccaggagggagagtag

SEQ ID NO: 120612 - DNA, 1233 bp, Artificial Sequence
  Description of Artificial Sequence: Synthetic coding sequence
atggtggttcagaatagcgccgatgctggcgatatgagggcaggtgttcagcttgaaccatttctccaccaggttgggggacatatgagtgttatgaagtatgacgagcataccgtgtgcaagccactcgtatctcgcgaacagagattctatgagagtctgccattggccatgaaacgtttcacaccgcagtacaaaggtaccgtgactgtccatctgtggaaggattcaacaggccacttgtccctggtagcaaatccagttaaggagagtcaggagcctttcaaagtcagcactgaatctgctgctgtggccatctggcagaccctacagcaaaccactggctctaacgggagcgactgtacactggcccagtggcctcacgcacagcttgccaggtccccaaaggagagccctgccaaggccctattaagatcagagcctcaccttaacactccagccttcagtctcgttgaagacactaacggaaaccaggttgagcggaagagcttcaacccttggggcttacagtgtcaccaggctcatcttacgcgtctctgttcggaatatcctgagaacaaacgacacagattcttgctgcttgaaaatgtcgtgagccagtatactcatccgtgcgttcttgacttgaaaatgggaaccaggcagcacggtgatgatgctagcgaggaaaaaaaggctaggcacatgcggaagtgcgctcagagcacctctgcttgtctcggagtacggatctgtggtatgcaggtttatcaaacagataagaagtacttcttgtgcaaggacaagtactatggccggaagctgtctgtcgaaggcttcagacaggcactttatcaattcctccataatggctcacacctgcggcgagaattgctagagcctatcctccaccagcttcgggcattactgtctgtgattcgcagccagagctcctatagattctattcatcttcactgctggtaatctacgatggccaggagccacctgagagggccccagggagcccacatcctcacgaggccccacaggccgctcacgggtcctctcccgggggcctaaccaaagtggacattcgaatgattgattttgcccataccacatacaaaggatattggaatgagcacacgacgtacgacggccctgatcccgggtatatcttcggactggagaatttgattaggattcttcaagacatacaggagggtgagtag

SEQ ID NO: 120613 - DNA, 1080 bp, Artificial Sequence
  Description of Artificial Sequence: Synthetic coding sequence
atggcaccaatgggcattagattgagtccattaggcgtcgcagtgttttgcttactgggtctcggggtgctctaccatttgtactctggatttttagctggccgcttttcactcttcggtcttggcggtgaaccaggggggggggcagccggccccgcggctgccgctgacggggggaccgtggatctcagagagatgttggccgtcagtgtgctggccgctgttcgggggggagatgaggttcgacgagtcagagaaagtaatgtgctgcacgagaagtcgaaaggcaagacacgtgagggagccgaagataaaatgaccagtggtgatgtgctttctaatcgcaagatgttctatctgcttaagactgctttcccgagtgtgcagatcaacactgaagaacacgtagatgccgccgaccaagaagttatcctgtgggatcacaagatacctgaggacatcctgaaggaagtgacaacaccaaaggaggttcctgctgagtcagtgactgtgtggatcgacccgctggacgcaacacaggagtacacggaggaccttcggaagtatgtaacaacaatggtatgtgtggccgtcaacggtaaaccaatgctcggggtcatccataagcctttttcagagtatacagcctgggccatggtagatgggggaagcaatgtcaaagctagatctagttataacgagaaaacgccaagaatcgtggtgagccgtagccactctgggatggtgaaacaagtggccctacagacgttcggaaatcagaccactattattcccgcgggcggcgccggctacaaagtccttgccctattggatgtcccagataagagccaggagaaggccgacctttacattcacgtgacctatattaaaaaatgggacatttgcgcaggcaacgctatcctgaaagcacttggtggacacatgaccacactgagcggagaagagatcagttatacaggcagtgatggcatcgaggggggcctccttgccagcatcaggatgaatcatcaggcattggtgcgaaaactgccagatctggagaaaaccggccacaaatag

SEQ ID NO: 120614 - DNA, 1251 bp, Artificial Sequence
  Description of Artificial Sequence: Synthetic coding sequence
atggccacagagccacctagtcctctgcgcgtcgaagccccagggccaccggagatgagaacctctcctgccattgagagtacccctgaggggacaccccagccagctggggggcgcctgaggtttctgaacggttgtgtgcccctgtctcaccaagtcgcaggccacatgtatggtaaggataaggtcgggattttacagcatcccgatggcacagtccttaaacagcttcaaccccctcccaggggaccgcgcgagctggagttctataatatggtatacgctgccgactgttttgatggcgtgctgctggagctgaggaaatacttgccaaaatactacggcatttggtccccccctactgcccccaacgacctctacttgaagttggaggatgtcactcataaatttaataaaccatgcattatggacgtaaaaatcggacagaaatcctatgaccccttcgcgtcctccgagaaaattcagcagcaggtgagtaagtacccactgatggaggagatagggtttcttgtgctggggatgcgcgtgtatcacgttcatagtgatagttacgagaccgagaatcaacattatggccgcagtctgactaaggagactatcaaagacggcgtcagcagattttttcataacggctattgtttacgcaaagatgccgtagccgcctccatccagaaaattgagaaaatcctccaatggtttgagaaccaaaagcaacttaacttctacgctagcagcctgctgtttgtctacgagggcagttctcagcctaccacaactaaattgaacgacagaaccctcgctgaaaaatttctgtctaaaggccagcttagtgacactgaggtcttggaatataataataacttccatgtgttgagctccacagctaatggaaagatcgaatcctctgtgggcaaaagcctaagtaagatgtacgcacgccacaggaaaatctacactaaaaagcaccattcacaaacttccctgaaggtcgagaacctggagcaggacaacggctggaagagcatgtcccaggagcacctgaacggcaacgtactctctcaactggagaaggtgttctaccacctgccaacaggatgccaagaaattgcagaggtagaagtgcggatgatcgactttgctcacgtgttcccatctaatacaatcgatgaggggtacgtgtatggtctcaagcacctaatttctgtgctgcggagcattctggataattag

SEQ ID NO: 120615 - DNA, 3777 bp, Artificial Sequence
  Description of Artificial Sequence: Synthetic coding sequence
atggcatccgcatgcggcgccccaggccccggcggtgcattaggcagccaagccccttcttggtaccaccgtgatctgtcccgagctgcagccgaagagctgctcgcccgagcgggtagggacggctccttcttagtacgagattctgagtcggtggccggggccttcgccctttgtgttctctaccaaaagcatgtacatacttatagaatcctgccagatggggaggattttctggccgtgcagacaagtcagggcgttcctgtccgccgattccagactctgggtgagctcatcggactttatgcccagccaaatcagggtctggtttgcgccctgttgctcccagtggagggggagcgcgagcctgaccctccagacgatcgggacgccagtgatggcgaggatgagaagccacctctgccccctaggagcggctccaccagcatctcagctcctaccggaccctcttctcctctgcctgcgccagaaacaccaactgcacccgccgcagaatcagcacctaatggcctgtccaccgtaagccatgactatctgaaaggcagctacggcctcgacttggaagcagttagagggggcgcttcccacttgccccacctaactagaaccctggctaccagctgtcgtaggctacattcagaagtggacaaggttttgtccgggctcgaaatactgtctaaggtgttcgaccagcaatcgagccccatggtcactagactattacagcagcagaacttgccccagaccggcgaacaggaacttgagagccttgtgttaaaactttctgtcttgaaagattttctgagtggtattcagaagaaggcactaaaggctcttcaagacatgtccagcaccgcccctcccgcccctcagccatctaccagaaaggcaaagacgataccagtccaagcgtttgaagttaagttagatgttaccttaggcgatctcaccaagataggtaagtcgcaaaaatttacactctccgttgatgtcgaagggggacggcttgtgttactgcggcgccagcgagactcccaggaagattggacaacctttacgcacgatcgcattcgccagctcattaaatcccaacgtgtgcaaaataagttaggggtggtctttgagaaggagaaagaccgaactcaacgcaaggattttatttttgtgagcgcacgaaagagagaagccttctgtcagctgctccagctgatgaagaacaaacattccaaacaagatgagcccgatatgattagcgtctttatcggcacttggaacatgggctccgttccgccaccgaaaaacgtcacaagttggtttacaagcaagggactaggaaaaactttagatgaggtgacagttaccatccctcatgatatttatgtcttcgggacccaagagaacagtgtgggggatcgagagtggttggatctgctccgaggcgggctgaaagagctgaccgacctggattacagacccatcgccatgcagagcctgtggaatatcaaagtggccgtgctggtcaagccagaacacgagaatcgcattagtcacgtctcgacatcgtcagtaaagactgggatcgctaatactctgggtaataaaggcgccgttggagtcagtttcatgttcaacgggacctccttcggctttgtcaactgtcatttaaccagcgggaatgagaagacagcccggcggaatcagaactatctcgatatactcagactactatccctcggagataggcagctgaatgctttcgatatctccctccgtttcactcatctgttttggtttggggatcttaactaccgacttgacatggacatacaggagattctgaattatatcagcagaaaggagtttgagcctctgttgcgcgttgaccaactgaacctcgagcgggagaaacataaagtattcctgcggttttccgaggaagaaattagttttccccctacttatcgctacgaacggggatccagggacacatacgcctggcacaaacaaaaacccacaggggtgcgtacaaatgtcccctcctggtgtgaccgcatcctctggaaatcctatccggaaacccatatcatttgtaattcctacgggtgcactgacgacatcgtgacatcagatcactcccctgttttcggaacgttcgaagttggagtaacaagtcagtttatctcaaaaaaagggctgagtaaaacaagcgaccaagcctatattgagtttgagagcatcgaagctattgtcaaaaccgcttccagaaccaagttttttatcgaattctatagcacctgtttagaggagtataagaaaagttttgagaatgacgcccaaagctctgacaacatcaacttcctcaaggtccagtggagcagcaggcagctgcccacgctgaaaccaattctggctgacattgagtaccttcaggaccagcatctgcttctgaccgttaagtctatggatggttacgagtcttatggggagtgtgtggtcgctcttaaaagcatgatcgggagcacagcacagcagtttctcacgtttctgagccataggggagaagaaaccgggaatattagaggctccatgaaagtccgagttcctactgaaagactggggactcgcgagcgattatacgaatggatatctatagacaaggacgaggccggcgccaagtctaaagcaccatcagtgagcagaggttctcaggagcctcggtcaggaagtcgaaagccagcttttacagaagcttcctgtccactgtcccgactttttgaagagcccgaaaagcctccccctactggacggcccccggctccacctagggccgcccccagagaggagcccctgactcccagactcaaacctgaaggtgctccagagcccgaaggcgtagctgcccctccgcccaagaacagcttcaacaatcctgcttattacgtgctggaaggagtgcctcaccagctgctgcccccagaacccccgtcgcccgccagagcccctgtcccctccgctactaagaacaaggtcgccattactgtgccagccccccagctgggccatcatagacatccaagagtgggggaaggctcatcttctgacgaagaatctggcggtacccttcctcccccagacttccctcctcctccgctgcctgattccgccattttcctgcctccgtccctagacccattgccaggccctgtggtcagggggaggggtggcgctgaagctcgaggccccccaccccctaaggctcacccccgcccacctcttccccctggccccagtcccgcatccaccttcctcggcgaagttgcgtccggtgacgacagatcatgtagcgtcctacaaatggccaaaaccctgtccgaggtcgactatgcccccgccggccctgctcggagcgcgctgctccccggacccttagagttgcagcccccgcggggcctgccttcagactatggcagaccactgagcttcccaccacctagaattagagagtccatccaggaggatctggcagaagaagccccttgcctgcaaggggggagggcctcggggttgggagaagcaggcatgtctgcttggctcagggctatcgggctagaaaggtacgaggaaggactagtgcacaatggttgggatgatctcgaatttctgagcgacatcactgaggaggatctagaggaagccggcgttcaagatcctgcacacaagcgactccttctcgatacattgcaattgtcgaaatag

SEQ ID NO: 120616 - DNA, 105 bp, Artificial Sequence
  Description of Artificial Sequence: Synthetic coding sequence
atggtgacacgcctgctgcagcagcagaacctcccgcagacaggggagcaagagttagaatccctagtgctgaagctgagcgtgctgaaagacttcctctcctag

SEQ ID NO: 120617 - DNA, 3051 bp, Artificial Sequence
  Description of Artificial Sequence: Synthetic coding sequence
atggttaccagactgcttcagcagcagaacctccctcagactggggagcaagaattggagtcattggtgcttaaattatctgttcttaaagactttcttagcggcattcagaaaaaggccttgaaggccctgcaggacatgtcatccactgctcctcctgctcctcaaccgtccactagaaaagcgaaaaccatccccgtccaggcattcgaggtcaagctggacgttactctcggagatctgactaaaatcggtaagagtcagaagtttaccctgagtgttgatgtggagggagggcgtctggtgcttcttcgacggcagcgtgattctcaggaggattggaccacgttcacccacgatcgcatccgacagctgattaaaagtcaacgggtgcagaataaactaggagtggtcttcgagaaggagaaggacaggacccagaggaaagacttcatctttgtcagcgcgaggaaaagggaggccttttgtcagctgctacagctgatgaaaaataagcactcaaagcaggacgaacctgacatgatttccgtcttcatcggtacttggaacatgggctctgtgccccccccaaagaacgtgacatcctggttcacatcaaaaggtctgggaaaaaccctcgacgaagtgaccgtaaccatccctcacgacatatatgttttcggtacacaggagaatagcgttggggaccgggaatggctggacctgctcagagggggcctgaaagagctgaccgatctggactatagacctatcgcgatgcagtctctatggaacatcaaggtagctgtgctggttaagcctgaacatgaaaatagaatctcccacgtctctactagctccgtcaaaactggtatcgccaataccctcgggaacaagggggctgtcggagtgtcctttatgttcaatggaacatcgtttggctttgtcaactgccatttaacttctggtaacgaaaagactgcgagaagaaaccagaactatctggacattctgaggctgttgagtctgggtgataggcagcttaatgcttttgatattagtctgaggttcacacatctgttttggttcggcgacttaaactatcggttggatatggatatccaggagatcctcaactatatttcaagaaaggaatttgaacccttactgagagtggatcagctcaacctggaacgcgagaagcataaagtgttccttcggttcagtgaggaagaaatctcattcccaccaacataccgatacgaacgtggctccagagatacttacgcttggcataaacaaaaaccaaccggagtgcgaacaaatgttccttcttggtgcgacaggatcttgtggaaatcttatcctgagacccacatcatttgtaactcctacggctgtaccgatgatatcgttacgagcgatcactccccagttttcgggacattcgaggtgggcgttacctctcagtttattagtaagaagggcctaagtaagacgtccgaccaggcctacatcgagtttgagagcatcgaggcaatcgtaaagaccgccagtcggactaaattcttcattgaattctattccacttgccttgaagaatataaaaagtcattcgagaacgatgcccagtcttcagacaatattaacttcctgaaggtgcagtggtctagtcggcagcttcccactcttaaacctattctcgccgatatcgagtacctgcaggatcagcacctgctgcttacagttaagtccatggacggctacgagtcttatggcgagtgtgtggtggccttgaaatccatgatcgggtcgaccgctcagcagttcttgacctttttaagccatagaggagaggagacaggcaacatcagggggtctatgaaagtgagagtgccaacagaaagactgggaacaagagagaggctttatgagtggatcagcatcgacaaggacgaggcgggagctaagtccaaagctcctagcgtgtctcgcggaagccaagaacccagaagcggtagtcgcaagccagctttcacagaggccagctgtccgctctcaagactgttcgaggagccggaaaagcctcctccaaccggccggcctccagcccccccccgcgcggcgcctagggaagagcctcttactcccaggctgaagcctgaaggcgcacccgaaccagaaggcgttgccgccccgccaccaaaaaactcctttaataatccagcctactacgtgctcgaaggagtcccacatcagttgcttcctcctgaaccaccctctccagctagagccccagtcccgtccgccaccaagaataaggtggcaatcaccgttcccgctccccagctgggccatcaccgccatcctcgcgtcggtgaggggagctcttctgacgaggagagcggaggaaccctgccaccccccgactttccccccccccccctccccgacagtgcaatcttcctacctccctctctggacccactccctgggccagtggtcaggggtagggggggcgcagaagccagaggcccaccaccacccaaggcacaccctaggcctcctttgcctcctggtccatcccccgcctcaacatttttgggagaagttgcctcaggagacgaccgcagttgtagcgtccttcaaatggctaaaacattgagtgaagttgactacgctccggccggacccgcgaggagcgcactgttgccaggccctcttgagctacagcctcctcgagggcttccctctgattatggacggcctctctcattccctccccctaggattcgggaatctatccaagaggacctggcggaggaagccccctgtttgcaaggtggacgggcgtcaggactgggtgaggctggaatgtccgcttggctccgcgccatcgggctcgagagatatgaggagggcctggtgcataatggatgggacgacctcgagttcctgagtgacattaccgaggaagatctggaggaagcaggcgtccaggacccggctcacaagagactgctactggacacgcttcagctgtcgaagtag

SEQ ID NO: 120618 - DNA, 69 bp, Artificial Sequence
  Description of Artificial Sequence: Synthetic coding sequence
atggcctcagcctgtggcgctcctggtcctggtggagcgttaggcagccaggctccctcatggtactag

SEQ ID NO: 120619 - DNA, 3051 bp, Artificial Sequence
  Description of Artificial Sequence: Synthetic coding sequence
atggttactcggctcctccagcagcagaacctgccacaaacaggcgagcaagagctagagtccctggtcctaaagttgagcgtcttgaaggacttcctgtcaggcattcaaaaaaaggccttaaaggccttgcaggatatgagcagcacggcacctccggccccacaaccgagtacaagaaaggctaagaccattccagtgcaggcatttgaggtgaaattggatgtgactctgggtgaccttaccaagatcggcaaaagccaaaaatttacactctcagttgacgtcgagggcggcaggcttgtgctgctgaggcggcagagggacagccaggaggattggaccacatttacccatgacagaattagacaacttataaagagtcaacgggttcagaacaaactgggcgtggtatttgaaaaggagaaggataggactcagagaaaagatttcatcttcgtctctgcacggaagcgtgaagctttttgtcaactgttgcagctgatgaagaataaacacagtaagcaagacgaacctgatatgatcagcgtgttcatcggcacgtggaatatgggctccgtcccaccccccaagaatgtcacatcttggtttacttctaagggattgggtaagacattggacgaggtcaccgttactatcccacatgatatttacgtgttcggtacacaagaaaactccgtgggagaccgagaatggctagatctgctgcgtggtggacttaaggagttgacggacttggattatagaccgatcgctatgcagtctctgtggaacataaaagtcgctgtcctggtgaagcctgagcatgagaaccgaatctctcatgtcagtactagttcagtcaaaaccggcattgcaaacacattagggaacaaaggagctgttggtgtgagcttcatgtttaacgggaccagcttcggattcgtgaattgccacctgacctcagggaatgaaaagacagccagaaggaatcagaactatctggacatcttgaggttactgagtctgggggatcggcagctcaatgccttcgatattagcctccggttcacacacctgttttggtttggcgacctgaactacaggttggacatggacatccaagagatcctgaattacatctcaagaaaggagttcgagcctctgctgagggtcgatcagttaaacctagaaagggaaaagcacaaggtttttctaagattctccgaggaggaaatctcctttcccccaacatatcgctacgagcgcgggtcgagagacacttatgcttggcacaagcagaaacctactggggtcagaactaacgtgccttcgtggtgcgacaggatcctgtggaaatcttatcctgagactcacattatttgcaatagctacggatgtactgacgatatcgtgacaagtgatcattccccagtattcggcacttttgaagtgggagtgacctctcaatttatctctaagaagggattgagtaagacctcagatcaggcgtatattgagttcgagtcaattgaagctatcgtgaaaactgcaagtagaacaaagttttttatcgaattctacagtacctgcttagaagaatacaaaaaatcctttgaaaacgacgcccagtccagtgacaatatcaactttctgaaggttcagtggtcatcccgtcagcttcctacactgaagcctattctggctgatatcgaatatttacaggatcaacacctgctcctcacggtcaagagtatggacgggtatgagtcatatggagagtgcgttgtcgccttgaagagcatgatcggctctacggcccagcagttcctgacgttcttgagccaccgcggtgaggaaacaggaaatattaggggctcgatgaaagtgagagtacccacagagcggctcgggactcgggagcggttgtacgaatggatttctatagacaaagatgaggccggtgcaaagtcaaaggctccatccgtttcaagaggctcccaggaacccagatcagggtctcgcaaacctgcatttactgaagccagctgtccactttcacgattgtttgaggaaccagagaaacccccccccactggtcgccctcccgcccctccaagagccgcaccaagggaagagcccctgaccccgagattgaaaccagagggcgcacctgaacccgagggcgtagctgccccacctccaaaaaactccttcaacaatccagcctactatgtcctcgagggcgtgccccatcaactcttaccccccgaacctcctagtcccgcacgcgcacctgtgccaagtgccaccaagaacaaggttgccataacagtacccgcaccccaactggggcatcaccgacatccacgagtgggcgagggaagttcatccgacgaagaatcaggggggaccctgccccctcccgactttccgccgcctcctttgcctgacagcgccatcttcctccctccttccctggatccgctaccagggcccgtcgtccgcggcaggggaggggcggaagccaggggcccacccccaccaaaagcccatccaaggccaccccttccacctggccctagtccggcaagcacttttcttggcgaagtagcgtcaggcgatgaccgatcctgttctgtgctgcagatggccaagacactcagtgaggtagactatgcccctgccggaccagcacggtccgccctgctccctggcccattagagttgcagcctcccagagggctcccatccgactacgggcgtcctctgtccttcccacccccgaggatacgtgagtccatacaggaggacctcgccgaagaggccccgtgcctgcaggggggccgggcatccggtctgggggaagcgggaatgtccgcctggcttcgcgctataggcctcgagcgctatgaggagggacttgtccacaacggatgggatgacttagaattcctcagcgacatcaccgaggaagacctggaggaggccggtgtccaggacccagcacacaaacggttactgctggacactctccagctttctaaatag

SEQ ID NO: 120620 - DNA, 57 bp, Artificial Sequence
  Description of Artificial Sequence: Synthetic coding sequence
atggctagcgcctgcggcgccccaggcccaggcggcgcactgggttcacaagcttag

SEQ ID NO: 120621 - DNA, 474 bp, Artificial Sequence
  Description of Artificial Sequence: Synthetic coding sequence
atggtcacacgactgctgcaacaacaaaaccttccgcaaacgggcgaacaggagctggaatccctagtgctcaagctaagcgtcttgaaagattttctgtccggtatccagaaaaaagccctcaaggctcttcaggatatgtctagtaccgccccaccagctcctcagcctagtacccgaaaggctaagacaatcccagtgcaggcttttgaagtgaagctcgatgtgacgcttggtgatctcacaaagataggaaaatctcagaagtttactctcagcgtcgacgtggaaggtgggcggctggttttactgcggagacagcgagacagccaagaggactggacaaccttcactcacgacagaattcggcagttaatcaagtcccaacgcgtgcagaacaagctgggtgtcgtattcgagaaagagaaggatcggacccagcgcaaagattttatcttcgtttccgctcggtag

SEQ ID NO: 120622 - DNA, 1200 bp, Artificial Sequence
  Description of Artificial Sequence: Synthetic coding sequence
atgagcgatattcttcgcgagctgctgtgtgttagcgaaaaagcggccaacattgccagagcctgtcggcagcaggaagcactctttcagttgctgattgaagagaaaaaggaaggagaaaagaataaaaagttcgctgtcgactttaaaacgcttgccgacgtcctcgtccaggaggtgataaaacagaatatggagaataaattcccgggcctggagaagaacatctttggggaagagagtaatgaatttaccaatgactggggggaaaagataaccctgcgcctctgctcaactgaggaggagaccgccgagctgctcagcaaggtgctaaacggtaataaagtcgcctccgaggccctggcaagagtggttcaccaggatgtcgccttcaccgatccaaccctcgattctacggaaataaatgtcccgcaagatatcttgggaatttgggtcgaccccattgattccacttaccagtacatcaaaggaagtgccgacattaagagcaatcagggcatctttccttgtggattgcagtgcgtaaccatcctaatcggagtgtacgatatacagaccggagtgccgcttatgggagtcatcaatcagccattcgtgtcaagggaccctaacacactacggtggaagggccaatgttattggggactgtcttatatgggaacaaacatgcatagtcttcagttaacgattagccgaagaaatggctcagagactcacactggaaacaccggcagcgaggccgctttttcgcccagcttctctgctgtgatctctacgtccgaaaaagagacaatcaaagctgcgttaagtagagtctgtggggacagaatctttggagcagctggggcaggctacaaatctctttgtgtcgtccagggactagtggatatctacatatttagcgaagacacaactttcaagtgggattcttgtgcagcccacgccatcctgcgcgccatgggtggcggcatagtcgatctgaaggaatgtctcgagcggaacccagagaccgggctggacttgcctcagctcgtgtatcatgtcgagaatgagggcgcggcgggggtggatcggtgggccaataaaggcggcctgatcgcatatagaagtcggaagcgattagagacattcctcagcctgctggtgcaaaacttggcgcctgcagaaactcacacatag

SEQ ID NO: 120623 - DNA, 1200 bp, Artificial Sequence
  Description of Artificial Sequence: Synthetic coding sequence
atgagcgacatcctaagagagttgctgtgcgtttccgaaaaggctgcaaatattgcaagagcatgcagacaacaggaggccctttttcaactgcttatagaagagaaaaaagagggagagaaaaacaaaaaatttgccgtggatttcaagaccctggctgacgtcctggtgcaagaagtgattaagcagaacatggaaaacaaatttccaggactagagaaaaacatcttcggagaagagtcaaacgaatttaccaatgactggggagagaaaattactttgagactatgttccaccgaggaggagacggccgagctgctctcaaaagtgttgaatggaaacaaagtggctagcgaagctttggcaagagtagtccaccaggatgtagccttcacggaccccactctcgactctacagaaatcaatgtgccccaagacatacttggcatctgggtggaccctatcgattccacttatcaatacatcaagggaagcgcagacatcaagtctaatcaaggcattttcccatgtggacttcagtgcgtaacgattctcataggtgtgtatgacatacaaaccggggtgccattgatgggtgtgattaaccaaccttttgtgtctagggacccgaatactcttcggtggaagggacagtgttactggggcctgtcatacatgggcacaaatatgcatagtctccagctgacgattagcaggagaaacggatctgaaacacacacagggaatacagggtctgaggcagctttttccccgagtttttccgctgttatttctacaagtgaaaaagagaccattaaagccgctctgtctagagtctgcggtgaccggatcttcggcgctgccggcgcgggttataaaagcctctgtgtggtccaggggttggtggacatctatattttttcggaggacaccacctttaaatgggacagttgcgctgcacatgctattctcagagcgatgggaggcggaattgtcgacctgaaagaatgcctggagcggaaccctgaaacaggcctggatttgccccagctcgtgtaccacgttgaaaatgaaggcgcagctggagtagatcgttgggcaaacaagggcggcttgatcgcttacagatcacgaaagcgattagaaacattcctctctcttctagtgcagaacctggcacccgctgagacacacacttag

SEQ ID NO: 120624 - DNA, 468 bp, Artificial Sequence
  Description of Artificial Sequence: Synthetic coding sequence
atgtccgatatcctgcgcgaactgctctgtgtctccgaaaaggcagctaatatagctcgtgcttgccggcagcaggaagctctctttcagttacttatcgaggagaaaaaggaaggagaaaagaacaagaaattcgcagtagattttaaaaccctcgcggacgtgctggtgcaggaagtaattaagcaaaacatggagaataagtttcctgggttggaaaaaaacattttcggggaagagtccaacgagttcactaatgattggggagaaaagattaccctgcgcctgtgtagcactgaagaagagactgcagaactccttagtaaagttctgaacggaaacaaggtcgcctcagaagccttggctagagtggttcaccaggacgtggccttcacggatccaacccttgactctaccgagattaacgttccccaggacattctcggtatctgggtggatccaatttag

SEQ ID NO: 120625 - DNA, 267 bp, Artificial Sequence
  Description of Artificial Sequence: Synthetic coding sequence
atgtccgatattctcagggagcttctgtgtgtgtccgaaaaagcagccaacatcgccagggcctgcaggcaacaggaagcccttttccagctgctgatcgaagaaaaaaaagaaggagagaagaataaaaagtttgccgtggacttcaagaccctggctgatgtgcttgtacaggaggtgattaagcagaacatggaaaataagttcccgggcctcgaaaagaacatattcggtgaagagagcaacgaattcaccaacgattggtag

SEQ ID NO: 120626 - DNA, 639 bp, Artificial Sequence
  Description of Artificial Sequence: Synthetic coding sequence
atgagcgatatcttgcgcgaactgctatgtgtgagcgagaaagccgcaaatatagctcgtgcgtgccggcagcaggaagccctgttccagcttctcatcgaagagaagaaggagggcgaaaagaacaaaaaatttgccgttgatttcaaaacactcgctgacgtgctggtccaggaggtgatcaagcagaacatggagaacaagtttcccggcctcgagaagaacatcttcggggaggagagcaatgagtttaccaatgattggggcgaaaagataactcttagactgtgctcgacggaggaggaaacagcagagctgctctctaaggtcctaaatgggaacaaggtcgcatcagaagccctggcccgagtagttcatcaggatgtcgcattcactgatccaaccctagatagcacggagatcaacgtgccccaggatattcttggaatatgggttgacccaattgatagcacctaccaatacataaaagggtccgcggatatcaaaagcaaccagggcatctttccgtgcggccttcagtgcgtcactatactgattggtgtgtatgatatccaaaccggagttccactgatgggggttatcaaccaaccatttgttagtcgagatcctaatacttag

SEQ ID NO: 120627 - DNA, 30 bp, Artificial Sequence
  Description of Artificial Sequence: Synthetic coding sequence
atgagcgatatccttcgcgagctactgtag

SEQ ID NO: 120628 - DNA, 642 bp, Artificial Sequence
  Description of Artificial Sequence: Synthetic coding sequence
atgtctgatatactcagggaactgctgtgcgtttcagaaaaggccgcaaacatcgctcgtgcatgccgacaacaagaagcgttatttcagctcctgatcgaggagaaaaaagaaggtgagaagaacaaaaagttcgcagtcgatttcaagacactcgcagacgtcctggtccaggaagtgatcaaacaaaacatggagaataagtttcctgggttggagaaaaacattttcggagaggaatcaaacgaattcacaaatgactggggagaaaagattaccttacggctgtgcagcacagaagaggaaacagccgaactgttaagcaaggttcttaatggaaataaagtggccagcgaggctctggcccgagtcgtacatcaagacgtggcttttacggaccccactctcgactcgactgaaattaatgtgccccaggacattttaggtatctgggtggatcccattgactctacttatcagtatattaaagggtccgctgatatcaaatctaatcagggaatattcccctgcgggctccaatgtgtgactatccttatcggggtatacgatatacagaccggagtgccgctgatgggggttattaatcagcccttcgtttccagagacccaaataccctgtag

SEQ ID NO: 120629 - DNA, 573 bp, Artificial Sequence
  Description of Artificial Sequence: Synthetic coding sequence
atgagtgacatcctacgagaactgctgtgcgtatctgagaaggccgcaaacatcgcccgcgcctgtcgccaacaggaggccctgtttcagcttctgattgaagagaaaaaggaaggggagaagaacaagaagttcgctgtcgacttcaaaaccctggctgacgtgctggtgcaggaggtgataaagcagaacatggagaataaattcccaggtctcgaaaaaaatatattcggcgaggagtccaatgaattcacaaacgactggggtgaaaaaatcaccctgagactatgctctactgaggaggagacagcagagcttctcagcaaagtgctgaatggcaataaagtggccagcgaagccctggccagagtggtgcatcaggatgttgccttcaccgatccaacactggacagcactgaaattaatgttcctcaggatattttggggatctgggtagatccaatagactcgacttaccagtatattaaaggatctgccgacatcaagagcaatcaaggcatcttcccatgcggactgcaatgcgtcactattctgattggggtttacgactag

SEQ ID NO: 120630 - DNA, 93 bp, Artificial Sequence
  Description of Artificial Sequence: Synthetic coding sequence
atgagcgatatcctgagagagcttctctgcgtgagtgagaaggctgcaaacatcgccagagcttgcagacagcaggaagctctgtttcagtag

SEQ ID NO: 120631 - DNA, 207 bp, Artificial Sequence
  Description of Artificial Sequence: Synthetic coding sequence
atgtcagatatcctcagagagcttctgtgcgtgagcgagaaggccgccaatatcgcacgagcttgccggcagcaagaggcattgtttcaactcctgattgaggaaaaaaaagagggagagaagaacaaaaagttcgccgttgattttaagaccttggcagacgttttagtgcaagaagtgattaaacaaaatatggaaaataagtag

SEQ ID NO: 120632 - DNA, 432 bp, Artificial Sequence
  Description of Artificial Sequence: Synthetic coding sequence
atgagcgatattctgcgggagctgctctgtgtctctgaaaaagccgccaacatcgccagagcctgccggcagcaagaagccctcttccagcttttaatcgaggagaaaaaggagggcgaaaaaaacaagaagtttgccgtggattttaaaacattggccgacgtgttggtgcaggaggtgattaaacagaatatggaaaacaaatttcctgggcttgaaaagaacatcttcggggaagaaagtaatgaattcactaacgattggggagagaagattacactgcgtttatgctccacagaggaagagaccgccgagctgctatccaaggtgctgaacggaaacaaagtcgctagtgaagctttggcccgcgtggtgcatcaagatgtggcctttactgaccccaccctcgactctaccgagataaatgtttag

SEQ ID NO: 120633 - DNA, 1200 bp, Artificial Sequence
  Description of Artificial Sequence: Synthetic coding sequence
atgtcagacattctacgcgagctgctgtgtgtctccgaaaaggctgccaacatcgcccgggcctgcagacagcaggaggcactattccaacttctgattgaggaaaagaaggagggggaaaaaaataaaaaatttgccgttgacttcaagaccctggcagatgttttagtacaggaagtcatcaagcaaaacatggagaacaagtttccaggcctcgaaaagaacatttttggcgaagaatccaacgagtttacaaatgactggggcgaaaagatcacccttaggctctgctcaaccgaagaagagacggccgaactgctgagtaaagtgttgaatggcaacaaggttgcttcagaggcgctggctagagttgtgcaccaggacgttgcctttacggaccctactcttgattccactgagatcaacgtacctcaagacatcctgggaatttgggtagaccctattgacagcacttaccagtacatcaaggggagcgccgatattaaatccaaccaaggaatcttcccatgcgggctgcaatgtgtgactatcctcatcggggtatatgacattcagacaggtgtcccgttgatgggcgtgatcaatcagccctttgtctcaagggatcctaatactctgcgttggaagggacagtgttattggggattatcttatatgggaacaaatatgcattccctgcagctcacaatttcccggcggaacggcagtgagacccataccggtaataccggaagtgaagctgccttttctccctcgttttccgccgtgattagtacaagcgaaaaagagaccattaaagctgctctctctcgcgtttgtggtgacaggatttttggtgcggccggagcgggctacaaatctctctgcgtagttcaagggcttgtcgatatttatatatttagcgaagacactacctttaagtgggattcttgtgctgcccatgccatcctcagggctatgggaggtggtatcgtcgacctgaaggagtgcctggagcggaacccagagacggggctggatcttcctcaactcgtgtaccacgttgagaatgagggggcagctggggtggatcgttgggcaaataagggcggactgatcgcttaccgcagcagaaaacgcctggaaacgtttttgtctctgcttgtacagaacctggcaccggctgaaacgcatacttag

SEQ ID NO: 120634 - DNA, 2934 bp, Artificial Sequence
  Description of Artificial Sequence: Synthetic coding sequence
atgaccgcccgagaacacagcccgaggcatggagccagagcccgcgcgatgcagcgcgcctctactatcgacgtcgctgccgatatgcttgggctctctctggcagggaatatccaggaccctgatgagcccatcttggagttttcgctggcctgctcagaattacacaccccctctctggacagaaaaccaaactcattcgtcgccgtcagcgttaccacaccaccacaagctttctggaccaaacacgctcaaactgagattatcgaggggacaaacaaccccattttcttgtctagcatcgcattcttccaggacagcctgatcaaccagatgacacaggtgaagttatcagtctacgacgtgaaagatcgcagccaagggaccatgtacttgttgggttcgggtacattcatcgtcaaagatctgctgcaggaccgacaccatcgcctgcacttgacactcagaagcgccgagtccgatagagtgggcaacattactgtcattggctggcagatggaggaaaagagtgaccaacggccacccgtgacccggtcagtggacacagtgaacggccgcatggtactgcccgtagatgaaagcctcactgaggcactaggcatccgctcaaaatatgcatcccttcgaaaagatacactgttgaaatcagtgtttggaggcgcgatctgcaggatgtatcgatttccgacaacagacggaaaccatttgcggattcttgagcagatggcagaatctgtcctgagcttacatgtccctagacagttcgttaaattgctgctggaggaagatgctgcgcgagtgtgtgagttagaggaactgggcgagttgagcccatgctgggagagcctacgccggcagatagtgacgcaatatcagaccatcatactgacctaccaagaaaatctgaccgatttgcaccagtaccgcggtcctagttttaaggctagctctcttaaggcggacaagaagctggaatttgtgcccacaaacctccatatacagcgaatgagagtccaggatgatggaggatccgatcaaaactatgatattgtcaccattggagcaccagccgcccactgtcaagggttcaagtctggtgggcttaggaaaaagctacataaattcgaggagaccaagaaacatttcgaggaatgttgtaccagttcaggctgtcaaagcatcatatacatcccccaagatgtcgtccgggccaaggagattatcgctcagataaacacgctgaaaactcaagtgtcctactatgccgaaaggctgagcagagctgcgaaagatcggtccgcgacaggtttggaaaggactctggcaatcctggccgataagactaggcagttggtcaccgtatgcgactgcaaattattggcaaacagtatccacgggctgaacgccgcccgccccgactatatcgctagcaaggcctcgcctacgtcgaccgaagaagaacaggttatgttaagaaacgaccaagatacactgatggctagatggacagggagaaattcccggtcctccctgcaggtggattggcacgaggaagaatgggagaaagtatggttgaacgtagataagagcttggaatgtatcatacaaagggtggataaactgttacaaaaagagcggctgcatggggaaggatgtgaggacgtttttccttgcgctggatcctgtacatctaagaaggggaatccggatagccacgcttactggatccgacccgaggaccccttttgcgatgtgccctcttccccatgtccgtccaccatgccctccaccgcatgtcacccccacttaacaactcattgcagtcctcctccagaggaaagttccccgggcgagtggtcagaggccctgtacccactcctcaccaccctaaccgattgtgttgccatgatgtccgataaggccaagaaggctatggtttttctgttgatgcaggactccgcgccgaccatcgccacctatttgagtctgcagtacaggcgtgacgttgtgttctgccaaacgttaaccgctcttatctgcggcttcattattaagcttcggaactgtctccatgatgatggatttcttcggcagttatataccattggtttgctagcccagttcgaatctctgctgtccacatatggagaggagctagccatgcttgaagacatgtctctgggtatcatggacctgaggaatgtgacgttcaaagtgacccaggctacctctagcgcatctgctgacatgctgcctgtgatcactggcaatcgggatggatttaatgtgagagtgcccctcccaggcccgctgtttgacgctctgccaagggagattcaaagtgggatgctcctccgtgtacagcccgtcctgttcaacgtgggtatcaacgagcagcagacattggctgagcggttcggcgacacctctctgcaggaagttataaacgtggaatcccttgttcggttgaattcctacttcgaacagtttaaagaggtcttacctgaggactgcctaccaagatctcgttcacagacctgccttccggagttattacggttcttaggtcagaacgtccatgcgcggaaaaacaagaacgtggatattctttggcaggctgcggagatctgtcgccgcctcaatggagtgcgcttcactagttgtaagagtgctaaggatcgcacagccatgagtgtcacgctcgaacagtgtctgatcctgcaacatgagcatggcatggccccccaggtgtttacgcaggctctggaatgcatgcggtctgagggatgccgacgtgagaacaccatgaagaatgtaggctcacggaagtacgccttcaatagcttacagctgaaagcattccccaagcattaccgaccaccagagggtacatatgggaaagtggagacatag

SEQ ID NO: 120635 - DNA, 2817 bp, Artificial Sequence
  Description of Artificial Sequence: Synthetic coding sequence
atgacagcacgggagcactctccgcgccatggcgcgcgcgcccgagctatgcagagggctagcacaatcgacgtggctgctgacatgctgggacttagccttgctgggaacattcaagatccagatgaacccatcttagagttctccttggcctgctccgaactccacacgccatcactggaccggaaacccaattcgttcgtggctgtatctgtgacaactcctcctcaggccttttggacaaaacacgcccagactgagattatcgagggaacgaataaccctatcttcttgagctcaattgccttttttcaagatagccttataaaccaaatgacccaggtgaaactgtcggtctacgatgttaaggacaggagtcaaggcacgatgtatctcctggggagcggaaccttcatcgtgaaggatctgctgcaggacagacaccatcggcttcacttgacgctcaggtctgctgaatcagatcgcgtcggcaacataaccgttatcgggtggcagatggaggagaaatccgatcagcgcccgcccgtgacacgcagtgtcgacaccgttaacggaagaatggtgctgccagtagacgagtccctaacagaggccctggggatcagatcaaagtacgcctcattgcggaaggataccctgctcaagagcgttttcggcggcgccatctgccgaatgtatcggttcccaaccaccgatggcaatcatctgcgcattctggaacagatggcggagtctgtgctgtcactgcatgtcccacgtcagttcgtgaaactgctgcttgaagaagacgccgctagagtctgtgaacttgaggagctcggtgaactgagtccatgttgggagtctctcaggaggcagatcgtgactcagtaccagacaattattttaacataccaagagaacttaacagacctgcaccaatacagggggccctcatttaaagcctcctcacttaaggctgataaaaagttagagtttgtgccaacgaacctgcatattcagagaatgagagtccaagatgacggtggatcagaccagaattacgatattgtgacaatcggcgcccctgccgcgcattgtcagggttttaagtccggtggcctaaggaagaagctacacaagtttgaagaaacgaagaagcattttgaggagtgctgcacatcctctggctgccaatctatcatctacatcccccaggatgtggttcgggcgaaggagattatagcgcagattaatactctaaaaacacaagtttcttattatgcagaacgtctaagcagggccgccaaagatcgcagcgctactgggctggagcgaactctggccatcttggctgataagactaggcagctagtaaccgtttgcgactgcaaactccttgctaattctattcacgggcttaatgccgctagacccgactacatcgcttctaaagcgtccccaacctctacggaagaggaacaggtgatgctgagaaacgaccaggacaccctgatggctcggtggaccggtcgcaactccaggtcaagtttgcaggtggactggcacgaggaagaatgggaaaaggtttggcttaacgtcgacaagtcactggagtgcatcattcaaagagtagacaagctgctgcagaaagagcgccttcatggagagggctgcgaagatgtctttccgtgtgccgggtcctgtacctccaagaaggactgttctcctccacccgaggaatcatctcccggcgagtggagtgaagccttgtatcctctactgaccactttaaccgattgcgtcgccatgatgtccgataaggccaagaaagccatggtattcctgctcatgcaggatagcgcacccacaattgctacctacctaagcctgcagtaccgacgcgatgttgtgttttgccaaacgctcacagctttgatctgtgggttcataataaagctgcggaactgtctccacgacgacggattcttacgtcaattatacaccatcgggctactcgcccagttcgaaagcttgttgtccacctatggggaggagttggctatgctagaggacatgtctctgggcataatggacctgcgcaatgtcaccttcaaagtcacccaggccacgagcagtgcttctgccgatatgttacccgtaataactggaaatagggacgggtttaacgtgagggtaccactcccaggacccctattcgacgccctgcctagggaaattcagtccggtatgctcttgagagtgcaacctgtgctgtttaacgtgggcataaatgaacagcagacccttgcggagaggttcggggacacatcattgcaggaagttattaatgttgaatccttggtaaggctgaactcatactttgagcagtttaaggaggtgctgccagaggactgcctgccccggagccgatctcaaacatgtctgccagaattgctgagattcttgggtcagaatgtgcatgcccgcaagaataagaacgtggatattttatggcaggcagctgagatatgtagaagattaaatggcgtgaggtttacatcatgcaaaagcgctaaagaccgcaccgctatgtccgtcactttagagcagtgcctgatccttcagcatgaacacggaatggcgccccaagtttttacccaggcattagaatgtatgcggtctgaaggctgccgtagggagaacactatgaagaatgtcggatctaggaaatacgcatttaattccctgcaattgaaggcattccctaagcattaccgccctcccgaaggcacctacggcaaggtcgagacgtag

SEQ ID NO: 120636 - DNA, 2865 bp, Artificial Sequence
  Description of Artificial Sequence: Synthetic coding sequence
atgacagctagggagcactcccctcgccatggagcgagagcccgagccatgcagagagcctctaccatcgacgtggccgcagatatgctggggctctctctcgcgggaaatattcaagatcccgacgaacctatactggagttcagcctggcttgtagtgagctgcatacgcctagtctggatcgtaagcctaacagtttcgttgcagtgtcggtgacaaccccacctcaggccttttggaccaaacatgcgcaaacggaaattattgagggcaccaataatcccattttcttgtcttccatagcctttttccaggactctctaatcaaccagatgacgcaagtgaagctctcagtctatgacgtgaaggaccgatctcagggcaccatgtatcttctaggctctggcactttcattgtgaaggacctcttgcaggaccgccatcatagattacacctaaccctgaggtcagctgaatctgacagagtgggcaatataactgtcatcgggtggcagatggaagagaaatcagaccaacggccccccgtgactcggtccgtagatactgtcaacggacgcatggttctgccagtggacgaaagtttgactgaggctctcggcattaggtccaaatacgcctcccttcgaaaagataccctgctgaagtccgtgttcggaggtgcaatttgtcgcatgtataggttcccgacaaccgacggcaaccatttaaggattctggagcagatggccgagtcagtactgtcccttcacgtgcctaggcaattcgtgaaactgctgcttgaggaagatgcagcacgagtgtgcgagctggaagagctgggggagctttccccctgttgggaatccctgagaagacaaattgtgacacagtaccagacgatcattttaacatatcaggaaaacctgactgacttacatcagtaccgagggccctccttcaaagcttcctccctaaaggctgacaagaagcttgagtttgtccccacaaacctccacattcagcggatgcgcgtgcaggacgacggtggaagtgaccagaactacgatatcgtcacaatcggggcaccagctgctcattgtcaaggctttaagagcggcggactgaggaaaaagttgcataagtttgaggagacaaaaaagcatttcgaagaatgctgcacttcctctggctgtcagagcatcatctacatcccacaagatgtggtgagagcaaaggagatcatagcccagataaacaccctgaagacacaggtgtcctactatgctgagaggctgtctcgtgcagccaaggatcgatcggccactgggctggaaagaaccttggctatccttgccgacaaaacccgacaattggttaccgtttgtgattgcaagctattagccaactccattcacgggttaaacgccgcacggcctgattacatagccagcaaggcctcgcccacaagcaccgaagaagagcaggtgatgttgcgtaacgatcaggacacactcatggcaagatggactgggcgcaatagcaggtctagcctgcaggtggactggcatgaggaggagtgggaaaaagtgtggctgaatgtcgacaagtctcttgagtgtatcatccaacgcgtggataagctcctgcagaaagagaggctgcacggagagggttgtgaagatgtgtttccgtgcgccggtagttgcaccagtaaaaaagattgcagcccacctcctgaagagtcaagccccggcgagtggtccgaggctctgtacccactcctgactaccttaacggactgtgtcgctatgatgagtgacaaagcaaaaaaagccatggtgttcctactcatgcaggatagcgctcccacaattgctacttatctaagccttcagtaccgccgagacgtggttttctgccagacattgaccgctttgatatgcgggtttatcatcaaactcagaaactgccttcacgacgatggtttcttgagacagctgtatacgatcggacttttggcccagttcgagtccctactatcaacttatggcgaggagctggctatgctggaggatatgtccctgggcattatggacctgcgaaacgtgactttcaaggtgactcaggctacttccagtgcttctgccgacatgttgcccgtgattacaggtaaccgggacgggttcaatgttcgcgtgcccctaccaggccctctcttcgacgccttgccaagggaaattcagagcggtatgctgctgcgggtgcagccagtgctgttcaatgttgggatcaacgagcagcagacactggcggagagattcggggacacttccctccaggaagtaatcaatgtcgaaagcctagtgagactgaactcctatttcgaacagttcaaagaggtgttaccggaagactgtcttcctcgttcacggagtcagacctgccttcctgagctcttgcgctttctagggcagaacgttcatgcacggaagaacaagaatgtagatatcctctggcaggccgcagagatttgtcgcagacttaatggtgtcaggtttacatcgtgtaagtccgccaaggaccgcactgcgatgtcggtcaccctcgagcagtgcctgattttgcagcatgagcacggtatggctccccaggtgtttacacaggccctggagtgtatgcgctccattggtacccgagaggtggttactcaaaagaacctgagcggactggttcctatcagggacctccggcttgacccaagcctgctgtgcagcattcccctcctagccctgtcaccaaacctgctgatcgtctggttgtttttgagcattgcctacctggtcacaaaacttaggtgcaagtag

SEQ ID NO: 120637 - DNA, 2919 bp, Artificial Sequence
  Description of Artificial Sequence: Synthetic coding sequence
atgactgcgagggaacatagtccgcgccacggggctcgcgcgagagctatgcaacgcgcaagcactatcgatgttgcagcagacatgctgggtctgagcctcgcaggcaacatccaggaccctgacgagccaatcctcgaattttctttggcgtgcagcgaattgcatacacctagcctagaccgaaagccaaatagcttcgttgcagtgagtgtaactacccctccccaggccttttggaccaagcacgcccagaccgagattatcgaggggactaataatccaatttttctttctagcatcgctttttttcaggatagtcttatcaatcagatgactcaagtaaagttgagcgtgtacgacgtgaaggaccgatctcagggaactatgtacttgctgggttctggcacattcatagtgaaagacctgctccaggatcgccaccatagacttcacttaacactgagatctgccgagtcggaccgggtagggaacatcacagtcattggctggcagatggaggaaaaatcagatcaacgcccgcccgtgacccgcagtgttgacacagttaacggtcggatggttctgcctgtggacgaatctctgaccgaggccctgggcatccgaagtaagtacgcatccctacgcaaggacacactcttgaaaagtgtcttcggaggagccatttgtcgaatgtacaggtttcctaccacggatggcaatcacctgagaattctcgaacaaatggccgaaagcgtgctgtctctacacgtgccccgccagtttgttaaactcctgctggaagaagatgcagcccgcgtctgtgagctcgaggagttgggtgagctatcgccatgctgggagtcactgcgccgccagatagtcactcaatatcagactattattttgacgtaccaggaaaacttgactgacctacatcagtatagggggcccagcttcaaggcaagtagtctgaaggccgataagaaactggagttcgttcccacaaacctgcatatccaacgcatgcgtgttcaggacgatggcgggtccgaccaaaactatgatatcgtaacaataggagcgcccgctgcccactgccagggttttaaatctggaggtctgcgcaaaaaattgcacaaattcgaggagactaagaaacacacctctagtggttgtcagtctattatctacattccccaggacgtcgttagagcaaaagaaatcatcgcgcaaataaacaccctgaagacacaggtatcctactatgctgagcgcctcagccgcgcagctaaagaccgcagcgcgacgggtttggaaagaacactggctattttggccgataaaacacggcagctggttacggtgtgtgattgcaagctgctggccaactccattcatggcttgaacgcagcacgccccgattacatcgccagcaaggcttctcctacatcgaccgaagaagagcaggtgatgctcaggaatgatcaggatacacttatggcacgatggaccggtagaaatagtagatcttccctgcaggttgactggcatgaggaggaatgggaaaaagtatggctaaacgttgacaagtcacttgagtgcattatccagcgggtggataaattactgcagaaggaaaggcttcacggcgagggatgtgaagacgtgttcccctgcgcgggctcttgcaccagcaagaaaggcaatcccgactcccacgcctattggatacggcctgaagacccgttctgtgacgtgcccagcagcccttgtccttccacgatgccctccacggcgtgccatcctcatctcactacgcattgcagccccccaccagaagaatcctcacctggagagtggtcagaggccctctacccattgctgaccactttaacagactgtgtcgccatgatgagtgataaagctaagaaggctatggtttttctcctcatgcaggactcagccccgaccattgccacatatctgagcttgcaatatagaagggatgtggtgttctgtcaaaccttgacggctctgatctgtggctttattatcaagctaagaaattgcctgcacgatgacggatttctgcgccagttgtatactatcggtctgctggcacagtttgagagtctgttatccacatacggggaagagcttgcaatgctggaggacatgtcattgggcattatggacctgaggaacgtgacgttcaaggtgactcaagcaaccagcagcgcttctgcggatatgctgccagtgattacgggtaatcgagatgggttcaacgtaagagtgccgctgcccggccctttatttgacgcattaccacgcgaaattcagtctggcatgcttcttagagtgcagcccgtgttgttcaacgtgggcatcaatgagcagcagactctggcagagcggttcggggatacttccctccaagaagtaatcaacgtggagagtctggttcgcctgaactcatatttcgaacagtttaaggaggtgttaccagaagattgtctgcctaggtcccgatcgcagacatgcttgcctgagctactccggttcctagggcagaacgtgcacgcaaggaaaaacaagaacgtcgatattctgtggcaggcagcagaaatctgtcgtagactgaatggggtgcgctttacgtcatgcaagtccgccaaagatagaacagctatgagtgtgacacttgaacagtgtttgatactccaacacgagcatggtatggccccccaggtctttacccaggctcttgagtgtatgcggtccgaggggtgccgccgtgaaaacacgatgaaaaatgtgggctcccgcaagtatgcgttcaatagcctgcagctgaaggcattcccgaagcattatagaccacccgaaggtacatacgggaaggtggagacttag

SEQ ID NO: 120638 - DNA, 2934 bp, Artificial Sequence
  Description of Artificial Sequence: Synthetic coding sequence
atgacagcaagagaacactcccctcgacatggggcccgggcacgggctatgcaaagagcgtctactatcgatgttgccgccgacatgctgggcctgagccttgccggtaacattcaggatcccgatgaacccattctcgagttctcactggcttgttccgagctacatacccccagtctggataggaagcccaactcttttgtggccgtcagcgtcacaaccccaccccaagccttttggactaagcatgcacagacggagattatcgagggtacaaacaatcccatttttctgtccagtatagctttttttcaagacagtttaattaaccaaatgacacaggtaaagctgagtgtttacgacgttaaagaccgctcacaaggtacaatgtacctgctaggaagcggcacattcatagtgaaagacctgcttcaggataggcaccataggcttcacctgaccctgagaagtgccgagagcgacagagtcggaaacatcacagtgatcggctggcaaatggaagagaagagcgaccaaaggccgcccgtaacacgcagcgtggatacggtgaacggaagaatggtactccccgtggacgaatccctgaccgaggctttaggcattcgaagtaagtatgcgagcctaagaaaagacaccctgctgaaaagtgtgtttggcggcgctatctgccgtatgtataggttccctaccactgatggaaaccatctgcgtatcttggagcaaatggcagagtcggtgcttagtttacacgtccccaggcagtttgtaaaactactgctggaagaagatgctgcccgtgtttgtgagcttgaggagctcggggaactaagcccctgttgggagtcactgaggagacagattgttacacaatatcagacaatcatcctgacataccaggaaaatctgaccgacctgcaccagtacaggggtccctctttcaaagcaagcagtcttaaagctgataaaaaactggaattcgttccgaccaacctacacatccagaggatgagggtgcaggacgacggcggtagcgatcagaactacgacattgtcactattggcgcccccgccgcccattgtcagggcttcaagagtggggggttgcgaaagaaactgcacaagtttgaagaaacaaagaagcacttcgaagaatgctgtacgtcctccggctgccagagcattatatacatcccccaggacgtggtgagagccaaagagatcatagcacaaatcaatactttaaaaacacaggtaagctactacgccgaacgactgtcgcgggccgcaaaagacagaagcgcaaccggcctggagcgtacactggcaatcctggccgacaagacacgtcagctggtcactgtgtgcgattgcaagctcctggccaacagtatccatggtttgaacgccgccaggcctgattacatagctagtaaagctagtcctaccagcaccgaagaagagcaggttatgctccgcaacgatcaagatactctgatggctcgctggactgggaggaactcccgatcctcactgcaggtggattggcacgaagaggaatgggagaaggtgtggttgaacgtggataaatccttagaatgcatcatccaaagagtggacaaacttttacagaaggagagactgcatggcgagggatgcgaggacgtctttccatgtgccgggtcttgcaccagtaaaaagggtaaccccgattcacatgcttactggatcagaccagaggaccccttttgcgacgttcccagttctccctgcccgagcacgatgccttccactgcatgccatccacacctcaccactcattgtagtcctccgcccgaagagtcatcccctggcgagtggtccgaagcgctgtacccactactcacaacactgacagactgcgtagccatgatgagcgacaaagccaagaaggccatggtgttcctgctgatgcaagattcagccccgaccatcgctacttatctcagtctgcagtacaggagggacgtggtgttctgccagaccctgacggctctgatctgtggatttattataaaactgcgaaattgtttgcacgatgatgggttcttgcggcagttgtatacgatcggcctgcttgcccaatttgagtccctgctgtcaacgtatggagaagagcttgccatgcttgaggacatgagccttggcataatggacctgaggaatgttacttttaaagtcactcaagccacatcctccgctagcgccgacatgttaccagtgatcaccggtaatcgcgacggattcaacgtgagggtgccgctgccaggccctctattcgatgcattaccccgcgaaatacagagtggaatgctgctaagagtccaacctgtcctgttcaatgtgggtatcaatgaacagcagaccctggcagaacgttttggcgacacgtcactacaggaggtgattaatgttgaaagtctggtgcgccttaattcctattttgagcagtttaaggaggtcctgcctgaagattgcctgccaaggagccgcagccaaacctgcctgcccgaactgctgaggttcttaggacagaatgtacacgcgcgaaagaacaaaaacgtggatattctctggcaagctgccgaaatttgtaggaggctgaatggggtgcgattcacaagctgtaagtccgctaaggatcggaccgctatgtcagtcaccctggaacaatgcctgatcctgcaacacgaacacgggatggccccccaggtgttcacacaagctcttgagtgcatgcgatctgaaggctgtcgtagggagaacacgatgaagaatgtgggctcccggaagtacgcattcaactctctccagctgaaagcatttccgaagcactatcggccaccggaaggtacctacggaaaggtggagacttag

SEQ ID NO: 120639 - DNA, 2817 bp, Artificial Sequence
  Description of Artificial Sequence: Synthetic coding sequence
atgaccgccagagagcactccccccggcacggagcacgtgcacgagctatgcaacgcgctagtactatcgacgttgcggcggacatgctgggcctgtccctggccggcaacatccaggacccggatgagcccattttggagttctccctggcctgttcggagttgcacacgccctccctggatcggaaacccaattcttttgtagctgtgtccgtgaccactcctccacaggccttctggacaaagcacgcacagacagagattattgaggggactaataatccaatctttctttcgagcatcgccttctttcaggatagtttaatcaatcaaatgactcaggttaaactgtctgtatacgacgtgaaggatcgttcccaggggaccatgtacctcctgggctctgggacatttatcgtgaaagacctactgcaggatcggcaccaccgactgcacctaaccctgagatccgctgaatcggaccgggtggggaacatcaccgtaattggctggcagatggaagagaagagcgaccaacggccacctgtgactcgctcggtcgacactgtgaatggtcgcatggttctccctgtcgatgaaagcctgacggaggctctgggcatacgatctaaatacgcgagtcttcggaaagacacactgctcaaatctgtgttcggaggcgccatttgcagaatgtaccgtttccctacaacagatggaaatcacttgcggatactcgagcagatggccgaatctgtcctgtctctccatgtcccacggcagttcgtgaaactactgctggaagaggatgccgcacgtgtgtgcgagctggaggagctgggagaactgtcaccttgctgggagtctctgagaagacagattgtcacccaatatcagacgattatactgacctaccaggagaatctaacagatcttcatcaatacagggggccctcttttaaagcatcctccctgaaagccgacaaaaaactggagtttgtgcctacaaacctgcacatccagaggatgagagtccaggacgacggcgggagcgatcagaattatgatattgtgacaattggcgctcccgctgctcactgccagggctttaaatcaggcgggctaaggaagaagctgcacaagttcgaggaaaccaaaaaacagcaagaagaatcacggacaagctccggctgtcagtccatcatctacatcccacaggacgtcgtccgggctaaagagataatagcacagattaacaccctgaaaacccaggtgtcctattatgcagagaggctgtcgagggccgctaaggatagatccgccactgggctagagagaacactcgccatactggccgataaaacacgtcagctcgtgacggtatgtgattgcaaattgctcgctaactccatccacggtcttaacgctgccaggcccgattatatcgcgagcaaagcttcacccaccagcaccgaggaggagcaagtgatgctgaggaatgaccaagacactttgatggcaagatggacgggaagaaattctaggtcatctctgcaggtagattggcacgaggaggaatgggagaaggtgtggttgaacgtggataaatctctggaatgtatcattcaacgggtcgataagctgttacagaaggagagattacatggagagggctgtgaggacgtctttccttgtgctggttcttgtacatctaaaaaggattgttctccgcctcccgaggagagtagccctggtgaatggtctgaagcactctacccgttattaaccaccctgaccgattgcgttgctatgatgtccgacaaagctaagaaggcaatggtgtttctgctgatgcaggactccgcacctacaattgcgacttacctgagcctacagtatcgccgcgatgttgtcttttgccaaactcttacagccctcatttgcggattcatcataaagcttcgcaattgtttgcatgacgatggcttcctaaggcagctgtatactataggtctcctcgctcagtttgagagcttgttatccacatacggcgaagagttggcaatgcttgaagacatgagtctgggcatcatggacctgcggaacgtcaccttcaaagtgacgcaagcaacctcgagcgcaagtgcagatatgctccctgtgatcacagggaatcgagacggatttaatgtgagggtgcctctccctggaccactgttcgatgccctgcccagggagatccagtcaggcatgctcttacgggtccagcccgtcctgttcaacgtgggtattaacgagcagcagacgttggctgaaagatttggggacacgtcactgcaggaagtgataaacgtggaatctttagtaaggctaaattcctatttcgaacagttcaaagaagtactacccgaggattgtctccctagatcaagatcgcagacctgtctccccgaactgctccggttcctaggtcagaatgtccacgctagaaaaaataaaaacgtcgatattctgtggcaggctgccgagatttgtcgaagactgaacggcgtgaggtttacaagctgcaaatctgctaaggatcggacggctatgagtgttacgttagaacagtgtctaatcctccaacatgaacatggaatggctccccaagtgtttacacaagctttagagtgcatgcggtccgagggctgccgccgggagaacactatgaaaaacgtggggagccgcaagtacgccttcaactctctgcagttaaaggcgttccctaagcactatcgtccgccggaaggaacctacggcaaggtggagacgtag

SEQ ID NO: 120640 - DNA, 3021 bp, Artificial Sequence
  Description of Artificial Sequence: Synthetic coding sequence
atggagggccagtctagcagaggatccaggagacctggaactagggccgggctcggatcactgcccatgcctcagggagttgctcagacgggagcgcctagcaaggtggactcgagctttcagctcccggctaagaagaatgctgcgttgggaccatccgagcctcgcctggctctggctcctgttggccctcgcgccgcgatgtctgcctctagcgagggtcctagactggcgctggctagccctcggcctatcctggcccccttgtgtactcctgaaggacagaaaactgctactgcccataggagctcaagcctggcccctacctcggttggccagctggtcatgagcgctagcgctgggcccaaacctccaccggccacaactggctccgtccttgcaccgacatcgctcggactggtaatgcccgcctctgctggccctagatcgccccctgttaccctcggacctaaccttgccccaacaagccgtgaccagaaacaagagccccccgcatccgtcgggcccaagccaactctggcagcctcaggtctttccctcgccttggcatcagaagagcagccgcccgaactgccttccaccccttctccagtgcccagtcccgttctttctccaactcaggaacaagcacttgcacctgcttccacagcctcaggggccgcgtcggtgggacagaccagtgctaggaaacgggatgctcccgctccacgccccctgcccgccagcgaaggccatttacagccaccagcccaaacatccggccctacaggttccccgccctgtattcagacaagcccggatcccaggctgagcccctcttttcgggcaagaccagaagctctccactcttctcccgaagaccctgtgctgcccagaccaccacagacgctgccacttgacgtgggtcaaggtcccagcgagcctggcacacacagccctggactgcttagtcccacattcaggccaggagccccatccgggcagactgttccaccacccctgcccaaaccacccaggtcccccagccgtagcccatcccacagtcccaacaggagcccgtgcgtcccacccgcacctgacatggcacttccgcggctcggcactcagagcaccggtccaggccgctgtctgtcccctaatttgcaggcccaggaagcccctgctccagttacaacctcctcaagcaccagcactctgtccagcagcccgtggagcgcacagcccacctggaaatcagatccaggcttccggattaccgtagtgacgtggaacgtagggacagctatgccacctgatgacgttactagtctcttgcatctgggcggaggggatgattccgacggcgcggatatgatcgcaattggcctacaggaagtgaatagcatgctcaataagagattgaaggacgccctgtttactgatcagtggagcgagttgttcatggacgccctgggacccttcaatttcgtcctcgtgagtagcgtgaggatgcagggggtgatccttcttctgtttgcaaaatactatcacctgccctttctcagggacgttcagacagactgtactcggaccggtctgggcggctactggggcaacaaaggtggggtgagcgtacgcctggccgctttcggtcacatgctgtgcttcttaaattgtcatctaccagcccacatggacaaagccgagcagcgcaaagataattttcaaaccatcctgtcactgcagcagtttcaaggcccgggcgcacaggggatccttgaccatgacctcgtgttttggttcggagatttgaacttcaggatagagagttatgatttgcactttgtgaagtttgcaattgatagtgaccagctgcatcagctgtgggagaaagatcagctcaacatggcaaagaacacatggcccatactcaaaggcttccaggaaggaccactcaactttgctccaacattcaagtttgatgtagggacgaacaaatacgacacatcagctaagaaaagaaagcctgcttggacagaccgcatcttgtggaaagtcaaggcacccgggggtggccctagcccctctggaagaaagagccaccggctgcaggtgacgcaacattcctaccgtagccatatggagtacacagtgtcagatcacaagcccgtagccgctcaatttctactgcaatttgctttccgcgatgacatgcctctggttaggctagaagtagctgacgagtgggttcgccctgagcaagctgtggtgcgatatcgcatggaaacggtattcgcgcgctctagttgggattggatagggttatatagggttggcttccgccattgcaaggactacgttgcctatgtttgggccaagcacgaggacgtggacgggaacacataccaagtgacgttctcagaggagtcactgccaaagggccacggtgacttcattctgggctattactcgcacaatcatagcattctgatcggcatcacggaaccattccagatctctcttccctcaagcgaactcgccagctcaagcacagacagttcaggcacaagcagcgaaggggaggatgatagcacactggaattgctggcccctaagtctaggagcccctccccaggaaaatcaaaacggcatagaagccgttcgcccgggctggcccgcttccccggcctggctctgaggcccagtagcagggaacggcgtggcgcctctcgttctccttccccacagagccgccgattgtcgcgggtagcaccagacagaagttccaacggatctagtcggggctcatcagaggaaggtccgtcaggacttcccggcccatgggctttcccgccagcagtgccaaggtccctggggttgctgcccgccctcagattagagaccgttgatccaggcggtggaggatcttggggccctgaccgagaggctctggcccccaattcactgtctccaagtcctcaaggccaccgcggattggaggaaggcggccttggtccttag

SEQ ID NO: 120641 - DNA, 1920 bp, Artificial Sequence
  Description of Artificial Sequence: Synthetic coding sequence
atggcactgccccgtctgggaactcaatcaacagggcccggccggtgtctgagccctaatctgcaggcacaagaggcacctgcccccgtgacgacctcatcctccactagtaccctctcttcctccccatggagtgcacagcccacgtggaagtctgatccaggcttcagaattacagtcgttacctggaacgtgggaacagccatgccccccgatgatgtcactagcctgctacacctcggagggggagatgattctgacggggccgacatgatcgctataggccttcaagaggtgaattccatgctaaataaacggctaaaagacgcactgtttaccgatcaatggtcagagctgtttatggatgccctgggcccattcaatttcgtgttggtgtcttccgtgagaatgcaaggggtcatcctcctgctgtttgccaagtactaccatttacctttcctcagggacgtccagacagactgtacgcggaccggactgggcggctattgggggaataaagggggagtgagcgtgaggctggcagcatttggccatatgctctgtttcctcaattgtcatttgccagcacatatggacaaagcggaacagagaaaagataactttcagacaatattatccctgcaacagtttcagggccccggtgcgcaaggtatcctggatcacgatcttgtcttttggtttggtgacctgaacttccggatcgagtcctacgacctacattttgtcaagttcgccatcgattccgaccaactacatcagctgtgggaaaaagaccaactgaacatggctaaaaatacatggcccattttgaaaggcttccaggagggccctttaaacttcgcccccaccttcaaatttgacgtcggcacaaacaagtatgatacctctgctaagaaaaggaaacccgcctggacagaccgcatcctctggaaagtgaaggctccaggcgggggcccctctccatcaggccgtaagtctcaccgcctccaagttacccagcactcataccgctcacacatggagtacacggtgagcgatcacaaaccggttgcggcacagtttctgctgcagttcgcctttcgcgacgacatgcccctggtccgcctggaagtcgccgatgaatgggtgcgccccgagcaagccgtggtaaggtacagaatggaaacagtcttcgcgcgtagctcttgggattggattggactctaccgcgtaggatttagacattgtaaagactacgtcgcctatgtttgggccaagcacgaggacgtggatggaaatacctaccaggtgactttttccgaagagagtctgcctaagggacatggcgacttcattcttgggtattattctcataatcattctatcttaatcggcatcacagagccctttcagatcagccttccatcatccgagttggccagctcttccacggacagttccggcacctcctccgaaggagaagatgactccacccttgagcttctcgcgcctaagtccaggtccccaagtcccggaaagagcaagcggcatcggtccagaagtcctggcctggccagattcccaggcctggccttgaggccctcgtctagggagcggcgaggcgcttccagatccccatcccctcagtccagaaggctgtctcgggttgcacccgaccgcagttccaatggctcctctagggggagttctgaggagggaccgtccgggctgccaggaccttgggctttcccacccgcagtgcccagatccctaggccttctacccgccctacggctggagaccgtggacccgggggggggcggctcttggggcccggaccgggaagccctggcacccaactccctgtccccttcgcctcagggccacagagggctggaagagggcggcttaggcccgtag

SEQ ID NO: 120642 - DNA, 1917 bp, Artificial Sequence
  Description of Artificial Sequence: Synthetic coding sequence
atggagggccagtccagccgcgggtcacgtcgaccaggcacccgagcaggcttagggtccctgccaatgcctcagggcgtcgctcagactggcgccccttccaaagtggacagtagcttccagctgcctgccaagaagaatgccgcgcttggacctagtgaaccaagaattacagtggttacttggaatgtcgggaccgctatgccacccgacgacgtgaccagtctcctacacttaggcggtggagacgattccgatggcgctgatatgatagccatagggctgcaggaagtgaatagcatgctgaacaaaaggctcaaggatgctctgttcactgaccaatggtccgagctgtttatggatgccttgggccccttcaatttcgtgctcgtgtcctctgtgcgaatgcagggggtcattcttctcctcttcgctaaatattatcacctgcccttcctgagggacgtccagactgattgtaccaggactggtctgggaggctactggggaaataaaggcggagtgagcgttcgacttgcagctttcggtcacatgctttgtttcctgaactgccatctgcccgcacacatggataaggcagaacagcgcaaggataactttcagacaattttgagccttcagcagtttcagggccctggcgcccagggcattttggaccacgacctcgtgttttggttcggcgaccttaattttcggattgagtcctacgacttgcactttgtaaagttcgctattgattctgaccagctgcatcagctctgggaaaaagatcaactcaacatggcaaagaatacttggcctattctgaaagggtttcaagaaggcccactgaactttgcaccaacctttaaatttgatgtcggaactaataaatatgatacctccgctaagaagagaaaaccagcctggacagataggattttgtggaaagttaaagctcccggcggaggcccgagcccctcaggcaggaaaagccaccgccttcaggtgactcagcatagctatcgctcacacatggagtataccgtgagcgatcataaacccgtggccgcccaatttctgctccagttcgccttccgcgacgacatgccactcgtcaggctggaggtggcagatgagtgggtgcggcccgagcaggctgtcgtacggtatcggatggagacagtgttcgcacgctcctcatgggattggatcggcctctatagagtagggttcaggcattgtaaggattatgtcgcctatgtgtgggcgaagcacgaggatgttgacggtaacacataccaggttacttttagtgaggagagcctgcccaagggacatggcgattttattctcggatattattctcacaatcactccatactgattggcatcactgagcctttccagatcagcctacccagcagtgaactggctagcagctcaaccgactcctctggcacatctagcgaaggtgaggacgatagcaccctggaacttctggcgccaaagagcaggtctccatcccccggcaagtcaaagagacatcggagcaggtcaccagggcttgcacggtttcctgggcttgcactccgcccctcctcccgggagcggaggggggcctctcggtcacctagccctcagtctcgtcggctatcccgggtcgcaccagataggagctcaaatggctcttcccgcgggagcagcgaggagggccctagcggtctccccggtccctgggctttccctcccgctgtgcctcgatccctgggtttgttgcccgctctgcgattggagacagtggatcctggagggggcggcagttggggccccgaccgggaggctctggcccccaactccctaagcccatcaccacagggacatcgggggctggaggaagggggcctgggcccctag

SEQ ID NO: 120643 - DNA, 1920 bp, Artificial Sequence
  Description of Artificial Sequence: Synthetic coding sequence
atggcattgccgcgtcttgggactcaatccacaggaccgggcagatgcctgagtccaaacctgcaggctcaggaagctccagcccccgtgaccactagcagcagcacaagcaccctgtcgtcctccccctggtcagcacagccaacttggaagtcggatccgggatttcggatcaccgtcgttacgtggaacgtaggcaccgccatgccgccagatgacgtgaccagtttactgcacctggggggcggcgatgactcggacggtgccgacatgattgccatcggactgcaggaggttaacagtatgctgaataagcgactcaaggacgcgctgttcactgatcagtggtctgagctttttatggatgcccttggacctttcaacttcgtcttagtcagctccgtaaggatgcaaggcgttattctgcttctgttcgccaagtactaccatttaccctttttgagagacgttcaaaccgactgcacccgcactggcctgggcggctattggggaaacaagggtggtgtttcggttcggcttgctgccttcggccacatgttgtgctttttgaactgccaccttcccgcccacatggacaaggcagaacaacgaaaggacaacttccaaactatcttatctctgcagcagttccagggacccggagcacaagggatactagaccacgacttggtattctggtttggagacctgaacttccgcatagagtcctacgacctccacttcgtcaagttcgctattgattccgaccaactgcaccaactctgggagaaagaccagcttaatatggcgaaaaatacttggcctattctgaaggggttccaggaaggcccactgaattttgcccctacctttaaattcgacgtgggaactaacaagtacgacacttctgccaagaagagaaaaccagcctggaccgaccgaatcttatggaaagtgaaagcacctgggggtggcccatcgccatccggccgcaagagtcacaggctgcaggtcactcagcacagctaccggtcgcatatggaatatacggtgagcgaccacaaaccagtagctgcacagtttctgctccaattcgcttttcgggatgacatgccactagtacgcctggaagtggctgacgaatgggtgcggccagaacaggcggtggtgagataccggatggagacagtgtttgcacgcagcagctgggattggatcggcctctatagggttgggttccgacactgcaaagattacgtggcttacgtctgggcaaagcacgaagatgtggatggtaacacctaccaggtgacttttagcgaggagagcttgccaaaaggccatggtgatttcattctggggtactacagtcataatcattccatacttatagggattaccgagccttttcaaattagcctacccagctcagaactggcctccagctccacggactcatctggcaccagttccgagggggaggatgatagtactctggaactccttgcccccaaatctaggtcaccctcgccaggcaaaagcaaacgccaccggtctagatcgcccggtttagcaaggtttcccgggttagccctccgcccaagctcacgcgagcggcggggcgcatcaagaagcccttcaccccagtctcgccgtttgtccagggttgctccagaccgctctagtaatgggtccagtcgcgggagctccgaagaaggcccatcaggactccctggaccatgggcattcccccccgcagtccctaggagcctaggcttactgcctgctttacggttggagacagtcgaccccggtgggggggggagctggggcccagatcgcgaggcattagcaccaaattcactgtcccccagtccgcagggacacagaggcttagaggagggcggattgggtccttag

SEQ ID NO: 120644 - DNA, 2820 bp, Artificial Sequence
  Description of Artificial Sequence: Synthetic coding sequence
atgtcggcctccagcgaagggccacggctagccttggcctctccaaggcctatcttggctcccctgtgtacacccgaggggcagaaaactgcaactgcacatcgttcaagctcactcgcacctacctccgtagggcaactggtgatgagcgccagtgccgggcccaagccaccaccagccacaactggtagcgtgcttgcgcctaccagcctgggccttgtgatgcccgccagtgctggtcctagatcgccgccggtgacactcggccctaaccttgctcccacctctagagaccaaaaacaggaaccccctgcttcagtcggccccaagccgaccttggcagcatcaggcctctccctggccctggctagtgaggagcagccaccagagcttccctctacgccatccccggtgccaagcccggtcctgtcacctacccaggaacaggccctggctcccgcctcgacagcatcgggggccgctagcgtggggcagacttcggcccgcaaacgggatgctcccgccccgagacctttgcctgcctccgaaggtcacctacagccccctgcgcagaccagtggaccgaccgggagccctccttgtattcagacaagccccgacccccggttgtccccgtctttcagggccaggccagaagctttgcattctagtccagaagaccctgtgctccctaggcccccacagaccctgccattggatgtgggccaagggcctagtgagcctggaactcactctccgggcctcctgtcccccacattccgccccggagctccgtccggacaaacagttcctccccctttgcccaaacctcctcgcagtccaagtaggtctccatcacattctcctaatcggagcccgtgcgtaccacccgctccagacatggccctgccgaggttgggtacccagtccactggtccagggaggtgcctcagtcccaatctgcaggctcaggaggctcccgcacctgtaaccacctccagttcgacctcgacactcagtagtagcccttggtcagcacagcccacctggaagtcagaccctggctttcgaatcactgtggtgacatggaatgtgggcaccgccatgccgccagatgacgtcacatcacttctgcatctgggagggggggatgattcagacggcgcggatatgatagccataggccttcaggaagtcaattctatgttgaacaagcggctgaaagacgccctcttcacagatcagtggtccgagctctttatggatgcactgggacccttcaatttcgtgctggtatcctctgttcgcatgcagggcgtgatcctactcctgttcgctaagtactaccacctccccttcctccgagatgttcagacagactgtacacgaacaggtctaggcggatactgggggaataagggaggggtgtccgtgaggcttgccgccttcggtcacatgctttgcttccttaactgccatcttcctgcacacatggataaagcagaacagcggaaggataacttccagacaatcctctcgctccagcagttccagggacccggagcgcaggggatcctggatcacgacctggttttctggttcggggatcttaacttcagaattgagagctatgatcttcacttcgtcaaatttgccattgacagcgaccagctgcaccaactgtgggagaaggatcagttgaacatggctaagaatacatggcctattctgaagggattccaggagggtcctctgaactttgctcccacttttaaatttgatgtggggaccaataaatatgatacctctgcaaagaaacgtaagccggcatggaccgaccgaattctctggaaggtgaaggctcccggaggaggacccagccccagtgggcggaagtctcatagacttcaggtgacccagcattcatatcgatcacacatggagtacactgttagtgaccacaagcctgtggctgcacaattcctactccagttcgccttccgcgacgacatgcccttagttcggctggaggttgcggacgagtgggtgcgtcccgagcaggccgtggtgcgttatcggatggagacagtatttgcaaggagctcctgggactggatagggttgtacagggtcgggtttcggcactgcaaggactatgtggcatatgtgtgggccaagcatgaggatgtcgacgggaatacctaccaggtgacattctccgaagagtccttgccaaaaggccatggggactttattctcgggtattattcccataatcatagtatactgatagggataactgagccgtttcagattagtttgccatcttctgaattggcaagctcaagtacagactccagtgggactagttcggagggtgaggatgattccaccctcgaactgctcgcccccaaaagtcgaagtcctagtcctggcaaatctaagcgccatcggtcacgatcccctgggctggcacgcttcccaggcctggcccttcgcccctcctcaagggagaggagaggtgcttccagatccccatcccctcaatccagaaggctgtccagggtggctccagaccggagcagtaatggcagctctagaggtagtagtgaggaggggccaagcgggctgcccggtccctgggccttccccccggcagtgcctcggagcttgggtcttctgccagcccttaggcttgaaactgttgacccaggaggcggtggatcctggggccctgacagagaggcgttggcgcccaattcgctgtctcccagcccacagggccatcgcggacttgaggaagggggcctgggaccgtag

SEQ ID NO: 120645 - DNA, 3534 bp, Artificial Sequence
  Description of Artificial Sequence: Synthetic coding sequence
atggtgccctgctggaatcacggcaatatcacgagatctaaggccgaagagctcctttcacgcacagggaaagacggaagctttctcgtcagagctagtgagtccatctcacgggcctacgctctgtgtgttctttatcgcaattgtgtttatacctaccggatcctgccaaatgaagatgacaagttcactgtgcaggccagcgaaggcgtgtcaatgcgcttcttcacgaaattagatcagctaattgaattttataaaaaagagaatatgggacttgtgacacacctacagtatccggtgccactggaagaggaggacacaggcgatgatcccgaagaggacactgtcgaatctgtagtgtccccccctgagctgccacctaggaatatccctctgacagcgagttcatgtgaagccaaggaggtgccattttccaatgaaaatccacgagcgacagaaacgtcgcgtccttctctgagcgagaccctcttccagcgcctccagagcatggatacatcggggctcccagaggagcatctgaaagcgattcaagactacctttcaactcaattggcgcaagattccgaattcgtcaagactggctcaagctcactgccccacctaaaaaaacttacaactctgctgtgcaaagagctgtatggccaaatgctgagaactgtgccaggaattggaaaagttaaggaggaggaccacgtaccgggtgaagccaatcccatcaacatggtgagtaagctgagtcagctgacttcactcttatcgagcattgaagataaggtcaaggccctgttgcacgaagggcctgaaagcccccatcgtcctagtctgatcccgcccgtgactttcgaagtgaaagccgaatccttgggcatccctcagaagatgcaactgaaggttgatgtcgagtccggtaagctgattatcaaaaaaagcaaggatggctccgaagataaattctacagccataagaagatcttacaactgattaagtcacaaaagtttctcaacaagcttgtcattctggttgagactgaaaaggagaagatcctgaggaaggaatacgttttcgccgatagcaaaaagagagaaggcttttgtcagctgctccagcagatgaaaaataaacactccgaacagccagagcccgatatgattaccatttttataggaacctggaatatgggtaatgctcctccacctaagaagatcacctcctggttcctctctaaaggtcaaggcaaaaccagagatgactctgctgattacatcccccacgatatctatgtcattggtacccaggaggaccctttatcagaaaaagagtggcttgaaattttgaagcacagccttcaggaaattaccagcgtgaccttcaagacggttgctattcatactctgtggaacattagaatcgttgttctggcaaaacctgagcatgaaaaccgcatttctcatatctgtacagacaacgttaagacaggtattgcaaacacacttgggaacaaaggcgcagtcggagtctcttttatgtttaacggcacctccttaggctttgttaattcccacctgaccagcggctctgaaaagaaactgaggcggaaccagaactacatgaacatattgagatttttggcgctcggtgacaagaagcttagtccattcaatattacgcatcggttcacacacctgttttggttcggcgacttgaactaccgagtggatctgccaacgtgggaagccgagacaataattcagaagataaagcagcaacagtatgccgatctcctgagtcatgaccagttattgactgaacgcagagaacaaaaagtgttccttcatttcgaggaggaggaaatcacctttgcgccgacgtacaggtttgaaaggctcactagggacaagtatgcctatacgaagcaaaaggcgactgggatgaaatataacctgcctagctggtgtgatcgtgtactgtggaaatcctaccctttagtgcatgttgtttgccagtcttacggcagcacgtccgacatcatgacctccgaccactctcctgtgttcgcgacctttgaggccggggtcacatcccaattcgtctccaaaaacggcccaggcaccgttgactcacagggccagatcgagttccttcggtgttatgccacgctgaaaacaaaaagtcagacgaagttttacctggagttccacagtagctgtctcgagtcatttgtaaaaagccaagagggggaaaatgaagaaggctctgaaggggagctggtggttaaattcggtgaaaccctgcctaagctgaagccaatcatttccgatcccgaatacctgctcgatcaacacatcctgatttccataaaatcttcggatagcgacgaaagctacggtgagggctgtattgcactgaggctggaggcaaccgaaacgcagctacctatttacactccactgacccatcacggcgaattaactggccacttccagggcgaaattaaactgcagacctcacaaggcaaaactagagaaaagctttatgatttcgtgaaaaccgagcgagatgaatcttccggtcctaaaactctgaaatctttaacatcacacgatccgatgaaacagtgggaagttaccagtcgcgctcctccctgctctggatcttcaatcaccgagattatcaatcccaactacatgggtgtgggcccatttggcccccccatgcccctgcatgttaaacagaccctttctccagatcagcagcccacagcctggtcttatgatcaacctccaaaggattccccactgggcccatgtagaggagaaagcccaccaacccctcctggacagcctcccatttcccccaagaaatttctgccctccaccgcaaacagaggtctaccacccagaacccaggagagtcgtccgtccgacctggggaagaacgccggggatactttacctcaggaggacctgcccctcaccaagcctgagatgtttgagaacccactttacggctcactgtctagttttcccaaaccggctcctcgcaaagatcaggagtctcccaagatgccaagaaaggagccccccccttgcccagagccggggatcctttccccctcgatcgtgttgacaaaggctcaagaggcagacagaggagagggacctggcaaacaagtcccagccccaagacttcggtcatttacctgcagtagctccgccgaaggccgggccgccggaggcgataaatcccagggtaagcccaagactcctgtgagctcccaggctcctgtcccagctaaaaggcctatcaaaccctcgcgatctgagatcaaccagcagacccctcccactcccacgccccgtcccccactcccggtgaaaagtcccgccgttctgcacttgcagcactcaaagggtagagactatagggataacaccgaattgccacaccatggcaagcatcgtccagaggaaggccctcctggaccccttggccggaccgccatgcagtag

SEQ ID NO: 120646 - DNA, 2433 bp, Artificial Sequence
  Description of Artificial Sequence: Synthetic coding sequence
aaacgcgaaggcttctgccagctgctgcaacagatgaaaaacaaacacagcgaacagcccgagccggacatgattacaatctttataggcacctggaatatgggtaacgccccccccccaaagaagatcacaagctggtttttgagcaaggggcaaggcaaaacgcgagacgacagcgcagattacatccctcatgatatttacgtgatcggcacacaggaggacccgctttccgagaaggagtggctcgaaatccttaaacacagccttcaggaaataaccagtgtcacattcaagactgtcgcaatccataccttgtggaatatcagaatcgtagtgttagcaaagccagagcacgaaaatcggatttctcacatctgtactgataacgtgaaaaccggcatcgctaacactcttggcaacaaaggggctgtgggcgtgagttttatgtttaacggcaccagccttgggtttgtgaatagccacctcacctcaggttctgagaaaaaattgagacgaaatcaaaattacatgaacattctcagattcctggcccttggcgataagaaattgagtccatttaacatcactcacaggtttacccacctcttttggttcggcgacctgaactaccgggtggatctgcctacatgggaggccgagaccattatacaaaaaatcaaacagcagcaatatgcggatctgctatcacacgaccaactcttaaccgaaagacgcgaacagaaggttttcttacactttgaagaagaagagataacttttgcgccaacctaccggtttgagaggttaactagagacaaatatgcgtacacgaagcagaaggcaactggcatgaagtacaatctgccgagttggtgtgacagggttctgtggaaatcgtatcctctggtccatgtcgtgtgccagagctatggatccaccagcgatataatgacctcagatcattcacctgtcttcgctactttcgaagctggcgttacctctcagtttgtctctaaaaatggccctgggaccgtggattcacagggacagatcgaatttttgaggtgctacgctaccctgaagacaaagtcacagacaaagttttacctcgaatttcattcttcatgcctggagtctttcgtcaagtcccaagagggggaaaacgaggaggggtcagaaggagaattggtggttaagttcggcgaaactctgcctaagctgaagcctatcatatctgacccagagtatctcctcgatcagcacatcctgatatcaatcaaaagctctgactctgatgagagctatggggagggctgcatcgctctgagactggaagccaccgaaactcagcttcctatatatacgcccctaacacaccacggagagcttacagggcacttccagggggagatcaaactgcagacatctcaggggaaaaccagagaaaaactctatgatttcgttaaaacagagcgcgacgagtcctcggggccgaaaacactcaaaagcctgacaagccatgaccctatgaaacagtgggaggtgacaagccgtgctcctccgtgctccgggtcttccataacagaaataataaatcccaactacatgggggtagggccctttggcccacctatgcccttgcatgtgaagcaaacgctgtctccagaccagcaacctactgcttggtcctacgatcagccacccaaagattcgcctttaggcccatgccgcggcgaatcccctcccacacctccaggtcagccgcccatttctcccaagaagtttttgcctagcaccgcaaaccgtggattgccacctcggacccaagaaagcagacccagcgacctcggcaagaatgccggtgatacattaccgcaggaggatttgcccttgactaagcctgagatgtttgaaaatcctctgtacggttcactcagttcgttccccaagcccgccccaagaaaggatcaggaaagtcccaagatgcccagaaaagagccgcccccctgtcccgagccaggtatcttgagccccagcatcgtgctgacaaaggcacaggaggcggatcgaggcgagggcccaggaaagcaagtccctgccccccggctcaggtcatttacatgctcctccagcgcggagggccgcgccgccggaggcgataagtcacagggcaaacctaagactcccgtctcctcccaggctcccgtccccgctaaaaggccaatcaaaccatccagatcggagattaaccagcagacacctcctaccccaacaccccgccccccattgccagttaaaagccccgcagtgttgcacctgcaacacagcaaagggagagactatcgggataacacagaactgccacaccacggaaaacaccgaccggaagagggaccgcccggcccactggggaggacagctatgcagtag

SEQ ID NO: 120647 - DNA, 666 bp, Artificial Sequence
  Description of Artificial Sequence: Synthetic coding sequence
atggtcccctgttggaaccacggcaatataacccggtctaaggcggaagaacttttgtcgagaacgggcaaagacggaagctttctggtcagagcctcagagagcataagccgtgcctacgctctctgtgtactgtacaggaattgtgtctatacctaccgcatcctcccaaacgaggatgataagtttacagtgcaggcctctgaaggcgtgtccatgcgctttttcaccaaactcgaccagctgatcgaattttacaaaaaagagaatatgggcctggtgacacacctgcagtatcccgtccccctcgaggaggaggatacaggtgacgaccccgaggaggatactgagagtgtggtctctcccccggaactgccaccgagaaacattcccctgaccgcctcttcatgcgaggctaaggaagtgcctttctcgaacgagaaccctagagctaccgaaacttccagaccctccctttccgagaccctattccagcggctgcagtcaatggacacatccggtctcccagaggagcatttaaaagccattcaggactacctttcaacacaactagctcaggactccgagtttgttaagaccggcagctccagtctgcctcacctgaaaaaattgaccaccctgctgtgtaaggagctgtatggatag

SEQ ID NO: 120648 - DNA, 2433 bp, Artificial Sequence
  Description of Artificial Sequence: Synthetic coding sequence
aagcgagaaggcttctgtcagttgctccagcagatgaaaaacaagcactccgaacagcccgagccggatatgataaccatatttatcggcacttggaatatggggaacgcacctcctccaaagaaaatcacttcgtggttcttgtctaaaggacaaggcaagacccgggacgattccgcagactatatcccacatgacatatatgtgataggtactcaggaggaccccctcagcgaaaaagaatggctcgaaatcctcaagcacagccttcaagaaatcaccagcgtgaccttcaaaactgtagctatccatacgctgtggaacataaggatcgtggtgttggctaaacctgaacatgaaaatcgcatctctcatatctgcactgacaacgtgaaaacaggtattgcaaacacactgggcaacaagggcgccgtgggcgtgtcttttatgttcaacggtacatccctgggctttgtcaactcccacctgaccagtggatcagagaagaaactgcggcgaaatcaaaattacatgaacattctccgctttctggcgctaggcgacaaaaaactgtcccccttcaacataactcaccgattcacccacctgttctggttcggcgatctcaactatcgggtcgaccttcctacctgggaagccgagaccataatccaaaagatcaagcaacaacagtacgctgacttgttgtcccacgatcagttgcttaccgagcgtagggaacagaaagttttccttcacttcgaggaggaagagattacatttgccccaacttatagattcgagcgcctgactcgagataaatacgcttacaccaagcaaaaagccacaggaatgaagtacaacctcccgagctggtgtgacagagtgttgtggaagtcctatcccctggtgcacgtagtctgccagtcctacggatcaacatccgatatcatgacttcagatcacagcccggttttcgcaacattcgaagctggagtcacatctcagtttgtttcaaaaaatggacctggcacagtggactcacagggtcagatagagttcctcaggtgctatgccacattgaaaactaagagccagacaaagttttatctggagttccactctagctgtctagaatcgttcgtcaagtcccaggagggggaaaatgaggaggggagcgaaggggaactggtcgtgaaatttggtgagaccctgcctaagctcaagcctattatatctgatccagaatacctgctcgaccagcacattctgatctctattaagagttctgatagcgacgaaagctacggagaaggttgtatagccctcagacttgaggccacagaaacgcagttacccatctacacaccgctgacacatcatggcgagctcaccggccatttccaaggagagattaaactgcaaacctcgcagggtaagactagagagaagctgtacgatttcgtgaagaccgaaagagacgaaagctctggtcctaagacgttaaaaagcctgacatcacatgatcctatgaaacagtgggaagtcacctcccgggcccctccgtgttctggctcctccataaccgaaattatcaatccaaattatatgggggtgggtcctttcggccctcccatgccacttcatgtaaaacagaccctgtctccagaccagcagcccaccgcctggagctacgatcagccacccaaggattcccccctgggcccatgtcgcggcgagtcacccccgacgccccccggacagccccctatttcacccaagaagttcctgccaagcacagctaaccgggggctgcctccacggactcaagagtctcgcccttcagatctaggcaagaatgctggagacactttgccgcaggaagacctaccacttacgaagccagaaatgtttgaaaaccccctctacggcagcctgtcatcatttcccaaacctgctcctagaaaggatcaggagagcccgaagatgccccgcaaagagccccctccctgtcctgaaccaggaattctgagtccttctattgtcttgacaaaagcccaggaagccgatagaggagagggccctggtaagcaggtgccagcccccagacttcggtcttttacctgctcctcaagtgcagaagggagagctgccggaggtgataaatcacaaggaaaacccaagaccccagtgagcagccaggcacccgtccccgccaaaagaccaatcaagccaagtcgctcggagattaaccagcagacaccaccgaccccaacccctcgacctcccctgcctgtgaaatcaccagcagtgctgcaccttcagcattccaaaggacgggattatcgggacaacaccgaattgccacaccacggcaagcaccggcccgaagaaggcccgcctggtccgctcggaaggaccgccatgcagtag

SEQ ID NO: 120649 - DNA, 2433 bp, Artificial Sequence
  Description of Artificial Sequence: Synthetic coding sequence
aagcgggagggtttttgtcagttgctgcagcagatgaagaataagcacagcgaacagcccgagcctgacatgatcactattttcatcggtacatggaatatggggaatgcacccccccccaagaaaattactagttggtttctctcaaagggtcaagggaaaactagggacgactctgcagactacatcccccacgacatatacgtgatcggcacccaggaagatccattgagtgagaaagagtggcttgagattctgaagcatagcctgcaggagatcacctctgtgaccttcaagaccgtagcaatccacaccctgtggaacatccgtatagtggtgctcgccaagcctgagcatgaaaataggatcagccacatatgtacagataatgtgaagacagggatagctaacaccttggggaacaaaggagcagttggggtgagctttatgtttaatgggacctccttggggttcgtgaattcacatctaacctcaggatccgagaagaagctgcgacgcaaccagaattacatgaacatccttcggtttctggcccttggcgataaaaagctgtccccattcaacattacacatagattcacccatctgttttggttcggtgacttgaactaccgtgtggacctgcccacatgggaggctgagaccattattcagaaaatcaagcaacagcagtacgccgatctgctttctcatgatcaactactaacagaaaggagagagcaaaaagtgttcctccattttgaggaggaggagatcacattcgctcccacataccgctttgagagactcacccgtgataaatacgcatacacaaagcagaaggccacaggtatgaaatacaacctgccttcctggtgcgaccgggtcctctggaagagttatcccctcgttcacgtcgtatgccaatcatacggaagcacaagcgacatcatgacgtcagaccactcccctgtgtttgcaaccttcgaagcaggggtaacgtcacagtttgtgtccaagaatggccctgggaccgtggattctcagggccagatcgaattcctgcggtgctacgctaccctgaagactaaaagccaaaccaaattctacctagagtttcactcctcctgcctggagtcctttgttaagagtcaggagggcgaaaacgaagagggcagcgaaggggaattagtcgtgaaattcggcgagacactgccaaaactgaaaccgataatatccgatcccgagtatttgctagatcagcacattctaatcagcatcaagtcgagtgactccgatgaatcctatggggaaggatgcatagcactgaggctggaggccacagaaacccagcttcccatctatacacctctcacacaccatggtgagctgacgggccattttcagggagagattaaactgcaaaccagccagggaaaaactagagaaaagctatatgactttgttaagacggagcgggacgaatccagcggtcctaagaccctcaagtccctgacctctcacgatcctatgaaacaatgggaggtaacctcccgggcacctccttgcagcgggtcttccatcactgagattataaaccccaactacatgggtgttggtccattcggccctccaatgccactgcacgttaagcagacactgagtcctgaccagcagcctacagcctggagttacgaccaacctcctaaggactcaccattgggcccctgccgcggagaatcgccgcccacgccccccggccagcccccgatttcacctaagaaattcctgccttctacggctaatagagggctaccacctcggacccaggagtctaggccatccgacctgggtaagaacgctggcgacactctcccccaggaggacttaccactcactaagccagaaatgttcgagaatcctctgtatggctctttgagttcctttccaaaaccggcaccacgtaaagaccaagaatctcccaagatgcccagaaaagagcccccaccgtgtccagaaccaggcattctgagcccttctattgtgctgactaaagcgcaggaggccgataggggtgaaggaccggggaaacaagtccctgccccccgcctgagatcatttacctgctcctcttccgccgaaggccgtgctgccggcggagacaaatctcaaggtaaaccaaagacccctgtcagttctcaggcccccgttccggctaagaggccaatcaagcctagccgctctgaaattaatcagcagactccacccacacctacccccaggccacctctcccagttaagagtcctgctgtactccacttacaacattcaaagggcagggactatcgggataacactgagctcccacatcacggaaagcacagacctgaagaagggccacctgggccactcggccgcaccgccatgcagtag

SEQ ID NO: 120650 - DNA, 2826 bp, Artificial Sequence
  Description of Artificial Sequence: Synthetic coding sequence
agaccccaggtgccaggggaagctaatcctatcaacatggtgtccaaactctcacagcttacatccctgttatcctctatcgaggataaggtgaaagcactcctccatgagggcccagaaagcccacaccggccaagtttgatccctcctgttactttcgaggtcaaggccgagagcctggggatccctcaaaagatgcagctgaaggtggacgtagaatcaggaaagctgattataaagaagtccaaagacggctctgaggataaattttattcgcacaagaagatcctgcagttgataaagtctcagaaattcctgaataaactggtgatcttggtagagaccgaaaaggaaaagattttgcggaaagagtatgtgtttgccgattctaagaagcgggaaggattctgccagctcctccagcagatgaaaaataagcacagtgaacagcccgaacccgacatgatcactatcttcattggaacttggaatatgggtaatgcacccccacccaaaaaaattacgtcgtggttcctttctaaaggccagggaaagacccgagacgattccgcagactatatcccccatgatatatacgtcatcgggacgcaggaggaccctttatccgagaaggagtggctcgaaatactcaaacattcgttgcaggagattacttcagtgacttttaagaccgtggctatccataccttgtggaatataagaatcgtcgtgcttgccaagccagaacacgaaaaccgcatctcccacatctgcactgataacgtgaagacgggcattgccaatacattaggtaacaaaggtgccgttggcgtgagcttcatgtttaacggcacctctctgggctttgtgaacagccacctgacgtctggctcagaaaagaagctcagacgcaatcagaattacatgaacatcctcaggttcttggccctaggagacaagaaactgtctccgtttaatattactcaccgattcacccaccttttttggttcggcgatctgaattaccgggttgatcttcccacctgggaagccgagactattatccagaaaataaagcaacagcagtatgcggatttactttcccatgaccagctcttgactgaacggcgtgagcagaaagtgtttctccacttcgaagaggaggaaattaccttcgcaccgacgtaccgttttgaacgactcacgcgtgataaatatgcctataccaagcagaaggctacaggaatgaaatataacttgccctcttggtgtgaccgggtcctttggaaatcctaccccctggtccatgttgtgtgccaaagctacggctccacaagcgacattatgaccagcgaccactctccagtgttcgcgaccttcgaggccggcgtgacttcccagttcgtgtccaaaaacggcccaggaaccgttgatagccagggccaaatagagtttctccgttgttacgccactttgaagacaaaatctcagacaaagttttacctagaatttcactcaagctgcctcgagtcttttgtaaagagtcaagagggcgagaatgaggaaggctccgagggggagctggtcgtgaaatttggggaaactcttcccaaattgaaacccatcatctcggatccagagtacttgctcgaccagcatatcctgatttcaattaaatcatcagactctgatgagtcgtacggcgaaggatgtattgccttaaggctcgaggccacagagacccaactacccatttacacccctctgacacatcacggcgagctgacaggtcactttcagggcgaaattaagttgcagacttcacaaggcaaaacccgggagaaactttacgactttgtcaaaaccgagcgcgacgagtcaagcgggcccaagacattgaaaagcttgacctcccacgaccccatgaagcagtgggaagttacttcaagggcaccaccttgctcaggatcttccatcaccgaaattatcaaccctaactatatgggtgttggcccatttggcccaccgatgcctctgcatgtcaagcagaccctctccccagaccagcaacctacagcttggagttacgatcagcctcctaaggattcccctttaggaccgtgtcgcggtgagtcccctcccacccctccaggccagcctccgataagtcccaaaaaatttctgccctcaacagccaatcgcggtttaccaccacggacccaggaaagccgccctagtgatctgggtaaaaatgcaggcgacacactcccgcaggaggacctccctctcaccaaaccagaaatgtttgagaatccgctatacggatccctgagctctttcccaaagcccgcacccagaaaggaccaggaatctcccaagatgccaagaaaagagccccccccgtgtcctgagcccgggattttgagcccttcgattgtgctgactaaagcacaggaagcagatcgcggagaaggcccaggcaagcaggtgcctgctcctaggttgaggtccttcacatgttctagctctgctgagggaagggctgccgggggcgacaagtctcaaggaaagcctaaaacaccagtatccagccaagcgcccgtccccgcgaagcgccctataaaaccatctcgctctgagattaatcaacagaccccccctactcctaccccaagaccacctctgccagttaagagtcccgccgttctgcacttgcagcacagtaaaggccgggactaccgcgacaacacggagttgccccaccacggcaaacatcgccctgaggaggggcccccaggccctctgggccggactgccatgcagtag

SEQ ID NO: 120651 - DNA, 669 bp, Artificial Sequence
  Description of Artificial Sequence: Synthetic coding sequence
atggtcccctgctggaaccatggtaatataaccagaagcaaggctgaggagctgctctccagaaccggcaaagatgggagttttctggtgcgagcctcagagtctatctctagggcatacgccctgtgcgttttatacagaaactgcgtttacacataccggatcttaccgaatgaagatgataagtttactgttcaggcgtcagaaggggtgtcaatgcgcttctttaccaaacttgatcagctgattgagttctataaaaaggaaaatatgggtctggtgacccacctgcagtaccccgttccgcttgaggaagaggataccggtgacgatcccgaagaggatacagtagaatctgtcgtttctccacctgagcttcctccgcgcaacattccgcttaccgcctcttcttgtgaggccaaggaggtccccttcagcaatgagaatcctcgagccacggaaactagccggcccagcttgtcggagactctctttcaacgcctgcaatcgatggacacatctggactgcctgaggagcatctcaaagctattcaggactatctgtccacgcagctcgctcaggacagcgagttcgtcaagaccgggtcaagctccttgccgcatctgaagaagctgacaactctcctttgcaaagagctgtacgggtag

SEQ ID NO: 120652 - DNA, 2826 bp, Artificial Sequence
  Description of Artificial Sequence: Synthetic coding sequence
ccccctcaggtgccaggagaagccaatccgattaatatggtgagcaagctctctcagcttacaagtctccttagttctatagaagacaaggtaaaggctcttctgcatgagggtcctgagagcccacatcgaccgtccctcattccaccagtcaccttcgaggtcaaagcagagtcactggggatccctcagaaaatgcagctgaaagtggatgtggagtccggcaaactaataatcaaaaaatcaaaagatggaagtgaggacaaattctactcccacaagaaaattttacaactgattaagtcacagaagttccttaacaagctggtaatacttgttgagactgaaaaggagaaaatactgcggaaggagtacgtgtttgcagacagcaaaaaacgagaaggcttttgtcaactactgcagcaaatgaagaataagcacagcgaacaacctgagccagatatgataaccatctttatcggcacatggaacatgggcaacgctccgccgccaaagaaaatcacctcttggttcctgagcaaggggcagggcaagactagagacgattctgccgactacattccacacgatatttatgtcattggaactcaggaagacccacttagcgagaaggaatggcttgagattttaaaacacagcctccaggaaattacatccgtgacgttcaaaaccgtcgctatccacaccttgtggaatattagaatcgtggtcttggctaagccggagcatgagaacaggatatcgcatatctgtacagataacgtcaaaaccggcatcgctaacaccctggggaacaagggcgccgtgggcgtgtcatttatgtttaacgggacttctttgggatttgtcaactcacacctgacttcaggctctgaaaagaaactgaggaggaatcagaattacatgaatatcctcagatttctcgccctgggagataagaaactatccccttttaacatcactcatcggttcacgcacctcttctggttcggcgatctgaactaccgcgtcgacctgcctacatgggaagctgagactattatccagaaaatcaaacagcagcaatacgctgacctcctcagtcacgatcagctattgaccgaacgccgggagcagaaggtcttcctgcactttgaggaagaggagataacatttgcacccacctacaggttcgagaggctgacaagggacaaatacgcatataccaagcagaaggcgacaggtatgaaatataatcttcccagttggtgcgaccgggtgctctggaagagctacccgctggtgcacgttgtctgccagtcatatggctccacctccgatataatgaccagtgaccattcgccagtgttcgccacttttgaggcaggagttacctcacagttcgtgagcaagaacggaccaggaacagtggactctcaaggccaaattgaattcctaagatgctacgccactctgaagactaagagtcagaccaaattctatctggagttccatagctcctgcctggaatccttcgtgaagagtcaggagggggagaatgaagagggatctgagggcgaactcgtggtgaagtttggcgaaaccctgcctaagttgaaacccataatctcagatcctgaatatcttcttgatcagcacattttgatttctattaaatcatcggactcggatgaaagttacggcgaaggatgcatcgctctgaggctcgaagcgactgaaacacagctgcccatatatacaccactaacccatcacggtgaactgacaggtcacttccagggggaaatcaaactccagacatctcagggcaaaacacgcgagaaactctatgatttcgtcaaaacggagcgcgatgaaagctccggtccaaaaactctcaagtccctcacatctcacgatcccatgaagcagtgggaagtgaccagccgagccccgccctgctctggttctagtatcactgaaatcattaatccgaactatatgggcgtggggccgtttggtccaccgatgcctctgcacgtgaaacaaaccctttcccccgaccagcagccaaccgcctggtcctatgatcagccacctaaggacagtccgcttgggccatgtcggggcgagtcgccacccacccctccaggccagccacccatatcccctaagaaattcctacccagcacggcgaacagagggctcccacctcgcacacaagagtctcgccccagcgacctagggaagaatgcaggggacacgctaccgcaggaagatctgccccttaccaagcccgaaatgttcgagaatccgctgtatggatccctgagctccttcccgaagccagccccccgaaaggaccaggagagccctaagatgccgcggaaagagcccccgccctgtcctgaacccggcattctctctccttcaatcgtgctcacgaaggcacaggaagcagacagaggagaagggccaggcaagcaggtccccgccccccgtctgcggagcttcacttgctcctcaagcgcagaaggccgagccgcaggcggtgacaagagccaaggaaagcccaagactcctgttagtagtcaagcaccagtgccagcaaagcgaccaattaaaccaagcagatctgaaattaaccagcagacaccccccactcctactcctcgaccacctctcccagtgaagagcccagcggtgttgcatcttcaacattctaaaggacgcgactacagagacaacaccgagctgccccaccatgggaagcacagacccgaggaagggcctcctgggcccttggggaggacagctatgcaatag

SEQ ID NO: 120653 - DNA, 1791 bp, Artificial Sequence
  Description of Artificial Sequence: Synthetic coding sequence
atggtgccatgctggaatcatgggaacatcaccaggagtaaagccgaggaactcctgtcaagaacaggtaaggatggaagtttcctggtgcgggccagcgagtccatcagccgtgcctacgctctgtgtgtactctatcggaattgcgtctatacttatcgcatactaccaaatgaggatgacaaatttacagtccaggcatccgagggagttagtatgagatttttcacgaaattagatcagctgatcgagttttacaagaaagaaaacatgggcctcgtaacacatttgcagtaccccgtcccactggaggaagaggatacgggggatgacccggaagaagacacggtggagtctgttgtgtccccccccgagctacctccccggaacattcctcttacagccagctcctgcgaagccaaggaggtccccttttccaacgagaaccccagggcaaccgagaccagtcgaccctctctgtctgagaccctcttccagcgcttgcagtctatggacacgtctgggcttcccgaagaacatttgaaagcgatccaggattacctctccacacagcttgcacaggatagcgagttcgtcaaaacaggtagctccagcctgccacaccttaaaaaactgaccacactgctatgtaaggagctatacggttattgcctcgaggtcctgttgtcctatcctctttcattgttgagtcaggtccccggcgaagctaatcctatcaatatggtgagcaaactgagtcagctgacttcactccttagctccatcgaagacaaagtaaaggccctgcttcatgaaggcccagagagcccccatagaccaagcctcattcccccagtcacttttgaagtgaaagcagaaagccttgggattccacagaagatgcagctgaaggttgacgtagagtccgggaagcttattatcaagaagagcaaggatgggagcgaggacaagttttactcccacaaaaagattctgcaattgattaaatcacagaaattcctgaacaagctggtaatactcgtcgaaaccgagaaagagaaaattttgcggaaagaatatgtttttgccgactcgaagaaaagagagggcttttgtcagctgctgcagcagatgaagaataagcatagcgagcagcctgagccagatatgatcacgatttttatcgggacatggaacatggggaatgcccctcctccaaaaaagattacgtcatggtttctctcaaagggacaggggaaaactagagatgatagtgctgattacattccacatgatatttatgtaattggtactcaagaagaccccttaagcgagaaagaatggctggaaattctgaagcacagcttgcaagaaattaccagcgttacatttaagactgttgcaatccacaccctgtggaacatcaggattgttgtgctcgccaagccggagcatgaaaatagaatttcccatatatgcacagataacgtcaaaactgggattgccaatacattgggcaataagggcgccgtaggcgttagctttatgtttaacggcactagtttggggttcgtgaatagccacttaacgtcagggtccgagaagaagctgagacgcaatcagaactacatgaacattctccggttcctagccctaggggacaaaaaactctccccttttaacatcactcaccgctttacacatctgttttggtttggagatctgaactaccgggtagacttgcccacttgggaggctgaaacgataattcagaagataaaacagcaatag

SEQ ID NO: 120654 - DNA, 837 bp, Artificial Sequence
  Description of Artificial Sequence: Synthetic coding sequence
taacagaagaattggctgagggagttctaccaagtggtccatacccacaagcctcattttatggccctacactgtcaagagttcggaggcaagaactacgaggcatccatgagccacgtggataaatttgtcaaagagttgctcagtagcgacgctatgaaagagtacaacagagcccgggtctacttagacgaaaactacaagtcccaggaacacttcaccgcactgggaagcttctactttctgcatgagtctctgaagaacatctatcaatttgactttaaagccaagaagtacaggaaagtcgctgggaaagagatttatagtgatacgctggaatcaactcctatgttggagaaggaaaaattcccacaggattactttccagagtgtaagtggtcccggaagggattcatcagaactcgctggtgcatcgccgattgtgcattcgacctcgttaatattcacttgttccacgacgccagcaacctagtagcttgggagacaagcccctccgtgtattccgggattcgccataaagcattgggctacgtactggatcgcattatcgatcaacgctttgagaaggtcagttatttcgtgttcggagatttcaatttcaggctcgactctaaatcggtggtggaactgttagaatttgacaaggaactcagcgtgttcaaagaccgactctatgagctggatatctcttttcctccttcttatccctatagcgaggatgccagacaaggggagcagtacatgaacacacgatgcccagcttggtgtgacaggatcctaatgtcgccttctgctaaggaactggtcctgagatag

SEQ ID NO: 120655 - DNA, 1164 bp, Artificial Sequence
  Description of Artificial Sequence: Synthetic coding sequence
atggcagggaaggctgccgctcctggcacagccgttctgctggtcactgctaatgtggggtctctgttcgatgaccccgaaaacctgcagaaaaattggctgcgggagttttaccaagttgtgcatacacacaagccccattttatggcgttgcactgtcaggagttcggcgggaaaaattatgaggcctctatgtctcacgtcgataaatttgtaaaggaactgttgtcctctgacgctatgaaagagtacaacagggcccgtgtctatctcgatgagaattacaagtctcaggagcattttaccgccctcggctctttctattttttacatgaaagtctcaagaacatctaccagtttgactttaaagcaaagaagtataggaaggtcgctggcaaagagatatacagtgacaccctggaatccaccccaatgctcgaaaaggagaagtttcctcaggattacttcccggagtgtaagtggagccgtaaggggtttattcgaacacgttggtgcatcgccgactgcgcttttgatttggtgaacatacacctgtttcacgatgcgtcaaaccttgtggcgtgggagacatcaccctccgtctactcaggaatacggcacaaagctctgggttatgtcctcgatcgcatcattgaccagagattcgagaaggtgagttattttgtctttggagacttcaacttccgcttggactctaaatccgtggtggagacattatgcacgaaagctaccatgcaaacagttcgtgcagccgacactaacgaggtggtgaagctgattttcagagagtctgataacgatagaaaggtcatgctgcagcttgagaagaagttgtttgactacttcaaccaggaggtattccgggataacaatggcaccgctcttctagagtttgacaaggaactctctgtttttaaggatcggttatatgaattggacatctcctttccacccagctacccatattcagaggacgcgagacagggcgaacagtacatgaatacccgctgccccgcctggtgcgaccggatactaatgtcaccctcagccaaagagttggtcttgcgggtgtccgtgtgctgcccctcccctggtcacagaggtatgtggtcagcaggatcaggactggctcagccttggtag

SEQ ID NO: 120656 - DNA, 1239 bp, Artificial Sequence
  Description of Artificial Sequence: Synthetic coding sequence
atggcgggtaaagctgctgctcccggcaccgctgtgctcctggtcacagcgaacgtgggatctctgtttgacgatcccgagaatctgcagaagaattggctgcgcgagttctatcaagtcgtccatactcataaaccacacttcatggccctccactgccaggaatttggcggtaagaactatgaggcatctatgtcccatgtggataaattcgtcaaagagcttctatcctccgacgctatgaaggaatacaacagggcgcgggtttacctcgacgagaactacaaatcgcaggagcatttcaccgccctgggtagcttctactttttacatgaatcactgaagaatatctatcagttcgacttcaaggcaaagaaatacagaaaagtcgccgggaaggaaatatactccgacaccctcgaatccacgcccatgcttgagaaggaaaagtttcctcaggattacttccccgaatgcaaatggtcccgtaagggcttcatccgcactagatggtgcatcgccgattgtgcattcgacctcgtgaatatccatctctttcatgatgcctccaatctcgtggcttgggaaacaagcccctctgtctactctggcatccgacataaagctctcggttatgtgctcgacagaataatcgaccagcgctttgagaaagtctcctatttcgtgttcggcgacttcaacttccgcctggatagcaaatcagtggtggagacactctgcaccaaagccactatgcagacagtgcgggccgcggacactaacgaagttgttaaactgatcttcagggaatctgataacgatcgaaaagttatgctccagctggagaagaagctgttcgattacttcaatcaggaagtcttccgcgacaacaacggcacagcgctgctcgagttcgataaggaactttctgtgtttaaggaccgtctttacgagttggacatttcatttccccccagctacccgtacagtgaggatgcccgacagggagagcagtacatgaataccagatgtcctgcctggtgtgatcgtattttgatgagtcccagtgcaaaggagttagtgctgcgctcagagagtgaggaaaaggtggtgacttacgatcacattggccctaatgtctgtatgggagatcacaagccagtctttttagcctttcgcattatgcctggggcaggcaagcctcacgcccacgtccacaagtgttgtgtggttcaatag

SEQ ID NO: 120657 - DNA, 558 bp, Artificial Sequence
  Description of Artificial Sequence: Synthetic coding sequence
atggctggtaaggccgctgcccctggtaccgccgttctgctggtcacggcaaacgtcggttctctgttcgacgacccagaaaacttacagaaaaactggctgagggagttctaccaggtcgtgcacacccacaaacctcactttatggccctgcattgtcaagagtttgggggcaagaattatgaggctagcatgtctcacgttgacaaatttgtgaaagagctgctgtcctcagacgccatgaaggagtataatcgggcaagggtgtacttggacgagaactacaaatcacaagagcactttaccgctcttgggagcttctacttcctgcatgagagcctcaagaacatctaccagttcgactttaaagccaagaaatatcgaaaggtagcggggaaagaaatctactctgacacactggagagcaccccaatgttggagaaggaaaaattcccccaagactattttccagagcggcacgttccacatacctcacttgaagcgttgcttatcctgcacgaggaccctcagttgcctgatccacacctgcccctttag

SEQ ID NO: 120658 - DNA, 1068 bp, Artificial Sequence
  Description of Artificial Sequence: Synthetic coding sequence
atggcgggaaaagccgccgcacctggaaccgccgtccttctggtgacagctaatgttggatctctgtttgatgatcctgaaaacctccagaaaaactggctgagggaattctaccaggtggtacatacccacaagccccactttatggccctgcattgtcaggaattcggagggaagaactatgaagccagcatgtcccacgtggacaaattcgtgaaagagctactgtctagcgatgctatgaaagagtacaaccgagccagagtgtatctggatgagaattacaagagtcaggaacactttactgctctaggttcattctacttcctgcacgagtctctgaagaatatctaccagtttgactttaaagccaagaaataccgaaaagtcgctgggaaagagatttacagcgacaccttggaaagcacccccatgctcgaaaaggaaaagtttccccaagactatttcccggaatgtaagtggtcacggaagggattcatccgcactcgctggtgcatagccgattgcgctttcgacctcgttaatattcacctctttcatgatgcgtctaacctcgtcgcctgggagacgtctccaagcgtgtactctggcattagacacaaggctctgggttacgttttagatagaattatcgaccagcggtttgaaaaagtcagctatttcgtgttcggtgactttaactttcgactcgatagcaaaagcgtcgtcgagctgttagagttcgataaagaactgtctgtgttcaaagataggctgtacgagctcgacatctcctttccgccatcttatccctatagtgaagacgccagacagggcgagcaatatatgaacacacgatgtcccgcctggtgcgaccgcatcttgatgtctccaagtgccaaggaactggttctgcgatcagagtcagaggagaaagtcgttacctacgatcacataggaccaaacgtatgcatgggcgatcacaaaccagtgttcctggcctttagaattatgcctggcgccggaaagccacacgcccacgttcataaatgttgcgtggtgcagtag

SEQ ID NO: 120659 - DNA, 417 bp, Artificial Sequence
  Description of Artificial Sequence: Synthetic coding sequence
gtgactgccaatgtgggaagtttgttcgatgacccagaaaatcttcagaagaattggctgagagaattttatcaagcccttggttccttttacttcctgcatgagtctctgaaaaacatttaccagtttgatttcaaggctaaaaagtataggaaggtcgccggtaaggagatctatagcgatacattggaatctacacctatgttggagaaggagaaatttcctcaagactattttcctgagtgtaagtggtcacggaagggctttattcgaaccagatggtgcatcgccgattgcgcatttgatcttgtcaatatccacctgtttcatgacgcctcgaatctggtggcatgggaaaccagtccttccgtgtactcgggaattcggcataaagccctgggttacgtgctggactag

SEQ ID NO: 120660 - DNA, 990 bp, Artificial Sequence
  Description of Artificial Sequence: Synthetic coding sequence
atgaaggaatacaatcgggcacgagtctacctcgacgagaactataagagccaggaacattttacagcgctcggcagcttctacttcctccatgaaagtttgaaaaatatttaccagttcgacttcaaagctaaaaaatatcgcaaagtggcgggaaaagagatttattcagacactctcgaaagcactcccatgctggagaaggagaaattccccttgctgccacgggtccagatggtgaaaaagcgtttacatcccgacgaggtcatcgcggattgtgccttcgacttagtcaacatacacctttttcacgatgcctccaacttggtagcctgggagacatccccttcggtatactcagggattagacataaagctctcgggtacgtgctagatcgtatcatcgaccaaaggttcgagaaagtatcttacttcgtatttggagattttaattttaggttggactcgaagagtgtcgttgagactttgtgtacgaaagccacaatgcagaccgtgagggctgccgacacgaatgaggtcgtcaagctgatcttccgcgagtcagataatgaccgcaaagtcatgctgcagcttgaaaagaagcttttcgactacttcaatcaggaggtttttagggataataacggaacagctctacttgaattcgataaagaactgagcgtgttcaaagatcggctatatgagctcgatatctccttcccaccttcctacccatacagcgaagacgcaagacagggcgaacaatacatgaacacccgatgtcccgcatggtgcgatcgcatcctgatgagtcccagcgccaaggagctggttttgcgatctgagagtgaggagaaggtggtcacctacgatcacatcggaccaaatgtttgcatgggggatcacaagccggttttcttggctttccgcatcatgcctggggcaggcaagccccacgcgcatgtgcacaaatgctgtgtggttcagtag

SEQ ID NO: 120661 - DNA, 315 bp, Artificial Sequence
  Description of Artificial Sequence: Synthetic coding sequence
ctcgacatttcctttccaccttcatacccctattccgaggatgctcgacagggggagcagtatatgaatacgagatgtccggcttggtgcgaccggatcttgatgtctcccagtgctaaggaactcgttctacgctcagagtccgaagagaaggtcgtcacttatgatcacattggtcctaatgtctgcatgggcgatcacaagcctgtgttcctagcgttccgcatcatgccaggagccggtaagcggtgccaacgccacgaacgaaccctacgggaaccaccgtgcagcagggggccaaatacacacagctag

SEQ ID NO: 120662 - DNA, 546 bp, Artificial Sequence
  Description of Artificial Sequence: Synthetic coding sequence
gctgcggctcccggtacagccgtgcttctagtgactgctaacgttgggagccttttcgacgatcccgaaaacctccaaaagaactggcttagggaattttaccaagtggtacatactcataagccccattttatggctctgcactgtcaagagtttggggggaagaattacgaagcctccatgagtcacgtggataaattcgttaaagagctgctgtcatcagatgccatgaaggagtataaccgtgctcgcgtgtatctggatgagaactacaaaagtcaagaacacttcacggcactaggctctttctactttctccacgagagcttgaaaaacatctatcagttcgactttaaggcaaagaaatataggaaagtggcagggaaggagatctactccgatacactggaatcaacccccatgctcgagaaggaaaagtttcctcaggactatttccccgagagacatgtaccccataccagtttagaggccctgctgatccttcatgaggatccccagttgccagatcctcatctgcctttatag

SEQ ID NO: 120663 - DNA, 459 bp, Artificial Sequence
  Description of Artificial Sequence: Synthetic coding sequence
atggcaggcaaggctgccgctccaggcaccgctgttttgctggtgaccgcaaatgttggatccctgtttgacgacccagagaacctgcagaagaactggctgagggaattctatcaggctttggggagcttttacttcttgcacgagtctctaaagaacatttatcaatttgactttaaggccaagaagtaccgcaaagtcgctgggaaggaaatctattccgacaccttggagagcaccccaatgctggagaaagaaaagttccctcaggactattttcccgagtgcaagtggtcacgaaaggggttcatcaggaccaggtggtgcatcgctgattgtgcattcgacctggtgaatattcatttgtttcatgacgcgagcaatttggttgcttgggaaacctccccctctgtctactccggcattcggcataaagcccttggctacgtgctagattag

SEQ ID NO: 120664 - DNA, 1935 bp, Artificial Sequence
  Description of Artificial Sequence: Synthetic coding sequence
atgccttcaaaggcagagaacctcaggccatctgagcctgcaccacagcctcccgagggaagaacactgcagggacagttgccaggcgcccctcctgctcagcgcgccggatctcctccggatgcaccaggcagtgagtcccctgctctggcatgctccacacctgcaaccccgagcggcgaggatccccccgccagggcagcccccatcgccccaaggccccccgccagacctcgactggagcgagcgctctccctggatgataagggatggaggcgcagacgctttcgagggtcgcaggaagatttggaagctaggaatgggacctcaccttcacgaggcagtgtgcagagcgagggacccggggcccccgctcattcatgctctccgccctgtttatctaccagcctccaggagatacctaagagccgcggggtgttaagttccgagcgaggatcaccatcctctggcgggaatcctctgagtggtgtggcaagctcgtcacctaacctccctcaccgcgatgcagcagtggccggcagttcgcctagattaccatccctcctgccccccagaccaccacccgctctgagcctcgacattgcaagcgatagcctgcgcaccgctaataaggttgattccgatctggcagattataagttacgtgcgcagcctctgttggtgagggctcacagctctctgggccctggacgcccgagatccccactggcgtgtgacgattgctcactgcgaagcgccaagtccagctttagtctgctggcaccaatcaggagcaaagatgttcgatcgaggagttatcttgagggctccctgctcgcatcgggggccctcctgggcgctgatgagttggcaaggtacttccctgatcggaacgtggccctctttgtcgcgacctggaatatgcaagggcagaaagagcttccgccctcgttggatgagtttctactgcctgcagaggccgactacgcccaggacctctatgtgatcggagtccaggaagggtgctccgaccgacgggagtgggagacacgactccaggagaccctcggaccccactacgtgctgctgagctctgccgctcacggcgtgctatacatgagcctgttcataagaagggacctgatttggttttgtagtgaagtggaatgtagcactgtaactacaagaatcgtgagccagatcaagaccaagggagcactgggtatttcatttactttctttggcacttccttcttatttattacctcccatttcacgagtggagatggtaaggtggcagagcgactcttagattacaccagaactgtgcaggccctcgtactaccccggaatgtgcctgacacgaacccttacaggtcgtcagcggcggatgtcactacgaggttcgacgaggtcttctggtttggagattttaactttagattgtccggtgggcgcacagtggtcgacgccctcttgtgtcaagggttagttgtcgacgtgcccgcgctcctgcagcacgatcagcttattagagagatgagaaaaggctctattttcaaagggttccaggaacctgatattcacttcctgccttcttataagtttgacatagggaaggatacgtacgattccacatctaaacagaggaccccgtcatacacagatagagtcctgtatagatcaagacacaaaggcgatatttgtccagtaagttacagctcctgccccgggataaaaaccagtgatcatagacctgtgtacgggttgtttcgggtgaaagtgagacctggccgggataatattcctcttgcagctggaaaattcgatcgggaactgtatctgttaggaatcaaacgacgtatatcaaaagagatccagcggcagcaggccctccagtcccaaaacagctcgacgatctgttcagtgtcttag

SEQ ID NO: 120665 - DNA, 960 bp, Artificial Sequence
  Description of Artificial Sequence: Synthetic coding sequence
atggaccagtcagtagctattcaagaaacactggccgaaggcgagtactgtgtaatcgctgtccagggtgtgctgtgcgagggagattcccggcaaagccgactcctggggctagttagatacaggcttgagcacggggggcaggaacacgccttattcctgtacacacatcggcggatggccatcaccggtgacgacgtgtcgttagaccaaatagttcccgtctctcgcgacttcacactcgaagaggtgtcgcctgacggcgagctgtatattctaggctcagatgtcacagtgcagctcgatactgctgaattgagcctggtctttcagcttccatttggatcccaaacgagaatgttcctgcacgaagtggcacgagcctgtccagggttcgatagcgctacacgtgacccggaattcctctggctatcgaggtatcgctgtgccgaacttgaactggagatgccaactcctagaggctgtaattctgccttggtgacatggcctggttacgccaccatcggtggcggtcggtacccgtctcggaaaaaaaggtggggccttgaagaagctcgaccacagggggctggtagtgtgctcttctgggggggcgccatggaaaaaactggattcagactcatggaacgtgcacacggcggcggctttgtttggggacgatccgccagagatggcaggagggatgaggagcttgaagaagcagggcgtgagatgtctgccgccgctgggtcaagagagcgaaataccgccggtagtgccggcggcggcaaattagggtggggggccgggccgggcgccgctgtgaggcccgctctcggctgggcaggatccgcagtttggcccgtggatgccagaggcgaggatcagtcccccggaggtcccctggaggctggcaccttgggacaaaagttctgtgatgtcctgttaaggagagcgtag

SEQ ID NO: 120666 - DNA, 2982 bp, Artificial Sequence
  Description of Artificial Sequence: Synthetic coding sequence
atggatcagagcgtggcaattcaagaaaccctcgcagagggggagtactgcgtgatagctgttcagggcgtcctatgtgaaggcgattccaggcagagtcgtttactggggcttgtccgttacaggttagaacatggcggacaagagcatgcactgttcctgtacacgcacaggcgcatggccataacaggagacgatgtatccctggaccagatcgtgccagtatctcgcgactttactctggaagaggtgtcccccgacggcgagttatatatactgggatcggacgtgacggtgcagctggacaccgcggaactgtcacttgtattccaactgccgttcggcagtcaaactcggatgtttttacatgaagtcgctagagcctgtccaggctttgactcggctacccgtgacccagagtttctgtggctgtccaggtaccgatgcgctgaactggaactggagatgccgacccccagagggtgtaattccgccctggtgacatggcctggatacgctactatcggaggtggacggtacccatctcgtaaaaagcggtggggactggaggaagcaagacctcagggggccgggagcgtcttattttggggaggagcaatggagaagaccggttttaggctcatggaacgggcccatggcggcggctttgtctggggccggtcggcaagagacgggcgaagagatgaagaactcgaagaggcaggcagggaaatgtccgcagctgcaggttcgagggaacgcaacaccgccggtgggagcaattttgacgggctccgacccaatggcaaaggggtcccaatggaccagtctagccgcgggcaggataagcccgagtccctccagccgaggcaaaacaagagtaaatctgagatcacagatatggtgagaagctctaccattacagtcagtgataaagcgcacatattatccatgcagaagttcgggctgcgcgacacaatcgtgaaatcacacttattgcagaaggaggaagactacacctacatccagaatttccggttttttgccggaacatataacgtgaacgggcagtccccaaaagaatgtctacgcctgtggctttcaaatggaattcaggctcctgatgtgtattgcgtcgggtttcaagagctggatctgtccaaagaggccttctttttccacgatacccctaaggaagaagagtggttcaaggcggtatccgaaggacttcatccagatgctaaatatgcaaaggttaagctgattagacttgtgggcatcatgctgctactgtatgttaaacaggaacatgctgcctacatttcagaggtcgaggccgaaacagtgggcacgggaataatgggccgcatgggcaacaagggtggggtggcgatacggttccaatttcacaatacatcaatctgtgtggtcaactctcaccttgctgcccatatcgaagagtatgagcgcagaaatcaagattacaaagatatctgcagtcggatgcagttctgtcaacctgatccatctctacctcccctgacaatcagcaaccacgacgtgatcctgtggctgggagatcttaactaccgcattgaagaactcgacgtggaaaaggtgaaaaaactgatcgaagaaaaggattttcagatgctatatgcctatgaccagttgaagattcaggtcgcagcaaagactgtgttcgaaggttttacggaaggagagctcacttttcaacccacctataagtacgacacgggtagcgacgactgggacactagcgaaaaatgccgcgcgccagcatggtgtgaccgcatcctgtggaaaggaaagaacattacgcagttgagctaccaatctcacatggcccttaagaccagtgaccacaagcccgtcagtagtgtcttcgatatcggggtgagggtggtgaacgatgagctgtataggaaaacccttgaggaaattgttagatctctagacaaaatggaaaacgccaacattcccagcgtaagcctgagcaaacgggaattctgctttcaaaatgtcaagtacatgcagttgaaagtagaaagttttaccatccataacggccaggtgccttgtcattttgagttcattaataagcctgatgaggaatcatattgtaagcagtggctgaacgccaacccctctcgaggtttcctgctccccgactcagacgttgaaatcgatttggagctgttcgtgaacaagatgacggcaacgaaactgaacagtggcgaggacaaaatagaggacattctggtactgcacctcgaccgcggaaaggattactttctgagcgtgagcggaaactacctgccatcttgcttcggcagtcccattcataccctgtgctacatgcgggaacccattctcgatctcccactggagactatctctgagctaactctcatgcccgtatggaccggagacgacggcagccaactcgactccccaatggagatcccaaaagaactgtggatgatggttgactatttataccgtaacgccgttcagcaggaagatctttttcagcaacccggtcttaggtcagagtttgagcacatccgggactgcctggacaccggcatgatagacaacctctcagcctctaaccatagcgtcgctgaagcgttgctcctctttttagaaagcctccctgaaccagtgatctgctattcaacctatcacaactgcctggaatgtagcggcaattataccgcatcgaagcaagtgatctctaccctaccaatatttcataaaaacgttttccactatctgatggcatttcttagagaacttctcaaaaacagtgcaaagaaccacctggatgagaatattttggcatccatattcggcagtctgttgttacgcaacccagctgggcatcagaaactggacatgactgagaagaagaaggctcaggaattcatccaccagtttttatgtaacccactgtag

SEQ ID NO: 120667 - DNA, 2742 bp, Artificial Sequence
  Description of Artificial Sequence: Synthetic coding sequence
atggatcagtcagtcgccattcaggaaactctagccgagggggagtactgtgtgattgcagtgcaaggagtactgtgtgagggagactcccggcagtctcgcctactgggcctagtgcggtatcgcctggagcatggcggccaggagcatgctttgttcttatatacccaccgtagaatggccataaccggagatgacgtgtccttggaccagatcgtgcctgtctctcgtgatttcacactagaagaagtgtctcccgacggcgagctgtatatattgggatccgacgttaccgtgcaattagacacagccgagctgtcactcgtgtttcaacttccgttcgggagccagacgagaatgttccttcacgaagtggcaagagcctgtcccggctttgactctgctacgcgggatcccgagttcctgtggctgtcgcgttatcggtgtgcagagctagagctggaaatgcctactcctcgaggatgcaacagtgcactggtcacatggccaggctacgctacaatcggtggcggtggttcaaactttgatggactgcgtcccaacggaaagggggtccccatggaccagtcatcacggggacaagacaagccggagagcctgcaaccacgacagaacaagtcaaagagcgagatcactgatatggtcaggtcatcgacaatcacagtctccgacaaagcccacatattgagcatgcagaaatttggactgcgggataccattgtaaaatctcacctcctccaaaaggaggaggactatacttatatccaaaacttcaggttctttgccggtacatacaatgtcaatggccagagtccaaaagagtgtctgcgcttgtggctgagcaacggaatccaagcccccgatgtttattgtgtcggatttcaagagctagatctcagcaaggaagcgttcttctttcatgatacacccaaagaggaagagtggtttaaggcagtgagtgaaggactgcaccccgacgccaagtatgctaaagtgaagctgatccgcttggtggggatcatgctactattgtacgtgaaacaagagcacgccgcctacatctcagaggtcgaagccgagactgtgggcacaggcatcatgggccggatgggcaataaaggaggagtggccatccgcttccaatttcacaacacttctatttgtgtggtgaattctcaccttgccgcgcatattgaagaatacgagcgacggaatcaggactacaaagacatctgctccagaatgcagttctgtcaaccagacccttccctgcccccgttaaccatctcaaatcacgatgtaattttgtggcttggagacttgaattatcggatcgaggagctggatgtggaaaaagtgaagaaactcatagaagagaaggatttccagatgctctatgcgtatgatcagctaaaaatccaagtcgcagctaaaacagtatttgaggggtttaccgagggggagctgaccttccagcccacttacaaatacgatactggaagcgacgactgggacacctctgagaagtgcagagccccagcctggtgtgaccgcattctgtggaaagggaagaatatcacacaactcagctaccagtctcacatggctctgaagacctctgaccacaaacctgtttcttctgtgtttgatattggcgtgcgggtggtgaatgacgaactctacagaaagacattggaggagatcgtgaggtctttggacaaaatggaaaacgctaatatcccctctgtttcactctcaaagcgtgaattctgtttccagaatgtgaaatatatgcagcttaaagtggagtctttcactattcataacgggcaagtgccctgtcactttgaattcatcaacaaacccgacgaggaaagctactgcaaacagtggctgaatgcgaaccctagccgcgggttcttactgcccgattccgatgtcgagatcgacctagaactcttcgtgaataagatgacagcaacaaagctcaattcaggcgaggataaaatcgaagacatactggtgctgcacttagatcgcggaaaggactatttcttgtctgtctccgggaactatcttccctcttgttttgggtcaccaatacataccctgtgttatatgcgcgagcctattctggatctgccgctggagactatcagcgaactcactttgatgccagtgtggaccggggatgacgggagccaattggactctccgatggaaattccaaaagaactttggatgatggtagattatttgtaccgtaatgcagtccagcaggaggacctcttccagcagcccggtctgcgcagtgagttcgaacacatccgggattgcctggacacaggcatgatagacaatctgagcgcttctaaccattctgttgccgaggccctgctcttgttcctggagagcctccccgaacctgtcatttgctactcaacctatcataattgtcttgagtgcagtgggaactacacagcatcaaagcaagtaatctccactctgcctatctttcacaaaaacgttttccactacctaatggcgtttctgagagagctcctgaagaactcggctaagaatcacctggacgaaaacattctggccagcatattcggcagcctcctgttaaggaaccctgctggacatcaaaaactggacatgaccgagaaaaagaaagcacaggaatttatccaccagtttctctgcaaccccctctag

SEQ ID NO: 120668 - DNA, 2982 bp, Artificial Sequence
  Description of Artificial Sequence: Synthetic coding sequence
atggatcaaagcgtagcgatccaggagactttggcggagggtgaatattgcgtgatcgccgttcagggcgtgttatgtgaaggcgacagcagacagagccggttgctcggcctggtacgctatcggttggagcacggaggacaggagcatgctttatttctttacacacatagacgcatggctatcaccggcgatgacgtctctctggatcagatcgtacccgtgtcccgggattttactctggaagaagtgagccccgacggtgagctgtatattctgggcagcgatgttaccgttcaattagatacagccgagctgtccctggtgtttcaactgccttttggctcgcaaacgcggatgttcctccatgaagtggccagggcatgtccaggcttcgactctgctacgcgggacccggaattcttatggctgtccaggtatcggtgcgccgaactggagttagaaatgcctacccctcgcggctgcaactccgcgctcgtgacctggccaggttacgccaccataggtggcggacggtaccccagcagaaagaagagatggggcttggaagaggcacgaccccagggggctgggtcagtcctgttttgggggggggccatggaaaagacaggattccgcttaatggagagagcacacggcgggggtttcgtgtggggccgctccgcacgcgatggccgacgggatgaggagctggaggaagctggccgggagatgtcagctgcagccggtagcagagaacgcaatactgctgggggtagtaatttcgacggacttagaccgaacgggaagggagtacccatggaccaatcaagtcggggccaggataaacccgagtcccttcagccccggcagaacaaatcaaaaagcgaaatcactgacatggtgcggtcctccaccataacagtgtcagataaggctcacatactcagcatgcagaagttcggacttcgggacaccatcgtcaaatcacatctcttgcaaaaagaagaggattacacctatatacaaaacttccgcttttttgcaggtacatataatgtgaacggccagtctcctaaggaatgtcttagactttggttatcaaatgggatccaggccccagacgtgtactgtgtcggatttcaagagctggacctatcaaaagaggcttttttcttccacgacacccctaaagaggaggagtggtttaaagcagtttccgagggactgcaccccgacgcaaagtacgccaaggtgaaattgattagactcgtgggcattatgttgctgctgtacgtgaaacaggaacatgccgcctatattagtgaggtcgaggcagaaacggtggggaccggtatcatgggaaggatggggaacaaggggggagtggccatccggttccaatttcacaatacttccatatgcgtcgtaaactcccatctggccgcacatattgaggaatacgagcggcgaaatcaggactataaggatatatgttccagaatgcaattttgtcaacccgacccgtcccttccacctctcactatctcaaatcatgacgtcatcctatggctgggcgacttgaactacagaatcgaggaactcgatgtggaaaaagtgaagaaactgatcgaagagaaagactttcagatgctgtacgcctatgatcagttgaagatccaggtggctgccaagaccgtgtttgaggggtttactgagggcgagctgacgttccaacctacctataagtatgacactggaagcgatgattgggatactagcgaaaaatgccgcgcaccagcctggtgcgatcggattttgtggaagggtaagaacattacacagctttcttatcagtctcacatggctctgaagaccagcgatcataaaccagtgtctagcgtgttcgatatcggcgttagagtcgtgaacgatgaactgtataggaagaccctggaagagattgttcggagcctcgacaagatggagaacgctaatatccctagtgtatcactttctaagcgggagttttgttttcaaaatgttaaatatatgcagctcaaggttgagtcgttcaccatccacaacggccaggtgccgtgtcatttcgagttcatcaataaacccgacgaggagtcttattgtaaacaatggctgaacgccaatccgtctagaggtttcttgctgccagattcggacgttgagatcgatctggaactgttcgtgaacaagatgaccgctacaaagttgaattctggcgaagataagattgaggatattcttgtcctgcacctagaccgaggtaaagattactttctaagtgtttccggcaactacctgccgagctgctttggctcccctatacacactctatgttacatgcgtgaacctattctggacctgccgctcgaaactatctctgagttgaccctcatgcctgtctggaccggagatgacggaagccagctcgactccccaatggagatccccaaggagctgtggatgatggttgactacctgtacagaaacgctgtgcaacaagaagacctgtttcagcaaccggggctgcggagcgaattcgaacatattcgggattgtcttgatacaggaatgattgacaatctatcagcttctaaccactctgtggccgaagctctcctgctatttttagagtctctgccggagccggtgatatgctattcgacataccacaactgcctcgagtgttccggaaattacacagcatccaagcaggtgattagcactctgcccatctttcataaaaatgtgtttcattatctgatggcgtttttacgtgagctgctaaagaacagcgcaaagaaccacttggacgaaaacatcctggctagtatctttggaagtctgctgctccgaaacccagcaggccaccagaagcttgacatgaccgagaaaaagaaggcgcaggagtttattcatcaatttttatgcaacccactgtag

SEQ ID NO: 120669 - DNA, 2250 bp, Artificial Sequence
  Description of Artificial Sequence: Synthetic coding sequence
atgtcagcggctgccggaagcagagagaggaacacagcgggcggttcaaatttcgatgggttgcggcccaatgggaagggtgtaccaatggaccaaagcagccgcggccaagataagcctgaaagcctgcagccacgccagaataagtctaaaagcgagatcacagatatggtgagatcaagcacaataacggtgtctgataaggcacatattctctccatgcagaagttcggccttagagatacaattgtcaagagccatctgttacaaaaggaggaggactatacatatatacaaaacttcaggttcttcgccgggacctacaacgtgaatgggcagtctccaaaggaatgtctcaggttgtggttatcaaacggaatacaagcccccgacgtctattgcgtgggcttccaggagcttgatctgtcaaaagaagcttttttcttccacgatacgcccaaagaggaagagtggttcaaggccgtgtccgaaggtctccaccctgacgcaaagtacgccaaagtcaagctgatacgcctggtgggcattatgcttttgctgtatgtcaaacaagagcacgcagcctatatcagcgaggtggaggccgagaccgtaggtacgggaatcatgggccggatggggaataaggggggagttgccatcaggttccagttccacaacacctctatctgcgtggtgaacagccatctggcagctcacatcgaagaatacgaacgacgcaaccaagactataaggatatctgtagccgtatgcagttctgtcagcctgaccctagtctccccccccttacaatttcaaatcacgacgtgatcctgtggttaggcgatctgaactacagaattgaggaactcgacgtggagaaagtcaaaaagctgatcgaggagaaagattttcagatgttgtatgcctacgatcaactgaaaatccaagtggcagcaaagacggttttcgagggattcactgagggcgagcttacattccagcctacatacaaatatgatacgggtagtgacgattgggatacgagcgaaaagtgccgcgcgcctgcatggtgtgatcgaatcttatggaagggtaagaatatcacacagttgtcgtatcagtctcacatggcactgaagacatcggatcacaagccagtctcgagtgttttcgacattggggtgcgggtagtgaacgacgagctttacaggaagactctggaagagatcgtgcggtctctggacaagatggagaatgctaacatcccttctgtgagccttagcaagcgggagttctgttttcagaatgtgaagtacatgcaactgaaagtggaatcttttacaatacacaacgggcaggtcccctgccacttcgaattcatcaacaaaccggacgaggaaagttactgcaaacagtggctgaacgcaaacccatctagaggcttcttgttgcccgattctgatgtcgagatagacttggaactgtttgtgaacaagatgacggcaactaaactgaacagcggagaagacaagatagaggacatcctggtcttacacctggacaggggcaaggactattttctgtccgttagcggcaactacctgccctcctgtttcgggtccccgattcatacactatgttacatgcgggagcccatactggacctgcctctcgaaaccatttctgagcttacattaatgccagtatggaccggcgatgacggatcccagctcgattcaccaatggagatccccaaagaactctggatgatggtggactacctttaccgcaacgctgttcagcaggaagacctatttcagcagccaggccttcggtctgaatttgagcacatccgagattgcctggacacgggcatgattgacaatctatctgcttccaaccattccgtcgctgaagccctgctgttatttcttgagtctctgcccgagccggtcatttgttacagcacctaccacaattgcctggagtgtagtggcaactataccgccagtaaacaggttatttccaccctgcccatcttccacaaaaatgtgttccattatctgatggcttttctgcgcgagctgcttaagaactctgctaagaaccatttggatgagaatatcttggcctctatatttgggagtcttctgcttaggaatcccgccgggcaccaaaaattggatatgactgagaagaagaaggcgcaagaatttatacaccagttcctatgtaaccccctctag

SEQ ID NO: 120670 - DNA, 2487 bp, Artificial Sequence
  Description of Artificial Sequence: Synthetic coding sequence
atggatcagagcgtggctattcaggagacactggccgagggcgagtattgtgtgatcgccgtccagggcgtcttgtgcgaaggcgattcccgacaaagtaggcttctggggctggtgcggtatagacttgagcacggaggacaggagcacgccctgttcctatatacccatcgacgcatggcgattacaggagatgatgtgagtcttgatcagatcgtgccagtgagtcgggatttcactctagaggaggtgtcccccgatggcgagctgtacattctaggttctgacgtgaccgtgcaactggatactgctgagcttagcctagtctttcagctacctttcggttcccaaactcgaatgtttctccatgaggtggcaagggcctgtcccggattcgattccgcgactcgggatcctgagtttctctggttgtccaggtatcgctgtgcagagctcgaactggaaatgcctacccccagagggtgtaactcggccctggtgacatggcctggatatgcgactattggcggagggcggtatccatctaggaagaagcgttggggtctagaggaagcccgcccccagggagccgggagtgtactcttctggggcggcgccatggagaagacagggttcagacttatggagcgtgcccacggaggggggtttgtgtggggtagatccgctcgggacggccggagagatgaagagctggaagaagccggcagggaaatgagtgctgcggctgggtccagagagcgaaatacagcgggcgggtccaacttcgatggactgagacctaacggtaaaggcgtgcccatggaccagagtagtcgtgggcaggataaacctgaaagtttgcagccccgacagaacaagtcaaagtctgagatcaccgatatggtccgcagctccacaatcactgtatcggataaggcacacattctttccatgcaaaagtttggattgcgcgatactattgtaaaaagccacctgctgcaaaaggaggaagattacacttacatccagaattttcgtttcttcgccggcacatacaacgttaacggccagtctcccaaggagtgtttaaggctctggttatccaacggaatacaggcacccgatgtgtactgcgtgggcttccaagagctcgacctatccaaagaggcattttttttccatgacacgcctaaggaagaggaatggttcaaggccgtgagcgaagggctgcatccggacgcaaagtatgccaaggtgaagttgatccggttagtcggaattatgctgctgttatacgtgaagcaggaacacgccgcatatattagcgaggtagaagctgagaccgtgggcacagggatcatgggaagaatgggtaataagggtggcgtagccattaggtttcagtttcacaacaccagcatctgcgtggtgaattctcacctcgccgctcatatcgaagagtatgagcggaggaatcaggactataaggatatatgttcaagaatgcagttctgccaacctgatccatcactccctccactgacaatctctaaccacgacgtcatactgtggctgggtgaccttaactacagaattgaagagctcgatgttgaaaaggtgaaaaaactaatcgaagaaaaggatttccagatgttgtacgcttacgatcagctgaagatccaagtggccgcaaagactgtcttcgaagggttcactgagggcgagctcacttttcaacccacatataagtatgacactgggtctgacgactgggatacctcagagaaatgtagggctccggcctggtgcgacaggatcctgtggaaggggaaaaacatcacacaattgtcataccagagtcatatggctctgaagaccagcgatcataagccagtgtcttcggtcttcgatatcggggttagagtggtcaatgacgaactgtatcgtaaaacgttggaagagatcgtgaggtccttggacaagatggagaacgcgaatattccatcagtatcactgagtaagcgggagttttgcttccagaacgtgaagtatatgcagctcaaggtcgaatcctttactattcataacgggcaggtgccatgccattttgagttcattaacaaacctgacgaagagagctattgcaagcagtggctgaacgcaaacccgagccgcggcttcttgttacccgattcagacgtggaaatcgacttagaactgtttgtcaataagatgacagccactaaattgaactcgggcgaagataagatagaagacatcctggtgcttcatttagataggggcaaagattactttttgagtgtaagcgggaactatctaccatcgtgcttcgggagcccgatccatacactctgctacatgcgggagcccatcttagacttacccctggagaccatttccgaattactggcgtacttggcagcctactgctttgagactcagctggtgacaaagtccctgatttag

SEQ ID NO: 120671 - DNA, 528 bp, Artificial Sequence
  Description of Artificial Sequence: Synthetic coding sequence
atgcagaaatttggactgcgcgacactatcgtgaaatcccatctactgcagaaggaagaggactacacttacatacagaacttcaggttctttgccggcacttataatgtgaatggccaatcccctaaggagtgtctgcggctgtggctgagtaacggcattcaggctccagatgtatactgcgtgggtttccaggagctggacctctccaaagaagctttttttttccatgacacaccaaaggaagaggagtggtttaaagctgtatctgaagggctgcatcctgacgccaagtatgccaaggttaagcttatcaggcttgtgggcataatgttactgctgtacgtgaagcaggagcatgcagcatatatcagcgaggtggaggctgaaaccgttggcaccgggatcatgggtcgcatgtgtgatcttgtcgccggtgggccacagctgcaggatcgacgagcaggttgcggcaagtcagaaaaagcacatcgtagggagggactgagcaatgcagtttgtatctag

SEQ ID NO: 120672 - DNA, 834 bp, Artificial Sequence
  Description of Artificial Sequence: Synthetic coding sequence
atggcagatccatggcaggaatgtatggactacgctgtcactctggcacggcaggcaggagaggttgtgtgcgaggctatcaaaaacgaaatgaatgtgatgctgaaatcctctccagtggatctggtaaccgcaaccgaccagaaagtggagaaaatgttaatctcttccatcaaagagaagtatcctagtcatagttttataggggaggagtccgtggctgcaggtgagaaaagcatcttaaccgacaatcctacctggataatcgacccgatagatggaaccactaatttcgtacaccggtttcccttcgtagccgtgagtattggatttgccgtaaataagaaaatcgagttcggggtggtctattcttgtgtggagggcaaaatgtacaccgctaggaagggcaagggagccttctgtaacgggcagaagctccaggtgagtcagcaggaagacatcaccaaaagcttactggttacagagctgggaagttccaggacacctgagaccgtgagaatggtgctgagcaacatggagaagctgttctgcatccccgtgcatggaatccgatccgttggcacagccgctgttaacatgtgcttagtggccacaggcggagcggatgcgtattacgagatgggaatacactgttgggatgtggctggagccggaatcattgtaacagaagccgggggggtgctcatggacgtaacgggcggtcctttcgatctcatgtcgcgcagagttattgccgctaacaataggatcctggcggagcgcattgccaaggagatccaggtcattcctttacagagggacgacgaggattag

SEQ ID NO: 120673 - DNA, 597 bp, Artificial Sequence
  Description of Artificial Sequence: Synthetic coding sequence
atggccgatccttggcaggaatgcatggattatgcagtgacactggcccgacaggctggcgaggtggtctgtgaagccataaaaaatgagatgaatgtgatgctcaagtcttcaccagtagatttggtgactgctactgatcagaaggtagagaagatgctgatctccagcatcaaggaaaagtatcctagccactcttttattggtgaggagagcgtcgcagccggcgagaaatctattctgacagacaatcctacctggattatcgaccctatagacggcacgactaactttgtgcataggttccctttcgtcgcagtgtccatcgggttcgccgttaacaagaaaattgaattcggcgtggtctactcctgtgtagaagggaagatgtacaccgcacgtaagggcaagggtgcattctgcaacgggcagaagctgcaggtctctcaacaagaagggtctggcgtactagagcagcaactgctcatctgcgcgttgtggcagttggcagagcagatgcacatcatgaagtgggagttcacagcagggatgttgcaggaactcgccctgcttctcctcaagttggtggcttgctag

SEQ ID NO: 120674 - DNA, 1011 bp, Artificial Sequence
  Description of Artificial Sequence: Synthetic coding sequence
atgggccagcggcccggacccgtgcttccagccgtggccgttctgggacaggtggcaaaacgtaaggtcgcatggttgctgcggtggaaggcggtaaccagaactgagactgccgggaactcctcaggtgtgtatggtttcgggaaaatgaagatttttgttaagtatttccagaagatggcggacccctggcaggaatgtatggactatgcggtaacactcgctaggcaagccggcgaggtcgtttgtgaggccattaagaacgaaatgaacgtcatgctgaaatcctcaccagtcgatttggtaaccgccactgaccagaaggtcgaaaaaatgcttatttcctccattaaagagaagtacccaagccattcattcatcggcgaggagagcgtcgccgccggagagaaatcaattctgacagacaaccctacctggatcatagatccaattgacggcaccacaaactttgtgcaccgcttcccattcgtggcagtttccatcggctttgccgtcaataagaagatcgagttcggagtcgtgtactcgtgcgtcgagggaaaaatgtacacagccaggaaaggaaaaggggccttttgcaacggacagaagctgcaggtgtctcagcaggaagacataacaaagagtctactggtgacggagctgggtagctccaggaccccggagaccgtgcgcatggtgctgtctaacatggaaaaacttttctgcatccccgtccacgggattcgctctgtaggaacagctgcagtgaacatgtgtctggtggccactggaggcgccgatgcctactatgagatgggaattcattgttgggacgtggcaggcgccgggatcatagtcactgaggctggaggagttctcatggacgtaaccggtggaccatttgatctgatgtcacggcgagttatcgcagccaacaaccgtatccttgccgagcgcatcgccaaagagatacaggtgatccctttgcaacgagatgatgaggactag

SEQ ID NO: 120675 - DNA, 462 bp, Artificial Sequence
  Description of Artificial Sequence: Synthetic coding sequence
atggctgacccctggcaggaatgcatggactacgccgtgacactagctagacaggccggagaagtcgtgtgtgaagcaatcaagaatgagatgaacgtgatgttgaaatcttcccccgtggacctggtgacagctacagatcaaaaggttgaaaagatgttaatcagctccataaaggagaaatacccctcgcacagattcccctttgttgcggtgtcgattgggttcgccgtaaataagaagatagagttcggagttgtgtatagttgcgttgagggcaagatgtacactgccaggaaagggaagggggccttctgcaacggccagaagttacaggtgtcacaacaagaggacataacaaaatcgctcttggtgacagagctgggaagttccagaacccctgaaactgtgcgcatggtgctgtccaacatggagaagctcttctgtattccggtgcattag

SEQ ID NO: 120676 - DNA, 636 bp, Artificial Sequence
  Description of Artificial Sequence: Synthetic coding sequence
atggggcagagacctggccccgttctgcctgccgtggccgtccttggacaggtggccaagcgcaaagtcgcctggttgctgcggtggaaggccgtgacaaggaccgagacagcaggtaacagctcgggcgtgtacggctttggaaaaatgaaaatcttcgtgaagtattttcagaagatggccgacccatggcaagaatgtatggattacgctgtgacgcttgctaggcaggctggcgaagtcgtctgtgaagcgatcaagaatgagatgaacgtaatgttgaagtcaagccccgtggaccttgtgactgccacagaccagaaagtggagaaaatgctgatttctagtattaaagaaaagtacccttctcacagtttcatcggggaggagagtgtagctgccggagaaaagtccatcttgaccgacaatccgacttggattattgatcccatcgacggcaccaccaacttcgttcatcgatttcccttcgtagccgtctctataggatttgcagtaaataaaaagatagaattcggagtggtctacagctgtgtggagggaaagatgtacacagcccgcaagggcaaaggtgccttctgcaacgggcagaagttgcaagtcagccagcaggaatag

SEQ ID NO: 120677 - DNA, 867 bp, Artificial Sequence
  Description of Artificial Sequence: Synthetic coding sequence
atgaaaccctccggcgaggatcaagctgcactggccgccggcccctgggaagaatgtttccaggccgcagttcaactggctctgcgggcagggcagatcattagaaaagcattaaccgaggaaaaacgcgtttctactaagacatcggcggctgatctcgtcacagaaacggaccacctggtagaagacctgataatttcagagctgcgcgaacggtttccaagccatcggtttatcgctgaagaggccgccgcttctggtgctaagtgcgtgttaacacacagtccaacatggattatcgaccctatagacggcacttgcaatttcgtccaccgatttcctactgttgctgtaagtatcggtttcgcggtgaggcaggaactcgagtttggagtgatctaccactgcacagaagaaagactttacacgggcagaagaggacgtggagctttctgtaacggtcaacgattacgggtgtccggagaaacagatttgtccaaagcgttggtactgacagagatcggtcctaagagggatccagccactttgaagttgtttctgagcaacatggaaagactattacacgcaaaggcccacggagttcgggtgataggatcatcaaccctggcgttgtgtcacttagcttcaggcgccgccgacgcatactatcagttcggcctacattgctgggaccttgcggcagctacggtgattattcgcgaagctggaggaatcgtaatcgatacatctggaggcccactggacttgatggcttgccgcgtagtggcagcttctacccgcgagatggccatgttgatagcccaggcattacagaccattaattacggtagggatgatgaaaaatag

SEQ ID NO: 120678 - DNA, 258 bp, Artificial Sequence
  Description of Artificial Sequence: Synthetic coding sequence
atgaaaccatctggggaagaccaggccgcgctggctgcaggaccatgggaggagtgctttcaggctgccgtgcaactggctttacgagccgggcagatcatacggaaggctctgaccgaagaaaaacgggtgagcacgaaaacaagcgcagccgacctagtcacggagacagatcatctggtggaagacctcatcatcagcgagctgagggagaggtttccttcccaccggtcaccgtttagcctggtccatatgtag

SEQ ID NO: 120679 - DNA, 1071 bp, Artificial Sequence
  Description of Artificial Sequence: Synthetic coding sequence
atgctggagcaaatcagacgcgatataagggattttcgttccagtgcgggtctggacaaggtcatcgttctttggacagcaaatactgagcgcttttgcgaagtcattccaggcttgaacgacaccgctgagaatctccttcgaacaatagaactcggccttgaggtgagcccaagtacattgtttgctgtggcctccatcctggagggttgcgccttcctgaatggctcacctcaaaatactcttgtaccaggcgctctggaattggcctggcagcacagggtgtttgtgggcggggacgactttaagtctggacagaccaaggtcaaatccgtactcgtggactttttaattggctcggggctgaagaccatgagtatcgtgtcctataaccaccttgggaacaacgacggggagaacctttctgccccattacagtttcgtagtaaagaggtgtccaagtcaaacgtggtcgacgacatggtgcagagcaaccccgtgctgtatacaccaggggaggagcccgaccactgcgttgtgataaagtatgtgccctacgtcggcgatagcaagagggccttagacgaatatacctccgaactgatgctgggaggaactaacacactggttctccacaatacctgcgaggacagtttactcgctgcacccatcatgttggacctggccctcctgacggagctttgtcagcgtgtcagtttttgcacagatatggacccagagccccagacctttcaccctgttctgagtctcctttcttttctgttcaaggcccctttagtgccacctggcagccccgtagtaaacgctctgttccggcagagatcctgcatagaaaatattcttcgcgcgtgtgtggggttgccaccccagaatcacatgcttttagagcataagatggaaaggccaggacctagtctgaagagagtcggacccgtcgcagctacatatcctatgctgaataaaaagggcccagtgcccgccgccaccaacggctgtacaggggatgctaatggccatctgcaggaggaaccacccatgccaactacttag

SEQ ID NO: 120680 - DNA, 1677 bp, Artificial Sequence
  Description of Artificial Sequence: Synthetic coding sequence
atggaggctgccgcccagttttttgttgagagccccgacgtggtgtatggcccagaggcaattgaggcccagtacgagtaccgcaccacacgagtctcccgggagggaggagtactaaaagtgcatcctacatccaccagattcactttcaggaccgcccgacaggtccccaggctcggcgtgatgctcgtcggctggggcgggaacaatggctccacactcacagctgccgttctagcgaaccggctgcggctaagctggcccacccgaagcgggaggaaggaggccaactactatggctcacttactcaagccggtacggtctctttaggtttagacgcggagggacaggaagtgtttgtaccattcagtgccgtcctcccaatggtggcgcccaatgacttggtgtttgatggatgggatatctctagtcttaacctagccgaggcgatgaggagggcaaaagtgctcgattgggggctacaagagcagctgtggcctcacatggaggcgttgcgccctcgaccatccgtatacatccctgagtttatcgccgccaaccagagcgccagagccgataatttaattcccgggtctagggcccagcagctggaacaaattaggcgggatatcagagattttaggtccagtgctggcctagacaaggtcatcgtcttatggacagcaaacactgagaggttctgtgaagttattcctgggctaaatgacactgcagagaacctgctgcgaacgatagagctcggcctggaagtttctccctctaccctatttgccgtggccagtatattggaaggatgtgcttttctaaacgggtcccctcagaacaccctggtacccggggcactggagctcgcctggcagcacagagttttcgtaggcggagatgactttaaaagtggccagaccaaagtaaagtctgttctcgtggactttctcattggctccggccttaaaacaatgagcatcgttagctacaatcaccttggaaacaatgacggagaaaacctcagcgctcctttacagtttcgttctaaagaggtatccaaatcaaacgtggttgatgacatggtccaatcaaaccccgtactctatacaccaggtgaggagcctgatcattgtgtggtcatcaagtatgtgccatacgtaggggattcaaaaagggctttagatgagtatacctcagaactgatgttaggcggcacaaacacgctggtcctacataatacttgcgaggacagtctgttagctgcacctatcatgcttgatctggccttgttaacggagctgtgccagcgggtcagcttctgcaccgatatggacccggaaccgcagacattccaccctgtgctgtcactcctgtcgttcctgtttaaagcccccctggtcccacccgggagtcccgttgttaacgccttgtttcgtcagaggtcatgcatcgagaatatcctgcgcgcgtgtgtagggttgccacctcagaaccacatgctgttagaacacaagatggagcgccccgggccctcccttaagagagttggccccgttgccgcaacatatcctatgctgaacaagaagggtcccgtgccagcagcaacaaatggctgtaccggagacgcgaacggtcatctgcaggaggaacctcctatgcctaccacttag

SEQ ID NO: 120681 - DNA, 1515 bp, Artificial Sequence
  Description of Artificial Sequence: Synthetic coding sequence
atggaggcagccgcccagtttttcgtggagtctcccgatgttgtgtatgggccggaggcaatcgaagcccaatatgaataccgaaccactagggtgtctagggaaggtggcgtgctgaaggaagctaattactacggttccctgactcaggcgggcaccgtctctctcggcctggacgccgagggacaagaggtcttcgttcctttctccgccgtgctacccatggttgcccccaatgacctggtattcgacgggtgggacatcagctctctgaatttggccgaggccatgcgccgcgcaaaagtactcgattgggggctgcaggaacagctctggccccatatggaggcactgaggccgagaccttccgtatacatccccgaattcattgctgccaatcagtctgcccgggcagacaatctaatacccgggtctagagctcaacaactggaacagatccgccgagacattagagacttccgtagttccgcaggactagacaaagtaattgtgctctggaccgcaaacacagagagattttgcgaggtcattccgggtctgaacgataccgcggagaacttgcttagaaccatagaacttggcctggaggtgtctccgtctaccttgtttgccgttgccagtattctggagggctgtgcatttctcaacgggagtccacagaacaccctggtgcccggggccttagagctggcttggcaacatcgggtattcgtggggggcgatgactttaaatccggtcagaccaaggtgaaaagcgtcctcgtggattttctcatcgggtctggtctgaagacaatgagtattgtgtcgtataatcaccttggtaacaatgatggcgaaaatttgtccgcccccctccagtttagaagcaaggaagtctcaaagtcaaacgtagtcgacgacatggtgcagtcaaatcctgtgctctatacgccaggtgaggaaccagaccactgtgttgtcatcaaatacgtcccctatgtcggggactctaagagagcattggatgagtatacatctgagcttatgcttggagggacaaacaccttggtgctgcataatacctgcgaagacagcctgctggccgctcctatcatgttggacctcgctttgctcactgagctgtgtcaacgagtctcattctgtaccgacatggacccagagcctcagacctttcatcccgtactcagtcttctgtcttttctattcaaggcacctttagttccccccgggtcaccggtggtcaacgcactttttcgacagaggagctgcatagagaacatcttgcgggcctgtgtaggactgccacctcaaaatcacatgctgctcgaacacaagatggaaagacctggcccctctctgaaacgggttggtcccgttgctgcaacctatcccatgctcaataagaaaggccccgtgcctgcagcaacaaacggatgcacaggtgatgctaacggccaccttcaagaggagccacccatgcccaccacttag

SEQ ID NO: 120682 - DNA, 1227 bp, Artificial Sequence
  Description of Artificial Sequence: Synthetic coding sequence
atgaggagggccaaggtactggactggggccttcaggagcagctctggcctcatatggaggccctgcgcccaaggccaagcgtgtacatacccgaatttatcgccgccaaccagtccgcacgcgcagataatcttatcccaggatcacgggcccagcagctcgaacagattcgccgggacatacgcgactttaggagcagcgctggcctggacaaagtgatcgtgttatggactgcgaacacggagcgattctgcgaggtaatcccaggactgaatgatactgctgaaaacctgctacgtaccattgagctcggacttgaggtgtctccgagcacattatttgctgtggcctcaatcttagagggctgcgcgtttctgaatggcagtccccagaatacactcgtccccggggccctcgaactggcgtggcaacaccgagtcttcgtggggggtgacgattttaagtctggccagaccaaggtgaaatcggttctggttgattttttaatagggagcgggctcaaaactatgagcatcgttagctacaaccaccttggaaataacgatggggagaatctgagcgccccattgcaattcaggtctaaggaggtgagtaagtccaacgtggttgacgacatggtgcagagtaatcctgttctgtacactcctggagaggagcccgaccactgtgtggtcatcaaatatgttccatatgtgggcgacagtaagcgggctctcgatgagtataccagcgaactaatgttagggggcactaatacactcgttttgcacaatacttgcgaagactccctgctggccgcacccatcatgctcgatctcgcccttctcaccgagctgtgtcagcgagttagcttctgtaccgacatggaccctgagccacagacgttccatccagttctgagtctgcttagctttttgtttaaagctcccctggtgccacccggatcccccgtggtgaatgcactgtttcgccagagatcctgtatcgagaacatattgagagcctgcgtgggattgccaccccaaaaccacatgctgctagaacacaaaatggaacgccccgggcccagcctgaagcgggtggggcctgtggccgctacctatcccatgcttaacaaaaagggcccggtgcccgctgccacaaatggttgtactggcgatgcaaatgggcacctgcaggaggaaccccctatgcctaccacatag

SEQ ID NO: 120683 - DNA, 1386 bp, Artificial Sequence
  Description of Artificial Sequence: Synthetic coding sequence
atgacattacccggaggccccacaggaatggctcgtcccgggggagctaggccttgttcacccggcctggagagggccccccggcgctcagtcggcgagctacgtctgctgttcgaagctagatgtgcagctgtggctgccgctgcggcagccggggaaccccgggccagaggcgccaaaagaaggggaggacaggttcctaatggcctgcctcgggcccctcctgccccagtaatcccacaactcacagttaccgcagaggagcccgatgtgccccctacaagcccaggcccacctgaacgagaaagagactgcttaccagccgcgggttcctcacacctgcagcagcctcggaggttgagcacctcctctgtgtcaagcacaggttcgtcctccttattggaggattcagaggacgacctgctgagcgactctgaatcccgctctcggggcaacgtccaattggaggcgggcgaagatgtcggccaaaagaatcattggcaaaagatcaggaccatggtgaacctgccggtcatttcaccttttaagaagagatacgcttgggtccaactggccggtcatacagggagctttaaagctgctggaacttcaggactgatcctaaagagatgttcagagcccgagcgatactgtctcgcaaggctgatggccgatgccctgagggggtgcgtgcctgcttttcatggggtcgtggaaagggatggcgagtcctacctccaacttcaggacctgcttgatgggtttgatgggccttgcgtcctggattgtaagatgggggttcggacgtaccttgaagaggaacttaccaaagctcgcgaaagacctaagttgaggaaggatatgtacaagaaaatgctggccgtggatccagaagccccaacagaagaggaacatgctcagagagccgtgacaaaaccacggtacatgcaatggagagagggaatctcctcttcaaccacactggggttcagaatcgaaggaattaagaaggctgatggatcatgcagcactgacttcaaaacaacaagaagcagggagcaagtactgagggtctttgaggagttcgtccagggagatgaagaagtacttcggcgttatttgaaccgcctgcaacagattcgcgataccttggaagtttctgagttctttcgaaggcacgaggtgatcggaagttctttactgtttgtgcacgaccattgccatagagcgggagtctggctgatcgatttcggaaagacgacacctctgcccgatggccagattctcgaccatcggagaccctgggaggagggcaatagggaagatggatatctgctgggcctggacaacctgatcggcattctggcgagcctcgcggagcggtag

SEQ ID NO: 120684 - DNA, 2841 bp, Artificial Sequence
  Description of Artificial Sequence: Synthetic coding sequence
atggccgtttactgctatgccctgaacagtctcgtcattatgaattcggcaaatgaaatgaaaagcggtggaggccccggcccctctgggtccgagactccaccgccgccccgccgggctgtgctgagtccggggtctgtgttcagccccgggcgtggagccagctttctgtttccacccgctgagagcctttcccccgaggagcctagatcaccagggggatggaggagtgggcgccgccgccttaactcctcctctggctccggctcaggctcgagcggctcgagcgtttcatcacctagctgggctggccgtctgcggggtgaccgccagcaggtcgtggcagctggcactctgagccccccaggacctgaagaagcaaaacgaaaactgcgaattctccaaagagaactccagaacgtccaggtgaaccaaaaggtcggaatgttcgaagcccatatccaggcgcagtcgagcgccatccaggcccctcgctccccacggcttggacgagcccgcagtccttcaccatgtcccttcaggtccagtagtcagcccccaggacgcgtgctggtgcaaggcgctcgatccgaagaacgtcgaacgaagtcatggggggagcagtgtcccgagacttccggcacagactcagggagaaaaggtggccctagcctttgctcctctcaagtgaaaaaaggtatgcctccactgcctggacgggcggctccaaccgggtctgaagcacagggtccgtccgctttcgtgcgcatggaaaagggaattccggcctctccaagatgcggaagtcccaccgccatggagatcgacaagagaggtagccccaccccgggtacccgctcatgcctggcaccttcactaggacttttcggcgcttcgctcactatggcaactgaagtggctgcacgggtgacatcaacgggaccccataggccgcaggacttggcactgaccgagcctagcggaagagctcgcgagctcgaggaccttcagccacccgaagccctcgtcgagcgacagggtcagttcttggggtcggaaacctctccagccccagagaggggcggtccacgcgacggtgagcctccgggaaagatgggaaaagggtatctgccatgtgggatgcctggaagcggggaacccgaagtggggaagagaccagaagaaacgactgtatccgtgcagagtgcagagtccagcgacagcttatcctggagtcgactgccacgggctttagcatcggtgggcccagaagaagcccgatcgggcgcacctgtgggcggcggccgatggcagttgtcagacagggttgaagggggctctcctacgctgggcctgctgggagggtccccatcagcccagccaggaaccggcaacgtggaagccggcatcccatcagggaggatgctggagcctctgccttgctgggatgcggccaaggatttgaaagaaccgcagtgtccgcctggagaccgggtaggagtgcaacctggtaacagtagggtctggcagggcacaatggagaaggcaggcctagcatggactaggggcactggggtgcagtcagaggggacatgggagagccaaaggcaagactcagatgccctgccgtccccagaattgttacctcaggatcccgacaagcctttcctgagaaaggcctgcagcccgtctaatatacctgctgtcattatcacggacatggggacgcaagaggacggggcactggaggaaactcagggttctcccaggggcaatctgccactcagaaaattatccagctcatcggcatccagtacaggattttcttcatcgtacgaggactcagaagaggatatctctagtgatccggagagaacgttggatccaaattccgcctttctccacaccctggaccaacagaagcctagagtaagcaagagttggcggaagattaaaaacatggttcactggtctcctttcgtgatgagctttaagaaaaagtacccttggatacagctggccggccatgctggcagcttcaaggctgcggccaatggaagaatcttgaagaaacactgtgagagcgagcagaggtgcctggatagattaatggtcgatgttctgcggcccttcgttcctgcttatcacggtgatgtggtgaaagatggggaaagatataatcaaatggacgatttactggccgatttcgacagcccctgtgtcatggattgtaagatggggatcaggacatacctggaggaggagctgactaaggctcggaagaaaccttctttgaggaaggacatgtatcagaaaatgattgaagtggaccccgaagctcccacggaggaagagaaggcccagcgagctgtgacgaagcctcgatacatgcagtggagagaaactattagcagcaccgcgacattgggcttccgaatcgaaggcattaaaaaggaagacggcaccgtcaaccgcgattttaagaagaccaagacccgggagcaggtgacagaagcgttccgggaatttaccaagggcaaccataacattctgatagcctaccgggacagactcaaagccataagaacaacactggaggttagcccatttttcaaatgtcacgaggtcattgggtcttcattactctttatccacgacaagaaggagcaagccaaagtgtggatgatcgactttggcaaaacaacaccactcccagaagggcagacgctccaacacgatgtcccatggcaggaaggcaatagagaggacggatatttgtctggactgaacaatctggtcgacatcctaaccgagatgagccaagacgctcctctggcatag

SEQ ID NO: 120685 - DNA, 1935 bp, Artificial Sequence
  Description of Artificial Sequence: Synthetic coding sequence
atggcagtgtattgttacgctcttaatagtcttgttatcatgaattccgccaacgaaatgaaatctgggggaggcccaggcccgagcggctctgagactcccccaccccctcgcagggcggtcctgagccccggcagcgtgttttcccctggccgaggcgccagtttcctctttcctcctgccgaatctctgtcgcctgaggaaccgaggtcccctggaggatggcgttcaggccgacgacgcttgaactcctcgtccggcagcggcagtggcagttccgggtccagtgtgtcatctccatcttgggcgggccgactgcggggtgatcgccagcaggtggtggccgcaggaaccctgtccccccctggacccgaggaggccaagcgcaaacttcggatcctgcagcgcgagctacagaacgtgcaggttaatcaaaaggtaggcatgttcgaggctcacatccaggcacagtccagcgctattcaggcgccacgctcaccaagattagggcgcgcccgctctccatcgccctgtcctttccgttcttcgtctcagccccccgggagggtgctcgtccagggtgcaaggtctgaggagcggagaacaaaatcgtggggtgagcagtgtcctgagacatctggcaccgattccggtcggaagggagggccttctctgtgttcttcccaagtcaagaaggggatgccaccactccccggccgcgccgctccaacaggctccgaagcccagggcccttcggcctttgtgcggatggaaaaaggaatcccagcctcaccccggtgtggttcacctaccgccatggagattgacaagcgcggaagtcccactcctgggacccggagctgcctggctccgtctctgggtctcttcggcgcctcattgaccatggccaccgaggtggccgctagggtgacgtccaccggccctcatcgccctcaggaccttgctctaacagagccctcaggccgcgctcgagagttagaggacttgcaaccaccagaggctctggtcgagaggcagggtcagttcttgggctccgaaacgtcaccggcccctgagcgaggaggtccccgtgatggcgagccacctggcaagatgggtaaggggtatctcccatgcggcatgccaggatctggagaaccagaagtcgggaaaaggcctgaggaaaccacagtcagcgtgcaaagcgctgagagcagcgacagtttaagttggtcacgcctcccccgtgccttggccagtgttggcccagaggaagctcgcagcggcgctccagtcgggggtggaaggtggcaattatccgatcgagttgaaggggggtctccgaccctcggcttgctaggagggtccccttcagcccagcccgggactggtaacgtggaagcaggcattccatccgggcgcatgctggagccacttccatgctgggacgcggcaaaagatctgaaggaaccacaatgtccgcctggggatcgtgtcggcgtgcagccaggcaactctcgcgtgtggcaaggcacaatggagaaagccggcctggcatggacaagaggcactggtgtgcagagcgaagggacatgggagtcccagagacaggacagtgacgctctgccatcccccgagctcttgccccaagaccctgataagcccttcttaaggaaggcatgcagcccctcgaacatccctgccgtgattattaccgatatgggcacacaagaggatggcgccctggaggaaacacagggctctccaagaggcaatctccccctgcgaaagttgagttcttctagtgcctcatcgacaggttttagtagcagttacgaagactctgaggaagatatcagtagtgacccggagagaaccctcgatccaaattcagcctttctgcacaccctagatcagcagaagcctcgggtttag

SEQ ID NO: 120686 - DNA, 2841 bp, Artificial Sequence
  Description of Artificial Sequence: Synthetic coding sequence
atggccgtctactgctacgcactcaatagcctcgtaatcatgaatagtgcaaacgaaatgaaaagtgggggggggcccggtccctcaggttccgagactccacccccccctcggagagccgttttatcaccaggtagcgtatttagtcccggacgaggggcgtcattcctattcccccccgcagagagtctgtcccccgaagagccacgcagtcccggaggttggaggtccggccgaaggcgactaaattcctcatccggctcaggatctggcagcagcggctctagcgtttcttctcccagttgggctggcaggctgagaggggaccgacagcaggttgtagctgccggaaccctaagtccccctgggccagaagaggcgaaaaggaaacttcggattttgcagcgggagctgcagaatgtgcaggtgaatcagaaagtagggatgttcgaggcgcacatccaggctcaatcttccgccatacaagcacctcgatccccccgtctggggcgtgcccgctcaccatcaccttgcccattccgatcttcgtctcagccccccggcagggtattagtacagggcgccagatcagaagagaggaggaccaagagctggggggagcagtgccccgagacctcagggaccgactccggcaggaaaggtggcccatcattatgctcctcccaggtcaagaagggcatgccccccttacccggacgggccgcccccaccggcagtgaggcccaaggcccttcagcatttgtaaggatggagaaaggtattcccgcttccccaaggtgcgggagcccgaccgccatggagattgataagcgagggagtccaacacccggaacgcggagttgtctggcaccatccctgggactgttcggcgccagcctgactatggcgactgaagtagctgccagggttacatccaccggtcctcatcggccacaggacctggcattgaccgaaccttcgggacgagctagggaattagaggatctccagcctccggaggctctcgttgagaggcagggccaattcttgggctcggaaacctcccccgcccctgagcgagggggtccccgtgacggcgagccgcctggcaaaatgggcaagggttacctgccctgcgggatgccaggcagcggtgaaccggaagtgggaaaacgccctgaggagacaacagtgtcagtgcagtcagcagagtcaagcgactcccttagctggagcaggctgcctagagctctggccagtgtggggcccgaagaagctcggtccggtgcccctgtgggtgggggaagatggcaactgtctgaccgcgtggagggcggaagccctactctgggcctgctgggaggatcacctagtgcccagcccggcaccggaaatgtggaggcaggcattcccagcggcaggatgctcgagcccctgccttgttgggatgcggctaaggatctgaaggagccccagtgccccccaggcgatcgggtgggtgtccagccgggcaattctcgagtctggcaaggaaccatggagaaagccggactggcttggacccggggcaccggagtacagagcgaggggacctgggagagccagcgacaggactcagatgcattgccgtcccctgaactcctaccccaagacccagataagccatttctgagaaaggcttgttctccttccaatataccggcggtgattatcacagacatgggaacacaggaggatggggcactcgaggagacccagggcagccccagagggaatctccctttgcgtaagctgtcctcttcttccgcttcatccactggtttcagcagtagctacgaagacagtgaagaggacatttcaagtgacccagagaggacgctggatcccaactccgcttttctgcacacactcgatcagcaaaaacccagggtttcgaagtcttggcgcaaaatcaaaaacatggtgcactggagtcctttcgtgatgtcttttaaaaaaaagtacccctggatccaactggccgggcatgctggatcttttaaggctgctgctaatggaagaatattaaaaaagcactgtgaaagtgagcaaaggtgcctggatcgtctaatggtggacgtcctcagaccattcgtgccagcctaccacggcgatgtggtgaaagatggtgaacgttataaccagatggacgatctgctggctgactttgatagcccctgtgtgatggactgcaaaatgggtatccgcacgtacctggaggaagagctgactaaggctcgcaaaaaaccaagcctgaggaaagacatgtatcagaaaatgatcgaggtcgacccagaagctcctacggaggaggagaaagctcagcgggctgtgacaaaacctagatatatgcagtggcgagagaccatttcctcaactgctaccctgggattccgcatcgagggtattaagaaggaagatggaactgttaacagggattttaagaaaaccaaaacccgggaacaagtcacagaggccttccgggagtttaccaaaggcaaccacaatatactgatcgcgtaccgcgatagactcaaggctattagaaccaccctggaggtctcacctttctttaagtgtcacgaagtcattggcagttctctcttgtttattcacgacaaaaaggagcaggcgaaagtgtggatgattgacttcgggaaaaccacaccactccctgaaggtcaaacccttcagcacgacgtgccctggcaagaaggtaatcgcgaggatggctacctctcaggattaaataatctggtggatatccttaccgaaatgagccaggatgctcccctggcctag

SEQ ID NO: 120687 - DNA, 2052 bp, Artificial Sequence
  Description of Artificial Sequence: Synthetic coding sequence
atgcggcggtgcccatgtaggggatcattgaatgaggctgaggctggagcgttgcccgcagccgctaggatgggactggaagcccctcggggcgggcggcgtagacaacctggccagcaacggcctgggccaggagccggcgctcccgccggaagacccgagggcggcgggccatgggccaggactgaaggcagctctctacattcggaacccgaacgagccggactgggccccgctcccggaactgagtccccgcaagcggagttctggactgacggccagacagaacccgcagccgctggactgggagtcgagaccgagcgaccaaagcagaagacagaaccagatcggagcagcttgaggacgcacctcgaatggtcttggagtgagctggaaactacctgtttatggaccgagaccggaacagacgggctttggactgaccctcacagaagcgatctccagtttcagccagaggaggccagtccttggacccagcctggcgttcatggaccctggaccgagcttgagactcacggcagccagacacagcctgaaagagttaaatcttgggctgacaatctctggacacatcagaatagctcctcactacagacccaccccgagggggcctgcccctctaaggaaccttctgccgatgggagctggaaagaactttatactgacggcagccgaacacagcaagacatcgagggcccatggacagagccatacacagatggctcccagaagaaacaggatacagaagctgccagaaaacagcctgggaccggcggttttcagattcagcaggacaccgacggcagctggacccaacccagtaccgatggtagtcaaactgcgcccgggactgattgcttgctgggagaacccgaggacggcccgcttgaagagccagagcctggcgaactgcttacccacttatatagtcatctgaagtgcagtcccctgtgccccgtgcctagacttattatcacccctgagaccccagagccggaagcccagcctgttggtccccctagccgggtggagggtggatcgggcgggttctccagtgcaagcagctttgacgagtctgaggatgacgtggtggctggcggcgggggcgcctcagatccagaggataggagtgggtccaagccttggaaaaaactgaagacagttctcaaatactctccctttgtcgtctcgttcaggaaacactatccttgggtacaactcagcggccacgctgggaattttcaggctggtgaggatggcagaatcttgaagagattctgccaatgcgagcagaggagtcttgaacagttaatgaaggaccccctgcgcccctttgttcctgcatattatggcatggtgttgcaggatggtcaaacattcaaccagatggaggatctcctggctgatttcgaaggcccctctattatggattgcaagatgggctcccgtacatatctggaggaagaactcgtgaaagccagagaaaggcccagacccaggaaggatatgtacgagaaaatggtggcagtggaccccggcgctccgacgcctgaggagcacgcacaaggagccgtgacaaagcccagatacatgcaatggcgggagacgatgtcctcaaccagtacactcgggttccggatcgagggcataaagaaagctgatggcacgtgtaatactaacttcaagaagacccaagctctggaacaagtaactaaggtcctggaagatttcgtggacggggatcacgtcatcctccaaaaatacgtcgcgtgcctcgaggagctgcgggaggccctggaaatttcgccattcttcaagacacatgaggtggtagggtcctctctgttatttgtccatgatcacacaggactcgcaaaggtctggatgatcgactttgggaaaaccgttgccctgcccgaccaccaaactctttctcacagattaccatgggcggagggtaatagggaagatggctacctctggggcctcgacaatatgatatgccttttacagggcctggctcagagttag

SEQ ID NO: 120688 - DNA, 1740 bp, Artificial Sequence
  Description of Artificial Sequence: Synthetic coding sequence
atgcgacgacctcccggcaacggggaagctgcgtcggaaggaccgggcggatgggggctgtggggcgtacaggaaagtcgacgactgtgttgtgccggccacgatcgctgtaagcaggcattgctgcagatcggaattaacatgatggcgctgccaggtggcagacaccttgatagcgtaactctcccaggacagcgactgcaccttatgcaggtcgattcagtccagaggtggatggaggacctgaagctgatgaccgaatgcgagtgtatgtgcgttcttcaagccaagcctataagcttggaagaggacgctcagggtgacctgatactagccggaggcccagggccgggtgacccactccagttgttactgaagagggggtgggtaatatctactgaactgcgtcgaattggacaaaagttagcccaagacaggtgggctagggtgcacagcatgagcgtcaggttgacatgccacgctcgctcaatggtgtctgaatatagcgctgtgtcaaggaatagccttaaagaaatgggagagatcgaaaagttgctgatggagaaatgctctgaattgtctgcggtgaccgaaagatgtctgcaagtggaaaatgaacacgtgcttaaatcgatgaaggcttgcgtaagtgaaactctgtctatgctgggacaacacttcgggcagcttctcgaattggcactaacgcgagaggttcaggccttggtgagaaagatagacgcatcagataatatctacactacagaaagtaccactggcaatctgttctctctgactcaggagggcgctcctctatgtcgtataatcgctaaagaggggggggtggtcgccctcttcaaagtgtgccgccaggactcttttaggtgtctctatccccaagctctgagaacactggcctctatttgctgcgtggaggagggcgtgcatcagctggaaaaagtcgacggggtgttgtgccttgctgatatcctcaccgacaacagccatagtgaagccactcgagctgaagcagccgcagtagtggcgcaggtcacgagcccccaccttccagtcactcagcatctgtctagcttcctggagagtatggaggaaatcgttacagctctggtgaaattatgtcaggaggcctcatccggtgaagtgttccttctcgcatctgcagctcttgctaacattacgtttttcgacacaatggcctgtgagatgctattgcagttgaatgctattcgcgtcctgttggaagcttgctccgacaaacaacgggtagatacaccatacacacgcgatcaaattgtcacgatcctcgccaacatgtcagtgttagaacagtgcgcctccgatataatccaagaaaacggcgtgcaattgatcatggggatgcttagtgaaaagccccgcagtggcacgcccgcagaggtggcggcttgtgagagggtccagcagaaggcagccgtcaccctcgcccggctgagccgcgatcccgacgtcgctcgagaagccgttcgtcttagttgcatgtctcgtttgatcgaactctgtagatccccctccgaacgcaactcaagcgacgcagtgctcgtggcttgcttggctgcgctcagacggctcgcaggcgtgtgcccagagggccttcaggattctgacttccagcagctggtgcagcctaggctggtggactcctttttgctctgcagtaatatggaggaatcttttgtatag

SEQ ID NO: 120689 - DNA, 1599 bp, Artificial Sequence
  Description of Artificial Sequence: Synthetic coding sequence
atgatggctctccccggcgggcgacacctggatagtgtcacactcccagggcagcgactgcacctgatgcaggtcgacagtgtgcaaagatggatggaggatcttaaacttatgacagagtgcgaatgtatgtgcgtgctgcaggctaagccgatctcactagaggaggacgcccagggagatctgattctggccgggggccctgggcctggcgaccctttacagctcctgctgaagcgcggctgggtgataagtactgaattgagacggattggccagaaattagcccaggataggtgggcgcgggtccactcaatgagcgtacgcctcacttgtcacgctcgtagtatggtgtccgaatattcagccgtctctcgaaactctctgaaagagatgggagagatagaaaaactgttgatggaaaagtgcagcgagctatccgccgttacagagaggtgtctgcaggtggaaaacgaacatgtgctcaaaagtatgaaggcgtgcgttagtgaaacactatctatgctggggcaacactttgggcagctgttggagctcgctctgacgcgtgaagtgcaagccctagtgaggaagatcgacgctagtgacaatatttataccactgagagtacgaccggtaatcttttcagtctgacgcaggagggggccccattatgcaggatcatcgccaaggaaggcggagtagtcgcacttttcaaggtttgccgtcaggacagcttccgctgcctgtacccacaggccctacggacccttgctagtatctgctgtgttgaggagggagtgcaccagctcgagaaggtcgatggggtcctctgccttgccgatattctgactgacaatagtcacagcgaggcaacccgagcagaggcggctgctgtcgtggctcaggttacctcaccacatctgcccgtgacacaacacctgtcttccttcctcgagtctatggaggagattgtaactgcgttggtaaaactatgtcaggaggcatcctcaggcgaagtgtttttactagcttccgccgccttggctaacatcacattttttgacaccatggcatgtgagatgctgcttcagctgaatgctatacgcgtgctactggaggcgtgttccgacaagcaacgcgtggatacaccttacactagggaccagatcgtcaccatactggcaaatatgtctgttctcgagcagtgcgcttctgacattatccaggagaatggtgtccagctcataatgggtatgctatctgaaaaacctcggtccggaactcctgccgaagtagcagcttgcgagcgagtgcagcagaaggccgcagtcacattggcgcgtctaagtagggacccggacgtggccagagaagctgttcggctatcatgcatgtcgcgcctcatcgagctttgcagatctccctctgaacgtaactcaagtgacgctgtgttagttgcttgcctggccgctctcaggcgtctcgccggagtgtgccctgaggggctgcaggattccgacttccagcaattagtgcaaccgcggctagtggattccttcttgctgtgtagcaacatggaagagagctttgtctag

SEQ ID NO: 120690 - DNA, 927 bp, Artificial Sequence
  Description of Artificial Sequence: Synthetic coding sequence
atgatggccctgcctggtggtcggcatctggactccgtgactcttccgggccagcggctccacctgatgcaggtggattctgtgcagaggtggatggaggatttaaagctgatgacagagtgtgaatgtatgtgtgtgctgcaggccaaacccattagtctggaagaggatgcacagggcgacctgatacttgctggagggcctggcccaggagatcctttgcagttactgctgaaaaggggctgggtcatctcgaccgagctgcggaggatcggtcagaaactggctcaggaccggtgggcgcgcgtgcactctatgtctgtgaggttaacctgtcacgcgcgttccatggtatccgagtatagtgcagtgtcccgcaactctctcaaagagatgggagaaatcgaaaagctgcttatggaaaaatgctctgagctgtctgctgtcacagagcgctgtctacaggtcgaaaatgagcacgttctcaagagtatgaaggcgtgcgtgagcgagacgttgtcaatgcttggccagcactttggacagctcctggagctcgccctaacccgtgaggtccaggtcgaatcacattctgtgacccgtctggaatgcagcggcgcgatcagtgcccagtgcaatcttcgcttactggggagcagcgacagccccgcaagtgctagccaagctctcgtgagaaagatcgacgctagtgacaatatttatactacagagtcgactacgggcaacctgtttagcctcacacaagaaggggcgccgctgtgcaggataattgcaaaggaggggggagttgtggcactgtttaaagtgtgccggcaggacagcttcagatgcctatacccccaggcgctaaggactctcgcttccatatgttgcgtggaagagggagtgcaccagttggaaaagtag

SEQ ID NO: 120691 - DNA, 1473 bp, Artificial Sequence
  Description of Artificial Sequence: Synthetic coding sequence
atgatggcgttgccaggcggaaggcatctggactcagtaacgctgccaggacagagactgcacctcatgcaggtcgattcagtgcagcgctggatggaggaccttaagttaatgacggagtgtgaatgcatgtgtgtgctgcaggctaagcccattagcttggaggaggatgcccagggggacctgatcctggctggcggccccgggcccggcgacccactacagctgcttcttaaaagaggatgggtcatttccacagaacttagacgaattgggcagaagctggctcaggataggtgggctcgagtccactctatgtctgtcaggttaacatgccacgcacgctctatggtatccgagtactcggcagtgtctcgaaactctctgaaggagatgggagagatcgagaagctgcttatggagaagtgctcagaacttagtgccgtcaccgaaagatgtctgcaagtggagaacgagcatgtcctgaaatcgatgaaggcctgtgtgtcggaaactctgtctatgcttggacagcattttgggcagctcctggagttggccctgacccgggaggtgcaggccctggtaaggaaaattgatgcatcggacaacatctacacaacagagtcaactaccggcaaccttttctctttgacccaggaaggcgctcccctctgtcgcattatcgctaaggtggatggcgtgctgtgcctggccgacattctcacagataacagccattccgaagccacgagagccgaggccgccgctgttgtggctcaggtcacaagtccacacctgcccgtcacacagcacctgtcatctttcctagagtcaatggaggaaattgtgacggctcttgtgaaattgtgtcaggaggcctcctccggcgaagtgtttctcttggcatccgccgcgttggccaacattacattctttgatactatggcttgcgagatgctgctgcaacttaatgctattagagtgctgctggaggcttgtagcgataaacagcgggtagataccccttatacccgcgatcagattgtaactatattagcaaacatgagcgttttggaacagtgcgcatcagacataatacaggaaaacggtgtgcaactcatcatgggcatgctgtcggaaaagccacgcagtggcactcccgccgaagttgcagcttgtgagagagtgcagcagaaggccgccgtgacactggcaagactatcgagagaccccgacgtcgcacgcgaggccgtacgactgtcttgtatgtcacggcttattgagctatgccgctcccctagcgaaagaaacagctctgacgccgtcctggtcgcctgtcttgcagccctccgtagattagctggcgtgtgtcccgaaggactgcaggacagtgatttccagcagctggttcaacctcggttagtggactccttcctcctgtgcagcaatatggaagagagttttgtgtag

SEQ ID NO: 120692 - DNA, 1473 bp, Artificial Sequence
  Description of Artificial Sequence: Synthetic coding sequence
atgatggctctaccagggggtcgtcatctcgatagcgtgacactgccggggcagcgtctgcacctgatgcaagtcgactcagtgcagagatggatggaagatctcaagcttatgacagagtgcgagtgtatgtgcgtgctccaggctaagcctatttcactcgaggaggacgctcagggagacctcatactggctggtggacccgggccaggcgatcccctgcagctgctacttaagcgcggttgggtcatttcaacagaacttcggcgcattggacagaaacttgcacaagatcgttgggctagggtacactctatgtccgtccgcctgacatgtcatgccaggagcatggtgtcggaatattccgcggtgtcacggaacagcctgaaggaaatgggagagatcgagaagttgctaatggaaaaatgctccgagctgtccgccgtgacggagcgctgcctccaggtggaaaacgagcatgttctcaagagtatgaaggcgtgcgtgtccgagaccctttctatgctcgggcagcatttcggccaacttctggagctcgctctgacacgggaggtccaggcgctggtgcggaaaatcgatgcctcagacaatatctatactacagagtcaacgacgggcaatcttttctcgctgacccaggagggagctcctctgtgcagaatcatcgctaaagtggacggcgttctttgtctcgccgatatcttgaccgacaattctcactccgaagcgactcgggctgaggctgcggcagtcgtggctcaggtcacgagtccacatcttcctgttactcagcacctgtcgagtttcctcgaatcaatggaagaaatcgtgaccgcccttgtcaaactttgccaggaagcctcgtctggcgaggtgttcctgctagcaagcgccgccctcgccaatatcacttttttcgataccatggcatgtgaaatgctgcttcaactgaacgccatacgcgtgttactggaggcctgttctgataaacagcgcgtggataccccttatacacgtgatcaaatcgtgacaattctggcaaacatgtctgttctcgaacagtgtgcctcagatattatccaggagaatggagtacagctgatcatgggaatgttgtcagaaaaaccccgttccggtactccagccgaggttgccgcctgcgaacgggtacaacagaaggcggctgtgaccctcgcccgcctctctcgggaccccgatgtggcccgggaggccgttagattgagttgtatgtcacggctgatcgagttatgcagatctccatccgaacgcaacagctctgacgccgttttagtggcctgccttgcggcgctacggaggcttgcaggagtgtgtcccgaaggtctgcaggattcagatttccagcagttggtgcagcctcggttagtggacagttttctcctatgctcaaacatggaggagtcctttgtatag

SEQ ID NO: 120693 - DNA, 1599 bp, Artificial Sequence
  Description of Artificial Sequence: Synthetic coding sequence
atgatggcactgccggggggcagacacctcgatagcgtcaccctgccgggtcaaaggctgcacctgatgcaggtggatagcgtgcagagatggatggaggacttgaagcttatgacagaatgcgaatgcatgtgcgttcttcaggctaaaccaatctccctggaagaggatgcccagggtgatctgatcctagccggaggccccggtccaggcgatccactgcagctcctgctgaaaaggggctgggtgatatctaccgagctccgacggatcggacagaaactggctcaggacaggtgggcccgggtccatagcatgagtgtgaggctgacatgtcacgcgaggagcatggtgagcgaatattcggcggtgagccgtaatagtctcaaggaaatgggggaaatcgaaaaattgctcatggaaaaatgctctgagctgagcgccgtgacagaaaggtgcctgcaggttgagaatgagcatgttttaaagtccatgaaagcctgcgttagcgagaccttatcaatgctgggacagcacttcggtcagctgctagaattagccctcacccgggaggtgcaggctctcgtacgcaaaatcgacgcttctgacaacatctatacgaccgagtcgactactggcaatctattctccctaacccaggaaggagcccccctctgtaggattatcgctaaggaggggggggtggttgctctatttaaggtctgtcgccaagactcattcaggtgcctgtatccccaggccctgagaacgctggcatcaatctgttgcgtggaagagggcgtgcatcagcttgaaaaggtggacggagtgctttgcctggctgatatactcactgacaattcccatagcgaagctacacgtgccgaggctgccgctgtggtcgcccaggtaacttcgccccatctgccagttactcagcacttgagttctttcctggagtctatggaggagattgtcacagcattagtcaagctttgccaggaggccagcagcggtgaggtgtttttgctggcatccgccgccctcgctaacatcactttttttgacactatggcttgcgaaatgctcctccagctgaatgccatcagggtcctgctcgaagcatgttctgataagcagagggtcgacacaccatacacgcgcgaccaaattgtgacaatcttagcaaatatgagcgtgctggaacagtgcgcatctgatattatacaggagaacggcgtgcagttaataatggggatgttaagcgagaaacctcgaagcggcacccctgcagaggtcgccgcgtgcgagcgggtccaacagaaagctgcggtaacactggctcggctgagtagagaccctgacgtcgcccgagaagccgttcggctgtcatgtatgagcaggctcatcgagttgtgtagatccccatcggaacggaactcatcagatgcggttctggtggcttgcctcgccgccctgcggaggctcgctggcgtttgcccagaggggctccaggatagcgatttccagcagctggttcagccaaggctggtcgacagcttcctgctctgtagcaatatggaagaatctttcgtttag

SEQ ID NO: 120694 - DNA, 834 bp, Artificial Sequence
  Description of Artificial Sequence: Synthetic coding sequence
atgccacgtcttcacgaccatttttggagctgcagctgcgctcatagtgctcgtcgtaggggacccccgcgtgcgtcggctgctggactggctgccaaggtgggcgaaatgatcaatgtctctgtcagcggcccatcactcctggcagctcacggggcaccagatgcagatccagctccaagggggcggtctgccgccatgagtgggcccgaacccggatctccttatccaaacacttggcaccaccgattactccagagatccctagtgttattcagcgttggcgtggtcttagccctcgtgctgaatctccttcaaatacagagaaacgtaaccctgttccctgaggaagtgattgctactatcttcagcagcgcttggtgggtgccaccatgttgcggcaccgctgccgctgtggtggggctgctgtacccatgcattgattctcacctgggcgagccacacaaatttaagagggagtgggccagcgtcatgcgctgtattgcagttttcgtgggcatcaaccatgcatccgccaagttagacttcgcaaacaatgttcagctctccctcaccttggccgcccttagcctcgggttatggtggacttttgatcgttcaaggtccggcctgggtctgggcattaccattgcattcctcgccactctgattacacagttcttagtgtataatggcgtgtatcaatacacctcgcccgactttctctacatcagatcatggctcccctgtattttcttcagcggcggcgtgacagtgggcaatatcggacggcagctggcaatgggcgtgccagaaaagccccactctgactag

SEQ ID NO: 120695 - DNA, 537 bp, Artificial Sequence
  Description of Artificial Sequence: Synthetic coding sequence
atgccgcgcctgcatgatcacttttggtcatgcagctgtgcacacagcgctagacgtcggggaccccctagagcatcagccaaactggatttcgccaacaacgtgcaactgtccctgaccctggcagccttgtcattgggactctggtggaccttcgacaggagtagatcaggcttaggcctcggaattacgatcgccttcttggccactttgattacacagttcctggtatataatggcgtgtatcagtatacctcccctgatttcctttatataagatcatggctgccttgcattttttttagcggaggtgtgacagttggaaacattggcaggcagctggcaatgttgattcctttctgtgaagagttgaacctgaagaccacctggctgtttcacaaaaccagatcaaactatcgcgtgttcttgaaatccccaatagtcatcgagtcttcgaagccgcctattctacgcgctcgcaaaattcttgaggagaacttgaccgttgattatgacaaagactacctgtttagctag

SEQ ID NO: 120696 - DNA, 372 bp, Artificial Sequence
  Description of Artificial Sequence: Synthetic coding sequence
atgcctcgcctgcacgatcatttctggtcttgctcatgtgctcattccgccaggagacgaggaccgcctagggcaagcgcagctggcttagcagctaaggtcggcgagatgatcaacgtctcagtgagcggaccatcgctcttggctgcccatggggcaccagatgcggatccagccccacgcgggcggagtgccgctatgtcgggaccggagcccggaagcccctatcccaatacatggcatcacaggctcctgcagcgctccttggtgttatttagtgttggggtggtcctggctctggtgctgaacctgctgcaaatccagaggaatgtaacactcttccctgaggaagtaatagcgaccatcttctag

SEQ ID NO: 120697 - DNA, 495 bp, Artificial Sequence
  Description of Artificial Sequence: Synthetic coding sequence
atgccaaggcttcatgatcacttttggtcgtgcagctgtgctcacagcgctcgacgcagaggacccccccgggcgagcgcagcgggcctcgctgcgaaggttggcgagatgatcaatgtttctgttagtggcccttccctcctcgcagctcacggagctcctgatgcagaccccgcaccaaggggccggtcagccgcaatgtcagggcctgagccaggatctccctatcccaacacttggcaccacaggctcttacagcgcagcctggttctcttctctgtgggagtggtgttagcactggtactgaacctccttcagattcagagaaatgtgacgctgtttcctgaggaggtgattgccactattttttccagcgcctggtgggtaccaccttgctgcggcacagccgccggcattcatccacagatatcttccatattcgtattaggcagtctggtgtacttctcccaggaggcatctaggtgggggacatag

SEQ ID NO: 120698 - DNA, 678 bp, Artificial Sequence
  Description of Artificial Sequence: Synthetic coding sequence
atggcggaaggtgagaccgagtcccccggcccaaagaagtgtgggccctatataagcagtgtcaccagccagagcgttaacttgatgattagaggtgttgtccttttttttataggagtattcttggccctggtgcttaatctactgcaaattcaaaggaatgtgacccttttcccacctgatgttattgcctcaatattttcgtcagcatggtgggttcccccttgttgcggcactgcgtccgccgtgattgggctgctttacccttgtattgatcgtcacctgggggaaccccacaaatttaagcgggagtggagtagtgtgatgcggtgcgtcgcagtattcgttggcattaaccatgctagcgcaaaagtggacttcgataacaacatacagctgtcgctgactttagctgctcttagcattggcctctggtggactttcgatcggtcaagatccgggtttggcctgggagtgggtattgctttcttggctaccgtggtaacacaactcctcgtgtacaacggggtgtatcagtatacatcacctgattttttgtacgtgcgttcatggctcccttgtatatttttcgcaggtgggatcactatgggtaacatcggccggcaacttgccatgtatgagtgtaaagtaatcgcagaaaagagtcaccaagagtag

SEQ ID NO: 120699 - DNA, 4149 bp, Artificial Sequence
  Description of Artificial Sequence: Synthetic coding sequence
atggccactgggggaaggcggggggcagctgcggctcctttgctcgttgccgtggctgccctgctgctgggcgccgccggacatctatatcccggcgaggtctgccctggaatggatattcgaaacaacctgaccaggctgcatgagctggagaattgttctgtgatcgagggacatctgcagattctgctgatgtttaagacacgcccagaggacttcagggatctgtctttcccaaaactcatcatgatcacggattacttgcttctgttcagagtgtacgggctggagtccctgaaagacctctttcctaatttgacagtcattcggggttcacggctgtttttcaactacgcgctcgttatatttgagatggttcatctgaaggaactgggactctataatctgatgaacattacaaggggatccgtccgaattgaaaaaaataatgagctctgctatctggcgacaattgactggtccaggatcctcgattccgtagaagataattatattgtgcttaacaaagatgataacgaggaatgtggcgatatttgccctggaaccgccaaagggaaaacgaactgccccgcaacagtcatcaatgggcagttcgtggaacgctgctggacacacagtcactgccagaaggtttgtcctacaatctgtaagagtcacggctgcaccgcagagggcttatgttgtcattccgaatgccttggcaactgtagtcaacccgacgaccccactaaatgtgtggcctgccgaaacttctatctggatggtcggtgcgtggaaacatgcccccccccgtactatcactttcaggattggcggtgcgtgaacttttccttttgtcaggatctccaccacaagtgcaagaattctaggcggcagggctgtcatcagtacgtcatccacaacaataagtgtattccagaatgccctagcggttatactatgaacagttccaatctcctttgcacaccttgtttgggaccctgtccaaaggtgtgccacctgctggagggcgagaagacgattgatagtgtcacatctgcccaagagctgcgaggctgcacagtcatcaacgggagtctgattataaacataagaggaggaaataatctggccgcggagctggaagcaaaccttggtcttatcgaggaaataagtggatatctgaagatccgccgcagctacgctctcgtgtcattgtccttttttcgtaagcttcggctcattaggggcgaaacactcgaaatcggtaattatagtttctatgccctggacaaccagaacctgcgccagctgtgggactggagcaaacataaccttactatcacccaaggcaaattgtttttccactataatccaaaactttgtctcagtgaaattcataaaatggaggaagtaagcgggacaaagggccggcaggagcgcaacgacattgccctcaaaacaaatggagatcaggcttcttgcgagaatgaattgttaaaattctcatatatacgaacctcttttgacaagattctgctcagatgggaaccctattggccgccagattttagggatctgcttggcttcatgcttttctataaggaggccccctatcagaatgtcacggagttcgacgggcaggatgcgtgcggctcaaatagctggactgtggtggacatcgatcctcctctgcgatctaatgacccaaagtctcagaaccacccggggtggctcatgcgaggcctgaagccatggacacagtacgccatttttgtgaaaactttggtaactttcagcgacgagcggcggacctacggcgctaagtctgacataatctacgtccagacagatgctaccaatccgagtgtccccctggaccccatcagtgtaagcaattcttccagccagatcatactgaaatggaaacctccatcagaccccaacggtaacatcacccactatctggtgttctgggaacggcaagccgaagattctgagctctttgagctggactactgccttaaaggactgaagttgcccagcagaacttggagtcctccttttgaatcagaggactcacaaaagcacaatcagtccgaatatgaggacagcgctggggagtgttgcagttgtcccaagacagatagccagattcttaaggagttagaagaaagctcctttaggaaaacttttgaagactaccttcataatgtcgtcttcgtaccacgtaagacctcttctgggacgggcgcggaagatccaaggccctccagaaaaaggcgaagcctgggtgacgtgggcaacgttaccgtcgctgtgccgacagttgccgccttccccaacacaagttccacctccgtcccaactagtcccgaagagcaccgcccctttgagaaggtggtgaataaggagtctttggttatttccggattgaggcattttactggatatcggatagaattgcaagcttgtaaccaggacacgcctgaggaacgctgctccgtggcggcatacgtgtctgctcggactatgcccgaggctaaagctgacgatatagtggggcctgttacccacgaaatcttcgaaaacaacgtggtgcatctgatgtggcaggagccaaaggaacccaacggccttatagtgttgtacgaggtttcatatagacgctatggagacgaggagctccatttatgcgtgtcaagaaagcactttgccctggagcggggctgtaggctgagagggctcagccccggcaattactccgtccggatcagagccacctcccttgctggtaacggaagctggactgagccaacgtatttttacgtgactgattatcttgacgttccctcaaacatagcgaaaatcattatcggccctctgattttcgtctttctgttctccgtggtcattgggagcatctacctcttcttacgaaaaaggcagcccgatggcccattaggacctttgtatgcctcgagtaaccctgagtacctgtcagctagcgacgtcttcccatgttccgtgtacgtgcccgacgagtgggaggttagtcgggagaaaataaccctccttcgggagctcgggcagggttcatttgggatggtctatgagggcaatgcgcgggacataattaagggcgaggctgaaaccagagtcgctgtgaaaacagtcaacgagagcgcatcacttagggagcgaatcgagttcctgaacgaggcctccgtaatgaaaggttttacgtgccatcacgttgtgagactgctgggcgtagtctccaagggccagcccactcttgtcgtcatggagctgatggcccatggagaccttaaaagctacctgcggagcctgcgtcccgaggcggagaacaaccctggaaggcccccaccgaccctccaggaaatgatacagatggccgcggagatcgccgacggcatggcctacctgaatgctaaaaaattcgtgcaccgagatctggctgccagaaattgcatggtggcccacgatttcacggtcaaaatcggggatttcggcatgaccagagatatctacgaaaccgactattaccgcaaaggaggtaaaggactgctgccggtgagatggatggcccccgagagcctgaaggatggggtatttactaccagctccgacatgtggtccttcggagtcgtgctttgggagattacttccctcgccgagcagccctatcagggcctgtctaacgagcaggtgctgaaatttgttatggatggcggttacctcgaccagccagacaattgccccgaacgagtaaccgatctgatgaggatgtgctggcagttcaatcctaaaatgcggcctactttccttgaaatcgtgaatctgctgaaggacgatctccacccttctttcccagaagtgagtttctttcatagcgaggaaaacaaggccccggagtcagaggagttagaaatggaatttgaggacatggaaaacgtacctctagaccgcagcagccattgtcaaagagaagaggctgggggcagagacgggggttccagcctcggtttcaaacgatcatatgaagaacatataccttatacacacatgaatggcggtaaaaaaaacggccgaatcctgaccctcccgcggagcaacccctcatag

SEQ ID NO: 120700 - DNA, 4113 bp, Artificial Sequence
  Description of Artificial Sequence: Synthetic coding sequence
atggccaccggagggcgtcggggcgcggctgcagctcccctcctggtggcagtcgccgccttgctgctgggagctgccggtcatctgtaccctggcgaggtctgccccggtatggacatccgcaacaacctgacacggttgcacgagctcgagaattgttccgtgattgaaggccaccttcaaattctgctgatgtttaagaccaggccagaagacttccgtgacctgtctttccctaagctgattatgatcactgactacctgctcctgtttcgggtgtacggactggagtccctcaaagacctgttcccaaatctgaccgtgatacgaggctctcggctcttctttaattatgcacttgttatatttgaaatggttcatctcaaggaattaggactgtacaacctgatgaacattacacgcggctcggtgaggatcgaaaaaaataacgagctctgttacctagccacgatcgattggagccggattctagactcggtcgaggataactacatcgttcttaacaaagatgataacgaagagtgcggggacatctgcccagggaccgccaaaggcaagacgaattgtcctgcaacggtcatcaacgggcaattcgtggagagatgctggacacatagccactgccagaaggtgtgtcctactatttgcaaaagtcatggctgtacagctgaaggcctttgttgtcattccgaatgcctgggtaactgttctcaacccgacgatcctacaaagtgcgtggcttgtaggaatttctatctggatggccgctgtgtggaaacctgcccccctccttactaccattttcaagattggaggtgtgtgaacttttccttctgccaggacctccatcacaagtgcaagaacagtcgcaggcaaggctgtcatcagtatgtcattcacaacaataagtgcatccctgaatgtccctctgggtacacaatgaacagctctaatttgttgtgcactccctgcttgggcccatgccctaaggtgtgccatctgttagagggagagaagacaatagactcagtgacgtccgcccaggaactgcgggggtgcaccgtaatcaatgggagcctgatcattaacatccgcgggggtaacaacctggcagccgagctcgaggccaaccttggactcattgaggaaatttctggctatctgaagataagaagatcatacgccttggtgtccctttccttttttcgcaaactgagactcatacggggcgaaaccctggagattgggaactattcattttacgccttggataaccaaaatcttcggcagctgtgggactggagtaagcacaacctgacaattacccaggggaaattattcttccactataatcccaaactctgtcttagcgaaatccataaaatggaggaagtcagcggaacaaagggccgtcaggaaaggaatgatattgcactaaaaacaaacggcgaccaggcatcctgtgagaacgaactgttaaagttctcgtacattcgcacaagctttgacaaaatactgctccggtgggagccctactggcctccagactttcgcgaccttttgggctttatgttattttataaagaagcaccctatcagaacgttaccgagtttgatggacaggacgcgtgcggctctaactcctggactgtggtggatattgatccccctcttcggtccaatgaccccaagagtcagaaccatcctgggtggctaatgagaggattgaagccatggactcagtatgccatattcgtaaagacgctagtgacatttagcgacgaacggagaacctacggtgccaagtccgacattatttacgtgcaaacggacgcaacaaatccctctgttccccttgaccctatctctgtgtcaaatagctccagtcaaatcatattgaagtggaagccacccagcgacccgaacggcaatattacacactacctggtgttctgggagaggcaagcagaagactccgagctattcgagttggactactgtttgaaaggattaaagctgccatcacggacctggtcgccgcccttcgagtccgaggattctcagaaacataatcagagcgaatatgaggactccgccggcgaatgctgttcttgtccaaaaactgacagccaaattttaaaagaattggaagaatcgagcttccgaaagaccttcgaggactacctacataacgtggtgttcgtgcctcggccgagccggaaaaggcgctcgctcggggatgttggaaacgtcaccgtggccgtccccacagtggccgctttccccaacacaagcagtacttctgtgcccaccagccctgaagagcaccgaccctttgaaaaagttgttaataaagaaagcctggtaatctctggcctgagacatttcaccggctaccggatcgagctacaggcctgtaaccaagatactccagaggaacgctgcagcgtggccgcatacgtgagcgctaggactatgccggaagcaaaggctgatgatatagtagggcctgtcacgcatgagatttttgagaataatgtggtgcatctgatgtggcaagagcctaaagagccaaacggcctgatagtgctctatgaagtctcatatcgtcgatacggagatgaggagctgcatctctgtgtctcaaggaagcatttcgcactggaaaggggatgccgtctgcgtggactgtctccagggaattacagcgttcgcattcgagccactagcctggccggaaatggttcttggacagagcccacatacttctatgtcactgattacctggatgtcccgtccaacatcgccaagattatcattgggcccctgatctttgtttttctttttagcgtggtgatcggatctatatatctgtttctgagaaagcgtcagcctgatggacccttggggccgttgtatgcgtcctcgaatcccgagtatctgtccgcaagcgacgttttcccctgcagtgtttacgttccggacgaatgggaggtctcacgggaaaagattactttgcttcgtgagctgggacagggaagtttcggcatggtgtacgaagggaacgcgcgtgatataattaagggtgaagccgagactcgggtggctgtgaagaccgtgaatgagtcagctagcctgcgggaaaggatcgagtttcttaatgaggctagtgttatgaagggcttcacatgccatcacgtcgtgcgtctgcttggagtggtgagtaagggccaacctacattagtggtgatggaattgatggcccacggtgatttgaagtcctatttacgcagcttacgccctgaggcggagaacaaccccggaaggcctccccctaccctccaggagatgattcagatggcagctgagatcgctgacgggatggcttacctcaatgctaagaagtttgtgcatagagatctcgccgcccgcaactgcatggtagcacatgattttaccgtcaaaatcggcgattttggaatgacgcgtgatatctacgagacagattattataggaaggggggcaagggcctgctgcctgtccgctggatggcccccgagtctcttaaggatggagtatttacaacgtcatccgatatgtggagtttcggagtagtgctttgggagatcacaagtttagcagaacaaccttatcaaggcctgtccaacgagcaggtgctgaaatttgtgatggatgggggctacctagatcagccagacaactgcccagaacgggttacagacctaatgcgtatgtgctggcagttcaacccaaaaatgaggccgaccttcctcgaaatagtaaacttactgaaggacgatctccatccaagttttcccgaggtctctttctttcattcagaggaaaataaagcccctgagtccgaggagctggagatggagttcgaggatatggaaaatgtgcccttagaccgcagttcgcactgccagcgcgaagaggcaggcggccgagacggcggtagcagcctggggtttaaacgctcctacgaagagcacattccttacacccacatgaacggtggcaagaagaatggacgaattctgacactccctaggtccaatccatcctag

SEQ ID NO: 120701 - DNA, 252 bp, Artificial Sequence
  Description of Artificial Sequence: Synthetic coding sequence
ccataccaaaacgttaccgaattcgacgggcaagacgcctgcgggagcaactcttggactgtcgtcgacatcgatcccccgctgcgctcgaacgaccccaagtcccaaaatcaccctggctggttgatgaggggtttgaagccttggacacagtacgccatatttgtcaagacgctcgttactttctcagatgagcgcagaacatatggtgctaagtcagacatcatctacgtacaaaccgatgccacttag

SEQ ID NO: 120702 - DNA, 4017 bp, Artificial Sequence
  Description of Artificial Sequence: Synthetic coding sequence
atggcctctccgccgaggcacggcccccccggccccgcctccggggacggcccaaacctgaacaataataataataacaataaccatagtgtcaggaaatgtggatacctgcgaaagcagaaacacgggcacaagcgattttttgtcctgaggggccctggcgcaggcggcgacgaagctaccgctggaggtggttctgctccacaaccaccaagactcgaatattacgagagcgagaaaaagtggcgcagcaaggcgggtgcacccaagcgcgtcatcgcccttgattgctgcttgaatataaacaagagggcagacgctaaacacaaatatctcatagccctgtacacgaaagacgagtattttgctgtcgcggcagaaaacgagcaggagcaggaggggtggtaccgggccttgacggatctagtctctgaaggccgggcggcggctggggatgcgcccccggctgctgcaccggcagcgagttgttcagccagtctgccaggcgcccttggtgggtcagccggtgctgctggggcagaagacagttatggtctcgtggctccagcaacagccgcttaccgcgaggtgtggcaagtgaacctcaagcccaagggcctgggacaatccaaaaacctcaccggagtgtatagactgtgtctttcagcccgcactattgggtttgtaaagttgaattgtgagcagccctccgtgactttgcagcttatgaatatccggagatgcggacactcagacagtttttttttcattgaggtgggacgaagcgcggtgacaggtccaggcgaactttggatgcaggctgatgacagcgttgtggcccagaatatccatgaaactattctggaggcaatgaaagctcttaaagaattattcgaatttcggccccgcagcaaatcccagagtagcggatcaagcgctactcacccgattagtgtcccaggcgcccgcaggcaccaccatctggtgaacctgcccccaagtcaaaccggtctagtgagaaggtctcgaaccgatagcctggccgctacgccccctgccgccaagtgctcctcctgtcgcgtgcgaactgccagtgaaggggatggcggggccgctgcaggcgcagcagccgcgggggccaggcctgtgtcagtggctggcagtcccctgtccccagggcccgtacgcgctccccttagccgcagtcacactttatcaggagggtgtggaggccgaggttctaaggtagctctgttgcctgcaggcggagcactccagcactcccggagcatgtctatgcccgtcgctcacagccctcccgccgccacctccccagggtcactgtctagttcctcaggacatgggagcgggagttaccccccccctcctggccctcaccctccattgccccatcctctgcaccacgggccagggcagcgccctagttctggttccgcgtcagcttcgggatcaccctccgaccctgggttcatgtctttggatgagtatggctcctctcccggagatttgcgtgcgttttgttcacatcgttcaaacacgccagaatcaatcgctgagacccctcccgctcgcgatggagggggagggggcgagttttatggttatatgacaatggataggccactttcccactgtggtagaagctacaggcgcgtgagcggagatgccgcacaggacctggatcgagggctgcgaaagaggacatattctctcacaactcccgccaggcaaagaccagtccctcagccatcgtccgcaagccttgacgagtacactctcatgcgagctacatttagcggctctgcaggtaggctctgccctagttgccctgcgtcatcccccaaggtggcttaccacccctatcccgaagactacggtgatatcgagataggaagccacagaagctcgtcttcaaatcttggagctgatgatggttacatgcccatgacacccggcgctgcgttggccgggagtggctccggaagttgcagatctgacgactacatgccaatgtctcctgcgtcagtgtcagctcccaaacaaatcctgcaacctcgagcagccgctgccgccgcagccgccgtcccgtctgccgggcccgcaggccctgctccaaccagtgcagccggcagaacattccccgcgagcggtggcgggtataaggcatcttcccctgcggaatcaagtcctgaggatagtgggtatatgagaatgtggtgtggctctaagctgtccatggagcacgccgacgggaaattgctgcccaacggtgattatctcaacgtctccccttcagacgccgtgactaccggcactcctcctgacttcttcagcgcagctctgcacccaggcggtgagccgctgcgaggtgtccctggttgctgttacagcagcctgccacgctcgtacaaagctccttacacctgtggaggtgactccgaccagtatgtgctgatgtcctcccccgtgggtcgcatcttggaggaagaacgcctcgaaccacaagccacccccggtccatctcaggccgcctctgcctttggggccgggcccacacagcccccacacccagtggtcccaagtcctgtacggccatccggggggaggcccgagggttttcttggccaaagggggagggcagtgaggcccactagactaagtctggaaggacttccctccctgcccagcatgcatgagtatccccttccacccgaacctaaaagcccaggcgagtacatcaatatagacttcggagaaccgggcgcccggctcagccccccagcccctcctctgctggcttctgctgcctctagttccagcctgttgtctgcttcttctccagccagtagcttgggttcgggtacgccaggaacgtctagcgattctcgccaaaggagtcctctctcagactacatgaatcttgattttagttcaccaaaaagtcctaagccgggagcaccctctggccatcccgtaggtagccttgatgggctgctttctcctgaggcctcctcaccctatcctcccttgccccctagacccagtgccagcccctccagcagtctgcagcctcctccaccacccccagcgcccggggaactgtaccgcctccctcccgcgtctgctgttgccacagcacagggtccgggggccgcttcctctttgtcaagcgatacgggcgacaacggagactacacagagatggcgtttggggtggccgccacacccccacagcccattgccgcccctccgaagcccgaggctgctcgtgttgcatctcccacttccggtgtgaagagactaagcttaatggagcaggtcagtggagttgaggcgtttctgcaggccagtcagccacccgatcctcaccgaggggccaaagtgattagagctgacccgcagggagggcgccggcggcactcctctgagacattctcatccacaactacggtgaccccggtcagtccgagtttcgcccacaacccaaagagacataactctgcctctgtggaaaatgtttctttgcggaagtcatctgaaggaggcgtgggtgtcggcccaggcggaggtgacgagcctccaacgtcaccacgccagctgcagccagcccctcctcttgccccacagggcaggccttggaccccgggtcaaccaggagggttggtgggctgtcctggctccgggggcagccccatgagacgcgagacatccgctggattccaaaatggcctcaactacattgctatagacgtccgcgaggagccgggcctccccccccagccccagccgccacctccaccgctgccccagcccggcgataagagctcctggggacgaacacggtctctgggaggattgatcagcgctgttggcgtgggatcgactggagggggatgtggcgggcccggcccaggagccttaccaccggctaacacctatgcgtctattgacttcctctcacatcatctaaaagaagctaccatcgtcaaggaatag

SEQ ID NO: 120703 - DNA, 3894 bp, Artificial Sequence
  Description of Artificial Sequence: Synthetic coding sequence
atggctgtcccttccctgtggccttggggcgcttgtctgcctgtgatctttttgtcccttggcttcggactcgatacggttgaggtatgtccctccttggacatccggtctgaggtcgccgagctgaggcagctcgaaaactgctcagtcgtcgagggccacttgcaaatcttgctcatgttcaccgctactggagaggactttaggggattgtcatttcccagattaactcaagttactgattacctgctcttattccgggtgtacgggctggagtcattacgggacctgtttcctaatctggcagtaatccgcggtacacgtttgttccttgggtatgcccttgtgatattcgagatgccacatctgcgggacgtcgccctcccagccttaggagctgttttacgtggagccgtgcgagtagaaaagaatcaggaactgtgccacctgtctacgatcgattggggactgttgcagccagctcccggggcaaatcatatcgtgggcaataagctgggtgaggaatgcgcggacgtctgccccggggtgctgggagccgccggggagccctgcgcgaagaccactttcagcgggcatactgattacaggtgctggacaagcagccactgtcagcgggtttgcccatgccctcatggaatggcctgcaccgctaggggagaatgctgccatacggagtgccttggcggctgtagtcaacccgaggacccaagagcctgcgttgcctgtcgccatctttattttcagggcgcctgcctgtgggcatgtccacccggcacatatcagtatgagtcgtggcgctgtgtgaccgctgaacgctgtgcgtccctccacagtgtgccagggcgggcgagcaccttcggcattcaccagggctcgtgtcttgcacaatgtccgtccgggtttacacgaaactcgagctccatcttttgccacaaatgtgaagggttgtgccctaaagagtgcaaggttggaaccaagacaatcgattcaatccaggccgctcaggacttagtgggttgcactcacgtggaagggagcttgatcctgaatcttcgccaaggctataacctcgagccacagttgcagcacagcctgggcctggtcgagacgatcacaggattcctcaaaatcaaacattctttcgccctggtgtccctgggctttttcaagaacttgaaactgatcaggggagacgctatggttgatggcaactatactctctatgtgctggacaaccagaacttacaacaactgggatcctgggtggcagccggcctaacaatcccggtgggtaagatttattttgcattcaatccacgcttgtgcctagaacacatatacaggctggaggaggttactggaacacgcggcaggcagaataaggccgaaatcaatcccaggaccaacggagatcgcgctgcttgccagacccgcaccttgaggttcgtaagcaacgtgactgaggccgatcgaatccttctcaggtgggagaggtacgagccgcttgaagcgcgggatctcctatcttttattgtctactataaggaaagccccttccagaatgctaccgaacacgtgggacctgacgcttgcggaacgcagagttggaacttgctcgatgtggaactgcctctgagccggacacaagaaccaggcgtcacacttgcatccctaaaaccttggacccagtacgctgtgttcgtgcgggccattactctgactaccgaagaggacagccctcaccagggcgctcagtccccgatcgtgtacttgagaacgcttccagctgcaccaacagtaccccaggacgtgatcagtactagcaattcgagcagtcatctgttggtgcggtggaagccccctacgcaaaggaacgggaacctcacatattacctggtgttgtggcagagactcgcagaggacggggacttatacttgaacgattactgtcacagaggcctgcgactgcctacttccaataacgaccctaggtttgatggagaggacggtgacccggaggcagagatggagtccgactgctgtccgtgtcaacatccccctcctggccaggttctgcccccgctggaagcacaggaagcttcattccagaagaaatttgagaacttcctgcataacgctattactatccccataagcccttggaaggtcacaagtattaacaaaagcccacagcgggactctggcaggcatagacgtgctgcgggacctttacgcctaggtggaaatagctccgatttcgagatccaggaggacaaagtgcctagagagagagcagtactctcgggtctccgccactttacggaataccggattgacatacacgcttgcaatcatgccgcccacaccgtcggatgtagcgcagcaactttcgtgtttgccagaacaatgcctcatcgggaggccgatggaattcccggtaaagtggcctgggaggcatcctctaaaaattccgtactgcttcggtggctcgaaccacccgatcccaatggcctgatcctaaaatacgagattaaatatcgaaggctgggagaagaggccactgtgttgtgtgtgtcacgcctgaggtacgctaagttcggcggggttcacctggcccttctccctcccggcaattactccgcccgagtgcgggctacgagtttggccggcaatgggagctggacggatagcgtcgccttctacatactcggcccggaagaggaagacgccggaggcctccatgtcctgcttactgctacccctgtgggtctgactctactgattgtactggccgcactggggttcttctacggaaaaaaaaggaacagaaccctatacgcaagcgtaaacccggaatattttagtgcttcggatatgtacgttcctgatgagtgggaagtgccacgagagcagatcagtattatccgtgaacttggtcagggtagcttcggaatggtctacgagggcctggcaaggggtctggaggccggggaggaatccactcccgtagcacttaaaacagtcaacgagctggccagccccagggagtgtatcgaatttcttaaagaagcgtctgtgatgaaggccttcaagtgccatcacgttgtgcgcctgctcggcgtggtcagccaaggccaaccaaccctggtcattatggaacttatgactagaggggacctgaaatcacacctgagatctctgcgacccgaggccgagaataaccctggactgcctcagcctgccctgggcgagatgattcaaatggctggtgagattgctgacgggatggcatatctggctgccaacaagttcgttcacagggacctggccgctcgcaattgcatggtgtcacaggacttcacagtgaagataggtgatttcgggatgactcgcgatgtctacgagactgattattatcggaaaggcgggaagggcttgctgcctgtacggtggatggcccccgagagcctgaaagatgggatttttactacccattcagatgtctggtcattcggagttgtgctttgggagattgtcactctggccgaacaaccttaccagggacttagcaacgagcaagttctgaagttcgtgatggacgggggggtcttggaggagctggaggggtgccccctacagttgcaagagctgatgagcagatgctggcaacccaaccctcggctcagaccctctttcactcacatactggacagcatccaggaagagcttcgtcctagctttcgcctgttgtctttctattattcccccgagtgtaggggcgctcggggcagtttacccacaaccgatgctgaacctgattccagcccgacgcctagggattgttcgcctcagaatggtggccctgggcactag

SEQ ID NO: 120704 - DNA, 3060 bp, Artificial Sequence
  Description of Artificial Sequence: Synthetic coding sequence
atgcgttataggcttgcctggctgctacatcctgcgcttccaagcaccttccgtagcgtgctgggcgcccgactgcctccccctgaacgactgtgtggattccagaaaaagacctatagcaagatgaataaccccgctataaagcgaattgggaatcacatcaccaagtctccagaagacaaacgcgaataccgagggctcgagctggctaacggcatcaaagtgctccttatttcagaccccacaaccgataaaagctccgctgctctggatgtgcacataggttcattgtctgatccgcctaatatcgctggcctctcacatttttgtgaacacatgctctttctgggaacaaaaaagtaccccaaggaaaatgaatattcgcagtttctaagtgagcacgctggctcatcaaacgcgttcacctccggtgagcacacgaactactacttcgatgtcagccatgagcacctggaaggtgccctcgacaggtttgctcagttttttctgtgccccctgttcgatgaaagctgcaaagatagggaagtgaatgcagttgatagcgagcatgaaaaaaacgtgatgaacgatgcgtggcggctgttccaactggagaaggctactggaaatccgaagcatccgttttcaaagttcgggactggcaacaaatataccctggagacaaggcctaaccaagaaggcattgacgtgcgccaggaacttttgaaattccactcagcctattattctagcaacctgatggcagtatgtgtcttggggcgcgagtctctcgatgacctgactaatttggtggttaagttgttcagtgaagtggaaaacaaaaacgtgcccttaccagaattcccagagcaccccttccaagaagagcatctgaagcagctgtataagattgtccccattaaagacattagaaatctgtatgtgaccttccctatccctgatttgcagaagtattataagagcaatcctgggcattaccttggtcatctcattggccacgagggaccaggatcgctgttgagtgaactgaagtccaagggatgggtcaatacactggtgggagggcagaaggagggggcgcgtggcttcatgttcttcataatcaatgtcgacctcactgaggaaggcctgctgcatgtagaggacattattctgcatatgttccagtatattcagaagttacgggcagaaggtcctcaagagtgggtgttccaggaatgcaaggatctgaacgctgtcgcattccgatttaaggataaagagaggccccgggggtataccagtaagatcgccggcattctgcattactatcctttggaagaagtcctcacagctgaatacctcctcgaagagttcaggcccgatttaatcgagatggtgctcgacaaattgcgtccagaaaatgtgcgcgtcgctatcgtgtcaaagagcttcgaaggaaagaccgaccgtaccgaggaatggtacgggacacaatacaaacaggaagcaatccctgatgaagtcataaaaaagtggcagaacgccgacttaaacggtaagtttaagctccctacaaaaaatgaattcattccgacgaacttcgagattctccctctcgaaaaagaggccaccccctatcctgcactcataaaggatactgcgatgtcaaagttatggtttaaacaggatgacaagttcttcttgccaaaggcgtgccttaactttgagttttttagcccctttgcttacgtggaccctctacactgtaacatggcatacctttacctggagctcctgaaggatagcctcaacgaatatgcttacgccgccgagctggccggcttgtcttacgacctgcagaatacaatctacggaatgtatctgtcagtcaaaggatataacgataagcaacccatactgctcaagaagatcattgagaaaatggctacatttgagatcgacgaaaagcggtttgaaataatcaaggaggcttatatgcggagcctgaacaacttcagggctgagcagccccaccaacacgctatgtattatttaagactgctcatgacagaggtggcttggaccaaagacgaacttaaggaagcccttgatgatgtgactctaccacggcttaaggcattcatccctcagctgttgtcccggcttcacattgaggctctcctgcacggcaatattacaaagcaggccgctctgggcattatgcagatggttgaggacacactcatagaacatgcgcacaccaagccacttcttcccagtcaactggtgcgatatcgtgaggttcagctgcccgaccggggctggttcgtataccagcagaggaacgaagtccacaataattgcggcattgagatctactaccagacggatatgcagtcaacatctgaaaacatgttcttggaattattttgtcaaatcatctcagagccgtgtttcaacacgctgcggaccaaagaacaactcgggtacatagtattctctggacctcggagagcaaacggaatacaggggctccgctttattattcagagtgagaagcctcctcactatctggagtctcgagtggaagcctttctgattaccatggagaagtctattgaagacatgactgaagaagcttttcagaagcacatccaggcactggctatcagacgccttgacaagcccaaaaagctctctgcagaatgtgccaagtactggggagagatcatttcgcaacaatacaattttgatcgcgataataccgaggtagcctatctcaagaccttgacgaaggaggatattattaaattttataaggagatgctggcagtcgacgcccctcgccgccataaggtttctgtgcacgtgctggctagggagatggacagctgccccgttgttggagagttcccgtgccagaacgatattaacctgagccaagctcctgcgctgccgcagccagaagttattcaaaatatgaccgagtttaagagggggcttccactgtttccattagttaagccacacatcaattttatggcagctaagctctag

SEQ ID NO: 120705 - DNA, 1395 bp, Artificial Sequence
  Description of Artificial Sequence: Synthetic coding sequence
atgtccaagctgtggtttaagcaggatgacaagttttttcttcccaaggcttgtctcaatttcgaattcttttcacctttcgcatatgtcgatccgctgcattgcaatatggcctatctgtatctcgaactccttaaggacagccttaacgaatacgcatacgctgctgagttggcggggttgagttatgacctgcaaaacacaatttacgggatgtatctttcagttaaaggctacaatgataagcagccaatactactgaagaaaatcatcgagaagatggccactttcgaaatcgatgaaaaacgctttgagattattaaagaagcatatatgcgaagtcttaacaatttcagggctgagcagccacatcaacatgctatgtattatctccggctcctgatgactgaggtggcctggacgaaagacgagctgaaggaggcccttgatgacgttaccctgcccagactcaaggcatttattccacagttgctgagcaggctccacattgaggccctgctccatggtaatatcaccaaacaggccgctctcggcatcatgcagatggtggaggatacgctgatcgagcacgcccacacgaagcccttgctgccctctcaacttgttagataccgagaagtgcaattacctgaccggggatggtttgtctaccagcagcgtaatgaggtccataacaattgcggaattgaaatctattatcagaccgacatgcaatccacttccgagaacatgttcttggagctattttgccagatcatctctgaaccctgttttaacaccctgaggacaaaggagcagctggggtacattgttttttctggccctaggcgcgccaacggaatacagggccttagatttattatccagagtgaaaagccaccccattaccttgagagccgggtcgaggcatttttaattacgatggagaagtcgatcgaggatatgaccgaggaggcctttcaaaagcacattcaggcattggcgattcgacgtctggacaagcccaagaagctgtccgccgagtgcgccaagtactggggcgaaatcatttcgcaacaatacaacttcgacagggacaataccgaggtggcatatttgaagacccttacgaaagaggacataatcaagttttacaaagagatgttggcagtggatgcacccaggcgacacaaagttagcgtgcacgtgctagctagggaaatggattcatgccccgtagtgggagaatttccatgccagaatgatataaacctgtctcaagctccagccttgccacagcctgaagtgattcaaaatatgactgaatttaaacgtggcttgcctcttttcccgctggtcaaaccccacattaattttatggccgccaaactctag

SEQ ID NO: 120706 - DNA, 774 bp, Artificial Sequence
  Description of Artificial Sequence: Synthetic coding sequence
gagtttattatccggggaggcagggtgccgtcgcattgcctacacttttctcgctcatttcagaagaagacctactccaagatgaataatccagctataaagcggataggcaaccacatcactaagagtcccgaggacaaaagggagtataggggactagaattggccaacggcattaaagtgcttttgatcagtgatcctacaacagacaaatcctctgctgcacttgacgtgcacatcgggtccctgagtgacccacccaatatcgccggcttgagccacttctgtgagcacatgctgttcctaggtaccaaaaagtacccaaaagaaaacgaatacagccagttcctttcagagcatgccggatcctcaaacgcttttacttctggagagcacaccaactattactttgacgtgagtcacgaacacctcgaaggcgccttggatcggtttgcccagttttttctatgccctttgtttgatgagtcctgtaaggacagagaggtgaatgccgtggactcagagcatgagaaaaatgtgatgaatgatgcttggcgcctctttcagctcgaaaaagccaccggcaaccccaagcaccccttttccaaattcggcacaggtaataagtacaccctagaaacaagacccaatcaagaaggcatcgacgtgagacaagagttgctgaaattccattctgcgtactatagtagtaacttaatggctgtttgtgtgttaggccgggaatccctggacgacctgaccaaccttgtgtag

SEQ ID NO: 120707 - DNA, 396 bp, Artificial Sequence
  Description of Artificial Sequence: Synthetic coding sequence
atggatcctcgcctgcctgcctgggctctggttctactcgggcctgccctggtcttcgcattgggacctgctcctacccctgaaatgcgcgagaaattatgcggtcaccactttgtgcgagctctggttagggtatgcggaggccctagatggtccactgaggcccggcgcccagctacggggggcgatcgggaactacttcagtggctggagagaagacacttgttacatggtctggtggctgactctaacctcactctcgggcccggcctgcagccactcccccaaacgagccaccatcacagacatcaccgagcggcagctaccaaccctgctcggtactgctgcctgtccgggtgcacacaacaggacctcctgactctctgcccgtactag

SEQ ID NO: 120708 - DNA, 474 bp, Artificial Sequence
  Description of Artificial Sequence: Synthetic coding sequence
atggatcctcgactccctgcctgggccctggtccttctgggacctgctcttgtttttgccttgggacctgccccaaccccagagatgagggagaagctgtgcgggcaccacttcgttcgagctctggtcagggtctgcggcgggcctcggtggtctactgaagccagacggcctgccaccggcggagatcagcgcgagagccactctgtcagtcaggcagggctgaagctgctgagttcatctaatcctcctacgcttacctttcaatccgtcgggatatccgacgtgagttgctacagcggctggcgagacgatatatgttcaatgggctggtggcctacagtaatttcacgctgggaccttgcatgcagcccatgccctcgccccttaaccatcacagccaccaccgttcagctaccccctaccctgcacgccactgctgcatctgtggccgttcctaataagacatgctag

SEQ ID NO: 120709 - DNA, 420 bp, Artificial Sequence
  Description of Artificial Sequence: Synthetic coding sequence
atggcgtcgctgttcaggtcctatctccccgccatctggcttctcctgtcccaactgttacgagagagtctggcagctgagctcagagggtgcggccctcgttttgggaaacatcttctgtcatactgtcctatgccagagaaaactttcacgaccaccccaggtggatggctcctggagtccgggcgccctaaggaaatggtgtctacgtccaataacaaggacggccaggccctaggtacgacatccgaatttatccctaatcttagtccagagctgaagaagcccctgagtgaaggccagccatctttaaaaaagattatcctttctaggaagaaacgttccgggagacaccgcttcgaccccttttgctgcgaggtgatctgtgacgacggtactagcgtgaagctctgcacttag

SEQ ID NO: 120710 - DNA, 408 bp, Artificial Sequence
  Description of Artificial Sequence: Synthetic coding sequence
atgaaaggcagcatcttcacgctcttccttttctccgttctgtttgcaatcagtgaggtgcgttccaaagagtcagtgagattgtgcggcctagagtacatcagaactgtgatatacatttgcgctagttcccgctggcgtcgccatcaggaaggtattccccaagcacagcaagcagaaacaggaaacagctttcagctcccacacaagcgagaattttccgaggagaatcctgctcagaatttaccaaaggtggatgcctcgggggaagaccggctgtggggtgggcaaatgcctaccgaggagctttggaaatcaaagaagcattccgtaatgagccgtcaggatttacagacactctgctgtacagatggctgcagcatgacagacctgtccgctctctgctag

SEQ ID NO: 120711 - DNA, 642 bp, Artificial Sequence
  Description of Artificial Sequence: Synthetic coding sequence
atgccaaggctgctccgcctctccctattgtggctggggttactgctggtgcgcttttcacgcgaactgtcagacatctcttccgcgcgcaagctctgtggtcgttatttggttaaagaaattgagaaactatgtggtcacgccaactggtcccagtttcgcttcgaagaggagactccattttcccgactgatcgcccaggcctcagagaaggtcgaggcttattccccctaccagttcgaatcgcctcaaaccgcgtccccagcaagaggcaggggaacaaaccctgtctctaccagctgggaggaggccgtgaattcctgggaaatgcaaagcctgcccgaatacaaggataagaaaggttacagtccccttggcaagacacgggaattcagctctagtcacaacattaatgtatacattcatgaaaacgcaaaattccagaagaaaaggcgtaacaagataaaaaccctcagcaatctgttttggggccaccacccacaacggaaaagacggggttacagcgaaaagtgttgtctcacgggatgcacaaaggaggaattaagcatcgcctgtctaccctatatcgacttcaaacggctgaaggagaaaaggagtagcctcgtgactaaaatctactag

SEQ ID NO: 120712 - DNA, 1734 bp, Artificial Sequence
  Description of Artificial Sequence: Synthetic coding sequence
atgaacaagctgtacattggcaatcttaacgagagcgttactccagctgatctagagaaagtgttcgccgaacacaagatttcatacagtggacaatttctggtgaagagcgggtacgccttcgtagactgcccagatgagcactgggccatgaaggctatcgagacattcagtggcaaggtcgagctgcagggtaaacgactcgaaattgagcactccgtccccaagaaacagaggtcgaggaagatccagatccggaacatcccaccccagctcagatgggaggtgctagattcccttctggcgcagtatggaactgtggaaaattgtgagcaggttaacaccgagagcgaaaccgctgtggtgaacgtaacttactcaaatcgcgagcaaacccgccaagccattatgaaactgaacggacaccagctggagaaccacgctctcaaggtgagctatatcccggacgagcagatcgcccaaggtccagagaacggtcgccgagggggtttcgggtctagaggtcagcccagacaggggtccccagtggccgctggtgctccagccaagcagcaacaggtcgacattcccctgcgtctattagtccccactcaatatgttggcgccataattggaaaagagggggcaacgataaggaatattacgaaacagactcagagtaaaatcgatgtgcaccggaaagagaacgcaggggctgccgagaaggcaatttctgtgcattctaccccagagggctgctccagcgcctgcaaaatgatcctcgaaatcatgcataaagaggctaaagatactaagaccgctgatgaggttccactgaaaatcctggcccacaataatttcgtgggaaggctgatcggtaaggaaggacggaacctcaagaaagtggagcaggacaccgagaccaagatcaccatttcaagcctgcaagaccttacgctatacaatcctgagcggacgattaccgtcaagggcgctattgagaactgttgtcgggcagaacaggagataatgaaaaaagtgagggaagcgtacgagaatgatgtggctgcaatgtctctgcaaagccacttaattcctggcctcaatctcgctgccgttggcctcttccccgctagttccagcgccgtgcccccacctcctagcagcgtcacaggagctgcaccgtacagctcatttatgcaggctccagaacaggagatggtgcaggtgtttattcctgcccaggcggttggcgctattatcgggaaaaaggggcagcatataaagcagctgtctagatttgcaagcgcttccattaagatcgcgcccccagagacaccagactctaaagtcagaatggttatcatcacgggaccgcctgaagcccagttcaaagcccaggggcggatctacggaaagttgaaggaggagaatttcttcggccctaaggaagaagtgaagctggagacccatattagagttcctgcatcagccgcaggcagagtaatagggaagggcggcaagactgtaaacgaattacagaacctgactgcggctgaggtcgtcgtcccacgagaccagacacctgacgagaacgaccaggtgattgtgaagatcatcgggcatttctatgcatcacagatggctcagcgtaagatccgagacatactcgcacaagtcaagcaacaacaccagaaggggcagtcaaaccaggctcaggcccgccggaagtag

SEQ ID NO: 120713 - DNA, 1317 bp, Artificial Sequence
  Description of Artificial Sequence: Synthetic coding sequence
atgaacaaactatacattggaaaccttaatgagtcagtcacacctgccgacctggaaaaggtctttgccgaacataaaatttcctattctggacagttcttagtcaagagtggctatgctttcgttgactgtccagatgagcactgggccatgaaggctatcgagacattcagcgggaaggtggaacttcagggcaagcggttggaaatagagcacagcgtgcccaaaaagcagcgatcgagaaagatccaaatcaggaacattccaccccaactccggtgggaggtcctagactctttgctggcgcagtacgggacggtagagaactgcgagcaggtgaataccgaatccgagaccgcagtggtgaatgtgacctactcgaatcgcgaacagacacgccaggccgatgaggtgccactgaaaatcctcgctcacaataactttgtgggacgtttgatcggaaaagaggggcgcaatctcaaaaaggtggagcaggataccgagaccaagataaccatttcatctctacaggacttgacactttataacccagaacgcacgatcactgtgaagggcgccattgaaaactgctgtcgagccgagcaggagattatgaaaaaagttagggaggcctacgagaacgacgttgcggccatgagcctgcaatcccacctaattccaggattaaacctcgctgcggtggggttgttcccagcctcatctagcgcagtgccacctccacccagtagtgtcaccggggcagccccttattcgagttttatgcaagctcccgaacaggagatggttcaggtgtttattcccgcccaggccgttggcgctatcatcggcaagaaagggcagcatatcaagcagctttccagattcgcgagcgccagtattaagatcgccccacccgagacgcccgattcaaaggtgaggatggtgatcattaccggccctcccgaggctcaattcaaagcgcagggccggatttatggaaagctgaaagaggagaatttttttggtcccaaggaggaagtcaagctagagacccatattcgagtgcccgcttccgctgcgggtcgtgtcatcgggaagggcggcaaaaccgtgaacgagctgcagaacctgacagctgccgaggtagtggtgcctcgagatcagactcctgatgagaacgatcaagtcattgtgaaaattattgggcacttctatgccagccagatggcccaaagaaagattcgggacattttggcccaagtgaagcagcagcatcaaaaagggcagtccaaccaggcacaggcgcgtcgtaagtag

SEQ ID NO: 120714 - DNA, 1671 bp, Artificial Sequence
  Description of Artificial Sequence: Synthetic coding sequence
atgatgaataagctgtacattggaaatctctcccctgcagttactgcggatgatcttcggcagctctttggcgaccggaagctccccctggccggccaggtgctgctgaaatccggatacgcattcgttgactaccctgatcagaactgggccattcgcgccatcgaaactctaagcgggaaagtggagctgcacggaaaaattatggaggtggactatagtgtgtccaaaaagctgcggtctaggaagatacagattaggaacatccccccccatttgcaatgggaggtcttggatggcttgctggctcagtacggtaccgtggaaaacgtggaacaggtaaataccgacacggaaaccgctgtggtcaacgttacttacgcgacgagagaggaagcaaagattgcaatggagaagctgtccggtcatcaattcgagaactacagttttaagatttcttacattcctgatgaagaagtgtcatctccgtctcctcctcagcgggcccaaaggggagaccacagcagcagggagcaaggtcacgcccccgggggaaccagccaggctaggcagatcgacttcccgctccggatcctggttcccactcaattcgtcggcgctattatcggcaaggaggggctgaccataaaaaacatcacaaagcagacccagagtcgggttgacattcatcggaaggaaaactcaggcgccgccgagaaaccagtgaccattcacgccacacccgaggggacctctgaggcctgtaggatgattctcgagattatgcagaaagaggccgacgaaactaaattggccgaggagatacctttaaaaattcttgcccacaatggtctggtcgggcggctgatcggtaaggagggtcggaatttgaagaagatcgaacatgagactggaacaaagataaccatctcctcgctgcaagatctctcaatctataatcccgagcgaacaattacagtcaaaggtacagtggaggcctgcgcatccgctgagatcgagattatgaaaaaacttcgggaggcctttgagaacgatatgctcgccgtgaacacccattcaggctatttctcaagcctgtatccccaccaccagtttggcccgttcccccaccatcatagttatcctgagcaggaaatagtgaatctgttcatcccaactcaggcagtcggtgccattattggtaaaaaaggtgcccacatcaaacagcttgcgaggttcgccggcgccagtatcaaaatcgcccctgctgaggggcccgacgtgagcgagagaatggttatcattaccggaccaccggaggcccagttcaaggcccaggggcgcatcttcggaaagctgaaagaggaaaacttctttaacccaaaggaggaggttaagctggaagctcatatcagagtaccctcaagtactgccgggcgtgtcatcggtaagggcgggaagactgtgaacgagctccagaacctgacatccgctgaagttattgtgccgagagatcagactccggacgaaaacgaagaggtgatcgtgcggataatagggcactttttcgcatcccagacagctcaacgaaagatccgggagatcgtgcagcaggtgaaacagcaagagcaaaagtacccccagggcgtggcatcccagaggagtaaatag

SEQ ID NO: 120715 - DNA, 1800 bp, Artificial Sequence
  Description of Artificial Sequence: Synthetic coding sequence
atgatgaacaagttatacatcggcaatctcagtccagctgtcacagctgatgacttacgacagctgtttggagatcgcaagttgccgcttgccgggcaggtcttgttgaagtccggctacgcattcgtcgattaccctgatcagaattgggctatcagggcaattgaaacactgagtgggaaggttgaactgcacggaaagattatggaggtggactactcagtgagcaaaaaactacgttcacggaaaatccagattcgcaacatacctccacatttgcagtgggaagttcttgatggcctgttggctcagtacggaaccgtcgagaacgtcgaacaggtgaacaccgataccgaaaccgccgtggtgaatgttacttatgcaacccgcgaagaggctaagatagccatggagaagctttctggtcaccagttcgagaattattctttcaaaatctcatacatccctgacgaagaagtgagcagtccctcaccacctcaaagagctcaacggggggatcatagcagccgcgagcaggggcacgctccaggcgggacttcacaagccaggcagatcgactttccacttaggattctggtcccgactcagttcgttggcgcaatcattggtaaagaagggctgactataaagaacatcacaaaacagactcagtctagagtggacattcacaggaaggaaaatagcggagccgcagaaaaacccgttaccattcacgcaacacccgagggaacctctgaagcctgcagaatgatcttagagataatgcaaaaggaggcagacgaaactaagttagccgaagaaattcctctaaagatactcgcccacaatggtctcgttggtagacttatcgggaaagaaggcagaaatcttaagaaaatcgagcacgagaccggcactaaaatcaccatatcatcattacaggacctatccatatacaatcccgagcggactattacggtgaagggtactgtggaggcgtgcgcatcagccgaaatcgaaataatgaaaaagctccgggaagcattcgagaatgatatgctggctgtgaaccagcaggcgaatttgatccctggcttgaaccttagtgcactgggcattttttccactgggttgagtgtcctatcccctcctgctggacccagaggagcccccccagccgctccgtatcatccatttaccacacattccggatacttcagtagcctgtacccgcaccaccagtttgggcccttcccacaccaccattcgtacccagagcaagagatagtgaacctgtttatccctacacaggccgttggggccattataggcaagaagggtgcacacatcaagcagctcgcccgtttcgccggtgcatctataaaaatcgcccctgctgagggtccagatgtttcagaacggatggtaatcataaccggaccgcctgaagcacagttcaaagcccagggaaggatcttcggaaaattgaaagaggagaatttcttcaacccaaaggaggaggtaaagctcgaagcccacatcagggtacccagctctacagccggtcgggtgatcggtaagggcggaaagactgttaatgaactgcaaaacctgacctctgctgaggtgatcgtgccgcgagatcaaacccctgatgagaatgaagaggttatcgtgcggataatcgggcatttctttgcatctcaaacagctcaaaggaagattcgggagatcgtacagcaagtcaaacaacaggagcagaagtacccacagggcgttgcttcccagcggtcgaaatag

SEQ ID NO: 120716 - DNA, 1629 bp, Artificial Sequence
  Description of Artificial Sequence: Synthetic coding sequence
atgtttagttgccccggacactaccacgtggacggcttcctcaacccaggctcacgcaagatccagattcgaaatatccctccacaccttcagtgggaagtgctggatggtctattggcccagtatggtaccgtcgaaaatgttgaacaggtgtttgccttcagtctggtgaacaccgacacagaaactgcggttgtgaatgtgacctacgccacacgcgaagaagcgaagatcgcgatggagaagcttagtgggcatcagtttgaaaattacagttttaagattagctacattccagatgaggaagtgtccagcccctcccccccgcagcgcgcccagagaggagaccactccagcagggagcagggacatgctcctggagggacgtcccaggcccgccagatcgactttccgctgcgaatattggttccaactcagtttgtcggtgctattatcggcaaagaagggctgactattaagaacattacaaagcagacccagtcacgcgtcgatatccaccgtaaagagaatagcggcgctgccgagaagcctgtcacaatccatgctacaccagaaggcacaagtgaggcatgcagaatgatactcgagatcatgcagaaagaagccgacgagacaaagctcgccgaggaaattcccctcaagattctggctcacaacggactcgtgggaaggctgatcggtaaggagggtcggaacctgaaaaagatcgaacacgagacaggcaccaagattacaatcagttccctccaggacttgtcaatctataatcctgagcgaacgatcacagttaagggcactgtggaagcttgtgcctccgccgaaattgagattatgaagaaacttagggaagcatttgaaaacgacatgcttgccgtgaatcagcaggctaacctcatcccgggccttaatcttagtgcgctgggaatcttctcaactggcctgtcagtcttatctcctcctgctggcccgcgcggagctccccccgcggctccctatcatcccttcactacacattccggctacttcagtagcctgtacccccaccaccagttcggccctttccctcatcaccattcataccctgaacaagagattgttaacctgtttataccaacccaggccgtgggggccatcatcggcaaaaaaggagcacacattaagcaattagcaagatttgccggcgcaagtattaagatcgctccagccgaaggtcctgatgtctcagaacgcatggtgataatcactgggccacctgaagcccagttcaaagcacaggggaggattttcgggaaacttaaagaggaaaacttcttcaaccccaaagaggaagtcaaacttgaggcccatattagggtacccagttctactgccgggagggttatagggaaaggcggcaagaccgttaacgagcttcagaacctgacttctgctgaggtgattgtgccccgtgaccagacacctgacgagaatgaggaggttatcgtccggattatcggacattttttcgcgtcccaaaccgctcagcgtaagattagggagattgttcagcaggtgaagcagcaggaacagaagtatccacagggcgtggcgtcacagcggagcaagtag

SEQ ID NO: 120717 - DNA, 1740 bp, Artificial Sequence
  Description of Artificial Sequence: Synthetic coding sequence
atgaataaactctacatcgggaacctgtccgagaatgccgcccctagtgaccttgagagcatctttaaagatgcaaagattccggtgagcggtccattcctcgttaaaactggctacgcgtttgtcgactgtccagatgaatcgtgggcgctaaaggccatagaagctctgtcaggaaaaatcgagctgcacggcaaaccaattgaggtggaacactccgttccgaagcgccagaggatccgcaaactccagattcggaatatccccccccatctccagtgggaggtacttgatagcctgctggtgcagtacggcgtcgtcgaaagctgcgaacaggtgaatactgacagcgaaaccgcagtggtgaatgtgacatatagctctaaggatcaggcccggcaggcactcgacaaactcaacggcttccagctcgagaacttcaccttgaaggtggcgtatattcctgatgagatggcagcacagcaaaacccactgcagcaaccaagggggcggagaggcctaggacaacgcggttcctcacgtcaaggatctcccggctctgtttcaaagcagaagccatgcgacctgcccctccgactactcgtccctacacaatttgtgggggcaataatagggaaggaaggggcgaccattcggaacattaccaagcaaacccaaagtaaaattgatgtgcatcgtaaggaaaacgccggagccgccgagaagagcataaccattctgtctacccccgaggggacgtcagccgcatgcaaatccattctcgagattatgcataaggaggcacaggatatcaaattcacggaggagatcccccttaagatcctagcccacaacaacttcgtgggtcgtctcattgggaaagaagggcgcaacctgaagaaaatcgagcaggacactgatacaaaaatcactatctctcctctccaggagctaacactgtataatccagaaaggaccatcaccgtgaaaggaaatgttgaaacttgcgcaaaagccgaggaggagataatgaaaaagatacgagagtcttacgaaaatgatattgcttctatgaatctgcaggctcatctcatccctggactcaatctaaacgccctcggcctatttcctccgacctctgggatgccccccccaacctctggtcccccatccgcaatgactcctccgtatccccaattcgaacaatccgagaccgaaaccgtgcatctgtttattcctgccctttcagtcggtgcgatcattggtaaacaggggcagcacattaagcagctgtcccgctttgccggcgccagtattaagattgcacccgctgaagcgcctgatgctaaagtccgcatggtcataatcacaggccccccagaggcccagttcaaagctcaaggacgcatttacggcaagatcaaggaagaaaacttcgtaagcccaaaagaagaggtcaagctagaggcccacatccgggtgcccagcttcgctgccggaagagtcatcggcaaaggcggcaagactgtgaacgaactgcagaatttgtcctcggccgaggtggttgtcccaagagaccagacccctgacgaaaacgaccaggtagtggtcaaaattactggacacttttatgcatgccaggtggcccagcggaaaatccaggagatcctaacacaggttaagcaacaccagcaacagaaggctctgcagtcgggccccccccaaagccggcgcaaatag

SEQ ID NO: 120718 - DNA, 7476 bp, Artificial Sequence
  Description of Artificial Sequence: Synthetic coding sequence
atgggggcagccgctggcaggtctcctcacctgggaccagcaccagctcggcgaccacagaggagcctgctcctgcttcagttgcttctgcttgtcgccgcacccggatctactcaggctcaggcagccccatttccggaactgtgctcctatacgtgggaagcagtggacacgaagaataatgtgctttacaaaattaatatctgcggatcagtggacatcgtacagtgcgggccctcctctgcagtctgtatgcacgacttaaagacgaggacgtaccactccgtcggcgactccgtattaaggagcgctacccgaagtcttctcgaattcaatactaccgtgagctgcgatcaacagggcacaaatcaccgcgtgcagagctccattgccttcctgtgcggcaaaacgctgggcacccctgaattcgtcacagccaccgagtgtgtgcactatttcgagtggaggaccaccgcagcatgcaaaaaagatatttttaaagccaacaaggaggtgccctgctacgtgtttgatgaagagctgagaaagcatgacctgaacccactgattaaactgtcgggagcatatctcgttgatgacagtgacccagacacgagcctcttcattaacgtttgtagggacatcgatacgctgcgggatccaggcagccagctgcgcgcttgcccccccgggactgcggcgtgcctggtaagaggccaccaggcatttgatgtcggtcagccaagggacgggttgaaacttgtgagaaaggatagacttgtgctcagctacgtacgcgaggaagctgggaagcttgacttctgcgatggccattcgcccgccgtcacaattaccttcgtgtgtccttctgaacgaagggaaggaaccatccctaagttaaccgccaagtccaactgtcgttacgagatcgagtggattactgaatatgcttgccatagagattacctagaatcaaagacatgtagtctgagcggagaacagcaggacgtctctatcgacttgaccccattggcccagtccggaggctcaagctatataagcgatggcaaagaatacctgttttaccttaacgtttgcggtgagaccgaaatacagttttgtaacaagaagcaggctgccgtgtgtcaagtaaagaagagcgacactagtcaagtgaaagcagcgggccgttatcataatcagacgctgcggtactctgacggtgatctgaccctcatctatttcggaggtgatgaatgttcttcagggttccagcggatgtcagtgattaacttcgagtgcaacaaaaccgccgggaatgacggtaaggggaccccggttttcactggggaggttgactgtacctactttttcacatgggacactgagtatgcctgtgtgaaggagaaggaagaccttctgtgtggcgctacagatggcaagaagcgctatgacctgtccgcccttgtacgccacgctgaaccagagcagaactgggaggctgtggatggaagtcagaccgaaactgagaagaagcacttctttatcaatatatgccaccgggtcctgcaagaggggaaagctaggggctgccctgaggatgccgcagtgtgcgcggtagataagaacggctctaagaatctggggaagttcataagcagtcccatgaaagaaaaggggaacatccagctgtcatactcagatggcgacgactgtgggcatggcaagaagatcaagactaacattacactcgtctgcaagcccggggatctggaatcagccccagtcctacgaacttcaggggagggaggatgtttctacgagttcgagtggcatacagctgccgcttgtgttttgtcaaaaacggaaggagagaattgcactgtctttgactctcaggcagggttctcattcgacctttctccactgactaaaaaaaatggagcttacaaggtcgagacaaaaaagtacgacttctatatcaatgtatgtggtcctgtgtctgtgtctccttgccagcccgactccggtgcttgtcaagtcgccaaatcagacgaaaagacatggaatttgggactgtctaatgccaaactctcttactatgatggcatgattcagcttaactatcgcgggggcacgccttacaacaatgagcggcacacacctcgggccactctcatcacatttctttgcgaccgggacgctggggtgggatttcccgaataccaggaggaggacaactctacctataacttcaggtggtacacatcctatgcgtgtcctgaggagccactcgaatgtgtcgtcacagatccgtcaacactcgagcagtatgatttatcttctctcgccaagagtgagggagggctgggaggcaactggtacgcaatggataattccggagagcatgtgacttggcggaaatattatattaatgtgtgccggccgcttaatcccgtgcccggatgcaatcgttatgcatcagcatgtcagatgaaatacgagaaggaccagggctcctttacagaagttgtgagcattagtaacttagggatggccaagactggccccgtggtggaggacagcgggtcgctgctgttagaatacgtcaacggtagtgcctgcacgacaagcgatggcaggcagaccacatataccacgcgaatccacctggtttgctccagaggaaggctcaattcccatccgatcttctcgctaaactgggagtgcgtcgttagcttcctgtggaataccgaggcagcatgtccaatacaaaccactacagacactgatcaagcctgttcaatccgggacccaaactcgggattcgtctttaacctgaaccccctcaatagctcgcaggggtacaacgtgtccggcatcggcaagatattcatgttcaacgtgtgcggtacaatgcctgtttgtgggacaattcttggaaagccagcctctggttgcgaagctgaaacgcagaccgaggaattaaagaactggaagcccgccagacctgtagggatagagaagtccttgcagctaagcaccgaaggctttattaccctgacctacaaaggccccctctctgctaaagggacagctgatgctttcatcgtccggttcgtgtgcaacgacgacgtatactccgggcctcttaagttccttcaccaggatatagactccggtcaggggattagaaacacttattttgagttcgaaacagcactggcatgcgtccccagcccagtagattgtcaggtgactgatcttgctgggaatgaatatgatctgacaggattgagcaccgtccggaagccttggactgctgtcgacacatcagtcgatggaagaaaaagaaccttttacctctcagtatgcaacccgctgccatatatccccgggtgccaaggaagcgccgtgggctcatgtctggtgtctgaaggaaatagttggaacttaggggttgtgcagatgtcaccacaggctgctgccaacggatcgctaagtataatgtacgtgaatggggacaagtgtggtaaccaacgttttagcaccaggataacgttcgaatgtgcccagatctcaggctctcccgctttccaacttcaggacggttgcgaatatgtctttatttggcggactgttgaggcttgtccggtggtgagagtggaaggtgacaattgtgaagttaaggacccgaggcacggcaacctctacgatctgaaacccctgggcttaaacgatacaatcgtgtcggctggcgaatatacatactatttccgggtttgcggaaagctaagtagcgacgtgtgtccaaccagcgacaagtccaaggtggtaagcagctgtcaggagaaacgcgagccgcaaggcttccataaagtggctgggctactgacacagaaattgacctatgagaacgggctgctgaaaatgaacttcacaggcggggatacctgccacaaagtttaccagcgaagcactgcaatcttcttttattgtgaccgtgggactcagcgtcccgtgtttcttaaggaaacctctgattgttcttacttgttcgagtggagaactcagtacgcttgcccaccattcgatctgacagaatgctcgtttaaggacggcgcgggcaactcctttgacctctcttctctgtcaaggtactctgacaattgggaagcaattaccggcacaggggaccctgagcattatttgattaatgtgtgtaagtccctggccccacaggcaggcaccgaaccgtgtcctccagaggcagcagcttgcctgctaggtggaagcaagccggtcaatctgggacgtgtgcgagacgggccccagtggcgggacggtattattgtcctgaaatatgttgacggcgacctatgcccggacgggatcaggaagaaaagcaccacgatcaggttcacatgctccgaatcccaggttaatagtaggccaatgttcattagcgcagtggaggactgcgaatatacttttgcctggcctacagctactgcctgcccaatgaaatccaacgaacatgacgattgccaagtcacaaatccctcaactggtcatctctttgatctgagctccctgagtggaagggcgggcttcacggccgcgtactccgaaaaaggcctagtatacatgtcgatatgcggtgagaacgagaactgccctcctggtgttggcgcatgcttcggtcaaactcggatttctgtggggaaagcgaataagcggctgagatatgtggatcaagtgttgcagctggtctacaaggacggttccccgtgcccttccaaaagtggactttcctacaaaagtgtgatttctttcgtgtgtcgacccgaagcaagaccaactaataggcccatgctaatctcgcttgacaaacaaacatgcaccctgtttttctcatggcacacccccctggcgtgcgagcaagcgacagagtgttcagtgcgaaatgggtcttcaattgtcgacctgagcccattgattcatcgaactgggggctacgaagcatatgatgaaagcgaagatgacgcctcggatacaaacccagacttctatataaacatctgccaacctttaaaccctatgcatggagtgccctgccccgctggcgccgccgtatgcaaagttcccatcgatggtccgccgattgacatagggagggtggcaggaccaccgatactcaacccgatcgccaacgagatttacctgaactttgagtcaagcaccccctgcttggctgacaagcacttcaactatacatccttaatcgcctttcactgcaagcggggcgtgtcaatgggcacgcccaagctcttgcggacgagcgagtgtgatttcgtcttcgaatgggaaacccccgtggtctgccccgacgaagtacggatggatggatgtacccttacggacgaacagcttctttactccttcaatttaagcagcttgtcaacgagtacctttaaggttactcgggattctcgaacatactccgtcggcgtctgtacattcgctgtgggccccgagcagggggggtgcaaagatggcggcgtatgcctactaagtgggaccaaaggcgcatcatttggcaggctgcagagcatgaagcttgattatcggcatcaggatgaggcggtggtgctgagttatgtgaatggcgaccgatgtcccccggaaacagatgacggtgtgccctgcgtctttccgttcatctttaacggaaaatcatacgaggaatgcatcatcgagtccagggcaaagctgtggtgtagcaccacagcggattacgatcgcgatcatgagtgggggttttgtaggcactccaactcctacagaacaagctccattatttttaaatgtgacgaggatgaggatataggtcgcccccaggtcttctccgaagtcagggggtgtgatgtgacttttgagtggaaaaccaaggtggtgtgtccacctaaaaagctggagtgtaagtttgtccaaaaacataagacatacgacctgaggctcctgtcaagcctgaccggctcctggagtttagttcataacggtgtgtcttactacatcaatctgtgtcagaagatttataaaggacccctagggtgcagcgagcgggcatctatctgtagaaggaccactacaggagacgtgcaggtactcggactcgtgcatactcagaagctgggggtgatcggcgacaaggttgtggtgacctattcaaagggatacccctgtggtggtaataaaaccgctagctctgttattgaactcacctgtaccaaaaccgtgggaaggcctgccttcaaaaggtttgacatcgactcctgcacatattacttctcctgggacagtagggccgcctgcgccgtgaaaccacaggaggtccaaatggtgaatgggactatcacaaaccccatcaacgggaagagctttagcctcggcgacatctatttcaagctgtttcgagcgagtggtgatatgagaactaacggcgataactacctgtatgagattcagttatcaagtatcacctcttccagaaaccctgcatgtagcggtgcaaatatttgccaagtgaagcccaatgaccagcacttcagccgcaaggtaggtacatctgacaaaaccaaatactatctgcaggatggagacctggatgtagttttcgcctcctccagtaagtgtggcaaggacaagacaaagtctgtatcctcaacaatcttcttccactgtgacccattggtcgaagacggtatcccagagtttagtcatgagaccgcagactgtcaatatctgttctcttggtataccagcgccgtatgcccccttggggtgggtttcgactcagagaacccaggagatgacggccagatgcataaggggctcagcgagcggtcacaggcagtgggcgccgtcctgtctttgctcttggtcgctctcacctgctgtctgctggctctgctgttgtacaagaaagagcgacgcgagacagttatctccaagttaactacctgctgtaggcgttctagtaacgtctcttataagtattctaaggttaacaaagaagaggagacagacgaaaacgaaacagagtggctaatggaggagatccagctgccgcccccacgtcagggaaaggaggggcaagagaatggacatataaccaccaaaagtgtgaaggccttaagttccttgcatggagacgatcaggatagtgaagatgaggtgttgacgatcccagaggttaaggtgcactccgggagaggagctggcgcagagtcttcacatcccgttcggaacgcccagtccaacgccctgcaggaaagggaagacgaccgggtgggcctagtccgcggcgaaaaggcaaggaagggcaaatcaagtagcgcccagcagaagacagtgagctcaacaaagttggtctctttccacgacgattccgacgaggatctcttacatatatag

SEQ ID NO: 120719 - DNA, 780 bp, Artificial Sequence
  Description of Artificial Sequence: Synthetic coding sequence
atgagcgaggtgccggtggcccgcgtgtggcttgtactccttctgctcactgttcaagtgggggttactgccggggctccctggcagtgtgccccatgttcagccgagaaactcgccctatgtccaccggtgtccgcaagttgctcggaggtgacaagaagcgcggggtgcggatgctgtcctatgtgcgcccttcctcttggcgccgcctgcggggtggccactgctagatgcgctcgggggctctcatgccgggctctgccaggtgaacagcagccactgcacgccctgactcggggacaaggcgcctgtgtccaggagtccgacgcaagcgccccccacgccgccgaagccggatcgcccgagagtcccgaaagcacggagattaccgaggaagagttattggacaatttccacttgatggccccctcagaggaggatcacagtatcctgtgggatgccatcagcacttacgatggctccaaggccctccatgtcaccaatattaaaaagtggaaagagccatgtagaatcgagttgtacagggtcgtagaaagtctggccaaagcgcaggaaacgtcaggagaggagattagtaaattctatctaccaaattgtaacaagaacggattctatcactctcgccagtgtgagacatccatggatggcgaggccggtctgtgttggtgcgtgtacccctggaatggcaagcgaattcccggaagcccagaaatccgaggcgaccctaattgtcagatttatttcaacgtccagaactag

SEQ ID NO: 120720 - DNA, 777 bp, Artificial Sequence
  Description of Artificial Sequence: Synthetic coding sequence
atgctacccctctgtctggtcgcggcattgctcctggccgctggcccgggcccgagtctgggcgacgaagcaatccattgcccaccgtgctccgaggagaagcttgctcgctgtagaccaccagtaggctgtgaggagctcgtaagggagcccggctgcgggtgctgcgccacctgtgctctgggattaggcatgccatgtggggtgtatacaccacggtgtggatcaggactcaggtgttacccaccgcgcggtgtggaaaaaccgctacacacgttgatgcatggacagggcgtctgcatggaactggcggagattgaagcgattcaggaaagcttgcagcctagcgataaagatgagggcgatcatccaaataatagcttcagtccatgttcagcacatgaccgccggtgcttacagaaacatttcgccaagatcagagatcggtcaacctccggggggaaaatgaaagtgaatggggcacctcgagaggatgctcggcctgtgccacaggggtcgtgtcaaagtgagcttcaccgcgccttggagcgtttggcggcttcccagtctcgcacccacgaagacctgtacataatccccataccaaattgcgacagaaacggcaacttccaccccaagcagtgccaccccgcactcgacggccagcggggaaagtgttggtgcgtcgaccgcaaaactggcgtgaaactgcctggcggcttggagccgaagggggagctcgattgccaccagctcgctgactcttttcgggagtag

SEQ ID NO: 120721 - DNA, 477 bp, Artificial Sequence
  Description of Artificial Sequence: Synthetic coding sequence
atggagctcgccgaaatcgaggcaatccaggagtctctccagccatccgataaggacgagggggaccaccctaataattcatttagtccatgcagcgcacacgacagaagatgcctgcagaagcatttcgcaaaaattcgtgatcgcagcacgagtggtggaaagatgaaggttaatggggccccccgagaggacgctcgtccagtcccacaggggagttgtcagtccgagcttcaccgtgctctggagcggctggccgcctcacagtcccgcacccacgaggatctttacatcatccccatcccaaattgcgacaggaacggaaactttcatcccaaacagtgccatccagccctagacggccagagaggtaagtgctggtgtgtggatcgtaaaacaggcgtgaagctgccaggtggactcgagccaaagggagaactcgactgccatcaacttgcggatagcttccgggagtag

SEQ ID NO: 120722 - DNA, 849 bp, Artificial Sequence
  Description of Artificial Sequence: Synthetic coding sequence
atggagaggccttcactacgcgctttacttttgggggcagccggattgttgctccttctgctgcccctttcttcctctagtagcagcgacacgtgtgggccgtgcgagcctgcctcctgtcctcctctaccccccctgggatgtttgctaggcgagaccagggacgcctgtggctgctgtcccatgtgcgcacggggcgagggcgaaccctgcggcggaggaggcgctggaaggggttactgtgcccctgggatggagtgcgtcaagagcaggaagcggcgaaaaggtaaggcaggagccgctgcgggcggcccaggggtttctggcgtgtgtgtttgcaaaagcaggtacccagtctgcggctccgatggaaccacctacccatccgggtgtcagctcagagctgcatctcaacgtgccgagtcccgaggcgagaaggctatcacacaggtgtctaagggtacatgcgaacaaggaccgtcaatcgtgaccccacccaaggacatctggaacgttacaggagctcaagtgtatctgtcctgcgaagtgatcggcatcccaactcctgtgctaatatggaataaagttaaaagaggacattatggcgttcaacgaactgaattgctgcccggtgacagagataacttagcaattcagacccgcggcggccccgagaaacatgaggttacaggctgggttctggttagtcccctatctaaggaagacgctggggaatatgaatgtcatgcctcaaactcacagggccaggcttcagcttcggctaaaataaccgtggtggacgccctgcatgaaattcccgtgaaaaaaggcgagggagccgagctctag

SEQ ID NO: 120723 - DNA, 840 bp, Artificial Sequence
  Description of Artificial Sequence: Synthetic coding sequence
atggaacgaccatctctgagagccttgctgctgggcgccgcaggacttctgctgctcctgctccctctgtcctccagcagtagttctgatacatgtgggccttgcgagcccgcatcctgccctccgctccccccgctgggctgcttgctgggggagaccagggacgcatgcggctgttgccccatgtgcgccaggggcgaaggcgagccatgcggcggtgggggggcaggcagggggtactgtgctcctgggatggagtgtgtcaaatctaggaaaagacgaaagggcaaagccggcgcagctgctggaggccccggtgtttctggagtttgtgtttgcaaatcccgatatcccgtgtgcggatcagacggaaccacttacccttccgggtgtcagctgcgggctgctagccagcgggccgaatctcgaggagagaaagctataactcaggtgagcaaaggcacatgtgaacaagggcccagcatagtgacgcccccaaaggatatttggaacgtgactggcgcccaggtatacctgagctgcgaggtaataggcattcctacacccgttctaatttggaacaaggtgaagcgggggcactatggcgtgcagcgcaccgagttactgccaggagacagagacaatctcgctatacagaccaggggtggcccagagaagcatgaggtgacggggtgggtgctggtgagccccctgagcaaagaagatgctggagaatatgagtgccacgcttcaaacagccagggtcaggcgtcagcaagcgccaaaattacagtggtggacgcgcttcatgagatccccgtgaaaaaagggacccagtag

SEQ ID NO: 120724 - DNA, 393 bp, Artificial Sequence
  Description of Artificial Sequence: Synthetic coding sequence
atggagactctcggcgcgcttttagtgctggagtttctgctgctgtctcctgttgaggcgcagcaggccactgagcaccgactaaagccttggctcgtaggtctggccgcagtagtcgggttcttgttcatcgtttatctcgtgctcctggccaacaggctgtggtgctccaaagcgcgggctgaggacgaggaagaaacaacttttagaatggaatccaacttgtaccaagaccaatctgaggataagcgcgaaaagaaagaagccaaagagaaggaggagaagcgcaagaaggagaaaaagaccgccaaagaaggtgaatcgaacctaggcctggacctggaggagaaagaacctggtgaccacgagcgcgcaaagtcaaccgttatgtag

SEQ ID NO: 120725 - DNA, 1932 bp, Artificial Sequence
  Description of Artificial Sequence: Synthetic coding sequence
atggcactccgaaaagctggcgacctggaaccccagttcaccccagagaggaggttccgcctttgttggtatcaggcacacagcggaagggccctgctgggccccccgcctcaggcctcacctcctgccggaggattggcccttgccctgttgctactatcctgggttgctctaggacctagatctctagaaggagccgatccaggtactcctggagaagccgaagggcctgcatgccccgcagcctgtgtctgctcctacgatgacgacgctgatgagctgtcggttttctgtagtagccggaatctgacaaggttaccggacggcgtgcctggcggaactcaggctctgtggctcgacggaaacaacctgagcagcgtgccacccgcggctttccagaacctgagcagcctgggcttccttaacctgcagggtggtcagctcggtagtctggagccccaggcattattgggactcgaaaatctgtgtcacttacatttagaacggaatcagctgcgatcactcgctctgggaacgttcgcccacaccccggcactggcctccctcgggctgtcaaacaacaggctctctcggttggaagacgggctgttcgaaggattaggtagcctctgggatctcaatctgggctggaactcgctggcagttctacctgacgccgcgtttaggggtctgggatctctacgggaacttgtgctggcagggaacagactcgcctatctccagcctgccctcttcagtggactggctgagttaagagaattagacctgtccagaaatgccctccgcgcaattaaggccaacgtgtttgtgcagttgccccggctccagaaactctatctcgataggaacttgattgccgcagtcgcccccggtgcttttctcggcctgaaggccctgcggtggctcgacctgtcccataatcgcgtggctggtctgttggaagatacctttcctgggttgctcggcttacgcgtcctgcggctgtcccacaatgccattgctagtctaagaccgaggacgttcaaggacctgcacttcctggaggagctccagttaggtcacaatcgaatccgacagttagctgaaagatccttcgaggggttgggtcagctggaggtgctgactctagaccacaaccagctgcaggaagttaaggcaggggcctttctcggacttactaatgtggccgtcatgaatttaagcgggaattgcctgaggaatctgcccgaacaagtttttagaggacttggaaagttgcactcacttcaccttgaaggatcttgcctaggccggatccggccccacacgttcacggggctgtcaggattgcggcgcctcttcctgaaagacaatggcctcgtggggatcgaggaacaatctctctggggcttagcagaactgttggagcttgacttgacctctaaccaattgacacatttgccgcacaggctgtttcaaggcctgggtaagctcgaatacctgctccttagcaggaatagactggctgagcttcccgctgacgccctggggcctttgcaaagggctttctggctcgatgtgagtcacaaccggctggaagccctgccaaatagcctactggcacctctgggcaggctgcgctacttgagcctgcggaataattccctgcgaacgtttaccccccagccccctggactggagaggctgtggctggaaggcaacccgtgggactgcggatgcccgctaaaggccctgagagattttgccctgcagaacccatctgcggtcccccggttcgtgcaagctatctgtgagggcgacgattgccaacctcccgcctacacatacaataacatcacatgtgccagtccgccagaggtggtcgggctggacttgcgagacctgtcagaagcccactttgctccctgttag

SEQ ID NO: 120726 - DNA, 1533 bp, Artificial Sequence
  Description of Artificial Sequence: Synthetic coding sequence
atgcctcgaggtttcctggtgaagcgaagcaaaaaatcaacacccgttagctaccgggtccgaggcggcgaggatggagaccgagcactgttattgagcccttcctgcggcggagccagggcagaaccgcctgctccctcccctgtcccaggaccacttcctcctcctccccccgctgaaagggcccatgccgcgctggcagccgccctcgcctgtgccccaggacctcagccacctccacagggcccgcgggctgctcacttcggcaaccctgaagccgcccatcccgccccactgtattctcctactcggcctgtgagcagagaacacgagaagcacaaatacttcgagaggtcctttaacttaggatctcctgtcagtgcggagagcttccctactccagccgctctgctggggggaggagggggggggggcgctagcggggcgggtggcgggggtacatgcggaggggatcccttgcttttcgcccccgcagagcttaagatgggaactgcttttagtgccggggccgaagctgccagagggcccggaccaggccctcccctgccacccgccgccgctcttaggcctccaggaaagaggccaccaccccccactgccgccgaaccccctgctaaagccgtgaaagccccaggcgcaaaaaagcccaaagccataagaaaactgcattttgaagatgaggtgactacttccccagtgctggggctgaagataaaagaaggccctgttgaagctcctaggggccgggccgggggagctgctaggcccctgggcgagtttatctgccagctctgcaaagaagaatacgctgaccctttcgccttggcccaacacaagtgcagtcggatcgtgagggtagaatacagatgccctgaatgcgccaaggttttctcttgtcctgccaaccttgcctctcacaggcggtggcacaagccaaggcccgcccccgcagccgcgagggccccagagcccgaagctgcagccagagcagaggcgcgggaagcaccaggcggcggatctgatcgggacaccccctcccccgggggcgtgtctgaatccgggtctgaagacggcctctacgagtgccaccactgtgccaaaaaattccgccgccaggcctacctgcggaaacacctgctggcccaccatcaggccttacaggccaaaggtgcccccctggctccaccagcggaggatctgctggccctttaccctggtcctgacgagaaggccccccaggaggcagccggtgacggcgaaggggcgggggtgctgggcctgtccgcgagcgctgagtgtcatctctgtccagtgtgcggggaaagtttcgccagcaagggcgcccaggaaaggcatctgaggctgctgcacgctgctcaggtgtttccttgcaagtattgtccagccacgttctatagtagtccggggttgacacgacacataaacaagtgccatccatccgagaaccgacaagtaatactactgcaggtccctgttaggccagcttgttag

SEQ ID NO: 120727 - DNA, 1701 bp, Artificial Sequence
  Description of Artificial Sequence: Synthetic coding sequence
atgcctcgtggctttttagttaagagaaccaagcgtaccggggggctatatagagtccgattggctgaacgagtgttcccacttcttggcccccagggagccccacccttcctagaggaagcaccctctgcttcacttcctggagctgaaagagctacccccccaaccagggaggagccagggaaaggtcttacagcagaggccgcacgggagcaatccggttctccctgtagagcagctggggtgagtccaggcacgggtgggcgggaaggtgcagagtggagagccggcggaagggaaggaccagggccatctcctagcccttcccctagcccggcgaaacctgcaggcgcggaactgcgaagggcattcctcgaaaggtgcctgtcaagtccggtgtctgcggagtcattccctgggggggcggcggctgtggctgccttcagctgcagtgttgctcccgcagctgccccaacaccaggcgagcagtttctactcccgctcagagccccatttcctgagcctgctcttcagcccgatccagcccctctgagtgccgcgctccagtcactgaagcgtgccgctggtggggagcggagaggaaaagcccccacagactgcgcttcagggccggccgcggcggggatcaaaaagcctaaagccatgcgaaagctgagctttgcagacgaagtgactaccagtcccgtgctaggtcttaaaatcaaggaagaagagccaggcgccccttctagagggctgggaggctccagaacacctttgggggaattcatctgtcagctgtgcaaggagcagtacgcagacccctttgcgctcgcccagcaccgctgctccaggatcgtgagggtggagtacagatgtcccgagtgtgataaggttttcagctgtccagccaacctagccagtcaccgcaggtggcataagccaaggccagctgccgccaatgcagcaacagtgagctctgcagacggaaaaccaccatcttcctccagcagctcctcccgcgactccggcgccatcgcgtcatttttggcagagggcaaggaaaatagcagaatcgaacggacagcggaccaacatccccaggcccgcgattcgtccggcgccgaccagcatccggatagcgctcccagacagggcctgcaggtactgacccacccagaacctcctttgcctcaggggccgtacacagagggggtgcttggcaggcgggtgcctgtgccgggcagcacaagcggaggaagaggttcggagatctttgtttgcccatactgccacaagaaattcaggcgacaggcttacctcagaaagcatctgagtacccatgaggcgggatcagcccgggccctggctccaggctttggatcagaaagaggagcccccctcgcctttgcttgtcccctttgcggcgcacactttcccactgctgatatccgagaaaaacaccgtctttggcatgccgtgcgggaagaattgttgctgccagccttggctggcgcccctcctgagacttcagggccgtcgggcccgtccgatggcagtgcacagcagattttttcttgtaagcattgtccctctacattttttagcagtcccggccttacgcggcatatcaataagtgtcatcccagcgaatccaggcaagtgctgctgctgcaaatgcctctaagacccggttgctag

SEQ ID NO: 120728 - DNA, 792 bp, Artificial Sequence
  Description of Artificial Sequence: Synthetic coding sequence
atggtaaagatagccttcaacacacccacagccgtccagaaggaggaagcacgacaggacgtggaggctctgctgtcgaggactgtgcgcactcagatcttaacgggtaaggagctcagagttgccacacaggaaaaggaaggcagtagtggccgctgcatgctgacgctcctaggcttgagttttatcctggctggtctcatcgtcggcggggcttgcatctacaaatatttcatgccaaaaagcaccatctaccggggggagatgtgtttcttcgactcagaggatccagcaaacagtctgcggggcggtgaaccaaatttcctgcccgtcaccgaagaggcagatattagagaggacgacaatattgcaattatcgatgtccccgtcccgagttttagcgattcagatcccgcagcaataatacacgacttcgagaagggcatgactgcgtacctggacctcctcctgggcaactgctatcttatgcctcttaacacctcaattgtgatgccccctaaaaaccttgttgagctgttcgggaagctggccagtggtagatatctgccacagacatatgttgtgcgggaagacctcgtggccgtggaggaaatccgtgatgtcagcaatctcgggatcttcatttaccagctctgtaataataggaagtcttttcgactgcggcggagagacctgctgctcgggtttaacaaaagggcaattgataagtgttggaagatacgacattttcctaatgaattcatcgtcgaaaccaagatttgtcaggagtag

SEQ ID NO: 120729 - DNA, 660 bp, Artificial Sequence
  Description of Artificial Sequence: Synthetic coding sequence
atggtgaaaattgcctttaatacaccaaccgctgtacaaaaagaagaggctcgccaggatgtagaggcgctcttgagcaggacagttcgaacacagatcctgactgggaaatcaacaatctatcggggtgaaatgtgcttttttgactcggaagatcccgccaactcactccgcggtggcgaacctaattttctgccagtgactgaggaagccgacattagggaagacgacaatatagccataatcgatgtacctgtgccttccttttctgactcggacccagccgccattatccatgacttcgaaaaaggtatgacggcgtaccttgacctattattggggaattgttatctgatgcccctgaatacgagtatcgtcatgccgcccaagaacctcgtagagctcttcgggaagctcgcttccggcaggtacttgccccaaacttacgtggtgcgtgaagacctagtggccgtcgaggagatcagggatgtgtccaacctggggatattcatctatcagctctgtaacaatcgcaaaagctttcgattacgacggcgggacctattgcttggctttaataaaagggcgatcgataagtgttggaagatccggcacttccccaacgagtttatcgtggaaacgaaaatctgtcaggagtag

SEQ ID NO: 120730 - DNA, 801 bp, Artificial Sequence
  Description of Artificial Sequence: Synthetic coding sequence
atggtgaaagtgacgtttaactctgccctcgcgcaaaaggaagccaaaaaggacgagccaaagtccggcgaagaggcccttatcatcccgcctgacgcggttgcagttgactgcaaagaccctgatgacgtagtcccagtgggacagcgacgcgcctggtgttggtgcatgtgtttcggtttagcctttatgctggcaggggtgatcctcggtggcgcatatctatataagtactttgctctgcagcccgatgatgtgtattactgtgggatcaaatacataaaggacgacgtgattctgaatgagccatccgcggatgccccagctgccctgtatcagacgatcgaggaaaacattaaaatattcgaggaagaggaggttgaatttatctctgtacccgtacctgaattcgctgattccgacccagccaacatcgtgcacgactttaacaaaaagttaacagcttatctggaccttaatctcgacaaatgctacgtgatacccctgaacacaagcatagttatgcctccaaggaacctactggaactactcatcaacatcaaggcgggcacctacctgccccagtcgtacctaatccacgagcacatggttataactgatagaattgaaaatatcgaccatctcggcttttttatctaccggttgtgtcatgacaaagagacctataaactccagcggcgcgagaccattaagggaattcagaaacgggaagcttccaattgcttcgccataagacactttgagaacaagttcgctgtagagaccctgatctgtagctag

SEQ ID NO: 120731 - DNA, 693 bp, Artificial Sequence
  Description of Artificial Sequence: Synthetic coding sequence
atggtgaaaatttcattccaaccagctgtggctggcatcaaaggagataaagccgacaaggcgagcgcctctgccccagcaccagcttctgccacggagatcctgctgacgcccgctagagaagagcagccaccccagcaccggagtaagcgcggaggctctgtagggggcgtatgttacctgagtatgggcatggtggtgctactcatggggctggtgtttgctagcgtctatatttaccgatatttcttcctggctcaattggcacgggacaactttttccggtgcggagtgctgtatgaagattcacttagcagtcaggttcgcacgcagatggaactggaggaggatgtgaagatctatctggatgagaattatgagcgaataaatgtgccagtgccccagtttgggggcggtgatcctgctgatatcattcatgactttcagaggcgtggtacgtatctcccacagacctacatcattcaggaagagatggtcgttacagagcatgtgtccgataaggaagccctcggtagtttcatatatcacctttgcaacgggaaagacacttaccgtcttaggcgaagagctacccggcggaggattaacaagcggggtgccaaaaattgcaatgcaatcagacacttcgagaacacatttgtggttgagacgcttatatgtggcgtggtctag

SEQ ID NO: 120732 - DNA, 804 bp, Artificial Sequence
  Description of Artificial Sequence: Synthetic coding sequence
atggttaaaatctcattccaaccagccgtggcggggatcaaaggtgataaggccgacaaggccagtgcttcggcgccggcacctgcctccgccacagagatcctgttaacccccgcacgagaggagcagccccctcaacacaggagtaagcggggcggctccgtcggcggcgtgtgctacctgtctatggggatggtcgtgctgttaatgggactggtcttcgcatccgtctatatatatcggtacttcttcctcgcacagctcgcaagggataattttttccggtgtggggtgctgtatgaagattccctaagttcccaagtgaggacccaaatggaactagaggaagatgtcaaaatatacctggacgagaattatgagaggatcaatgtccccgtccctcaatttgggggaggcgaccccgccgatattatacacgatttccagcgagggttaaccgcctatcacgacataagcctagacaagtgttacgtgattgaacttaacaccactatcgtgctgccaccgaggaatttctgggaactgcttatgaatgtgaaaagggggacatacttgcctcagacttacattattcaggaggaaatggtggtcactgaacatgttagcgacaaagaagccctagggtcctttatttatcacctatgtaacggcaaggatacatacagattgaggcgacgggctacacggaggcgcatcaataaacggggagccaagaactgcaatgcaattagacactttgagaacacatttgtggtggagacactcatctgtggcgtggtgtag

SEQ ID NO: 120733 - DNA, 663 bp, Artificial Sequence
  Description of Artificial Sequence: Synthetic coding sequence
atggtcaagatcagcttccagccagcagtcgccggaatcaagggcgataaagccgataaggcttcagcatcagcacccgctccagcttcagcaaccgagattctcctgacgccggcgaggctggcccgggacaattttttccggtgtggagtcctgtatgaggacagtctctcttcgcaggtgcgcacccagatggaactggaggaggatgttaagatctaccttgatgagaactacgagcgcatcaacgtgcctgtcccgcagttcggcggaggtgatcccgctgacatcatccacgatttccagaggggtctgaccgcataccacgatatctctttggacaaatgttatgtgattgaactgaatactaccattgtcctgccgccgcgcaatttctgggaactcctgatgaatgtgaaaagaggcacttacctcccacagacgtatatcatacaggaggaaatggtggttactgagcatgtttctgacaaggaggctctggggtcattcatctaccatctgtgtaatggaaaggatacatacaggctgagacgtagggctacacgcaggagaatcaacaagcgaggagctaagaattgcaacgccattaggcatttcgaaaacacctttgtggtagaaacactaatctgtggagttgtctag

SEQ ID NO: 120734 - DNA, 543 bp, Artificial Sequence
  Description of Artificial Sequence: Synthetic coding sequence
atggtgaagatcagtttccagcctgccgtggcaggaattaagggagacaaggccgacaaggcatctgcctcagccccggcacctgcaagtgccacggagatccttttaacgcctgcccgtgaagaacaaccgccccagcacagatccaagagaggtggctccgtgggtggcgtctgctatctcagcatgggtatggttgttctcctgatgggactggtctttgccagcgtctacatatatcgttacttctttctcgctcagctggctagggacaacttttttcgctgcggagtcctgtacgaggactcactatctagccaggtgcgtacacaaatggagctcgaagaggacgtgaagatctacctggatgaaaactacgagaggatcaatgtgcctgtcccccagttcggtgggggcgatccagctgacatcattcatgacttccagcgtggcctgacggcttatcatgacatctccctggataagtgttatgtgatcgaattgaatacaacgatcgttctgccccctcggaatttttggtag

SEQ ID NO: 120735 - DNA, 1839 bp, Artificial Sequence
  Description of Artificial Sequence: Synthetic coding sequence
atggcagcagctggcagactaccttcttcctgggctctgttcagcccactgctggctggattggcacttcttggggtagggccagtgcccgctagagccctgcataatgtgacagcagaactttttggggctgaggcatggggtacgttggccgcctttggagatttaaattccgacaagcagacggacttgtttgtactgcgcgaacgaaacgacctgattgtcttcctcgctgaccaaaacgctccctatttcaaacctaaagtgaaggtgtcgttcaagaaccactccgctctgattacctctgtggtgcccggggattatgacggcgactcccagatggatgtgctgttgacttatctgcccaaaaattacgcgaaatccgaattgggagcagtgattttttggggccagaatcaaacgttagatcctaacaacatgaccatcctaaataggacattccaggacgaaccgttaatcatggactttaacggggatctaataccagatatcttcggaataactaatgaatctaaccaacctcagattctcctgggcgggaatctgtcgtggcatcccgctctgacgacaacttctaagatgcgcatcccccactcccatgcctttatagacctgacagaggacttcactgctgacctcttcctcacgactctgaatgccaccacctctacgttccaatttgagatttgggagaatcttgatggcaactttagcgtgtccactatcctggaaaaaccacaaaacatgatggtggttggacagagtgcctttgcagactttgacggagatggccacatggatcacctgctccctggttgtgaggacaaaaattgtcaaaagagtacaatctatctcgtgcggtcaggaatgaaacaatgggtccctgtcctgcaggatttttccaacaaaggcacactgtggggatttgtcccatttgttgacgagcaacaacccactgagattccaatccccatcacccttcatataggggactacaacatggatggctatcccgacgcactcgtcattctgaaaaataccagtgggtctaaccagcaggcttttttgctcgaaaacgtgccctgcaacaacgcaagctgtgaagaagcccgacgcatgttcaaagtttattgggagctcacagatctaaatcagataaaggatgccatggttgccacgtttttcgatatctacgaagacggaatcttggacatagtggtgctgtctaagggctacactaagaatgattttgcgattcacacgctgaaaaacaatttcgaggcggatgcctattttgtgaaggtcattgtgctcagcgggctgtgctcaaacgactgccccaggaaaatcacaccgttcggtgtgaaccagcctggcccttacattatgtataccaccgtggatgcaaacggctacttaaaaaacggatccgccgggcagctcagccagtcagcccacctagcccttcagcttccttacaatgttctgggcctcgggcgttccgcaaattttctggatcacctttatgtggggataccaaggccttccggggaaaagtccatcagaaaacaggagtggacagctatcatacctaactcgcaactcatagttattccataccctcacaacgtgccacggtcctggtctgccaagctgtacctaaccccttctaatatcgtactgctgacagccattgcccttatcggcgtttgtgtatttatcctcgccatcataggtatcctgcactggcaggaaaagaaggccgatgacagagaaaagcgacaggaggcccataggttccacttcgatgcaatgtag

SEQ ID NO: 120736 - DNA, 819 bp, Artificial Sequence
  Description of Artificial Sequence: Synthetic coding sequence
atggacggttacccagacgctctggtgatactcaagaatacgagcggctccaaccaacaggcctttttgcttgagaacgtgccttgcaataatgcctcctgcgaagaggctcgcaggatgtttaaagtttattgggagcttacagatttgaatcaaatcaaagatgccatggtggccacattcttcgacatctatgaggacggcattctggacatcgtggttctgagtaaagggtacacaaagaatgattttgcgatccacaccctgaaaaacaacttcgaagcagatgcttactttgtgaaggttatagtgcttagcggattgtgttccaatgactgccctagaaagataaccccctttggagtgaaccagcctggtccctacatcatgtacaccaccgtggatgcaaatggctacttgaaaaatggtagcgccggacagcttagccagagcgcgcacctggcgcttcagctcccctacaacgtgctggggcttggaaggagcgctaacttcctggatcatctttatgttggcattccccggccaagcggcgagaaatcaatcaggaaacaggagtggaccgccattatcccaaatagccagctcatcgtcatcccctatccacacaacgttcctagaagttggtccgctaagctgtacctgaccccctctaatattgtgctgctgactgctattgcgctgatcggagtctgtgtgttcatcctagctattatagggatcctgcattggcaagaaaagaaagctgatgaccgcgaaaagagacaggaagcccatcggttccactttgatgccatgtag

SEQ ID NO: 120737 - DNA, 1074 bp, Artificial Sequence
  Description of Artificial Sequence: Synthetic coding sequence
atgatggtggtggggcaaagcgcctttgctgatttcgacggcgatggacacatggatcacctcttgcccggatgcgaggataagaattgtcaaaaaagcaccatttatctagtgcgctctggcatgaaacagtgggtccccgtgttgcaagatttctcgaacaaaggcaccctatggggatttgtgcccttcgtggatgagcaacagccgacagagattcccattccaattaccttgcacatcggagactataatatggatggctaccccgatgccctggtgatcctaaagaatacctctggatccaatcagcaggcttttcttctggagaatgtcccttgtaataacgcctcttgcgaggaggcccgacggatgttcaaggtctattgggagctgactgatctcaatcaaattaaggacgctatggttgctacgttcttcgatatttacgaggatgggattttagatattgtggtgctatcaaaaggatacaccaagaatgattttgcaattcacacactgaagaacaactttgaggcagacgcttatttcgttaaggtaatcgtactgtcaggactgtgctccaatgactgccctcgaaagattactccctttggggtgaatcaaccggggccttatatcatgtacactaccgtggacgctaacggttatctcaaaaacggttccgccggccaactcagccagtcagcccatttagctctccaactaccctacaacgtccttggtctgggtcggagcgctaatttcctcgaccatctctatgtgggcatcccacggccttccggagaaaaaagcatcaggaagcaggaatggacagcgattattccaaactcccagcttatcgtcattccatacccacacaacgtcccccgtagttggtccgctaaactttacctgactccatccaacatcgtgctgctcacggccattgccctgatcggtgtgtgtgtcttcattctggctatcattggcattttgcactggcaggagaagaaagctgacgatagggaaaagagacaggaggctcacaggtttcattttgatgcgatgtag

SEQ ID NO: 120738 - DNA, 1395 bp, Artificial Sequence
  Description of Artificial Sequence: Synthetic coding sequence
atggatgtattgctcacttatctgcccaaaaattatgctaagtctgagctgggggcggtgattttctgggggcaaaatcagaccctggatcccaataacatgactatactaaatcgcaccttccaagacgaaccactgattatggatttcaatggagatctcatacctgacattttcggcatcaccaatgagagtaaccagccacaaatattgttgggaggtaatcttagctggcaccccgctctcactactacctctaagatgcgaatcccacactcacacgccttcatcgatctcacagaggactttacagctgacctgtttctcaccacacttaacgcaacaactagtactttccagtttgagatctgggaaaatttggacgggaatttcagcgtctcaaccatcctggaaaaaccacagaacatgatggtagtcggtcagagcgcttttgccgactttgacggggatgggcatatggatcaccttctgcctggctgcgaggataagaactgccagaagagcactatttacctggtccgctccggcatgaaacagtgggtccctgtgctgcaagacttcagtaacaaaggcaccctgtggggattcgtcccatttgtggacgaacagcagccgaccgagatcccaattccaataacactacatatcggggactataacatggacggctaccctgacgccctcgtcatccttaaaaacacatccgggtctaatcagcaggcctttctgctcgagaacgtgccatgcaacaacgcaagctgcgaggaggcaagacggatgtttaaagtgtattgggagctcacagatctaaatcaaattaaagatgcgatggtagcaacgttctttgacatttatgaggacggtattctcgatatagttgtactgagcaaagggtatacaaagaacgattttgcgatccataccttaaagaataatttcgaggccgatgcgtacttcgtcaaagtgatcgtcctgagcgggctgtgtagcaatgactgccctagaaagataacaccgttcggagtgaatcagcctgggccttatataatgtacacaactgtagacgctaacggatatctgaagaacgggtccgcaggacagctgtctcaatcagcccacctcgctctccagctcccatataatgtgctaggtcttggacgatccgccaatttcctggaccacctctacgttggaattcctcgcccttctggtgagaagagtatccgtaaacaggagtggacagcaatcatccctaattctcagctcatcgtgatcccctatccgcacaatgtacctcggtccagccatagatgtttgtgctttcatctgggtaacaactggcattttactttagccggaaaggaatcccgctag

SEQ ID NO: 120739 - DNA, 1044 bp, Artificial Sequence
  Description of Artificial Sequence: Synthetic coding sequence
atgtcccttctgtgtcgcaataaaggatgtggccagcactttgaccccaatacaaacctgcccgactcttgttgccatcatcctggagttcccatatttcacgatgccttgaagggttggtcttgttgtcggaagagaaccgtggacttcagcgaatttttaaacattaagggctgcacaatgggtccacactgtgctgagaagttgcccgaggcaccgcagcctgaagggccagccacgtcaagctccctccaggaacagaaaccgctgaacgtcatcccgaagtcagccgagacccttagacgagagcgccctaagtcagaactaccactcaaactattacctctcaatatcagccaggcacttgagatggccttggaacagaaggagctcgaccaggaaccgggtgccggcttggactcccttatacgcactgggagctcatgccagaacccggggtgtgacgctgtttaccagggtcctgaatcggatgccaccccctgtacctaccaccccggggccccgaggtttcatgaagggatgaaaagctggagctgctgcggcatacagactcttgatttcggcgcttttctcgcgcaacctggatgtcgcgtcggccgacacgactgggggaagcagctgcccgcctcatgtaggcatgattggcaccaaacagacagcctggtcgtcgttaccgtttacggccagatccccctccctgccttcaactgggtcaaagcgagccagacagagctgcacgttcacattgtcttcgacggtaaccgtgtgtttcaagcccagatgaagctctggggcgtgatcaacgtggagcagagttccgtgttcttgatgccgagtcgtgtcgaaatttcactggtgaaggcagaccctgggagctgggcacaattggagcaccctgacgccctggctaaaaaggccagggccggagtcgtgctggagatggacgaggaagagtcagatgattctgatgatgacctgagctggacagaggaagaggaagaagaggaagcaatgggcgaatag

SEQ ID NO: 120740 - DNA, 990 bp, Artificial Sequence
  Description of Artificial Sequence: Synthetic coding sequence
atgagcactgactcctgctgccatcatcccggtgtgccaattttccacgacgctctaaaaggttggtcctgctgcaggaaaaggacagtggattttagtgaattccttaacatcaaaggctgcacaatgggcccacattgtgctgagaagttgcctgaagccccccaaccggaaggccctgccaccagctcttcccttcaggaacagaaacctctgaatgtcatcccaaagagcgccgaaacactgcggagggaacgccccaagtctgaactgcccctgaagctgctacctctgaacatatcccaggcgctggaaatggccttagaacagaaggaactggatcaggaacccggggccggactggacagcctcatcagaaccggcagtagctgccagaaccccggatgtgatgccgtctatcaggggcctgagtctgacgccactccttgcacttaccaccccggagcacccaggttccatgaaggaatgaagtcttggtcctgctgcgggatacaaactctagattttggcgcgtttttggcccagccaggttgccgcgtgggaagacacgattggggaaagcagttgccggcaagctgtagacacgattggcatcagaccgacagcttggtagtggttacagtctatggccaaatacccctgcccgcttttaattgggtgaaggcatcccagacggaactccatgtgcacatcgttttcgatggcaatcgcgtttttcaggcacagatgaagctctggggggtaattaatgtcgaacagagctctgtgttcctgatgccctcacgggtcgagatttctctggtgaaggctgatcctggtagctgggctcaactggaacaccctgatgcccttgccaaaaaggcccgggccggcgtggtcttggaaatggacgaggaggaaagtgacgatagtgacgacgatctatcttggactgaagaggaggaggaggaagaagctatgggggaatag

SEQ ID NO: 120741 - DNA, 603 bp, Artificial Sequence
  Description of Artificial Sequence: Synthetic coding sequence
atgtttcggaagggaaaaaaaaggcacagctctagctcaagccaaagcagcgaaattagcacgaaatccaaatccgtcgactctagcctcggaggcctgtctaggtcctcaacagtggcctcgctggatacagactctactaagtcatcaggccagtccaacaacaactccgatacttgcgccgagttccgaatcaaatatgtgggagccatcgagaaactgaaactctctgagggaaaggggcttgaggggcctctggatttgatcaattatatcgacgtggctcagcaggatggcaaactgccattcgttccccctgaggaggaatttatcatgggagtcagcaaatacggcataaaggttagcactagcgatcagtatgacgtgttgcacaggcatgctctttatttaattattaggatggtgtgttacgacgatggcctcggagcagggaagtctctgctggcactgaagactacagacgcctcaaacgaagaatatagtctgtgggtgtatcagtgcaatagcctggagcaggcccaggcgatctgtaaggtcttgagtacagcatttgatagtgtgctgaccagcgagaaaccttag

SEQ ID NO: 120742 - DNA, 603 bp, Artificial Sequence
  Description of Artificial Sequence: Synthetic coding sequence
atgttccgcaaaggaaaaaagaggcatagctcgagctcctcacagtcctctgagatctcaacaaagagtaaaagcgtggattccagcctcggcgggctttcgaggagcagcacggtcgcttctctggataccgacagcacaaaatcctctgggcagtcaaacaacaattcagatacctgcgcagaatttcgaatcaagtatgttggcgccatcgagaaactaaagctgagcgagggaaaaggtctggaaggacctctggatctgatcaactatatagatgttgcccagcaggatgggaaacttccatttgtccctccagaggaggagttcattatgggagtgtctaagtacggtataaaggtatcaactagtgaccagtacgacgtgctgcatcgccacgctctgtatctcatcattcgcatggtctgttacgacgacggccttggggccggaaaatctttactagccctgaagaccactgacgcatccaacgaggagtactctctctgggtgtatcagtgcaattccctcgagcaagctcaggcgatctgtaaggttctctcaactgcctttgactcagtcctgacttctgagaaaccttag

SEQ ID NO: 120743 - DNA, 255 bp, Artificial Sequence
  Description of Artificial Sequence: Synthetic coding sequence
atgttcagaaagggcaagaagaggcacagctcctcatcatcccaatcatctgagatatcaaccaaatcaaagagcgtggatagcagcctgggcggactatctcggtccagcacagtggcgtcactggacaccgacagtactaaaagctctggtcagagcaacaataactcagatacctgtgccgaatttaggatcaaatacgtcggcgccattgagaaactcaagttgagcgagggtaaggggttagaagggtag

SEQ ID NO: 120744 - DNA, 291 bp, Artificial Sequence
  Description of Artificial Sequence: Synthetic coding sequence
atgttcaggaagggaaagaagcgccatagcagttcaagcagccagagctcagaaatttccaccaaatccaaatccgtggacagtagcctggggggactgagtagaagcagcacagttgcgtcacttgacaccgattctactaagagttccggacagtctaacaacaactccgatacttgcgcagagttccgaattaaatatgtgggcgccatcgagaagctgaaactctctgagggaaaaggcctggagggaccactagatttgattaattacatcgacgttgcccagtag

SEQ ID NO: 120745 - DNA, 261 bp, Artificial Sequence
  Description of Artificial Sequence: Synthetic coding sequence
atgttccggaagggcaagaagcgacatagcagctcctcttcccagtcctcagaaatctctaccaagtccaagagcgtcgatagtagcctgggcggcctcagtaggtcctctactgtagcttcacttgatacggattccactaagtcttctggtcagtccaataacaattcagacacttgtgccgagtttcggatcaagtacgtaggtgctatcgaaaaacttaagttatcagaggggaaggggcttgaaggacctttatag

SEQ ID NO: 120746 - DNA, 411 bp, Artificial Sequence
  Description of Artificial Sequence: Synthetic coding sequence
atgttccgaaagggaaagaagagacactcatcctccagctcacagtcttccgaaatctctacaaagtcgaagtctgtcgatagttcactgggtggcctcagtcgcagctctacggtcgcctccctcgataccgacagtacaaaatcctcgggccagagtaataataattcggacacctgcgcagagttccgcatcaagtacgttggtgcaatcgaaaagttaaaattgagcgagggcaaaggcctggagggacccctggatctcatcaattatattgatgttgcacaacaggacgggaagttacctttcgtgccgcccgaagaagagttcataatgggagtgtctaagtacggtataaaggtgtccacctcagaccaatatgacgtgctgcacaggcacgctctctattag

SEQ ID NO: 120747 - DNA, 345 bp, Artificial Sequence
  Description of Artificial Sequence: Synthetic coding sequence
atgtttcgcaaaggcaagaagaggcactcatcttccagctcccagtccagcgagattagtaccaagagcaagtctgttgacagcagtttgggcgggctgagtagatccagcactgtggcttctctggacacagattccaccaaaagcagtggacagtccaacaataactccgatacctgcgcagagtttcggattaaatatgtgggagcaatcgaaaagctgaaactctctgaaggcaaaggcttggaaggaccattggacttgataaactacatcgatgtggcccaacaggatgggaagctgcccttcgtgccgcctgaagaggagttcataatgggtgtgtag

SEQ ID NO: 120748 - DNA, 198 bp, Artificial Sequence
  Description of Artificial Sequence: Synthetic coding sequence
atgttccgtaaagggaagaagcgccatagtagtagcagttcacagagctcggaaatatcgactaagtctaagagcgttgactcaagcctgggcgggctgagcagaagctcaacagttgcctctttagacaccgatagcacgaaaagtagcgggcagtcaaataacaattctgacacctgcgccgagttcagaatatag

SEQ ID NO: 120749 - DNA, 453 bp, Artificial Sequence
  Description of Artificial Sequence: Synthetic coding sequence
atgttcagaaaaggcaaaaagcgccacagctctagttcctctcagtcgtcagaaatcagcaccaagagtaagagcgttgactcaagcctgggcggactatctaggtccagtaccgtcgctagtctcgatacggattctacgaaaagcagtggtcagtctaataataactctgacacctgcgccgagttccgcatcaagtatgttggggcaatcgaaaagctcaaattgtctgagggcaaggggctggaaggtcccctggacctcataaactacatagacgtggcccagcaagacggcaaactgccatttgtgccacccgaggaggagtttatcatgggagtgagcaagtacggcattaaagtctcaacaagcgaccaatatgaacaggcccaggccatatgtaaggtgcttagcaccgccttcgattccgtactgacctctgaaaagccctag

SEQ ID NO: 120750 - DNA, 534 bp, Artificial Sequence
  Description of Artificial Sequence: Synthetic coding sequence
atgcccgtcaaaagaagcctgaaactggacggcctccttgaggaaaatagtttcgatccatccaagatcacacgcaagaaatcagtgattacttatagtcctacgacaggaacgtgtcagatgtccctctttgcatctcccacttcttcggaggaacaaaagcatcggaacggcctgagcaatgaaaaacgtaagaagctcaatcacccgtccctaacggagtccaaggaatcaaccactaaggacaacgacgaatttatgatgctgctctctaaggtggagaagttgtcagaggagattatggaaatcatgcagaatctgagctcaattcaggctctggaaggctcccgggaactcgaaaacctgatcggaatttcatgcgcatcacactttttgaagcgcgaaatgcagaagacgaaagagctcatgacaaaagttaacaaacagaagctgtttgaaaaatctacaggactaccccacaaagcgtcaaggcacttagactcctacgagtttctcaaggctattctgaactag

SEQ ID NO: 120751 - DNA, 513 bp, Artificial Sequence
  Description of Artificial Sequence: Synthetic coding sequence
atgcccgttaagagatccctcaagctcgatggactactcgaagagaacagtttcgatccgtctaaaattactcgtaaaaaatctgtcattacgtacagccccactacgggaacatgtcagatgtctctcttcgcctcccccacaagctccgaagagcagaaacatcgtaatggactcagcaacgaaaaaagaaagaagctgaatcatccttcgcttaccgagagtaaagaatccactactaaagacaatgatgaatttatgatgctgttgtccaaggtagaaaaactttcagaagagatcatggagatcatgcagaacttatctagcatacaggcgctggagggatcaagggaattggagaatcttattggtatatcatgtgcctcacatttcctgaaacgcgagatgcagaagacaaaagaactgatgacaaaggtgaataagcagaagctatttgaaaagagcacaggcctgccacacaaaggacaaccccagatgtctcaaccattatag

SEQ ID NO: 120752 - DNA, 651 bp, Artificial Sequence
  Description of Artificial Sequence: Synthetic coding sequence
atgcccttcgcaccggtggcccaggctcgggttcagtggcacgacttcagaagcctgcagcacttgctccctgcatttaaaaggttctcatgcctgtctctcgggtcaagttgggactactccgtcaagcgatcattgaaactggatggcctgctggaagaaaactcctttgatccctcgaagatcaccagaaagaagagcgtgatcacctattccccgacaactggcacctgtcagatgtccctgtttgcctctcctacctcatcagaggaacagaagcatcggaatggcctctccaacgaaaagcggaaaaaactcaatcacccgagcctgacagagtcaaaagaaagtacaaccaaggacaatgacgaatttatgatgcttctgagcaaagttgagaaactgtctgaggagataatggagatcatgcagaatctcagtagcatccaggccctggaaggcagcagagagctggaaaaccttatcggaatttcctgtgcttcccactttctgaagcgtgagatgcagaaaaccaaggagctcatgacaaaagtgaataagcagaaattattcgaaaaaagtacaggactcccacataaggcatcccgtcatttggatagttacgaatttctgaaagccattttgaattag

SEQ ID NO: 120753 - DNA, 3540 bp, Artificial Sequence
  Description of Artificial Sequence: Synthetic coding sequence
atggcaccaagacccagagctagacccggcgttgctgtggcgtgctgctggctgctaacagtcgtcttgcgctgttgcgtatcttttaatgttgatgtgaaaaactccatgacatttagtgggcctgtcgaagacatgtttggctacacagttcaacagtacgagaatgaggaaggcaagtgggttctcattggttccccgctagtgggccagccaaaaaatagaaccggcgacgtctacaagtgtccggtgggacgcggcgagtctctgccctgtgtgaaactcgacttgccagttaacacgagtattcccaatgtgaccgaagtgaaggagaatatgacattcggatcaaccctcgtcaccaacccaaacggtgggtttttggcctgtgggcctctctatgcataccgctgtggacatttgcattatacaactggtatttgttccgacgtctccccaacttttcaggtcgttaactcaatagcacctgtacaggagtgcagcacacagctcgatatcgtgatagtgttggacggctccaattctatctacccctgggactctgtcactgcattcctgaatgatcttctggaacgtatggatatcggccccaagcagacccaagtcggcatcgtacaatatggtgagaacgtcactcatgagttcaacctaaacaagtacagttccaccgaagaagttctggtagctgctaagaagatcgtacagcgggggggccgtcagacaatgacagctttgggcattgacacagccagaaaggaagctttcactgaggccagaggcgcccgccgaggcgttaagaaagtgatggttattgtgaccgatggggagagtcacgacaatcatagacttaaaaaggtcatccaggactgcgaagatgagaacattcagagattctccatcgcaattttaggcagctacaatagggggaatttgtccaccgaaaaattcgtcgaggaaatcaagtccatcgcctccgagccgacagagaagcacttcttcaacgtgtccgacgaattggccctcgttacaattgtcaagacactgggtgagcggatctttgccctggaggccacagccgaccagtcggccgctagctttgagatggaaatgagtcagacagggttttcagcccactactcccaggactgggtcatgctgggagctgtgggggcctacgactggaatgggactgtggtcatgcagaaggcctcccaaatcataatcccaagaaacaccacgtttaatgtcgagagcacaaaaaaaaatgaacccctcgcgagttacctgggctacacagtgaacagtgcaactgctagctctggagacgtcctttatattgccgggcaacctcgctataatcataccggacaggtgatcatatacagaatggaagatgggaatattaagatactgcagacactctctggggagcagattggcagctacttcgggagcatcctgactaccactgacattgataaggactctaacaccgacattctcctggtcggcgctccgatgtacatgggaacggagaaagaggaacagggtaaggtgtatgtctacgcactgaatcaaaccaggttcgaatatcaaatgagtttagagccgataaaacagacgtgttgcagttctcgacaacacaatagctgtacgactgagaataagaacgaaccttgcggagctcggtttggcacagcaattgccgcagtaaaggaccttaatctggacgggtttaatgacatagtcatcggagccccgttggaagacgaccacggcggcgcagtctatatttatcacggatctggtaagactataagaaaagagtacgcacagcggatcccaagcggtggtgatggaaaaaccctgaagttctttggccaatcaatacacggcgagatggacctgaacggcgacggacttaccgacgtgacaattggaggtctgggcggagcggctctcttctggagccgtgatgtagccgtggtcaaggtgaccatgaacttcgaaccaaacaaggtcaacatccagaaaaaaaattgccacatggaaggaaaggaaactgtctgtattaacgctacagtgtgcttcgatgttaaactgaagagcaaggaggacacaatttacgaggccgatctgcagtacagggtgaccttagattcattacggcagatttcacggtcattctttagcgggacccaagagcgaaaggtccagaggaatatcactgtccggaaaagcgagtgtactaagcacagtttttatatgttggataagcacgattttcaagattccgtgaggataaccttggattttaacctgactgaccctgaaaatggtccagtattggacgactcattgcccaacagcgtccacgagtacatcccctttgcgaaggattgcgggaataaagaaaagtgcatctccgatttatccctgcatgttgccaccactgaaaaggacctccttattgtacgctcccagaacgataaattcaatgtgagtctaaccgtcaagaacacaaaagactccgcctacaatactagaactatcgtgcattactctccaaacctcgtctttagtggcatagaagccatccaaaaagattcttgtgagtccaatcacaacattacgtgtaaagtcggttatccgttcctgaggagaggcgagatggtgacttttaaaatcctgtttcaattcaacacatcttatctgatggagaatgtgaccatctacctgtctgcgaccagcgacagtgaagagcctcctgagacattaagtgataacgtggtgaacatttcaataccagtgaagtacgaagtagggctgcagttctactcatcagccagcgagtaccacatctccattgcagctaacgaaacagtgcccgaagtgatcaactccacagaagatataggaaatgagattaatattttctacttaattcgaaagtctgggtccttcccaatgcctgaactgaaactgagcatctcattccccaacatgacctccaacggttaccccgtgctgtatccaaccggtctgtcctcctcagaaaacgccaattgtagaccgcacatctttgaggatccatttagcatcaattcgggcaagaagatgactaccagcacagaccatctgaagagggggactattctggactgcaacacctgtaagtttgcaacgatcacctgtaacctgactagctcagatatcagtcaggtaaacgtatctctcattctgtggaaacccacgttcataaagtcctacttttcctccctcaatctgacaatccggggtgaactgaggtccgagaacgcgtcgctggtgctgtcctctagcaaccagaagcgcgaacttgccatccagatcagtaaagatggtctccccgggcgggtgcccctgtgggtgatcctcctgtctgcctttgccggattgctcctcctgatgctcttgatattggcgttatggaaaatcgggttctttaaaaggcccctgaagaagaagatggagaagtag

SEQ ID NO: 120754 - DNA, 3567 bp, Artificial Sequence
  Description of Artificial Sequence: Synthetic coding sequence
atggacctgcctaggggcctagtggtagcgtgggcactatcactgtggccaggctttacggatactttcaacatggatacaagaaaaccccgcgtgatccccggtagcaggaccgctttcttcgggtataccgtgcaacagcacgacatctcaggaaataagtggcttgttgtcggcgcccccctggaaacaaatgggtaccagaaaacaggcgacgtgtacaagtgtcctgtgattcacggaaattgtaccaagctcaatctggggcgcgtgactctttctaatgtgagcgaaaggaaggataacatgcggctcggactcagtctggcgaccaatcccaaagacaacagttttctagcctgctcccctctatggtcccatgagtgcggaagctcttactacacaacgggtatgtgctctcgagtcaacagcaatttccgatttagcaaaaccgtggcacctgcgctgcaaaggtgccaaacttatatggatattgttatcgtgttggacgggtccaattctatatatccgtgggtcgaagtacagcattttttgatcaacattctaaaaaagttttatataggtcccggccagattcaggtaggagtggtgcaatatggcgaggatgtagttcatgaattccaccttaacgattacaggagcgtgaaggacgtggtggaggcagcatctcacatcgagcaacgcggggggaccgagacgcggaccgcgttcggcatcgagtttgcccgatcagaggcctttcagaaaggcggccgcaagggagctaagaaggtgatgatcgtaataacagatggagagtctcacgactcgccggatctggagaaagtgatccagcagagtgaaagagataacgttacccgctatgctgttgccgtcctcgggtattacaaccgccggggtattaatcccgagacctttcttaatgaaatcaagtatattgccagtgacccagatgataaacattttttcaatgtaacggatgaggctgccttgaaggacattgtggatgcactgggtgatcgcattttttctctggagggcactaataaaaatgagacatccttcggactcgagatgtctcagacggggttttcttcacacgtggtcgaggacggagtgcttcttggggcagtgggcgcctacgattggaacggggctgtgttaaaggagaccagcgctggcaaggtgattcccctcagagaatcatatctgaaggagttcccagaggaactgaagaatcacggagcctatcttggttatacagtaacttcagtagtctcttctaggcaaggccgagtttacgtcgccggcgcccctcgttttaaccacacaggcaaggtcattttatttactatgcacaacaatagatctctaaccattcatcaggcaatgcggggccagcaaatcggatcctattttggttcagagattacttctgtggatattgacggagatggagttaccgacgtcctcttggtcggcgcacctatgtacttcaacgaggggcgagagcgaggtaaggtgtacgtatacgagttgcgacagaacctttttgtgtataatggcacacttaaggactctcactcataccagaacgcccggttcggtagtagcatagccagcgtcagagatctcaaccaggactcctataacgatgtagtcgtgggagccccgctggaggacaatcacgccggcgcaatctacatctttcacgggtttcgcgggtctatcctgaagacaccaaaacaacgcattactgcaagcgaactcgctaccggcctccagtatttcggctgcagcatccacggacaactcgatttgaacgaggatggactgattgaccttgccgtgggcgcattaggcaacgctgttatcttatggtcccgcccggtagttcagatcaacgcatctctgcactttgagccttctaaaatcaacatatttcatagagactgcaagagatccggaagggacgccacctgcctcgccgccttcctttgttttacccccatctttctggcgccacactttcagacaacgacagttggtatccgctataatgccacgatggacgaacggcgttataccccacgggcccacctggatgaaggaggcgacagattcaccaatcgcgcagtcctgctgagctctggacaagaactttgtgagagaatcaacttccatgttttggacactgccgactatgttaagcctgttacgttttcagtggagtatagcttagaggatccagaccacggacctatgctggacgatgggtggccaaccacgctgcgggtgtcggttcccttctggaatggctgcaacgaggatgagcattgcgttccagatcttgtcctggatgctaggtcagacctgcccacagcgatggaatattgccagagggtgctacgcaaacctgcccaggattgctcggcctatacgcttagctttgatacgaccgtctttattatcgaaagtacacgacaaagggtcgcagtggaagccacactcgaaaaccggggtgagaatgcttatagcacagttctgaacatttcccaatctgccaacctacagtttgcctccctcattcagaaagaggacagtgatggttccatcgaatgcgtgaacgaagagagaagacttcaaaaacaggtttgtaatgtctcttaccctttctttagagccaaggcgaaagttgcctttcgccttgatttcgaattctccaagtccatattcctccaccacctggaaatagaactggccgcggggagcgatagtaacgagcgggacagtacgaaagaagataacgttgctccgcttcgatttcaccttaagtatgaggcggatgtgctgttcacacggagctccagcctgtcacattatgaagtaaagcccaatagttccctggaacgttatgatggtattggcccgccttttagttgtatatttaggatacagaaccttggcctctttcctatccatggaatgatgatgaagatcactatccctattgctaccagatctggtaatcgtctactgaagctaagagactttcttaccgacgaggcgaataccagctgcaatatctggggcaactccaccgagtatcggccaacgccagtggaggaggacttaagaagggccccccagctcaatcatagcaactctgatgttgttagcatcaactgcaatatacgtctcgtgcccaatcaggagatcaatttccacctgttggggaacctctggctgcgaagtttgaaggcactgaagtataaatcgatgaagatcatggtcaacgcagctttgcaaagacagtttcactcccccttcatctttcgggaagaagacccttcgcgacagatcgtgttcgaaatcagcaagcaagaggattggcaggttccaatctggatcatagttggatcaaccttgggtggtctgctcctgttagctctgcttgtgctggcgctgtggaagctcggcttcttccggagcgccaggagacgaagagaacctggactggacccaacgccaaaggtcttggaatag

SEQ ID NO: 120755 - DNA, 3570 bp, Artificial Sequence
  Description of Artificial Sequence: Synthetic coding sequence
atggatttacccaggggcctggtggtagcctgggcactgtcgctgtggcccggatttacagatacctttaatatggatacccggaaaccacgcgtgattcccgggtctcggactgctttttttggatacacggtccagcaacacgacatctcagggaataaatggcttgttgttggtgcgcccctggaaacgaacggttaccagaagaccggcgacgtctacaaatgcccagtcattcacgggaattgtacgaagctgaatcttggccgggttacgctaagcaacgtcagtgagcggaaggacaatatgcgcctggggttgagtcttgctacaaaccctaaggataattcctttctggcctgtagccccctctggagccatgaatgcggcagttcctactacactaccgggatgtgtagtcgcgtgaactctaactttagatttagtaagaccgtagcacctgctctgcagcggtgtcagacttacatggacattgtaatcgtgctcgacggcagtaactccatttatccctgggtggaggtacagcacttcttgattaacatcttgaagaaattttacataggtccaggccagatccaggtgggtgtagtgcagtacggagaggatgtagtgcatgagttccacctaaacgactatcggtctgttaaagatgtcgtcgaggccgcttctcacatcgaacagaggggaggcaccgaaacccgcaccgcctttggcattgaatttgccaggagtgaagccttccagaaaggcggaaggaagggagcaaaaaaagtcatgatagtgatcactgatggcgagtcacatgactccccagaccttgaaaaggtcatacaacagtccgagcgggacaatgttacacggtatgcggtggcagtcctcggctactataatcgtagaggcatcaatcccgaaacattcctgaacgaaatcaagtacatagcatcagatcccgacgacaaacatttttttaacgtgacagatgaggccgctctgaaagacattgttgacgcgctaggtgataggattttttctttagagggcacaaataagaacgaaacctccttcggactggagatgagtcagaccggcttctcctctcacgtggtggaggatggcgtcttgttaggggccgtcggggcctatgattggaacggagctgtgctgaaggaaacatctgccggcaaagtgatcccccttagggagagctatctgaaagaatttcctgaggagctgaaaaaccatggggcttacctgggatacacagtgacctccgtcgtttcaagtagacagggtcgagtctatgttgctggagctccccgctttaaccacacaggcaaggtgattttgttcacaatgcacaacaaccgatcactgacgatacaccaggcgatgcggggccagcagatcgggagctatttcggctctgaaatcacctccgtagacatcgatggtgacggagttactgacgtgctgctggtgggggcacccatgtacttcaatgaggggagagagcgaggaaaggtttacgtgtacgagcttcgacagaatctgttcgtttataatgggaccctgaaagattctcactcctaccaaaacgccagattcggttcttccatagccagcgtcagggacctcaaccaggattcttacaatgacgtcgtggtgggagcccccctcgaggacaaccatgccggcgctatctacatcttccacggattcagggggagtatcttaaagaccccaaagcagcggataaccgcaagcgagttggctactggactgcagtattttggctgtagcatccacggacagctagacctcaacgaggatggccttatagacctggccgtgggtgcactgggcaacgctgtcatcctttggtcacgcccagtagtccagattaatgcaagtctgcacttcgagccgagcaagatcaatatctttcatcgcgactgtaaaaggtcgggccgggatgcaacatgtcttgcagctttcctatgctttactcccattttcctcgccccccacttccagactacgacagtgggcatccgatacaatgcgacaatggacgagcgcagatacacgccccgcgctcaccttgacgagggcggggatcgattcacaaacagagcagtcctgctttcctccgggcaggaactatgcgaacgcattaattttcatgtacttgataccgctgattatgtgaaaccagtgacattctctgttgaatactctctagaggatcctgaccacggtccaatgctcgacgatgggtggcctacgacactgagagtgtctgtccctttctggaacggatgcaatgaagatgagcactgcgtgcctgacctcgtgctcgacgctcggagtgacctgcccactgctatggagtactgccagcgtgtgttgcgtaaacccgctcaagactgctctgcctatacactttcatttgacacaaccgtgtttatcatcgagagcacccgacagcgtgttgccgtcgaagccacactggaaaataggggagaaaatgcttattccaccgttctcaacattagccagagtgccaacttacagtttgccagcttgatccagaaggaagacagtgatggctcaatcgagtgtgtcaacgaggagcgacggctccagaaacaagtctgcaatgtaagctaccctttttttagggcaaaggcaaaggtggcattccggcttgacttcgagtttagcaaaagtatatttttacaccatttggaaatagagctggccgccgggtctgattccaatgagagagatagtactaaagaagataatgtcgctccgctgcggttccatctgaaatacgaggccgacgtgttgtttacccgctcaagctcattgtcccactatgaagttaagcccaacagcagtctggaaagatacgatggtatcgggcccccctttagctgcatcttccggattcagaacctaggactgtttcccatccatggcatgatgatgaagattaccattccaattgcaactcgaagcgggaacaggctgctcaagctccgtgatttcctgacggatgaagtggccaatacatcgtgcaatatttggggaaatagtactgaatatcggcccacgcctgtggaggaagatctgagaagagcgcctcagttaaaccatagcaactcagatgtggtgtccatcaattgtaacatccgcctcgtccctaatcaggaaattaatttccacctgctggggaacttatggttaagatcgttgaaagcccttaaatataaatctatgaaaatcatggtgaacgctgccctgcagcggcagtttcatagtcctttcatctttcgtgaggaggaccccagccggcagatcgtctttgaaatctccaagcaggaggactggcaagtaccaatttggatcatcgtggggagtaccctaggcggtctgctgttgttggccttgctggtgctcgccctttggaaactgggcttctttcggagcgctcggagaagacgagaacctggcctggatccaacgcctaaggtcctggagtag

SEQ ID NO: 120756 - DNA, 2472 bp, Artificial Sequence
  Description of Artificial Sequence: Synthetic coding sequence
atgtcccagacaggattctccagccatgtggtggaggacggagtcttactgggtgcggtgggggcatatgactggaacggcgccgtgttaaaagagacgtctgccggcaaggtcatcccgctgcgcgagtcctatctgaaggaattccctgaggaactcaaaaaccacggtgcctatctgggatacacggttaccagcgtcgtttcgagccggcagggccgcgtgtacgtggcgggcgcaccgcgctttaaccacactggcaaagtgatcctttttactatgcacaacaacagatccctgacaattcaccaggcaatgagaggtcagcagataggcagctacttcgggtctgagatcacttctgtggatatcgatggagatggtgtgaccgacgtcctactcgtcggagccccaatgtactttaatgagggccgagagcgtggtaaggtttatgtctacgagctccgacagaatctttttgtgtataacggaacactgaaagatagccatagttatcagaatgcacgatttggctcaagtatcgccagcgtccgcgacctgaaccaggacagctacaatgatgtcgtggttggcgcgccactggaggacaaccacgctggcgccatttacatcttccatggatttagaggatccatcctcaaaacccctaagcaaaggatcactgcttctgagttagccaccggcttgcagtacttcggatgctctatccatgggcaattggatctgaacgaggatggcctgatcgacctcgcagttggggcactaggtaacgccgtcattttgtggagtcgtcccgtggtgcagattaatgcttcattgcactttgagccatcgaaaatcaacatcttccacagagattgcaaacggagcgggcgagatgctacgtgtctggctgcctttctctgcttcactcctatcttcctggccccccactttcagactacgacagtgggcattagatacaatgctactatggatgaacgacgatacactccgagggcacacctagatgaaggcggcgatagatttaccaatcgagctgtcttgctttctagcggtcaggagctctgcgaacggatcaacttccacgtccttgacactgcagattacgtgaagcccgtgacattttctgtggagtactcactcgaggaccctgaccacggacccatgcttgacgacggatggcctaccaccctgcgggtcagcgtccctttctggaacggatgtaacgaagatgagcactgtgttcccgatctggttttggacgctcgtagcgatctacctaccgccatggagtactgtcagagagtgttacggaagccagcccaggactgtagtgcatataccctgagctttgataccacagtgtttattattgaaagtacaagacaacgagtcgcagtggaggccactctggaaaatagaggagagaatgcatactctaccgtactcaatatcagccaatccgccaacttgcagttcgcctctctgatccaaaaggaagatagtgacggctctatcgagtgcgtcaacgaagaaagacgtctccaaaaacaagtgtgcaatgtatcctatccctttttcagggcaaaagccaaagtggcgtttaggttagacttcgaattctccaagtcaatctttctgcatcatctagaaatcgaattggccgccggatccgatagcaacgagagggactctacaaaggaagataatgtggccccactgcgatttcatctgaagtacgaggccgatgttctgttcaccaggagcagctctctatcccactatgaagtgaaacctaattccagcttggagaggtatgatggtatcggccccccattctcttgcatctttcgcatccaaaatctgggcctgttccccatccacggaatgatgatgaagataaccatcccgatcgcaacaaggtcgggaaatcggctgctgaaactccgtgactttctcaccgatgaggcaaatacatcttgcaacatctggggcaattccactgaatacaggcccacaccagttgaagaggatctacggcgggcccctcagctgaatcacagtaattcagatgtcgttagcataaattgcaatattcgccttgtgcctaaccaggagatcaacttccatctgctgggaaatctgtggctacggtctcttaaggcactgaagtacaagtctatgaaaatcatggtgaatgcggccctccaacgtcagttccattctcccttcatatttcgagaggaagacccctctcggcagattgtctttgagatttctaaacaggaagattggcaggtccctatatggatcatagtaggatcaacgctgggtggactgcttctgctggccctgctggttctggccctgtggaagctgggctttttcaggtccgctaggaggcgtcgcgagcccggcctggaccctacccctaaagtactggaatag

SEQ ID NO: 120757 - DNA, 1953 bp, Artificial Sequence
  Description of Artificial Sequence: Synthetic coding sequence
atggatctccctagaggtctggtggttgcctgggctctgagtctctggccaggattcacagatacattcaatatggataccaggaagccgagggtgatcccagggtcccggaccgcctttttcggttatacggtgcagcagcacgatatctctggcaataaatggttggtggtgggcgctccgctggaaactaatggttaccagaaaactggtgatgtctacaaatgcccagtcatccacggaaattgcaccaagctcaatctgggaagggtcaccttgtccaacgtctccgagagaaaggacaatatgaggctggggctgagcctcgccacaaaccctaaggataactcttttctagcctgcagcccactgtggagccatgagtgcggctcatcttactataccacagggatgtgcagtcgtgtcaattcaaatttccggttctctaagaccgttgccccggcactccagaggtgccaaacctacatggatatcgtcatcgtcctagacgggtctaatagtatttatccatgggttgaagtgcagcactttttgatcaatatcttaaaaaagttctacattggtcctgggcagatacaggtaggagtagtgcagtatggagaggatgtggtgcacgagtttcatctaaatgattaccggagcgtgaaggacgtggtggaggcagcctcccacatcgagcagcgtggtgggacagagacccgcacggccttcggtatcgagtttgctcgctccgaggctttccagaagggtggacggaaaggcgcaaagaaggtcatgatagtgataaccgatggcgaaagtcacgattcaccagatcttgagaaggtcattcagcagtccgaaagggacaatgtgacccgctacgcggttgccgttttgggttattacaatcgacgaggtattaatcctgaaaccttcctcaacgagatcaaatacatagcatctgatcctgacgataaacatttcttcaatgtgaccgacgaggcagcactaaaagacatcgtggacgccctgggcgatcgtattttcagcctggagggaacaaacaagaatgagaccagctttggcctcgagatgtcccagacgggcttcagtagccatgtagtcgaagatggagtgctgctcggggccgtcggagcttatgattggaacggagcagtgcttaaggagacaagcgcgggtaaagtcataccattgcgcgagagctacctgaaggaattcccggaagaactaaagaaccacggtgcatacctggggtacactgtcacaagcgtggttagcagtaggcaaggccgagtgtacgtggccggggcaccacgctttaatcacacaggcaaggtcattctcttcacaatgcataacaataggagcctgactatacaccaggcaatgcgcgggcaacagatcggttcctattttggctctgagataacgtctgtagatatcgacggcgatggtgtaacagatgttctcttggtgggcgctcccatgtactttaatgaaggaagggaacgaggcaaggtctacgtgtacgagttacgacagaatctctttgtgtacaacgggactcttaaagactcacactcctatcagaacgctaggttcgggtcctcaatcgcatcagtgagagatctgaatcaagactcttacaacgacgtagtagtgggcgcaccgctggaggacaatcacgccggcgctatctatatcttccacggttttcgcggtagcattctgaaaacaccaaagcagcggatcacagcgtccgagctggccacagggttgcaatattttggctgttccattcacggccaactggatctgaatgaggacggcttaatcgacctggcagtgggtgcccttggcaatgcagttattctctggaccccccccccaaaatgttggtccgaggcccccgaggagacattgagttag

SEQ ID NO: 120758 - DNA, 3546 bp, Artificial Sequence
  Description of Artificial Sequence: Synthetic coding sequence
atgggcccagagcgaaccggtgctgccccactgcccctgttgctggtgcttgccctgtcccagggcatactgaactgttgtttggcttataatgtgggactgcccgaggccaagatcttttctgggccctcctccgagcagtttggatacgcggtccaacagttcataaaccctaagggaaattggttactggtcggaagcccgtggagtgggttcccggagaaccggatgggcgatgtttacaaatgccctgttgatctgtcgaccgcaacctgtgaaaagctcaatttgcagacatctaccagtattcctaatgttaccgagatgaagactaatatgagtctcggcctgattcttaccaggaatatgggaaccggcggttttctcacgtgtggccccctctgggcacagcagtgtggtaaccagtattatacaaccggagtctgtagcgacatctcccccgacttccaactgagcgctagcttttcaccagctacccaaccctgcccctctctcatcgatgtggtggttgtctgtgatgagtccaactcaatctacccatgggatgccgtaaagaatttccttgagaagttcgtacaggggttggatatcgggccaaccaagacccaggtgggtttaatccagtacgccaacaacccccgggtggtttttaatctaaacacatacaaaacaaaagaggagatgatagtagccaccagtcagacgagccaatatggcggagatttgaccaacaccttcggcgccattcagtacgcccgtaagtatgcctactccgcggctagcggcgggaggcggtccgctacaaaggtgatggtggtagttacggatggagagagccatgatggatcaatgctcaaagctgtaatagatcagtgcaaccatgacaacatcctcagattcggtattgcagtcctcggctatctgaaccggaacgcgctcgacacaaagaacctgatcaaagaaataaaagcaatcgccagtatccctaccgaacgctatttctttaacgtgtcagacgaagccgccctccttgaaaaggccggcacactgggcgagcagattttctctattgaggggaccgtacaggggggtgataactttcagatggaaatgtcccaggttgggtttagtgccgactactcaagccagaatgacatcctgatgcttggggccgtaggagcgttcgggtggagtggcaccatcgtgcagaagacttctcatggacatcttattttccccaagcaggcttttgatcagatcctacaggataggaatcactccagttacttaggctacagtgttgcggccatctcaacaggggagagcacacatttcgtggccggtgcaccacgcgccaattatacgggtcagatcgtgttatatagcgtaaatgagaacggcaacataaccgtgatccaggcccaccggggggaccagatcggctcctacttcggttccgtcctatgttcggtggatgtcgacaaagatactattaccgacgtgctgctggtaggcgcccccatgtatatgtcagacctgaaaaaagaagaaggtcgtgtgtacctatttactattaaagaagggatcctcggccagcatcagttcctggaggggcctgaaggtatcgaaaacacccgctttggatcagccatcgcggctctgagcgatatcaatatggacggcttcaacgacgttatcgtcgggagccctttagaaaatcagaacagcggggctgtctatatctacaacgggcaccagggtactatcaggaccaaatactctcaaaagattttgggttctgacggagcctttagatctcatctgcaatatttcggaaggtctctggacggatacggcgacttgaacggggatagcatcaccgatgtttctataggagcattcggtcaagttgtgcagctctggtctcagtccatcgcagacgtggccatcgaggcctcttttacacctgaaaagataaccctggtgaacaaaaacgcccagattatcctgaagctttgcttcagcgctaaattccggcctacgaaacagaataaccaggtggcgatcgtttacaatattaccctggacgccgatggcttttcatcacgcgtcacatccagagggctgtttaaagaaaacaatgagaggtgtttacagaagaacatggtcgtgaatcaggcgcagtcctgcccagaacatataatctacatacaggaaccaagtgatgtcgtgaactctttggacctgcgggtggatatcagcctcgagaatcctggaaccagccccgcgctggaagcatattctgagacagcaaaggttttttcaatccccttccataaggattgtggagaggacgggttatgcatctcagacctggtcttagacgtcagacagattcccgcagcgcaagagcagcccttcattgtgtctaatcaaaacaaacgcctgacattcagcgtgacactcaagaacaaacgtgagtctgcctacaatactgggattgtggtcgacttctccgaaaacctcttctttgctagctttagtctgcccgtggatggtacagaggtaacatgccaagtcgccgcttcacaaaaaagtgtggcctgcgacgtcggatacccagcattgaagcgagaacagcaggtgacgtttaccatcaactttgacttcaacctgcagaatctgcagaaccaggccagtcttagcttccaggccctctcggagtcccaggaggaaaataaggccgacaaccttgtgaatcttaaaatccccctgctttatgatgcagaaattcatctgaccagatcaaccaatattaacttctacgagatctcttctgatggaaacgtgccaagcattgtccactccttcgaagacgtcgggcccaaatttattttctccctcaaagtgaccacaggctctgtccctgtgagcatggccactgtgataatccacatcccccagtacaccaaagaaaagaatccactcatgtacctgacgggagtgcagactgacaaagcaggggacatttcctgtaacgcagatatcaaccccttgaagattgggcagacaagcagttcagttagcttcaagtccgaaaattttagacacacaaaagagctgaattgtcgcacagctagttgctccaatgtgacatgttggctcaaggacgtgcacatgaagggcgagtactttgttaacgtcactactaggatttggaacggcactttcgccagttcaacctttcaaacagtgcaattaacagcggccgctgagatcaacacctataacccagagatctacgtcatcgaggacaacactgtcacaatccccctgatgatcatgaaaccagatgaaaaggccgaagtgcctacaggcgtcattattggtagtatcattgccggtattctgctccttctggccctggttgcgatcctctggaagctggggttctttaagaggaaatatgagaaaatgacaaagaaccccgatgagatcgacgaaacaactgagctttcatcctag

SEQ ID NO: 120759 - DNA, 2448 bp, Artificial Sequence
  Description of Artificial Sequence: Synthetic coding sequence
atgggacccgagcggaccggagcggctccgctacctctccttctggtgctcgctctgagccagggcatcctgaactgttgtctggcctacaatgtcggactacccgaagccaagatcttctctggcccttccagtgaacagtttggatatgcagtccagcagttcatcaatcccaaggggaattggctgctggtgggaagtccctggagcggatttcccgagaaccgtatgggcgacgtgtataaatgcccagtggatctgtctaccgccacatgtgagaaattgaatctgcaaacgtccacaagtatcccaaacgtcactgaaatgaagacaaacatgtcgctaggactaatcctgacaagaaatatggggaccggcgggtttctgacatgcggaccgctatgggctcagcagtgcggcaaccagtattacacaaccggtgtgtgcagtgatatatccccagattttcagctatcagccagtttctcccccgcaacacagccctgcccttctctcatcgacgtagtggtcgtgtgtgatgaaagtaacagtatctatccctgggacgctgtcaaaaatttcctggagaagttcgtacagggtcttgacatcgggccaaccaaaacccaagtcgggttgattcagtatgctaataaccccagggtcgtgtttaatctaaatacctacaagactaaggaagagatgattgtcgctaccagccagacgtcacaatacggcggcgatttgactaatactttcggtgctatccagtacgccaggaagtatgcttattctgctgcttcaggtggtcgcaggagtgccaccaaggtcatggtggtagtgactgatggtgagagccacgatggaagcatgctgaaggcagtaattgatcaatgtaatcatgacaacatcctgcggtttgggatagccgtcctcggctatcttaatagaaacgccctcgacaccaagaacctgataaaggagattaaagctatcgcttctatccccacagaacggtatttctttaatgtgtcagacgaggccgctctgctcgagaaggcagggaccttgggcgaacagatattttctatagagggaacggtgcaaggaggcgacaacttccaaatggagatgtcccaggtcggctttagcgccgactacagcagccagaacgacatcctcatgctcggggctgtgggggctttcggctggtcgggcaccatagtgcagaaaacctcccacgggcatttaatcttccctaaacaggcctttgaccaaatcctccaggatcggaaccactcaagctaccttggatactcagtcgctgcaattagcacaggggagtcaactcactttgtggccggcgcaccccgcgctaattacactggtcagatagttctgtactccgttaatgaaaatgggaacataactgtgatccaggctcatcgcggtgatcaaattggctcatattttggaagcgtcctttgcagcgtcgatgtggacaaggacacgattacagacgtgttgctggttggagctcccatgtatatgagcgatcttaaaaaggaggaaggacgggtgtatctgtttaccatcaaagaagggatcttagggcaacaccaatttcttgagggccctgaaggcatagaaaacactagatttggctcagcgattgccgccctgagcgacatcaacatggacggatttaacgatgtgatcgttggcagtcccctggagaatcaaaattctggagcggtgtatatatataacggtcaccagggtaccatcaggactaaatattcccagaagatcctgggttcagatggggcgttcaggtcgcatcttcagtatttcgggcgtagcctggacggatacggcgacctgaacggtgactctattactgacgtgtcgataggcgcttttggacaggtcgtgcaactgtggagtcaatccattgctgatgttgcaattgaggcgtcctttacgcctgaaaaaatcaccctggtgaacaaaaacgctcagatcatactcaagctgtgtttctccgctaaatttcgtcctaccaaacagaataatcaggtggcaatcgtctataacattactctggatgcggatggtttctcctctcgggttacgtcccggggattatttaaagaaaacaatgaacggtgcctgcaaaagaacatggtggtgaatcaggcccagtcttgtccggagcacattatctatatacaggagccgtctgatgtggtcaattctttagacctgcgcgtggacatcagtcttgagaaccctggtacatcccctgccctggaagcgtatagcgagacagccaaggtgttttccatccccttccataaggattgtggtgaagatgggttgtgtatctcagacctggtgctagatgtcaggcagattcctgccgcacaactcatgggacagaagtag

SEQ ID NO: 120760 - DNA, 1926 bp, Artificial Sequence
  Description of Artificial Sequence: Synthetic coding sequence
atggggcctgagagaactggcgccgcacccctgcccctcctcctggtgctcgcgctgtcccagggcatcctgaactgctgtttggcctataatgtaggcctgccggaagctaagatcttcagtggacccagcagcgagcaattcggatatgcagtgcagcagtttataaaccccaagggcaactggctcctggtcgggtcgccttggtcaggtttcccagaaaatagaatgggggatgtgtataagtgtcctgtggacctgagtactgccacctgcgagaagctcaacctgcagaccagcacctctatccctaatgtaaccgaaatgaagaccaacatgagcctcggactgattctcacccggaatatgggaacaggaggcttcctgacttgcggccccctgtgggcccagcagtgtggtaatcagtactatacgaccggcgtgtgctccgatatttcacctgactttcagctcagcgcatcattttcacctgctacacagccatgtccctctctgatcgacgtagtggttgtgtgtgatgaatccaattctatttatccgtgggacgccgtgaaaaacttcctcgagaaattcgtgcagggcctggacattggacccacaaaaacacaggtgggtctgatccagtatgccaacaatcctagggttgtctttaacctgaacacctacaaaactaaggaggaaatgattgttgcgacatcccagactagtcagtacgggggcgacctgactaacacattcggagccattcagtacgccagaaagtacgcatactcagctgcaagtgggggacggcgcagtgccaccaaagtgatggtggtggtgaccgatggagagtctcacgatggcagtatgcttaaggccgtaatcgatcaatgcaaccacgacaacatcctcagatttgggatcgctgtcctgggctacctcaataggaacgccctggacacaaaaaatctcattaaggaaatcaaagccatcgcgtccatccctaccgaaagatatttcttcaatgtatcagacgaggcagccctgttggaaaaagccggtaccctaggtgagcagatcttctccattgagggaacagtccaaggaggagataacttccagatggaaatgagtcaggtgggattctccgcagactactctagtcaaaacgatattttaatgctaggagccgtcggggcattcggctggtctggcacaattgttcagaagacaagccacggtcatctcatttttccaaagcaggcatttgaccagattctgcaggaccgcaatcatagctcatatttaggctacagcgtggctgccatctcaaccggagagagcactcacttcgtggctggggcccccagagcaaactataccggccaaatcgtgctctattcagtgaacgagaatgggaacatcaccgttattcaggcacacagaggtgatcagatcggctcttactttggctccgttctttgcagcgtcgacgtagataaagacactattacggatgtgctacttgtgggggctccaatgtacatgagtgacctgaagaaagaggaaggaagagtctacctttttacaataaaagagggcattctaggccaacaccagtttctcgagggcccagagggcattgagaatacacgattcggatccgctattgccgctctgagcgatatcaatatggatgggttcaatgacgtgattgtgggatctcccctagagaaccagaactcgggcgcggtgtacatttacaacgggcaccaggggacaatacggaccaagtactctcagttgctgtgcacaataataagttgtcagacctgctcttttcgaaaatcatgggacccgatggaacccctgggagccatttcatccacccttggcgggccgtggatggctatggagatctag

SEQ ID NO: 120761 - DNA, 2829 bp, Artificial Sequence
  Description of Artificial Sequence: Synthetic coding sequence
atgggacctgaaaggactggcgctgcccctctcccccttctacttgtgttagccctgagtcagggaattctgaattgttgcttggcctataacgtgggcctacctgaggccaagatattctcggggccaagctccgaacaattcgggtatgcagttcagcagttcattaatcctaaaggaaactggctcctggttggctccccgtggtctgggttccctgagaaccgaatgggcgacgtgtataagtgtcctgtggacctgtcaactgctacctgtgagaagctaaatctgcagacgtccacctccattcccaacgtcacagagatgaagactaacatgagcttgggcctaattctcactaggaatatgggaactggaggattcctgacttgcggacccctctgggcacaacagtgcggtaaccagtactacactaccggggtctgttctgacatttctcccgactttcaactatctgccagcttctcaccggctacacagccttgcccaagcttgattgatgtggtggtggtttgtgacgaatccaatagtatttatccatgggacgcagtcaaaaactttctggagaaattcgtgcagggtctagacattgggcccaccaagacacaggtcggactgatccagtacgcaaataatccaagagtagtctttaatttgaatacctacaagactaaagaagagatgatagtggctacatctcagacctcacagtatggcggtgatctgaccaacacgtttggcgcaatccagtacgcacggaagtatgcatatagcgccgccagcggagggcggcggagtgccacgaaggtcatggttgttgtgaccgacggggagtcccacgacgggtctatgctaaaagctgtaatcgatcaatgtaaccatgataacatcctgaggttcggtatcgcagttttgggctatttgaatcgcaacgccctggatacaaagaacttgattaaagagatcaaagcaatcgcgtccatccccacagagaggtatttttttaatgtgagcgatgaagccgcattgttggaaaaagccggaacacttggggaacaaattttctccatcgaggggaccgttcagggcggcgataattttcaaatggaaatgtcccaagttgggtttagtgcagattacagttcccagaacgatattctcatgctgggagctgtgggagcgtttggctggagtggcacaattgtccaaaagacttcacacggccatctgatcttccctaagcaggcctttgaccagatcttacaggacagaaaccacagttcgtacctcggctatagtgtggccgccatctctacaggcgaaagtacacactttgtagccggagctccgagagctaattacaccgggcagatcgtgctttactctgtcaacgaaaatggaaacattacggtcattcaagcccacagaggggatcagataggcagttactttggaagcgtgctgtgcagcgttgatgtcgataaggacactatcacagacgtgttgctggtgggcgccccaatgtatatgagcgaccttaagaaagaagagggcagagtttacttgtttaccattaaagaagggattctgggtcagcatcaattcctggaaggaccggaaggtatcgaaaacacgagattcggatcggctatcgccgctctctctgacattaacatggacggctttaacgacgtgatcgtcggctcccccctggagaatcagaatagtggagccgtctatatctataacggccatcaggggaccatccgaacaaaatactctcaaaaaatcctgggatccgatggtgccttcaggagtcatctgcagtatttcgggcgcagtctggacggatacggcgacttaaacggtgattctatcacagatgtgtccattggcgcttttggacaggtagttcagctgtggtcacagtcaatcgctgatgtagccatcgaggccagcttcacgcctgaaaagatcacgctcgtcaacaaaaatgctcaaatcattttgaagctgtgtttcagcgccaaatttcggcctaccaaacagaacaaccaggttgctatcgtttataacattactttagatgccgacggattcagcagcagagttacctcccgaggtctcttcaaggaaaataatgagcggtgcttgcaaaagaatatggtggtgaatcaggcccagtcatgtcccgaacacataatttatatccaggaaccaagtgacgtggtgaattcacttgatctgagggtcgatatcagcttagagaacccaggaacctcacccgcgttggaggcttatagcgagactgcaaaggtgttttctattccattccataaagactgcggcgaagacggcctttgcatttctgatctcgtgctggatgtaagacagattccagctgcgcaggagcagcccttcatcgtgtcgaaccaaaacaaaaggctgactttttcagttacgctgaaaaataagcgggagtccgcatacaatacagggatcgtcgtggacttctccgagaaccttttcttcgctagttttagcctcccagttgacggcaccgaagtgacatgtcaggtcgctgccagccagaagtccgtggcctgcgatgtgggctacccagcccttaagagagagcagcaggtgacatttaccattaactttgatttcaatctgcagaacttgcaaaatcaggcaagtctgagttttcaagccctgagcgaaagccaggaagaaaacaaggcagacaatctggtgaatctcaagatcccccttctgtacgatgcagaaattcacctaactaggtag

SEQ ID NO: 120762 - DNA, 3120 bp, Artificial Sequence
  Description of Artificial Sequence: Synthetic coding sequence
atggctagagcactgtgcccactgcaggcgttgtggctcctagagtgggttctgctcctgttaggcccatgcgccgcccctcctgcgtgggccttgaacctcgaccccgtccaactgaccttctatgccgggccaaatgggtcacagttcggtttcagcctagacttccataaagacagtcacgggcgtgtggccatcgtggtgggagcgcctcgaaccctgggcccgtcccaggaggaaacaggaggagtgtttctatgtccttggcgcgctgagggcggtcaatgtcctagtcttctctttgacctaagggatgagacaaggaacgtggggagtcaaaccctacagaccttcaaggcaaggcaggggcttggcgcctctgtcgtttcttggtctgacgtgatcgtggcttgtgcgccctggcagcactggaatgtgctggaaaaaacagaagaagctgagaaaacacccgtcggatcctgcttcctcgcacagcccgaaagcggcaggagagctgaatatagtccatgcagaggtaacactctgagccgcatttacgtcgagaacgacttcagctgggacaagcgatactgcgaggctggtttctcttccgtcgtcacgcaggctggtgaactagtgcttggtgcccctgggggctactacttcctgggccttctggctcaggcccccgtagcagacatcttcagctcataccgcccgggaattctgctttggcatgtcagtagccagagcttgagtttcgatagttccaatcctgagtattttgacggatactgggggtatagcgtggcagttggagaatttgacggcgatctgaatactaccgaatatgtcgtcggagcgcccacctggtcctggactctgggagcagttgaaatcctcgatagctattaccagcggttacaccgattgcggggggagcagatggcaagttacttcggacattcagtcgcagtgacagatgtgaacggcgacgggagacacgacttactggtcggagcccccttgtacatggagtcacgagcagaccgcaaactggccgaagtaggacgggtatacctattcctccagccgagaggtccgcacgcgcttggtgccccctcattgttgctaacaggtacgcaactgtacggccgtttcggtagcgcaatagcccctcttggtgacttggaccgggacggttacaatgatatcgccgttgcagctccctacggcggaccgtccggacgcggacaggtacttgttttcctggggcagtcagaggggctgcgctctagaccatctcaggtgctcgacagccctttccccacgggcagcgcattcggcttctccctcagaggcgccgtggacattgacgacaacgggtaccctgatctgatcgtgggagcttacggcgccaatcaagtcgccgtctaccgggctcagcctgtcgttaaagcatctgtccagctcctggtacaggatagtctgaaccccgccgtgaagtcatgcgtgctccctcagactaagaccccagtgtcctgttttaacatacagatgtgcgtgggtgccacgggccataatatcccacaaaaactgtctttaaacgctgaacttcagcttgaccgtcagaaacctcgccagggccggagagtgcttctgttgggcagccagcaggccggcactaccctcaacctcgatctgggcggcaaacactcccccatttgccataccaccatggcattcctgagagacgaggccgatttccgtgacaaactgagtcccatcgtgctcagcctaaatgtgtccctcccacctacagaggcgggcatggcgccagccgtggttctccacggagacactcatgtccaggagcagacgaggatcgtgttagactgtggagaagacgatgtgtgtgtcccccaacttcaattgacagccagcgtgactgggtccccacttcttgtcggtgccgataacgtactcgaactgcagatggacgccgccaatgagggcgaaggcgcgtacgaggctgaactcgccgtccacctgccccagggggctcactacatgcgtgccctgagcaatgttgagggctttgagagactaatctgtaaccagaaaaaggaaaatgaaacgagagtggtgctgtgcgagctcgggaatcctatgaaaaaaaatgctcagatcggcatcgccatgctggtttctgtgggcaacttggaagaagcgggtgagagcgtgtcgtttcagctgcagattaggagcaagaacagccaaaatcctaattccaagatcgtcctgctggatgtgccggtcagggcggaggcccaggtggaactgcggggcaattcattccctgcaagcctggtcgtggctgctgaggagggcgagagagaacaaaacagcctagattcgtgggggccaaaggtcgagcacacctacgaactgcacaataatgggcccggcactgtcaacggattgcacttgagcatacatctgcccggacagagccagcctagtgatctgctgtatattttggacatccaaccccagggcggtctgcaatgttttccacagccccccgtgaatccactgaaagtggactggggtttgcccattccctccccgtcccctattcaccccgctcatcacaagagggaccgcaggcaaatctttttaccagaaccagaacaaccctctcgactgcaggatcccgttctggtgtcttgcgatagcgctccctgcacagtagtgcagtgtgatctgcaggagatggcgcgcgggcaaagagccatggttactgtcttagcatttctctggctgcccagtctgtatcagagacccctggatcagtttgttctgcagagccatgcttggttcaatgtatcttctctgccctatgcagtgccccctctctctctgccacggggggaggcgcaggtttggacacagctcctccgcgcactggaagagcgtgctatccccatctggtgggtattggttggggtgctcggggggctgctgctactgaccatcctcgtcttggccatgtggaaagttgggttctttaagaggaaccggcccccattagaggaagacgacgaggaaggcgaatag

SEQ ID NO: 120763 - DNA, 3018 bp, Artificial Sequence
  Description of Artificial Sequence: Synthetic coding sequence
atggctcgggccttgtgtcctcttcaggcgctttggttgctcgagtgggttctattattgctcggcccctgcgcagcgccacccgcttgggctttgaatctggatcccgtgcagctgacattttacgccggacctaatggctcacaattcggatttagtcttgactttcacaaagattcacatggtagggttgctatcgttgtcggggcccctagaaccctggggccttctcaggaagagacgggtggcgtgtttctttgtccctggcgggccgagggcggtcagtgtccctctctcctctttgacctgcgggacgagacccgtaatgtgggatcccagacccttcagacttttaaggcaagacagggcctgggggcctccgtcgtctcatggagcgacgtgattgtggcctgtgccccatggcagcactggaacgtgttagaaaagaccgaggaggccgagaagactcctgtggggtcatgctttctagctcaacccgagagcggacgtagggcagagtatagtccctgtcgtggcaataccttatctaggatctacgttgaaaacgatttctcatgggacaagcgttattgtgaggcaggttttagctccgtggtgacgcaggcaggcgagctcgtcctgggagcccccggaggctattatttcctcgggctgctagctcaagccccagtggccgatatcttcagttcatataggcctgggattctattatggcacgttagctcacagtctctttcatttgattcatccaatcctgagtacttcgacggatattgggggtactcggtggccgttggagagtttgacggggacctcaataccactgaatacgtcgtgggcgccccaacttggagctggactctaggggctgtggagatactggatagttactatcagagactccaccgtttgcgcggggaacaaatggcttcatacttcggtcacagtgtcgccgtcacagacgtcaatggtgacggacgccacgatctacttgtgggggcacctctatacatggaatcacgagctgatagaaagcttgcagaagtgggcagggtttaccttttccttcagcctagagggcctcacgccctaggtgctccctcccttctgctgactggtacccagctgtacggccgtttcgggtctgccatagccccattgggtgacttagaccgcgatggctataacgatattgcagtggccgcaccatatggtggtccctctgggcgtggccaagttttagtctttctgggccagtccgagggtttgaggtcaagacctagccaggtgctagattctccattcccaaccggaagtgcctttggatttagcctgcgcggggccgttgacatcgatgataacggctaccctgacctgatagtcggggcttacggtgccaatcaggtcgcggtctatcgagcccagcctgtggtcaaggcgtctgtgcagctgcttgtccaggactcactaaaccctgctgtgaagagctgtgtcctcccccaaacaaagacacccgtcagttgctttaatatccagatgtgtgtgggcgctactggccataacatcccccagaagttgtctctgaatgctgaactgcagcttgacaggcagaagcctcgccagggtcgacgagtactcctgctgggcagccagcaggcgggtactaccctgaatctggatttgggcggcaagcattcccccatttgccatactaccatggcttttttgcgagatgaagcggacttcagagataaactgagtccaattgtgctgtccctcaatgtgagtttacctcctaccgaggctggaatggccccggctgtggtattgcacggcgacacacatgtacaggagcagacacggatcgtcctggactgtggggaagacgatgtgtgcgtgcctcaactgcagctcaccgctagcgtcaccggctcacccctgctcgtcggggcggacaacgtgctggagctccagatggatgctgccaacgagggggagggcgcatacgaagccgaactggccgtgcacttgccacagggcgctcactacatgcgcgcgctttccaacgtggaaggatttgagcgtttaatatgcaaccagaagaaggagaatgagaccagggtcgtcctgtgcgagctgggaaacccaatgaagaaaaatgcccagatcgggatcgcaatgctcgtgtcagtgggcaacctcgaagaagccggcgaaagtgtgtccttccagctacagattcgctcaaaaaattcccagaacccaaatagtaaaattgtcctgctcgatgtgcctgtcagagccgaggcacaggtggagctcagaggcaattcattccccgccagcttggtggtagctgccgaagagggcgagcgggagcagaacagtctggactcctggggacccaaagtggaacatacctacgagctacacaacaatggtccgggcactgtgaatggattgcatctctcgatccacctaccgggtcagtcgcagccgagcgatcttctatatatccttgacattcagccccagggcgggcttcagtgctttccgcagccacctgtgaaccccttaaaggtggattggggcctgcccatcccatccccatcacccattcatcccgcgcaccataaaagagataggagacagattttcctgcccgaacctgagcaaccatctagactccaggacccagtgttggtttcttgtgacagcgccccctgcactgtcgttcagtgtgatttacaggaaatggctcggggccagagggccatggtaaccgtcttggcattcttatggctgccaagcttgtaccaggtttggactcagctgttaagggcactggaagaaagggccatacctatatggtgggtccttgttggagtgctgggcggactgctgctcctcaccattctagtgcttgcaatgtggaaagtgggtttcttcaaaaggaatcgaccacctctcgaggaagacgatgaagagggcgaatag

SEQ ID NO: 120764 - DNA, 660 bp, Artificial Sequence
  Description of Artificial Sequence: Synthetic coding sequence
atggcatcttacttcggccacagcgtagctgtgacagacgtaaatggcgatgggaggcacgaccttttagtcggcgccccactttacatggaatctagagctgacagaaagctcgccgaggtcggaagggtttatctgttcctccagcccaggggacctcacgctctcggcgcccctagccttttactaactgggacccaactgtatggaaggttcgggagcgccattgccccccttggagacctcgacagggatggctataacgacatagctgtggccgccccatacgggggcccatcaggtcgcggacaagtccttgtgttccttggtcagtcggagggtctcaggtctagaccatcccaggtgctggacagtcctttcccgactggaagcgcttttggattcagcctgaggggagccgtggacattgatgataacggatatccgggcgccctggactgcctgcaacttgagatgcccaagaagggcccttggacttttgctggctccgccaagcggcacggtcaaggtctcatgccagggctggtctcgcactacggcctgcctgaggggctcggggagacttcttctggcggtggtggtgtgggcaatccttgggaagatgaaatgaggatcccctgcccgaaccggcaattctag

SEQ ID NO: 120765 - DNA, 3201 bp, Artificial Sequence
  Description of Artificial Sequence: Synthetic coding sequence
atgggtcccgggcccagcagagcaccacgtgcccctaggctcatgctctgtgctctggctctgatggtagccgcaggtggttgtgtggtgtcagcgtttaacctcgacacaagattcctcgtggtcaaggaggcgggaaatccgggaagcctgtttggctattcagttgctctgcatcgccaaaccgagagacagcagaggtacctgctgctggccggcgcccctagggaattggcagtcccagatgggtacaccaaccgaaccggcgccgtatatctctgtcccctcaccgcgcataaggatgactgtgaacgcatgaacataactgtcaagaacgatcccggccaccacatcattgaggacatgtggctgggtgtcactgttgcttctcaggggccggccggccgggtgctggtgtgtgcccatcgctatacacaggtcctttggtcagggtcagaagaccagcgccgcatggtaggcaaatgttatgtgcgtggcaatgacttagaactggacagttctgacgactggcagacatatcacaacgagatgtgtaactcaaacaccgactatctggaaacaggaatgtgtcagctaggtacctcgggaggttttactcagaatacagtttactttggagcacccggcgcttataattggaaaggtaattcatatatgattcagaggaaggagtgggacctgtctgagtactcctataaagatccagaagatcagggcaatctttatattggatatacaatgcaggtcggttccttcattctccaccctaagaatattacaattgttaccggggcacctaggcaccgacatatgggggccgtgttcctgctctcgcaggaagcaggcggggatctgaggcggaggcaggttctggagggctcccaggtcggagcctacttcggaagcgccatcgccctcgctgacctgaataatgacggctggcaggatctcctcgtgggtgcaccttactactttgagaggaaagaggaggtcgggggcgccatctatgttttcatgaaccaagctggcacctcgtttccagctcatccatcgcttcttttgcatggaccctcaggctccgcattcggactaagtgtcgctagcattggcgatattaatcaggatggcttccaggacatcgcagtcggggccccttttgaggggctgggcaaagtgtacatctaccactcaagctccaagggtctactccgccaaccacagcaggtgatccacggggagaaacttgggctgcctggactggccacctttggctactctctttcaggacagatggatgttgatgagaacttttatcctgaccttctagtgggttctctgagcgatcacattgtgctgctcagggctcggccagttatcaacattgtacacaagaccctggtgccacgtcccgctgtcctggaccctgcgctctgtactgctactagctgtgtgcaggtggaactgtgctttgcctataatcagagcgccggcaacccaaattaccgccggaacatcacactggcttataccctcgaagccgaccgcgacagacgaccccctcggttacgttttgccggatccgagtctgcggtgttccacggattctttagcatgccagaaatgaggtgccagaagctcgagcttctcctcatggataatctaagggacaagctgcgacctattatcatctccatgaactacagtctcccactgaggatgcccgacagacctcgcctgggactccggtcactggacgcttaccccattcttaaccaggcacaggccctggagaaccacacggaggtccagttccaaaaagaatgcgggcctgataacaaatgtgagagcaatctgcaaatgcgagccgcattcgtgtcagaacagcaacaaaagttgtctagactccagtactcccgggatgtgagaaagctgctactgtcgattaatgtcaccaatacacgaactagcgagagatcgggggaagatgcccatgaggctttactgacactagtagttccgcctgctctccttctgtcaagtgtcaggccgccaggcgcatgtcaggctaatgagaccattttctgtgagctcggaaatccatttaaacggaatcagcgcatggagctacttatcgcttttgaagtaatcggcgtaaccctgcacacacgtgatttacaagttcagctgcagctgtctacgtctagccatcaggataatctctggcccatgatcctaacactactcgtcgactacacactgcagacttccctctctatggttaatcaccgcctgcagagcttttttggaggaacagtcatgggtgagtcgggcatgaaaacagtggaagacgttgggtcacctctgaagtatgagttccaggtgggccctatgggagagggcctggtggggttaggcactctggtgcttggtctggagtggccatacgaagtgtcaaacggcaagtggctcctgtatcccaccgaaataactgtgcacgggaacggttcctggccttgtcgacctccaggtgatctgataaacccactcaatttgacgctatccgatcctggagacagaccaagctccccgcagagaagacgaagacaactggatcctggcggcggtcagggtcctccaccagtgacccttgcggccgccaaaaaggctaagtctgagaccgtgctcacatgtgccacaggacgcgctcattgcgtgtggctcgagtgtccaatccccgatgcaccagtcgtaaccaatgtgaccgtgaaagccagggtctggaactccaccttcatcgaggactatcgggatttcgaccgggtgcgcgttaacggctgggcgacattgttcttacgcacaagcatcccaacaataaatatggaaaacaagaccacatggtttagtgtggatatcgattccgaactagtggaggaactccccgccgaaattgaactctggctggttctcgtagctgtgggcgctggactgctgttgctgggcttgattattctgctattgtggaagtgtgacttttttaagagaactaggtactaccagatcatgcctaaatatcacgcggtcaggatccgcgaggaggaaaggtacccaccccccgggagcaccctccctacaaagaagcattgggtgacctcttggcagactcgggaccagtattactag

SEQ ID NO: 120766 - DNA, 3156 bp, Artificial Sequence
  Description of Artificial Sequence: Synthetic coding sequence
atggggccagggcctagccgcgcgcccagagcaccaagactgatgctgtgtgccttggctttgatggtggccgcaggcggctgcgtggtttcggcctttaatttagatacacgattccttgtggtgaaggaagccgggaaccccgggtcactgttcgggtacagtgtggccctccatcggcagacagagcgacagcaaaggtatctgctgctcgcaggggctccacgggaattagcggtccccgatggatacacaaacaggacgggcgccgtgtatttatgccccctcaccgcccataaggatgattgcgagcgcatgaatataactgtaaagaatgaccccggccatcacataattgaggatatgtggctgggtgtgaccgtcgccagccaaggtcccgcaggtcgagtgttagtgtgtgctcaccggtatacgcaggtgttgtggagcgggagcgaggaccagaggagaatggtaggaaagtgttacgtgagaggcaacgatctggagcttgatagttccgacgactggcagacctaccacaacgagatgtgcaacagcaatacggactatctggaaacagggatgtgccagctgggaacctcaggggggttcacacagaataccgtatattttggtgcccctggagcatacaattggaagggaaattcatatatgattcaacgtaaagagtgggatctgagtgagtattcttacaaggatcctgaggatcaggggaacctgtatatcggatataccatgcaggtcggctcctttatcctacatccaaagaacatcacgatcgtcaccggagcgccccgacaccggcacatgggggccgttttcctcctaagccaagaggctggcggagatttacgccggcggcaggtgttggagggatctcaagtgggtgcatatttcggcagcgccatcgctctggccgacctgaataacgacgggtggcaagacctactggtgggtgccccttactacttcgaacgaaaagaagaagtcgggggggccatttatgtgttcatgaatcaggccgggacatcatttccggctcaccccagccttcttctccacggcccctcaggctctgcattcggattgagtgtggcgagcattggcgatattaaccaggatggatttcaagatattgccgtgggggccccctttgaaggcctgggcaaagtgtatatataccatagcagcagcaaaggcctgctgcgacagcctcagcaggtgattcatggcgaaaaactcggcctgccggggctcgctactttcgggtatagcctgagtgggcagatggacgtagacgaaaacttttatcccgatctcctggtcgggagcctctcagaccatatcgtgctcctgcgcgcacgcccggttataaacattgtgcataaaaccttagtgccacgtccagccgtgctagaccctgccctgtgtacagctacctcatgcgtccaggtggagctgtgttttgcctataatcagagcgcaggcaatcccaattatcgcagaaatattaccctggcttacacactcgaggccgacagggatagaaggccccctcgactgcggtttgccggtagcgaaagtgcagtgttccacgggtttttttccatgcccgaaatgcgctgccagaagctggagttgctgttaatggataacctgagagataaattgcgacctatcattatctcaatgaattatagcttacctctgaggatgccagacaggccccgcttaggtctgaggagcctggacgcctaccccatactaaaccaggctcaggcgctcgaaaaccatacagaagttcagtttcagaaggaatgcggtcccgataacaagtgtgaatcaaatctccagatgcgtgctgcattcgtctcagagcagcagcaaaagctgtcccgcctgcaatacagtcgcgatgtccggaaactactgctatctatcaatgttactaatactcgcactagcgagaggtctggcgaggatgcacatgaggcgctcctcactctggtagtgccccccgctcttctgctttcatccgtgcgcccgcccggagcatgtcaggctaacgaaacaatcttctgcgaattggggaatccatttaagagaaaccaacggatggagctcctcatcgccttcgaggtcattggggtcacactgcatactcgggatcttcaggtgcaactgcagttgtcgacatcatcacaccaagataacttgtggcccatgatcttgacactgctggtagactacactcttcagaccagcctctcaatggtaaaccacagactgcaatccttttttggtgggactgtgatgggtgagtctggaatgaagaccgtcgaggacgtcgggagcccgttgaagtacgagttccaggtgggaccaatgggcgagggcctggtgggcctaggaacccttgtcctgggtctggagtggccttacgaggtctccaatggcaaatggctattgtacccaactgaaattacagtccacggaaatggttcttggccttgtcgtccccctggggacttgataaacccactaaacctgaccttgagcgatcccggagaccggccaagctcgccgcagcgtcggcggcgccagctggacccgggaggtggccaggggccacctcccgtgactctggcagcagcgaaaaaggctaagtccgagaccgtgctgacttgtgcaactggtcgtgcacactgtgtgtggctcgaatgccccataccggatgctccagtcgtgactaatgtaaccgtgaaggcccgcgtgtggaattctactttcatcgaggattatcgggacttcgaccgagtgagagttaatggctgggccaccttgtttctgcgcacatctattcctactatcaacatggaaaataagactacctggttctctgtggatattgactcagagcttgttgaggaattgcctgcagaaatcgagttatggctggttttggttgcagtgggggctggactgctcctgctcgggctgattatcttactgctgtggaaatgtggctttttcaagcgagcacgtacgcgtgctctgtacgaagcaaaacgccagaaagctgaaatgaaatcacagcccagcgagacagaacggctgactgacgactactag

SEQ ID NO: 120767 - DNA, 3114 bp, Artificial Sequence
  Description of Artificial Sequence: Synthetic coding sequence
atgctgtgtgccctggccctgatggtagccgcaggaggctgtgtggtttccgccttcaacttggacacacgtttcctggtagtcaaggaggcagggaatccagggtctctgttcggttattctgtcgctttgcacaggcagacagagagacagcagcgctacctgctgctggcaggtgcacctagggagctggccgtcccagatggctatactaaccgcactggcgcggtgtatctttgccctctgaccgcacataaagacgactgtgaaagaatgaatattaccgtaaaaaatgaccctggccaccacataatagaagacatgtggcttggcgtgactgtggcctcccaaggccctgcaggacgagtcctggtatgtgctcataggtatacccaggtattgtggtccggtagcgaagaccagcgcagaatggtgggcaaatgctatgttcgcggtaatgacctggagcttgacagttctgatgattggcagacttatcacaacgagatgtgcaatagcaatacagactacctcgagacgggaatgtgtcagctgggaacctcgggcggcttcactcagaatactgtatacttcggtgcacctggggcctacaactggaaaggcaattcctatatgattcagagaaaagagtgggatctgtccgaatactcctacaaagaccccgaggatcagggcaacttgtacataggttacacgatgcaggtgggaagttttattcttcatcctaaaaatatcaccattgttacaggggccccacgccaccggcacatgggcgccgtattcttgctatctcaggaagcgggaggtgatctccggcgaaggcaagtattggaaggaagtcaggttggagcgtactttggttccgccatcgctctagctgacttaaacaatgacggctggcaggacctgttagtgggcgccccctattattttgaaaggaaggaggaggtggggggtgctatatacgtattcatgaatcaggccgggacaagctttccagcccatccatccctgctgctgcacgggccgagcgggtctgcgtttggacttagtgtggctagtatcggggatatcaatcaggacggttttcaggatatcgccgtgggcgctccctttgaaggactgggtaaggtatacatctatcatagctcatcgaaaggccttcttcggcagccccagcaagtaattcacggagagaagcttgggctgcctgggctggcaactttcgggtactccctgtccggccagatggacgtggatgaaaacttttaccctgatctgttagtcggctcactgagtgaccacatcgttctcctcagagcaaggcctgtgatcaacatagttcacaagacactggtgcctcgacctgccgttttggatccggccctctgtacggccacgagttgtgtacaggtagaactgtgttttgcttataatcagtctgccggcaaccccaactaccggagaaacattactctggcttatactcttgaggccgatagggatcgcagacccccccgattgagatttgccgggtcagagagcgccgtttttcacggcttcttttcgatgcctgaaatgcgatgtcaaaaactggagcttctgctcatggacaatctcagggacaaactgcgaccaataatcatcagcatgaactattccctgccactgagaatgccagacagacccaggcttggattacgctctctggatgcttaccctatccttaaccaggctcaggctcttgaaaatcataccgaggtgcagtttcagaaagagtgcggacccgacaataagtgcgagtctaacctccagatgcgtgcggctttcgttagtgagcaacagcagaagctgagtagactccaatactcaagggatgttcggaaacttctgttgtcaataaacgtgaccaatacacggaccagtgagagatctggagaggatgcacacgaggccctcctgaccctggtggtgcctcctgcactactcctcagttccgtgcggccaccgggagcttgtcaagcaaatgagactattttctgtgagctgggaaatcccttcaaacggaaccagcgtatggagctactcattgcattcgaggtgattggtgtgactctgcacacccgcgatctgcaggtacagcttcagctctcgactagcagccaccaggacaatctgtggccaatgattctcacattactggtggattatacactgcagacctcgttaagtatggtcaatcacagactccagtcattcttcggcggcaccgttatgggagagtccggcatgaagacagtggaggacgtgggtagtcctctgaaatacgagttccaggtcggacccatgggggagggcctcgtcggcctcgggaccttagtattggggctcgaatggccatacgaggtgtccaatggaaagtggctcctctatccaaccgaaatcactgtgcacggtaacgggtcctggccatgccgcccaccaggtgatttaattaacccattaaacctcacgctgagtgacccaggggacagacccagcagccctcagcgaaggagacgccagttggaccccgggggaggccaggggcccccgcctgtaaccttagccgcagcaaagaaagccaagagcgaaacagtcctaacctgtgcgaccggccgtgctcattgcgtgtggctggaatgccctatccccgacgctcccgtggtaacaaacgtgacagtaaaggctagggtgtggaattccacattcattgaggactacagagactttgaccgggtgcgggtgaatggttgggcaaccctgttcctaaggacttccatcccaactatcaatatggagaacaagacaacctggttttccgtagacattgattccgagctcgtggaagagctgccagccgaaatcgaactttggctggtgttggtcgcggtgggtgccgggctgcttctgctgggcctcataatcctgcttctgtggaagtgcggcttttttaagcgggctcggacaagggccctctatgaggcgaagaggcaaaaagccgaaatgaaatctcagccaagcgaaacggagcggttgaccgacgattactag

SEQ ID NO: 120768 - DNA, 885 bp, Artificial Sequence
  Description of Artificial Sequence: Synthetic coding sequence
atgatccagcggaaggagtgggatctctctgaatactcctacaaggacccagaagaccaaggcaatctgtacattggatatactatgcaggttggctcctttatcctccacccaaagaatatcactattgtgactggtgccccaaggcaccgccatatgggagctgtatttctcctcagccaggaagcagggggagatctgcgccgcagacaggttctggaaggtagccaggttggcgcatattttggctcagcaatcgccctcgctgacctgaacaacgatggctggcaggacctcttggtgggtgctccttactactttgagagaaaggaggaggtggggggagccatatacgtgtttatgaaccaggcaggaacctctttccccgcacatccatcacttctgttgcacggaccttcaggctccgcttttggtctttccgtcgcatctattggcgatattaaccaggatggattccaggatatcgcggtgggagccccctttgagggactcggcaaggtgtatatttatcattcttcatccaaaggtttgctcagacagccccagcaagttatccacggcgaaaagctgggattgcctggcctggctacgttcggctatagcctcagcgggcaaatggacgtcgatgagaatttttaccccgacctgcttgtgggctccctgtcagaccatatcgtactgttacgggcccgccctgtgataaatattgtacacaagactctggttcctagacccgcagttctggatcctgccctgtgtaccgccacttcctgcgtgcaggttgaactctgttttgcttacaaccaaagtgctgggaaccccaactatcgcagaaatattagcgaatgttggggagccgcctag

SEQ ID NO: 120769 - DNA, 3108 bp, Artificial Sequence
  Description of Artificial Sequence: Synthetic coding sequence
atgggaggacccgctgcaccaagaggcgccggacgcctgagggctctgttattagctctggtggtggcgggaattcccgcaggggcgtacaatttggacccacagaggcccgtccactttcagggccctgctgactctttctttggctacgccgttctggagcactttcacgataacacgcgatgggttctcgtaggggctccaaaggcagattctaagtactcccccagcgtaaagagccctggcgctgtgttcaagtgccgggtacacactaatcctgatcgtaggtgtaccgagctggatatggctagaggaaagaatagagggaccagctgcggcaagacgtgtcgggaggacagggacgacgagtggatgggggtctcattagctcggcagccgaaggcggacggcagagtgcttgcatgcgcccacaggtggaaaaacatttactacgaggccgatcacatactgccacacggtttttgttatatcataccttctaatctgcaagccaaaggccgcaccctgatcccctgttacgaggagtacaagaagaaatacggagaggaacatggctcttgccaggccggtatcgctgggttttttaccgaggagctggtggtgatgggcgctccaggttctttttactgggcaggcacaattaaggtgctaaatctcactgacaacacttatctaaaactgaacgacgaagtgatcatgaaccgccgctacacttatctcgggtatgctgtgacagctggccactttagccatccttctacgatcgatgttgtcgggggcgcaccccaggacaaaggaattggcaaggtgtacatcttcagggccgatcgcagatcggggaccctcattaaaatattccaagcgagtggtaaaaaaatgggcagctacttcggaagctcgttatgcgccgttgacctcaatggcgacgggctgagcgacttgttggtgggcgcaccaatgtttagcgaaatcagggatgaggggcaggttaccgtctacatcaaccgcggtaacggagcactcgaggagcagttagcgctgaccggtgatggggcctataatgcccactttggcgagagcatcgcctcacttgacgacctcgataatgacggcttccctgatgtcgcaattggggctccaaaggaagacgacttcgcaggcgcggtgtacatttaccacggcgacgcaggaggtattgttccgcaatattctatgaaactgagcggccaaaagattaacccggtcctacgtatgtttggccaaagcatctcaggaggcatagatatggatggtaacggataccccgatgtcaccgtcggagccttcatgtccgacagcgttgttcttttacgtgcaaggcccgtaattaccgtcgatgtgagcatttttctgcctggcagcattaatattaccgctccacagtgccatgacggccagcaaccggtcaattgcctcaatgtgactacatgtttctctttccacgggaagcacgttccaggggagatcgggctcaattacgttctgatggccgacgtggcaaagaaagaaaagggacaaatgccaagagtttacttcgtcctattgggagagacaatgggtcaggtcactgaaaagctccagctgacgtatatggaagagacgtgccgccactacgtggcacacgttaagagaagagttcaagacgtgatctctccaattgtgttcgaagctgcttactctctgagcgagcacgtgacaggcgaggaggagagggagcttccccccctcacacccgtcctccgctggaaaaaggggcagaagattgctcagaagaaccagaccgtctttgaacgcaactgtagatcggaggattgcgcggccgaccttcagttacagggcaagctgttgttgagcagcatggacgaaaagacactctacctggccctgggggcggttaaaaatattagcctcaacatctcaataagcaacctgggagatgatgcctacgacgccaatgtgagttttaatgttagcagggagctcttcttcattaacatgtggcagaaagaggagatgggaattagctgtgagttgttggagtcggacttcctcaagtgttcagtggggtttccttttatgaggtctaaatcaaagtacgagttcagtgtaatcttcgatacatcgcacctgagtggcgaagaggaagtcctctcctttattgtcaccgcacagagcggaaacacggagcgctccgagtccctgcatgacaacactctggtgctgatggtccctctgatgcacgaggtggatacctctattacgggaattatgagtccaacctcctttgtctacggcgagagtgtggatgctgctaactttatacaattggatgatcttgagtgccatttccagccaattaacattaccttgcaggtgtataacaccggtcctagcaccttgcctggctccagtgtctccatcagcttccctaataggctttctagcgggggcgctgagatgtttcatgtccaagaaatggtcgttgggcaggagaagggaaattgcagttttcaaaagaacccaaccccttgcatcattccccaagagcaggaaaacatattccacactatcttcgcattttttacaaagtccggccgtaaggtgttggattgtgagaagccaggaatctcctgtctcactgcgcactgcaatttctccgccctggccaaggaggagtcccgcacaatcgacatttacatgttgctgaacaccgagattcttaagaaagacagtagctctgtcatccagtttatgagcagagcgaaagtgaaggtggacccagccctaagagttgtcgagatcgctcatggcaaccctgaggaagtgaccgtagttttcgaagccctccataatcttgagcctcggggctatgtcgtaggctggatcatagcgatttccctgcttgtaggcattttgattttcttgctcctggccgtgctgttatggaaaatgggcttcttcagacggcgctacaaagagattatcgaggctgagaaaaaccggaaggaaaacgaagactcatgggattgggtgcaaaagaaccaatag

SEQ ID NO: 120770 - DNA, 696 bp, Artificial Sequence
  Description of Artificial Sequence: Synthetic coding sequence
atgtgtcaaccgccaccaacagcacctggtagctggccagttgcaaggccctgtactgagtctgtaggacgtactcatacccaaagggtacctgccagttgctgggccagagccggtcgcagttcgagacagtcccccaccccccgccagttcgctctgatgcagtattccaacctgttgaagatccattttacctttacacagttccggacaagcccgagtcagcagtctctagtggatcctatagtgcagctgaaaggtctcacgttcaccgctactggcatcctgactgtggtcacacagctgttccaccataaaaatggggccagaaaaagtgcaaagaagatcctcatagtgatcacagatgggcagaagtataaagacccattggaatacagcgacgtgatccctcaggcggagaaggcagggatcattcgatatgccatcggagtgcgcctgttttttactcctgctccgggcagcgcctgcatctcttttaggtgttctgctgcagggctgatcctccttggctgtctctctgcggctggtggcactcggtttccaggaactcattgccaggctggtgcggagtaccatcagctgagcgctagcgcggggcctagagtacagggtggacagctttgttcaccgtggcagcaccccgaagctgccgccggcgaggatctgtgctcatag
